United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 52

SEQ ID NO: 1855114 - RNA, 21 nt, Salmonella typhimurium LT2
aucauauuuucuugcuacaua

SEQ ID NO: 1855115 - RNA, 24 nt, Salmonella typhimurium LT2
aucauauuuucuugcuacauaucu

SEQ ID NO: 1855116 - RNA, 18 nt, Salmonella typhimurium LT2
aucauauucgcagcucug

SEQ ID NO: 1855117 - RNA, 20 nt, Salmonella typhimurium LT2
aaaacguugacuuaaaaagc

SEQ ID NO: 1855118 - RNA, 21 nt, Salmonella typhimurium LT2
aucaucgacaguaccagcaga

SEQ ID NO: 1855119 - RNA, 22 nt, Salmonella typhimurium LT2
aucaucgcaggcggucagcaca

SEQ ID NO: 1855120 - RNA, 14 nt, Salmonella typhimurium LT2
aucauccccaccac

SEQ ID NO: 1855121 - RNA, 15 nt, Salmonella typhimurium LT2
aucaggaaaucuucc

SEQ ID NO: 1855122 - RNA, 13 nt, Salmonella typhimurium LT2
aucaggaaaugaa

SEQ ID NO: 1855123 - RNA, 16 nt, Salmonella typhimurium LT2
aucaggaaaugaacca

SEQ ID NO: 1855124 - RNA, 19 nt, Salmonella typhimurium LT2
aucaggccuacgacagcgc

SEQ ID NO: 1855125 - RNA, 21 nt, Salmonella typhimurium LT2
aucaggccuacgggucauggu

SEQ ID NO: 1855126 - RNA, 21 nt, Salmonella typhimurium LT2
aaaacgccgccuugcggcggc

SEQ ID NO: 1855127 - RNA, 18 nt, Salmonella typhimurium LT2
aaaacgcgcucgccagcg

SEQ ID NO: 1855128 - RNA, 23 nt, Salmonella typhimurium LT2
aaaacgcgcugauacuuauuacg

SEQ ID NO: 1855129 - RNA, 16 nt, Salmonella typhimurium LT2
aaaacgcgucccaugg

SEQ ID NO: 1855130 - RNA, 17 nt, Salmonella typhimurium LT2
aucagugagaagggcag

SEQ ID NO: 1855131 - RNA, 19 nt, Salmonella typhimurium LT2
aucaguggcggcaaaaaau

SEQ ID NO: 1855132 - RNA, 21 nt, Salmonella typhimurium LT2
aucauaaaaggcugagaaggu

SEQ ID NO: 1855133 - RNA, 12 nt, Salmonella typhimurium LT2
aucauauaaucu

SEQ ID NO: 1855134 - RNA, 19 nt, Salmonella typhimurium LT2
aucauagugccgguggcau

SEQ ID NO: 1855135 - RNA, 17 nt, Salmonella typhimurium LT2
aucagcaacacaaucag

SEQ ID NO: 1855136 - RNA, 18 nt, Salmonella typhimurium LT2
aucagcaagaugacccau

SEQ ID NO: 1855137 - RNA, 21 nt, Salmonella typhimurium LT2
aucagauugcgaaagaauuac

SEQ ID NO: 1855138 - RNA, 11 nt, Salmonella typhimurium LT2
aucagaugacc

SEQ ID NO: 1855139 - RNA, 21 nt, Salmonella typhimurium LT2
aucagaugcgcuucagcgacu

SEQ ID NO: 1855140 - RNA, 20 nt, Salmonella typhimurium LT2
aucagauacggcuccagcac

SEQ ID NO: 1855141 - RNA, 18 nt, Salmonella typhimurium LT2
aucagauaucccugcaaa

SEQ ID NO: 1855142 - RNA, 12 nt, Salmonella typhimurium LT2
aucagaggggau

SEQ ID NO: 1855143 - RNA, 16 nt, Salmonella typhimurium LT2
aucagacgcacaaucg

SEQ ID NO: 1855144 - RNA, 23 nt, Salmonella typhimurium LT2
aucagacguuuauaccccaccau

SEQ ID NO: 1855145 - RNA, 14 nt, Salmonella typhimurium LT2
aucagaccugccug

SEQ ID NO: 1855146 - RNA, 15 nt, Salmonella typhimurium LT2
aucagacuaucuucg

SEQ ID NO: 1855147 - RNA, 22 nt, Salmonella typhimurium LT2
aucagacuuuggauaaagccaa

SEQ ID NO: 1855148 - RNA, 23 nt, Salmonella typhimurium LT2
aucagacugaucgccgcugcugg

SEQ ID NO: 1855149 - RNA, 22 nt, Salmonella typhimurium LT2
aucagcuuugcggccagcauau

SEQ ID NO: 1855150 - RNA, 18 nt, Salmonella typhimurium LT2
aucagcgcguuuuccauc

SEQ ID NO: 1855151 - RNA, 14 nt, Salmonella typhimurium LT2
aucagcgcgggaua

SEQ ID NO: 1855152 - RNA, 22 nt, Salmonella typhimurium LT2
aucagcgcggcgugaucaaauu

SEQ ID NO: 1855153 - RNA, 17 nt, Salmonella typhimurium LT2
aucagcgcgcuccagac

SEQ ID NO: 1855154 - RNA, 13 nt, Salmonella typhimurium LT2
aucagcgccagcc

SEQ ID NO: 1855155 - RNA, 14 nt, Salmonella typhimurium LT2
aucagcgccagccc

SEQ ID NO: 1855156 - RNA, 15 nt, Salmonella typhimurium LT2
aucagcaucccaccg

SEQ ID NO: 1855157 - RNA, 22 nt, Salmonella typhimurium LT2
aucagcaucuuaugcgcaaaaa

SEQ ID NO: 1855158 - RNA, 22 nt, Salmonella typhimurium LT2
aucagcaucuuuggcuuuauga

SEQ ID NO: 1855159 - RNA, 13 nt, Salmonella typhimurium LT2
aucagcaucccac

SEQ ID NO: 1855160 - RNA, 22 nt, Salmonella typhimurium LT2
aucagcauuggucaucgcccau

SEQ ID NO: 1855161 - RNA, 14 nt, Salmonella typhimurium LT2
aucagcauuuucac

SEQ ID NO: 1855162 - RNA, 16 nt, Salmonella typhimurium LT2
aucagcgcaauaaauu

SEQ ID NO: 1855163 - RNA, 15 nt, Salmonella typhimurium LT2
aucagcgccaccaca

SEQ ID NO: 1855164 - RNA, 14 nt, Salmonella typhimurium LT2
aucagcgccaccac

SEQ ID NO: 1855165 - RNA, 17 nt, Salmonella typhimurium LT2
aucagccauuaaccaga

SEQ ID NO: 1855166 - RNA, 13 nt, Salmonella typhimurium LT2
aucagccauuaac

SEQ ID NO: 1855167 - RNA, 12 nt, Salmonella typhimurium LT2
aucagccaggcg

SEQ ID NO: 1855168 - RNA, 21 nt, Salmonella typhimurium LT2
aucagccagccgccaaaaaua

SEQ ID NO: 1855169 - RNA, 12 nt, Salmonella typhimurium LT2
aucagccagcau

SEQ ID NO: 1855170 - RNA, 20 nt, Salmonella typhimurium LT2
aucagaaaaaauuacagccg

SEQ ID NO: 1855171 - RNA, 17 nt, Salmonella typhimurium LT2
aucagaauuucgcccug

SEQ ID NO: 1855172 - RNA, 23 nt, Salmonella typhimurium LT2
aucagaauuucgcccuguauaca

SEQ ID NO: 1855173 - RNA, 21 nt, Salmonella typhimurium LT2
aucagacaggcaugguuaaca

SEQ ID NO: 1855174 - RNA, 16 nt, Salmonella typhimurium LT2
aucagaccgacaaaac

SEQ ID NO: 1855175 - RNA, 17 nt, Salmonella typhimurium LT2
aucagaccgacaaaaca

SEQ ID NO: 1855176 - RNA, 17 nt, Salmonella typhimurium LT2
aucagacauuguugcgu

SEQ ID NO: 1855177 - RNA, 12 nt, Salmonella typhimurium LT2
aucacgcgcugg

SEQ ID NO: 1855178 - RNA, 15 nt, Salmonella typhimurium LT2
aucacgguacgcauc

SEQ ID NO: 1855179 - RNA, 15 nt, Salmonella typhimurium LT2
aucacguagccagag

SEQ ID NO: 1855180 - RNA, 20 nt, Salmonella typhimurium LT2
aucacuuccgccaccacgcc

SEQ ID NO: 1855181 - RNA, 13 nt, Salmonella typhimurium LT2
aucacgcaucacu

SEQ ID NO: 1855182 - RNA, 18 nt, Salmonella typhimurium LT2
aucacgccacaguauuca

SEQ ID NO: 1855183 - RNA, 18 nt, Salmonella typhimurium LT2
aucacgccguccagcacc

SEQ ID NO: 1855184 - RNA, 14 nt, Salmonella typhimurium LT2
aucaccuccagcac

SEQ ID NO: 1855185 - RNA, 21 nt, Salmonella typhimurium LT2
aucaaugggauagugccugcc

SEQ ID NO: 1855186 - RNA, 15 nt, Salmonella typhimurium LT2
aucaauuccuacaau

SEQ ID NO: 1855187 - RNA, 13 nt, Salmonella typhimurium LT2
aucaccggcauuu

SEQ ID NO: 1855188 - RNA, 17 nt, Salmonella typhimurium LT2
aucaccggcauuucacc

SEQ ID NO: 1855189 - RNA, 20 nt, Salmonella typhimurium LT2
aucaaacggauaaguaaguu

SEQ ID NO: 1855190 - RNA, 19 nt, Salmonella typhimurium LT2
aucaacagcggagagacau

SEQ ID NO: 1855191 - RNA, 23 nt, Salmonella typhimurium LT2
aucaacagcggagagacauuggu

SEQ ID NO: 1855192 - RNA, 18 nt, Salmonella typhimurium LT2
aucaaaccaccccagguu

SEQ ID NO: 1855193 - RNA, 19 nt, Salmonella typhimurium LT2
aucaaacaaaccaaacuga

SEQ ID NO: 1855194 - RNA, 22 nt, Salmonella typhimurium LT2
aucaacgaccaugguucccgcc

SEQ ID NO: 1855195 - RNA, 15 nt, Salmonella typhimurium LT2
aucaaccugcugacu

SEQ ID NO: 1855196 - RNA, 16 nt, Salmonella typhimurium LT2
aucaaucaccaccagg

SEQ ID NO: 1855197 - RNA, 18 nt, Salmonella typhimurium LT2
aucaauagcaagggcaag

SEQ ID NO: 1855198 - RNA, 20 nt, Salmonella typhimurium LT2
aucaaugcgcguaauuugcg

SEQ ID NO: 1855199 - RNA, 21 nt, Salmonella typhimurium LT2
aucaaugcccagcgcaaucac

SEQ ID NO: 1855200 - RNA, 17 nt, Salmonella typhimurium LT2
aucaaugcaucuucacu

SEQ ID NO: 1855201 - RNA, 14 nt, Salmonella typhimurium LT2
aucaauaccagccc

SEQ ID NO: 1855202 - RNA, 9 nt, Salmonella typhimurium LT2
aucaauacg

SEQ ID NO: 1855203 - RNA, 17 nt, Salmonella typhimurium LT2
aucaauaaccgccagca

SEQ ID NO: 1855204 - RNA, 19 nt, Salmonella typhimurium LT2
aucaauaaccgccagcagc

SEQ ID NO: 1855205 - RNA, 22 nt, Salmonella typhimurium LT2
aucaauaaagccgcauuuuucc

SEQ ID NO: 1855206 - RNA, 17 nt, Salmonella typhimurium LT2
aucaauaaaauuaucca

SEQ ID NO: 1855207 - RNA, 15 nt, Salmonella typhimurium LT2
aucaagcccauguuc

SEQ ID NO: 1855208 - RNA, 13 nt, Salmonella typhimurium LT2
aucaagcccagcu

SEQ ID NO: 1855209 - RNA, 20 nt, Salmonella typhimurium LT2
aucaagcuuugcguaaaaaa

SEQ ID NO: 1855210 - RNA, 20 nt, Salmonella typhimurium LT2
auauuuauuuuauaaauuaa

SEQ ID NO: 1855211 - RNA, 17 nt, Salmonella typhimurium LT2
auauuucaagccgcagc

SEQ ID NO: 1855212 - RNA, 20 nt, Salmonella typhimurium LT2
auauuggcgaggaacaucag

SEQ ID NO: 1855213 - RNA, 17 nt, Salmonella typhimurium LT2
auauuggcuggccugcu

SEQ ID NO: 1855214 - RNA, 17 nt, Salmonella typhimurium LT2
auauuguagguuuuccu

SEQ ID NO: 1855215 - RNA, 19 nt, Salmonella typhimurium LT2
auauuuuguuuuaaauuca

SEQ ID NO: 1855216 - RNA, 21 nt, Salmonella typhimurium LT2
auauuuuguuuuaaauucaac

SEQ ID NO: 1855217 - RNA, 22 nt, Salmonella typhimurium LT2
auauuuuguaggccuaaaaaua

SEQ ID NO: 1855218 - RNA, 13 nt, Salmonella typhimurium LT2
auauuuucaccuc

SEQ ID NO: 1855219 - RNA, 16 nt, Salmonella typhimurium LT2
auauuuucagaaauca

SEQ ID NO: 1855220 - RNA, 22 nt, Salmonella typhimurium LT2
auauuuucagaaaucauauaaa

SEQ ID NO: 1855221 - RNA, 14 nt, Salmonella typhimurium LT2
auauuuuaucacua

SEQ ID NO: 1855222 - RNA, 17 nt, Salmonella typhimurium LT2
auaugcaggcauaaaaa

SEQ ID NO: 1855223 - RNA, 23 nt, Salmonella typhimurium LT2
auaugcacaugauggugacuguc

SEQ ID NO: 1855224 - RNA, 17 nt, Salmonella typhimurium LT2
auaugcaauuaauauau

SEQ ID NO: 1855225 - RNA, 13 nt, Salmonella typhimurium LT2
auauucagcaaau

SEQ ID NO: 1855226 - RNA, 15 nt, Salmonella typhimurium LT2
auauucaugcuuuca

SEQ ID NO: 1855227 - RNA, 18 nt, Salmonella typhimurium LT2
auauucccacaguuaacg

SEQ ID NO: 1855228 - RNA, 17 nt, Salmonella typhimurium LT2
auauugcauaggggcaa

SEQ ID NO: 1855229 - RNA, 15 nt, Salmonella typhimurium LT2
auauugcgccgcagc

SEQ ID NO: 1855230 - RNA, 12 nt, Salmonella typhimurium LT2
auuaccagcaau

SEQ ID NO: 1855231 - RNA, 20 nt, Salmonella typhimurium LT2
auuaccagcaauaacaggca

SEQ ID NO: 1855232 - RNA, 16 nt, Salmonella typhimurium LT2
auuacaaaaugugcaa

SEQ ID NO: 1855233 - RNA, 14 nt, Salmonella typhimurium LT2
auuacaaaaauaga

SEQ ID NO: 1855234 - RNA, 15 nt, Salmonella typhimurium LT2
auuacacaauaucaa

SEQ ID NO: 1855235 - RNA, 16 nt, Salmonella typhimurium LT2
auuacacaauaucaau

SEQ ID NO: 1855236 - RNA, 15 nt, Salmonella typhimurium LT2
auuaauugcuuugca

SEQ ID NO: 1855237 - RNA, 21 nt, Salmonella typhimurium LT2
auuaauugcgacaagcucauu

SEQ ID NO: 1855238 - RNA, 15 nt, Salmonella typhimurium LT2
auuaauuuucacgcu

SEQ ID NO: 1855239 - RNA, 19 nt, Salmonella typhimurium LT2
auuaaugcuccaauaaaua

SEQ ID NO: 1855240 - RNA, 21 nt, Salmonella typhimurium LT2
auuaaugucaugaagcucaac

SEQ ID NO: 1855241 - RNA, 18 nt, Salmonella typhimurium LT2
auuaaucccaacccgacc

SEQ ID NO: 1855242 - RNA, 14 nt, Salmonella typhimurium LT2
auuaauccugcgcu

SEQ ID NO: 1855243 - RNA, 19 nt, Salmonella typhimurium LT2
auuaaugccgcaauguccc

SEQ ID NO: 1855244 - RNA, 18 nt, Salmonella typhimurium LT2
aaaagcaucguaccuuca

SEQ ID NO: 1855245 - RNA, 12 nt, Salmonella typhimurium LT2
auuaacaaauaa

SEQ ID NO: 1855246 - RNA, 20 nt, Salmonella typhimurium LT2
auuaacagacaaugaauauu

SEQ ID NO: 1855247 - RNA, 23 nt, Salmonella typhimurium LT2
auuaacagcgcgaccaggaaacc

SEQ ID NO: 1855248 - RNA, 18 nt, Salmonella typhimurium LT2
auuaaauaacaaaugaag

SEQ ID NO: 1855249 - RNA, 17 nt, Salmonella typhimurium LT2
auuaaauaacaaaugaa

SEQ ID NO: 1855250 - RNA, 16 nt, Salmonella typhimurium LT2
auuaaauuuauacuca

SEQ ID NO: 1855251 - RNA, 17 nt, Salmonella typhimurium LT2
auuaaauuuauacucaa

SEQ ID NO: 1855252 - RNA, 22 nt, Salmonella typhimurium LT2
auuaaacguuauucauuaccau

SEQ ID NO: 1855253 - RNA, 22 nt, Salmonella typhimurium LT2
auuaaacagacaauaccagggc

SEQ ID NO: 1855254 - RNA, 16 nt, Salmonella typhimurium LT2
auuaaaauuguaauaa

SEQ ID NO: 1855255 - RNA, 17 nt, Salmonella typhimurium LT2
auuaaaauuauccacaa

SEQ ID NO: 1855256 - RNA, 16 nt, Salmonella typhimurium LT2
auguuuugucguucac

SEQ ID NO: 1855257 - RNA, 19 nt, Salmonella typhimurium LT2
auuaaaaaaggcagaagaa

SEQ ID NO: 1855258 - RNA, 17 nt, Salmonella typhimurium LT2
auguucauaccggauau

SEQ ID NO: 1855259 - RNA, 23 nt, Salmonella typhimurium LT2
auguucagcgaccugcagcucca

SEQ ID NO: 1855260 - RNA, 22 nt, Salmonella typhimurium LT2
auguucaacgucagcuggaaug

SEQ ID NO: 1855261 - RNA, 20 nt, Salmonella typhimurium LT2
auguccugccgcaaacgccu

SEQ ID NO: 1855262 - RNA, 13 nt, Salmonella typhimurium LT2
auguccccugaca

SEQ ID NO: 1855263 - RNA, 19 nt, Salmonella typhimurium LT2
auguccccugacagagcuc

SEQ ID NO: 1855264 - RNA, 20 nt, Salmonella typhimurium LT2
auguccgccuaccagcacau

SEQ ID NO: 1855265 - RNA, 15 nt, Salmonella typhimurium LT2
auguccgccaauucc

SEQ ID NO: 1855266 - RNA, 11 nt, Salmonella typhimurium LT2
augucccugcc

SEQ ID NO: 1855267 - RNA, 20 nt, Salmonella typhimurium LT2
auguccgguugcauugacca

SEQ ID NO: 1855268 - RNA, 19 nt, Salmonella typhimurium LT2
auguugcguaaauaaaugc

SEQ ID NO: 1855269 - RNA, 22 nt, Salmonella typhimurium LT2
auguuggguuucgacuucgccu

SEQ ID NO: 1855270 - RNA, 17 nt, Salmonella typhimurium LT2
auguuguuccagagugc

SEQ ID NO: 1855271 - RNA, 20 nt, Salmonella typhimurium LT2
auguuucgacaguuucuucg

SEQ ID NO: 1855272 - RNA, 15 nt, Salmonella typhimurium LT2
auguuuaccgugucc

SEQ ID NO: 1855273 - RNA, 22 nt, Salmonella typhimurium LT2
auuacgacugcacccaucuuua

SEQ ID NO: 1855274 - RNA, 16 nt, Salmonella typhimurium LT2
auuacgauugcgccau

SEQ ID NO: 1855275 - RNA, 22 nt, Salmonella typhimurium LT2
auuacgcacacuugcucccaga

SEQ ID NO: 1855276 - RNA, 18 nt, Salmonella typhimurium LT2
auuaccccgugguggggu

SEQ ID NO: 1855277 - RNA, 17 nt, Salmonella typhimurium LT2
auuaccccugguggggu

SEQ ID NO: 1855278 - RNA, 18 nt, Salmonella typhimurium LT2
auuacgacccacaaugag

SEQ ID NO: 1855279 - RNA, 20 nt, Salmonella typhimurium LT2
aaaagcuguagcauaaaugc

SEQ ID NO: 1855280 - RNA, 21 nt, Salmonella typhimurium LT2
aaaagcucgucuguuguucuu

SEQ ID NO: 1855281 - RNA, 16 nt, Salmonella typhimurium LT2
auuagcgucauacuua

SEQ ID NO: 1855282 - RNA, 14 nt, Salmonella typhimurium LT2
auuaucagcaauaa

SEQ ID NO: 1855283 - RNA, 24 nt, Salmonella typhimurium LT2
auuaucagcaauaauuuuaccauu

SEQ ID NO: 1855284 - RNA, 12 nt, Salmonella typhimurium LT2
auuaucaccauu

SEQ ID NO: 1855285 - RNA, 19 nt, Salmonella typhimurium LT2
auuaugccgcacuccccag

SEQ ID NO: 1855286 - RNA, 16 nt, Salmonella typhimurium LT2
auuauucaggccuccu

SEQ ID NO: 1855287 - RNA, 21 nt, Salmonella typhimurium LT2
auuauuccuugaucaggaaau

SEQ ID NO: 1855288 - RNA, 17 nt, Salmonella typhimurium LT2
auuaugaucgguuuuuu

SEQ ID NO: 1855289 - RNA, 22 nt, Salmonella typhimurium LT2
auucacaccuuuauauuuuucc

SEQ ID NO: 1855290 - RNA, 22 nt, Salmonella typhimurium LT2
aaaaggcagagcgcgcucugcc

SEQ ID NO: 1855291 - RNA, 18 nt, Salmonella typhimurium LT2
aaaagcugucgccaccuu

SEQ ID NO: 1855292 - RNA, 20 nt, Salmonella typhimurium LT2
aaaaggcgacgaugugcaua

SEQ ID NO: 1855293 - RNA, 13 nt, Salmonella typhimurium LT2
aaaaggccacgca

SEQ ID NO: 1855294 - RNA, 21 nt, Salmonella typhimurium LT2
auucaauuagcgccuccccua

SEQ ID NO: 1855295 - RNA, 14 nt, Salmonella typhimurium LT2
auuauugcacauaa

SEQ ID NO: 1855296 - RNA, 23 nt, Salmonella typhimurium LT2
auuauugccaucggacauauuuu

SEQ ID NO: 1855297 - RNA, 20 nt, Salmonella typhimurium LT2
auuauucggcgacuggaaca

SEQ ID NO: 1855298 - RNA, 15 nt, Salmonella typhimurium LT2
auucaacgcccccuu

SEQ ID NO: 1855299 - RNA, 22 nt, Salmonella typhimurium LT2
auucaaccagccgaucagcgcc

SEQ ID NO: 1855300 - RNA, 23 nt, Salmonella typhimurium LT2
auucaaccagccgaucagcgcca

SEQ ID NO: 1855301 - RNA, 21 nt, Salmonella typhimurium LT2
auucaacaggggccuuuuuuu

SEQ ID NO: 1855302 - RNA, 22 nt, Salmonella typhimurium LT2
auucaacagggguuccggcaau

SEQ ID NO: 1855303 - RNA, 19 nt, Salmonella typhimurium LT2
auucaacacauuccauuuu

SEQ ID NO: 1855304 - RNA, 17 nt, Salmonella typhimurium LT2
auucaaccaguuaauuu

SEQ ID NO: 1855305 - RNA, 20 nt, Salmonella typhimurium LT2
auucaggcaucguacgggca

SEQ ID NO: 1855306 - RNA, 12 nt, Salmonella typhimurium LT2
auucagguaaua

SEQ ID NO: 1855307 - RNA, 13 nt, Salmonella typhimurium LT2
auucagcggcugc

SEQ ID NO: 1855308 - RNA, 20 nt, Salmonella typhimurium LT2
auucagcgcagugaccagca

SEQ ID NO: 1855309 - RNA, 12 nt, Salmonella typhimurium LT2
auucagccgcag

SEQ ID NO: 1855310 - RNA, 17 nt, Salmonella typhimurium LT2
auucagcacccagcgaa

SEQ ID NO: 1855311 - RNA, 22 nt, Salmonella typhimurium LT2
auucagcacgcuuuggcaggcc

SEQ ID NO: 1855312 - RNA, 12 nt, Salmonella typhimurium LT2
auucagcaaaug

SEQ ID NO: 1855313 - RNA, 16 nt, Salmonella typhimurium LT2
auucagcaacucaucu

SEQ ID NO: 1855314 - RNA, 15 nt, Salmonella typhimurium LT2
auucagcaguucauu

SEQ ID NO: 1855315 - RNA, 16 nt, Salmonella typhimurium LT2
auucagcaggaggcuu

SEQ ID NO: 1855316 - RNA, 15 nt, Salmonella typhimurium LT2
auucacuuucuugcc

SEQ ID NO: 1855317 - RNA, 21 nt, Salmonella typhimurium LT2
auucacuuucuugccacuggc

SEQ ID NO: 1855318 - RNA, 22 nt, Salmonella typhimurium LT2
auucacuuucuugccacuggcc

SEQ ID NO: 1855319 - RNA, 16 nt, Salmonella typhimurium LT2
auucacucugaaaaau

SEQ ID NO: 1855320 - RNA, 18 nt, Salmonella typhimurium LT2
auucacucugaaaaauuu

SEQ ID NO: 1855321 - RNA, 23 nt, Salmonella typhimurium LT2
auucagaccccugugauuuaugu

SEQ ID NO: 1855322 - RNA, 20 nt, Salmonella typhimurium LT2
auucagacugcgcauuaaca

SEQ ID NO: 1855323 - RNA, 14 nt, Salmonella typhimurium LT2
auggcgacgcaggc

SEQ ID NO: 1855324 - RNA, 22 nt, Salmonella typhimurium LT2
auggccugcucuacucaguaag

SEQ ID NO: 1855325 - RNA, 19 nt, Salmonella typhimurium LT2
auggcgcgaaaacagcugg

SEQ ID NO: 1855326 - RNA, 12 nt, Salmonella typhimurium LT2
auggcgccaagu

SEQ ID NO: 1855327 - RNA, 15 nt, Salmonella typhimurium LT2
auggcgccaauauag

SEQ ID NO: 1855328 - RNA, 19 nt, Salmonella typhimurium LT2
auggcgccaauauagccga

SEQ ID NO: 1855329 - RNA, 17 nt, Salmonella typhimurium LT2
auggcacaucaggcaaa

SEQ ID NO: 1855330 - RNA, 21 nt, Salmonella typhimurium LT2
auggcaaagucgaacgacuga

SEQ ID NO: 1855331 - RNA, 18 nt, Salmonella typhimurium LT2
auggcaaacggauauuuu

SEQ ID NO: 1855332 - RNA, 20 nt, Salmonella typhimurium LT2
augcugggcgugucccugga

SEQ ID NO: 1855333 - RNA, 20 nt, Salmonella typhimurium LT2
auggcggcauaaucaggaaa

SEQ ID NO: 1855334 - RNA, 20 nt, Salmonella typhimurium LT2
auggcgcugucgcuuauucg

SEQ ID NO: 1855335 - RNA, 21 nt, Salmonella typhimurium LT2
auggcggcgagaaaaucccau

SEQ ID NO: 1855336 - RNA, 17 nt, Salmonella typhimurium LT2
auggcgcuaagccagcc

SEQ ID NO: 1855337 - RNA, 21 nt, Salmonella typhimurium LT2
auggcgcuacgccugaacgaa

SEQ ID NO: 1855338 - RNA, 18 nt, Salmonella typhimurium LT2
auggcggcggaaaggacu

SEQ ID NO: 1855339 - RNA, 16 nt, Salmonella typhimurium LT2
auggcgggcguccugc

SEQ ID NO: 1855340 - RNA, 17 nt, Salmonella typhimurium LT2
auggcgggcguccugcc

SEQ ID NO: 1855341 - RNA, 21 nt, Salmonella typhimurium LT2
auggcggugcuuaaccgggau

SEQ ID NO: 1855342 - RNA, 20 nt, Salmonella typhimurium LT2
auggcgguauaacugccuua

SEQ ID NO: 1855343 - RNA, 12 nt, Salmonella typhimurium LT2
auggcguaagcu

SEQ ID NO: 1855344 - RNA, 18 nt, Salmonella typhimurium LT2
auggcuuucagauuagcc

SEQ ID NO: 1855345 - RNA, 22 nt, Salmonella typhimurium LT2
augggcaggagaugaccugccc

SEQ ID NO: 1855346 - RNA, 18 nt, Salmonella typhimurium LT2
augggauacgccagcaga

SEQ ID NO: 1855347 - RNA, 20 nt, Salmonella typhimurium LT2
augggauagugccugccguc

SEQ ID NO: 1855348 - RNA, 23 nt, Salmonella typhimurium LT2
auggguaucgccuucgacuuccg

SEQ ID NO: 1855349 - RNA, 20 nt, Salmonella typhimurium LT2
auggguaggccggauaagcg

SEQ ID NO: 1855350 - RNA, 16 nt, Salmonella typhimurium LT2
auguaaaaaaauaaaa

SEQ ID NO: 1855351 - RNA, 19 nt, Salmonella typhimurium LT2
auguaaaacgguaugaaac

SEQ ID NO: 1855352 - RNA, 16 nt, Salmonella typhimurium LT2
auguaacgccuuugcc

SEQ ID NO: 1855353 - RNA, 19 nt, Salmonella typhimurium LT2
auguaaaaaaauaaaaaag

SEQ ID NO: 1855354 - RNA, 22 nt, Salmonella typhimurium LT2
augguuuugcccauuuccugca

SEQ ID NO: 1855355 - RNA, 13 nt, Salmonella typhimurium LT2
auggucuuaaaug

SEQ ID NO: 1855356 - RNA, 17 nt, Salmonella typhimurium LT2
auggucccugauauaca

SEQ ID NO: 1855357 - RNA, 18 nt, Salmonella typhimurium LT2
auggucgcgccaaaagag

SEQ ID NO: 1855358 - RNA, 16 nt, Salmonella typhimurium LT2
auggucgccagcgucu

SEQ ID NO: 1855359 - RNA, 21 nt, Salmonella typhimurium LT2
auggguuauccucuccugaag

SEQ ID NO: 1855360 - RNA, 18 nt, Salmonella typhimurium LT2
auguacucauccauuucc

SEQ ID NO: 1855361 - RNA, 13 nt, Salmonella typhimurium LT2
auguacuagucag

SEQ ID NO: 1855362 - RNA, 14 nt, Salmonella typhimurium LT2
auguaagaauaaca

SEQ ID NO: 1855363 - RNA, 24 nt, Salmonella typhimurium LT2
auguaagcgucuauuacacgauca

SEQ ID NO: 1855364 - RNA, 20 nt, Salmonella typhimurium LT2
auguaucgcgcggauuccgc

SEQ ID NO: 1855365 - RNA, 20 nt, Salmonella typhimurium LT2
auguaucgcgcuuacacaga

SEQ ID NO: 1855366 - RNA, 12 nt, Salmonella typhimurium LT2
aaaagauugcug

SEQ ID NO: 1855367 - RNA, 20 nt, Salmonella typhimurium LT2
auguagucgcucagguuguc

SEQ ID NO: 1855368 - RNA, 17 nt, Salmonella typhimurium LT2
aaaagauauuauaaaau

SEQ ID NO: 1855369 - RNA, 15 nt, Salmonella typhimurium LT2
augucaucaagauuu

SEQ ID NO: 1855370 - RNA, 17 nt, Salmonella typhimurium LT2
augucaucaagauuuug

SEQ ID NO: 1855371 - RNA, 15 nt, Salmonella typhimurium LT2
augucagcucaggaa

SEQ ID NO: 1855372 - RNA, 17 nt, Salmonella typhimurium LT2
augucaugacuuaacgu

SEQ ID NO: 1855373 - RNA, 17 nt, Salmonella typhimurium LT2
auguauuuaauuuuucc

SEQ ID NO: 1855374 - RNA, 18 nt, Salmonella typhimurium LT2
auguauuuaauuuuuccu

SEQ ID NO: 1855375 - RNA, 15 nt, Salmonella typhimurium LT2
auguauuucagacuu

SEQ ID NO: 1855376 - RNA, 17 nt, Salmonella typhimurium LT2
auguaucgcgcggauuc

SEQ ID NO: 1855377 - RNA, 15 nt, Salmonella typhimurium LT2
augucaccaucaucg

SEQ ID NO: 1855378 - RNA, 12 nt, Salmonella typhimurium LT2
augcguucaaaa

SEQ ID NO: 1855379 - RNA, 20 nt, Salmonella typhimurium LT2
augcgugcgccgcgagugca

SEQ ID NO: 1855380 - RNA, 22 nt, Salmonella typhimurium LT2
augcguauuuccaccuucucuu

SEQ ID NO: 1855381 - RNA, 15 nt, Salmonella typhimurium LT2
augcguccgcccaga

SEQ ID NO: 1855382 - RNA, 18 nt, Salmonella typhimurium LT2
augcgggagaucggcugu

SEQ ID NO: 1855383 - RNA, 17 nt, Salmonella typhimurium LT2
augcgggguuugcagau

SEQ ID NO: 1855384 - RNA, 18 nt, Salmonella typhimurium LT2
augcgggguuugcagaug

SEQ ID NO: 1855385 - RNA, 18 nt, Salmonella typhimurium LT2
augcggggguuguuuuac

SEQ ID NO: 1855386 - RNA, 19 nt, Salmonella typhimurium LT2
augcgaucgggcaauccau

SEQ ID NO: 1855387 - RNA, 15 nt, Salmonella typhimurium LT2
augcgauguaaaaau

SEQ ID NO: 1855388 - RNA, 16 nt, Salmonella typhimurium LT2
augcgauguaaaaaug

SEQ ID NO: 1855389 - RNA, 20 nt, Salmonella typhimurium LT2
augcgcagaaacugaucgaa

SEQ ID NO: 1855390 - RNA, 14 nt, Salmonella typhimurium LT2
augccgugaguaau

SEQ ID NO: 1855391 - RNA, 14 nt, Salmonella typhimurium LT2
augcgaugaucuug

SEQ ID NO: 1855392 - RNA, 17 nt, Salmonella typhimurium LT2
augcgcuuccagcauga

SEQ ID NO: 1855393 - RNA, 13 nt, Salmonella typhimurium LT2
augcgcuccagcu

SEQ ID NO: 1855394 - RNA, 23 nt, Salmonella typhimurium LT2
augcggaagguucgccuuccgca

SEQ ID NO: 1855395 - RNA, 23 nt, Salmonella typhimurium LT2
augcggcaaaaauccuucuucca

SEQ ID NO: 1855396 - RNA, 16 nt, Salmonella typhimurium LT2
augcgcuagcuggcag

SEQ ID NO: 1855397 - RNA, 15 nt, Salmonella typhimurium LT2
augcgcuauaaaaau

SEQ ID NO: 1855398 - RNA, 18 nt, Salmonella typhimurium LT2
augcuaacgcccucucuc

SEQ ID NO: 1855399 - RNA, 20 nt, Salmonella typhimurium LT2
aaaagaccauccgguuuuaa

SEQ ID NO: 1855400 - RNA, 18 nt, Salmonella typhimurium LT2
aaaagaccccgccaggcg

SEQ ID NO: 1855401 - RNA, 22 nt, Salmonella typhimurium LT2
aaaagaccuggggguaacacaa

SEQ ID NO: 1855402 - RNA, 18 nt, Salmonella typhimurium LT2
augcuacacgccccuuuc

SEQ ID NO: 1855403 - RNA, 14 nt, Salmonella typhimurium LT2
aaaagagaaaaaau

SEQ ID NO: 1855404 - RNA, 22 nt, Salmonella typhimurium LT2
augcucaacccgaccuacaaau

SEQ ID NO: 1855405 - RNA, 22 nt, Salmonella typhimurium LT2
augcuaucgguaguguuaucgc

SEQ ID NO: 1855406 - RNA, 23 nt, Salmonella typhimurium LT2
augcuaucgguaguguuaucgcc

SEQ ID NO: 1855407 - RNA, 14 nt, Salmonella typhimurium LT2
augcuauucagcag

SEQ ID NO: 1855408 - RNA, 14 nt, Salmonella typhimurium LT2
augcuauuuguggg

SEQ ID NO: 1855409 - RNA, 23 nt, Salmonella typhimurium LT2
aaaagaguaaaguuauucacgua

SEQ ID NO: 1855410 - RNA, 13 nt, Salmonella typhimurium LT2
augcuaucccagg

SEQ ID NO: 1855411 - RNA, 17 nt, Salmonella typhimurium LT2
augcucauuuugauaaa

SEQ ID NO: 1855412 - RNA, 15 nt, Salmonella typhimurium LT2
augcucauuauuugg

SEQ ID NO: 1855413 - RNA, 23 nt, Salmonella typhimurium LT2
augcucauugccuuucaauacuu

SEQ ID NO: 1855414 - RNA, 19 nt, Salmonella typhimurium LT2
augcucaccgcgaauauac

SEQ ID NO: 1855415 - RNA, 23 nt, Salmonella typhimurium LT2
augcucagggcauccgccgccgc

SEQ ID NO: 1855416 - RNA, 20 nt, Salmonella typhimurium LT2
augcaggcggucgaaacacg

SEQ ID NO: 1855417 - RNA, 14 nt, Salmonella typhimurium LT2
augcaggccaagca

SEQ ID NO: 1855418 - RNA, 16 nt, Salmonella typhimurium LT2
augcaggcauaaaaaa

SEQ ID NO: 1855419 - RNA, 21 nt, Salmonella typhimurium LT2
augaucguaugcagccaggcc

SEQ ID NO: 1855420 - RNA, 16 nt, Salmonella typhimurium LT2
augaucguaugcagcc

SEQ ID NO: 1855421 - RNA, 17 nt, Salmonella typhimurium LT2
augaucguuuccagcau

SEQ ID NO: 1855422 - RNA, 15 nt, Salmonella typhimurium LT2
augaucgccucuucg

SEQ ID NO: 1855423 - RNA, 19 nt, Salmonella typhimurium LT2
augaucgcgauagcgcuga

SEQ ID NO: 1855424 - RNA, 16 nt, Salmonella typhimurium LT2
augcaccgccuugccc

SEQ ID NO: 1855425 - RNA, 23 nt, Salmonella typhimurium LT2
augaucuauccaauaauaagaau

SEQ ID NO: 1855426 - RNA, 18 nt, Salmonella typhimurium LT2
augcaucagaacaaacuu

SEQ ID NO: 1855427 - RNA, 23 nt, Salmonella typhimurium LT2
augcaugccucgaaaauauauuc

SEQ ID NO: 1855428 - RNA, 13 nt, Salmonella typhimurium LT2
augcaugaagcgu

SEQ ID NO: 1855429 - RNA, 15 nt, Salmonella typhimurium LT2
augcaucuucacugu

SEQ ID NO: 1855430 - RNA, 13 nt, Salmonella typhimurium LT2
augcauaaaaaaa

SEQ ID NO: 1855431 - RNA, 15 nt, Salmonella typhimurium LT2
augcauaaaaaaacg

SEQ ID NO: 1855432 - RNA, 17 nt, Salmonella typhimurium LT2
augcaguucaucauccu

SEQ ID NO: 1855433 - RNA, 23 nt, Salmonella typhimurium LT2
augcagggguccuguaacaacug

SEQ ID NO: 1855434 - RNA, 22 nt, Salmonella typhimurium LT2
augccagaagagaagcuuuuuc

SEQ ID NO: 1855435 - RNA, 16 nt, Salmonella typhimurium LT2
augccacggcugaggc

SEQ ID NO: 1855436 - RNA, 23 nt, Salmonella typhimurium LT2
augccacugcccucaaguuaugu

SEQ ID NO: 1855437 - RNA, 14 nt, Salmonella typhimurium LT2
augccagcaggcca

SEQ ID NO: 1855438 - RNA, 21 nt, Salmonella typhimurium LT2
augccagcaggccaaagauua

SEQ ID NO: 1855439 - RNA, 16 nt, Salmonella typhimurium LT2
augccagaucugcauc

SEQ ID NO: 1855440 - RNA, 18 nt, Salmonella typhimurium LT2
augcauguggagaugagc

SEQ ID NO: 1855441 - RNA, 20 nt, Salmonella typhimurium LT2
augccccagaaaaugcucag

SEQ ID NO: 1855442 - RNA, 21 nt, Salmonella typhimurium LT2
augccgcuggccgaugucaau

SEQ ID NO: 1855443 - RNA, 17 nt, Salmonella typhimurium LT2
augccccgacaucagau

SEQ ID NO: 1855444 - RNA, 19 nt, Salmonella typhimurium LT2
augcccccuccagccagcg

SEQ ID NO: 1855445 - RNA, 17 nt, Salmonella typhimurium LT2
augcccccgcgcaggcg

SEQ ID NO: 1855446 - RNA, 23 nt, Salmonella typhimurium LT2
augccggugcgagaaaaagcaau

SEQ ID NO: 1855447 - RNA, 16 nt, Salmonella typhimurium LT2
augccguaccugcuga

SEQ ID NO: 1855448 - RNA, 23 nt, Salmonella typhimurium LT2
augccggguggcggcugcgccuu

SEQ ID NO: 1855449 - RNA, 21 nt, Salmonella typhimurium LT2
auuuagacuugggaaacuuau

SEQ ID NO: 1855450 - RNA, 14 nt, Salmonella typhimurium LT2
auuuaccucucacc

SEQ ID NO: 1855451 - RNA, 17 nt, Salmonella typhimurium LT2
auuuacucaguuugcug

SEQ ID NO: 1855452 - RNA, 11 nt, Salmonella typhimurium LT2
auuuacugccg

SEQ ID NO: 1855453 - RNA, 22 nt, Salmonella typhimurium LT2
auuuacaaaugaccucaagaau

SEQ ID NO: 1855454 - RNA, 15 nt, Salmonella typhimurium LT2
auuuaauuuuuccuu

SEQ ID NO: 1855455 - RNA, 15 nt, Salmonella typhimurium LT2
auuguggaaauaaga

SEQ ID NO: 1855456 - RNA, 20 nt, Salmonella typhimurium LT2
auugugcgcaagaaaaguuu

SEQ ID NO: 1855457 - RNA, 18 nt, Salmonella typhimurium LT2
auugugagaaaagcagag

SEQ ID NO: 1855458 - RNA, 21 nt, Salmonella typhimurium LT2
auugugagccagacgccgcgc

SEQ ID NO: 1855459 - RNA, 21 nt, Salmonella typhimurium LT2
auugugaagggggccagagca

SEQ ID NO: 1855460 - RNA, 14 nt, Salmonella typhimurium LT2
auugucagaauuuc

SEQ ID NO: 1855461 - RNA, 20 nt, Salmonella typhimurium LT2
auugucauaaugucccugcc

SEQ ID NO: 1855462 - RNA, 20 nt, Salmonella typhimurium LT2
auuguuuguggcaaaguacg

SEQ ID NO: 1855463 - RNA, 13 nt, Salmonella typhimurium LT2
auuuaaaaguaca

SEQ ID NO: 1855464 - RNA, 19 nt, Salmonella typhimurium LT2
auuuaagccagauguaauc

SEQ ID NO: 1855465 - RNA, 21 nt, Salmonella typhimurium LT2
auuuaagccagacgcgcagca

SEQ ID NO: 1855466 - RNA, 17 nt, Salmonella typhimurium LT2
auuuaaaauccggcugc

SEQ ID NO: 1855467 - RNA, 17 nt, Salmonella typhimurium LT2
auuuaauccaccacagu

SEQ ID NO: 1855468 - RNA, 24 nt, Salmonella typhimurium LT2
auuuaauauugcugaauaccuuca

SEQ ID NO: 1855469 - RNA, 17 nt, Salmonella typhimurium LT2
auuuaauggucuuaaau

SEQ ID NO: 1855470 - RNA, 17 nt, Salmonella typhimurium LT2
auuuaaugucgacauaa

SEQ ID NO: 1855471 - RNA, 23 nt, Salmonella typhimurium LT2
auuuaauugauaucgcaacagau

SEQ ID NO: 1855472 - RNA, 12 nt, Salmonella typhimurium LT2
auuggcaaugaa

SEQ ID NO: 1855473 - RNA, 15 nt, Salmonella typhimurium LT2
auuggcaaacugccg

SEQ ID NO: 1855474 - RNA, 18 nt, Salmonella typhimurium LT2
auuggcgcagccuuuuuc

SEQ ID NO: 1855475 - RNA, 14 nt, Salmonella typhimurium LT2
auuggcaucauaaa

SEQ ID NO: 1855476 - RNA, 19 nt, Salmonella typhimurium LT2
auuguaucauuuuuguuaa

SEQ ID NO: 1855477 - RNA, 23 nt, Salmonella typhimurium LT2
aaaaguacaaugcaaagaaaaac

SEQ ID NO: 1855478 - RNA, 18 nt, Salmonella typhimurium LT2
auugucaccguaauauaa

SEQ ID NO: 1855479 - RNA, 17 nt, Salmonella typhimurium LT2
auugucacuauucuuau

SEQ ID NO: 1855480 - RNA, 18 nt, Salmonella typhimurium LT2
auugucacuauucuuauc

SEQ ID NO: 1855481 - RNA, 18 nt, Salmonella typhimurium LT2
auuggucaauaagugaua

SEQ ID NO: 1855482 - RNA, 19 nt, Salmonella typhimurium LT2
aaaagguggguuccagcgc

SEQ ID NO: 1855483 - RNA, 21 nt, Salmonella typhimurium LT2
auugcgccugggauaagcaga

SEQ ID NO: 1855484 - RNA, 21 nt, Salmonella typhimurium LT2
auugcgcgcuauguucaugcu

SEQ ID NO: 1855485 - RNA, 14 nt, Salmonella typhimurium LT2
auugcuuuuuucca

SEQ ID NO: 1855486 - RNA, 17 nt, Salmonella typhimurium LT2
auugcugacgaaacauu

SEQ ID NO: 1855487 - RNA, 16 nt, Salmonella typhimurium LT2
auugcugaagauaaaa

SEQ ID NO: 1855488 - RNA, 16 nt, Salmonella typhimurium LT2
auugauaauaaccguc

SEQ ID NO: 1855489 - RNA, 17 nt, Salmonella typhimurium LT2
auugauaaucagcaaga

SEQ ID NO: 1855490 - RNA, 13 nt, Salmonella typhimurium LT2
auugcgagaaaaa

SEQ ID NO: 1855491 - RNA, 15 nt, Salmonella typhimurium LT2
auugcgagaaaaaac

SEQ ID NO: 1855492 - RNA, 14 nt, Salmonella typhimurium LT2
auugcgaguuaucu

SEQ ID NO: 1855493 - RNA, 14 nt, Salmonella typhimurium LT2
auugcgccaccuua

SEQ ID NO: 1855494 - RNA, 18 nt, Salmonella typhimurium LT2
auugcgauacagcguauc

SEQ ID NO: 1855495 - RNA, 17 nt, Salmonella typhimurium LT2
auugauuggcaaacugc

SEQ ID NO: 1855496 - RNA, 18 nt, Salmonella typhimurium LT2
auugauuacaaagggcaa

SEQ ID NO: 1855497 - RNA, 13 nt, Salmonella typhimurium LT2
auugaccuucaug

SEQ ID NO: 1855498 - RNA, 17 nt, Salmonella typhimurium LT2
auugaacggcucaaaau

SEQ ID NO: 1855499 - RNA, 20 nt, Salmonella typhimurium LT2
auugaauuugacgacaugca

SEQ ID NO: 1855500 - RNA, 18 nt, Salmonella typhimurium LT2
auugaagguauccagcca

SEQ ID NO: 1855501 - RNA, 20 nt, Salmonella typhimurium LT2
auugagcgcaaaacgcugcu

SEQ ID NO: 1855502 - RNA, 17 nt, Salmonella typhimurium LT2
auugagcagucguucac

SEQ ID NO: 1855503 - RNA, 20 nt, Salmonella typhimurium LT2
auugagguguuuccagugca

SEQ ID NO: 1855504 - RNA, 16 nt, Salmonella typhimurium LT2
auugaggcuacccaga

SEQ ID NO: 1855505 - RNA, 17 nt, Salmonella typhimurium LT2
auucucccaaauuuuuu

SEQ ID NO: 1855506 - RNA, 18 nt, Salmonella typhimurium LT2
auucuguuagcgcccucu

SEQ ID NO: 1855507 - RNA, 14 nt, Salmonella typhimurium LT2
auucuguuccuaau

SEQ ID NO: 1855508 - RNA, 13 nt, Salmonella typhimurium LT2
auucuuucgucac

SEQ ID NO: 1855509 - RNA, 19 nt, Salmonella typhimurium LT2
auucuuuguuuaaaaauuu

SEQ ID NO: 1855510 - RNA, 23 nt, Salmonella typhimurium LT2
auucuuuguuuaaaaauuuuuau

SEQ ID NO: 1855511 - RNA, 19 nt, Salmonella typhimurium LT2
auucggccuucgguuuuau

SEQ ID NO: 1855512 - RNA, 16 nt, Salmonella typhimurium LT2
auucggcgagaaaacc

SEQ ID NO: 1855513 - RNA, 14 nt, Salmonella typhimurium LT2
auucggcuccagau

SEQ ID NO: 1855514 - RNA, 17 nt, Salmonella typhimurium LT2
auucgguaguuccagaa

SEQ ID NO: 1855515 - RNA, 21 nt, Salmonella typhimurium LT2
auucgggacaaacccccagcc

SEQ ID NO: 1855516 - RNA, 14 nt, Salmonella typhimurium LT2
auucgaauucugau

SEQ ID NO: 1855517 - RNA, 18 nt, Salmonella typhimurium LT2
auucgagaugcauaaaaa

SEQ ID NO: 1855518 - RNA, 14 nt, Salmonella typhimurium LT2
auuccugacugcgc

SEQ ID NO: 1855519 - RNA, 16 nt, Salmonella typhimurium LT2
auucgccaccaggcuc

SEQ ID NO: 1855520 - RNA, 23 nt, Salmonella typhimurium LT2
auucgccaccgcgcgcuuaaucg

SEQ ID NO: 1855521 - RNA, 16 nt, Salmonella typhimurium LT2
auucgcccaaaugcuc

SEQ ID NO: 1855522 - RNA, 16 nt, Salmonella typhimurium LT2
auuccccguccugaau

SEQ ID NO: 1855523 - RNA, 15 nt, Salmonella typhimurium LT2
auuccgcucagauaa

SEQ ID NO: 1855524 - RNA, 23 nt, Salmonella typhimurium LT2
auuccgcucagauaacauaugag

SEQ ID NO: 1855525 - RNA, 13 nt, Salmonella typhimurium LT2
auuccggcacaac

SEQ ID NO: 1855526 - RNA, 23 nt, Salmonella typhimurium LT2
auuccggcacucugcgccagguu

SEQ ID NO: 1855527 - RNA, 14 nt, Salmonella typhimurium LT2
auuccggcgcuggc

SEQ ID NO: 1855528 - RNA, 14 nt, Salmonella typhimurium LT2
auuccggcacaacc

SEQ ID NO: 1855529 - RNA, 20 nt, Salmonella typhimurium LT2
auuccgguaucgugcgggcg

SEQ ID NO: 1855530 - RNA, 11 nt, Salmonella typhimurium LT2
auuccagaccc

SEQ ID NO: 1855531 - RNA, 19 nt, Salmonella typhimurium LT2
auucccagauguugagcaa

SEQ ID NO: 1855532 - RNA, 10 nt, Salmonella typhimurium LT2
auuccccacc

SEQ ID NO: 1855533 - RNA, 19 nt, Salmonella typhimurium LT2
auucccauccgugcgauaa

SEQ ID NO: 1855534 - RNA, 15 nt, Salmonella typhimurium LT2
auucccauugagcag

SEQ ID NO: 1855535 - RNA, 15 nt, Salmonella typhimurium LT2
auuccagucgcucca

SEQ ID NO: 1855536 - RNA, 17 nt, Salmonella typhimurium LT2
auuccagugacaaugua

SEQ ID NO: 1855537 - RNA, 20 nt, Salmonella typhimurium LT2
auucccacgcauaguccugc

SEQ ID NO: 1855538 - RNA, 12 nt, Salmonella typhimurium LT2
auucccagaccc

SEQ ID NO: 1855539 - RNA, 14 nt, Salmonella typhimurium LT2
auuccaguccuuuc

SEQ ID NO: 1855540 - RNA, 15 nt, Salmonella typhimurium LT2
auuuugauaaaucag

SEQ ID NO: 1855541 - RNA, 24 nt, Salmonella typhimurium LT2
auuuugucaggccgcgugggacgu

SEQ ID NO: 1855542 - RNA, 12 nt, Salmonella typhimurium LT2
auuuugcgccua

SEQ ID NO: 1855543 - RNA, 17 nt, Salmonella typhimurium LT2
auuuugcgguuuuaauu

SEQ ID NO: 1855544 - RNA, 21 nt, Salmonella typhimurium LT2
auuuuguaguuguuuuaugug

SEQ ID NO: 1855545 - RNA, 21 nt, Salmonella typhimurium LT2
auuuuguaggccuaaaaauag

SEQ ID NO: 1855546 - RNA, 23 nt, Salmonella typhimurium LT2
auuuuguaggccuaaaaauagcu

SEQ ID NO: 1855547 - RNA, 20 nt, Salmonella typhimurium LT2
auuuugguuacuauuuuuca

SEQ ID NO: 1855548 - RNA, 14 nt, Salmonella typhimurium LT2
auuuuaaaccaauc

SEQ ID NO: 1855549 - RNA, 11 nt, Salmonella typhimurium LT2
auuuuauucau

SEQ ID NO: 1855550 - RNA, 21 nt, Salmonella typhimurium LT2
auuuucaccuggaugcugccu

SEQ ID NO: 1855551 - RNA, 21 nt, Salmonella typhimurium LT2
auuuucagccauuuuuuauug

SEQ ID NO: 1855552 - RNA, 20 nt, Salmonella typhimurium LT2
auuuucagcuucagucauaa

SEQ ID NO: 1855553 - RNA, 19 nt, Salmonella typhimurium LT2
auuuucccaacuguauuuu

SEQ ID NO: 1855554 - RNA, 22 nt, Salmonella typhimurium LT2
auuuuccccgaugccauuugca

SEQ ID NO: 1855555 - RNA, 13 nt, Salmonella typhimurium LT2
caaaaacgccaga

SEQ ID NO: 1855556 - RNA, 16 nt, Salmonella typhimurium LT2
caaaaagcgcgcggcu

SEQ ID NO: 1855557 - RNA, 19 nt, Salmonella typhimurium LT2
caaaaagcgcgcggcugcg

SEQ ID NO: 1855558 - RNA, 18 nt, Salmonella typhimurium LT2
caaaaaguaguuccagca

SEQ ID NO: 1855559 - RNA, 20 nt, Salmonella typhimurium LT2
caaaaaguaguuccagcaua

SEQ ID NO: 1855560 - RNA, 12 nt, Salmonella typhimurium LT2
caaaaacgccag

SEQ ID NO: 1855561 - RNA, 20 nt, Salmonella typhimurium LT2
caaaaacauccacauaggcg

SEQ ID NO: 1855562 - RNA, 11 nt, Salmonella typhimurium LT2
caaaaaagccc

SEQ ID NO: 1855563 - RNA, 12 nt, Salmonella typhimurium LT2
caaaaauaccac

SEQ ID NO: 1855564 - RNA, 20 nt, Salmonella typhimurium LT2
caaaaauauggucgaaaaua

SEQ ID NO: 1855565 - RNA, 21 nt, Salmonella typhimurium LT2
caaaaagugaaaaaacggaac

SEQ ID NO: 1855566 - RNA, 23 nt, Salmonella typhimurium LT2
caaaaauggcuucggcaauuucc

SEQ ID NO: 1855567 - RNA, 21 nt, Salmonella typhimurium LT2
caaaaauuucgaccucuucgu

SEQ ID NO: 1855568 - RNA, 21 nt, Salmonella typhimurium LT2
caaaaauauggucgaaaauau

SEQ ID NO: 1855569 - RNA, 20 nt, Salmonella typhimurium LT2
caaaaaucgucaucagauag

SEQ ID NO: 1855570 - RNA, 22 nt, Salmonella typhimurium LT2
caaaaaucgucaucagauaggc

SEQ ID NO: 1855571 - RNA, 22 nt, Salmonella typhimurium LT2
caaaacaaccgucgauuuuaau

SEQ ID NO: 1855572 - RNA, 14 nt, Salmonella typhimurium LT2
caaaacacagcuca

SEQ ID NO: 1855573 - RNA, 21 nt, Salmonella typhimurium LT2
caaaacacagcucaauaucau

SEQ ID NO: 1855574 - RNA, 19 nt, Salmonella typhimurium LT2
auuuuuuuaaugccggcgc

SEQ ID NO: 1855575 - RNA, 12 nt, Salmonella typhimurium LT2
auuuuuuugccu

SEQ ID NO: 1855576 - RNA, 22 nt, Salmonella typhimurium LT2
auuuuuuuagcauaacguuucc

SEQ ID NO: 1855577 - RNA, 18 nt, Salmonella typhimurium LT2
caaaaaacgguauaaaaa

SEQ ID NO: 1855578 - RNA, 19 nt, Salmonella typhimurium LT2
caaaaaacgguauaaaaaa

SEQ ID NO: 1855579 - RNA, 13 nt, Salmonella typhimurium LT2
caaaaaagagaag

SEQ ID NO: 1855580 - RNA, 13 nt, Salmonella typhimurium LT2
caaaaaagcugcg

SEQ ID NO: 1855581 - RNA, 21 nt, Salmonella typhimurium LT2
auuuuuugacaacaaaaagau

SEQ ID NO: 1855582 - RNA, 11 nt, Salmonella typhimurium LT2
auuuuuaggcg

SEQ ID NO: 1855583 - RNA, 14 nt, Salmonella typhimurium LT2
auuuguaugacaaa

SEQ ID NO: 1855584 - RNA, 20 nt, Salmonella typhimurium LT2
auuuguauuaucccggccgc

SEQ ID NO: 1855585 - RNA, 17 nt, Salmonella typhimurium LT2
auuuguagcugcgccug

SEQ ID NO: 1855586 - RNA, 19 nt, Salmonella typhimurium LT2
auuuguagcggcaacagca

SEQ ID NO: 1855587 - RNA, 19 nt, Salmonella typhimurium LT2
auuuguacaaaaaauguga

SEQ ID NO: 1855588 - RNA, 17 nt, Salmonella typhimurium LT2
auuugugagcuauacgg

SEQ ID NO: 1855589 - RNA, 16 nt, Salmonella typhimurium LT2
auuugucccuguucca

SEQ ID NO: 1855590 - RNA, 21 nt, Salmonella typhimurium LT2
auuugucccuguuccaucucu

SEQ ID NO: 1855591 - RNA, 15 nt, Salmonella typhimurium LT2
auuuguugguuuaaa

SEQ ID NO: 1855592 - RNA, 14 nt, Salmonella typhimurium LT2
auuuguuaguccgc

SEQ ID NO: 1855593 - RNA, 14 nt, Salmonella typhimurium LT2
auuuguuccuggca

SEQ ID NO: 1855594 - RNA, 15 nt, Salmonella typhimurium LT2
auuugcuguuaaaac

SEQ ID NO: 1855595 - RNA, 13 nt, Salmonella typhimurium LT2
auuugcugcaacg

SEQ ID NO: 1855596 - RNA, 23 nt, Salmonella typhimurium LT2
auuugguuagggaucaucuucac

SEQ ID NO: 1855597 - RNA, 16 nt, Salmonella typhimurium LT2
auuuggcuuaaauaau

SEQ ID NO: 1855598 - RNA, 13 nt, Salmonella typhimurium LT2
auuucuccugcau

SEQ ID NO: 1855599 - RNA, 16 nt, Salmonella typhimurium LT2
auuucuccugcgccag

SEQ ID NO: 1855600 - RNA, 12 nt, Salmonella typhimurium LT2
auuugcauuuuc

SEQ ID NO: 1855601 - RNA, 16 nt, Salmonella typhimurium LT2
auuugcagaaagauuu

SEQ ID NO: 1855602 - RNA, 14 nt, Salmonella typhimurium LT2
auuugcccagccga

SEQ ID NO: 1855603 - RNA, 22 nt, Salmonella typhimurium LT2
auuugcgacaucagccagccgc

SEQ ID NO: 1855604 - RNA, 23 nt, Salmonella typhimurium LT2
auuugccugaacgguuuauaccg

SEQ ID NO: 1855605 - RNA, 16 nt, Salmonella typhimurium LT2
auuugccugccgcagc

SEQ ID NO: 1855606 - RNA, 18 nt, Salmonella typhimurium LT2
auuugcgcuuucagcgca

SEQ ID NO: 1855607 - RNA, 17 nt, Salmonella typhimurium LT2
auuugcggcgucgccug

SEQ ID NO: 1855608 - RNA, 14 nt, Salmonella typhimurium LT2
auuuaggauuuguc

SEQ ID NO: 1855609 - RNA, 22 nt, Salmonella typhimurium LT2
auuucaauaauauguuccacaa

SEQ ID NO: 1855610 - RNA, 14 nt, Salmonella typhimurium LT2
auuucauaauaagc

SEQ ID NO: 1855611 - RNA, 23 nt, Salmonella typhimurium LT2
auuucaugcggugcaugaauauc

SEQ ID NO: 1855612 - RNA, 14 nt, Salmonella typhimurium LT2
auuucauuaaucag

SEQ ID NO: 1855613 - RNA, 16 nt, Salmonella typhimurium LT2
auuucaucuauuauuu

SEQ ID NO: 1855614 - RNA, 20 nt, Salmonella typhimurium LT2
auuucaucuauuauuuuucu

SEQ ID NO: 1855615 - RNA, 21 nt, Salmonella typhimurium LT2
auuuccagugccaguuaagca

SEQ ID NO: 1855616 - RNA, 13 nt, Salmonella typhimurium LT2
auuuccaguucaa

SEQ ID NO: 1855617 - RNA, 12 nt, Salmonella typhimurium LT2
auuuccucugcc

SEQ ID NO: 1855618 - RNA, 17 nt, Salmonella typhimurium LT2
auuuccagugccaguua

SEQ ID NO: 1855619 - RNA, 16 nt, Salmonella typhimurium LT2
auuuccaccuucucuu

SEQ ID NO: 1855620 - RNA, 17 nt, Salmonella typhimurium LT2
auuucauuuauggucau

SEQ ID NO: 1855621 - RNA, 13 nt, Salmonella typhimurium LT2
auuucgcacccug

SEQ ID NO: 1855622 - RNA, 19 nt, Salmonella typhimurium LT2
auuucgcccaucgcuuuca

SEQ ID NO: 1855623 - RNA, 13 nt, Salmonella typhimurium LT2
auuucgccgccgc

SEQ ID NO: 1855624 - RNA, 20 nt, Salmonella typhimurium LT2
auuucucaaaaacaccauuu

SEQ ID NO: 1855625 - RNA, 18 nt, Salmonella typhimurium LT2
auuucucaaagugcgccg

SEQ ID NO: 1855626 - RNA, 19 nt, Salmonella typhimurium LT2
cacacugacgcgccagcuc

SEQ ID NO: 1855627 - RNA, 15 nt, Salmonella typhimurium LT2
cacacugcgccgcca

SEQ ID NO: 1855628 - RNA, 23 nt, Salmonella typhimurium LT2
cacagaauuacauaugcgcggcg

SEQ ID NO: 1855629 - RNA, 14 nt, Salmonella typhimurium LT2
cacacucucuccag

SEQ ID NO: 1855630 - RNA, 14 nt, Salmonella typhimurium LT2
cacacccugcagac

SEQ ID NO: 1855631 - RNA, 15 nt, Salmonella typhimurium LT2
cacaccauuucacaa

SEQ ID NO: 1855632 - RNA, 18 nt, Salmonella typhimurium LT2
cacaccauuucacaaauu

SEQ ID NO: 1855633 - RNA, 21 nt, Salmonella typhimurium LT2
cacaccggguucguaauaagg

SEQ ID NO: 1855634 - RNA, 20 nt, Salmonella typhimurium LT2
cacaaauuuugauaaaaaca

SEQ ID NO: 1855635 - RNA, 18 nt, Salmonella typhimurium LT2
cacaacaauauuccauau

SEQ ID NO: 1855636 - RNA, 13 nt, Salmonella typhimurium LT2
cacaauugccaug

SEQ ID NO: 1855637 - RNA, 21 nt, Salmonella typhimurium LT2
cacaaugguugccuggugucc

SEQ ID NO: 1855638 - RNA, 14 nt, Salmonella typhimurium LT2
cacaaugucaucaa

SEQ ID NO: 1855639 - RNA, 22 nt, Salmonella typhimurium LT2
cacacaagucaccguuuuucau

SEQ ID NO: 1855640 - RNA, 16 nt, Salmonella typhimurium LT2
cacagacccaguacaa

SEQ ID NO: 1855641 - RNA, 20 nt, Salmonella typhimurium LT2
cacagaggaauauuaucaau

SEQ ID NO: 1855642 - RNA, 14 nt, Salmonella typhimurium LT2
cacagcggaaagca

SEQ ID NO: 1855643 - RNA, 14 nt, Salmonella typhimurium LT2
cacagcggaauaga

SEQ ID NO: 1855644 - RNA, 13 nt, Salmonella typhimurium LT2
cacaggccaacau

SEQ ID NO: 1855645 - RNA, 13 nt, Salmonella typhimurium LT2
cacaggaaccggu

SEQ ID NO: 1855646 - RNA, 20 nt, Salmonella typhimurium LT2
cacaguagcucauagcccag

SEQ ID NO: 1855647 - RNA, 17 nt, Salmonella typhimurium LT2
cacaguauucaccugga

SEQ ID NO: 1855648 - RNA, 15 nt, Salmonella typhimurium LT2
cacaguacgcccggc

SEQ ID NO: 1855649 - RNA, 14 nt, Salmonella typhimurium LT2
cacagguacaggcc

SEQ ID NO: 1855650 - RNA, 20 nt, Salmonella typhimurium LT2
cacagguaaaauugccgcca

SEQ ID NO: 1855651 - RNA, 21 nt, Salmonella typhimurium LT2
cacagguacaggccgccgccu

SEQ ID NO: 1855652 - RNA, 16 nt, Salmonella typhimurium LT2
cacaaaacccgcagcc

SEQ ID NO: 1855653 - RNA, 21 nt, Salmonella typhimurium LT2
cacaaacggcgguuuuuuuau

SEQ ID NO: 1855654 - RNA, 22 nt, Salmonella typhimurium LT2
cacaaacggcgguuuuuuuauc

SEQ ID NO: 1855655 - RNA, 22 nt, Salmonella typhimurium LT2
cacaaagagugccagaaacauc

SEQ ID NO: 1855656 - RNA, 22 nt, Salmonella typhimurium LT2
cacaaagcgcgagggauuaucu

SEQ ID NO: 1855657 - RNA, 22 nt, Salmonella typhimurium LT2
caauuugguuagggaucaucuu

SEQ ID NO: 1855658 - RNA, 21 nt, Salmonella typhimurium LT2
caauuuuaauuuaauaauaaa

SEQ ID NO: 1855659 - RNA, 13 nt, Salmonella typhimurium LT2
caauuuuuaguuc

SEQ ID NO: 1855660 - RNA, 17 nt, Salmonella typhimurium LT2
caauuuuguuaaauccc

SEQ ID NO: 1855661 - RNA, 18 nt, Salmonella typhimurium LT2
caauguucauacaccgca

SEQ ID NO: 1855662 - RNA, 17 nt, Salmonella typhimurium LT2
caauuaaaugaaugagu

SEQ ID NO: 1855663 - RNA, 21 nt, Salmonella typhimurium LT2
caauguuuuaccggcagcucu

SEQ ID NO: 1855664 - RNA, 12 nt, Salmonella typhimurium LT2
caauuaacauuu

SEQ ID NO: 1855665 - RNA, 17 nt, Salmonella typhimurium LT2
caauuacggacagaaaa

SEQ ID NO: 1855666 - RNA, 21 nt, Salmonella typhimurium LT2
caauuacggacagaaaaaaua

SEQ ID NO: 1855667 - RNA, 17 nt, Salmonella typhimurium LT2
caauuacccucgcgcuc

SEQ ID NO: 1855668 - RNA, 13 nt, Salmonella typhimurium LT2
caauuaauuuaua

SEQ ID NO: 1855669 - RNA, 23 nt, Salmonella typhimurium LT2
caauuauauucguccuuuaucag

SEQ ID NO: 1855670 - RNA, 17 nt, Salmonella typhimurium LT2
caauuagcgacgcauac

SEQ ID NO: 1855671 - RNA, 22 nt, Salmonella typhimurium LT2
caauugacgggcggcuuccguu

SEQ ID NO: 1855672 - RNA, 20 nt, Salmonella typhimurium LT2
cacaucuguuugagaaaaac

SEQ ID NO: 1855673 - RNA, 17 nt, Salmonella typhimurium LT2
cacaugauguuuuaaca

SEQ ID NO: 1855674 - RNA, 19 nt, Salmonella typhimurium LT2
cacaugcaagucgaacggu

SEQ ID NO: 1855675 - RNA, 16 nt, Salmonella typhimurium LT2
caccaaguagacagag

SEQ ID NO: 1855676 - RNA, 12 nt, Salmonella typhimurium LT2
cacauuggcaaa

SEQ ID NO: 1855677 - RNA, 18 nt, Salmonella typhimurium LT2
cacauugcaaugcaguuc

SEQ ID NO: 1855678 - RNA, 17 nt, Salmonella typhimurium LT2
cacauucucuucuuuaa

SEQ ID NO: 1855679 - RNA, 16 nt, Salmonella typhimurium LT2
cacaugcggaagcaaa

SEQ ID NO: 1855680 - RNA, 17 nt, Salmonella typhimurium LT2
caccaauacgugagcga

SEQ ID NO: 1855681 - RNA, 12 nt, Salmonella typhimurium LT2
caccaauugcca

SEQ ID NO: 1855682 - RNA, 14 nt, Salmonella typhimurium LT2
caccaccuccugcu

SEQ ID NO: 1855683 - RNA, 20 nt, Salmonella typhimurium LT2
caccacgguguaccccgccu

SEQ ID NO: 1855684 - RNA, 22 nt, Salmonella typhimurium LT2
caccacgguguaccccgccuga

SEQ ID NO: 1855685 - RNA, 18 nt, Salmonella typhimurium LT2
caccacgguguaccccgc

SEQ ID NO: 1855686 - RNA, 17 nt, Salmonella typhimurium LT2
caccacggcgcagguaa

SEQ ID NO: 1855687 - RNA, 17 nt, Salmonella typhimurium LT2
caccaccugcaugggga

SEQ ID NO: 1855688 - RNA, 13 nt, Salmonella typhimurium LT2
caccaucuuuuuu

SEQ ID NO: 1855689 - RNA, 17 nt, Salmonella typhimurium LT2
caccaugacgcagugca

SEQ ID NO: 1855690 - RNA, 16 nt, Salmonella typhimurium LT2
caccaugcaaaaugcu

SEQ ID NO: 1855691 - RNA, 16 nt, Salmonella typhimurium LT2
caccaucguugccagc

SEQ ID NO: 1855692 - RNA, 19 nt, Salmonella typhimurium LT2
caccaucguugccagcggc

SEQ ID NO: 1855693 - RNA, 20 nt, Salmonella typhimurium LT2
caccaucguugccagcggcc

SEQ ID NO: 1855694 - RNA, 17 nt, Salmonella typhimurium LT2
caccaucgggucggcca

SEQ ID NO: 1855695 - RNA, 19 nt, Salmonella typhimurium LT2
caccaucagcgucagcacc

SEQ ID NO: 1855696 - RNA, 20 nt, Salmonella typhimurium LT2
caccaucagcgucagcacca

SEQ ID NO: 1855697 - RNA, 21 nt, Salmonella typhimurium LT2
caccaguucacuccuaagaga

SEQ ID NO: 1855698 - RNA, 16 nt, Salmonella typhimurium LT2
caccaguucauauuug

SEQ ID NO: 1855699 - RNA, 15 nt, Salmonella typhimurium LT2
caccaguucacuccu

SEQ ID NO: 1855700 - RNA, 17 nt, Salmonella typhimurium LT2
caccauauucgccaccg

SEQ ID NO: 1855701 - RNA, 15 nt, Salmonella typhimurium LT2
caccauaaaaccauu

SEQ ID NO: 1855702 - RNA, 23 nt, Salmonella typhimurium LT2
caccaguuuauccgccagccagc

SEQ ID NO: 1855703 - RNA, 15 nt, Salmonella typhimurium LT2
caccauacccaacag

SEQ ID NO: 1855704 - RNA, 17 nt, Salmonella typhimurium LT2
caccauacccaacagca

SEQ ID NO: 1855705 - RNA, 20 nt, Salmonella typhimurium LT2
caccauacccaacagcagac

SEQ ID NO: 1855706 - RNA, 17 nt, Salmonella typhimurium LT2
caccauaauuaccggca

SEQ ID NO: 1855707 - RNA, 13 nt, Salmonella typhimurium LT2
aaaauaaaaaagg

SEQ ID NO: 1855708 - RNA, 17 nt, Salmonella typhimurium LT2
caccagggauuuugcuu

SEQ ID NO: 1855709 - RNA, 17 nt, Salmonella typhimurium LT2
aaaaguuugaccagcaa

SEQ ID NO: 1855710 - RNA, 15 nt, Salmonella typhimurium LT2
caccagcuuguuauc

SEQ ID NO: 1855711 - RNA, 21 nt, Salmonella typhimurium LT2
caccagcgcaucgcccugcca

SEQ ID NO: 1855712 - RNA, 18 nt, Salmonella typhimurium LT2
caccagcgauaaacgcca

SEQ ID NO: 1855713 - RNA, 18 nt, Salmonella typhimurium LT2
caccagcgauaucaacgu

SEQ ID NO: 1855714 - RNA, 17 nt, Salmonella typhimurium LT2
caccagcgauccagacc

SEQ ID NO: 1855715 - RNA, 18 nt, Salmonella typhimurium LT2
caccagcgauccagaccg

SEQ ID NO: 1855716 - RNA, 16 nt, Salmonella typhimurium LT2
caccagccuaaaaaca

SEQ ID NO: 1855717 - RNA, 13 nt, Salmonella typhimurium LT2
caccagccguuca

SEQ ID NO: 1855718 - RNA, 20 nt, Salmonella typhimurium LT2
caccagcccuggcugcccuu

SEQ ID NO: 1855719 - RNA, 12 nt, Salmonella typhimurium LT2
caccagacgcug

SEQ ID NO: 1855720 - RNA, 21 nt, Salmonella typhimurium LT2
caccagaccgacaagcccccc

SEQ ID NO: 1855721 - RNA, 17 nt, Salmonella typhimurium LT2
cacccguucgcugcauu

SEQ ID NO: 1855722 - RNA, 14 nt, Salmonella typhimurium LT2
cacccggagagaaa

SEQ ID NO: 1855723 - RNA, 15 nt, Salmonella typhimurium LT2
cacccggagagaaac

SEQ ID NO: 1855724 - RNA, 15 nt, Salmonella typhimurium LT2
cacccgcgcuaaauc

SEQ ID NO: 1855725 - RNA, 21 nt, Salmonella typhimurium LT2
cacccgcgugaacacacccuu

SEQ ID NO: 1855726 - RNA, 19 nt, Salmonella typhimurium LT2
caccauuucacaaauuaaa

SEQ ID NO: 1855727 - RNA, 12 nt, Salmonella typhimurium LT2
caccauuuccgc

SEQ ID NO: 1855728 - RNA, 16 nt, Salmonella typhimurium LT2
caccauucccagcgcc

SEQ ID NO: 1855729 - RNA, 21 nt, Salmonella typhimurium LT2
caccauuaugaccaauaauaa

SEQ ID NO: 1855730 - RNA, 14 nt, Salmonella typhimurium LT2
caccauucuucaac

SEQ ID NO: 1855731 - RNA, 14 nt, Salmonella typhimurium LT2
caccauucgcgcau

SEQ ID NO: 1855732 - RNA, 20 nt, Salmonella typhimurium LT2
cacccgauacacgccgacgc

SEQ ID NO: 1855733 - RNA, 18 nt, Salmonella typhimurium LT2
cacccgaaagucaaaaua

SEQ ID NO: 1855734 - RNA, 20 nt, Salmonella typhimurium LT2
caccgcgaugaccaucaaau

SEQ ID NO: 1855735 - RNA, 12 nt, Salmonella typhimurium LT2
caccgccgcgcu

SEQ ID NO: 1855736 - RNA, 23 nt, Salmonella typhimurium LT2
caccgccggacaguucgccaacg

SEQ ID NO: 1855737 - RNA, 18 nt, Salmonella typhimurium LT2
caccgccagucccagcac

SEQ ID NO: 1855738 - RNA, 12 nt, Salmonella typhimurium LT2
caccgcccaggc

SEQ ID NO: 1855739 - RNA, 15 nt, Salmonella typhimurium LT2
caccgcccgccgggc

SEQ ID NO: 1855740 - RNA, 16 nt, Salmonella typhimurium LT2
caccgccagcgccgcg

SEQ ID NO: 1855741 - RNA, 14 nt, Salmonella typhimurium LT2
caccgccagcgccg

SEQ ID NO: 1855742 - RNA, 13 nt, Salmonella typhimurium LT2
caccgccagcagu

SEQ ID NO: 1855743 - RNA, 18 nt, Salmonella typhimurium LT2
caccgccagagcacgaaa

SEQ ID NO: 1855744 - RNA, 18 nt, Salmonella typhimurium LT2
caccgccagacgccccaa

SEQ ID NO: 1855745 - RNA, 22 nt, Salmonella typhimurium LT2
caccgcaaauucgucgccgcca

SEQ ID NO: 1855746 - RNA, 17 nt, Salmonella typhimurium LT2
caccguagcaucaucaa

SEQ ID NO: 1855747 - RNA, 12 nt, Salmonella typhimurium LT2
caccgucuugcu

SEQ ID NO: 1855748 - RNA, 16 nt, Salmonella typhimurium LT2
caccucuuccgccagg

SEQ ID NO: 1855749 - RNA, 15 nt, Salmonella typhimurium LT2
caccucuuccgccag

SEQ ID NO: 1855750 - RNA, 20 nt, Salmonella typhimurium LT2
caccugaauaacccgcagcc

SEQ ID NO: 1855751 - RNA, 22 nt, Salmonella typhimurium LT2
caccugauugauacgcgcccga

SEQ ID NO: 1855752 - RNA, 19 nt, Salmonella typhimurium LT2
caccugauuugucgcgcau

SEQ ID NO: 1855753 - RNA, 14 nt, Salmonella typhimurium LT2
caccugcaugggga

SEQ ID NO: 1855754 - RNA, 21 nt, Salmonella typhimurium LT2
caccugcagcagcuucgccag

SEQ ID NO: 1855755 - RNA, 20 nt, Salmonella typhimurium LT2
caccggccauugccgcgccg

SEQ ID NO: 1855756 - RNA, 23 nt, Salmonella typhimurium LT2
aaaauaagagggcgccaugcuga

SEQ ID NO: 1855757 - RNA, 15 nt, Salmonella typhimurium LT2
caccggaugauucag

SEQ ID NO: 1855758 - RNA, 20 nt, Salmonella typhimurium LT2
caccggaauggucgcgccag

SEQ ID NO: 1855759 - RNA, 14 nt, Salmonella typhimurium LT2
caccggcgcgccag

SEQ ID NO: 1855760 - RNA, 13 nt, Salmonella typhimurium LT2
caccggcgcgcca

SEQ ID NO: 1855761 - RNA, 16 nt, Salmonella typhimurium LT2
caccgggguucagacc

SEQ ID NO: 1855762 - RNA, 20 nt, Salmonella typhimurium LT2
caccggguccagucgcgccg

SEQ ID NO: 1855763 - RNA, 22 nt, Salmonella typhimurium LT2
caccgguuuuuccgcuucaccu

SEQ ID NO: 1855764 - RNA, 18 nt, Salmonella typhimurium LT2
caccgguuuuuuccugca

SEQ ID NO: 1855765 - RNA, 15 nt, Salmonella typhimurium LT2
caccguaaacggcuc

SEQ ID NO: 1855766 - RNA, 17 nt, Salmonella typhimurium LT2
caccguaacuaaaauac

SEQ ID NO: 1855767 - RNA, 19 nt, Salmonella typhimurium LT2
caccguaaaaggaaucaac

SEQ ID NO: 1855768 - RNA, 15 nt, Salmonella typhimurium LT2
caccgguuaacauau

SEQ ID NO: 1855769 - RNA, 19 nt, Salmonella typhimurium LT2
cacgcagauaucuuccagc

SEQ ID NO: 1855770 - RNA, 20 nt, Salmonella typhimurium LT2
cacgcagauaucuuccagcg

SEQ ID NO: 1855771 - RNA, 13 nt, Salmonella typhimurium LT2
cacgcagccaugu

SEQ ID NO: 1855772 - RNA, 14 nt, Salmonella typhimurium LT2
cacgcaggcucucg

SEQ ID NO: 1855773 - RNA, 17 nt, Salmonella typhimurium LT2
cacgccaaaaagugaau

SEQ ID NO: 1855774 - RNA, 15 nt, Salmonella typhimurium LT2
cacgcaguccaacaa

SEQ ID NO: 1855775 - RNA, 22 nt, Salmonella typhimurium LT2
cacgcaaugccugaccaacguc

SEQ ID NO: 1855776 - RNA, 19 nt, Salmonella typhimurium LT2
cacgcacgacggugcuaua

SEQ ID NO: 1855777 - RNA, 18 nt, Salmonella typhimurium LT2
cacgccagauaaaucagc

SEQ ID NO: 1855778 - RNA, 15 nt, Salmonella typhimurium LT2
cacgccagauaaauc

SEQ ID NO: 1855779 - RNA, 15 nt, Salmonella typhimurium LT2
cacgccaccgggcuu

SEQ ID NO: 1855780 - RNA, 19 nt, Salmonella typhimurium LT2
cacgccaccgggcuuuaau

SEQ ID NO: 1855781 - RNA, 22 nt, Salmonella typhimurium LT2
cacgccagcuuggguauagagc

SEQ ID NO: 1855782 - RNA, 11 nt, Salmonella typhimurium LT2
cacgcccagcg

SEQ ID NO: 1855783 - RNA, 12 nt, Salmonella typhimurium LT2
cacgccgcgcug

SEQ ID NO: 1855784 - RNA, 19 nt, Salmonella typhimurium LT2
caccuuugacgccugcauc

SEQ ID NO: 1855785 - RNA, 22 nt, Salmonella typhimurium LT2
caccuucggucccaucgcgcca

SEQ ID NO: 1855786 - RNA, 16 nt, Salmonella typhimurium LT2
caccugcguggucauc

SEQ ID NO: 1855787 - RNA, 16 nt, Salmonella typhimurium LT2
cacgaaggaaacgcca

SEQ ID NO: 1855788 - RNA, 17 nt, Salmonella typhimurium LT2
cacgaaggaaacgccag

SEQ ID NO: 1855789 - RNA, 19 nt, Salmonella typhimurium LT2
cacgaaguaccacuaacag

SEQ ID NO: 1855790 - RNA, 19 nt, Salmonella typhimurium LT2
cacgaacgggaucaugauu

SEQ ID NO: 1855791 - RNA, 17 nt, Salmonella typhimurium LT2
cacgauacgucccugcu

SEQ ID NO: 1855792 - RNA, 13 nt, Salmonella typhimurium LT2
cacggcguccugc

SEQ ID NO: 1855793 - RNA, 15 nt, Salmonella typhimurium LT2
cacggcgucgccugu

SEQ ID NO: 1855794 - RNA, 14 nt, Salmonella typhimurium LT2
cacggccagcagcc

SEQ ID NO: 1855795 - RNA, 15 nt, Salmonella typhimurium LT2
cacggcauaagccuc

SEQ ID NO: 1855796 - RNA, 23 nt, Salmonella typhimurium LT2
cacggcauucacgucgcgcgccg

SEQ ID NO: 1855797 - RNA, 16 nt, Salmonella typhimurium LT2
cacggacaucggcuuc

SEQ ID NO: 1855798 - RNA, 19 nt, Salmonella typhimurium LT2
cacggaacaacggcacaca

SEQ ID NO: 1855799 - RNA, 15 nt, Salmonella typhimurium LT2
cacggacagcgcgca

SEQ ID NO: 1855800 - RNA, 20 nt, Salmonella typhimurium LT2
cacgcuuuuuaccggcgacc

SEQ ID NO: 1855801 - RNA, 20 nt, Salmonella typhimurium LT2
cacgcuugcccggaucgcca

SEQ ID NO: 1855802 - RNA, 17 nt, Salmonella typhimurium LT2
cacgcugaccuuuuuca

SEQ ID NO: 1855803 - RNA, 14 nt, Salmonella typhimurium LT2
cacgcuucccagcg

SEQ ID NO: 1855804 - RNA, 20 nt, Salmonella typhimurium LT2
cacgcugaccacgccgccgc

SEQ ID NO: 1855805 - RNA, 22 nt, Salmonella typhimurium LT2
cacgcugaaaaccgcaucaagc

SEQ ID NO: 1855806 - RNA, 18 nt, Salmonella typhimurium LT2
cacgccggaaagaauaau

SEQ ID NO: 1855807 - RNA, 21 nt, Salmonella typhimurium LT2
cacgccggaaucgcgauccag

SEQ ID NO: 1855808 - RNA, 14 nt, Salmonella typhimurium LT2
cacgcucgcggaag

SEQ ID NO: 1855809 - RNA, 15 nt, Salmonella typhimurium LT2
cacgcucgcuggugc

SEQ ID NO: 1855810 - RNA, 19 nt, Salmonella typhimurium LT2
cacgcucgcggaagcgacc

SEQ ID NO: 1855811 - RNA, 19 nt, Salmonella typhimurium LT2
cacgucacgcaacaggccg

SEQ ID NO: 1855812 - RNA, 18 nt, Salmonella typhimurium LT2
cacguauaaacgccgccg

SEQ ID NO: 1855813 - RNA, 23 nt, Salmonella typhimurium LT2
cacgucauuaaagcgcucaagcg

SEQ ID NO: 1855814 - RNA, 17 nt, Salmonella typhimurium LT2
cacgucauccggcaagc

SEQ ID NO: 1855815 - RNA, 17 nt, Salmonella typhimurium LT2
cacguccucuucuacgc

SEQ ID NO: 1855816 - RNA, 15 nt, Salmonella typhimurium LT2
cacgguucuuccguc

SEQ ID NO: 1855817 - RNA, 15 nt, Salmonella typhimurium LT2
cacgguuggcccagc

SEQ ID NO: 1855818 - RNA, 17 nt, Salmonella typhimurium LT2
cacgguguaccccgccu

SEQ ID NO: 1855819 - RNA, 19 nt, Salmonella typhimurium LT2
cacggguuuuacuggcgcg

SEQ ID NO: 1855820 - RNA, 14 nt, Salmonella typhimurium LT2
cacgguaaaccucu

SEQ ID NO: 1855821 - RNA, 19 nt, Salmonella typhimurium LT2
cacggguuacaacugcgag

SEQ ID NO: 1855822 - RNA, 17 nt, Salmonella typhimurium LT2
cacggucaaucaucaga

SEQ ID NO: 1855823 - RNA, 18 nt, Salmonella typhimurium LT2
cacggucaaucaucagaa

SEQ ID NO: 1855824 - RNA, 23 nt, Salmonella typhimurium LT2
caaacagagcgccggcaaagcca

SEQ ID NO: 1855825 - RNA, 23 nt, Salmonella typhimurium LT2
caaacagcacuacagcccuuuca

SEQ ID NO: 1855826 - RNA, 18 nt, Salmonella typhimurium LT2
caaacagcgacucgcugg

SEQ ID NO: 1855827 - RNA, 21 nt, Salmonella typhimurium LT2
caaacacuaccgggcagcauc

SEQ ID NO: 1855828 - RNA, 13 nt, Salmonella typhimurium LT2
caaacacggcugu

SEQ ID NO: 1855829 - RNA, 17 nt, Salmonella typhimurium LT2
caaacacggcugucggu

SEQ ID NO: 1855830 - RNA, 19 nt, Salmonella typhimurium LT2
caaacacccagccccccua

SEQ ID NO: 1855831 - RNA, 13 nt, Salmonella typhimurium LT2
caaacaccagauc

SEQ ID NO: 1855832 - RNA, 21 nt, Salmonella typhimurium LT2
caaacccgccacaggccaaca

SEQ ID NO: 1855833 - RNA, 22 nt, Salmonella typhimurium LT2
caaacccacccgguaauaccga

SEQ ID NO: 1855834 - RNA, 18 nt, Salmonella typhimurium LT2
caaaccgauaaucaccag

SEQ ID NO: 1855835 - RNA, 16 nt, Salmonella typhimurium LT2
caaaccgacccaaaaa

SEQ ID NO: 1855836 - RNA, 15 nt, Salmonella typhimurium LT2
caaaccgcaaauaau

SEQ ID NO: 1855837 - RNA, 15 nt, Salmonella typhimurium LT2
caaacgacacauaaa

SEQ ID NO: 1855838 - RNA, 14 nt, Salmonella typhimurium LT2
caaacccuuuggca

SEQ ID NO: 1855839 - RNA, 18 nt, Salmonella typhimurium LT2
caaacgccugcaucaaca

SEQ ID NO: 1855840 - RNA, 15 nt, Salmonella typhimurium LT2
caaacgccugcuccg

SEQ ID NO: 1855841 - RNA, 14 nt, Salmonella typhimurium LT2
caaacgcgccgcug

SEQ ID NO: 1855842 - RNA, 23 nt, Salmonella typhimurium LT2
caaacgccggaugacacaucacc

SEQ ID NO: 1855843 - RNA, 16 nt, Salmonella typhimurium LT2
caaacgcccaaaaugc

SEQ ID NO: 1855844 - RNA, 11 nt, Salmonella typhimurium LT2
caaacgccagc

SEQ ID NO: 1855845 - RNA, 20 nt, Salmonella typhimurium LT2
caaacacaaucacacccagc

SEQ ID NO: 1855846 - RNA, 23 nt, Salmonella typhimurium LT2
caaacacaaauuucgagcagaac

SEQ ID NO: 1855847 - RNA, 18 nt, Salmonella typhimurium LT2
caaacaccaacaaagugg

SEQ ID NO: 1855848 - RNA, 15 nt, Salmonella typhimurium LT2
caaaauuuucaauac

SEQ ID NO: 1855849 - RNA, 19 nt, Salmonella typhimurium LT2
caaaauggcaaguaaaaua

SEQ ID NO: 1855850 - RNA, 18 nt, Salmonella typhimurium LT2
caaaaugcccuucuaccg

SEQ ID NO: 1855851 - RNA, 20 nt, Salmonella typhimurium LT2
caaaaugauguccacacuga

SEQ ID NO: 1855852 - RNA, 16 nt, Salmonella typhimurium LT2
caaaaucaaacagaau

SEQ ID NO: 1855853 - RNA, 10 nt, Salmonella typhimurium LT2
caaaaucaaa

SEQ ID NO: 1855854 - RNA, 14 nt, Salmonella typhimurium LT2
caaaaucacgcaca

SEQ ID NO: 1855855 - RNA, 18 nt, Salmonella typhimurium LT2
caaaauaacgcuucaccu

SEQ ID NO: 1855856 - RNA, 15 nt, Salmonella typhimurium LT2
caaaauauauaauuu

SEQ ID NO: 1855857 - RNA, 18 nt, Salmonella typhimurium LT2
caaaacccaccagcaggg

SEQ ID NO: 1855858 - RNA, 20 nt, Salmonella typhimurium LT2
caaagugauuauaaaucaau

SEQ ID NO: 1855859 - RNA, 20 nt, Salmonella typhimurium LT2
caaagugcgcugucagcaca

SEQ ID NO: 1855860 - RNA, 14 nt, Salmonella typhimurium LT2
caaaguuaaucagc

SEQ ID NO: 1855861 - RNA, 18 nt, Salmonella typhimurium LT2
caaaguuaucccugcuga

SEQ ID NO: 1855862 - RNA, 15 nt, Salmonella typhimurium LT2
caaaguugcaucaag

SEQ ID NO: 1855863 - RNA, 16 nt, Salmonella typhimurium LT2
caaaguugcaucaaga

SEQ ID NO: 1855864 - RNA, 18 nt, Salmonella typhimurium LT2
caaauaaaagccgccaug

SEQ ID NO: 1855865 - RNA, 19 nt, Salmonella typhimurium LT2
caaauaaaagccgccaugu

SEQ ID NO: 1855866 - RNA, 22 nt, Salmonella typhimurium LT2
caaauaaagcggucuuucaaca

SEQ ID NO: 1855867 - RNA, 19 nt, Salmonella typhimurium LT2
caaauacagcaauaugacu

SEQ ID NO: 1855868 - RNA, 18 nt, Salmonella typhimurium LT2
caaauaccggacagacuu

SEQ ID NO: 1855869 - RNA, 17 nt, Salmonella typhimurium LT2
caaauacgcgcgccgcc

SEQ ID NO: 1855870 - RNA, 22 nt, Salmonella typhimurium LT2
caaauacguuguacuucauauu

SEQ ID NO: 1855871 - RNA, 19 nt, Salmonella typhimurium LT2
caaacucaggagcuaaaua

SEQ ID NO: 1855872 - RNA, 16 nt, Salmonella typhimurium LT2
caaacuauuuuuagcc

SEQ ID NO: 1855873 - RNA, 13 nt, Salmonella typhimurium LT2
caaacucaccuga

SEQ ID NO: 1855874 - RNA, 15 nt, Salmonella typhimurium LT2
caaacuggccacagc

SEQ ID NO: 1855875 - RNA, 22 nt, Salmonella typhimurium LT2
caaacugcgcuagccgccgugu

SEQ ID NO: 1855876 - RNA, 17 nt, Salmonella typhimurium LT2
caaagauaaucugaaua

SEQ ID NO: 1855877 - RNA, 14 nt, Salmonella typhimurium LT2
caaagauaaacgac

SEQ ID NO: 1855878 - RNA, 20 nt, Salmonella typhimurium LT2
caaaggggccacaggcggca

SEQ ID NO: 1855879 - RNA, 23 nt, Salmonella typhimurium LT2
caaagggugggggaguguuggau

SEQ ID NO: 1855880 - RNA, 22 nt, Salmonella typhimurium LT2
caaagcguucugaacuguaacc

SEQ ID NO: 1855881 - RNA, 19 nt, Salmonella typhimurium LT2
caaagcaccauucuucaac

SEQ ID NO: 1855882 - RNA, 15 nt, Salmonella typhimurium LT2
caaagcccacgcccu

SEQ ID NO: 1855883 - RNA, 16 nt, Salmonella typhimurium LT2
caaagcguaccgucug

SEQ ID NO: 1855884 - RNA, 19 nt, Salmonella typhimurium LT2
caaagcauugugcagccau

SEQ ID NO: 1855885 - RNA, 21 nt, Salmonella typhimurium LT2
caaaugcagcggaauucccac

SEQ ID NO: 1855886 - RNA, 14 nt, Salmonella typhimurium LT2
caaaugccauccca

SEQ ID NO: 1855887 - RNA, 18 nt, Salmonella typhimurium LT2
caaauuaugauucaaucg

SEQ ID NO: 1855888 - RNA, 21 nt, Salmonella typhimurium LT2
caaauuauaaacuacuggcug

SEQ ID NO: 1855889 - RNA, 19 nt, Salmonella typhimurium LT2
caaauuacgcacacuugcu

SEQ ID NO: 1855890 - RNA, 22 nt, Salmonella typhimurium LT2
caaaugggccggauagcgcugu

SEQ ID NO: 1855891 - RNA, 22 nt, Salmonella typhimurium LT2
caaauggcguacuaaauaggcg

SEQ ID NO: 1855892 - RNA, 22 nt, Salmonella typhimurium LT2
caacaacaggccagaauaacgu

SEQ ID NO: 1855893 - RNA, 14 nt, Salmonella typhimurium LT2
caacaacaguugca

SEQ ID NO: 1855894 - RNA, 16 nt, Salmonella typhimurium LT2
caacaagaauauauuc

SEQ ID NO: 1855895 - RNA, 15 nt, Salmonella typhimurium LT2
caacaaugcuuucac

SEQ ID NO: 1855896 - RNA, 15 nt, Salmonella typhimurium LT2
caacaaugccacgcc

SEQ ID NO: 1855897 - RNA, 21 nt, Salmonella typhimurium LT2
caacaaugccacgccccuaag

SEQ ID NO: 1855898 - RNA, 18 nt, Salmonella typhimurium LT2
caacaaugccacgccccu

SEQ ID NO: 1855899 - RNA, 11 nt, Salmonella typhimurium LT2
caacaauuucu

SEQ ID NO: 1855900 - RNA, 20 nt, Salmonella typhimurium LT2
caacacuuagaacgcggaag

SEQ ID NO: 1855901 - RNA, 21 nt, Salmonella typhimurium LT2
caacacuuugcgcugcgcauu

SEQ ID NO: 1855902 - RNA, 16 nt, Salmonella typhimurium LT2
caacagcuugcgccca

SEQ ID NO: 1855903 - RNA, 14 nt, Salmonella typhimurium LT2
caacagcucgccau

SEQ ID NO: 1855904 - RNA, 17 nt, Salmonella typhimurium LT2
caacagacuauccaggg

SEQ ID NO: 1855905 - RNA, 14 nt, Salmonella typhimurium LT2
caacacgcagaccc

SEQ ID NO: 1855906 - RNA, 17 nt, Salmonella typhimurium LT2
caacacggcgcucagga

SEQ ID NO: 1855907 - RNA, 23 nt, Salmonella typhimurium LT2
caacacaucagcaacuugaagua

SEQ ID NO: 1855908 - RNA, 14 nt, Salmonella typhimurium LT2
caacacauccagcg

SEQ ID NO: 1855909 - RNA, 15 nt, Salmonella typhimurium LT2
caacgacccccacca

SEQ ID NO: 1855910 - RNA, 16 nt, Salmonella typhimurium LT2
caacgacccccaccau

SEQ ID NO: 1855911 - RNA, 21 nt, Salmonella typhimurium LT2
caacgaggugaauaaauccuu

SEQ ID NO: 1855912 - RNA, 19 nt, Salmonella typhimurium LT2
caacgagugcucaccgaca

SEQ ID NO: 1855913 - RNA, 22 nt, Salmonella typhimurium LT2
caacgcaaugcgauaagcgucu

SEQ ID NO: 1855914 - RNA, 23 nt, Salmonella typhimurium LT2
caacgcaggcgaaaucaaaaggc

SEQ ID NO: 1855915 - RNA, 12 nt, Salmonella typhimurium LT2
caacgccaagcg

SEQ ID NO: 1855916 - RNA, 14 nt, Salmonella typhimurium LT2
caacgccagaugcg

SEQ ID NO: 1855917 - RNA, 16 nt, Salmonella typhimurium LT2
caacgcaggcuggaga

SEQ ID NO: 1855918 - RNA, 17 nt, Salmonella typhimurium LT2
caacgcaggcuggagag

SEQ ID NO: 1855919 - RNA, 14 nt, Salmonella typhimurium LT2
caacgcaucaaaua

SEQ ID NO: 1855920 - RNA, 19 nt, Salmonella typhimurium LT2
caacgcaggcuggagagcg

SEQ ID NO: 1855921 - RNA, 14 nt, Salmonella typhimurium LT2
caacgccaacauag

SEQ ID NO: 1855922 - RNA, 23 nt, Salmonella typhimurium LT2
caaccuguaggccggauaagcau

SEQ ID NO: 1855923 - RNA, 17 nt, Salmonella typhimurium LT2
caaccugcgcugacggc

SEQ ID NO: 1855924 - RNA, 19 nt, Salmonella typhimurium LT2
caaccgcaggcucuuuuuc

SEQ ID NO: 1855925 - RNA, 18 nt, Salmonella typhimurium LT2
caaccgcgccaaagauaa

SEQ ID NO: 1855926 - RNA, 12 nt, Salmonella typhimurium LT2
caaccugcgcug

SEQ ID NO: 1855927 - RNA, 11 nt, Salmonella typhimurium LT2
caaccugauau

SEQ ID NO: 1855928 - RNA, 21 nt, Salmonella typhimurium LT2
caaccgcugaccaucaacaau

SEQ ID NO: 1855929 - RNA, 18 nt, Salmonella typhimurium LT2
caaccaaagccggcgcca

SEQ ID NO: 1855930 - RNA, 14 nt, Salmonella typhimurium LT2
caacauauccaggc

SEQ ID NO: 1855931 - RNA, 16 nt, Salmonella typhimurium LT2
caacauaauaaagccg

SEQ ID NO: 1855932 - RNA, 23 nt, Salmonella typhimurium LT2
caacauagcggcaaggaaaacca

SEQ ID NO: 1855933 - RNA, 13 nt, Salmonella typhimurium LT2
caacauacaugcc

SEQ ID NO: 1855934 - RNA, 21 nt, Salmonella typhimurium LT2
caacaggggccuuuuuuucuc

SEQ ID NO: 1855935 - RNA, 14 nt, Salmonella typhimurium LT2
caacaggccgcgaa

SEQ ID NO: 1855936 - RNA, 20 nt, Salmonella typhimurium LT2
caacaggccgcgaaagcggc

SEQ ID NO: 1855937 - RNA, 12 nt, Salmonella typhimurium LT2
caaccagcaaug

SEQ ID NO: 1855938 - RNA, 14 nt, Salmonella typhimurium LT2
caacccgacugcca

SEQ ID NO: 1855939 - RNA, 22 nt, Salmonella typhimurium LT2
caacccauauucgucuucaucu

SEQ ID NO: 1855940 - RNA, 13 nt, Salmonella typhimurium LT2
caaccgacgcauu

SEQ ID NO: 1855941 - RNA, 21 nt, Salmonella typhimurium LT2
caacccgcuccagaagcacuu

SEQ ID NO: 1855942 - RNA, 19 nt, Salmonella typhimurium LT2
caaucaucgacaguaccag

SEQ ID NO: 1855943 - RNA, 18 nt, Salmonella typhimurium LT2
caaucaugcgcaguugca

SEQ ID NO: 1855944 - RNA, 20 nt, Salmonella typhimurium LT2
caauauucacacgaauuccu

SEQ ID NO: 1855945 - RNA, 19 nt, Salmonella typhimurium LT2
caauauucaugcuuucaau

SEQ ID NO: 1855946 - RNA, 19 nt, Salmonella typhimurium LT2
caauauuccauauaacaga

SEQ ID NO: 1855947 - RNA, 16 nt, Salmonella typhimurium LT2
caauauucugugcuca

SEQ ID NO: 1855948 - RNA, 13 nt, Salmonella typhimurium LT2
caaucaucaccac

SEQ ID NO: 1855949 - RNA, 17 nt, Salmonella typhimurium LT2
caaucgggaacagccac

SEQ ID NO: 1855950 - RNA, 17 nt, Salmonella typhimurium LT2
caaucgggccugcuccg

SEQ ID NO: 1855951 - RNA, 15 nt, Salmonella typhimurium LT2
caaucucuuccgccc

SEQ ID NO: 1855952 - RNA, 13 nt, Salmonella typhimurium LT2
caaucucuauacc

SEQ ID NO: 1855953 - RNA, 20 nt, Salmonella typhimurium LT2
caaucgcuuccagcgccggu

SEQ ID NO: 1855954 - RNA, 17 nt, Salmonella typhimurium LT2
caaucgcuuuuaucugg

SEQ ID NO: 1855955 - RNA, 21 nt, Salmonella typhimurium LT2
caaucggcgucuggagcgugc

SEQ ID NO: 1855956 - RNA, 19 nt, Salmonella typhimurium LT2
caaucgcgugcaacaguug

SEQ ID NO: 1855957 - RNA, 15 nt, Salmonella typhimurium LT2
caauccguuccaauc

SEQ ID NO: 1855958 - RNA, 15 nt, Salmonella typhimurium LT2
caaugauuuuuagcc

SEQ ID NO: 1855959 - RNA, 14 nt, Salmonella typhimurium LT2
caaugcaaagaaaa

SEQ ID NO: 1855960 - RNA, 15 nt, Salmonella typhimurium LT2
caaugcaaagaaaaa

SEQ ID NO: 1855961 - RNA, 17 nt, Salmonella typhimurium LT2
caaugaugccuugcgaa

SEQ ID NO: 1855962 - RNA, 18 nt, Salmonella typhimurium LT2
caaugauauagccuucaa

SEQ ID NO: 1855963 - RNA, 20 nt, Salmonella typhimurium LT2
caaugaagcauaaaaagacu

SEQ ID NO: 1855964 - RNA, 20 nt, Salmonella typhimurium LT2
caaucucuuucggcgcgccc

SEQ ID NO: 1855965 - RNA, 16 nt, Salmonella typhimurium LT2
caaucuugauuacagu

SEQ ID NO: 1855966 - RNA, 18 nt, Salmonella typhimurium LT2
caaucuugauuacagucu

SEQ ID NO: 1855967 - RNA, 15 nt, Salmonella typhimurium LT2
caaugccauuuuugc

SEQ ID NO: 1855968 - RNA, 14 nt, Salmonella typhimurium LT2
caaugcggaaacca

SEQ ID NO: 1855969 - RNA, 18 nt, Salmonella typhimurium LT2
caaugcgcguaauuugcg

SEQ ID NO: 1855970 - RNA, 15 nt, Salmonella typhimurium LT2
caaugcgaauaacau

SEQ ID NO: 1855971 - RNA, 18 nt, Salmonella typhimurium LT2
caaugcgacgcccaacca

SEQ ID NO: 1855972 - RNA, 16 nt, Salmonella typhimurium LT2
caaugccuaacccuuu

SEQ ID NO: 1855973 - RNA, 19 nt, Salmonella typhimurium LT2
caaugccuaacccuuuucc

SEQ ID NO: 1855974 - RNA, 17 nt, Salmonella typhimurium LT2
caaugccugacgccacc

SEQ ID NO: 1855975 - RNA, 22 nt, Salmonella typhimurium LT2
caaugcccgguuuuuuaaugag

SEQ ID NO: 1855976 - RNA, 19 nt, Salmonella typhimurium LT2
caaugccgccgagaacauu

SEQ ID NO: 1855977 - RNA, 14 nt, Salmonella typhimurium LT2
caaugcccuuaaau

SEQ ID NO: 1855978 - RNA, 20 nt, Salmonella typhimurium LT2
caaugccgcgagaaauacca

SEQ ID NO: 1855979 - RNA, 14 nt, Salmonella typhimurium LT2
caaguaaaauaacc

SEQ ID NO: 1855980 - RNA, 16 nt, Salmonella typhimurium LT2
caaguugcgccacugc

SEQ ID NO: 1855981 - RNA, 20 nt, Salmonella typhimurium LT2
caauaacgaccccaauagcg

SEQ ID NO: 1855982 - RNA, 14 nt, Salmonella typhimurium LT2
caauaaccgccagc

SEQ ID NO: 1855983 - RNA, 18 nt, Salmonella typhimurium LT2
caauaaccgccagcagca

SEQ ID NO: 1855984 - RNA, 15 nt, Salmonella typhimurium LT2
caauaacagccagcg

SEQ ID NO: 1855985 - RNA, 21 nt, Salmonella typhimurium LT2
caauaauauguuccacaauca

SEQ ID NO: 1855986 - RNA, 18 nt, Salmonella typhimurium LT2
caauaaucccaaaauuua

SEQ ID NO: 1855987 - RNA, 19 nt, Salmonella typhimurium LT2
caauaaucccuucuuuuac

SEQ ID NO: 1855988 - RNA, 21 nt, Salmonella typhimurium LT2
caauaaugcaaauuauuuuau

SEQ ID NO: 1855989 - RNA, 19 nt, Salmonella typhimurium LT2
caauaugcagaucgacggu

SEQ ID NO: 1855990 - RNA, 19 nt, Salmonella typhimurium LT2
caauaugaugcuugcucgu

SEQ ID NO: 1855991 - RNA, 17 nt, Salmonella typhimurium LT2
caauaugucuuaaacag

SEQ ID NO: 1855992 - RNA, 20 nt, Salmonella typhimurium LT2
caauaugaaaccgcccugca

SEQ ID NO: 1855993 - RNA, 20 nt, Salmonella typhimurium LT2
caauauuaaugcugcguuua

SEQ ID NO: 1855994 - RNA, 14 nt, Salmonella typhimurium LT2
caauauuaaaugac

SEQ ID NO: 1855995 - RNA, 17 nt, Salmonella typhimurium LT2
caauaugugcaucggca

SEQ ID NO: 1855996 - RNA, 16 nt, Salmonella typhimurium LT2
caauaguuaacgccgu

SEQ ID NO: 1855997 - RNA, 19 nt, Salmonella typhimurium LT2
caauagccaauaacgucug

SEQ ID NO: 1855998 - RNA, 16 nt, Salmonella typhimurium LT2
caauagcgagaggcaa

SEQ ID NO: 1855999 - RNA, 14 nt, Salmonella typhimurium LT2
caauagcaauaaau

SEQ ID NO: 1856000 - RNA, 16 nt, Salmonella typhimurium LT2
caauagcaaucuguaa

SEQ ID NO: 1856001 - RNA, 14 nt, Salmonella typhimurium LT2
caauagcaaugaag

SEQ ID NO: 1856002 - RNA, 19 nt, Salmonella typhimurium LT2
caauagcaaugaagcaagu

SEQ ID NO: 1856003 - RNA, 21 nt, Salmonella typhimurium LT2
caauagagugcgauuugacau

SEQ ID NO: 1856004 - RNA, 22 nt, Salmonella typhimurium LT2
caauacuuuuugacuccugaca

SEQ ID NO: 1856005 - RNA, 19 nt, Salmonella typhimurium LT2
caaggucaaugugcucaac

SEQ ID NO: 1856006 - RNA, 22 nt, Salmonella typhimurium LT2
caagguggugcucuaaccaacu

SEQ ID NO: 1856007 - RNA, 22 nt, Salmonella typhimurium LT2
caagguuauuaaaaagccagcg

SEQ ID NO: 1856008 - RNA, 17 nt, Salmonella typhimurium LT2
caagggagugagucccc

SEQ ID NO: 1856009 - RNA, 21 nt, Salmonella typhimurium LT2
caagggaaggcgcccgggaga

SEQ ID NO: 1856010 - RNA, 14 nt, Salmonella typhimurium LT2
caagggugggcgca

SEQ ID NO: 1856011 - RNA, 20 nt, Salmonella typhimurium LT2
caagggucuuaacccauggc

SEQ ID NO: 1856012 - RNA, 21 nt, Salmonella typhimurium LT2
caagggucuuaacccauggcu

SEQ ID NO: 1856013 - RNA, 20 nt, Salmonella typhimurium LT2
caaggggggccugauggcgc

SEQ ID NO: 1856014 - RNA, 15 nt, Salmonella typhimurium LT2
caaggagacgcccgu

SEQ ID NO: 1856015 - RNA, 16 nt, Salmonella typhimurium LT2
caaggaaaaccaguaa

SEQ ID NO: 1856016 - RNA, 13 nt, Salmonella typhimurium LT2
caagcggcggcca

SEQ ID NO: 1856017 - RNA, 13 nt, Salmonella typhimurium LT2
caagcgucagcau

SEQ ID NO: 1856018 - RNA, 17 nt, Salmonella typhimurium LT2
caagcgcggacagcaga

SEQ ID NO: 1856019 - RNA, 17 nt, Salmonella typhimurium LT2
caagcgcggcagcagcu

SEQ ID NO: 1856020 - RNA, 18 nt, Salmonella typhimurium LT2
caagccagguugcgcccg

SEQ ID NO: 1856021 - RNA, 14 nt, Salmonella typhimurium LT2
caagcccagcucag

SEQ ID NO: 1856022 - RNA, 11 nt, Salmonella typhimurium LT2
caagcccagcu

SEQ ID NO: 1856023 - RNA, 15 nt, Salmonella typhimurium LT2
caagauuugcaauau

SEQ ID NO: 1856024 - RNA, 13 nt, Salmonella typhimurium LT2
caagcacaaaaag

SEQ ID NO: 1856025 - RNA, 24 nt, Salmonella typhimurium LT2
caagagguaaugcccgauggcgcu

SEQ ID NO: 1856026 - RNA, 17 nt, Salmonella typhimurium LT2
caagagcguccaguccu

SEQ ID NO: 1856027 - RNA, 11 nt, Salmonella typhimurium LT2
caacuucuuca

SEQ ID NO: 1856028 - RNA, 16 nt, Salmonella typhimurium LT2
caacuuuuucuuaagc

SEQ ID NO: 1856029 - RNA, 20 nt, Salmonella typhimurium LT2
caacuuuuucuuaagcugag

SEQ ID NO: 1856030 - RNA, 23 nt, Salmonella typhimurium LT2
caagaaccgcuuuuccugcugcc

SEQ ID NO: 1856031 - RNA, 17 nt, Salmonella typhimurium LT2
caagaacgguuuauccc

SEQ ID NO: 1856032 - RNA, 21 nt, Salmonella typhimurium LT2
caagaacgguuuauccccgcu

SEQ ID NO: 1856033 - RNA, 19 nt, Salmonella typhimurium LT2
caagaagauuucuuaauuc

SEQ ID NO: 1856034 - RNA, 22 nt, Salmonella typhimurium LT2
caagaccgauagagacugccgc

SEQ ID NO: 1856035 - RNA, 17 nt, Salmonella typhimurium LT2
caagaccgccuaacagc

SEQ ID NO: 1856036 - RNA, 18 nt, Salmonella typhimurium LT2
caagaccgccuaacagcg

SEQ ID NO: 1856037 - RNA, 13 nt, Salmonella typhimurium LT2
caacgccggcaac

SEQ ID NO: 1856038 - RNA, 19 nt, Salmonella typhimurium LT2
caacgccggcaacacccgc

SEQ ID NO: 1856039 - RNA, 19 nt, Salmonella typhimurium LT2
caacgccggaugacgccgu

SEQ ID NO: 1856040 - RNA, 17 nt, Salmonella typhimurium LT2
caacguuuguaacagca

SEQ ID NO: 1856041 - RNA, 21 nt, Salmonella typhimurium LT2
caacguuuguaacagcaggac

SEQ ID NO: 1856042 - RNA, 11 nt, Salmonella typhimurium LT2
caacuccagca

SEQ ID NO: 1856043 - RNA, 23 nt, Salmonella typhimurium LT2
caacuccgccggcgcggaaggga

SEQ ID NO: 1856044 - RNA, 21 nt, Salmonella typhimurium LT2
caacuccccgccccagcagca

SEQ ID NO: 1856045 - RNA, 18 nt, Salmonella typhimurium LT2
caacugauuaaucugccg

SEQ ID NO: 1856046 - RNA, 19 nt, Salmonella typhimurium LT2
caacugauuaaucugccga

SEQ ID NO: 1856047 - RNA, 16 nt, Salmonella typhimurium LT2
caacuucguucaguuc

SEQ ID NO: 1856048 - RNA, 21 nt, Salmonella typhimurium LT2
caacuucuaauuuuuccagca

SEQ ID NO: 1856049 - RNA, 17 nt, Salmonella typhimurium LT2
caacuguucuucgcuuu

SEQ ID NO: 1856050 - RNA, 14 nt, Salmonella typhimurium LT2
cagcgcgacauaga

SEQ ID NO: 1856051 - RNA, 19 nt, Salmonella typhimurium LT2
cagcgccuuuucaaaagag

SEQ ID NO: 1856052 - RNA, 22 nt, Salmonella typhimurium LT2
cagcgcgaccugcaucccuuuc

SEQ ID NO: 1856053 - RNA, 14 nt, Salmonella typhimurium LT2
cagcgcgaccugca

SEQ ID NO: 1856054 - RNA, 20 nt, Salmonella typhimurium LT2
cagcgcgaguauucgcgccc

SEQ ID NO: 1856055 - RNA, 21 nt, Salmonella typhimurium LT2
cagcgcgccaauggccgcccc

SEQ ID NO: 1856056 - RNA, 16 nt, Salmonella typhimurium LT2
cagcgcgccagcgcca

SEQ ID NO: 1856057 - RNA, 12 nt, Salmonella typhimurium LT2
cagcgcgccgcg

SEQ ID NO: 1856058 - RNA, 12 nt, Salmonella typhimurium LT2
cagcgcgccgca

SEQ ID NO: 1856059 - RNA, 14 nt, Salmonella typhimurium LT2
cagcgcgcgcaggg

SEQ ID NO: 1856060 - RNA, 22 nt, Salmonella typhimurium LT2
cagcgccuccgcguagcccagc

SEQ ID NO: 1856061 - RNA, 21 nt, Salmonella typhimurium LT2
cagcgccggaucgggcuucca

SEQ ID NO: 1856062 - RNA, 11 nt, Salmonella typhimurium LT2
cagcgccgccu

SEQ ID NO: 1856063 - RNA, 14 nt, Salmonella typhimurium LT2
cagcgccgcgcagg

SEQ ID NO: 1856064 - RNA, 13 nt, Salmonella typhimurium LT2
cagcgccaccaca

SEQ ID NO: 1856065 - RNA, 17 nt, Salmonella typhimurium LT2
cagcgcaccuucaacag

SEQ ID NO: 1856066 - RNA, 15 nt, Salmonella typhimurium LT2
cagcgacuucaggcg

SEQ ID NO: 1856067 - RNA, 16 nt, Salmonella typhimurium LT2
cagcgcaaucugcucg

SEQ ID NO: 1856068 - RNA, 20 nt, Salmonella typhimurium LT2
cagcgacucauucagcaacu

SEQ ID NO: 1856069 - RNA, 14 nt, Salmonella typhimurium LT2
cagcgacucgcugg

SEQ ID NO: 1856070 - RNA, 22 nt, Salmonella typhimurium LT2
cagcgacguaaugaucagcgcu

SEQ ID NO: 1856071 - RNA, 23 nt, Salmonella typhimurium LT2
cagcgacguaaugaucagcgcuc

SEQ ID NO: 1856072 - RNA, 17 nt, Salmonella typhimurium LT2
cagcgcccccaguuccu

SEQ ID NO: 1856073 - RNA, 22 nt, Salmonella typhimurium LT2
cagcgccauaaucgcguuuucc

SEQ ID NO: 1856074 - RNA, 23 nt, Salmonella typhimurium LT2
cagcgccauccacggccccgggc

SEQ ID NO: 1856075 - RNA, 17 nt, Salmonella typhimurium LT2
cagcgccaucaggccua

SEQ ID NO: 1856076 - RNA, 22 nt, Salmonella typhimurium LT2
cagcgccauccacggccccggg

SEQ ID NO: 1856077 - RNA, 17 nt, Salmonella typhimurium LT2
cagcgccagauagucac

SEQ ID NO: 1856078 - RNA, 14 nt, Salmonella typhimurium LT2
cagcgccagcagca

SEQ ID NO: 1856079 - RNA, 18 nt, Salmonella typhimurium LT2
cagcgccagcagcagugc

SEQ ID NO: 1856080 - RNA, 15 nt, Salmonella typhimurium LT2
cagcgccagcccugc

SEQ ID NO: 1856081 - RNA, 13 nt, Salmonella typhimurium LT2
cagcgccagccgc

SEQ ID NO: 1856082 - RNA, 15 nt, Salmonella typhimurium LT2
cagcgccagcgacug

SEQ ID NO: 1856083 - RNA, 16 nt, Salmonella typhimurium LT2
cagcgccagcccugcg

SEQ ID NO: 1856084 - RNA, 21 nt, Salmonella typhimurium LT2
cagcgccacggagcauaauuu

SEQ ID NO: 1856085 - RNA, 12 nt, Salmonella typhimurium LT2
cagcgccaccgg

SEQ ID NO: 1856086 - RNA, 11 nt, Salmonella typhimurium LT2
cagcgccaccg

SEQ ID NO: 1856087 - RNA, 22 nt, Salmonella typhimurium LT2
cagcccuauaacagcgccagua

SEQ ID NO: 1856088 - RNA, 12 nt, Salmonella typhimurium LT2
cagcccucauua

SEQ ID NO: 1856089 - RNA, 12 nt, Salmonella typhimurium LT2
cagcccuggcug

SEQ ID NO: 1856090 - RNA, 13 nt, Salmonella typhimurium LT2
cagcccugugccg

SEQ ID NO: 1856091 - RNA, 14 nt, Salmonella typhimurium LT2
cagcccuuccagcg

SEQ ID NO: 1856092 - RNA, 18 nt, Salmonella typhimurium LT2
cagccgaauggcugccuu

SEQ ID NO: 1856093 - RNA, 22 nt, Salmonella typhimurium LT2
cagccauggcccaaaagguagc

SEQ ID NO: 1856094 - RNA, 13 nt, Salmonella typhimurium LT2
cagccauccugca

SEQ ID NO: 1856095 - RNA, 20 nt, Salmonella typhimurium LT2
cagccauuaauuucuuacca

SEQ ID NO: 1856096 - RNA, 22 nt, Salmonella typhimurium LT2
cagcccgugaucggagaaauag

SEQ ID NO: 1856097 - RNA, 21 nt, Salmonella typhimurium LT2
cagcccguucugugcgccgcu

SEQ ID NO: 1856098 - RNA, 21 nt, Salmonella typhimurium LT2
cagccgauuuuucggcgcgcu

SEQ ID NO: 1856099 - RNA, 11 nt, Salmonella typhimurium LT2
cagccgaggug

SEQ ID NO: 1856100 - RNA, 17 nt, Salmonella typhimurium LT2
cagccgaucuauuucau

SEQ ID NO: 1856101 - RNA, 16 nt, Salmonella typhimurium LT2
cagccgauaacucuuc

SEQ ID NO: 1856102 - RNA, 21 nt, Salmonella typhimurium LT2
cagccgacgcauuucuccuga

SEQ ID NO: 1856103 - RNA, 14 nt, Salmonella typhimurium LT2
cagccgaucaggcc

SEQ ID NO: 1856104 - RNA, 17 nt, Salmonella typhimurium LT2
cagccgccaccacaaag

SEQ ID NO: 1856105 - RNA, 23 nt, Salmonella typhimurium LT2
cagccgcauuuuucauggugaac

SEQ ID NO: 1856106 - RNA, 12 nt, Salmonella typhimurium LT2
cagccgccaggc

SEQ ID NO: 1856107 - RNA, 22 nt, Salmonella typhimurium LT2
cagccgccaguuugguuaauuc

SEQ ID NO: 1856108 - RNA, 13 nt, Salmonella typhimurium LT2
cagccgccauccg

SEQ ID NO: 1856109 - RNA, 18 nt, Salmonella typhimurium LT2
cagccugaaucagcaucu

SEQ ID NO: 1856110 - RNA, 15 nt, Salmonella typhimurium LT2
cagccugccgucuuu

SEQ ID NO: 1856111 - RNA, 16 nt, Salmonella typhimurium LT2
cagccugcccgccuga

SEQ ID NO: 1856112 - RNA, 16 nt, Salmonella typhimurium LT2
cagccggauuuuaaau

SEQ ID NO: 1856113 - RNA, 14 nt, Salmonella typhimurium LT2
cagcgaauaaugaa

SEQ ID NO: 1856114 - RNA, 21 nt, Salmonella typhimurium LT2
cagcgaauuccggccaucaga

SEQ ID NO: 1856115 - RNA, 16 nt, Salmonella typhimurium LT2
cagccuggcggcuucc

SEQ ID NO: 1856116 - RNA, 19 nt, Salmonella typhimurium LT2
cagcgaaacugcgcgccgg

SEQ ID NO: 1856117 - RNA, 21 nt, Salmonella typhimurium LT2
cagcgaaaugacagccaccag

SEQ ID NO: 1856118 - RNA, 23 nt, Salmonella typhimurium LT2
cagcgaaaugacagccaccagcg

SEQ ID NO: 1856119 - RNA, 14 nt, Salmonella typhimurium LT2
cagcagauaauuuu

SEQ ID NO: 1856120 - RNA, 14 nt, Salmonella typhimurium LT2
cagcagacagguga

SEQ ID NO: 1856121 - RNA, 20 nt, Salmonella typhimurium LT2
cagcagacugccuacgcggc

SEQ ID NO: 1856122 - RNA, 20 nt, Salmonella typhimurium LT2
cagcagacuauccgcgcgcc

SEQ ID NO: 1856123 - RNA, 22 nt, Salmonella typhimurium LT2
cagcagcgcgaucgccccgacc

SEQ ID NO: 1856124 - RNA, 17 nt, Salmonella typhimurium LT2
cagcagcgcgccgacaa

SEQ ID NO: 1856125 - RNA, 13 nt, Salmonella typhimurium LT2
cagcagcgcggca

SEQ ID NO: 1856126 - RNA, 20 nt, Salmonella typhimurium LT2
cagcagcgcuuucuucuuca

SEQ ID NO: 1856127 - RNA, 22 nt, Salmonella typhimurium LT2
cagcagcgcuuucuucuucacg

SEQ ID NO: 1856128 - RNA, 17 nt, Salmonella typhimurium LT2
cagcagcguaauggcca

SEQ ID NO: 1856129 - RNA, 23 nt, Salmonella typhimurium LT2
cagcagcguaauggccaccagca

SEQ ID NO: 1856130 - RNA, 14 nt, Salmonella typhimurium LT2
cagcagcgcggcgu

SEQ ID NO: 1856131 - RNA, 22 nt, Salmonella typhimurium LT2
cagcagcuugcgauccauauag

SEQ ID NO: 1856132 - RNA, 13 nt, Salmonella typhimurium LT2
cagcagcugcugu

SEQ ID NO: 1856133 - RNA, 14 nt, Salmonella typhimurium LT2
cagcagcuccagag

SEQ ID NO: 1856134 - RNA, 19 nt, Salmonella typhimurium LT2
cagcagcuucgccagaugc

SEQ ID NO: 1856135 - RNA, 14 nt, Salmonella typhimurium LT2
cagcaggccuccga

SEQ ID NO: 1856136 - RNA, 20 nt, Salmonella typhimurium LT2
cagcaggucgaccaccugcu

SEQ ID NO: 1856137 - RNA, 20 nt, Salmonella typhimurium LT2
cagcaggucgcacuccucug

SEQ ID NO: 1856138 - RNA, 15 nt, Salmonella typhimurium LT2
cagcagguagcguuu

SEQ ID NO: 1856139 - RNA, 15 nt, Salmonella typhimurium LT2
cagcauacaaagcag

SEQ ID NO: 1856140 - RNA, 16 nt, Salmonella typhimurium LT2
cagcauacaaagcaga

SEQ ID NO: 1856141 - RNA, 21 nt, Salmonella typhimurium LT2
cagcauacaaagcagauagag

SEQ ID NO: 1856142 - RNA, 16 nt, Salmonella typhimurium LT2
cagcauauccagcgcc

SEQ ID NO: 1856143 - RNA, 14 nt, Salmonella typhimurium LT2
cagcauauccagcg

SEQ ID NO: 1856144 - RNA, 21 nt, Salmonella typhimurium LT2
cagcauacugaugucguugua

SEQ ID NO: 1856145 - RNA, 20 nt, Salmonella typhimurium LT2
cagcauagcgccuucaggca

SEQ ID NO: 1856146 - RNA, 14 nt, Salmonella typhimurium LT2
cagcauagucgcuc

SEQ ID NO: 1856147 - RNA, 18 nt, Salmonella typhimurium LT2
cagcauacgacaucgcca

SEQ ID NO: 1856148 - RNA, 16 nt, Salmonella typhimurium LT2
cagcagugggaaaauu

SEQ ID NO: 1856149 - RNA, 12 nt, Salmonella typhimurium LT2
cagcaguucgua

SEQ ID NO: 1856150 - RNA, 15 nt, Salmonella typhimurium LT2
cagccaccaugcaaa

SEQ ID NO: 1856151 - RNA, 17 nt, Salmonella typhimurium LT2
cagcauugaccaccaua

SEQ ID NO: 1856152 - RNA, 21 nt, Salmonella typhimurium LT2
cagcauugaggcuacccagac

SEQ ID NO: 1856153 - RNA, 22 nt, Salmonella typhimurium LT2
cagcauugaggcuacccagaca

SEQ ID NO: 1856154 - RNA, 19 nt, Salmonella typhimurium LT2
cagcauugggucaugcgga

SEQ ID NO: 1856155 - RNA, 16 nt, Salmonella typhimurium LT2
cagcauuggucaucgc

SEQ ID NO: 1856156 - RNA, 15 nt, Salmonella typhimurium LT2
cagccaaaacgucgu

SEQ ID NO: 1856157 - RNA, 15 nt, Salmonella typhimurium LT2
cagccacacugcugu

SEQ ID NO: 1856158 - RNA, 12 nt, Salmonella typhimurium LT2
cagcauuucuuc

SEQ ID NO: 1856159 - RNA, 23 nt, Salmonella typhimurium LT2
cagcauuucggcguguaacugca

SEQ ID NO: 1856160 - RNA, 19 nt, Salmonella typhimurium LT2
cagccagggaacuccagca

SEQ ID NO: 1856161 - RNA, 20 nt, Salmonella typhimurium LT2
cagccagcguuucuggaagu

SEQ ID NO: 1856162 - RNA, 11 nt, Salmonella typhimurium LT2
cagccaggcca

SEQ ID NO: 1856163 - RNA, 19 nt, Salmonella typhimurium LT2
cagccagcgccccugcggg

SEQ ID NO: 1856164 - RNA, 13 nt, Salmonella typhimurium LT2
cagccagccggag

SEQ ID NO: 1856165 - RNA, 20 nt, Salmonella typhimurium LT2
cagccacggcguguugaagu

SEQ ID NO: 1856166 - RNA, 22 nt, Salmonella typhimurium LT2
cagccacguugucggcucaucc

SEQ ID NO: 1856167 - RNA, 20 nt, Salmonella typhimurium LT2
cagcauguucaugcgcggcg

SEQ ID NO: 1856168 - RNA, 23 nt, Salmonella typhimurium LT2
cagcaugguguguucccgcgcca

SEQ ID NO: 1856169 - RNA, 17 nt, Salmonella typhimurium LT2
cagcaugagccagcccu

SEQ ID NO: 1856170 - RNA, 21 nt, Salmonella typhimurium LT2
cagcaugaauaaccucccgcc

SEQ ID NO: 1856171 - RNA, 17 nt, Salmonella typhimurium LT2
cagcaugaucauacugc

SEQ ID NO: 1856172 - RNA, 19 nt, Salmonella typhimurium LT2
cagcaucccgcuggcgcca

SEQ ID NO: 1856173 - RNA, 18 nt, Salmonella typhimurium LT2
cagcaucaucucccaggc

SEQ ID NO: 1856174 - RNA, 12 nt, Salmonella typhimurium LT2
cagcaucaucuc

SEQ ID NO: 1856175 - RNA, 22 nt, Salmonella typhimurium LT2
cagcaucaucucccaggccgcc

SEQ ID NO: 1856176 - RNA, 21 nt, Salmonella typhimurium LT2
cagcaucaugggcucaucaaa

SEQ ID NO: 1856177 - RNA, 15 nt, Salmonella typhimurium LT2
cagcaucauggcaua

SEQ ID NO: 1856178 - RNA, 14 nt, Salmonella typhimurium LT2
cagcaucgcccggg

SEQ ID NO: 1856179 - RNA, 13 nt, Salmonella typhimurium LT2
cagcaaugauaac

SEQ ID NO: 1856180 - RNA, 17 nt, Salmonella typhimurium LT2
cagcaaugccgccgcca

SEQ ID NO: 1856181 - RNA, 18 nt, Salmonella typhimurium LT2
cagcacaaugccuucugc

SEQ ID NO: 1856182 - RNA, 19 nt, Salmonella typhimurium LT2
cagcacaauggucagcgcc

SEQ ID NO: 1856183 - RNA, 20 nt, Salmonella typhimurium LT2
cagcacaauggucagcgccg

SEQ ID NO: 1856184 - RNA, 21 nt, Salmonella typhimurium LT2
cagcacaauggucagcgccgc

SEQ ID NO: 1856185 - RNA, 21 nt, Salmonella typhimurium LT2
cagcacaauuccggcccaggc

SEQ ID NO: 1856186 - RNA, 12 nt, Salmonella typhimurium LT2
cagcacaagggu

SEQ ID NO: 1856187 - RNA, 14 nt, Salmonella typhimurium LT2
cagcacaaaauccc

SEQ ID NO: 1856188 - RNA, 13 nt, Salmonella typhimurium LT2
cagcacaaagugc

SEQ ID NO: 1856189 - RNA, 22 nt, Salmonella typhimurium LT2
cagcacaaagugcgcugucagc

SEQ ID NO: 1856190 - RNA, 18 nt, Salmonella typhimurium LT2
cagcaauuuuguuaaauc

SEQ ID NO: 1856191 - RNA, 23 nt, Salmonella typhimurium LT2
cagcaauuccgccaucucauucg

SEQ ID NO: 1856192 - RNA, 14 nt, Salmonella typhimurium LT2
cagcaauucugcug

SEQ ID NO: 1856193 - RNA, 19 nt, Salmonella typhimurium LT2
cagcaacaucuaucacuuc

SEQ ID NO: 1856194 - RNA, 13 nt, Salmonella typhimurium LT2
cagcaacccugcc

SEQ ID NO: 1856195 - RNA, 17 nt, Salmonella typhimurium LT2
cagcaacgccuccagcg

SEQ ID NO: 1856196 - RNA, 13 nt, Salmonella typhimurium LT2
cagcaacgcgcca

SEQ ID NO: 1856197 - RNA, 16 nt, Salmonella typhimurium LT2
cagcacauagaagcuc

SEQ ID NO: 1856198 - RNA, 18 nt, Salmonella typhimurium LT2
cagcacauuacaggcauc

SEQ ID NO: 1856199 - RNA, 22 nt, Salmonella typhimurium LT2
cagcacauuacaggcaucuucc

SEQ ID NO: 1856200 - RNA, 15 nt, Salmonella typhimurium LT2
cagcacacuacacag

SEQ ID NO: 1856201 - RNA, 13 nt, Salmonella typhimurium LT2
cagcacagcaaaa

SEQ ID NO: 1856202 - RNA, 14 nt, Salmonella typhimurium LT2
cagcaccgcgcgcu

SEQ ID NO: 1856203 - RNA, 19 nt, Salmonella typhimurium LT2
cagcagaacaaccagugcg

SEQ ID NO: 1856204 - RNA, 17 nt, Salmonella typhimurium LT2
cagcacuucgcugauac

SEQ ID NO: 1856205 - RNA, 14 nt, Salmonella typhimurium LT2
cagcagaaacuggc

SEQ ID NO: 1856206 - RNA, 15 nt, Salmonella typhimurium LT2
cagcacuucccgcuc

SEQ ID NO: 1856207 - RNA, 15 nt, Salmonella typhimurium LT2
cagcacgcggaacac

SEQ ID NO: 1856208 - RNA, 20 nt, Salmonella typhimurium LT2
cagcacuucccacuguaaau

SEQ ID NO: 1856209 - RNA, 18 nt, Salmonella typhimurium LT2
cagcacgccggaaagaau

SEQ ID NO: 1856210 - RNA, 15 nt, Salmonella typhimurium LT2
cagaucgaccagcgc

SEQ ID NO: 1856211 - RNA, 22 nt, Salmonella typhimurium LT2
cagaucgacauaagaguccauu

SEQ ID NO: 1856212 - RNA, 21 nt, Salmonella typhimurium LT2
cagauaauccacauugcaaug

SEQ ID NO: 1856213 - RNA, 22 nt, Salmonella typhimurium LT2
cagauaauccacauugcaaugc

SEQ ID NO: 1856214 - RNA, 21 nt, Salmonella typhimurium LT2
cagaugcagguucccgcccug

SEQ ID NO: 1856215 - RNA, 23 nt, Salmonella typhimurium LT2
cagaugaccaccgauuucaucgc

SEQ ID NO: 1856216 - RNA, 16 nt, Salmonella typhimurium LT2
cagaucugucgccaug

SEQ ID NO: 1856217 - RNA, 20 nt, Salmonella typhimurium LT2
cagaucugcgcccauuuccu

SEQ ID NO: 1856218 - RNA, 22 nt, Salmonella typhimurium LT2
cagaucucacaagauucacucu

SEQ ID NO: 1856219 - RNA, 15 nt, Salmonella typhimurium LT2
cagauuacccccuuc

SEQ ID NO: 1856220 - RNA, 14 nt, Salmonella typhimurium LT2
cagauuugaacguc

SEQ ID NO: 1856221 - RNA, 15 nt, Salmonella typhimurium LT2
aaaaugaauaccaaa

SEQ ID NO: 1856222 - RNA, 12 nt, Salmonella typhimurium LT2
aaaaugaaaaau

SEQ ID NO: 1856223 - RNA, 14 nt, Salmonella typhimurium LT2
cagaugcugcugcg

SEQ ID NO: 1856224 - RNA, 14 nt, Salmonella typhimurium LT2
cagauggaaaccgg

SEQ ID NO: 1856225 - RNA, 23 nt, Salmonella typhimurium LT2
cagaugcuuaaugcucugcugug

SEQ ID NO: 1856226 - RNA, 18 nt, Salmonella typhimurium LT2
cagauggauaaccugccg

SEQ ID NO: 1856227 - RNA, 13 nt, Salmonella typhimurium LT2
cagauggcugcac

SEQ ID NO: 1856228 - RNA, 21 nt, Salmonella typhimurium LT2
cagauggcgucacauggcgaa

SEQ ID NO: 1856229 - RNA, 15 nt, Salmonella typhimurium LT2
cagaugucaguaaca

SEQ ID NO: 1856230 - RNA, 13 nt, Salmonella typhimurium LT2
cagaugugcuuuu

SEQ ID NO: 1856231 - RNA, 17 nt, Salmonella typhimurium LT2
cagauguuuacgcugcu

SEQ ID NO: 1856232 - RNA, 15 nt, Salmonella typhimurium LT2
cagauguugauacag

SEQ ID NO: 1856233 - RNA, 20 nt, Salmonella typhimurium LT2
cagauguugagcaaugggaa

SEQ ID NO: 1856234 - RNA, 13 nt, Salmonella typhimurium LT2
aaaaucagcaauc

SEQ ID NO: 1856235 - RNA, 13 nt, Salmonella typhimurium LT2
aaaaucagcagcg

SEQ ID NO: 1856236 - RNA, 19 nt, Salmonella typhimurium LT2
cagagagauccugagaaau

SEQ ID NO: 1856237 - RNA, 22 nt, Salmonella typhimurium LT2
cagagagcguuucuacgccaug

SEQ ID NO: 1856238 - RNA, 19 nt, Salmonella typhimurium LT2
aaaaucauucgaccacaac

SEQ ID NO: 1856239 - RNA, 21 nt, Salmonella typhimurium LT2
cagagcaacgagaacccacuu

SEQ ID NO: 1856240 - RNA, 17 nt, Salmonella typhimurium LT2
cagagauaauuuuccca

SEQ ID NO: 1856241 - RNA, 17 nt, Salmonella typhimurium LT2
cagaguccagcggcagc

SEQ ID NO: 1856242 - RNA, 18 nt, Salmonella typhimurium LT2
cagaguccagcggcagcu

SEQ ID NO: 1856243 - RNA, 15 nt, Salmonella typhimurium LT2
cagaggccugaaugc

SEQ ID NO: 1856244 - RNA, 23 nt, Salmonella typhimurium LT2
cagaggaaauccuuccagcgcca

SEQ ID NO: 1856245 - RNA, 16 nt, Salmonella typhimurium LT2
cagagugcucaauaag

SEQ ID NO: 1856246 - RNA, 15 nt, Salmonella typhimurium LT2
cagagugcucaauaa

SEQ ID NO: 1856247 - RNA, 17 nt, Salmonella typhimurium LT2
cagagucugaaaacuca

SEQ ID NO: 1856248 - RNA, 21 nt, Salmonella typhimurium LT2
cagagcagucguugcgccugu

SEQ ID NO: 1856249 - RNA, 13 nt, Salmonella typhimurium LT2
cagagccaacaga

SEQ ID NO: 1856250 - RNA, 15 nt, Salmonella typhimurium LT2
cagaggaaugaaaac

SEQ ID NO: 1856251 - RNA, 12 nt, Salmonella typhimurium LT2
cagaggaaaacg

SEQ ID NO: 1856252 - RNA, 17 nt, Salmonella typhimurium LT2
cagagcucgucaaaaau

SEQ ID NO: 1856253 - RNA, 17 nt, Salmonella typhimurium LT2
cagacuucauuuuccac

SEQ ID NO: 1856254 - RNA, 16 nt, Salmonella typhimurium LT2
cagacuguaugugcuc

SEQ ID NO: 1856255 - RNA, 14 nt, Salmonella typhimurium LT2
cagacucagccagg

SEQ ID NO: 1856256 - RNA, 22 nt, Salmonella typhimurium LT2
cagacuauccguccucuuuccc

SEQ ID NO: 1856257 - RNA, 20 nt, Salmonella typhimurium LT2
cagagaaguguacaaacacg

SEQ ID NO: 1856258 - RNA, 12 nt, Salmonella typhimurium LT2
cagagaaagucg

SEQ ID NO: 1856259 - RNA, 14 nt, Salmonella typhimurium LT2
cagacgcgcagcac

SEQ ID NO: 1856260 - RNA, 11 nt, Salmonella typhimurium LT2
cagacgcaucg

SEQ ID NO: 1856261 - RNA, 17 nt, Salmonella typhimurium LT2
cagacgcaucuuuuucc

SEQ ID NO: 1856262 - RNA, 13 nt, Salmonella typhimurium LT2
cagacgcuccgca

SEQ ID NO: 1856263 - RNA, 14 nt, Salmonella typhimurium LT2
cagacgcugguugu

SEQ ID NO: 1856264 - RNA, 19 nt, Salmonella typhimurium LT2
cagacguuacaucuccugg

SEQ ID NO: 1856265 - RNA, 21 nt, Salmonella typhimurium LT2
cagacuaaccguucaucuauc

SEQ ID NO: 1856266 - RNA, 17 nt, Salmonella typhimurium LT2
cagacguuuaucggcca

SEQ ID NO: 1856267 - RNA, 21 nt, Salmonella typhimurium LT2
cagacguuuaucggccagcag

SEQ ID NO: 1856268 - RNA, 16 nt, Salmonella typhimurium LT2
cagaccaccccacagc

SEQ ID NO: 1856269 - RNA, 20 nt, Salmonella typhimurium LT2
cagaccacgaaucaggauau

SEQ ID NO: 1856270 - RNA, 12 nt, Salmonella typhimurium LT2
cagacacuggaa

SEQ ID NO: 1856271 - RNA, 13 nt, Salmonella typhimurium LT2
cagacacugccac

SEQ ID NO: 1856272 - RNA, 12 nt, Salmonella typhimurium LT2
cagacagccgac

SEQ ID NO: 1856273 - RNA, 22 nt, Salmonella typhimurium LT2
cagacaguggccaucuuccagc

SEQ ID NO: 1856274 - RNA, 19 nt, Salmonella typhimurium LT2
cagaauuaacucaucacag

SEQ ID NO: 1856275 - RNA, 16 nt, Salmonella typhimurium LT2
cagaauuuccccaguu

SEQ ID NO: 1856276 - RNA, 12 nt, Salmonella typhimurium LT2
cagacaagcaca

SEQ ID NO: 1856277 - RNA, 21 nt, Salmonella typhimurium LT2
cagacaagcacauagcugaga

SEQ ID NO: 1856278 - RNA, 18 nt, Salmonella typhimurium LT2
cagacaauaaacgguccg

SEQ ID NO: 1856279 - RNA, 20 nt, Salmonella typhimurium LT2
cagacaauuagcgacgcaua

SEQ ID NO: 1856280 - RNA, 18 nt, Salmonella typhimurium LT2
cagacaccagcccuggcu

SEQ ID NO: 1856281 - RNA, 13 nt, Salmonella typhimurium LT2
cagaacaaaggcu

SEQ ID NO: 1856282 - RNA, 16 nt, Salmonella typhimurium LT2
cagaaauuaaaucauc

SEQ ID NO: 1856283 - RNA, 22 nt, Salmonella typhimurium LT2
cagaagacggaaaccagauacc

SEQ ID NO: 1856284 - RNA, 19 nt, Salmonella typhimurium LT2
cagaagagaagcuuuuucu

SEQ ID NO: 1856285 - RNA, 15 nt, Salmonella typhimurium LT2
cagaauggggauaau

SEQ ID NO: 1856286 - RNA, 17 nt, Salmonella typhimurium LT2
cagaagcgccugucuau

SEQ ID NO: 1856287 - RNA, 14 nt, Salmonella typhimurium LT2
cagaaacaguuccg

SEQ ID NO: 1856288 - RNA, 19 nt, Salmonella typhimurium LT2
cagaaaaaaugcaccgccu

SEQ ID NO: 1856289 - RNA, 22 nt, Salmonella typhimurium LT2
cagaaaaaagccaagcacaaaa

SEQ ID NO: 1856290 - RNA, 20 nt, Salmonella typhimurium LT2
cagaaauaaaauacuuccau

SEQ ID NO: 1856291 - RNA, 21 nt, Salmonella typhimurium LT2
cagaaaugcagggguccugua

SEQ ID NO: 1856292 - RNA, 22 nt, Salmonella typhimurium LT2
cagaaaucauauaaaacagccu

SEQ ID NO: 1856293 - RNA, 18 nt, Salmonella typhimurium LT2
cacuuucuugccacuggc

SEQ ID NO: 1856294 - RNA, 12 nt, Salmonella typhimurium LT2
cacuuucucggc

SEQ ID NO: 1856295 - RNA, 19 nt, Salmonella typhimurium LT2
cacuuuccagaccaagauc

SEQ ID NO: 1856296 - RNA, 17 nt, Salmonella typhimurium LT2
cacuuuccagccccuuc

SEQ ID NO: 1856297 - RNA, 17 nt, Salmonella typhimurium LT2
cacuuucgcccggcgcc

SEQ ID NO: 1856298 - RNA, 14 nt, Salmonella typhimurium LT2
cacgucugagcaga

SEQ ID NO: 1856299 - RNA, 21 nt, Salmonella typhimurium LT2
cacgucgguauacuguucuac

SEQ ID NO: 1856300 - RNA, 17 nt, Salmonella typhimurium LT2
cagcucauuuuuacaga

SEQ ID NO: 1856301 - RNA, 14 nt, Salmonella typhimurium LT2
cagcuccacaaaua

SEQ ID NO: 1856302 - RNA, 17 nt, Salmonella typhimurium LT2
cagcucaugcgcggcgg

SEQ ID NO: 1856303 - RNA, 12 nt, Salmonella typhimurium LT2
cagcuccagagc

SEQ ID NO: 1856304 - RNA, 17 nt, Salmonella typhimurium LT2
cagcuccagagcgccgu

SEQ ID NO: 1856305 - RNA, 18 nt, Salmonella typhimurium LT2
cagcucccgcgucacgac

SEQ ID NO: 1856306 - RNA, 15 nt, Salmonella typhimurium LT2
cagcuccauccacca

SEQ ID NO: 1856307 - RNA, 20 nt, Salmonella typhimurium LT2
cagcuccauccaccagcccc

SEQ ID NO: 1856308 - RNA, 20 nt, Salmonella typhimurium LT2
cagcuccagccgcugccuuc

SEQ ID NO: 1856309 - RNA, 16 nt, Salmonella typhimurium LT2
cagcucguuauuuccg

SEQ ID NO: 1856310 - RNA, 13 nt, Salmonella typhimurium LT2
cagcucgcacuga

SEQ ID NO: 1856311 - RNA, 17 nt, Salmonella typhimurium LT2
cagcucgacgacguggg

SEQ ID NO: 1856312 - RNA, 22 nt, Salmonella typhimurium LT2
cagcucgauaaucccggcgcgc

SEQ ID NO: 1856313 - RNA, 17 nt, Salmonella typhimurium LT2
cagcucauacccuucca

SEQ ID NO: 1856314 - RNA, 18 nt, Salmonella typhimurium LT2
aaaauugcgaggugguuu

SEQ ID NO: 1856315 - RNA, 15 nt, Salmonella typhimurium LT2
cagcuaauuuuacuu

SEQ ID NO: 1856316 - RNA, 15 nt, Salmonella typhimurium LT2
cagcuauagacgaca

SEQ ID NO: 1856317 - RNA, 18 nt, Salmonella typhimurium LT2
cagcucaccgagacugcc

SEQ ID NO: 1856318 - RNA, 19 nt, Salmonella typhimurium LT2
cagcuauuuuucaccauaa

SEQ ID NO: 1856319 - RNA, 16 nt, Salmonella typhimurium LT2
cagcucaaaucgcggc

SEQ ID NO: 1856320 - RNA, 23 nt, Salmonella typhimurium LT2
cagcgcuccgggguucuuuuuaa

SEQ ID NO: 1856321 - RNA, 20 nt, Salmonella typhimurium LT2
cagcgcgggcgaggccucgu

SEQ ID NO: 1856322 - RNA, 16 nt, Salmonella typhimurium LT2
cagcgcuuagcggcac

SEQ ID NO: 1856323 - RNA, 12 nt, Salmonella typhimurium LT2
cagcuuccaguu

SEQ ID NO: 1856324 - RNA, 22 nt, Salmonella typhimurium LT2
cagcucuucgaugaccgcuuuc

SEQ ID NO: 1856325 - RNA, 23 nt, Salmonella typhimurium LT2
cagcucuucgccguuaucggccu

SEQ ID NO: 1856326 - RNA, 18 nt, Salmonella typhimurium LT2
cagcucuuuaggcaggaa

SEQ ID NO: 1856327 - RNA, 21 nt, Salmonella typhimurium LT2
cagcuucacgaagucuggcug

SEQ ID NO: 1856328 - RNA, 16 nt, Salmonella typhimurium LT2
caggaacagauacugg

SEQ ID NO: 1856329 - RNA, 17 nt, Salmonella typhimurium LT2
caggaaaaacugucccu

SEQ ID NO: 1856330 - RNA, 15 nt, Salmonella typhimurium LT2
cagcuuuugcgcguu

SEQ ID NO: 1856331 - RNA, 22 nt, Salmonella typhimurium LT2
caggagauugccccccagccau

SEQ ID NO: 1856332 - RNA, 19 nt, Salmonella typhimurium LT2
caggauaaagaccggcaca

SEQ ID NO: 1856333 - RNA, 15 nt, Salmonella typhimurium LT2
caggauaauaaugau

SEQ ID NO: 1856334 - RNA, 22 nt, Salmonella typhimurium LT2
caggagcgccguggaaaagagc

SEQ ID NO: 1856335 - RNA, 16 nt, Salmonella typhimurium LT2
caggauacagccgaag

SEQ ID NO: 1856336 - RNA, 15 nt, Salmonella typhimurium LT2
caggauacagccgac

SEQ ID NO: 1856337 - RNA, 12 nt, Salmonella typhimurium LT2
caggauagcgcu

SEQ ID NO: 1856338 - RNA, 16 nt, Salmonella typhimurium LT2
caggacugacugcugu

SEQ ID NO: 1856339 - RNA, 15 nt, Salmonella typhimurium LT2
caggacuucccccuc

SEQ ID NO: 1856340 - RNA, 22 nt, Salmonella typhimurium LT2
caggacuuuuuccccgcgcuga

SEQ ID NO: 1856341 - RNA, 20 nt, Salmonella typhimurium LT2
caggacguugccgcccaccu

SEQ ID NO: 1856342 - RNA, 15 nt, Salmonella typhimurium LT2
caggaauaaagguca

SEQ ID NO: 1856343 - RNA, 13 nt, Salmonella typhimurium LT2
caggaagggcagc

SEQ ID NO: 1856344 - RNA, 18 nt, Salmonella typhimurium LT2
caggaaggggaaaagggu

SEQ ID NO: 1856345 - RNA, 17 nt, Salmonella typhimurium LT2
caggaacgcggcgccga

SEQ ID NO: 1856346 - RNA, 15 nt, Salmonella typhimurium LT2
caggaacaggcccgc

SEQ ID NO: 1856347 - RNA, 17 nt, Salmonella typhimurium LT2
caggaacaggcccgcca

SEQ ID NO: 1856348 - RNA, 18 nt, Salmonella typhimurium LT2
caggaacaugacggcagu

SEQ ID NO: 1856349 - RNA, 15 nt, Salmonella typhimurium LT2
caggaaccgccgaug

SEQ ID NO: 1856350 - RNA, 23 nt, Salmonella typhimurium LT2
caggaauaaccacugauggcugg

SEQ ID NO: 1856351 - RNA, 20 nt, Salmonella typhimurium LT2
caggaauaacaucguaaauc

SEQ ID NO: 1856352 - RNA, 16 nt, Salmonella typhimurium LT2
caggcuuccugcgcug

SEQ ID NO: 1856353 - RNA, 14 nt, Salmonella typhimurium LT2
cagggacaacgcau

SEQ ID NO: 1856354 - RNA, 18 nt, Salmonella typhimurium LT2
cagggacaacgcauugcc

SEQ ID NO: 1856355 - RNA, 12 nt, Salmonella typhimurium LT2
caggcuggaaau

SEQ ID NO: 1856356 - RNA, 16 nt, Salmonella typhimurium LT2
caggcuggcaaagcag

SEQ ID NO: 1856357 - RNA, 14 nt, Salmonella typhimurium LT2
caggcucagcgcca

SEQ ID NO: 1856358 - RNA, 15 nt, Salmonella typhimurium LT2
caggcuaugcucccc

SEQ ID NO: 1856359 - RNA, 18 nt, Salmonella typhimurium LT2
caggcgucauagccgcgc

SEQ ID NO: 1856360 - RNA, 19 nt, Salmonella typhimurium LT2
caggcgucauagccgcgcg

SEQ ID NO: 1856361 - RNA, 17 nt, Salmonella typhimurium LT2
caggcggugcgcagcca

SEQ ID NO: 1856362 - RNA, 18 nt, Salmonella typhimurium LT2
caggcgcaguugaaaaca

SEQ ID NO: 1856363 - RNA, 13 nt, Salmonella typhimurium LT2
caggcggucagca

SEQ ID NO: 1856364 - RNA, 14 nt, Salmonella typhimurium LT2
caggcgaugaauuc

SEQ ID NO: 1856365 - RNA, 11 nt, Salmonella typhimurium LT2
caggcgcaccu

SEQ ID NO: 1856366 - RNA, 23 nt, Salmonella typhimurium LT2
cagggcacgcucuccuacaccac

SEQ ID NO: 1856367 - RNA, 19 nt, Salmonella typhimurium LT2
cagggaaugccauacuuuu

SEQ ID NO: 1856368 - RNA, 16 nt, Salmonella typhimurium LT2
cagggcauccgccgcc

SEQ ID NO: 1856369 - RNA, 21 nt, Salmonella typhimurium LT2
cagggcaugauuacagauauc

SEQ ID NO: 1856370 - RNA, 18 nt, Salmonella typhimurium LT2
aaaauuuugcauaaauaa

SEQ ID NO: 1856371 - RNA, 11 nt, Salmonella typhimurium LT2
aaaauuuuuau

SEQ ID NO: 1856372 - RNA, 15 nt, Salmonella typhimurium LT2
caggggcaguaaauu

SEQ ID NO: 1856373 - RNA, 16 nt, Salmonella typhimurium LT2
cagggcguagacgacc

SEQ ID NO: 1856374 - RNA, 23 nt, Salmonella typhimurium LT2
cagggcguuuuccagcgcgcgca

SEQ ID NO: 1856375 - RNA, 16 nt, Salmonella typhimurium LT2
cagggcggaagcagau

SEQ ID NO: 1856376 - RNA, 22 nt, Salmonella typhimurium LT2
cagggcggcaggaugaaugacu

SEQ ID NO: 1856377 - RNA, 15 nt, Salmonella typhimurium LT2
caggaugccaaccac

SEQ ID NO: 1856378 - RNA, 12 nt, Salmonella typhimurium LT2
caggcauggcca

SEQ ID NO: 1856379 - RNA, 16 nt, Salmonella typhimurium LT2
caggcaugguuaacaa

SEQ ID NO: 1856380 - RNA, 19 nt, Salmonella typhimurium LT2
caggaucaaaaucgcgccc

SEQ ID NO: 1856381 - RNA, 22 nt, Salmonella typhimurium LT2
caggaucaccgccacggcaaga

SEQ ID NO: 1856382 - RNA, 14 nt, Salmonella typhimurium LT2
caggaucaccggca

SEQ ID NO: 1856383 - RNA, 18 nt, Salmonella typhimurium LT2
caggauauacuucaucag

SEQ ID NO: 1856384 - RNA, 14 nt, Salmonella typhimurium LT2
caggaucuucaucc

SEQ ID NO: 1856385 - RNA, 17 nt, Salmonella typhimurium LT2
caggaucuucaucccau

SEQ ID NO: 1856386 - RNA, 14 nt, Salmonella typhimurium LT2
caggaucuuuuuca

SEQ ID NO: 1856387 - RNA, 13 nt, Salmonella typhimurium LT2
caggaucuuuuuc

SEQ ID NO: 1856388 - RNA, 16 nt, Salmonella typhimurium LT2
caggaugaaugacugu

SEQ ID NO: 1856389 - RNA, 19 nt, Salmonella typhimurium LT2
caggaugaaugacugucca

SEQ ID NO: 1856390 - RNA, 14 nt, Salmonella typhimurium LT2
caggccacggcugu

SEQ ID NO: 1856391 - RNA, 20 nt, Salmonella typhimurium LT2
caggccacggcuguaauuga

SEQ ID NO: 1856392 - RNA, 22 nt, Salmonella typhimurium LT2
caggccauuaauauuuuaucac

SEQ ID NO: 1856393 - RNA, 20 nt, Salmonella typhimurium LT2
caggccaugcgcaagcgccc

SEQ ID NO: 1856394 - RNA, 18 nt, Salmonella typhimurium LT2
caggcccaguaccauuga

SEQ ID NO: 1856395 - RNA, 23 nt, Salmonella typhimurium LT2
caggcccgauaagcgcuggcuug

SEQ ID NO: 1856396 - RNA, 17 nt, Salmonella typhimurium LT2
caggccggauggcggcu

SEQ ID NO: 1856397 - RNA, 18 nt, Salmonella typhimurium LT2
caggccgccgggucagaa

SEQ ID NO: 1856398 - RNA, 20 nt, Salmonella typhimurium LT2
caggccgccgggucagaaaa

SEQ ID NO: 1856399 - RNA, 21 nt, Salmonella typhimurium LT2
caggccgauauauugucggcc

SEQ ID NO: 1856400 - RNA, 16 nt, Salmonella typhimurium LT2
caggccgaaacgcagc

SEQ ID NO: 1856401 - RNA, 19 nt, Salmonella typhimurium LT2
caggccugauaagcgcagc

SEQ ID NO: 1856402 - RNA, 20 nt, Salmonella typhimurium LT2
caggcgauagccguccaugu

SEQ ID NO: 1856403 - RNA, 14 nt, Salmonella typhimurium LT2
caggccggcagccu

SEQ ID NO: 1856404 - RNA, 17 nt, Salmonella typhimurium LT2
caggccggcagccugcc

SEQ ID NO: 1856405 - RNA, 16 nt, Salmonella typhimurium LT2
caggccuccugacgaa

SEQ ID NO: 1856406 - RNA, 16 nt, Salmonella typhimurium LT2
caggccugagccgaac

SEQ ID NO: 1856407 - RNA, 16 nt, Salmonella typhimurium LT2
cagugaacacccugcc

SEQ ID NO: 1856408 - RNA, 14 nt, Salmonella typhimurium LT2
cagugaacacccug

SEQ ID NO: 1856409 - RNA, 13 nt, Salmonella typhimurium LT2
cagugaaauaaau

SEQ ID NO: 1856410 - RNA, 12 nt, Salmonella typhimurium LT2
cagugaaaaaaa

SEQ ID NO: 1856411 - RNA, 15 nt, Salmonella typhimurium LT2
cagugaacguucacu

SEQ ID NO: 1856412 - RNA, 19 nt, Salmonella typhimurium LT2
cagugacaaaaaucugaau

SEQ ID NO: 1856413 - RNA, 13 nt, Salmonella typhimurium LT2
cagucugcccggc

SEQ ID NO: 1856414 - RNA, 19 nt, Salmonella typhimurium LT2
cagugcaggauuuguauca

SEQ ID NO: 1856415 - RNA, 13 nt, Salmonella typhimurium LT2
cagugcacugccu

SEQ ID NO: 1856416 - RNA, 14 nt, Salmonella typhimurium LT2
cagugcacugccug

SEQ ID NO: 1856417 - RNA, 14 nt, Salmonella typhimurium LT2
cagugcaacgccuu

SEQ ID NO: 1856418 - RNA, 12 nt, Salmonella typhimurium LT2
cagugcacugcc

SEQ ID NO: 1856419 - RNA, 17 nt, Salmonella typhimurium LT2
cagugcaaacucaccug

SEQ ID NO: 1856420 - RNA, 16 nt, Salmonella typhimurium LT2
cagugauggauuucac

SEQ ID NO: 1856421 - RNA, 15 nt, Salmonella typhimurium LT2
cagugauuacaaaau

SEQ ID NO: 1856422 - RNA, 20 nt, Salmonella typhimurium LT2
cagugauccaucgguucucu

SEQ ID NO: 1856423 - RNA, 22 nt, Salmonella typhimurium LT2
cagugauccaucgguucucugc

SEQ ID NO: 1856424 - RNA, 17 nt, Salmonella typhimurium LT2
cagugagcccuccucca

SEQ ID NO: 1856425 - RNA, 16 nt, Salmonella typhimurium LT2
caguccuccggcugaa

SEQ ID NO: 1856426 - RNA, 18 nt, Salmonella typhimurium LT2
caguccuccggcugaagc

SEQ ID NO: 1856427 - RNA, 21 nt, Salmonella typhimurium LT2
caguccguggcacgguaaacu

SEQ ID NO: 1856428 - RNA, 17 nt, Salmonella typhimurium LT2
caguccucgcccacuuc

SEQ ID NO: 1856429 - RNA, 13 nt, Salmonella typhimurium LT2
cagucgaacuuug

SEQ ID NO: 1856430 - RNA, 21 nt, Salmonella typhimurium LT2
caguccgguggcgaaaacgcu

SEQ ID NO: 1856431 - RNA, 23 nt, Salmonella typhimurium LT2
caguccgguacgacgacccuuuu

SEQ ID NO: 1856432 - RNA, 15 nt, Salmonella typhimurium LT2
caguccgcccgccuc

SEQ ID NO: 1856433 - RNA, 17 nt, Salmonella typhimurium LT2
cagucccuguucgccac

SEQ ID NO: 1856434 - RNA, 20 nt, Salmonella typhimurium LT2
cagucccuguucgccacccg

SEQ ID NO: 1856435 - RNA, 17 nt, Salmonella typhimurium LT2
caguccgaugguuaaau

SEQ ID NO: 1856436 - RNA, 21 nt, Salmonella typhimurium LT2
caguccgaugguuaaauugaa

SEQ ID NO: 1856437 - RNA, 14 nt, Salmonella typhimurium LT2
caguccccuuuuca

SEQ ID NO: 1856438 - RNA, 23 nt, Salmonella typhimurium LT2
cagucgucaucccagucaucguc

SEQ ID NO: 1856439 - RNA, 22 nt, Salmonella typhimurium LT2
cagucgggaaacucgccgccau

SEQ ID NO: 1856440 - RNA, 14 nt, Salmonella typhimurium LT2
cagucgcugagucu

SEQ ID NO: 1856441 - RNA, 16 nt, Salmonella typhimurium LT2
cagucgcuguacuuug

SEQ ID NO: 1856442 - RNA, 19 nt, Salmonella typhimurium LT2
cagucgggaucgccagauc

SEQ ID NO: 1856443 - RNA, 16 nt, Salmonella typhimurium LT2
cagucgcagagcccag

SEQ ID NO: 1856444 - RNA, 14 nt, Salmonella typhimurium LT2
cagucgcagagccc

SEQ ID NO: 1856445 - RNA, 20 nt, Salmonella typhimurium LT2
cagucgcgccgugcccagca

SEQ ID NO: 1856446 - RNA, 23 nt, Salmonella typhimurium LT2
cagucaacgaggugaauaaaucc

SEQ ID NO: 1856447 - RNA, 16 nt, Salmonella typhimurium LT2
cagucacauacuucug

SEQ ID NO: 1856448 - RNA, 17 nt, Salmonella typhimurium LT2
cagucacauacuucugu

SEQ ID NO: 1856449 - RNA, 13 nt, Salmonella typhimurium LT2
cagucaccagcag

SEQ ID NO: 1856450 - RNA, 22 nt, Salmonella typhimurium LT2
caguaugaucaugcccggcaaa

SEQ ID NO: 1856451 - RNA, 12 nt, Salmonella typhimurium LT2
caguaucuuuua

SEQ ID NO: 1856452 - RNA, 22 nt, Salmonella typhimurium LT2
caguaucuuuuauuauuacagg

SEQ ID NO: 1856453 - RNA, 18 nt, Salmonella typhimurium LT2
caguaucggcaggacuua

SEQ ID NO: 1856454 - RNA, 13 nt, Salmonella typhimurium LT2
caguaugcccccu

SEQ ID NO: 1856455 - RNA, 22 nt, Salmonella typhimurium LT2
caguaugcccccuccagccagc

SEQ ID NO: 1856456 - RNA, 14 nt, Salmonella typhimurium LT2
cagucaucgccgcu

SEQ ID NO: 1856457 - RNA, 15 nt, Salmonella typhimurium LT2
cagucauggcuuuua

SEQ ID NO: 1856458 - RNA, 16 nt, Salmonella typhimurium LT2
cagucagcgcgagcgu

SEQ ID NO: 1856459 - RNA, 19 nt, Salmonella typhimurium LT2
cagucagccuugaccgccu

SEQ ID NO: 1856460 - RNA, 17 nt, Salmonella typhimurium LT2
cagucagcaauuaacaa

SEQ ID NO: 1856461 - RNA, 17 nt, Salmonella typhimurium LT2
cagucaggcucaauaug

SEQ ID NO: 1856462 - RNA, 22 nt, Salmonella typhimurium LT2
cagucaggcucaauaugggcau

SEQ ID NO: 1856463 - RNA, 18 nt, Salmonella typhimurium LT2
caguccacaucuaccagg

SEQ ID NO: 1856464 - RNA, 22 nt, Salmonella typhimurium LT2
caguccagccgccgcgcggcag

SEQ ID NO: 1856465 - RNA, 18 nt, Salmonella typhimurium LT2
caguccagaugcgccaga

SEQ ID NO: 1856466 - RNA, 23 nt, Salmonella typhimurium LT2
caguccccagcguaccacgccgc

SEQ ID NO: 1856467 - RNA, 15 nt, Salmonella typhimurium LT2
caguauaaauaccuu

SEQ ID NO: 1856468 - RNA, 17 nt, Salmonella typhimurium LT2
caguagugucuucacga

SEQ ID NO: 1856469 - RNA, 21 nt, Salmonella typhimurium LT2
caguagugugguauucagccc

SEQ ID NO: 1856470 - RNA, 12 nt, Salmonella typhimurium LT2
caguagccaugc

SEQ ID NO: 1856471 - RNA, 20 nt, Salmonella typhimurium LT2
caguagccgccgcaggacag

SEQ ID NO: 1856472 - RNA, 13 nt, Salmonella typhimurium LT2
caguagcgcgccc

SEQ ID NO: 1856473 - RNA, 18 nt, Salmonella typhimurium LT2
caguagcgggggccggcc

SEQ ID NO: 1856474 - RNA, 20 nt, Salmonella typhimurium LT2
caguagcgggggccggccgc

SEQ ID NO: 1856475 - RNA, 22 nt, Salmonella typhimurium LT2
caguagcgggggccggccgcgg

SEQ ID NO: 1856476 - RNA, 16 nt, Salmonella typhimurium LT2
caguagcgcgacgcca

SEQ ID NO: 1856477 - RNA, 17 nt, Salmonella typhimurium LT2
caguacgcgcgcggcgu

SEQ ID NO: 1856478 - RNA, 22 nt, Salmonella typhimurium LT2
caguacgcgccaugucgaggau

SEQ ID NO: 1856479 - RNA, 15 nt, Salmonella typhimurium LT2
caguacgccaaaaaa

SEQ ID NO: 1856480 - RNA, 17 nt, Salmonella typhimurium LT2
caguacgaucaugaauc

SEQ ID NO: 1856481 - RNA, 22 nt, Salmonella typhimurium LT2
caguaccugacuuuuccauacu

SEQ ID NO: 1856482 - RNA, 17 nt, Salmonella typhimurium LT2
caguaccgccuucagcg

SEQ ID NO: 1856483 - RNA, 22 nt, Salmonella typhimurium LT2
caguacgucaacaaugcuuuca

SEQ ID NO: 1856484 - RNA, 15 nt, Salmonella typhimurium LT2
caguacuuucaccug

SEQ ID NO: 1856485 - RNA, 12 nt, Salmonella typhimurium LT2
caguagauggcg

SEQ ID NO: 1856486 - RNA, 14 nt, Salmonella typhimurium LT2
caggucugauaaaa

SEQ ID NO: 1856487 - RNA, 18 nt, Salmonella typhimurium LT2
caggucuuuaucuaucac

SEQ ID NO: 1856488 - RNA, 20 nt, Salmonella typhimurium LT2
caggugaauaccaaagcccg

SEQ ID NO: 1856489 - RNA, 14 nt, Salmonella typhimurium LT2
caggugaacauuac

SEQ ID NO: 1856490 - RNA, 12 nt, Salmonella typhimurium LT2
cagguucagcaa

SEQ ID NO: 1856491 - RNA, 12 nt, Salmonella typhimurium LT2
cagguuaaccca

SEQ ID NO: 1856492 - RNA, 15 nt, Salmonella typhimurium LT2
cagguuacucuucca

SEQ ID NO: 1856493 - RNA, 13 nt, Salmonella typhimurium LT2
cagguuagcagcc

SEQ ID NO: 1856494 - RNA, 15 nt, Salmonella typhimurium LT2
cagguuauacuguga

SEQ ID NO: 1856495 - RNA, 18 nt, Salmonella typhimurium LT2
cagguggaucccccuggc

SEQ ID NO: 1856496 - RNA, 11 nt, Salmonella typhimurium LT2
cagguggaucc

SEQ ID NO: 1856497 - RNA, 20 nt, Salmonella typhimurium LT2
cagguggaucccccuggccc

SEQ ID NO: 1856498 - RNA, 20 nt, Salmonella typhimurium LT2
caggugguacaucaaaucag

SEQ ID NO: 1856499 - RNA, 23 nt, Salmonella typhimurium LT2
caggucaucaccuccagcacgcg

SEQ ID NO: 1856500 - RNA, 19 nt, Salmonella typhimurium LT2
caggucaucaccuccagca

SEQ ID NO: 1856501 - RNA, 14 nt, Salmonella typhimurium LT2
caggucaucggccu

SEQ ID NO: 1856502 - RNA, 16 nt, Salmonella typhimurium LT2
caggucaugcaggacg

SEQ ID NO: 1856503 - RNA, 17 nt, Salmonella typhimurium LT2
cagggguguuacgccau

SEQ ID NO: 1856504 - RNA, 19 nt, Salmonella typhimurium LT2
caggggcucuaaaaaggaa

SEQ ID NO: 1856505 - RNA, 22 nt, Salmonella typhimurium LT2
caggggcgaguuaagcgcccgc

SEQ ID NO: 1856506 - RNA, 16 nt, Salmonella typhimurium LT2
cagggguuccggcaau

SEQ ID NO: 1856507 - RNA, 19 nt, Salmonella typhimurium LT2
cagggguccuguaacaacu

SEQ ID NO: 1856508 - RNA, 20 nt, Salmonella typhimurium LT2
caggucaaaauuaaucgcca

SEQ ID NO: 1856509 - RNA, 23 nt, Salmonella typhimurium LT2
caggucucauagcgccccaguaa

SEQ ID NO: 1856510 - RNA, 18 nt, Salmonella typhimurium LT2
caggucgcccagccauaa

SEQ ID NO: 1856511 - RNA, 13 nt, Salmonella typhimurium LT2
cagguuucaucgc

SEQ ID NO: 1856512 - RNA, 13 nt, Salmonella typhimurium LT2
cagguuuuacuuc

SEQ ID NO: 1856513 - RNA, 16 nt, Salmonella typhimurium LT2
cagguuucguccgccg

SEQ ID NO: 1856514 - RNA, 19 nt, Salmonella typhimurium LT2
cagguuucguccgccgcua

SEQ ID NO: 1856515 - RNA, 12 nt, Salmonella typhimurium LT2
aaacaacucuau

SEQ ID NO: 1856516 - RNA, 17 nt, Salmonella typhimurium LT2
aaacaacucuauuaaaa

SEQ ID NO: 1856517 - RNA, 22 nt, Salmonella typhimurium LT2
cagguuuuuugugaguucauaa

SEQ ID NO: 1856518 - RNA, 15 nt, Salmonella typhimurium LT2
caguaaaaagaaagc

SEQ ID NO: 1856519 - RNA, 19 nt, Salmonella typhimurium LT2
caguaaaaagaaagcugcc

SEQ ID NO: 1856520 - RNA, 15 nt, Salmonella typhimurium LT2
cagguuuuuaagcug

SEQ ID NO: 1856521 - RNA, 20 nt, Salmonella typhimurium LT2
cagguuuuuaagcugcccac

SEQ ID NO: 1856522 - RNA, 17 nt, Salmonella typhimurium LT2
cagguuuuuaagcugcc

SEQ ID NO: 1856523 - RNA, 14 nt, Salmonella typhimurium LT2
cagguugugcaucu

SEQ ID NO: 1856524 - RNA, 16 nt, Salmonella typhimurium LT2
cagguuguccagcagc

SEQ ID NO: 1856525 - RNA, 17 nt, Salmonella typhimurium LT2
cagguuuacguagcagc

SEQ ID NO: 1856526 - RNA, 14 nt, Salmonella typhimurium LT2
cagguugggucucg

SEQ ID NO: 1856527 - RNA, 15 nt, Salmonella typhimurium LT2
cagguucgaaucccg

SEQ ID NO: 1856528 - RNA, 21 nt, Salmonella typhimurium LT2
cagguucgggccaccuuccag

SEQ ID NO: 1856529 - RNA, 18 nt, Salmonella typhimurium LT2
cagguucugagaacccca

SEQ ID NO: 1856530 - RNA, 16 nt, Salmonella typhimurium LT2
cagguugaugcaaaug

SEQ ID NO: 1856531 - RNA, 16 nt, Salmonella typhimurium LT2
caguaaucgcacggcu

SEQ ID NO: 1856532 - RNA, 22 nt, Salmonella typhimurium LT2
caguaaucccggucgcgccagc

SEQ ID NO: 1856533 - RNA, 20 nt, Salmonella typhimurium LT2
caguaauuuuucucccagca

SEQ ID NO: 1856534 - RNA, 21 nt, Salmonella typhimurium LT2
caguaauauaaccaauuuaaa

SEQ ID NO: 1856535 - RNA, 21 nt, Salmonella typhimurium LT2
caguaagucgccgcagcucca

SEQ ID NO: 1856536 - RNA, 19 nt, Salmonella typhimurium LT2
caguaagauuugcgccgcc

SEQ ID NO: 1856537 - RNA, 22 nt, Salmonella typhimurium LT2
caguaaucaccgucuccggcgc

SEQ ID NO: 1856538 - RNA, 17 nt, Salmonella typhimurium LT2
caguacagccaaaaaua

SEQ ID NO: 1856539 - RNA, 13 nt, Salmonella typhimurium LT2
caguacagccaaa

SEQ ID NO: 1856540 - RNA, 16 nt, Salmonella typhimurium LT2
caguacagccaaaaau

SEQ ID NO: 1856541 - RNA, 15 nt, Salmonella typhimurium LT2
caguacaauuuccug

SEQ ID NO: 1856542 - RNA, 19 nt, Salmonella typhimurium LT2
caguacaauuuccugccac

SEQ ID NO: 1856543 - RNA, 22 nt, Salmonella typhimurium LT2
caguacaauuucuggccccuga

SEQ ID NO: 1856544 - RNA, 16 nt, Salmonella typhimurium LT2
caguacaaacaaauaa

SEQ ID NO: 1856545 - RNA, 15 nt, Salmonella typhimurium LT2
caguacaaacaaaua

SEQ ID NO: 1856546 - RNA, 13 nt, Salmonella typhimurium LT2
caguaaaggggag

SEQ ID NO: 1856547 - RNA, 20 nt, Salmonella typhimurium LT2
caguaaaucccgcaucaccc

SEQ ID NO: 1856548 - RNA, 22 nt, Salmonella typhimurium LT2
caguaaagauuuguuucaucgc

SEQ ID NO: 1856549 - RNA, 20 nt, Salmonella typhimurium LT2
caguaaauuaaacagcugua

SEQ ID NO: 1856550 - RNA, 13 nt, Salmonella typhimurium LT2
caguaagacaaaa

SEQ ID NO: 1856551 - RNA, 21 nt, Salmonella typhimurium LT2
caguaagaacgagaacucaga

SEQ ID NO: 1856552 - RNA, 22 nt, Salmonella typhimurium LT2
caguaagaacgagaacucagag

SEQ ID NO: 1856553 - RNA, 14 nt, Salmonella typhimurium LT2
caguaacucaucgc

SEQ ID NO: 1856554 - RNA, 17 nt, Salmonella typhimurium LT2
caguaacucaucgccag

SEQ ID NO: 1856555 - RNA, 18 nt, Salmonella typhimurium LT2
caguaacucaucgccagc

SEQ ID NO: 1856556 - RNA, 20 nt, Salmonella typhimurium LT2
caguaacgauacccaccagc

SEQ ID NO: 1856557 - RNA, 15 nt, Salmonella typhimurium LT2
caguaaccgccacag

SEQ ID NO: 1856558 - RNA, 17 nt, Salmonella typhimurium LT2
caguaaccgccacagca

SEQ ID NO: 1856559 - RNA, 20 nt, Salmonella typhimurium LT2
caguaaccuauuuuaaaaaa

SEQ ID NO: 1856560 - RNA, 14 nt, Salmonella typhimurium LT2
cauugagcguaaua

SEQ ID NO: 1856561 - RNA, 19 nt, Salmonella typhimurium LT2
cauugaggcuacccagaca

SEQ ID NO: 1856562 - RNA, 18 nt, Salmonella typhimurium LT2
cauugaggcuacccagac

SEQ ID NO: 1856563 - RNA, 16 nt, Salmonella typhimurium LT2
cauuuucggcagcgcg

SEQ ID NO: 1856564 - RNA, 21 nt, Salmonella typhimurium LT2
cauuuugcuggaaaaauaaga

SEQ ID NO: 1856565 - RNA, 17 nt, Salmonella typhimurium LT2
cauuuuuacaccccuga

SEQ ID NO: 1856566 - RNA, 21 nt, Salmonella typhimurium LT2
cauuuuuacucagcacauuca

SEQ ID NO: 1856567 - RNA, 18 nt, Salmonella typhimurium LT2
cauuuuucgaucuucucc

SEQ ID NO: 1856568 - RNA, 21 nt, Salmonella typhimurium LT2
cauuuuuccagccauuuuuuu

SEQ ID NO: 1856569 - RNA, 15 nt, Salmonella typhimurium LT2
cauuuuuuucagccu

SEQ ID NO: 1856570 - RNA, 17 nt, Salmonella typhimurium LT2
cauuuuuugacaacaaa

SEQ ID NO: 1856571 - RNA, 14 nt, Salmonella typhimurium LT2
cauuuuuucagccu

SEQ ID NO: 1856572 - RNA, 22 nt, Salmonella typhimurium LT2
cauuuuuggugacguguuugau

SEQ ID NO: 1856573 - RNA, 21 nt, Salmonella typhimurium LT2
ccaaaauggcaaguaaaauaa

SEQ ID NO: 1856574 - RNA, 16 nt, Salmonella typhimurium LT2
ccaaaacccaccagca

SEQ ID NO: 1856575 - RNA, 13 nt, Salmonella typhimurium LT2
ccaaaccagaccc

SEQ ID NO: 1856576 - RNA, 22 nt, Salmonella typhimurium LT2
ccaaaccagacucaccccuucu

SEQ ID NO: 1856577 - RNA, 18 nt, Salmonella typhimurium LT2
ccaaacccgccacaggcc

SEQ ID NO: 1856578 - RNA, 13 nt, Salmonella typhimurium LT2
ccaaacagcggcu

SEQ ID NO: 1856579 - RNA, 21 nt, Salmonella typhimurium LT2
ccaaaauucacgcuucucugg

SEQ ID NO: 1856580 - RNA, 19 nt, Salmonella typhimurium LT2
ccaaacgcggucaggguga

SEQ ID NO: 1856581 - RNA, 12 nt, Salmonella typhimurium LT2
ccaaacggcagc

SEQ ID NO: 1856582 - RNA, 18 nt, Salmonella typhimurium LT2
ccaaacugcgcgccgccc

SEQ ID NO: 1856583 - RNA, 19 nt, Salmonella typhimurium LT2
ccaaacugcggaauuuuau

SEQ ID NO: 1856584 - RNA, 22 nt, Salmonella typhimurium LT2
ccaagcgcgguaaauuucuuga

SEQ ID NO: 1856585 - RNA, 18 nt, Salmonella typhimurium LT2
ccaagcaggaaccccuga

SEQ ID NO: 1856586 - RNA, 12 nt, Salmonella typhimurium LT2
ccaagaaugaaa

SEQ ID NO: 1856587 - RNA, 18 nt, Salmonella typhimurium LT2
ccaaguaacacggcgaca

SEQ ID NO: 1856588 - RNA, 19 nt, Salmonella typhimurium LT2
ccaagcggcaucucgccaa

SEQ ID NO: 1856589 - RNA, 18 nt, Salmonella typhimurium LT2
ccaaccuacgcgccacgu

SEQ ID NO: 1856590 - RNA, 19 nt, Salmonella typhimurium LT2
ccaacguugugcuccgccg

SEQ ID NO: 1856591 - RNA, 17 nt, Salmonella typhimurium LT2
ccaacguugaagagcua

SEQ ID NO: 1856592 - RNA, 23 nt, Salmonella typhimurium LT2
ccaacccgaccaggacaaaaggc

SEQ ID NO: 1856593 - RNA, 21 nt, Salmonella typhimurium LT2
ccaacucccccauggagagcg

SEQ ID NO: 1856594 - RNA, 12 nt, Salmonella typhimurium LT2
ccaaacugcgga

SEQ ID NO: 1856595 - RNA, 18 nt, Salmonella typhimurium LT2
ccaaaguuaaucagcgcu

SEQ ID NO: 1856596 - RNA, 20 nt, Salmonella typhimurium LT2
ccaaagcccgcaaacagagc

SEQ ID NO: 1856597 - RNA, 17 nt, Salmonella typhimurium LT2
ccaaauaguccagcagc

SEQ ID NO: 1856598 - RNA, 18 nt, Salmonella typhimurium LT2
ccaaauaguccagcagcc

SEQ ID NO: 1856599 - RNA, 18 nt, Salmonella typhimurium LT2
ccaaaucuguucugucca

SEQ ID NO: 1856600 - RNA, 21 nt, Salmonella typhimurium LT2
ccaaaugccugccguuuuuaa

SEQ ID NO: 1856601 - RNA, 15 nt, Salmonella typhimurium LT2
ccaaauaacccaggg

SEQ ID NO: 1856602 - RNA, 19 nt, Salmonella typhimurium LT2
ccaacacaucgacaugcag

SEQ ID NO: 1856603 - RNA, 14 nt, Salmonella typhimurium LT2
ccaacaccagcacu

SEQ ID NO: 1856604 - RNA, 19 nt, Salmonella typhimurium LT2
ccaaccaucggcacacuuu

SEQ ID NO: 1856605 - RNA, 21 nt, Salmonella typhimurium LT2
ccaccguuuaaucgcccugcg

SEQ ID NO: 1856606 - RNA, 13 nt, Salmonella typhimurium LT2
ccaccguuauuuc

SEQ ID NO: 1856607 - RNA, 15 nt, Salmonella typhimurium LT2
ccaccguuauuucca

SEQ ID NO: 1856608 - RNA, 23 nt, Salmonella typhimurium LT2
ccaccggagcggcguccgccagc

SEQ ID NO: 1856609 - RNA, 14 nt, Salmonella typhimurium LT2
ccaccggaccgccg

SEQ ID NO: 1856610 - RNA, 19 nt, Salmonella typhimurium LT2
ccaccggaccuaauaacca

SEQ ID NO: 1856611 - RNA, 23 nt, Salmonella typhimurium LT2
ccaccggaccuaauaaccagccc

SEQ ID NO: 1856612 - RNA, 15 nt, Salmonella typhimurium LT2
ccaccgcuccgcgca

SEQ ID NO: 1856613 - RNA, 18 nt, Salmonella typhimurium LT2
ccacgcacgccggccccg

SEQ ID NO: 1856614 - RNA, 21 nt, Salmonella typhimurium LT2
ccaccuuugacgccugcaucc

SEQ ID NO: 1856615 - RNA, 13 nt, Salmonella typhimurium LT2
ccacgaaagucug

SEQ ID NO: 1856616 - RNA, 15 nt, Salmonella typhimurium LT2
ccaccuuucugcucc

SEQ ID NO: 1856617 - RNA, 18 nt, Salmonella typhimurium LT2
ccaccuuaaacuugccgu

SEQ ID NO: 1856618 - RNA, 18 nt, Salmonella typhimurium LT2
ccaccuguucgccuucgu

SEQ ID NO: 1856619 - RNA, 19 nt, Salmonella typhimurium LT2
ccaccuguuucgccaggcc

SEQ ID NO: 1856620 - RNA, 15 nt, Salmonella typhimurium LT2
ccaccuuccagggua

SEQ ID NO: 1856621 - RNA, 15 nt, Salmonella typhimurium LT2
ccaccugccaguccg

SEQ ID NO: 1856622 - RNA, 12 nt, Salmonella typhimurium LT2
ccaccacaaagc

SEQ ID NO: 1856623 - RNA, 18 nt, Salmonella typhimurium LT2
ccaccagccggagccggu

SEQ ID NO: 1856624 - RNA, 13 nt, Salmonella typhimurium LT2
ccaccagccgcau

SEQ ID NO: 1856625 - RNA, 16 nt, Salmonella typhimurium LT2
ccacccauuuuccgcu

SEQ ID NO: 1856626 - RNA, 17 nt, Salmonella typhimurium LT2
ccaccagccuaaaaaca

SEQ ID NO: 1856627 - RNA, 23 nt, Salmonella typhimurium LT2
ccaccagcgccauaauccagaau

SEQ ID NO: 1856628 - RNA, 19 nt, Salmonella typhimurium LT2
ccaccagcgguuggaucuc

SEQ ID NO: 1856629 - RNA, 10 nt, Salmonella typhimurium LT2
ccacccgcgu

SEQ ID NO: 1856630 - RNA, 15 nt, Salmonella typhimurium LT2
ccacccgccugcgcc

SEQ ID NO: 1856631 - RNA, 22 nt, Salmonella typhimurium LT2
ccaccccagguuauucaggugg

SEQ ID NO: 1856632 - RNA, 16 nt, Salmonella typhimurium LT2
ccaauaauaaucccaa

SEQ ID NO: 1856633 - RNA, 12 nt, Salmonella typhimurium LT2
ccaauaagaacu

SEQ ID NO: 1856634 - RNA, 18 nt, Salmonella typhimurium LT2
ccaaguaauaaagagaac

SEQ ID NO: 1856635 - RNA, 13 nt, Salmonella typhimurium LT2
ccaaugcagcgcg

SEQ ID NO: 1856636 - RNA, 12 nt, Salmonella typhimurium LT2
ccaaugagcugc

SEQ ID NO: 1856637 - RNA, 19 nt, Salmonella typhimurium LT2
ccaaugccugacgccacca

SEQ ID NO: 1856638 - RNA, 13 nt, Salmonella typhimurium LT2
ccacaaaggcgcg

SEQ ID NO: 1856639 - RNA, 18 nt, Salmonella typhimurium LT2
ccacaacgugauaaccaa

SEQ ID NO: 1856640 - RNA, 23 nt, Salmonella typhimurium LT2
ccacaagagcagcaacccugccg

SEQ ID NO: 1856641 - RNA, 22 nt, Salmonella typhimurium LT2
ccacaaauuuugauaaaaacac

SEQ ID NO: 1856642 - RNA, 23 nt, Salmonella typhimurium LT2
ccacaaccgcccccaacugagcg

SEQ ID NO: 1856643 - RNA, 14 nt, Salmonella typhimurium LT2
ccacaugaccagcg

SEQ ID NO: 1856644 - RNA, 17 nt, Salmonella typhimurium LT2
ccacaugaccagcgccg

SEQ ID NO: 1856645 - RNA, 15 nt, Salmonella typhimurium LT2
ccacauuaaagagcg

SEQ ID NO: 1856646 - RNA, 18 nt, Salmonella typhimurium LT2
ccacauuuccuuuucgca

SEQ ID NO: 1856647 - RNA, 13 nt, Salmonella typhimurium LT2
ccacaugaacucg

SEQ ID NO: 1856648 - RNA, 22 nt, Salmonella typhimurium LT2
ccacaugaacucgacuuuuucc

SEQ ID NO: 1856649 - RNA, 15 nt, Salmonella typhimurium LT2
ccacacucuccuccc

SEQ ID NO: 1856650 - RNA, 21 nt, Salmonella typhimurium LT2
ccacacgcuuauccagccacu

SEQ ID NO: 1856651 - RNA, 18 nt, Salmonella typhimurium LT2
ccacaccuucuucgccaa

SEQ ID NO: 1856652 - RNA, 17 nt, Salmonella typhimurium LT2
ccacagucgucuggcgc

SEQ ID NO: 1856653 - RNA, 21 nt, Salmonella typhimurium LT2
ccacagucauggcuuuuaccc

SEQ ID NO: 1856654 - RNA, 15 nt, Salmonella typhimurium LT2
ccacauagcauccag

SEQ ID NO: 1856655 - RNA, 17 nt, Salmonella typhimurium LT2
ccacauagcauccagac

SEQ ID NO: 1856656 - RNA, 16 nt, Salmonella typhimurium LT2
ccacauauaaguaacu

SEQ ID NO: 1856657 - RNA, 17 nt, Salmonella typhimurium LT2
ccacugcccgccgccac

SEQ ID NO: 1856658 - RNA, 12 nt, Salmonella typhimurium LT2
ccacugcccaga

SEQ ID NO: 1856659 - RNA, 12 nt, Salmonella typhimurium LT2
ccacugcccgcc

SEQ ID NO: 1856660 - RNA, 13 nt, Salmonella typhimurium LT2
ccacugcaucucu

SEQ ID NO: 1856661 - RNA, 13 nt, Salmonella typhimurium LT2
ccacgccacaaua

SEQ ID NO: 1856662 - RNA, 20 nt, Salmonella typhimurium LT2
ccacgccaauaugcgcaagg

SEQ ID NO: 1856663 - RNA, 17 nt, Salmonella typhimurium LT2
ccacugguaggcaucca

SEQ ID NO: 1856664 - RNA, 18 nt, Salmonella typhimurium LT2
ccacuggugacaucgcca

SEQ ID NO: 1856665 - RNA, 19 nt, Salmonella typhimurium LT2
ccacuuaacguuaccuuua

SEQ ID NO: 1856666 - RNA, 18 nt, Salmonella typhimurium LT2
ccacuucugacagaauau

SEQ ID NO: 1856667 - RNA, 21 nt, Salmonella typhimurium LT2
ccacuuuaccgcucacaaugc

SEQ ID NO: 1856668 - RNA, 14 nt, Salmonella typhimurium LT2
ccacuuucagcucc

SEQ ID NO: 1856669 - RNA, 19 nt, Salmonella typhimurium LT2
ccacuugauucugcagcga

SEQ ID NO: 1856670 - RNA, 11 nt, Salmonella typhimurium LT2
ccagacacagu

SEQ ID NO: 1856671 - RNA, 22 nt, Salmonella typhimurium LT2
ccagacacuggaaacagccaau

SEQ ID NO: 1856672 - RNA, 13 nt, Salmonella typhimurium LT2
ccagacacuggaa

SEQ ID NO: 1856673 - RNA, 17 nt, Salmonella typhimurium LT2
ccagacacuggaaacag

SEQ ID NO: 1856674 - RNA, 20 nt, Salmonella typhimurium LT2
ccagacagauaacaccagcg

SEQ ID NO: 1856675 - RNA, 15 nt, Salmonella typhimurium LT2
ccagacagauaacac

SEQ ID NO: 1856676 - RNA, 22 nt, Salmonella typhimurium LT2
ccagaauuuccuucgcuuccug

SEQ ID NO: 1856677 - RNA, 23 nt, Salmonella typhimurium LT2
ccagacaaaaucuuuccagcucc

SEQ ID NO: 1856678 - RNA, 17 nt, Salmonella typhimurium LT2
ccagacaaacaccgccu

SEQ ID NO: 1856679 - RNA, 17 nt, Salmonella typhimurium LT2
ccagaaugcccaggccc

SEQ ID NO: 1856680 - RNA, 18 nt, Salmonella typhimurium LT2
ccagaaggcgaacauaag

SEQ ID NO: 1856681 - RNA, 15 nt, Salmonella typhimurium LT2
ccagaauacgccgcc

SEQ ID NO: 1856682 - RNA, 19 nt, Salmonella typhimurium LT2
ccagaauacgccgccgccc

SEQ ID NO: 1856683 - RNA, 19 nt, Salmonella typhimurium LT2
ccagaacugcgaaaucacc

SEQ ID NO: 1856684 - RNA, 14 nt, Salmonella typhimurium LT2
ccagaagcacuucu

SEQ ID NO: 1856685 - RNA, 12 nt, Salmonella typhimurium LT2
ccagaagcacuu

SEQ ID NO: 1856686 - RNA, 18 nt, Salmonella typhimurium LT2
ccagaagcgcuuugccaa

SEQ ID NO: 1856687 - RNA, 20 nt, Salmonella typhimurium LT2
ccagaagcgcuuugccaaug

SEQ ID NO: 1856688 - RNA, 13 nt, Salmonella typhimurium LT2
ccagaaaccgccc

SEQ ID NO: 1856689 - RNA, 19 nt, Salmonella typhimurium LT2
ccacuuucuguaauuugaa

SEQ ID NO: 1856690 - RNA, 16 nt, Salmonella typhimurium LT2
ccacuuugcgcuccug

SEQ ID NO: 1856691 - RNA, 23 nt, Salmonella typhimurium LT2
ccagaacgaauuuacucgccaau

SEQ ID NO: 1856692 - RNA, 18 nt, Salmonella typhimurium LT2
ccagaacgagaggaggag

SEQ ID NO: 1856693 - RNA, 17 nt, Salmonella typhimurium LT2
ccagaaccguugcgccc

SEQ ID NO: 1856694 - RNA, 18 nt, Salmonella typhimurium LT2
ccagaaccugcucggcua

SEQ ID NO: 1856695 - RNA, 19 nt, Salmonella typhimurium LT2
ccagauuaucggccagcgc

SEQ ID NO: 1856696 - RNA, 15 nt, Salmonella typhimurium LT2
ccagaugucaguaac

SEQ ID NO: 1856697 - RNA, 17 nt, Salmonella typhimurium LT2
ccagauuaucggccagc

SEQ ID NO: 1856698 - RNA, 19 nt, Salmonella typhimurium LT2
ccagauguugauacagaaa

SEQ ID NO: 1856699 - RNA, 21 nt, Salmonella typhimurium LT2
ccagauggcugcacccggaga

SEQ ID NO: 1856700 - RNA, 17 nt, Salmonella typhimurium LT2
ccagauggcaagauuaa

SEQ ID NO: 1856701 - RNA, 18 nt, Salmonella typhimurium LT2
ccagauggauaaccugcc

SEQ ID NO: 1856702 - RNA, 23 nt, Salmonella typhimurium LT2
ccagaugcgccaguacguuaugc

SEQ ID NO: 1856703 - RNA, 22 nt, Salmonella typhimurium LT2
ccagauggcaagauuaaccagc

SEQ ID NO: 1856704 - RNA, 18 nt, Salmonella typhimurium LT2
ccagaugucgcggauaug

SEQ ID NO: 1856705 - RNA, 15 nt, Salmonella typhimurium LT2
ccagauguugagcaa

SEQ ID NO: 1856706 - RNA, 23 nt, Salmonella typhimurium LT2
ccagauguugagcaaugggaagg

SEQ ID NO: 1856707 - RNA, 17 nt, Salmonella typhimurium LT2
ccagaucgcgucugaca

SEQ ID NO: 1856708 - RNA, 13 nt, Salmonella typhimurium LT2
ccagaucgugcca

SEQ ID NO: 1856709 - RNA, 12 nt, Salmonella typhimurium LT2
ccagaucucaca

SEQ ID NO: 1856710 - RNA, 23 nt, Salmonella typhimurium LT2
ccagaugcuuaaugcucugcugu

SEQ ID NO: 1856711 - RNA, 19 nt, Salmonella typhimurium LT2
ccagaucgauauccgugcg

SEQ ID NO: 1856712 - RNA, 16 nt, Salmonella typhimurium LT2
ccagauaguggcugag

SEQ ID NO: 1856713 - RNA, 19 nt, Salmonella typhimurium LT2
ccagauagaaccacgcaaa

SEQ ID NO: 1856714 - RNA, 21 nt, Salmonella typhimurium LT2
ccagauaagcucuccuggaug

SEQ ID NO: 1856715 - RNA, 18 nt, Salmonella typhimurium LT2
ccagauaauuaugccugu

SEQ ID NO: 1856716 - RNA, 22 nt, Salmonella typhimurium LT2
ccagauaaucgccgccagcuca

SEQ ID NO: 1856717 - RNA, 20 nt, Salmonella typhimurium LT2
ccagauaaucaaacgcgccg

SEQ ID NO: 1856718 - RNA, 14 nt, Salmonella typhimurium LT2
ccagauaaggcuca

SEQ ID NO: 1856719 - RNA, 17 nt, Salmonella typhimurium LT2
ccagacgggccaggcga

SEQ ID NO: 1856720 - RNA, 15 nt, Salmonella typhimurium LT2
ccagacgcgccugca

SEQ ID NO: 1856721 - RNA, 19 nt, Salmonella typhimurium LT2
ccagacgcguaaccccugc

SEQ ID NO: 1856722 - RNA, 14 nt, Salmonella typhimurium LT2
ccagaccgcuuaac

SEQ ID NO: 1856723 - RNA, 19 nt, Salmonella typhimurium LT2
ccagaccggcaucucaucu

SEQ ID NO: 1856724 - RNA, 19 nt, Salmonella typhimurium LT2
ccagaccggcaugauggcg

SEQ ID NO: 1856725 - RNA, 17 nt, Salmonella typhimurium LT2
ccagacaugcacauggu

SEQ ID NO: 1856726 - RNA, 15 nt, Salmonella typhimurium LT2
ccagacaugcacaug

SEQ ID NO: 1856727 - RNA, 13 nt, Salmonella typhimurium LT2
ccagaccgacagc

SEQ ID NO: 1856728 - RNA, 18 nt, Salmonella typhimurium LT2
ccagaccauuaacgccgc

SEQ ID NO: 1856729 - RNA, 12 nt, Salmonella typhimurium LT2
ccagacccgcug

SEQ ID NO: 1856730 - RNA, 20 nt, Salmonella typhimurium LT2
ccagaggaucuggacgccaa

SEQ ID NO: 1856731 - RNA, 20 nt, Salmonella typhimurium LT2
ccagaggaaauccuuccagc

SEQ ID NO: 1856732 - RNA, 22 nt, Salmonella typhimurium LT2
ccagaguaaccacgauaaagac

SEQ ID NO: 1856733 - RNA, 14 nt, Salmonella typhimurium LT2
ccagagucaccagc

SEQ ID NO: 1856734 - RNA, 16 nt, Salmonella typhimurium LT2
ccagagucaccagcac

SEQ ID NO: 1856735 - RNA, 16 nt, Salmonella typhimurium LT2
ccagacucaccccuuc

SEQ ID NO: 1856736 - RNA, 19 nt, Salmonella typhimurium LT2
ccagacgcugauagccacg

SEQ ID NO: 1856737 - RNA, 20 nt, Salmonella typhimurium LT2
ccagacgcugauagccacgg

SEQ ID NO: 1856738 - RNA, 21 nt, Salmonella typhimurium LT2
ccagagagcguuucuacgcca

SEQ ID NO: 1856739 - RNA, 9 nt, Salmonella typhimurium LT2
ccagcagca

SEQ ID NO: 1856740 - RNA, 10 nt, Salmonella typhimurium LT2
ccagcagcca

SEQ ID NO: 1856741 - RNA, 21 nt, Salmonella typhimurium LT2
ccagcagcauaaaaccgccgc

SEQ ID NO: 1856742 - RNA, 12 nt, Salmonella typhimurium LT2
ccagcagcagcu

SEQ ID NO: 1856743 - RNA, 11 nt, Salmonella typhimurium LT2
ccagcagcgcg

SEQ ID NO: 1856744 - RNA, 21 nt, Salmonella typhimurium LT2
ccagcagcgcggcgucgccgc

SEQ ID NO: 1856745 - RNA, 16 nt, Salmonella typhimurium LT2
ccagcacuaacagcag

SEQ ID NO: 1856746 - RNA, 17 nt, Salmonella typhimurium LT2
ccagcacuaacagcagc

SEQ ID NO: 1856747 - RNA, 22 nt, Salmonella typhimurium LT2
ccagcacgcuuucaaaaugcgc

SEQ ID NO: 1856748 - RNA, 22 nt, Salmonella typhimurium LT2
ccagcaacagcgcguccagcgg

SEQ ID NO: 1856749 - RNA, 19 nt, Salmonella typhimurium LT2
ccagcaacgcgcuaaaugc

SEQ ID NO: 1856750 - RNA, 11 nt, Salmonella typhimurium LT2
ccagcaaaauu

SEQ ID NO: 1856751 - RNA, 12 nt, Salmonella typhimurium LT2
ccagcaaaucgc

SEQ ID NO: 1856752 - RNA, 22 nt, Salmonella typhimurium LT2
ccagcaaaucaauuugauggcu

SEQ ID NO: 1856753 - RNA, 19 nt, Salmonella typhimurium LT2
ccagauuucgcaacagcau

SEQ ID NO: 1856754 - RNA, 12 nt, Salmonella typhimurium LT2
ccagcacagccc

SEQ ID NO: 1856755 - RNA, 19 nt, Salmonella typhimurium LT2
ccagcacaggcgucccggu

SEQ ID NO: 1856756 - RNA, 16 nt, Salmonella typhimurium LT2
ccagcaccaucuuuuc

SEQ ID NO: 1856757 - RNA, 15 nt, Salmonella typhimurium LT2
ccagcaccagcagug

SEQ ID NO: 1856758 - RNA, 23 nt, Salmonella typhimurium LT2
ccagcaaggagacgcccgucacc

SEQ ID NO: 1856759 - RNA, 16 nt, Salmonella typhimurium LT2
ccagcaaugccgccgc

SEQ ID NO: 1856760 - RNA, 16 nt, Salmonella typhimurium LT2
ccagcaaugauuuuau

SEQ ID NO: 1856761 - RNA, 12 nt, Salmonella typhimurium LT2
ccagccacaaga

SEQ ID NO: 1856762 - RNA, 16 nt, Salmonella typhimurium LT2
ccagcauuucuucaag

SEQ ID NO: 1856763 - RNA, 14 nt, Salmonella typhimurium LT2
ccagccacugcgcc

SEQ ID NO: 1856764 - RNA, 15 nt, Salmonella typhimurium LT2
ccagccagcgccagc

SEQ ID NO: 1856765 - RNA, 18 nt, Salmonella typhimurium LT2
ccagccagggaucaagca

SEQ ID NO: 1856766 - RNA, 14 nt, Salmonella typhimurium LT2
ccagccaugccagc

SEQ ID NO: 1856767 - RNA, 19 nt, Salmonella typhimurium LT2
ccagccauucgaauucuga

SEQ ID NO: 1856768 - RNA, 19 nt, Salmonella typhimurium LT2
ccagcccucaacauugccg

SEQ ID NO: 1856769 - RNA, 16 nt, Salmonella typhimurium LT2
ccagcccuuccgccgg

SEQ ID NO: 1856770 - RNA, 19 nt, Salmonella typhimurium LT2
ccagccgcaucuuauauuu

SEQ ID NO: 1856771 - RNA, 18 nt, Salmonella typhimurium LT2
ccagccgaucaucacgaa

SEQ ID NO: 1856772 - RNA, 16 nt, Salmonella typhimurium LT2
ccagcccuaaaaauag

SEQ ID NO: 1856773 - RNA, 19 nt, Salmonella typhimurium LT2
ccagcccggcgcacacccu

SEQ ID NO: 1856774 - RNA, 20 nt, Salmonella typhimurium LT2
ccagcccggcgcacacccug

SEQ ID NO: 1856775 - RNA, 21 nt, Salmonella typhimurium LT2
ccagcccggcgcacacccugc

SEQ ID NO: 1856776 - RNA, 23 nt, Salmonella typhimurium LT2
ccagcccggcgcacacccugcag

SEQ ID NO: 1856777 - RNA, 19 nt, Salmonella typhimurium LT2
ccagcccaauacgccagcc

SEQ ID NO: 1856778 - RNA, 14 nt, Salmonella typhimurium LT2
ccagccccaccguc

SEQ ID NO: 1856779 - RNA, 12 nt, Salmonella typhimurium LT2
ccagccccagaa

SEQ ID NO: 1856780 - RNA, 21 nt, Salmonella typhimurium LT2
ccagccccuucgcuguccauu

SEQ ID NO: 1856781 - RNA, 23 nt, Salmonella typhimurium LT2
ccagcauagucgcuccccauaaa

SEQ ID NO: 1856782 - RNA, 15 nt, Salmonella typhimurium LT2
ccagcauauaaauac

SEQ ID NO: 1856783 - RNA, 17 nt, Salmonella typhimurium LT2
ccagcauauaaauaccg

SEQ ID NO: 1856784 - RNA, 22 nt, Salmonella typhimurium LT2
ccagcaggugcggacugggcug

SEQ ID NO: 1856785 - RNA, 21 nt, Salmonella typhimurium LT2
ccagcaggucgcacuccucug

SEQ ID NO: 1856786 - RNA, 21 nt, Salmonella typhimurium LT2
ccagcagguggaucugaaucu

SEQ ID NO: 1856787 - RNA, 23 nt, Salmonella typhimurium LT2
ccagcagguaaacagacaauuag

SEQ ID NO: 1856788 - RNA, 22 nt, Salmonella typhimurium LT2
ccagcagggcguuuuccagcgc

SEQ ID NO: 1856789 - RNA, 20 nt, Salmonella typhimurium LT2
ccagcaggguauuugcgccc

SEQ ID NO: 1856790 - RNA, 12 nt, Salmonella typhimurium LT2
ccagcagggcaa

SEQ ID NO: 1856791 - RNA, 11 nt, Salmonella typhimurium LT2
ccagcauuucu

SEQ ID NO: 1856792 - RNA, 23 nt, Salmonella typhimurium LT2
ccagcauuucaaucgcacccgcc

SEQ ID NO: 1856793 - RNA, 14 nt, Salmonella typhimurium LT2
ccagcauugauuuu

SEQ ID NO: 1856794 - RNA, 23 nt, Salmonella typhimurium LT2
ccagcauuaccagcaauaacagg

SEQ ID NO: 1856795 - RNA, 18 nt, Salmonella typhimurium LT2
ccagcauggcgucggcga

SEQ ID NO: 1856796 - RNA, 14 nt, Salmonella typhimurium LT2
ccagcaugcccgcc

SEQ ID NO: 1856797 - RNA, 21 nt, Salmonella typhimurium LT2
ccagcaugaucauacugccgc

SEQ ID NO: 1856798 - RNA, 15 nt, Salmonella typhimurium LT2
ccagcaugcccgcca

SEQ ID NO: 1856799 - RNA, 18 nt, Salmonella typhimurium LT2
ccagcaucucacguacaa

SEQ ID NO: 1856800 - RNA, 16 nt, Salmonella typhimurium LT2
ccagcaucgcccgggc

SEQ ID NO: 1856801 - RNA, 13 nt, Salmonella typhimurium LT2
ccagcaucccgcu

SEQ ID NO: 1856802 - RNA, 20 nt, Salmonella typhimurium LT2
ccagcaucaugggcucauca

SEQ ID NO: 1856803 - RNA, 15 nt, Salmonella typhimurium LT2
ccagcaucauuuuuu

SEQ ID NO: 1856804 - RNA, 19 nt, Salmonella typhimurium LT2
cauacuuuaccggcccuuc

SEQ ID NO: 1856805 - RNA, 23 nt, Salmonella typhimurium LT2
cauagaaaaagaacugcaaauac

SEQ ID NO: 1856806 - RNA, 18 nt, Salmonella typhimurium LT2
cauacuuuuccagcgccu

SEQ ID NO: 1856807 - RNA, 16 nt, Salmonella typhimurium LT2
cauacuuacugcuguc

SEQ ID NO: 1856808 - RNA, 15 nt, Salmonella typhimurium LT2
cauacuuacugcugu

SEQ ID NO: 1856809 - RNA, 15 nt, Salmonella typhimurium LT2
cauacuuccucaccg

SEQ ID NO: 1856810 - RNA, 23 nt, Salmonella typhimurium LT2
cauacuggcgaugauacccugaa

SEQ ID NO: 1856811 - RNA, 21 nt, Salmonella typhimurium LT2
cauacucuuggagagcaucau

SEQ ID NO: 1856812 - RNA, 19 nt, Salmonella typhimurium LT2
cauacugauuucggaauga

SEQ ID NO: 1856813 - RNA, 15 nt, Salmonella typhimurium LT2
cauacugaagauaaa

SEQ ID NO: 1856814 - RNA, 23 nt, Salmonella typhimurium LT2
cauacugaagauaaacagcagcg

SEQ ID NO: 1856815 - RNA, 16 nt, Salmonella typhimurium LT2
cauacugacggcgcuc

SEQ ID NO: 1856816 - RNA, 21 nt, Salmonella typhimurium LT2
cagugccaaaucaugagcgca

SEQ ID NO: 1856817 - RNA, 19 nt, Salmonella typhimurium LT2
cauagcaaaguacuggaau

SEQ ID NO: 1856818 - RNA, 17 nt, Salmonella typhimurium LT2
cauagagaucacgcugu

SEQ ID NO: 1856819 - RNA, 12 nt, Salmonella typhimurium LT2
cauagaaccacu

SEQ ID NO: 1856820 - RNA, 17 nt, Salmonella typhimurium LT2
cauagaaccacuuauuu

SEQ ID NO: 1856821 - RNA, 15 nt, Salmonella typhimurium LT2
cauauaaggcccaua

SEQ ID NO: 1856822 - RNA, 18 nt, Salmonella typhimurium LT2
cauauagugcgugacaau

SEQ ID NO: 1856823 - RNA, 20 nt, Salmonella typhimurium LT2
cauauaacagaauaagccag

SEQ ID NO: 1856824 - RNA, 18 nt, Salmonella typhimurium LT2
cauauaaauuucauccau

SEQ ID NO: 1856825 - RNA, 20 nt, Salmonella typhimurium LT2
cauagcggacuaaauuccug

SEQ ID NO: 1856826 - RNA, 20 nt, Salmonella typhimurium LT2
cauagcgcaacgcuucuucg

SEQ ID NO: 1856827 - RNA, 18 nt, Salmonella typhimurium LT2
cauagcgccaucagacau

SEQ ID NO: 1856828 - RNA, 13 nt, Salmonella typhimurium LT2
cauagcaucacca

SEQ ID NO: 1856829 - RNA, 14 nt, Salmonella typhimurium LT2
cauagccgccaccc

SEQ ID NO: 1856830 - RNA, 18 nt, Salmonella typhimurium LT2
cauagcugaauaaaaaau

SEQ ID NO: 1856831 - RNA, 21 nt, Salmonella typhimurium LT2
cauagcuaaauuaaaaauaau

SEQ ID NO: 1856832 - RNA, 22 nt, Salmonella typhimurium LT2
cauagcguugauaugcucgaca

SEQ ID NO: 1856833 - RNA, 16 nt, Salmonella typhimurium LT2
cauagcguugauaugc

SEQ ID NO: 1856834 - RNA, 23 nt, Salmonella typhimurium LT2
cauauuuuucuaaugucagcuca

SEQ ID NO: 1856835 - RNA, 13 nt, Salmonella typhimurium LT2
cauauuuuuaugc

SEQ ID NO: 1856836 - RNA, 15 nt, Salmonella typhimurium LT2
cauauuuuucacaca

SEQ ID NO: 1856837 - RNA, 19 nt, Salmonella typhimurium LT2
cauauuuucaacggcauca

SEQ ID NO: 1856838 - RNA, 20 nt, Salmonella typhimurium LT2
cauauugcgcuucacuaacu

SEQ ID NO: 1856839 - RNA, 20 nt, Salmonella typhimurium LT2
cauauugcguaucguaagcc

SEQ ID NO: 1856840 - RNA, 18 nt, Salmonella typhimurium LT2
caucaaauacgcgcgccg

SEQ ID NO: 1856841 - RNA, 20 nt, Salmonella typhimurium LT2
caucaaaugaacacaaaaaa

SEQ ID NO: 1856842 - RNA, 18 nt, Salmonella typhimurium LT2
caucaacagcggagagac

SEQ ID NO: 1856843 - RNA, 19 nt, Salmonella typhimurium LT2
caucaaguaccgugaagaa

SEQ ID NO: 1856844 - RNA, 23 nt, Salmonella typhimurium LT2
cauaucgcaguugauacauuuuu

SEQ ID NO: 1856845 - RNA, 22 nt, Salmonella typhimurium LT2
cauaucgaccuuuuucgcgccc

SEQ ID NO: 1856846 - RNA, 22 nt, Salmonella typhimurium LT2
cauauuccagccacacgacggu

SEQ ID NO: 1856847 - RNA, 14 nt, Salmonella typhimurium LT2
cauauugccgcaca

SEQ ID NO: 1856848 - RNA, 16 nt, Salmonella typhimurium LT2
cauauucgucuucauc

SEQ ID NO: 1856849 - RNA, 13 nt, Salmonella typhimurium LT2
caucacuggcauu

SEQ ID NO: 1856850 - RNA, 21 nt, Salmonella typhimurium LT2
caucacuuuuggcgacaggaa

SEQ ID NO: 1856851 - RNA, 20 nt, Salmonella typhimurium LT2
caucacuacggguucuugug

SEQ ID NO: 1856852 - RNA, 16 nt, Salmonella typhimurium LT2
caucaccuccagcacg

SEQ ID NO: 1856853 - RNA, 21 nt, Salmonella typhimurium LT2
caucaccuccagcacgcgcug

SEQ ID NO: 1856854 - RNA, 17 nt, Salmonella typhimurium LT2
caucacaaaaucauugc

SEQ ID NO: 1856855 - RNA, 16 nt, Salmonella typhimurium LT2
caucaauuucucuuuu

SEQ ID NO: 1856856 - RNA, 22 nt, Salmonella typhimurium LT2
caucaauaccggucggcaaauc

SEQ ID NO: 1856857 - RNA, 23 nt, Salmonella typhimurium LT2
caucaauaauauacuggaagcua

SEQ ID NO: 1856858 - RNA, 17 nt, Salmonella typhimurium LT2
caucaauaccagcccca

SEQ ID NO: 1856859 - RNA, 23 nt, Salmonella typhimurium LT2
caucaccaucguugccagcggcc

SEQ ID NO: 1856860 - RNA, 21 nt, Salmonella typhimurium LT2
caucacaugcggaagcaaaau

SEQ ID NO: 1856861 - RNA, 17 nt, Salmonella typhimurium LT2
caucacaucaaagcccc

SEQ ID NO: 1856862 - RNA, 16 nt, Salmonella typhimurium LT2
caucacagccacacug

SEQ ID NO: 1856863 - RNA, 15 nt, Salmonella typhimurium LT2
caucacagccacacu

SEQ ID NO: 1856864 - RNA, 18 nt, Salmonella typhimurium LT2
caucacagccacacugcu

SEQ ID NO: 1856865 - RNA, 20 nt, Salmonella typhimurium LT2
caucacagccacacugcugu

SEQ ID NO: 1856866 - RNA, 16 nt, Salmonella typhimurium LT2
caucggcgcgcuggcg

SEQ ID NO: 1856867 - RNA, 15 nt, Salmonella typhimurium LT2
caucggcggcaaagc

SEQ ID NO: 1856868 - RNA, 14 nt, Salmonella typhimurium LT2
caucgugauaaacg

SEQ ID NO: 1856869 - RNA, 21 nt, Salmonella typhimurium LT2
caucgcccugauggcgcgcca

SEQ ID NO: 1856870 - RNA, 17 nt, Salmonella typhimurium LT2
caucgccgauuccugcu

SEQ ID NO: 1856871 - RNA, 21 nt, Salmonella typhimurium LT2
caucgcuggugugcagccagu

SEQ ID NO: 1856872 - RNA, 20 nt, Salmonella typhimurium LT2
caucgcuuugagcagcgcca

SEQ ID NO: 1856873 - RNA, 16 nt, Salmonella typhimurium LT2
caucgcuugcccagca

SEQ ID NO: 1856874 - RNA, 16 nt, Salmonella typhimurium LT2
caucgcuuagcggcuc

SEQ ID NO: 1856875 - RNA, 20 nt, Salmonella typhimurium LT2
caucgcuggcgcgcgcgccu

SEQ ID NO: 1856876 - RNA, 12 nt, Salmonella typhimurium LT2
caucggcaaacg

SEQ ID NO: 1856877 - RNA, 19 nt, Salmonella typhimurium LT2
caucggcaaacgccgccug

SEQ ID NO: 1856878 - RNA, 22 nt, Salmonella typhimurium LT2
caucggcacacuuucgcccggc

SEQ ID NO: 1856879 - RNA, 15 nt, Salmonella typhimurium LT2
caucggcacagccag

SEQ ID NO: 1856880 - RNA, 16 nt, Salmonella typhimurium LT2
caucggcacagccagu

SEQ ID NO: 1856881 - RNA, 19 nt, Salmonella typhimurium LT2
caucgccacaugcggcagg

SEQ ID NO: 1856882 - RNA, 18 nt, Salmonella typhimurium LT2
caucgccauuaaaagcca

SEQ ID NO: 1856883 - RNA, 23 nt, Salmonella typhimurium LT2
caucgagccaacguauaaaaugg

SEQ ID NO: 1856884 - RNA, 21 nt, Salmonella typhimurium LT2
caucgagcuuugacgacccgc

SEQ ID NO: 1856885 - RNA, 20 nt, Salmonella typhimurium LT2
caucgcauauugcguaucgu

SEQ ID NO: 1856886 - RNA, 19 nt, Salmonella typhimurium LT2
cauccuuuacgcugccucu

SEQ ID NO: 1856887 - RNA, 23 nt, Salmonella typhimurium LT2
cauccggcgcugugcggcgugca

SEQ ID NO: 1856888 - RNA, 16 nt, Salmonella typhimurium LT2
cauccggcgcugauga

SEQ ID NO: 1856889 - RNA, 21 nt, Salmonella typhimurium LT2
cauccggcugcgucgcuuccu

SEQ ID NO: 1856890 - RNA, 17 nt, Salmonella typhimurium LT2
cauccgccagcgccucu

SEQ ID NO: 1856891 - RNA, 20 nt, Salmonella typhimurium LT2
cauccgcccgacaucaaacu

SEQ ID NO: 1856892 - RNA, 14 nt, Salmonella typhimurium LT2
cauccggccuguuc

SEQ ID NO: 1856893 - RNA, 18 nt, Salmonella typhimurium LT2
cauccggcauuuaugcug

SEQ ID NO: 1856894 - RNA, 21 nt, Salmonella typhimurium LT2
cauccggcacgccaucgccug

SEQ ID NO: 1856895 - RNA, 23 nt, Salmonella typhimurium LT2
caucccauccgggccacucucca

SEQ ID NO: 1856896 - RNA, 16 nt, Salmonella typhimurium LT2
cauccccccgccgcug

SEQ ID NO: 1856897 - RNA, 23 nt, Salmonella typhimurium LT2
cauccgauuucauggucaucgca

SEQ ID NO: 1856898 - RNA, 21 nt, Salmonella typhimurium LT2
cauccgauuucauggucaucg

SEQ ID NO: 1856899 - RNA, 22 nt, Salmonella typhimurium LT2
caucccgauuucgcuccacugg

SEQ ID NO: 1856900 - RNA, 21 nt, Salmonella typhimurium LT2
caucccgauaauggcgccgau

SEQ ID NO: 1856901 - RNA, 14 nt, Salmonella typhimurium LT2
cauccccggcgccc

SEQ ID NO: 1856902 - RNA, 18 nt, Salmonella typhimurium LT2
cauccauugcgccacgga

SEQ ID NO: 1856903 - RNA, 18 nt, Salmonella typhimurium LT2
cauccauguacuccuggu

SEQ ID NO: 1856904 - RNA, 16 nt, Salmonella typhimurium LT2
caucccaccggaaaug

SEQ ID NO: 1856905 - RNA, 15 nt, Salmonella typhimurium LT2
caucccacccagcaa

SEQ ID NO: 1856906 - RNA, 14 nt, Salmonella typhimurium LT2
cauccaucagcgcg

SEQ ID NO: 1856907 - RNA, 14 nt, Salmonella typhimurium LT2
cauccagcucaugu

SEQ ID NO: 1856908 - RNA, 21 nt, Salmonella typhimurium LT2
cauccaggaaguaaauuauuc

SEQ ID NO: 1856909 - RNA, 22 nt, Salmonella typhimurium LT2
cauccaggguuuaaucacgcca

SEQ ID NO: 1856910 - RNA, 19 nt, Salmonella typhimurium LT2
cauccaguuguuuauucca

SEQ ID NO: 1856911 - RNA, 15 nt, Salmonella typhimurium LT2
cauccagucagcaau

SEQ ID NO: 1856912 - RNA, 16 nt, Salmonella typhimurium LT2
cauccagucagcaauu

SEQ ID NO: 1856913 - RNA, 17 nt, Salmonella typhimurium LT2
caucaugucacccacgc

SEQ ID NO: 1856914 - RNA, 12 nt, Salmonella typhimurium LT2
caucauuuuuau

SEQ ID NO: 1856915 - RNA, 15 nt, Salmonella typhimurium LT2
caucauuuucccacu

SEQ ID NO: 1856916 - RNA, 19 nt, Salmonella typhimurium LT2
caucauuuucuuucaucaa

SEQ ID NO: 1856917 - RNA, 17 nt, Salmonella typhimurium LT2
cauccaacugcgccuga

SEQ ID NO: 1856918 - RNA, 21 nt, Salmonella typhimurium LT2
cauccaacuuaugaaaaccug

SEQ ID NO: 1856919 - RNA, 23 nt, Salmonella typhimurium LT2
caucaugaugaucuucagcccgu

SEQ ID NO: 1856920 - RNA, 17 nt, Salmonella typhimurium LT2
caucaugcccacaggca

SEQ ID NO: 1856921 - RNA, 18 nt, Salmonella typhimurium LT2
caucaugccagccgacag

SEQ ID NO: 1856922 - RNA, 15 nt, Salmonella typhimurium LT2
caucagccagcagcu

SEQ ID NO: 1856923 - RNA, 20 nt, Salmonella typhimurium LT2
caucaugacacuuuauucuc

SEQ ID NO: 1856924 - RNA, 22 nt, Salmonella typhimurium LT2
caucaugacacuuuauucucug

SEQ ID NO: 1856925 - RNA, 14 nt, Salmonella typhimurium LT2
cauccacagcgcca

SEQ ID NO: 1856926 - RNA, 17 nt, Salmonella typhimurium LT2
cauccacgccagcuugg

SEQ ID NO: 1856927 - RNA, 17 nt, Salmonella typhimurium LT2
cauccacggcaucaaua

SEQ ID NO: 1856928 - RNA, 14 nt, Salmonella typhimurium LT2
cauccacggccccg

SEQ ID NO: 1856929 - RNA, 14 nt, Salmonella typhimurium LT2
cauccagaucggca

SEQ ID NO: 1856930 - RNA, 11 nt, Salmonella typhimurium LT2
cauccagacca

SEQ ID NO: 1856931 - RNA, 12 nt, Salmonella typhimurium LT2
caucuuuaaccg

SEQ ID NO: 1856932 - RNA, 14 nt, Salmonella typhimurium LT2
caucuucuuuuucc

SEQ ID NO: 1856933 - RNA, 21 nt, Salmonella typhimurium LT2
caucguggccgauauugccuu

SEQ ID NO: 1856934 - RNA, 19 nt, Salmonella typhimurium LT2
caucgugguuaauacauca

SEQ ID NO: 1856935 - RNA, 23 nt, Salmonella typhimurium LT2
caugaacguuggcgauaaggucg

SEQ ID NO: 1856936 - RNA, 19 nt, Salmonella typhimurium LT2
caugaaaaauagacacaaa

SEQ ID NO: 1856937 - RNA, 22 nt, Salmonella typhimurium LT2
caugaaaaauagacacaaaugc

SEQ ID NO: 1856938 - RNA, 13 nt, Salmonella typhimurium LT2
caucuuuuuucac

SEQ ID NO: 1856939 - RNA, 11 nt, Salmonella typhimurium LT2
caugaaaauau

SEQ ID NO: 1856940 - RNA, 17 nt, Salmonella typhimurium LT2
caugaaaauaugaugcu

SEQ ID NO: 1856941 - RNA, 23 nt, Salmonella typhimurium LT2
caugaauaucaaaccacgcugag

SEQ ID NO: 1856942 - RNA, 21 nt, Salmonella typhimurium LT2
caugaaugccccagcgcugcu

SEQ ID NO: 1856943 - RNA, 18 nt, Salmonella typhimurium LT2
caugaaugccccagcgcu

SEQ ID NO: 1856944 - RNA, 17 nt, Salmonella typhimurium LT2
caugacaauaacggccu

SEQ ID NO: 1856945 - RNA, 22 nt, Salmonella typhimurium LT2
caugacaucgcuuaaugucaca

SEQ ID NO: 1856946 - RNA, 13 nt, Salmonella typhimurium LT2
caugacauccaug

SEQ ID NO: 1856947 - RNA, 14 nt, Salmonella typhimurium LT2
caugaccagcgccg

SEQ ID NO: 1856948 - RNA, 16 nt, Salmonella typhimurium LT2
caugacauucccauug

SEQ ID NO: 1856949 - RNA, 21 nt, Salmonella typhimurium LT2
caugaccauucgcacuccagg

SEQ ID NO: 1856950 - RNA, 13 nt, Salmonella typhimurium LT2
caugagaagaaaa

SEQ ID NO: 1856951 - RNA, 16 nt, Salmonella typhimurium LT2
caugagccagcccuca

SEQ ID NO: 1856952 - RNA, 21 nt, Salmonella typhimurium LT2
caugagcaguuaauuucccac

SEQ ID NO: 1856953 - RNA, 20 nt, Salmonella typhimurium LT2
caugacgccgcagccugaug

SEQ ID NO: 1856954 - RNA, 18 nt, Salmonella typhimurium LT2
caugccguauuuaugcua

SEQ ID NO: 1856955 - RNA, 22 nt, Salmonella typhimurium LT2
caugccggugcgagaaaaagca

SEQ ID NO: 1856956 - RNA, 21 nt, Salmonella typhimurium LT2
caugccgccugccgcgccgcc

SEQ ID NO: 1856957 - RNA, 15 nt, Salmonella typhimurium LT2
caugccgccacuucg

SEQ ID NO: 1856958 - RNA, 14 nt, Salmonella typhimurium LT2
caugccgccaaacu

SEQ ID NO: 1856959 - RNA, 18 nt, Salmonella typhimurium LT2
caugccucgaaaauauau

SEQ ID NO: 1856960 - RNA, 18 nt, Salmonella typhimurium LT2
caugcgacgugucgcgua

SEQ ID NO: 1856961 - RNA, 21 nt, Salmonella typhimurium LT2
caugcgaucgggcaauccauu

SEQ ID NO: 1856962 - RNA, 18 nt, Salmonella typhimurium LT2
caugcgcagaaacugauc

SEQ ID NO: 1856963 - RNA, 12 nt, Salmonella typhimurium LT2
caugccaucggc

SEQ ID NO: 1856964 - RNA, 17 nt, Salmonella typhimurium LT2
caugcccggacgauguc

SEQ ID NO: 1856965 - RNA, 15 nt, Salmonella typhimurium LT2
caugcaauuugaggu

SEQ ID NO: 1856966 - RNA, 15 nt, Salmonella typhimurium LT2
caugcagcucaagcg

SEQ ID NO: 1856967 - RNA, 16 nt, Salmonella typhimurium LT2
caugcaacuucaccuc

SEQ ID NO: 1856968 - RNA, 14 nt, Salmonella typhimurium LT2
caugcaccagcccc

SEQ ID NO: 1856969 - RNA, 17 nt, Salmonella typhimurium LT2
caugaugagcgccauau

SEQ ID NO: 1856970 - RNA, 14 nt, Salmonella typhimurium LT2
caugaucggccaga

SEQ ID NO: 1856971 - RNA, 13 nt, Salmonella typhimurium LT2
caugaucuuuccu

SEQ ID NO: 1856972 - RNA, 23 nt, Salmonella typhimurium LT2
caugauaguaucgcugcuaaacg

SEQ ID NO: 1856973 - RNA, 16 nt, Salmonella typhimurium LT2
caugaucauacugccg

SEQ ID NO: 1856974 - RNA, 12 nt, Salmonella typhimurium LT2
caugauccagcg

SEQ ID NO: 1856975 - RNA, 16 nt, Salmonella typhimurium LT2
caugauccagcggaac

SEQ ID NO: 1856976 - RNA, 16 nt, Salmonella typhimurium LT2
caugauggcguaaucc

SEQ ID NO: 1856977 - RNA, 20 nt, Salmonella typhimurium LT2
caugauggcgaacagcccca

SEQ ID NO: 1856978 - RNA, 16 nt, Salmonella typhimurium LT2
caugaugaucuucagc

SEQ ID NO: 1856979 - RNA, 21 nt, Salmonella typhimurium LT2
cauggcgaauccguugaucgu

SEQ ID NO: 1856980 - RNA, 15 nt, Salmonella typhimurium LT2
cauggcgauuaccca

SEQ ID NO: 1856981 - RNA, 21 nt, Salmonella typhimurium LT2
caugcuaaaacagauaacgaa

SEQ ID NO: 1856982 - RNA, 23 nt, Salmonella typhimurium LT2
caugcguccgcccagaaagauca

SEQ ID NO: 1856983 - RNA, 18 nt, Salmonella typhimurium LT2
caugcgggugacgcuggc

SEQ ID NO: 1856984 - RNA, 23 nt, Salmonella typhimurium LT2
caugcgugcgccgcgagugcagg

SEQ ID NO: 1856985 - RNA, 14 nt, Salmonella typhimurium LT2
caugcgcuuuuuca

SEQ ID NO: 1856986 - RNA, 22 nt, Salmonella typhimurium LT2
caugcgcgucccggcagugcau

SEQ ID NO: 1856987 - RNA, 19 nt, Salmonella typhimurium LT2
caugcggugcaugaauauc

SEQ ID NO: 1856988 - RNA, 21 nt, Salmonella typhimurium LT2
caugcggcagaggucgccgcu

SEQ ID NO: 1856989 - RNA, 14 nt, Salmonella typhimurium LT2
caugguguucagau

SEQ ID NO: 1856990 - RNA, 13 nt, Salmonella typhimurium LT2
cauggggaacagg

SEQ ID NO: 1856991 - RNA, 18 nt, Salmonella typhimurium LT2
caugguugaaaaaagccg

SEQ ID NO: 1856992 - RNA, 14 nt, Salmonella typhimurium LT2
cauguaaacuccau

SEQ ID NO: 1856993 - RNA, 19 nt, Salmonella typhimurium LT2
cauggcggcgacaaugcuc

SEQ ID NO: 1856994 - RNA, 17 nt, Salmonella typhimurium LT2
cauggcggccagauggc

SEQ ID NO: 1856995 - RNA, 18 nt, Salmonella typhimurium LT2
cauggcggccagauggca

SEQ ID NO: 1856996 - RNA, 22 nt, Salmonella typhimurium LT2
caugggacgggucuccaucaga

SEQ ID NO: 1856997 - RNA, 20 nt, Salmonella typhimurium LT2
caugucaaauucaagccaua

SEQ ID NO: 1856998 - RNA, 17 nt, Salmonella typhimurium LT2
cauguucccaugucagc

SEQ ID NO: 1856999 - RNA, 18 nt, Salmonella typhimurium LT2
cauguucaugcgcggcgg

SEQ ID NO: 1857000 - RNA, 18 nt, Salmonella typhimurium LT2
cauguugcguaaauaaau

SEQ ID NO: 1857001 - RNA, 21 nt, Salmonella typhimurium LT2
cauguugcggguuucugaaua

SEQ ID NO: 1857002 - RNA, 23 nt, Salmonella typhimurium LT2
cauguugaucguaaaaugaaaaa

SEQ ID NO: 1857003 - RNA, 22 nt, Salmonella typhimurium LT2
cauguugaucguaaaaugaaaa

SEQ ID NO: 1857004 - RNA, 18 nt, Salmonella typhimurium LT2
cauguuuuguauuaauug

SEQ ID NO: 1857005 - RNA, 12 nt, Salmonella typhimurium LT2
cauuaaaaugau

SEQ ID NO: 1857006 - RNA, 10 nt, Salmonella typhimurium LT2
cauuaaaaaa

SEQ ID NO: 1857007 - RNA, 15 nt, Salmonella typhimurium LT2
cauuaaaaaaacaug

SEQ ID NO: 1857008 - RNA, 13 nt, Salmonella typhimurium LT2
cauuaaaaaaacg

SEQ ID NO: 1857009 - RNA, 19 nt, Salmonella typhimurium LT2
cauuaacccggccccgaca

SEQ ID NO: 1857010 - RNA, 15 nt, Salmonella typhimurium LT2
cauuaacgccgugcu

SEQ ID NO: 1857011 - RNA, 16 nt, Salmonella typhimurium LT2
cauuaacggcaacagu

SEQ ID NO: 1857012 - RNA, 15 nt, Salmonella typhimurium LT2
cauuaauucaguccu

SEQ ID NO: 1857013 - RNA, 22 nt, Salmonella typhimurium LT2
cauuaauuucuuaccaaaagca

SEQ ID NO: 1857014 - RNA, 20 nt, Salmonella typhimurium LT2
cauuaaugccguuauacauc

SEQ ID NO: 1857015 - RNA, 19 nt, Salmonella typhimurium LT2
cauuaaugucaugaagcuc

SEQ ID NO: 1857016 - RNA, 12 nt, Salmonella typhimurium LT2
cauuaucaccau

SEQ ID NO: 1857017 - RNA, 17 nt, Salmonella typhimurium LT2
cauuauguaauaacuga

SEQ ID NO: 1857018 - RNA, 17 nt, Salmonella typhimurium LT2
cauucagcaacugcgua

SEQ ID NO: 1857019 - RNA, 14 nt, Salmonella typhimurium LT2
cauugacucaugaa

SEQ ID NO: 1857020 - RNA, 15 nt, Salmonella typhimurium LT2
cauugagcauucuac

SEQ ID NO: 1857021 - RNA, 17 nt, Salmonella typhimurium LT2
cauugagcauucuacag

SEQ ID NO: 1857022 - RNA, 19 nt, Salmonella typhimurium LT2
cauugacccucccugcgcu

SEQ ID NO: 1857023 - RNA, 23 nt, Salmonella typhimurium LT2
cauucuucagcgcguccuccagc

SEQ ID NO: 1857024 - RNA, 15 nt, Salmonella typhimurium LT2
cauucuugcgccgca

SEQ ID NO: 1857025 - RNA, 23 nt, Salmonella typhimurium LT2
cauucucaacccggacauccauc

SEQ ID NO: 1857026 - RNA, 13 nt, Salmonella typhimurium LT2
cauuccccacgcc

SEQ ID NO: 1857027 - RNA, 15 nt, Salmonella typhimurium LT2
cauucucuugccugc

SEQ ID NO: 1857028 - RNA, 20 nt, Salmonella typhimurium LT2
cauucucuguugccgcccgu

SEQ ID NO: 1857029 - RNA, 19 nt, Salmonella typhimurium LT2
cauucugcuuaccagaccg

SEQ ID NO: 1857030 - RNA, 22 nt, Salmonella typhimurium LT2
ccugcaggguuugcgcagacug

SEQ ID NO: 1857031 - RNA, 22 nt, Salmonella typhimurium LT2
ccugcaggcggugcgcagccac

SEQ ID NO: 1857032 - RNA, 17 nt, Salmonella typhimurium LT2
ccugcagggaauaagca

SEQ ID NO: 1857033 - RNA, 20 nt, Salmonella typhimurium LT2
ccugcagggaauaagcaccc

SEQ ID NO: 1857034 - RNA, 23 nt, Salmonella typhimurium LT2
ccugcacguuacccgccagucgg

SEQ ID NO: 1857035 - RNA, 15 nt, Salmonella typhimurium LT2
ccugcccuuucuuca

SEQ ID NO: 1857036 - RNA, 23 nt, Salmonella typhimurium LT2
ccugcccgccacccuccgggccg

SEQ ID NO: 1857037 - RNA, 17 nt, Salmonella typhimurium LT2
ccugccagcacagcggu

SEQ ID NO: 1857038 - RNA, 19 nt, Salmonella typhimurium LT2
ccugccagaauuuccgcuu

SEQ ID NO: 1857039 - RNA, 14 nt, Salmonella typhimurium LT2
ccugccagauaguu

SEQ ID NO: 1857040 - RNA, 21 nt, Salmonella typhimurium LT2
ccugcaguucguacuccugca

SEQ ID NO: 1857041 - RNA, 20 nt, Salmonella typhimurium LT2
ccugccacgcuuuuccuucc

SEQ ID NO: 1857042 - RNA, 23 nt, Salmonella typhimurium LT2
ccugcauacucacauucauaaaa

SEQ ID NO: 1857043 - RNA, 21 nt, Salmonella typhimurium LT2
ccugcgaaaagcgugcgccuu

SEQ ID NO: 1857044 - RNA, 17 nt, Salmonella typhimurium LT2
ccugcgaagaugagcca

SEQ ID NO: 1857045 - RNA, 21 nt, Salmonella typhimurium LT2
ccugcgaagaugagccacacg

SEQ ID NO: 1857046 - RNA, 19 nt, Salmonella typhimurium LT2
ccugcgacuuuuccaccac

SEQ ID NO: 1857047 - RNA, 13 nt, Salmonella typhimurium LT2
ccugccucaacau

SEQ ID NO: 1857048 - RNA, 20 nt, Salmonella typhimurium LT2
ccugccgucgcggcuuucag

SEQ ID NO: 1857049 - RNA, 10 nt, Salmonella typhimurium LT2
ccugccuguu

SEQ ID NO: 1857050 - RNA, 15 nt, Salmonella typhimurium LT2
ccugcucaagcugua

SEQ ID NO: 1857051 - RNA, 16 nt, Salmonella typhimurium LT2
ccugcgguaaacgcuc

SEQ ID NO: 1857052 - RNA, 17 nt, Salmonella typhimurium LT2
ccugcgguaaucgccgc

SEQ ID NO: 1857053 - RNA, 23 nt, Salmonella typhimurium LT2
ccugcggccaugaucgccgccau

SEQ ID NO: 1857054 - RNA, 17 nt, Salmonella typhimurium LT2
ccugcggcgcgcccggc

SEQ ID NO: 1857055 - RNA, 21 nt, Salmonella typhimurium LT2
ccugcgggcuuagggucagug

SEQ ID NO: 1857056 - RNA, 12 nt, Salmonella typhimurium LT2
ccugcucccaga

SEQ ID NO: 1857057 - RNA, 21 nt, Salmonella typhimurium LT2
ccugcugccagccgccgccgg

SEQ ID NO: 1857058 - RNA, 19 nt, Salmonella typhimurium LT2
ccugcuggucgccgcccau

SEQ ID NO: 1857059 - RNA, 21 nt, Salmonella typhimurium LT2
ccugcuggcgcuacguuuguc

SEQ ID NO: 1857060 - RNA, 16 nt, Salmonella typhimurium LT2
ccugcuggcaaaacgc

SEQ ID NO: 1857061 - RNA, 16 nt, Salmonella typhimurium LT2
ccugcugguuauuauc

SEQ ID NO: 1857062 - RNA, 22 nt, Salmonella typhimurium LT2
ccugcuguugcggaauacacga

SEQ ID NO: 1857063 - RNA, 23 nt, Salmonella typhimurium LT2
ccuggaaguugaagaaaaacccc

SEQ ID NO: 1857064 - RNA, 22 nt, Salmonella typhimurium LT2
ccuggaauagcgugggcagacc

SEQ ID NO: 1857065 - RNA, 18 nt, Salmonella typhimurium LT2
ccugcuuuuucagcgagg

SEQ ID NO: 1857066 - RNA, 20 nt, Salmonella typhimurium LT2
ccugcuuuuucaucauacug

SEQ ID NO: 1857067 - RNA, 17 nt, Salmonella typhimurium LT2
ccuggaaaaaagcgccc

SEQ ID NO: 1857068 - RNA, 20 nt, Salmonella typhimurium LT2
ccuggaauuaaucacaaugu

SEQ ID NO: 1857069 - RNA, 18 nt, Salmonella typhimurium LT2
ccuggagaucagcauggu

SEQ ID NO: 1857070 - RNA, 17 nt, Salmonella typhimurium LT2
ccuggagcguaagcgcg

SEQ ID NO: 1857071 - RNA, 22 nt, Salmonella typhimurium LT2
ccuggagagcagcgccagcgac

SEQ ID NO: 1857072 - RNA, 23 nt, Salmonella typhimurium LT2
ccuggauacguuccagcagcgca

SEQ ID NO: 1857073 - RNA, 11 nt, Salmonella typhimurium LT2
ccuggcaaagc

SEQ ID NO: 1857074 - RNA, 22 nt, Salmonella typhimurium LT2
ccuggauuagucugccauuucc

SEQ ID NO: 1857075 - RNA, 16 nt, Salmonella typhimurium LT2
ccuggcagguauuaau

SEQ ID NO: 1857076 - RNA, 21 nt, Salmonella typhimurium LT2
ccuggcagguauuaauccugc

SEQ ID NO: 1857077 - RNA, 16 nt, Salmonella typhimurium LT2
ccuggcagcuugccuu

SEQ ID NO: 1857078 - RNA, 16 nt, Salmonella typhimurium LT2
ccuggcagccgcguug

SEQ ID NO: 1857079 - RNA, 13 nt, Salmonella typhimurium LT2
ccuggcaguuuau

SEQ ID NO: 1857080 - RNA, 18 nt, Salmonella typhimurium LT2
ccuggccgauaugaauaa

SEQ ID NO: 1857081 - RNA, 19 nt, Salmonella typhimurium LT2
ccuggcgaucaucgcaggc

SEQ ID NO: 1857082 - RNA, 20 nt, Salmonella typhimurium LT2
ccuggccgguaaauuucacu

SEQ ID NO: 1857083 - RNA, 20 nt, Salmonella typhimurium LT2
ccuggcucaauccaggugga

SEQ ID NO: 1857084 - RNA, 21 nt, Salmonella typhimurium LT2
ccuggcguaguacgcgcgccg

SEQ ID NO: 1857085 - RNA, 20 nt, Salmonella typhimurium LT2
ccuggcguaugcuuucagca

SEQ ID NO: 1857086 - RNA, 19 nt, Salmonella typhimurium LT2
ccuggcuucaaccuccugc

SEQ ID NO: 1857087 - RNA, 20 nt, Salmonella typhimurium LT2
ccuggucuauucguucucug

SEQ ID NO: 1857088 - RNA, 20 nt, Salmonella typhimurium LT2
ccuggugcgggucaaaagcg

SEQ ID NO: 1857089 - RNA, 20 nt, Salmonella typhimurium LT2
ccuggugggguucccgagcg

SEQ ID NO: 1857090 - RNA, 17 nt, Salmonella typhimurium LT2
ccugggccgccacgacc

SEQ ID NO: 1857091 - RNA, 16 nt, Salmonella typhimurium LT2
ccuucacggucaaacg

SEQ ID NO: 1857092 - RNA, 22 nt, Salmonella typhimurium LT2
ccuucacguuauucggaaugau

SEQ ID NO: 1857093 - RNA, 23 nt, Salmonella typhimurium LT2
ccuucacauuggcaaaccccugc

SEQ ID NO: 1857094 - RNA, 18 nt, Salmonella typhimurium LT2
ccuucacacagugcgcga

SEQ ID NO: 1857095 - RNA, 14 nt, Salmonella typhimurium LT2
ccuucaccccuuca

SEQ ID NO: 1857096 - RNA, 12 nt, Salmonella typhimurium LT2
ccuucaccacuu

SEQ ID NO: 1857097 - RNA, 15 nt, Salmonella typhimurium LT2
ccuucacccagacug

SEQ ID NO: 1857098 - RNA, 17 nt, Salmonella typhimurium LT2
ccuuauccggccugccc

SEQ ID NO: 1857099 - RNA, 18 nt, Salmonella typhimurium LT2
ccuuacccggccuacauc

SEQ ID NO: 1857100 - RNA, 14 nt, Salmonella typhimurium LT2
ccuuacccggccug

SEQ ID NO: 1857101 - RNA, 17 nt, Salmonella typhimurium LT2
ccuuacccggccugcgu

SEQ ID NO: 1857102 - RNA, 21 nt, Salmonella typhimurium LT2
ccuuaugcucauugccuuuca

SEQ ID NO: 1857103 - RNA, 18 nt, Salmonella typhimurium LT2
ccuuauucgguuuauccc

SEQ ID NO: 1857104 - RNA, 12 nt, Salmonella typhimurium LT2
ccuuauucaggc

SEQ ID NO: 1857105 - RNA, 18 nt, Salmonella typhimurium LT2
ccuuaucgcagucagccu

SEQ ID NO: 1857106 - RNA, 15 nt, Salmonella typhimurium LT2
ccuuaucgagaauac

SEQ ID NO: 1857107 - RNA, 17 nt, Salmonella typhimurium LT2
ccuguaccgggcagaca

SEQ ID NO: 1857108 - RNA, 19 nt, Salmonella typhimurium LT2
ccuguacccgguacuuucu

SEQ ID NO: 1857109 - RNA, 21 nt, Salmonella typhimurium LT2
ccuguacccgguacuuucucc

SEQ ID NO: 1857110 - RNA, 24 nt, Salmonella typhimurium LT2
ccuuaauuugugauugcagauaau

SEQ ID NO: 1857111 - RNA, 12 nt, Salmonella typhimurium LT2
ccuuacaaaaau

SEQ ID NO: 1857112 - RNA, 17 nt, Salmonella typhimurium LT2
ccuucgcgcgauaauac

SEQ ID NO: 1857113 - RNA, 22 nt, Salmonella typhimurium LT2
ccuucuguacgcugaacaaccc

SEQ ID NO: 1857114 - RNA, 14 nt, Salmonella typhimurium LT2
ccuucuucgccaac

SEQ ID NO: 1857115 - RNA, 18 nt, Salmonella typhimurium LT2
ccuucuucaucuucaccu

SEQ ID NO: 1857116 - RNA, 17 nt, Salmonella typhimurium LT2
ccuucuucauauuugcu

SEQ ID NO: 1857117 - RNA, 17 nt, Salmonella typhimurium LT2
ccuucgaagaauuccac

SEQ ID NO: 1857118 - RNA, 22 nt, Salmonella typhimurium LT2
ccuucgcauauuguaccugccg

SEQ ID NO: 1857119 - RNA, 14 nt, Salmonella typhimurium LT2
ccuucgccgccgcu

SEQ ID NO: 1857120 - RNA, 14 nt, Salmonella typhimurium LT2
ccuucgaucaugcc

SEQ ID NO: 1857121 - RNA, 12 nt, Salmonella typhimurium LT2
ccuucauaaaua

SEQ ID NO: 1857122 - RNA, 18 nt, Salmonella typhimurium LT2
ccuuccuccaccaccauc

SEQ ID NO: 1857123 - RNA, 20 nt, Salmonella typhimurium LT2
ccuuccguauugagcagcgg

SEQ ID NO: 1857124 - RNA, 13 nt, Salmonella typhimurium LT2
ccuucaggcauca

SEQ ID NO: 1857125 - RNA, 13 nt, Salmonella typhimurium LT2
ccuuugucaucca

SEQ ID NO: 1857126 - RNA, 22 nt, Salmonella typhimurium LT2
ccuuuggccuggagaucagcau

SEQ ID NO: 1857127 - RNA, 20 nt, Salmonella typhimurium LT2
ccuuucggggcggauuuuuu

SEQ ID NO: 1857128 - RNA, 15 nt, Salmonella typhimurium LT2
ccuuugccuucgccg

SEQ ID NO: 1857129 - RNA, 12 nt, Salmonella typhimurium LT2
ccuuugccuuuc

SEQ ID NO: 1857130 - RNA, 24 nt, Salmonella typhimurium LT2
ccuuugcgcgcgauauccaccuga

SEQ ID NO: 1857131 - RNA, 23 nt, Salmonella typhimurium LT2
ccuuuggaggagagcgucaugaa

SEQ ID NO: 1857132 - RNA, 14 nt, Salmonella typhimurium LT2
ccuuuggccaccag

SEQ ID NO: 1857133 - RNA, 19 nt, Salmonella typhimurium LT2
ccuuucgugcacuucaugc

SEQ ID NO: 1857134 - RNA, 16 nt, Salmonella typhimurium LT2
ccuuucgcaaauggca

SEQ ID NO: 1857135 - RNA, 16 nt, Salmonella typhimurium LT2
ccuuucagacuucaau

SEQ ID NO: 1857136 - RNA, 22 nt, Salmonella typhimurium LT2
ccuuuaacgccuucauauuaaa

SEQ ID NO: 1857137 - RNA, 17 nt, Salmonella typhimurium LT2
ccuuuacuguugccuuu

SEQ ID NO: 1857138 - RNA, 20 nt, Salmonella typhimurium LT2
ccuuuacuauagauauuaaa

SEQ ID NO: 1857139 - RNA, 21 nt, Salmonella typhimurium LT2
ccuuuaauuccgccgggcaac

SEQ ID NO: 1857140 - RNA, 12 nt, Salmonella typhimurium LT2
ccuuuacaaucg

SEQ ID NO: 1857141 - RNA, 16 nt, Salmonella typhimurium LT2
ccuuuacccaccagcc

SEQ ID NO: 1857142 - RNA, 22 nt, Salmonella typhimurium LT2
ccuuuaccccucuuucacagcu

SEQ ID NO: 1857143 - RNA, 22 nt, Salmonella typhimurium LT2
ccuuuauauuuuucccuggccg

SEQ ID NO: 1857144 - RNA, 17 nt, Salmonella typhimurium LT2
ccuuucaccaucagcau

SEQ ID NO: 1857145 - RNA, 18 nt, Salmonella typhimurium LT2
ccuuucaaaaaagagaag

SEQ ID NO: 1857146 - RNA, 22 nt, Salmonella typhimurium LT2
ccuuguucaauagagcgcagca

SEQ ID NO: 1857147 - RNA, 20 nt, Salmonella typhimurium LT2
ccuuguuauccuaaaucugc

SEQ ID NO: 1857148 - RNA, 14 nt, Salmonella typhimurium LT2
ccuuguaagggagg

SEQ ID NO: 1857149 - RNA, 23 nt, Salmonella typhimurium LT2
ccuuguaacgggugaucuuuaua

SEQ ID NO: 1857150 - RNA, 16 nt, Salmonella typhimurium LT2
ccuugcgguugcagca

SEQ ID NO: 1857151 - RNA, 20 nt, Salmonella typhimurium LT2
ccuugacaggaaacagguac

SEQ ID NO: 1857152 - RNA, 17 nt, Salmonella typhimurium LT2
ccuugacgauaugcugc

SEQ ID NO: 1857153 - RNA, 21 nt, Salmonella typhimurium LT2
ccuugcuggccuguucaagug

SEQ ID NO: 1857154 - RNA, 20 nt, Salmonella typhimurium LT2
cgacggugaugacccgcagc

SEQ ID NO: 1857155 - RNA, 21 nt, Salmonella typhimurium LT2
cgacggucuuuuucgacggca

SEQ ID NO: 1857156 - RNA, 13 nt, Salmonella typhimurium LT2
cgacggcaggcgg

SEQ ID NO: 1857157 - RNA, 15 nt, Salmonella typhimurium LT2
cgacggccaguugcu

SEQ ID NO: 1857158 - RNA, 17 nt, Salmonella typhimurium LT2
cgacggccaguugcuuc

SEQ ID NO: 1857159 - RNA, 16 nt, Salmonella typhimurium LT2
cgacgcuuaucagccc

SEQ ID NO: 1857160 - RNA, 18 nt, Salmonella typhimurium LT2
cgacgcuuaccgcgucuu

SEQ ID NO: 1857161 - RNA, 12 nt, Salmonella typhimurium LT2
cgacgcucauua

SEQ ID NO: 1857162 - RNA, 18 nt, Salmonella typhimurium LT2
cgacgccgucucuuuuug

SEQ ID NO: 1857163 - RNA, 16 nt, Salmonella typhimurium LT2
cgacgccuuucuucac

SEQ ID NO: 1857164 - RNA, 13 nt, Salmonella typhimurium LT2
cgacgccuucuuc

SEQ ID NO: 1857165 - RNA, 20 nt, Salmonella typhimurium LT2
cgacgcccugcccaugaagc

SEQ ID NO: 1857166 - RNA, 15 nt, Salmonella typhimurium LT2
cgacgaucagcgcca

SEQ ID NO: 1857167 - RNA, 20 nt, Salmonella typhimurium LT2
cgacgagguuuccggcggga

SEQ ID NO: 1857168 - RNA, 22 nt, Salmonella typhimurium LT2
cgacgagguuuccggcgggagc

SEQ ID NO: 1857169 - RNA, 13 nt, Salmonella typhimurium LT2
cgacgacuucacc

SEQ ID NO: 1857170 - RNA, 17 nt, Salmonella typhimurium LT2
cgacgccauuccccagc

SEQ ID NO: 1857171 - RNA, 17 nt, Salmonella typhimurium LT2
cgacgcauuucuccuga

SEQ ID NO: 1857172 - RNA, 18 nt, Salmonella typhimurium LT2
cgacgccaaacccgccac

SEQ ID NO: 1857173 - RNA, 13 nt, Salmonella typhimurium LT2
cgacgccaaccgc

SEQ ID NO: 1857174 - RNA, 12 nt, Salmonella typhimurium LT2
cgaccugcagcu

SEQ ID NO: 1857175 - RNA, 13 nt, Salmonella typhimurium LT2
cgaccaauauccg

SEQ ID NO: 1857176 - RNA, 17 nt, Salmonella typhimurium LT2
cgacaugucaugacuua

SEQ ID NO: 1857177 - RNA, 17 nt, Salmonella typhimurium LT2
cgacaucuuuuccugaa

SEQ ID NO: 1857178 - RNA, 21 nt, Salmonella typhimurium LT2
cgacaugcgcaugugaguauc

SEQ ID NO: 1857179 - RNA, 20 nt, Salmonella typhimurium LT2
cgacaucugcacauacgcca

SEQ ID NO: 1857180 - RNA, 15 nt, Salmonella typhimurium LT2
cgaccacuagcgccg

SEQ ID NO: 1857181 - RNA, 13 nt, Salmonella typhimurium LT2
cgaccacgccacc

SEQ ID NO: 1857182 - RNA, 16 nt, Salmonella typhimurium LT2
cgaccaggaucagacc

SEQ ID NO: 1857183 - RNA, 20 nt, Salmonella typhimurium LT2
cgaccaugguucccgccacu

SEQ ID NO: 1857184 - RNA, 17 nt, Salmonella typhimurium LT2
cgaccacuucaacgccg

SEQ ID NO: 1857185 - RNA, 15 nt, Salmonella typhimurium LT2
cgaccagauaucccg

SEQ ID NO: 1857186 - RNA, 18 nt, Salmonella typhimurium LT2
cgaccagagauaccuuug

SEQ ID NO: 1857187 - RNA, 13 nt, Salmonella typhimurium LT2
cgaccagccugcc

SEQ ID NO: 1857188 - RNA, 18 nt, Salmonella typhimurium LT2
cgacccccaccaugucaa

SEQ ID NO: 1857189 - RNA, 11 nt, Salmonella typhimurium LT2
cgaccgccaua

SEQ ID NO: 1857190 - RNA, 16 nt, Salmonella typhimurium LT2
cgaccgaucaucaucc

SEQ ID NO: 1857191 - RNA, 22 nt, Salmonella typhimurium LT2
cgacccggcguuuucagaucca

SEQ ID NO: 1857192 - RNA, 15 nt, Salmonella typhimurium LT2
cgaccuacaagauuu

SEQ ID NO: 1857193 - RNA, 14 nt, Salmonella typhimurium LT2
cgaccguuuccgcc

SEQ ID NO: 1857194 - RNA, 20 nt, Salmonella typhimurium LT2
cgaccggcacucaccucuuc

SEQ ID NO: 1857195 - RNA, 13 nt, Salmonella typhimurium LT2
cgaccggcagccg

SEQ ID NO: 1857196 - RNA, 21 nt, Salmonella typhimurium LT2
cgaccggauuggucugauuca

SEQ ID NO: 1857197 - RNA, 16 nt, Salmonella typhimurium LT2
cgaacuucauccacgc

SEQ ID NO: 1857198 - RNA, 15 nt, Salmonella typhimurium LT2
cgaacugauggcgcu

SEQ ID NO: 1857199 - RNA, 19 nt, Salmonella typhimurium LT2
cgaaccuuaagcgcgaaau

SEQ ID NO: 1857200 - RNA, 19 nt, Salmonella typhimurium LT2
ccuuuuucauccucaacca

SEQ ID NO: 1857201 - RNA, 20 nt, Salmonella typhimurium LT2
ccuuuuuauggcccgccagc

SEQ ID NO: 1857202 - RNA, 15 nt, Salmonella typhimurium LT2
ccuuuuucaacagca

SEQ ID NO: 1857203 - RNA, 19 nt, Salmonella typhimurium LT2
cgaacgccaacucaacgcc

SEQ ID NO: 1857204 - RNA, 15 nt, Salmonella typhimurium LT2
cgaacgccaggccaa

SEQ ID NO: 1857205 - RNA, 14 nt, Salmonella typhimurium LT2
cgaacuccagcgcg

SEQ ID NO: 1857206 - RNA, 19 nt, Salmonella typhimurium LT2
cgaauccccaucuccagac

SEQ ID NO: 1857207 - RNA, 17 nt, Salmonella typhimurium LT2
cgaaucauguuuuucuc

SEQ ID NO: 1857208 - RNA, 18 nt, Salmonella typhimurium LT2
cgaaucacauccgccagc

SEQ ID NO: 1857209 - RNA, 16 nt, Salmonella typhimurium LT2
cgaauaacaaaaugag

SEQ ID NO: 1857210 - RNA, 22 nt, Salmonella typhimurium LT2
cgaauaacaaaaugagauugau

SEQ ID NO: 1857211 - RNA, 17 nt, Salmonella typhimurium LT2
cgaaguuuucuucuucg

SEQ ID NO: 1857212 - RNA, 15 nt, Salmonella typhimurium LT2
cgaauaucuuuaucc

SEQ ID NO: 1857213 - RNA, 13 nt, Salmonella typhimurium LT2
cgaaguggugggu

SEQ ID NO: 1857214 - RNA, 17 nt, Salmonella typhimurium LT2
cgaaguucauaaaugua

SEQ ID NO: 1857215 - RNA, 16 nt, Salmonella typhimurium LT2
cgaauccuccuguuga

SEQ ID NO: 1857216 - RNA, 19 nt, Salmonella typhimurium LT2
cgaaucgaauacagcgccu

SEQ ID NO: 1857217 - RNA, 21 nt, Salmonella typhimurium LT2
cgaaucgacaauccgccacgc

SEQ ID NO: 1857218 - RNA, 21 nt, Salmonella typhimurium LT2
cgaauccuucccccaccacca

SEQ ID NO: 1857219 - RNA, 23 nt, Salmonella typhimurium LT2
cgaauccuucccccaccaccauu

SEQ ID NO: 1857220 - RNA, 23 nt, Salmonella typhimurium LT2
cgaaugcuggggcggcgccaccu

SEQ ID NO: 1857221 - RNA, 18 nt, Salmonella typhimurium LT2
cgaaugcgccagcgagac

SEQ ID NO: 1857222 - RNA, 16 nt, Salmonella typhimurium LT2
cgaaugugcuuaucac

SEQ ID NO: 1857223 - RNA, 17 nt, Salmonella typhimurium LT2
cgacagggcgugaacca

SEQ ID NO: 1857224 - RNA, 21 nt, Salmonella typhimurium LT2
cgacaggcguaaaaccgcgcu

SEQ ID NO: 1857225 - RNA, 19 nt, Salmonella typhimurium LT2
cgacaggguuugccagcac

SEQ ID NO: 1857226 - RNA, 21 nt, Salmonella typhimurium LT2
cgacaggguuugccagcacca

SEQ ID NO: 1857227 - RNA, 14 nt, Salmonella typhimurium LT2
cgacaguaacugca

SEQ ID NO: 1857228 - RNA, 16 nt, Salmonella typhimurium LT2
cgacaguaccagcaga

SEQ ID NO: 1857229 - RNA, 17 nt, Salmonella typhimurium LT2
cgacaucagccagccgc

SEQ ID NO: 1857230 - RNA, 15 nt, Salmonella typhimurium LT2
cgacaucgccaccgc

SEQ ID NO: 1857231 - RNA, 14 nt, Salmonella typhimurium LT2
cgacaucagccagc

SEQ ID NO: 1857232 - RNA, 12 nt, Salmonella typhimurium LT2
cgacaucagaug

SEQ ID NO: 1857233 - RNA, 15 nt, Salmonella typhimurium LT2
cgacauagccuuugu

SEQ ID NO: 1857234 - RNA, 21 nt, Salmonella typhimurium LT2
cgacauaagcugcgacaacaa

SEQ ID NO: 1857235 - RNA, 15 nt, Salmonella typhimurium LT2
cgacagccaguaaug

SEQ ID NO: 1857236 - RNA, 22 nt, Salmonella typhimurium LT2
cgacagccauaccggcgcgcgc

SEQ ID NO: 1857237 - RNA, 20 nt, Salmonella typhimurium LT2
cgacagcccgccagcauaca

SEQ ID NO: 1857238 - RNA, 17 nt, Salmonella typhimurium LT2
cgacagccaggagucua

SEQ ID NO: 1857239 - RNA, 11 nt, Salmonella typhimurium LT2
cgacagcgcca

SEQ ID NO: 1857240 - RNA, 19 nt, Salmonella typhimurium LT2
cgacagauuggucagcagc

SEQ ID NO: 1857241 - RNA, 18 nt, Salmonella typhimurium LT2
cgacagauagcccugauc

SEQ ID NO: 1857242 - RNA, 23 nt, Salmonella typhimurium LT2
cgacagaauaugcauauucauau

SEQ ID NO: 1857243 - RNA, 18 nt, Salmonella typhimurium LT2
cgacacggcgcagauauu

SEQ ID NO: 1857244 - RNA, 22 nt, Salmonella typhimurium LT2
cgacacgcgcgcugcgccugga

SEQ ID NO: 1857245 - RNA, 21 nt, Salmonella typhimurium LT2
cgacacgcgcgcugcgccugg

SEQ ID NO: 1857246 - RNA, 15 nt, Salmonella typhimurium LT2
cgacacuccgcgcau

SEQ ID NO: 1857247 - RNA, 15 nt, Salmonella typhimurium LT2
cgacaacaaguccaa

SEQ ID NO: 1857248 - RNA, 20 nt, Salmonella typhimurium LT2
cgacaaagccaacgccgccc

SEQ ID NO: 1857249 - RNA, 13 nt, Salmonella typhimurium LT2
cgacaaauccucc

SEQ ID NO: 1857250 - RNA, 18 nt, Salmonella typhimurium LT2
cgacaaaccacugcugua

SEQ ID NO: 1857251 - RNA, 23 nt, Salmonella typhimurium LT2
cgacaaaacuuuuggugcccauc

SEQ ID NO: 1857252 - RNA, 15 nt, Salmonella typhimurium LT2
cgaauuucaucaguu

SEQ ID NO: 1857253 - RNA, 17 nt, Salmonella typhimurium LT2
cgaauuugccccagaua

SEQ ID NO: 1857254 - RNA, 22 nt, Salmonella typhimurium LT2
cgaauuuagcacccaggauggc

SEQ ID NO: 1857255 - RNA, 22 nt, Salmonella typhimurium LT2
cgaauucguccacacgccuggc

SEQ ID NO: 1857256 - RNA, 14 nt, Salmonella typhimurium LT2
cgacacaucaucgc

SEQ ID NO: 1857257 - RNA, 19 nt, Salmonella typhimurium LT2
cgacacccgauacacgccg

SEQ ID NO: 1857258 - RNA, 22 nt, Salmonella typhimurium LT2
cgacaagcuaauccccagcgcu

SEQ ID NO: 1857259 - RNA, 23 nt, Salmonella typhimurium LT2
cgacaagccccccgcacagcaca

SEQ ID NO: 1857260 - RNA, 17 nt, Salmonella typhimurium LT2
cgacaauguccgccaga

SEQ ID NO: 1857261 - RNA, 13 nt, Salmonella typhimurium LT2
ccgguauccagcg

SEQ ID NO: 1857262 - RNA, 23 nt, Salmonella typhimurium LT2
ccgguaugacgcuugagcgccuu

SEQ ID NO: 1857263 - RNA, 19 nt, Salmonella typhimurium LT2
ccgguagcuucagcggcgc

SEQ ID NO: 1857264 - RNA, 15 nt, Salmonella typhimurium LT2
ccgguagccagccaa

SEQ ID NO: 1857265 - RNA, 21 nt, Salmonella typhimurium LT2
ccggucgcgccagcgaccacc

SEQ ID NO: 1857266 - RNA, 19 nt, Salmonella typhimurium LT2
ccggugcggcaagcgcgcu

SEQ ID NO: 1857267 - RNA, 16 nt, Salmonella typhimurium LT2
ccgguggcgcugcgcu

SEQ ID NO: 1857268 - RNA, 16 nt, Salmonella typhimurium LT2
ccgguggcgccgcgcc

SEQ ID NO: 1857269 - RNA, 19 nt, Salmonella typhimurium LT2
ccggugccauuccagccgg

SEQ ID NO: 1857270 - RNA, 20 nt, Salmonella typhimurium LT2
ccggugauggugcagccccg

SEQ ID NO: 1857271 - RNA, 12 nt, Salmonella typhimurium LT2
ccggucggcgca

SEQ ID NO: 1857272 - RNA, 21 nt, Salmonella typhimurium LT2
ccggguauuucugaaaaaccg

SEQ ID NO: 1857273 - RNA, 23 nt, Salmonella typhimurium LT2
ccggguaggacauagccgccacc

SEQ ID NO: 1857274 - RNA, 21 nt, Salmonella typhimurium LT2
ccgggucagaaaagcuucguu

SEQ ID NO: 1857275 - RNA, 21 nt, Salmonella typhimurium LT2
ccgggcugaacgccaggccgu

SEQ ID NO: 1857276 - RNA, 23 nt, Salmonella typhimurium LT2
ccgggcucauuuuauccaacagc

SEQ ID NO: 1857277 - RNA, 16 nt, Salmonella typhimurium LT2
ccgggcgucacccgcc

SEQ ID NO: 1857278 - RNA, 15 nt, Salmonella typhimurium LT2
ccgggcgcccggccu

SEQ ID NO: 1857279 - RNA, 12 nt, Salmonella typhimurium LT2
ccggguggcggc

SEQ ID NO: 1857280 - RNA, 15 nt, Salmonella typhimurium LT2
ccgguaacguaaaua

SEQ ID NO: 1857281 - RNA, 22 nt, Salmonella typhimurium LT2
ccgguaauaauuggcauccagc

SEQ ID NO: 1857282 - RNA, 18 nt, Salmonella typhimurium LT2
ccgguaaagcagugcagu

SEQ ID NO: 1857283 - RNA, 21 nt, Salmonella typhimurium LT2
ccgguaaauuucacuucgccc

SEQ ID NO: 1857284 - RNA, 16 nt, Salmonella typhimurium LT2
ccgguaaacaugcugg

SEQ ID NO: 1857285 - RNA, 22 nt, Salmonella typhimurium LT2
ccgguaaacgcuccggcaggca

SEQ ID NO: 1857286 - RNA, 15 nt, Salmonella typhimurium LT2
ccggcuggcuauagu

SEQ ID NO: 1857287 - RNA, 15 nt, Salmonella typhimurium LT2
ccgggcaaacagcac

SEQ ID NO: 1857288 - RNA, 20 nt, Salmonella typhimurium LT2
ccggcugcgucgcuuccugu

SEQ ID NO: 1857289 - RNA, 15 nt, Salmonella typhimurium LT2
ccggcugccauuauc

SEQ ID NO: 1857290 - RNA, 12 nt, Salmonella typhimurium LT2
ccgggccacucu

SEQ ID NO: 1857291 - RNA, 18 nt, Salmonella typhimurium LT2
ccgggccgacaggcggca

SEQ ID NO: 1857292 - RNA, 20 nt, Salmonella typhimurium LT2
ccgggccgacaggcggcagc

SEQ ID NO: 1857293 - RNA, 13 nt, Salmonella typhimurium LT2
ccgggcgaccacc

SEQ ID NO: 1857294 - RNA, 18 nt, Salmonella typhimurium LT2
ccgggcgacacgcgcgcu

SEQ ID NO: 1857295 - RNA, 17 nt, Salmonella typhimurium LT2
ccgggccaaugccgccu

SEQ ID NO: 1857296 - RNA, 13 nt, Salmonella typhimurium LT2
ccgggccaaugcc

SEQ ID NO: 1857297 - RNA, 13 nt, Salmonella typhimurium LT2
ccgggcauggcuc

SEQ ID NO: 1857298 - RNA, 22 nt, Salmonella typhimurium LT2
ccgggcagcaucucgauuacag

SEQ ID NO: 1857299 - RNA, 18 nt, Salmonella typhimurium LT2
aaaccuaaauaaauacca

SEQ ID NO: 1857300 - RNA, 18 nt, Salmonella typhimurium LT2
ccggcgcagcaucugcgg

SEQ ID NO: 1857301 - RNA, 17 nt, Salmonella typhimurium LT2
ccggcggcgacuggcua

SEQ ID NO: 1857302 - RNA, 14 nt, Salmonella typhimurium LT2
ccggcgcagacggc

SEQ ID NO: 1857303 - RNA, 18 nt, Salmonella typhimurium LT2
ccggcguaauugcgccug

SEQ ID NO: 1857304 - RNA, 22 nt, Salmonella typhimurium LT2
ccggcgugaugcguaccgcgcu

SEQ ID NO: 1857305 - RNA, 19 nt, Salmonella typhimurium LT2
aaaccgccguuuugauuug

SEQ ID NO: 1857306 - RNA, 23 nt, Salmonella typhimurium LT2
ccggcgucccuuucccuuccagc

SEQ ID NO: 1857307 - RNA, 14 nt, Salmonella typhimurium LT2
ccggcguccggcgc

SEQ ID NO: 1857308 - RNA, 21 nt, Salmonella typhimurium LT2
ccggcgucucgcacucgccgc

SEQ ID NO: 1857309 - RNA, 19 nt, Salmonella typhimurium LT2
ccggcguuuuuagugacag

SEQ ID NO: 1857310 - RNA, 22 nt, Salmonella typhimurium LT2
ccggcguuuuugugucgaaccc

SEQ ID NO: 1857311 - RNA, 22 nt, Salmonella typhimurium LT2
ccggcuaacaacguuacgccag

SEQ ID NO: 1857312 - RNA, 22 nt, Salmonella typhimurium LT2
ccggcguuucguuuagcgccug

SEQ ID NO: 1857313 - RNA, 21 nt, Salmonella typhimurium LT2
ccggcaucauucugcaggcgg

SEQ ID NO: 1857314 - RNA, 20 nt, Salmonella typhimurium LT2
ccggcaugauggcgaacagc

SEQ ID NO: 1857315 - RNA, 22 nt, Salmonella typhimurium LT2
ccggcaucucaucuugcaagaa

SEQ ID NO: 1857316 - RNA, 17 nt, Salmonella typhimurium LT2
ccggcgaauagcgccag

SEQ ID NO: 1857317 - RNA, 19 nt, Salmonella typhimurium LT2
ccggcgaacgcuggcuggg

SEQ ID NO: 1857318 - RNA, 20 nt, Salmonella typhimurium LT2
ccggcgaaaucgugcgcccc

SEQ ID NO: 1857319 - RNA, 22 nt, Salmonella typhimurium LT2
ccggcaguuauuuuacgggcgu

SEQ ID NO: 1857320 - RNA, 19 nt, Salmonella typhimurium LT2
ccggcaucacaaaccagac

SEQ ID NO: 1857321 - RNA, 19 nt, Salmonella typhimurium LT2
ccggcagguagucauauuc

SEQ ID NO: 1857322 - RNA, 20 nt, Salmonella typhimurium LT2
ccggcaggcagcgccagcgg

SEQ ID NO: 1857323 - RNA, 20 nt, Salmonella typhimurium LT2
ccggcagcgucguccagccc

SEQ ID NO: 1857324 - RNA, 21 nt, Salmonella typhimurium LT2
ccggcaauuaccgccagcggc

SEQ ID NO: 1857325 - RNA, 14 nt, Salmonella typhimurium LT2
ccggcacacagaau

SEQ ID NO: 1857326 - RNA, 18 nt, Salmonella typhimurium LT2
ccggcacuguucggggau

SEQ ID NO: 1857327 - RNA, 18 nt, Salmonella typhimurium LT2
ccggcacuggcgcuggcu

SEQ ID NO: 1857328 - RNA, 20 nt, Salmonella typhimurium LT2
ccggcacugcgccuugcccc

SEQ ID NO: 1857329 - RNA, 18 nt, Salmonella typhimurium LT2
ccggcacggucaaucauc

SEQ ID NO: 1857330 - RNA, 18 nt, Salmonella typhimurium LT2
ccgcuuuaccgccuuccu

SEQ ID NO: 1857331 - RNA, 12 nt, Salmonella typhimurium LT2
ccgcuuuuccug

SEQ ID NO: 1857332 - RNA, 16 nt, Salmonella typhimurium LT2
ccgcuuugcgaacagc

SEQ ID NO: 1857333 - RNA, 16 nt, Salmonella typhimurium LT2
ccgcuuugccgcgcuc

SEQ ID NO: 1857334 - RNA, 16 nt, Salmonella typhimurium LT2
ccgcuuuuuccgccgc

SEQ ID NO: 1857335 - RNA, 17 nt, Salmonella typhimurium LT2
ccgcuuuuuccgccgcc

SEQ ID NO: 1857336 - RNA, 21 nt, Salmonella typhimurium LT2
ccgcuuuugguuuuucaacca

SEQ ID NO: 1857337 - RNA, 12 nt, Salmonella typhimurium LT2
ccgcuuuuuaau

SEQ ID NO: 1857338 - RNA, 14 nt, Salmonella typhimurium LT2
ccggacaaggcggu

SEQ ID NO: 1857339 - RNA, 16 nt, Salmonella typhimurium LT2
ccggacagagugucua

SEQ ID NO: 1857340 - RNA, 11 nt, Salmonella typhimurium LT2
ccggaccuaau

SEQ ID NO: 1857341 - RNA, 21 nt, Salmonella typhimurium LT2
ccggaccuaauaaccagcccc

SEQ ID NO: 1857342 - RNA, 14 nt, Salmonella typhimurium LT2
ccgcuucacacugg

SEQ ID NO: 1857343 - RNA, 18 nt, Salmonella typhimurium LT2
ccgcuguuuuucaucauc

SEQ ID NO: 1857344 - RNA, 19 nt, Salmonella typhimurium LT2
ccgcuuaaguugccgccgc

SEQ ID NO: 1857345 - RNA, 12 nt, Salmonella typhimurium LT2
ccgcuuccagcg

SEQ ID NO: 1857346 - RNA, 18 nt, Salmonella typhimurium LT2
ccgcuuccagcgcgucgg

SEQ ID NO: 1857347 - RNA, 17 nt, Salmonella typhimurium LT2
ccggacggcgcagcgcg

SEQ ID NO: 1857348 - RNA, 16 nt, Salmonella typhimurium LT2
ccggacgcaucgccgg

SEQ ID NO: 1857349 - RNA, 21 nt, Salmonella typhimurium LT2
ccggauacucgacgcacucca

SEQ ID NO: 1857350 - RNA, 14 nt, Salmonella typhimurium LT2
ccggauauucggug

SEQ ID NO: 1857351 - RNA, 12 nt, Salmonella typhimurium LT2
ccggaugacaca

SEQ ID NO: 1857352 - RNA, 18 nt, Salmonella typhimurium LT2
ccggaucgcuaauuuuua

SEQ ID NO: 1857353 - RNA, 16 nt, Salmonella typhimurium LT2
ccggaugcaccaucuc

SEQ ID NO: 1857354 - RNA, 16 nt, Salmonella typhimurium LT2
ccggaugcgccucauc

SEQ ID NO: 1857355 - RNA, 15 nt, Salmonella typhimurium LT2
ccggaugcgacgcgc

SEQ ID NO: 1857356 - RNA, 15 nt, Salmonella typhimurium LT2
ccggaugcgacucca

SEQ ID NO: 1857357 - RNA, 20 nt, Salmonella typhimurium LT2
ccggaugcgacuccaggaac

SEQ ID NO: 1857358 - RNA, 13 nt, Salmonella typhimurium LT2
ccggauuuaccag

SEQ ID NO: 1857359 - RNA, 22 nt, Salmonella typhimurium LT2
ccggauuaaggcguuugcgccg

SEQ ID NO: 1857360 - RNA, 14 nt, Salmonella typhimurium LT2
ccggauuccagaau

SEQ ID NO: 1857361 - RNA, 21 nt, Salmonella typhimurium LT2
ccggauggcggcggaaaggac

SEQ ID NO: 1857362 - RNA, 23 nt, Salmonella typhimurium LT2
ccggauggcggcauaaacgccuu

SEQ ID NO: 1857363 - RNA, 17 nt, Salmonella typhimurium LT2
ccggauggagcggcgcu

SEQ ID NO: 1857364 - RNA, 13 nt, Salmonella typhimurium LT2
ccggaugcggcua

SEQ ID NO: 1857365 - RNA, 13 nt, Salmonella typhimurium LT2
ccggauuuuaaau

SEQ ID NO: 1857366 - RNA, 22 nt, Salmonella typhimurium LT2
ccggcaaacgggcgaccgucgg

SEQ ID NO: 1857367 - RNA, 18 nt, Salmonella typhimurium LT2
ccggcaaagaagcuuaca

SEQ ID NO: 1857368 - RNA, 24 nt, Salmonella typhimurium LT2
ccggcaacagguaccccgccaccg

SEQ ID NO: 1857369 - RNA, 18 nt, Salmonella typhimurium LT2
ccuacacaaaaucauucg

SEQ ID NO: 1857370 - RNA, 19 nt, Salmonella typhimurium LT2
ccuacaaauuacacaauau

SEQ ID NO: 1857371 - RNA, 18 nt, Salmonella typhimurium LT2
ccuacucucgcaugggga

SEQ ID NO: 1857372 - RNA, 15 nt, Salmonella typhimurium LT2
ccuacggugugccug

SEQ ID NO: 1857373 - RNA, 20 nt, Salmonella typhimurium LT2
ccuagaugaaugacugucca

SEQ ID NO: 1857374 - RNA, 21 nt, Salmonella typhimurium LT2
ccuagaugaaugacuguccac

SEQ ID NO: 1857375 - RNA, 16 nt, Salmonella typhimurium LT2
ccuaccagcacaugau

SEQ ID NO: 1857376 - RNA, 11 nt, Salmonella typhimurium LT2
ccuaccgccau

SEQ ID NO: 1857377 - RNA, 20 nt, Salmonella typhimurium LT2
ccuacgcugacgcgaucgcc

SEQ ID NO: 1857378 - RNA, 15 nt, Salmonella typhimurium LT2
ccuacgcgccacguc

SEQ ID NO: 1857379 - RNA, 18 nt, Salmonella typhimurium LT2
ccuacgccaagcaccuag

SEQ ID NO: 1857380 - RNA, 19 nt, Salmonella typhimurium LT2
ccuacgauuucgcucgcuu

SEQ ID NO: 1857381 - RNA, 14 nt, Salmonella typhimurium LT2
ccuauaacagcgcc

SEQ ID NO: 1857382 - RNA, 11 nt, Salmonella typhimurium LT2
ccuauaaugcg

SEQ ID NO: 1857383 - RNA, 22 nt, Salmonella typhimurium LT2
ccuaucaggcguugaccgcuuc

SEQ ID NO: 1857384 - RNA, 19 nt, Salmonella typhimurium LT2
ccucaaucggcgauaaacc

SEQ ID NO: 1857385 - RNA, 20 nt, Salmonella typhimurium LT2
ccucaaugguuucacgcucu

SEQ ID NO: 1857386 - RNA, 20 nt, Salmonella typhimurium LT2
ccucacacugauggcagacc

SEQ ID NO: 1857387 - RNA, 22 nt, Salmonella typhimurium LT2
ccucaagugucgauaaccugga

SEQ ID NO: 1857388 - RNA, 23 nt, Salmonella typhimurium LT2
ccuauuucaguacagccaaaaau

SEQ ID NO: 1857389 - RNA, 18 nt, Salmonella typhimurium LT2
ccuauuuuaaauucccag

SEQ ID NO: 1857390 - RNA, 19 nt, Salmonella typhimurium LT2
ccuauuuuaaauucccagc

SEQ ID NO: 1857391 - RNA, 14 nt, Salmonella typhimurium LT2
ccuauuuugcgccu

SEQ ID NO: 1857392 - RNA, 14 nt, Salmonella typhimurium LT2
ccuauuuugcaaaa

SEQ ID NO: 1857393 - RNA, 19 nt, Salmonella typhimurium LT2
ccucagcaaugauuuuuag

SEQ ID NO: 1857394 - RNA, 12 nt, Salmonella typhimurium LT2
ccucagcaaaac

SEQ ID NO: 1857395 - RNA, 23 nt, Salmonella typhimurium LT2
ccucagcaaaacggauaauaucu

SEQ ID NO: 1857396 - RNA, 19 nt, Salmonella typhimurium LT2
ccucagauguaucgcgcuu

SEQ ID NO: 1857397 - RNA, 17 nt, Salmonella typhimurium LT2
ccucaucggcaaacauc

SEQ ID NO: 1857398 - RNA, 18 nt, Salmonella typhimurium LT2
ccucaucccggcuuaaau

SEQ ID NO: 1857399 - RNA, 22 nt, Salmonella typhimurium LT2
ccucauccccaacaucaugucc

SEQ ID NO: 1857400 - RNA, 19 nt, Salmonella typhimurium LT2
ccucaucccccagccgcag

SEQ ID NO: 1857401 - RNA, 21 nt, Salmonella typhimurium LT2
ccucauuuuguugcuccagca

SEQ ID NO: 1857402 - RNA, 22 nt, Salmonella typhimurium LT2
ccuccacgcccagcgccgggaa

SEQ ID NO: 1857403 - RNA, 19 nt, Salmonella typhimurium LT2
ccuccugccgaugccgccg

SEQ ID NO: 1857404 - RNA, 15 nt, Salmonella typhimurium LT2
ccuccggcgcggcgc

SEQ ID NO: 1857405 - RNA, 13 nt, Salmonella typhimurium LT2
ccuccggcgcgaa

SEQ ID NO: 1857406 - RNA, 18 nt, Salmonella typhimurium LT2
ccuccggcugaagcccca

SEQ ID NO: 1857407 - RNA, 17 nt, Salmonella typhimurium LT2
ccuccggaugacgccgc

SEQ ID NO: 1857408 - RNA, 21 nt, Salmonella typhimurium LT2
ccucccagaagaucgccggaa

SEQ ID NO: 1857409 - RNA, 23 nt, Salmonella typhimurium LT2
ccuccaucaguucggcgcgccag

SEQ ID NO: 1857410 - RNA, 14 nt, Salmonella typhimurium LT2
ccuccauacacugc

SEQ ID NO: 1857411 - RNA, 21 nt, Salmonella typhimurium LT2
ccuccauggcuugucgccaac

SEQ ID NO: 1857412 - RNA, 17 nt, Salmonella typhimurium LT2
ccucgcgcaccccggcc

SEQ ID NO: 1857413 - RNA, 16 nt, Salmonella typhimurium LT2
ccucgcgauccgccag

SEQ ID NO: 1857414 - RNA, 21 nt, Salmonella typhimurium LT2
ccucgauggcauuguccuuua

SEQ ID NO: 1857415 - RNA, 13 nt, Salmonella typhimurium LT2
ccucgaccccuuc

SEQ ID NO: 1857416 - RNA, 23 nt, Salmonella typhimurium LT2
ccucgaaugcuggggcggcgcca

SEQ ID NO: 1857417 - RNA, 20 nt, Salmonella typhimurium LT2
ccuccuuguaagggaggugc

SEQ ID NO: 1857418 - RNA, 20 nt, Salmonella typhimurium LT2
ccucgacuaaaggcagcgcg

SEQ ID NO: 1857419 - RNA, 22 nt, Salmonella typhimurium LT2
ccucgacuaaaggcagcgcgcu

SEQ ID NO: 1857420 - RNA, 16 nt, Salmonella typhimurium LT2
ccguuucccucuuaau

SEQ ID NO: 1857421 - RNA, 21 nt, Salmonella typhimurium LT2
ccguuucagaaagagauuaga

SEQ ID NO: 1857422 - RNA, 18 nt, Salmonella typhimurium LT2
ccguucugugcgccgcug

SEQ ID NO: 1857423 - RNA, 13 nt, Salmonella typhimurium LT2
ccguucccucuga

SEQ ID NO: 1857424 - RNA, 20 nt, Salmonella typhimurium LT2
ccguucauucgccccagcau

SEQ ID NO: 1857425 - RNA, 21 nt, Salmonella typhimurium LT2
ccguuaugcaguucaaaaggu

SEQ ID NO: 1857426 - RNA, 13 nt, Salmonella typhimurium LT2
ccguuaccagcau

SEQ ID NO: 1857427 - RNA, 13 nt, Salmonella typhimurium LT2
ccguuaagcugga

SEQ ID NO: 1857428 - RNA, 19 nt, Salmonella typhimurium LT2
ccguguugugugccgcgcu

SEQ ID NO: 1857429 - RNA, 15 nt, Salmonella typhimurium LT2
ccguuaacugcugcu

SEQ ID NO: 1857430 - RNA, 17 nt, Salmonella typhimurium LT2
ccguuaagauccugacu

SEQ ID NO: 1857431 - RNA, 17 nt, Salmonella typhimurium LT2
ccuaauaaccagcccca

SEQ ID NO: 1857432 - RNA, 12 nt, Salmonella typhimurium LT2
ccuaacgccugc

SEQ ID NO: 1857433 - RNA, 18 nt, Salmonella typhimurium LT2
ccuaacuggaaaaagacc

SEQ ID NO: 1857434 - RNA, 20 nt, Salmonella typhimurium LT2
ccuaacuggaaaaagaccaa

SEQ ID NO: 1857435 - RNA, 15 nt, Salmonella typhimurium LT2
ccuaacaucauuccc

SEQ ID NO: 1857436 - RNA, 15 nt, Salmonella typhimurium LT2
ccguuugcagccaga

SEQ ID NO: 1857437 - RNA, 14 nt, Salmonella typhimurium LT2
ccguuugccgggca

SEQ ID NO: 1857438 - RNA, 21 nt, Salmonella typhimurium LT2
ccguuucguugccagaguuca

SEQ ID NO: 1857439 - RNA, 16 nt, Salmonella typhimurium LT2
ccguuuucgcccccag

SEQ ID NO: 1857440 - RNA, 19 nt, Salmonella typhimurium LT2
ccguuuuucauccagcggu

SEQ ID NO: 1857441 - RNA, 16 nt, Salmonella typhimurium LT2
ccguuuuggcagcgcc

SEQ ID NO: 1857442 - RNA, 13 nt, Salmonella typhimurium LT2
ccuaaaaauagcu

SEQ ID NO: 1857443 - RNA, 17 nt, Salmonella typhimurium LT2
ccuaaaaaccagaacuu

SEQ ID NO: 1857444 - RNA, 17 nt, Salmonella typhimurium LT2
ccgguucggcaucgccc

SEQ ID NO: 1857445 - RNA, 22 nt, Salmonella typhimurium LT2
ccgguucggacgguaccugaag

SEQ ID NO: 1857446 - RNA, 15 nt, Salmonella typhimurium LT2
ccgguucgcggcaga

SEQ ID NO: 1857447 - RNA, 20 nt, Salmonella typhimurium LT2
ccgguuccggcauaaauaau

SEQ ID NO: 1857448 - RNA, 16 nt, Salmonella typhimurium LT2
ccgguuauaccgccau

SEQ ID NO: 1857449 - RNA, 15 nt, Salmonella typhimurium LT2
ccgguuagcgccgcg

SEQ ID NO: 1857450 - RNA, 17 nt, Salmonella typhimurium LT2
ccgucguagccaccauc

SEQ ID NO: 1857451 - RNA, 18 nt, Salmonella typhimurium LT2
ccgucggcaauuaacauu

SEQ ID NO: 1857452 - RNA, 15 nt, Salmonella typhimurium LT2
ccgucgcugacuuca

SEQ ID NO: 1857453 - RNA, 19 nt, Salmonella typhimurium LT2
ccgucgccugccucgcuga

SEQ ID NO: 1857454 - RNA, 16 nt, Salmonella typhimurium LT2
ccgucgccuguuucug

SEQ ID NO: 1857455 - RNA, 17 nt, Salmonella typhimurium LT2
ccgucgauaaaauccuc

SEQ ID NO: 1857456 - RNA, 13 nt, Salmonella typhimurium LT2
aaacgacagcgcc

SEQ ID NO: 1857457 - RNA, 12 nt, Salmonella typhimurium LT2
aaacgacgugga

SEQ ID NO: 1857458 - RNA, 14 nt, Salmonella typhimurium LT2
aaacgagcgcggca

SEQ ID NO: 1857459 - RNA, 15 nt, Salmonella typhimurium LT2
ccguggcauucgcuu

SEQ ID NO: 1857460 - RNA, 18 nt, Salmonella typhimurium LT2
ccguggcugcgccugcgc

SEQ ID NO: 1857461 - RNA, 15 nt, Salmonella typhimurium LT2
ccguguggucgcggc

SEQ ID NO: 1857462 - RNA, 13 nt, Salmonella typhimurium LT2
ccguguuccagcg

SEQ ID NO: 1857463 - RNA, 16 nt, Salmonella typhimurium LT2
ccguggguggcaaggc

SEQ ID NO: 1857464 - RNA, 18 nt, Salmonella typhimurium LT2
ccguggugcguugcgcca

SEQ ID NO: 1857465 - RNA, 14 nt, Salmonella typhimurium LT2
ccgugcccagcauc

SEQ ID NO: 1857466 - RNA, 23 nt, Salmonella typhimurium LT2
ccgugcaguuuugcuucaugcac

SEQ ID NO: 1857467 - RNA, 15 nt, Salmonella typhimurium LT2
ccgugcccaggucuc

SEQ ID NO: 1857468 - RNA, 13 nt, Salmonella typhimurium LT2
ccgucucaccagg

SEQ ID NO: 1857469 - RNA, 21 nt, Salmonella typhimurium LT2
ccgucgugacuaauagccaaa

SEQ ID NO: 1857470 - RNA, 22 nt, Salmonella typhimurium LT2
ccgucgugccuuucaggcgcgg

SEQ ID NO: 1857471 - RNA, 20 nt, Salmonella typhimurium LT2
ccgucucuuuaucuaacugc

SEQ ID NO: 1857472 - RNA, 22 nt, Salmonella typhimurium LT2
ccgucucuuuaucuaacugcgg

SEQ ID NO: 1857473 - RNA, 22 nt, Salmonella typhimurium LT2
ccgucuccuccuugugggcagc

SEQ ID NO: 1857474 - RNA, 15 nt, Salmonella typhimurium LT2
ccgccguaacgugcu

SEQ ID NO: 1857475 - RNA, 19 nt, Salmonella typhimurium LT2
ccgccgucgucaccgccgc

SEQ ID NO: 1857476 - RNA, 14 nt, Salmonella typhimurium LT2
ccgccuccaggccg

SEQ ID NO: 1857477 - RNA, 16 nt, Salmonella typhimurium LT2
ccgccuaacagcgccg

SEQ ID NO: 1857478 - RNA, 23 nt, Salmonella typhimurium LT2
ccgccggggcucccacucuucca

SEQ ID NO: 1857479 - RNA, 19 nt, Salmonella typhimurium LT2
ccgccgggucagaaaagcu

SEQ ID NO: 1857480 - RNA, 17 nt, Salmonella typhimurium LT2
ccgccgggcgucacccg

SEQ ID NO: 1857481 - RNA, 17 nt, Salmonella typhimurium LT2
ccgccgccaaacugcgc

SEQ ID NO: 1857482 - RNA, 22 nt, Salmonella typhimurium LT2
ccgccgcaauuccugacugcgc

SEQ ID NO: 1857483 - RNA, 18 nt, Salmonella typhimurium LT2
ccgccgcaauuccugacu

SEQ ID NO: 1857484 - RNA, 14 nt, Salmonella typhimurium LT2
ccgccgcacaggcg

SEQ ID NO: 1857485 - RNA, 15 nt, Salmonella typhimurium LT2
ccgccgccaucgcca

SEQ ID NO: 1857486 - RNA, 14 nt, Salmonella typhimurium LT2
ccgccgccagguua

SEQ ID NO: 1857487 - RNA, 15 nt, Salmonella typhimurium LT2
ccgccgccugccaga

SEQ ID NO: 1857488 - RNA, 12 nt, Salmonella typhimurium LT2
ccgccgcgagaa

SEQ ID NO: 1857489 - RNA, 13 nt, Salmonella typhimurium LT2
ccgccgccgcgcu

SEQ ID NO: 1857490 - RNA, 14 nt, Salmonella typhimurium LT2
ccgccgccgggccg

SEQ ID NO: 1857491 - RNA, 16 nt, Salmonella typhimurium LT2
ccgccgccgggccgcc

SEQ ID NO: 1857492 - RNA, 14 nt, Salmonella typhimurium LT2
ccgccgccuucugc

SEQ ID NO: 1857493 - RNA, 15 nt, Salmonella typhimurium LT2
ccgccgcuggcgggc

SEQ ID NO: 1857494 - RNA, 14 nt, Salmonella typhimurium LT2
ccgccgcgggcagc

SEQ ID NO: 1857495 - RNA, 14 nt, Salmonella typhimurium LT2
ccgccgcggccagc

SEQ ID NO: 1857496 - RNA, 21 nt, Salmonella typhimurium LT2
ccgcccgcggcgaucaccacg

SEQ ID NO: 1857497 - RNA, 13 nt, Salmonella typhimurium LT2
ccgcccgcguagc

SEQ ID NO: 1857498 - RNA, 13 nt, Salmonella typhimurium LT2
ccgccccugugga

SEQ ID NO: 1857499 - RNA, 15 nt, Salmonella typhimurium LT2
ccgcccaucaauacc

SEQ ID NO: 1857500 - RNA, 21 nt, Salmonella typhimurium LT2
ccgccccaaaucucccccggc

SEQ ID NO: 1857501 - RNA, 14 nt, Salmonella typhimurium LT2
ccgcccccuccagu

SEQ ID NO: 1857502 - RNA, 12 nt, Salmonella typhimurium LT2
ccgcccaggcca

SEQ ID NO: 1857503 - RNA, 23 nt, Salmonella typhimurium LT2
ccgcccagauguugauacagaaa

SEQ ID NO: 1857504 - RNA, 22 nt, Salmonella typhimurium LT2
ccgcccagaaagaucagcagaa

SEQ ID NO: 1857505 - RNA, 20 nt, Salmonella typhimurium LT2
ccgccauucgcuuccgccgg

SEQ ID NO: 1857506 - RNA, 18 nt, Salmonella typhimurium LT2
ccgccauggcgaauccgu

SEQ ID NO: 1857507 - RNA, 12 nt, Salmonella typhimurium LT2
ccgccaugaaaa

SEQ ID NO: 1857508 - RNA, 17 nt, Salmonella typhimurium LT2
ccgccaucuccggcagc

SEQ ID NO: 1857509 - RNA, 18 nt, Salmonella typhimurium LT2
ccgccaucgccaguaccg

SEQ ID NO: 1857510 - RNA, 18 nt, Salmonella typhimurium LT2
ccgcccuguccuccaugg

SEQ ID NO: 1857511 - RNA, 13 nt, Salmonella typhimurium LT2
ccgcccugcccgc

SEQ ID NO: 1857512 - RNA, 12 nt, Salmonella typhimurium LT2
ccgcccugcagg

SEQ ID NO: 1857513 - RNA, 17 nt, Salmonella typhimurium LT2
aaaccccugguuaaccc

SEQ ID NO: 1857514 - RNA, 16 nt, Salmonella typhimurium LT2
aaaccccuucaccacu

SEQ ID NO: 1857515 - RNA, 18 nt, Salmonella typhimurium LT2
aaaccccagauuacugcc

SEQ ID NO: 1857516 - RNA, 21 nt, Salmonella typhimurium LT2
aaacccaucucaggccgacaa

SEQ ID NO: 1857517 - RNA, 22 nt, Salmonella typhimurium LT2
aaacccacccgguaauaccgau

SEQ ID NO: 1857518 - RNA, 21 nt, Salmonella typhimurium LT2
aaaccauuuauaaaauauuua

SEQ ID NO: 1857519 - RNA, 20 nt, Salmonella typhimurium LT2
aaaccauguugaucguaaaa

SEQ ID NO: 1857520 - RNA, 18 nt, Salmonella typhimurium LT2
ccgccaccuuucugcucc

SEQ ID NO: 1857521 - RNA, 15 nt, Salmonella typhimurium LT2
ccgccacggcaagaa

SEQ ID NO: 1857522 - RNA, 17 nt, Salmonella typhimurium LT2
ccgccagacucagccag

SEQ ID NO: 1857523 - RNA, 16 nt, Salmonella typhimurium LT2
ccgccagauccuggcu

SEQ ID NO: 1857524 - RNA, 13 nt, Salmonella typhimurium LT2
ccgccagacucag

SEQ ID NO: 1857525 - RNA, 13 nt, Salmonella typhimurium LT2
ccgccagcacagc

SEQ ID NO: 1857526 - RNA, 14 nt, Salmonella typhimurium LT2
ccgccagcacagca

SEQ ID NO: 1857527 - RNA, 11 nt, Salmonella typhimurium LT2
ccgccagcagc

SEQ ID NO: 1857528 - RNA, 16 nt, Salmonella typhimurium LT2
ccgcauuuugcuucac

SEQ ID NO: 1857529 - RNA, 14 nt, Salmonella typhimurium LT2
ccgccaaagcgccc

SEQ ID NO: 1857530 - RNA, 15 nt, Salmonella typhimurium LT2
ccgcauuuuuccagc

SEQ ID NO: 1857531 - RNA, 18 nt, Salmonella typhimurium LT2
ccgccaagcgcggacagc

SEQ ID NO: 1857532 - RNA, 14 nt, Salmonella typhimurium LT2
ccgccaccgcgcgc

SEQ ID NO: 1857533 - RNA, 15 nt, Salmonella typhimurium LT2
ccgccaccgccucgc

SEQ ID NO: 1857534 - RNA, 12 nt, Salmonella typhimurium LT2
ccgccacccggu

SEQ ID NO: 1857535 - RNA, 14 nt, Salmonella typhimurium LT2
ccgccaccacgccc

SEQ ID NO: 1857536 - RNA, 15 nt, Salmonella typhimurium LT2
aaaccagaacuucca

SEQ ID NO: 1857537 - RNA, 17 nt, Salmonella typhimurium LT2
aaaccagaauuuguugg

SEQ ID NO: 1857538 - RNA, 13 nt, Salmonella typhimurium LT2
aaaccaguuuuuc

SEQ ID NO: 1857539 - RNA, 20 nt, Salmonella typhimurium LT2
aaaccaguuuuucauuuguu

SEQ ID NO: 1857540 - RNA, 20 nt, Salmonella typhimurium LT2
aaaccauaauaaugccaaaa

SEQ ID NO: 1857541 - RNA, 21 nt, Salmonella typhimurium LT2
aaaccauaauaaugccaaaau

SEQ ID NO: 1857542 - RNA, 22 nt, Salmonella typhimurium LT2
aaaccauaauaaugccaaaaug

SEQ ID NO: 1857543 - RNA, 22 nt, Salmonella typhimurium LT2
aaaccaggcuuagccgccgugg

SEQ ID NO: 1857544 - RNA, 16 nt, Salmonella typhimurium LT2
ccgccagcgggccggu

SEQ ID NO: 1857545 - RNA, 15 nt, Salmonella typhimurium LT2
ccgccagcggcgcca

SEQ ID NO: 1857546 - RNA, 13 nt, Salmonella typhimurium LT2
ccgccagcgccgc

SEQ ID NO: 1857547 - RNA, 12 nt, Salmonella typhimurium LT2
ccgccagcgccu

SEQ ID NO: 1857548 - RNA, 16 nt, Salmonella typhimurium LT2
ccgccaucagacaggc

SEQ ID NO: 1857549 - RNA, 19 nt, Salmonella typhimurium LT2
ccgccaucagacaggcaug

SEQ ID NO: 1857550 - RNA, 18 nt, Salmonella typhimurium LT2
ccgccauaggucagcgcu

SEQ ID NO: 1857551 - RNA, 20 nt, Salmonella typhimurium LT2
ccgccauaggucagcgcuuc

SEQ ID NO: 1857552 - RNA, 16 nt, Salmonella typhimurium LT2
ccgccaucgcugggau

SEQ ID NO: 1857553 - RNA, 11 nt, Salmonella typhimurium LT2
ccgccaucaug

SEQ ID NO: 1857554 - RNA, 19 nt, Salmonella typhimurium LT2
ccgccauccggcacaguau

SEQ ID NO: 1857555 - RNA, 22 nt, Salmonella typhimurium LT2
ccgccauccggcaaaaagcuua

SEQ ID NO: 1857556 - RNA, 21 nt, Salmonella typhimurium LT2
ccgccaggucuuuaucuauca

SEQ ID NO: 1857557 - RNA, 21 nt, Salmonella typhimurium LT2
ccgccaguuuguaaccaacaa

SEQ ID NO: 1857558 - RNA, 23 nt, Salmonella typhimurium LT2
ccgccaguaauuuuucucccagc

SEQ ID NO: 1857559 - RNA, 13 nt, Salmonella typhimurium LT2
ccgcacaucggca

SEQ ID NO: 1857560 - RNA, 13 nt, Salmonella typhimurium LT2
ccgcacugcaucg

SEQ ID NO: 1857561 - RNA, 18 nt, Salmonella typhimurium LT2
ccgcaauugguaauuaaa

SEQ ID NO: 1857562 - RNA, 16 nt, Salmonella typhimurium LT2
ccgcacacagcggaaa

SEQ ID NO: 1857563 - RNA, 21 nt, Salmonella typhimurium LT2
ccgcacagauuacaaggaaug

SEQ ID NO: 1857564 - RNA, 18 nt, Salmonella typhimurium LT2
ccgcaaugaccacaaauu

SEQ ID NO: 1857565 - RNA, 14 nt, Salmonella typhimurium LT2
ccgcaauccuggcu

SEQ ID NO: 1857566 - RNA, 15 nt, Salmonella typhimurium LT2
ccgcaaucgcugccu

SEQ ID NO: 1857567 - RNA, 23 nt, Salmonella typhimurium LT2
ccgcaaucgcugccuugagugac

SEQ ID NO: 1857568 - RNA, 12 nt, Salmonella typhimurium LT2
ccgcaaaaccuu

SEQ ID NO: 1857569 - RNA, 22 nt, Salmonella typhimurium LT2
ccgcaauaccaauuaccggcuu

SEQ ID NO: 1857570 - RNA, 15 nt, Salmonella typhimurium LT2
ccgcaauacagcccg

SEQ ID NO: 1857571 - RNA, 18 nt, Salmonella typhimurium LT2
ccgauucugccaguucac

SEQ ID NO: 1857572 - RNA, 13 nt, Salmonella typhimurium LT2
ccgauucccaguc

SEQ ID NO: 1857573 - RNA, 15 nt, Salmonella typhimurium LT2
ccgauucccgccugc

SEQ ID NO: 1857574 - RNA, 21 nt, Salmonella typhimurium LT2
ccgauuucguucuuucugcca

SEQ ID NO: 1857575 - RNA, 23 nt, Salmonella typhimurium LT2
ccgcagacuuuagccauucccga

SEQ ID NO: 1857576 - RNA, 12 nt, Salmonella typhimurium LT2
ccgcagcggcuc

SEQ ID NO: 1857577 - RNA, 14 nt, Salmonella typhimurium LT2
ccgcaggcuuccag

SEQ ID NO: 1857578 - RNA, 17 nt, Salmonella typhimurium LT2
ccgcaggcucuuuuucu

SEQ ID NO: 1857579 - RNA, 17 nt, Salmonella typhimurium LT2
ccgcaggucggacaguu

SEQ ID NO: 1857580 - RNA, 14 nt, Salmonella typhimurium LT2
ccgcaguuuuccag

SEQ ID NO: 1857581 - RNA, 19 nt, Salmonella typhimurium LT2
ccgcauccccauagacagu

SEQ ID NO: 1857582 - RNA, 18 nt, Salmonella typhimurium LT2
ccgcaucagcaacgcgcc

SEQ ID NO: 1857583 - RNA, 14 nt, Salmonella typhimurium LT2
ccgcauauuuuucu

SEQ ID NO: 1857584 - RNA, 12 nt, Salmonella typhimurium LT2
ccgcaucggccc

SEQ ID NO: 1857585 - RNA, 20 nt, Salmonella typhimurium LT2
ccgcaucguucaacucgcua

SEQ ID NO: 1857586 - RNA, 15 nt, Salmonella typhimurium LT2
ccgcauuaacugccu

SEQ ID NO: 1857587 - RNA, 20 nt, Salmonella typhimurium LT2
aaacagauaagcgucugcaa

SEQ ID NO: 1857588 - RNA, 14 nt, Salmonella typhimurium LT2
cccuuaucaaaggc

SEQ ID NO: 1857589 - RNA, 18 nt, Salmonella typhimurium LT2
cccuguuuuuucgccgcg

SEQ ID NO: 1857590 - RNA, 20 nt, Salmonella typhimurium LT2
cccugguuaacccgguuuau

SEQ ID NO: 1857591 - RNA, 13 nt, Salmonella typhimurium LT2
cccuuuuugcauu

SEQ ID NO: 1857592 - RNA, 21 nt, Salmonella typhimurium LT2
cccuuuuugcauucgcuccuc

SEQ ID NO: 1857593 - RNA, 23 nt, Salmonella typhimurium LT2
cccuuuuugacguaaaucugaaa

SEQ ID NO: 1857594 - RNA, 23 nt, Salmonella typhimurium LT2
cccuuuuuugguuauccagcagc

SEQ ID NO: 1857595 - RNA, 21 nt, Salmonella typhimurium LT2
aaacaggcgcaggcauuaaaa

SEQ ID NO: 1857596 - RNA, 15 nt, Salmonella typhimurium LT2
aaacagguaaaacaa

SEQ ID NO: 1857597 - RNA, 11 nt, Salmonella typhimurium LT2
cccuuuuucaa

SEQ ID NO: 1857598 - RNA, 13 nt, Salmonella typhimurium LT2
cccuuuuucaauu

SEQ ID NO: 1857599 - RNA, 20 nt, Salmonella typhimurium LT2
aaacaggucuguaugacaac

SEQ ID NO: 1857600 - RNA, 14 nt, Salmonella typhimurium LT2
aaacagcuguaaau

SEQ ID NO: 1857601 - RNA, 19 nt, Salmonella typhimurium LT2
aaacagcgugggaagcagc

SEQ ID NO: 1857602 - RNA, 21 nt, Salmonella typhimurium LT2
aaacagcgugggaagcagcag

SEQ ID NO: 1857603 - RNA, 17 nt, Salmonella typhimurium LT2
aaacagccaaucauaaa

SEQ ID NO: 1857604 - RNA, 16 nt, Salmonella typhimurium LT2
aaacagccaaucauaa

SEQ ID NO: 1857605 - RNA, 23 nt, Salmonella typhimurium LT2
aaacagcaguucguaauuuaaac

SEQ ID NO: 1857606 - RNA, 23 nt, Salmonella typhimurium LT2
aaacagcgccaguuuuuccuguu

SEQ ID NO: 1857607 - RNA, 20 nt, Salmonella typhimurium LT2
aaacagcgccccgacaaaac

SEQ ID NO: 1857608 - RNA, 21 nt, Salmonella typhimurium LT2
aaacagcgccggcaacagcuc

SEQ ID NO: 1857609 - RNA, 15 nt, Salmonella typhimurium LT2
aaacagccgccaugg

SEQ ID NO: 1857610 - RNA, 13 nt, Salmonella typhimurium LT2
ccgaagccaacgc

SEQ ID NO: 1857611 - RNA, 17 nt, Salmonella typhimurium LT2
aaacaucgcccuccagc

SEQ ID NO: 1857612 - RNA, 20 nt, Salmonella typhimurium LT2
ccgaagacuccccugcagau

SEQ ID NO: 1857613 - RNA, 14 nt, Salmonella typhimurium LT2
ccgaaucaauuccu

SEQ ID NO: 1857614 - RNA, 13 nt, Salmonella typhimurium LT2
ccgaaucgccgcu

SEQ ID NO: 1857615 - RNA, 20 nt, Salmonella typhimurium LT2
ccgaauaagcgacagcgcca

SEQ ID NO: 1857616 - RNA, 22 nt, Salmonella typhimurium LT2
aaacauaccgccgguaaggcca

SEQ ID NO: 1857617 - RNA, 13 nt, Salmonella typhimurium LT2
aaacauaagcaaa

SEQ ID NO: 1857618 - RNA, 15 nt, Salmonella typhimurium LT2
aaacauaagcaaauc

SEQ ID NO: 1857619 - RNA, 20 nt, Salmonella typhimurium LT2
ccgaaaggguauacaaaaaa

SEQ ID NO: 1857620 - RNA, 14 nt, Salmonella typhimurium LT2
aaacaucagccauu

SEQ ID NO: 1857621 - RNA, 15 nt, Salmonella typhimurium LT2
aaacaucaugcccaa

SEQ ID NO: 1857622 - RNA, 20 nt, Salmonella typhimurium LT2
aaacaucauuucuacaaaug

SEQ ID NO: 1857623 - RNA, 14 nt, Salmonella typhimurium LT2
aaacaucccgauaa

SEQ ID NO: 1857624 - RNA, 16 nt, Salmonella typhimurium LT2
aaacaucauaauaauu

SEQ ID NO: 1857625 - RNA, 16 nt, Salmonella typhimurium LT2
ccgaacgcguccauga

SEQ ID NO: 1857626 - RNA, 23 nt, Salmonella typhimurium LT2
ccgagcaggacgcgcgcgaaaag

SEQ ID NO: 1857627 - RNA, 22 nt, Salmonella typhimurium LT2
ccgagccagaacgagaggagga

SEQ ID NO: 1857628 - RNA, 15 nt, Salmonella typhimurium LT2
ccgacgcgaugccag

SEQ ID NO: 1857629 - RNA, 23 nt, Salmonella typhimurium LT2
ccgacgauaaacagauaugaaau

SEQ ID NO: 1857630 - RNA, 19 nt, Salmonella typhimurium LT2
ccgacgcauuucuccugau

SEQ ID NO: 1857631 - RNA, 14 nt, Salmonella typhimurium LT2
ccgaccgucggcgc

SEQ ID NO: 1857632 - RNA, 17 nt, Salmonella typhimurium LT2
ccgacgaaaaagccaaa

SEQ ID NO: 1857633 - RNA, 14 nt, Salmonella typhimurium LT2
ccgacgaacaaaau

SEQ ID NO: 1857634 - RNA, 21 nt, Salmonella typhimurium LT2
ccgacgaccggcgcagcgccc

SEQ ID NO: 1857635 - RNA, 15 nt, Salmonella typhimurium LT2
ccgacagcggcgcag

SEQ ID NO: 1857636 - RNA, 21 nt, Salmonella typhimurium LT2
ccgacagcguaaugcgccagg

SEQ ID NO: 1857637 - RNA, 12 nt, Salmonella typhimurium LT2
ccgacaggaugu

SEQ ID NO: 1857638 - RNA, 14 nt, Salmonella typhimurium LT2
ccgacaggaugucc

SEQ ID NO: 1857639 - RNA, 18 nt, Salmonella typhimurium LT2
ccgacaggcggcagcuua

SEQ ID NO: 1857640 - RNA, 20 nt, Salmonella typhimurium LT2
ccgacaggcgcgaaacgccu

SEQ ID NO: 1857641 - RNA, 16 nt, Salmonella typhimurium LT2
aaaccacgcugaggcg

SEQ ID NO: 1857642 - RNA, 19 nt, Salmonella typhimurium LT2
ccgaccaucgcgccgcugg

SEQ ID NO: 1857643 - RNA, 15 nt, Salmonella typhimurium LT2
ccgaccauuacccac

SEQ ID NO: 1857644 - RNA, 15 nt, Salmonella typhimurium LT2
cccgguggcgccgcg

SEQ ID NO: 1857645 - RNA, 17 nt, Salmonella typhimurium LT2
cccgguggcgcugcgcu

SEQ ID NO: 1857646 - RNA, 14 nt, Salmonella typhimurium LT2
cccgguaaacgcuu

SEQ ID NO: 1857647 - RNA, 17 nt, Salmonella typhimurium LT2
cccgguaaacgcuuuuu

SEQ ID NO: 1857648 - RNA, 18 nt, Salmonella typhimurium LT2
cccggucaacgcgccgcc

SEQ ID NO: 1857649 - RNA, 19 nt, Salmonella typhimurium LT2
cccggucaacgcgccgcca

SEQ ID NO: 1857650 - RNA, 12 nt, Salmonella typhimurium LT2
cccggucacauu

SEQ ID NO: 1857651 - RNA, 21 nt, Salmonella typhimurium LT2
cccggcuuaccggcuaucagc

SEQ ID NO: 1857652 - RNA, 22 nt, Salmonella typhimurium LT2
cccggcugccauuaucaccauu

SEQ ID NO: 1857653 - RNA, 20 nt, Salmonella typhimurium LT2
cccgggagaacgccgggccu

SEQ ID NO: 1857654 - RNA, 19 nt, Salmonella typhimurium LT2
cccgccgggcgucacccgc

SEQ ID NO: 1857655 - RNA, 20 nt, Salmonella typhimurium LT2
cccgccgguucaauaaauca

SEQ ID NO: 1857656 - RNA, 21 nt, Salmonella typhimurium LT2
cccggcguuuugccgggcguu

SEQ ID NO: 1857657 - RNA, 22 nt, Salmonella typhimurium LT2
cccguuucccggauaaauguuu

SEQ ID NO: 1857658 - RNA, 15 nt, Salmonella typhimurium LT2
cccguuuuuuccagu

SEQ ID NO: 1857659 - RNA, 23 nt, Salmonella typhimurium LT2
cccguuuuuuccagugccgccag

SEQ ID NO: 1857660 - RNA, 14 nt, Salmonella typhimurium LT2
cccuaagccuaagu

SEQ ID NO: 1857661 - RNA, 22 nt, Salmonella typhimurium LT2
cccguucacguuuuuacucuug

SEQ ID NO: 1857662 - RNA, 14 nt, Salmonella typhimurium LT2
cccgucucuuuauc

SEQ ID NO: 1857663 - RNA, 14 nt, Salmonella typhimurium LT2
cccgucaugcuuca

SEQ ID NO: 1857664 - RNA, 19 nt, Salmonella typhimurium LT2
cccgucaucuucuaccuga

SEQ ID NO: 1857665 - RNA, 12 nt, Salmonella typhimurium LT2
cccgucauacuu

SEQ ID NO: 1857666 - RNA, 14 nt, Salmonella typhimurium LT2
aaacaccauuuuuu

SEQ ID NO: 1857667 - RNA, 20 nt, Salmonella typhimurium LT2
cccucaacgcccugcuccca

SEQ ID NO: 1857668 - RNA, 21 nt, Salmonella typhimurium LT2
cccucaacgcccugcucccac

SEQ ID NO: 1857669 - RNA, 23 nt, Salmonella typhimurium LT2
cccucaaguuauguuauccccac

SEQ ID NO: 1857670 - RNA, 15 nt, Salmonella typhimurium LT2
cccuccaguagcagc

SEQ ID NO: 1857671 - RNA, 12 nt, Salmonella typhimurium LT2
cccuccugccuu

SEQ ID NO: 1857672 - RNA, 13 nt, Salmonella typhimurium LT2
cccucgcaccaac

SEQ ID NO: 1857673 - RNA, 22 nt, Salmonella typhimurium LT2
cccucgauuaccguguuuaccu

SEQ ID NO: 1857674 - RNA, 19 nt, Salmonella typhimurium LT2
cccucgguuuauccccgcu

SEQ ID NO: 1857675 - RNA, 20 nt, Salmonella typhimurium LT2
cccugaaucgccucaacgcu

SEQ ID NO: 1857676 - RNA, 18 nt, Salmonella typhimurium LT2
cccugaauuucaauaauc

SEQ ID NO: 1857677 - RNA, 14 nt, Salmonella typhimurium LT2
cccucuuccaucag

SEQ ID NO: 1857678 - RNA, 21 nt, Salmonella typhimurium LT2
cccugcaaacuguguacgcca

SEQ ID NO: 1857679 - RNA, 16 nt, Salmonella typhimurium LT2
cccugcaaaaguuuga

SEQ ID NO: 1857680 - RNA, 23 nt, Salmonella typhimurium LT2
cccugauggcgcgccacuucuuu

SEQ ID NO: 1857681 - RNA, 22 nt, Salmonella typhimurium LT2
cccugaugcguauccagcgcgg

SEQ ID NO: 1857682 - RNA, 21 nt, Salmonella typhimurium LT2
cccugacgauacauaaaaugu

SEQ ID NO: 1857683 - RNA, 15 nt, Salmonella typhimurium LT2
cccugccggcggcag

SEQ ID NO: 1857684 - RNA, 16 nt, Salmonella typhimurium LT2
cccugccaauucaaca

SEQ ID NO: 1857685 - RNA, 14 nt, Salmonella typhimurium LT2
cccugcuccugcca

SEQ ID NO: 1857686 - RNA, 13 nt, Salmonella typhimurium LT2
cccugcuccugcc

SEQ ID NO: 1857687 - RNA, 16 nt, Salmonella typhimurium LT2
cccugcgguagcgccg

SEQ ID NO: 1857688 - RNA, 23 nt, Salmonella typhimurium LT2
cccugcgucacgauaguuuuaau

SEQ ID NO: 1857689 - RNA, 14 nt, Salmonella typhimurium LT2
cccugggccucgcc

SEQ ID NO: 1857690 - RNA, 19 nt, Salmonella typhimurium LT2
cccugggccucgccccuuc

SEQ ID NO: 1857691 - RNA, 20 nt, Salmonella typhimurium LT2
cccccugccacaaccgcccc

SEQ ID NO: 1857692 - RNA, 13 nt, Salmonella typhimurium LT2
cccccucggcagc

SEQ ID NO: 1857693 - RNA, 17 nt, Salmonella typhimurium LT2
ccccgauaaaccaggca

SEQ ID NO: 1857694 - RNA, 18 nt, Salmonella typhimurium LT2
ccccgauaaaccaggcag

SEQ ID NO: 1857695 - RNA, 22 nt, Salmonella typhimurium LT2
ccccgaugucgccacgccgccc

SEQ ID NO: 1857696 - RNA, 16 nt, Salmonella typhimurium LT2
ccccgauucgcaugaa

SEQ ID NO: 1857697 - RNA, 20 nt, Salmonella typhimurium LT2
cccccagauagaaccacgca

SEQ ID NO: 1857698 - RNA, 14 nt, Salmonella typhimurium LT2
cccccaucgccagc

SEQ ID NO: 1857699 - RNA, 21 nt, Salmonella typhimurium LT2
cccccaucgccagcacuuccu

SEQ ID NO: 1857700 - RNA, 19 nt, Salmonella typhimurium LT2
ccccauaagcaaaggcggu

SEQ ID NO: 1857701 - RNA, 13 nt, Salmonella typhimurium LT2
ccccagccgccac

SEQ ID NO: 1857702 - RNA, 13 nt, Salmonella typhimurium LT2
ccccaucccagac

SEQ ID NO: 1857703 - RNA, 13 nt, Salmonella typhimurium LT2
ccccaucuccaga

SEQ ID NO: 1857704 - RNA, 19 nt, Salmonella typhimurium LT2
cccaugggcggccugcgcc

SEQ ID NO: 1857705 - RNA, 20 nt, Salmonella typhimurium LT2
cccauguugagcgcuugcug

SEQ ID NO: 1857706 - RNA, 24 nt, Salmonella typhimurium LT2
cccauuucuggacgggcuaucaau

SEQ ID NO: 1857707 - RNA, 20 nt, Salmonella typhimurium LT2
cccauuuccguuaaucuggu

SEQ ID NO: 1857708 - RNA, 22 nt, Salmonella typhimurium LT2
cccauuugcggguggugugcgu

SEQ ID NO: 1857709 - RNA, 17 nt, Salmonella typhimurium LT2
cccaugcaccagcccca

SEQ ID NO: 1857710 - RNA, 14 nt, Salmonella typhimurium LT2
cccaucuuuuuccu

SEQ ID NO: 1857711 - RNA, 18 nt, Salmonella typhimurium LT2
cccaucguaacgccgucg

SEQ ID NO: 1857712 - RNA, 16 nt, Salmonella typhimurium LT2
cccaugacauucccau

SEQ ID NO: 1857713 - RNA, 12 nt, Salmonella typhimurium LT2
ccccagccagag

SEQ ID NO: 1857714 - RNA, 19 nt, Salmonella typhimurium LT2
ccccagccauaauacaauc

SEQ ID NO: 1857715 - RNA, 18 nt, Salmonella typhimurium LT2
ccccagcacgacagagau

SEQ ID NO: 1857716 - RNA, 20 nt, Salmonella typhimurium LT2
ccccagaugccguagccaag

SEQ ID NO: 1857717 - RNA, 23 nt, Salmonella typhimurium LT2
ccccacgauacgucccugcuggc

SEQ ID NO: 1857718 - RNA, 15 nt, Salmonella typhimurium LT2
ccccagauagcccuc

SEQ ID NO: 1857719 - RNA, 16 nt, Salmonella typhimurium LT2
ccccagauagcccucu

SEQ ID NO: 1857720 - RNA, 13 nt, Salmonella typhimurium LT2
ccccaccgccaga

SEQ ID NO: 1857721 - RNA, 17 nt, Salmonella typhimurium LT2
ccccaaaaugccgccca

SEQ ID NO: 1857722 - RNA, 20 nt, Salmonella typhimurium LT2
cccauuuuuuguauccacca

SEQ ID NO: 1857723 - RNA, 15 nt, Salmonella typhimurium LT2
ccccaaacgcucaua

SEQ ID NO: 1857724 - RNA, 13 nt, Salmonella typhimurium LT2
cccauuuuccgcu

SEQ ID NO: 1857725 - RNA, 19 nt, Salmonella typhimurium LT2
ccccacaggaucaccgcca

SEQ ID NO: 1857726 - RNA, 11 nt, Salmonella typhimurium LT2
cccgccgccau

SEQ ID NO: 1857727 - RNA, 12 nt, Salmonella typhimurium LT2
cccgccgccauc

SEQ ID NO: 1857728 - RNA, 14 nt, Salmonella typhimurium LT2
cccgccgccagccu

SEQ ID NO: 1857729 - RNA, 21 nt, Salmonella typhimurium LT2
cccgccgcacacgccgugcac

SEQ ID NO: 1857730 - RNA, 15 nt, Salmonella typhimurium LT2
cccgccgccaccaug

SEQ ID NO: 1857731 - RNA, 14 nt, Salmonella typhimurium LT2
cccgcccacaggcu

SEQ ID NO: 1857732 - RNA, 18 nt, Salmonella typhimurium LT2
cccgccgaaggcaacgcc

SEQ ID NO: 1857733 - RNA, 15 nt, Salmonella typhimurium LT2
cccgccagcauacaa

SEQ ID NO: 1857734 - RNA, 14 nt, Salmonella typhimurium LT2
cccgccagcggcgc

SEQ ID NO: 1857735 - RNA, 13 nt, Salmonella typhimurium LT2
cccgccaggguau

SEQ ID NO: 1857736 - RNA, 18 nt, Salmonella typhimurium LT2
cccgccaggguaucauca

SEQ ID NO: 1857737 - RNA, 21 nt, Salmonella typhimurium LT2
cccgccagaugcagcggcagu

SEQ ID NO: 1857738 - RNA, 15 nt, Salmonella typhimurium LT2
cccgccagcacagca

SEQ ID NO: 1857739 - RNA, 13 nt, Salmonella typhimurium LT2
cccgccagaugca

SEQ ID NO: 1857740 - RNA, 13 nt, Salmonella typhimurium LT2
cccgcagccacuc

SEQ ID NO: 1857741 - RNA, 15 nt, Salmonella typhimurium LT2
cccgcacucgcgcuu

SEQ ID NO: 1857742 - RNA, 20 nt, Salmonella typhimurium LT2
cccgcagaaaagaccggcgg

SEQ ID NO: 1857743 - RNA, 19 nt, Salmonella typhimurium LT2
cccgcaaacuggccacagc

SEQ ID NO: 1857744 - RNA, 11 nt, Salmonella typhimurium LT2
cccgcaaaagc

SEQ ID NO: 1857745 - RNA, 14 nt, Salmonella typhimurium LT2
cccgagcgacgccc

SEQ ID NO: 1857746 - RNA, 17 nt, Salmonella typhimurium LT2
cccgagcggccaaaggg

SEQ ID NO: 1857747 - RNA, 21 nt, Salmonella typhimurium LT2
cccgaaaagcguaacgccccc

SEQ ID NO: 1857748 - RNA, 22 nt, Salmonella typhimurium LT2
cccgacaggguuugccagcacc

SEQ ID NO: 1857749 - RNA, 13 nt, Salmonella typhimurium LT2
cccgaccacgccc

SEQ ID NO: 1857750 - RNA, 14 nt, Salmonella typhimurium LT2
cccgacagcggcgc

SEQ ID NO: 1857751 - RNA, 18 nt, Salmonella typhimurium LT2
ccccuuuuuugcuggcaa

SEQ ID NO: 1857752 - RNA, 12 nt, Salmonella typhimurium LT2
ccccuuuuucaa

SEQ ID NO: 1857753 - RNA, 20 nt, Salmonella typhimurium LT2
ccccuuucgguucgccgcgc

SEQ ID NO: 1857754 - RNA, 22 nt, Salmonella typhimurium LT2
ccccuucuuuaucuucugcugc

SEQ ID NO: 1857755 - RNA, 15 nt, Salmonella typhimurium LT2
ccccuuuacccacca

SEQ ID NO: 1857756 - RNA, 16 nt, Salmonella typhimurium LT2
ccccuuuacccaccag

SEQ ID NO: 1857757 - RNA, 20 nt, Salmonella typhimurium LT2
ccccucggcagcaauacgcc

SEQ ID NO: 1857758 - RNA, 18 nt, Salmonella typhimurium LT2
ccccucuuuuaagccgua

SEQ ID NO: 1857759 - RNA, 23 nt, Salmonella typhimurium LT2
ccccggucggguguucucauccc

SEQ ID NO: 1857760 - RNA, 14 nt, Salmonella typhimurium LT2
ccccgcuggcgcgg

SEQ ID NO: 1857761 - RNA, 12 nt, Salmonella typhimurium LT2
ccccgucagucg

SEQ ID NO: 1857762 - RNA, 11 nt, Salmonella typhimurium LT2
aaacaccagaa

SEQ ID NO: 1857763 - RNA, 13 nt, Salmonella typhimurium LT2
aaacaccagaaug

SEQ ID NO: 1857764 - RNA, 12 nt, Salmonella typhimurium LT2
aaacaccaacaa

SEQ ID NO: 1857765 - RNA, 12 nt, Salmonella typhimurium LT2
cccauaccagcg

SEQ ID NO: 1857766 - RNA, 22 nt, Salmonella typhimurium LT2
aaacacaaucacaacgucaucc

SEQ ID NO: 1857767 - RNA, 17 nt, Salmonella typhimurium LT2
aaacaauuuacgcagcc

SEQ ID NO: 1857768 - RNA, 19 nt, Salmonella typhimurium LT2
cccauaaccgaugcacaug

SEQ ID NO: 1857769 - RNA, 12 nt, Salmonella typhimurium LT2
cccaguuuaccc

SEQ ID NO: 1857770 - RNA, 18 nt, Salmonella typhimurium LT2
cccaguuucuucaggcca

SEQ ID NO: 1857771 - RNA, 20 nt, Salmonella typhimurium LT2
cccaguuucuucaggccagc

SEQ ID NO: 1857772 - RNA, 22 nt, Salmonella typhimurium LT2
cccaguuucuucaggccagccu

SEQ ID NO: 1857773 - RNA, 18 nt, Salmonella typhimurium LT2
cccaguuuuuuucugcca

SEQ ID NO: 1857774 - RNA, 14 nt, Salmonella typhimurium LT2
cccauaaaaauggc

SEQ ID NO: 1857775 - RNA, 14 nt, Salmonella typhimurium LT2
cccaucgagccaac

SEQ ID NO: 1857776 - RNA, 21 nt, Salmonella typhimurium LT2
cccaucgggccgcucagcauc

SEQ ID NO: 1857777 - RNA, 23 nt, Salmonella typhimurium LT2
cccaucgccccgaauccacuguc

SEQ ID NO: 1857778 - RNA, 18 nt, Salmonella typhimurium LT2
cccaucagggaaaaaugu

SEQ ID NO: 1857779 - RNA, 11 nt, Salmonella typhimurium LT2
cccaucccaga

SEQ ID NO: 1857780 - RNA, 16 nt, Salmonella typhimurium LT2
cccauccgcccaccca

SEQ ID NO: 1857781 - RNA, 17 nt, Salmonella typhimurium LT2
cccauagcaaaguacug

SEQ ID NO: 1857782 - RNA, 15 nt, Salmonella typhimurium LT2
cccauacugcccagc

SEQ ID NO: 1857783 - RNA, 22 nt, Salmonella typhimurium LT2
cccauacugacggcgcucuuua

SEQ ID NO: 1857784 - RNA, 22 nt, Salmonella typhimurium LT2
cccaucaauaacgauaauuuua

SEQ ID NO: 1857785 - RNA, 14 nt, Salmonella typhimurium LT2
cccaucagcgccag

SEQ ID NO: 1857786 - RNA, 17 nt, Salmonella typhimurium LT2
cccaucagcgccagccc

SEQ ID NO: 1857787 - RNA, 17 nt, Salmonella typhimurium LT2
cccaguacaaacaaaua

SEQ ID NO: 1857788 - RNA, 16 nt, Salmonella typhimurium LT2
cccaguaauccggcaa

SEQ ID NO: 1857789 - RNA, 18 nt, Salmonella typhimurium LT2
cccaguaauccggcaacu

SEQ ID NO: 1857790 - RNA, 23 nt, Salmonella typhimurium LT2
cccagguuguaucauguuccggc

SEQ ID NO: 1857791 - RNA, 14 nt, Salmonella typhimurium LT2
cccagucacggcuc

SEQ ID NO: 1857792 - RNA, 20 nt, Salmonella typhimurium LT2
cccagucaucgucugcgucu

SEQ ID NO: 1857793 - RNA, 12 nt, Salmonella typhimurium LT2
cccaguagccau

SEQ ID NO: 1857794 - RNA, 18 nt, Salmonella typhimurium LT2
cccagugccaccagccgg

SEQ ID NO: 1857795 - RNA, 15 nt, Salmonella typhimurium LT2
cccagucgucauccc

SEQ ID NO: 1857796 - RNA, 20 nt, Salmonella typhimurium LT2
cccaggcgcaaggcgucgcu

SEQ ID NO: 1857797 - RNA, 18 nt, Salmonella typhimurium LT2
cccaggcuggcgcagccg

SEQ ID NO: 1857798 - RNA, 18 nt, Salmonella typhimurium LT2
cccaggcgcuauucccag

SEQ ID NO: 1857799 - RNA, 21 nt, Salmonella typhimurium LT2
cccaggcgauauccacaaugu

SEQ ID NO: 1857800 - RNA, 18 nt, Salmonella typhimurium LT2
cccaggucacgcccgccg

SEQ ID NO: 1857801 - RNA, 18 nt, Salmonella typhimurium LT2
cccaggucuccgcccagc

SEQ ID NO: 1857802 - RNA, 22 nt, Salmonella typhimurium LT2
cccaggucugaugagcgcagcg

SEQ ID NO: 1857803 - RNA, 18 nt, Salmonella typhimurium LT2
cccacuuugcucaccacg

SEQ ID NO: 1857804 - RNA, 20 nt, Salmonella typhimurium LT2
cccacuuguagcgagcgccg

SEQ ID NO: 1857805 - RNA, 20 nt, Salmonella typhimurium LT2
cccagauguugauacagaaa

SEQ ID NO: 1857806 - RNA, 14 nt, Salmonella typhimurium LT2
cccagcaaaccggc

SEQ ID NO: 1857807 - RNA, 20 nt, Salmonella typhimurium LT2
cccagcaauacagccagcac

SEQ ID NO: 1857808 - RNA, 21 nt, Salmonella typhimurium LT2
cccagccgugaauggucacau

SEQ ID NO: 1857809 - RNA, 17 nt, Salmonella typhimurium LT2
cccagcccugugccgcu

SEQ ID NO: 1857810 - RNA, 15 nt, Salmonella typhimurium LT2
cccagcagcagccgg

SEQ ID NO: 1857811 - RNA, 15 nt, Salmonella typhimurium LT2
cccagcagagaucuu

SEQ ID NO: 1857812 - RNA, 22 nt, Salmonella typhimurium LT2
cccagcagagaucuuucacccc

SEQ ID NO: 1857813 - RNA, 20 nt, Salmonella typhimurium LT2
cccagcccaucggucgcgcg

SEQ ID NO: 1857814 - RNA, 14 nt, Salmonella typhimurium LT2
cccaggaacaugac

SEQ ID NO: 1857815 - RNA, 20 nt, Salmonella typhimurium LT2
cccaggcauaaaaaaagcgc

SEQ ID NO: 1857816 - RNA, 20 nt, Salmonella typhimurium LT2
cccaggccauauugaaugcc

SEQ ID NO: 1857817 - RNA, 15 nt, Salmonella typhimurium LT2
cccaggccgccaccg

SEQ ID NO: 1857818 - RNA, 18 nt, Salmonella typhimurium LT2
cccagcgucaacugcgcc

SEQ ID NO: 1857819 - RNA, 18 nt, Salmonella typhimurium LT2
cccagcgucgccaguaac

SEQ ID NO: 1857820 - RNA, 21 nt, Salmonella typhimurium LT2
cccagcgugccugccgcagaa

SEQ ID NO: 1857821 - RNA, 18 nt, Salmonella typhimurium LT2
cccagcuaaaaacgccaa

SEQ ID NO: 1857822 - RNA, 22 nt, Salmonella typhimurium LT2
cccagcugacuggcagcggaaa

SEQ ID NO: 1857823 - RNA, 22 nt, Salmonella typhimurium LT2
cccagcugagcuaaucacccac

SEQ ID NO: 1857824 - RNA, 19 nt, Salmonella typhimurium LT2
cccagcgcggcccauucaa

SEQ ID NO: 1857825 - RNA, 20 nt, Salmonella typhimurium LT2
cccagcgcgccgcagcgccg

SEQ ID NO: 1857826 - RNA, 17 nt, Salmonella typhimurium LT2
cccagcgcuccaccaac

SEQ ID NO: 1857827 - RNA, 23 nt, Salmonella typhimurium LT2
cccagcggaugucggucaucagg

SEQ ID NO: 1857828 - RNA, 14 nt, Salmonella typhimurium LT2
cccagcgcccccag

SEQ ID NO: 1857829 - RNA, 16 nt, Salmonella typhimurium LT2
cccagcgcccccagca

SEQ ID NO: 1857830 - RNA, 18 nt, Salmonella typhimurium LT2
cccagcgccagccgcgcc

SEQ ID NO: 1857831 - RNA, 13 nt, Salmonella typhimurium LT2
cccagcgccagcc

SEQ ID NO: 1857832 - RNA, 14 nt, Salmonella typhimurium LT2
cccagcgccagccg

SEQ ID NO: 1857833 - RNA, 14 nt, Salmonella typhimurium LT2
cccagcgaacuggc

SEQ ID NO: 1857834 - RNA, 16 nt, Salmonella typhimurium LT2
ccauccgggccacucu

SEQ ID NO: 1857835 - RNA, 15 nt, Salmonella typhimurium LT2
ccauccggcaucucu

SEQ ID NO: 1857836 - RNA, 14 nt, Salmonella typhimurium LT2
ccauccggcaaaau

SEQ ID NO: 1857837 - RNA, 17 nt, Salmonella typhimurium LT2
ccauccggcacaguauu

SEQ ID NO: 1857838 - RNA, 23 nt, Salmonella typhimurium LT2
ccauccggcacggucaaucauca

SEQ ID NO: 1857839 - RNA, 16 nt, Salmonella typhimurium LT2
ccauccaccagaaccu

SEQ ID NO: 1857840 - RNA, 13 nt, Salmonella typhimurium LT2
ccauccacgccag

SEQ ID NO: 1857841 - RNA, 14 nt, Salmonella typhimurium LT2
ccauccacgccagc

SEQ ID NO: 1857842 - RNA, 18 nt, Salmonella typhimurium LT2
ccaucgcgccaucggcuu

SEQ ID NO: 1857843 - RNA, 20 nt, Salmonella typhimurium LT2
ccaucgccugaugaccgccg

SEQ ID NO: 1857844 - RNA, 21 nt, Salmonella typhimurium LT2
ccaucgccugaugaccgccgu

SEQ ID NO: 1857845 - RNA, 19 nt, Salmonella typhimurium LT2
ccaucgccaguaccgacgc

SEQ ID NO: 1857846 - RNA, 21 nt, Salmonella typhimurium LT2
ccaucgccagcacuuccugcu

SEQ ID NO: 1857847 - RNA, 22 nt, Salmonella typhimurium LT2
ccauccucauuuuguugcucca

SEQ ID NO: 1857848 - RNA, 23 nt, Salmonella typhimurium LT2
ccauauuuuuucugccaguuucu

SEQ ID NO: 1857849 - RNA, 12 nt, Salmonella typhimurium LT2
ccauauugcugu

SEQ ID NO: 1857850 - RNA, 18 nt, Salmonella typhimurium LT2
ccauauuuaugcagcgcg

SEQ ID NO: 1857851 - RNA, 12 nt, Salmonella typhimurium LT2
ccauauuuucca

SEQ ID NO: 1857852 - RNA, 14 nt, Salmonella typhimurium LT2
ccauaguccaugcc

SEQ ID NO: 1857853 - RNA, 22 nt, Salmonella typhimurium LT2
ccauaugcccccgcgcaggcgg

SEQ ID NO: 1857854 - RNA, 15 nt, Salmonella typhimurium LT2
ccaucauaccgccaa

SEQ ID NO: 1857855 - RNA, 20 nt, Salmonella typhimurium LT2
ccaucauugacuucaacgca

SEQ ID NO: 1857856 - RNA, 15 nt, Salmonella typhimurium LT2
ccaucauucaacgca

SEQ ID NO: 1857857 - RNA, 15 nt, Salmonella typhimurium LT2
ccaucaggcauaaac

SEQ ID NO: 1857858 - RNA, 16 nt, Salmonella typhimurium LT2
ccaugcauaaugcagc

SEQ ID NO: 1857859 - RNA, 18 nt, Salmonella typhimurium LT2
ccaugcauaaugcagcca

SEQ ID NO: 1857860 - RNA, 17 nt, Salmonella typhimurium LT2
ccaugcaaaaugcuucu

SEQ ID NO: 1857861 - RNA, 15 nt, Salmonella typhimurium LT2
ccaugagcgaaacuc

SEQ ID NO: 1857862 - RNA, 19 nt, Salmonella typhimurium LT2
ccaugacgcagugcaauau

SEQ ID NO: 1857863 - RNA, 14 nt, Salmonella typhimurium LT2
ccaugacgacaggu

SEQ ID NO: 1857864 - RNA, 18 nt, Salmonella typhimurium LT2
ccaugacgcaccguggaa

SEQ ID NO: 1857865 - RNA, 19 nt, Salmonella typhimurium LT2
ccaugcccaguucaaucaa

SEQ ID NO: 1857866 - RNA, 16 nt, Salmonella typhimurium LT2
ccaugccgaagacucc

SEQ ID NO: 1857867 - RNA, 21 nt, Salmonella typhimurium LT2
ccaugccgaagacuccccugc

SEQ ID NO: 1857868 - RNA, 17 nt, Salmonella typhimurium LT2
ccaugcccggcggcggc

SEQ ID NO: 1857869 - RNA, 14 nt, Salmonella typhimurium LT2
ccauggccgcagcc

SEQ ID NO: 1857870 - RNA, 22 nt, Salmonella typhimurium LT2
ccaucuuugcaccgcuaaaaaa

SEQ ID NO: 1857871 - RNA, 14 nt, Salmonella typhimurium LT2
ccaucuuuuuucac

SEQ ID NO: 1857872 - RNA, 16 nt, Salmonella typhimurium LT2
ccaucuuucacccauu

SEQ ID NO: 1857873 - RNA, 22 nt, Salmonella typhimurium LT2
ccaugaccaccagcgcgaccgg

SEQ ID NO: 1857874 - RNA, 22 nt, Salmonella typhimurium LT2
ccaucgcuuuacguuuggcggc

SEQ ID NO: 1857875 - RNA, 17 nt, Salmonella typhimurium LT2
ccaucggcaaacgccgc

SEQ ID NO: 1857876 - RNA, 19 nt, Salmonella typhimurium LT2
ccaucggcaaacgccgccu

SEQ ID NO: 1857877 - RNA, 23 nt, Salmonella typhimurium LT2
ccaucgggcauucaguuugcaac

SEQ ID NO: 1857878 - RNA, 14 nt, Salmonella typhimurium LT2
ccaucguccagcca

SEQ ID NO: 1857879 - RNA, 19 nt, Salmonella typhimurium LT2
ccauguugcguaaauaaau

SEQ ID NO: 1857880 - RNA, 21 nt, Salmonella typhimurium LT2
ccauguugagcgcuugcugcg

SEQ ID NO: 1857881 - RNA, 19 nt, Salmonella typhimurium LT2
ccaugguucccgccacuga

SEQ ID NO: 1857882 - RNA, 15 nt, Salmonella typhimurium LT2
ccauguacuccuggu

SEQ ID NO: 1857883 - RNA, 20 nt, Salmonella typhimurium LT2
ccauggguuauccucuccug

SEQ ID NO: 1857884 - RNA, 18 nt, Salmonella typhimurium LT2
ccauucccguaaaagaag

SEQ ID NO: 1857885 - RNA, 12 nt, Salmonella typhimurium LT2
ccauuccccagc

SEQ ID NO: 1857886 - RNA, 20 nt, Salmonella typhimurium LT2
ccauucccgauaaugaccga

SEQ ID NO: 1857887 - RNA, 16 nt, Salmonella typhimurium LT2
ccauucggccugcggu

SEQ ID NO: 1857888 - RNA, 24 nt, Salmonella typhimurium LT2
ccauuauuuauuuucauacuauuu

SEQ ID NO: 1857889 - RNA, 22 nt, Salmonella typhimurium LT2
ccauucgccagcccgaucaucu

SEQ ID NO: 1857890 - RNA, 13 nt, Salmonella typhimurium LT2
ccauuagcuguug

SEQ ID NO: 1857891 - RNA, 12 nt, Salmonella typhimurium LT2
ccauuacucuca

SEQ ID NO: 1857892 - RNA, 17 nt, Salmonella typhimurium LT2
ccauucccgauaaugac

SEQ ID NO: 1857893 - RNA, 22 nt, Salmonella typhimurium LT2
ccauuaaaagccagcacggcuu

SEQ ID NO: 1857894 - RNA, 22 nt, Salmonella typhimurium LT2
ccauguuuuuuacaggcauccg

SEQ ID NO: 1857895 - RNA, 13 nt, Salmonella typhimurium LT2
ccauuaaugcagg

SEQ ID NO: 1857896 - RNA, 13 nt, Salmonella typhimurium LT2
ccauuaaugccgc

SEQ ID NO: 1857897 - RNA, 15 nt, Salmonella typhimurium LT2
ccauuaauauuuuau

SEQ ID NO: 1857898 - RNA, 23 nt, Salmonella typhimurium LT2
ccauuaauauuuuaucacuauua

SEQ ID NO: 1857899 - RNA, 15 nt, Salmonella typhimurium LT2
cccaacugagcgcca

SEQ ID NO: 1857900 - RNA, 16 nt, Salmonella typhimurium LT2
cccaacugagcgccaa

SEQ ID NO: 1857901 - RNA, 18 nt, Salmonella typhimurium LT2
cccaacuguuaucauaga

SEQ ID NO: 1857902 - RNA, 20 nt, Salmonella typhimurium LT2
cccaacggaugcgccauccc

SEQ ID NO: 1857903 - RNA, 23 nt, Salmonella typhimurium LT2
cccaacgcuucggcgaucgcuuu

SEQ ID NO: 1857904 - RNA, 15 nt, Salmonella typhimurium LT2
cccaacgaccauaaa

SEQ ID NO: 1857905 - RNA, 17 nt, Salmonella typhimurium LT2
cccaacgagagcacuac

SEQ ID NO: 1857906 - RNA, 18 nt, Salmonella typhimurium LT2
ccauuuugguuacuauuu

SEQ ID NO: 1857907 - RNA, 17 nt, Salmonella typhimurium LT2
ccauuuuucagauagcg

SEQ ID NO: 1857908 - RNA, 13 nt, Salmonella typhimurium LT2
ccauuuuuuuagc

SEQ ID NO: 1857909 - RNA, 21 nt, Salmonella typhimurium LT2
ccauuucgccuauuuucucuu

SEQ ID NO: 1857910 - RNA, 14 nt, Salmonella typhimurium LT2
ccauuugccagaua

SEQ ID NO: 1857911 - RNA, 17 nt, Salmonella typhimurium LT2
ccauuugccagauagcg

SEQ ID NO: 1857912 - RNA, 22 nt, Salmonella typhimurium LT2
ccauuugaacucuuccagauac

SEQ ID NO: 1857913 - RNA, 23 nt, Salmonella typhimurium LT2
ccauuuuccuauggacauuggcc

SEQ ID NO: 1857914 - RNA, 11 nt, Salmonella typhimurium LT2
ccauugccgcg

SEQ ID NO: 1857915 - RNA, 13 nt, Salmonella typhimurium LT2
ccauugcccgcug

SEQ ID NO: 1857916 - RNA, 12 nt, Salmonella typhimurium LT2
ccauugcccauu

SEQ ID NO: 1857917 - RNA, 14 nt, Salmonella typhimurium LT2
ccauugcguauuuc

SEQ ID NO: 1857918 - RNA, 19 nt, Salmonella typhimurium LT2
ccauugcgaguuaucuuuu

SEQ ID NO: 1857919 - RNA, 16 nt, Salmonella typhimurium LT2
ccauugcugacaaaau

SEQ ID NO: 1857920 - RNA, 16 nt, Salmonella typhimurium LT2
ccauugcugucgacaa

SEQ ID NO: 1857921 - RNA, 21 nt, Salmonella typhimurium LT2
ccauugcugcuauauaacaua

SEQ ID NO: 1857922 - RNA, 21 nt, Salmonella typhimurium LT2
ccauaaugaucguaugcagcc

SEQ ID NO: 1857923 - RNA, 23 nt, Salmonella typhimurium LT2
ccauaauuaccggcacaccggcc

SEQ ID NO: 1857924 - RNA, 17 nt, Salmonella typhimurium LT2
ccaguuuuuuccagcgc

SEQ ID NO: 1857925 - RNA, 12 nt, Salmonella typhimurium LT2
ccauaaaaugau

SEQ ID NO: 1857926 - RNA, 20 nt, Salmonella typhimurium LT2
ccauaaaaauggcauugccc

SEQ ID NO: 1857927 - RNA, 20 nt, Salmonella typhimurium LT2
ccaguuguccgcuggucagc

SEQ ID NO: 1857928 - RNA, 17 nt, Salmonella typhimurium LT2
ccaguugcuuaccuugu

SEQ ID NO: 1857929 - RNA, 14 nt, Salmonella typhimurium LT2
ccaguugcgcaggg

SEQ ID NO: 1857930 - RNA, 20 nt, Salmonella typhimurium LT2
ccaguugcucauaacggcua

SEQ ID NO: 1857931 - RNA, 17 nt, Salmonella typhimurium LT2
ccaguugcauacauaaa

SEQ ID NO: 1857932 - RNA, 17 nt, Salmonella typhimurium LT2
ccaguugcgaagccacu

SEQ ID NO: 1857933 - RNA, 16 nt, Salmonella typhimurium LT2
ccauacccggcuccca

SEQ ID NO: 1857934 - RNA, 16 nt, Salmonella typhimurium LT2
ccauacccaacagcag

SEQ ID NO: 1857935 - RNA, 21 nt, Salmonella typhimurium LT2
ccauacacugcauaaauaucu

SEQ ID NO: 1857936 - RNA, 18 nt, Salmonella typhimurium LT2
ccauacagcccauaccac

SEQ ID NO: 1857937 - RNA, 20 nt, Salmonella typhimurium LT2
ccauacacugcauaaauauc

SEQ ID NO: 1857938 - RNA, 17 nt, Salmonella typhimurium LT2
ccauacgguggccagac

SEQ ID NO: 1857939 - RNA, 16 nt, Salmonella typhimurium LT2
ccauagggcagggugc

SEQ ID NO: 1857940 - RNA, 23 nt, Salmonella typhimurium LT2
ccauagucagaucccuaacuggu

SEQ ID NO: 1857941 - RNA, 15 nt, Salmonella typhimurium LT2
ccagugaucggcugg

SEQ ID NO: 1857942 - RNA, 17 nt, Salmonella typhimurium LT2
ccagugccaguuaagca

SEQ ID NO: 1857943 - RNA, 23 nt, Salmonella typhimurium LT2
ccagugccaccagccggagccgg

SEQ ID NO: 1857944 - RNA, 21 nt, Salmonella typhimurium LT2
ccagugccaccagccggagcc

SEQ ID NO: 1857945 - RNA, 18 nt, Salmonella typhimurium LT2
ccagugccgccagaauca

SEQ ID NO: 1857946 - RNA, 22 nt, Salmonella typhimurium LT2
ccaguucaauauccagcccgcg

SEQ ID NO: 1857947 - RNA, 22 nt, Salmonella typhimurium LT2
ccaguucacuccuaagagaaaa

SEQ ID NO: 1857948 - RNA, 16 nt, Salmonella typhimurium LT2
ccaguucauuaacauc

SEQ ID NO: 1857949 - RNA, 15 nt, Salmonella typhimurium LT2
ccagucgcuccacca

SEQ ID NO: 1857950 - RNA, 18 nt, Salmonella typhimurium LT2
ccagucgacucaucuuuu

SEQ ID NO: 1857951 - RNA, 21 nt, Salmonella typhimurium LT2
ccaguccuccggcugaagccc

SEQ ID NO: 1857952 - RNA, 14 nt, Salmonella typhimurium LT2
ccaguccccuuuuc

SEQ ID NO: 1857953 - RNA, 14 nt, Salmonella typhimurium LT2
ccagucccuguucg

SEQ ID NO: 1857954 - RNA, 22 nt, Salmonella typhimurium LT2
ccagucccuguucgccacccgc

SEQ ID NO: 1857955 - RNA, 14 nt, Salmonella typhimurium LT2
ccagugaaaaaaag

SEQ ID NO: 1857956 - RNA, 17 nt, Salmonella typhimurium LT2
ccagugaauccaccacg

SEQ ID NO: 1857957 - RNA, 14 nt, Salmonella typhimurium LT2
ccagugaauacugc

SEQ ID NO: 1857958 - RNA, 21 nt, Salmonella typhimurium LT2
ccagugacacguaccugccug

SEQ ID NO: 1857959 - RNA, 17 nt, Salmonella typhimurium LT2
ccagucgcuccaccacu

SEQ ID NO: 1857960 - RNA, 20 nt, Salmonella typhimurium LT2
ccaguaacucaucgccagcc

SEQ ID NO: 1857961 - RNA, 20 nt, Salmonella typhimurium LT2
ccaguaaaaucgggccuccg

SEQ ID NO: 1857962 - RNA, 20 nt, Salmonella typhimurium LT2
ccaguaacgcguccaacugg

SEQ ID NO: 1857963 - RNA, 17 nt, Salmonella typhimurium LT2
ccaguaagagaacaaua

SEQ ID NO: 1857964 - RNA, 20 nt, Salmonella typhimurium LT2
ccaguacgccaggcuaagau

SEQ ID NO: 1857965 - RNA, 19 nt, Salmonella typhimurium LT2
ccaguacaaacaaauaaau

SEQ ID NO: 1857966 - RNA, 23 nt, Salmonella typhimurium LT2
ccaguaauuuuucucccagcaga

SEQ ID NO: 1857967 - RNA, 17 nt, Salmonella typhimurium LT2
ccaguacaaacaaauaa

SEQ ID NO: 1857968 - RNA, 20 nt, Salmonella typhimurium LT2
ccaguacaacaauugugaug

SEQ ID NO: 1857969 - RNA, 14 nt, Salmonella typhimurium LT2
ccagucaucgccgc

SEQ ID NO: 1857970 - RNA, 22 nt, Salmonella typhimurium LT2
ccaguccacaucuaccagguug

SEQ ID NO: 1857971 - RNA, 21 nt, Salmonella typhimurium LT2
ccagucaacgaggugaauaaa

SEQ ID NO: 1857972 - RNA, 15 nt, Salmonella typhimurium LT2
ccagucaauaaaaca

SEQ ID NO: 1857973 - RNA, 22 nt, Salmonella typhimurium LT2
ccagucagcaauuaacaaauaa

SEQ ID NO: 1857974 - RNA, 13 nt, Salmonella typhimurium LT2
ccagucaccagca

SEQ ID NO: 1857975 - RNA, 14 nt, Salmonella typhimurium LT2
ccaguagcugcucc

SEQ ID NO: 1857976 - RNA, 15 nt, Salmonella typhimurium LT2
ccaguacuuucuuuu

SEQ ID NO: 1857977 - RNA, 21 nt, Salmonella typhimurium LT2
ccaguacuuuggccuaacagu

SEQ ID NO: 1857978 - RNA, 12 nt, Salmonella typhimurium LT2
ccaguagcagcg

SEQ ID NO: 1857979 - RNA, 14 nt, Salmonella typhimurium LT2
ccaguagcgcgccc

SEQ ID NO: 1857980 - RNA, 18 nt, Salmonella typhimurium LT2
ccaggugucguuaaugcu

SEQ ID NO: 1857981 - RNA, 16 nt, Salmonella typhimurium LT2
ccagguuauucaggug

SEQ ID NO: 1857982 - RNA, 18 nt, Salmonella typhimurium LT2
ccagguuauucaggugga

SEQ ID NO: 1857983 - RNA, 17 nt, Salmonella typhimurium LT2
ccagguucaagcuggaa

SEQ ID NO: 1857984 - RNA, 17 nt, Salmonella typhimurium LT2
ccagguugaugcaaaug

SEQ ID NO: 1857985 - RNA, 18 nt, Salmonella typhimurium LT2
ccaggugacuuugcccuu

SEQ ID NO: 1857986 - RNA, 20 nt, Salmonella typhimurium LT2
ccaggugacuuugcccuuuu

SEQ ID NO: 1857987 - RNA, 13 nt, Salmonella typhimurium LT2
ccagccgcuuaau

SEQ ID NO: 1857988 - RNA, 21 nt, Salmonella typhimurium LT2
ccagccgcgccaucuccuccu

SEQ ID NO: 1857989 - RNA, 13 nt, Salmonella typhimurium LT2
ccagccgccgccg

SEQ ID NO: 1857990 - RNA, 19 nt, Salmonella typhimurium LT2
ccagguaacauacaaaaag

SEQ ID NO: 1857991 - RNA, 22 nt, Salmonella typhimurium LT2
ccagguaacauacaaaaaguac

SEQ ID NO: 1857992 - RNA, 19 nt, Salmonella typhimurium LT2
cggcggcgcaucgcucacc

SEQ ID NO: 1857993 - RNA, 22 nt, Salmonella typhimurium LT2
cggcgcgguauuucgccgccgc

SEQ ID NO: 1857994 - RNA, 15 nt, Salmonella typhimurium LT2
cggcgcggggaacac

SEQ ID NO: 1857995 - RNA, 18 nt, Salmonella typhimurium LT2
cggcgcguaauucagcau

SEQ ID NO: 1857996 - RNA, 14 nt, Salmonella typhimurium LT2
cggcgcucaaugug

SEQ ID NO: 1857997 - RNA, 15 nt, Salmonella typhimurium LT2
cggcgcuggcgcgcu

SEQ ID NO: 1857998 - RNA, 22 nt, Salmonella typhimurium LT2
cggcgcugucacuccggcugca

SEQ ID NO: 1857999 - RNA, 21 nt, Salmonella typhimurium LT2
cggcgcuuucgauaaucugac

SEQ ID NO: 1858000 - RNA, 17 nt, Salmonella typhimurium LT2
cggcgcugucguuccac

SEQ ID NO: 1858001 - RNA, 15 nt, Salmonella typhimurium LT2
cggcgcuucgcagcg

SEQ ID NO: 1858002 - RNA, 23 nt, Salmonella typhimurium LT2
cggcguaaaccccuucaccacuu

SEQ ID NO: 1858003 - RNA, 14 nt, Salmonella typhimurium LT2
cggcggucagccag

SEQ ID NO: 1858004 - RNA, 13 nt, Salmonella typhimurium LT2
cggcggucgccgc

SEQ ID NO: 1858005 - RNA, 15 nt, Salmonella typhimurium LT2
cggcguaccgcgcgc

SEQ ID NO: 1858006 - RNA, 16 nt, Salmonella typhimurium LT2
cggcgauagcgcccca

SEQ ID NO: 1858007 - RNA, 21 nt, Salmonella typhimurium LT2
cggcgccaaucaccgccagca

SEQ ID NO: 1858008 - RNA, 18 nt, Salmonella typhimurium LT2
cggcgcauuuucggcagc

SEQ ID NO: 1858009 - RNA, 14 nt, Salmonella typhimurium LT2
cggcgccaacaauc

SEQ ID NO: 1858010 - RNA, 20 nt, Salmonella typhimurium LT2
cggcgccaacaaucgggaac

SEQ ID NO: 1858011 - RNA, 21 nt, Salmonella typhimurium LT2
cggcgccaacaaucgggaaca

SEQ ID NO: 1858012 - RNA, 22 nt, Salmonella typhimurium LT2
cggcgccaacaaucgggaacag

SEQ ID NO: 1858013 - RNA, 19 nt, Salmonella typhimurium LT2
cggcgcagacacugccacc

SEQ ID NO: 1858014 - RNA, 12 nt, Salmonella typhimurium LT2
cggcgcacaccc

SEQ ID NO: 1858015 - RNA, 18 nt, Salmonella typhimurium LT2
cggcgcacacccugcaga

SEQ ID NO: 1858016 - RNA, 14 nt, Salmonella typhimurium LT2
cggcgcgcgccagc

SEQ ID NO: 1858017 - RNA, 17 nt, Salmonella typhimurium LT2
cggcgcgcucuuuuucu

SEQ ID NO: 1858018 - RNA, 15 nt, Salmonella typhimurium LT2
cggcgcgcugccgcc

SEQ ID NO: 1858019 - RNA, 18 nt, Salmonella typhimurium LT2
cggcgcgaaucccgcguu

SEQ ID NO: 1858020 - RNA, 18 nt, Salmonella typhimurium LT2
cggcgcgaccauaaugac

SEQ ID NO: 1858021 - RNA, 14 nt, Salmonella typhimurium LT2
cggcgcgccaccau

SEQ ID NO: 1858022 - RNA, 10 nt, Salmonella typhimurium LT2
cggcgcgccc

SEQ ID NO: 1858023 - RNA, 15 nt, Salmonella typhimurium LT2
cggcgcccauccgcc

SEQ ID NO: 1858024 - RNA, 17 nt, Salmonella typhimurium LT2
cggcgcgaaagcgccuu

SEQ ID NO: 1858025 - RNA, 21 nt, Salmonella typhimurium LT2
cggcgccuuuaauuccgccgg

SEQ ID NO: 1858026 - RNA, 21 nt, Salmonella typhimurium LT2
cggccugcgcuggaacugauc

SEQ ID NO: 1858027 - RNA, 22 nt, Salmonella typhimurium LT2
cggccugcggugguggggccua

SEQ ID NO: 1858028 - RNA, 21 nt, Salmonella typhimurium LT2
cggcgaaaaaccaggcaacag

SEQ ID NO: 1858029 - RNA, 20 nt, Salmonella typhimurium LT2
cggcgaaaucgugcgcccca

SEQ ID NO: 1858030 - RNA, 15 nt, Salmonella typhimurium LT2
cggcgaaccggcauc

SEQ ID NO: 1858031 - RNA, 19 nt, Salmonella typhimurium LT2
cggcgaaccggcaucggca

SEQ ID NO: 1858032 - RNA, 14 nt, Salmonella typhimurium LT2
cggcgacagcgacc

SEQ ID NO: 1858033 - RNA, 17 nt, Salmonella typhimurium LT2
cggcgaacgcgcgcgcu

SEQ ID NO: 1858034 - RNA, 14 nt, Salmonella typhimurium LT2
cggcgaccagcaaa

SEQ ID NO: 1858035 - RNA, 14 nt, Salmonella typhimurium LT2
cggcgacaggcaca

SEQ ID NO: 1858036 - RNA, 16 nt, Salmonella typhimurium LT2
cggcgacgugacgcgc

SEQ ID NO: 1858037 - RNA, 15 nt, Salmonella typhimurium LT2
cggccggaugccagu

SEQ ID NO: 1858038 - RNA, 22 nt, Salmonella typhimurium LT2
cggcccaggcaucgacgccagc

SEQ ID NO: 1858039 - RNA, 13 nt, Salmonella typhimurium LT2
cggcccaggcauc

SEQ ID NO: 1858040 - RNA, 21 nt, Salmonella typhimurium LT2
cggcagugccgguugccugau

SEQ ID NO: 1858041 - RNA, 20 nt, Salmonella typhimurium LT2
cggcaguccuugcagccaga

SEQ ID NO: 1858042 - RNA, 23 nt, Salmonella typhimurium LT2
cggcauacaggccgccgggucag

SEQ ID NO: 1858043 - RNA, 16 nt, Salmonella typhimurium LT2
cggcauaacccgccgc

SEQ ID NO: 1858044 - RNA, 20 nt, Salmonella typhimurium LT2
cggcauaagccagcccugcc

SEQ ID NO: 1858045 - RNA, 12 nt, Salmonella typhimurium LT2
cggcagucgcua

SEQ ID NO: 1858046 - RNA, 19 nt, Salmonella typhimurium LT2
cggcagcgcgacauagagc

SEQ ID NO: 1858047 - RNA, 18 nt, Salmonella typhimurium LT2
cggcagcgucguccagcc

SEQ ID NO: 1858048 - RNA, 20 nt, Salmonella typhimurium LT2
cggcaggccggagcugauac

SEQ ID NO: 1858049 - RNA, 22 nt, Salmonella typhimurium LT2
cggcaggccuaacacaugcaag

SEQ ID NO: 1858050 - RNA, 17 nt, Salmonella typhimurium LT2
cggcaggcagcgccagc

SEQ ID NO: 1858051 - RNA, 15 nt, Salmonella typhimurium LT2
cggcaggcagcgcca

SEQ ID NO: 1858052 - RNA, 23 nt, Salmonella typhimurium LT2
cggcaggacaaucauaauaaacu

SEQ ID NO: 1858053 - RNA, 15 nt, Salmonella typhimurium LT2
cggcagacggcuggg

SEQ ID NO: 1858054 - RNA, 20 nt, Salmonella typhimurium LT2
cggcagacguuuaucggcca

SEQ ID NO: 1858055 - RNA, 19 nt, Salmonella typhimurium LT2
cggcagaaauuaaaucauc

SEQ ID NO: 1858056 - RNA, 20 nt, Salmonella typhimurium LT2
cggcagccgccaccacaaag

SEQ ID NO: 1858057 - RNA, 21 nt, Salmonella typhimurium LT2
cggcagccugccgcaucugac

SEQ ID NO: 1858058 - RNA, 23 nt, Salmonella typhimurium LT2
cggcagcgcauaagccacuucaa

SEQ ID NO: 1858059 - RNA, 12 nt, Salmonella typhimurium LT2
cgcuugccacua

SEQ ID NO: 1858060 - RNA, 21 nt, Salmonella typhimurium LT2
cgcuugccaguacgccaggcu

SEQ ID NO: 1858061 - RNA, 15 nt, Salmonella typhimurium LT2
cgcuugcaccauggc

SEQ ID NO: 1858062 - RNA, 15 nt, Salmonella typhimurium LT2
cgcuugagcaggcuu

SEQ ID NO: 1858063 - RNA, 14 nt, Salmonella typhimurium LT2
cgcuugcgccgcca

SEQ ID NO: 1858064 - RNA, 14 nt, Salmonella typhimurium LT2
cgcuugcuccgcag

SEQ ID NO: 1858065 - RNA, 14 nt, Salmonella typhimurium LT2
cggcacgagcacug

SEQ ID NO: 1858066 - RNA, 19 nt, Salmonella typhimurium LT2
cggcaugaauugccguggu

SEQ ID NO: 1858067 - RNA, 19 nt, Salmonella typhimurium LT2
cggcaucuuuaaccgccug

SEQ ID NO: 1858068 - RNA, 13 nt, Salmonella typhimurium LT2
cggcaucacgccg

SEQ ID NO: 1858069 - RNA, 14 nt, Salmonella typhimurium LT2
cggcaucagauggc

SEQ ID NO: 1858070 - RNA, 18 nt, Salmonella typhimurium LT2
cggcaucccuuucauuuu

SEQ ID NO: 1858071 - RNA, 16 nt, Salmonella typhimurium LT2
cggcauauccggcgca

SEQ ID NO: 1858072 - RNA, 16 nt, Salmonella typhimurium LT2
cggcauaugcaggucg

SEQ ID NO: 1858073 - RNA, 11 nt, Salmonella typhimurium LT2
cggcauagcug

SEQ ID NO: 1858074 - RNA, 19 nt, Salmonella typhimurium LT2
cggcauaugcaggucgcgc

SEQ ID NO: 1858075 - RNA, 21 nt, Salmonella typhimurium LT2
cggcauauggauauucauugc

SEQ ID NO: 1858076 - RNA, 16 nt, Salmonella typhimurium LT2
cggcaugucgccagcc

SEQ ID NO: 1858077 - RNA, 16 nt, Salmonella typhimurium LT2
cggcauuaauuucuug

SEQ ID NO: 1858078 - RNA, 23 nt, Salmonella typhimurium LT2
cggcauguccggcgacuccagaa

SEQ ID NO: 1858079 - RNA, 13 nt, Salmonella typhimurium LT2
cggcauggucagc

SEQ ID NO: 1858080 - RNA, 17 nt, Salmonella typhimurium LT2
cggcauuagcaugggcu

SEQ ID NO: 1858081 - RNA, 14 nt, Salmonella typhimurium LT2
cggccaccaggccu

SEQ ID NO: 1858082 - RNA, 22 nt, Salmonella typhimurium LT2
cggccaaagcgcgacuggaacg

SEQ ID NO: 1858083 - RNA, 14 nt, Salmonella typhimurium LT2
cggccaaagggagc

SEQ ID NO: 1858084 - RNA, 19 nt, Salmonella typhimurium LT2
cggccaacuuauccgacgc

SEQ ID NO: 1858085 - RNA, 20 nt, Salmonella typhimurium LT2
cggccaguucuuguaguuuu

SEQ ID NO: 1858086 - RNA, 18 nt, Salmonella typhimurium LT2
cggccaguugcuucauau

SEQ ID NO: 1858087 - RNA, 23 nt, Salmonella typhimurium LT2
cggccaguugcuucauaucgcca

SEQ ID NO: 1858088 - RNA, 19 nt, Salmonella typhimurium LT2
cggccaguguacauagcuu

SEQ ID NO: 1858089 - RNA, 20 nt, Salmonella typhimurium LT2
cggccaggcaaagauccacc

SEQ ID NO: 1858090 - RNA, 19 nt, Salmonella typhimurium LT2
cgccgacccccuccuugua

SEQ ID NO: 1858091 - RNA, 16 nt, Salmonella typhimurium LT2
cgccgaccccggcggg

SEQ ID NO: 1858092 - RNA, 14 nt, Salmonella typhimurium LT2
cgccgaccaccagc

SEQ ID NO: 1858093 - RNA, 21 nt, Salmonella typhimurium LT2
cgccgaccacuucaacgccgc

SEQ ID NO: 1858094 - RNA, 20 nt, Salmonella typhimurium LT2
cgccgacauucccugcgcau

SEQ ID NO: 1858095 - RNA, 17 nt, Salmonella typhimurium LT2
cgccgacucacgcagcg

SEQ ID NO: 1858096 - RNA, 14 nt, Salmonella typhimurium LT2
cgccgacucacgca

SEQ ID NO: 1858097 - RNA, 16 nt, Salmonella typhimurium LT2
cgccgacucacgcagc

SEQ ID NO: 1858098 - RNA, 15 nt, Salmonella typhimurium LT2
cgccgaucagcacca

SEQ ID NO: 1858099 - RNA, 19 nt, Salmonella typhimurium LT2
cgccgcaaacgccgagccg

SEQ ID NO: 1858100 - RNA, 21 nt, Salmonella typhimurium LT2
cgccgauuaaugcuccaauaa

SEQ ID NO: 1858101 - RNA, 16 nt, Salmonella typhimurium LT2
cgccgcaaccaaagcc

SEQ ID NO: 1858102 - RNA, 20 nt, Salmonella typhimurium LT2
cgccgccagauagccgcgcu

SEQ ID NO: 1858103 - RNA, 15 nt, Salmonella typhimurium LT2
cgccgccgaacagac

SEQ ID NO: 1858104 - RNA, 14 nt, Salmonella typhimurium LT2
cgccgccaggucuu

SEQ ID NO: 1858105 - RNA, 13 nt, Salmonella typhimurium LT2
cgccgccaggucu

SEQ ID NO: 1858106 - RNA, 16 nt, Salmonella typhimurium LT2
cgcccuuucaguucaa

SEQ ID NO: 1858107 - RNA, 23 nt, Salmonella typhimurium LT2
cgcccuuucaguucaaccugcgc

SEQ ID NO: 1858108 - RNA, 16 nt, Salmonella typhimurium LT2
cgccgaacaggccaug

SEQ ID NO: 1858109 - RNA, 22 nt, Salmonella typhimurium LT2
cgccgaacgauugacccgccgc

SEQ ID NO: 1858110 - RNA, 16 nt, Salmonella typhimurium LT2
cgcccuucgucaggag

SEQ ID NO: 1858111 - RNA, 15 nt, Salmonella typhimurium LT2
cgcccugcgcgccuu

SEQ ID NO: 1858112 - RNA, 14 nt, Salmonella typhimurium LT2
cgcccguuuuuucc

SEQ ID NO: 1858113 - RNA, 22 nt, Salmonella typhimurium LT2
cgcccugcaggcggugcgcagc

SEQ ID NO: 1858114 - RNA, 14 nt, Salmonella typhimurium LT2
cgcccugcgccagc

SEQ ID NO: 1858115 - RNA, 16 nt, Salmonella typhimurium LT2
cgcccugcgucgcgcu

SEQ ID NO: 1858116 - RNA, 19 nt, Salmonella typhimurium LT2
cgcccugcgguagcgccga

SEQ ID NO: 1858117 - RNA, 18 nt, Salmonella typhimurium LT2
cgcccgcucgcgauccuc

SEQ ID NO: 1858118 - RNA, 14 nt, Salmonella typhimurium LT2
cgcccggcgccagc

SEQ ID NO: 1858119 - RNA, 22 nt, Salmonella typhimurium LT2
cgcccgguugcaauuccgccau

SEQ ID NO: 1858120 - RNA, 17 nt, Salmonella typhimurium LT2
cgcccguuguccgccag

SEQ ID NO: 1858121 - RNA, 18 nt, Salmonella typhimurium LT2
cgcccguuguccgccagc

SEQ ID NO: 1858122 - RNA, 18 nt, Salmonella typhimurium LT2
cgcccguaccgcggcgcu

SEQ ID NO: 1858123 - RNA, 15 nt, Salmonella typhimurium LT2
cgcccaucgccacag

SEQ ID NO: 1858124 - RNA, 16 nt, Salmonella typhimurium LT2
cgcccaucgccacagc

SEQ ID NO: 1858125 - RNA, 16 nt, Salmonella typhimurium LT2
cgcccauccagagcag

SEQ ID NO: 1858126 - RNA, 15 nt, Salmonella typhimurium LT2
cgcccauccgcccac

SEQ ID NO: 1858127 - RNA, 17 nt, Salmonella typhimurium LT2
cgcccaggccagugcca

SEQ ID NO: 1858128 - RNA, 23 nt, Salmonella typhimurium LT2
cgccccagcaugagccagcccuc

SEQ ID NO: 1858129 - RNA, 16 nt, Salmonella typhimurium LT2
cgccccagccaaagcc

SEQ ID NO: 1858130 - RNA, 21 nt, Salmonella typhimurium LT2
cgccccagcgguaccaccagc

SEQ ID NO: 1858131 - RNA, 21 nt, Salmonella typhimurium LT2
cgccccagcaugagccagccc

SEQ ID NO: 1858132 - RNA, 15 nt, Salmonella typhimurium LT2
cgcccaugcggcuga

SEQ ID NO: 1858133 - RNA, 21 nt, Salmonella typhimurium LT2
cgcccagcguacguaacuucu

SEQ ID NO: 1858134 - RNA, 17 nt, Salmonella typhimurium LT2
cgcccagauauccgcgc

SEQ ID NO: 1858135 - RNA, 17 nt, Salmonella typhimurium LT2
cgcccagcacuaacagc

SEQ ID NO: 1858136 - RNA, 12 nt, Salmonella typhimurium LT2
cgcccagcgccg

SEQ ID NO: 1858137 - RNA, 18 nt, Salmonella typhimurium LT2
cgcccgcgaucgcuucca

SEQ ID NO: 1858138 - RNA, 15 nt, Salmonella typhimurium LT2
cgcccgcgcgccagc

SEQ ID NO: 1858139 - RNA, 14 nt, Salmonella typhimurium LT2
cgcccgcgcucccg

SEQ ID NO: 1858140 - RNA, 12 nt, Salmonella typhimurium LT2
cgccccggcggc

SEQ ID NO: 1858141 - RNA, 18 nt, Salmonella typhimurium LT2
cgccauuugccagauagc

SEQ ID NO: 1858142 - RNA, 13 nt, Salmonella typhimurium LT2
cgccauuuccagc

SEQ ID NO: 1858143 - RNA, 22 nt, Salmonella typhimurium LT2
cgccauuggcaaucaguacgcg

SEQ ID NO: 1858144 - RNA, 16 nt, Salmonella typhimurium LT2
cgccauugcgggagcu

SEQ ID NO: 1858145 - RNA, 20 nt, Salmonella typhimurium LT2
cgccauugcugucgguuaac

SEQ ID NO: 1858146 - RNA, 18 nt, Salmonella typhimurium LT2
cgccauuccugccgccgc

SEQ ID NO: 1858147 - RNA, 23 nt, Salmonella typhimurium LT2
cgcccacuuguaccaacugcugc

SEQ ID NO: 1858148 - RNA, 11 nt, Salmonella typhimurium LT2
cgcccaaugcg

SEQ ID NO: 1858149 - RNA, 14 nt, Salmonella typhimurium LT2
cgcccaaccagccc

SEQ ID NO: 1858150 - RNA, 19 nt, Salmonella typhimurium LT2
cgccaucaggcuggguaac

SEQ ID NO: 1858151 - RNA, 17 nt, Salmonella typhimurium LT2
cgccaucaggcauaaac

SEQ ID NO: 1858152 - RNA, 21 nt, Salmonella typhimurium LT2
cgccaucaugcccacaggcag

SEQ ID NO: 1858153 - RNA, 22 nt, Salmonella typhimurium LT2
cgccaucaggcaugaccugccg

SEQ ID NO: 1858154 - RNA, 15 nt, Salmonella typhimurium LT2
cgccaucaggcaugc

SEQ ID NO: 1858155 - RNA, 17 nt, Salmonella typhimurium LT2
cgccaucaggcaaucuu

SEQ ID NO: 1858156 - RNA, 22 nt, Salmonella typhimurium LT2
cgccaucaggcaauucggcccu

SEQ ID NO: 1858157 - RNA, 16 nt, Salmonella typhimurium LT2
cgccaucagccgcgcu

SEQ ID NO: 1858158 - RNA, 18 nt, Salmonella typhimurium LT2
cgccaucaacuccuccgg

SEQ ID NO: 1858159 - RNA, 20 nt, Salmonella typhimurium LT2
cgccaucaauuuugcgccua

SEQ ID NO: 1858160 - RNA, 12 nt, Salmonella typhimurium LT2
cgccaucaccag

SEQ ID NO: 1858161 - RNA, 17 nt, Salmonella typhimurium LT2
cgccaucagacauuguu

SEQ ID NO: 1858162 - RNA, 14 nt, Salmonella typhimurium LT2
cgccaucgccgccu

SEQ ID NO: 1858163 - RNA, 15 nt, Salmonella typhimurium LT2
cgccauccugcaccg

SEQ ID NO: 1858164 - RNA, 19 nt, Salmonella typhimurium LT2
cgccaucgccgccucgcgu

SEQ ID NO: 1858165 - RNA, 21 nt, Salmonella typhimurium LT2
cgccauccggcaauuuauacc

SEQ ID NO: 1858166 - RNA, 17 nt, Salmonella typhimurium LT2
cgccauccggcacaaaa

SEQ ID NO: 1858167 - RNA, 19 nt, Salmonella typhimurium LT2
cgccauccggcacggucaa

SEQ ID NO: 1858168 - RNA, 15 nt, Salmonella typhimurium LT2
cgccauccaccagga

SEQ ID NO: 1858169 - RNA, 22 nt, Salmonella typhimurium LT2
cgccauccgguaaacaugcugg

SEQ ID NO: 1858170 - RNA, 13 nt, Salmonella typhimurium LT2
cgccauccggccu

SEQ ID NO: 1858171 - RNA, 14 nt, Salmonella typhimurium LT2
cgccauccggccuc

SEQ ID NO: 1858172 - RNA, 21 nt, Salmonella typhimurium LT2
cgccauaaaucagauccacgc

SEQ ID NO: 1858173 - RNA, 18 nt, Salmonella typhimurium LT2
cgccauaaaucagaucca

SEQ ID NO: 1858174 - RNA, 22 nt, Salmonella typhimurium LT2
cgccauaaaaaacaccugucug

SEQ ID NO: 1858175 - RNA, 23 nt, Salmonella typhimurium LT2
cgccaguuuuugcgccauugccg

SEQ ID NO: 1858176 - RNA, 16 nt, Salmonella typhimurium LT2
cgccaguuuuuauacu

SEQ ID NO: 1858177 - RNA, 17 nt, Salmonella typhimurium LT2
cgccauauccccgccau

SEQ ID NO: 1858178 - RNA, 15 nt, Salmonella typhimurium LT2
cgccauauccgcaga

SEQ ID NO: 1858179 - RNA, 19 nt, Salmonella typhimurium LT2
cgccauaaugcuuaauuca

SEQ ID NO: 1858180 - RNA, 23 nt, Salmonella typhimurium LT2
cgccauaaugcuuaauucauaac

SEQ ID NO: 1858181 - RNA, 13 nt, Salmonella typhimurium LT2
cgccauacccggc

SEQ ID NO: 1858182 - RNA, 19 nt, Salmonella typhimurium LT2
cgccaguucaauauccagc

SEQ ID NO: 1858183 - RNA, 19 nt, Salmonella typhimurium LT2
cgccaguucauccagcagc

SEQ ID NO: 1858184 - RNA, 17 nt, Salmonella typhimurium LT2
cgccaguucauucgcca

SEQ ID NO: 1858185 - RNA, 18 nt, Salmonella typhimurium LT2
cgccaguuccgccacggc

SEQ ID NO: 1858186 - RNA, 15 nt, Salmonella typhimurium LT2
cgccaguccggucga

SEQ ID NO: 1858187 - RNA, 17 nt, Salmonella typhimurium LT2
cgccagugaugccaaac

SEQ ID NO: 1858188 - RNA, 21 nt, Salmonella typhimurium LT2
cgccagugcauagcagcgccc

SEQ ID NO: 1858189 - RNA, 19 nt, Salmonella typhimurium LT2
cgccagguuuuacgugccg

SEQ ID NO: 1858190 - RNA, 14 nt, Salmonella typhimurium LT2
cgccagguuaucca

SEQ ID NO: 1858191 - RNA, 22 nt, Salmonella typhimurium LT2
cgccaggucucauagcgcccca

SEQ ID NO: 1858192 - RNA, 21 nt, Salmonella typhimurium LT2
cgccaggucucauagcgcccc

SEQ ID NO: 1858193 - RNA, 15 nt, Salmonella typhimurium LT2
cgccaggcgcugcgu

SEQ ID NO: 1858194 - RNA, 17 nt, Salmonella typhimurium LT2
cgccaggguaucaucaa

SEQ ID NO: 1858195 - RNA, 17 nt, Salmonella typhimurium LT2
cgccagcgggccgguaa

SEQ ID NO: 1858196 - RNA, 13 nt, Salmonella typhimurium LT2
cgccagcggcgcc

SEQ ID NO: 1858197 - RNA, 21 nt, Salmonella typhimurium LT2
cgccagcggcgccaucaccau

SEQ ID NO: 1858198 - RNA, 16 nt, Salmonella typhimurium LT2
cgccagcggccacagc

SEQ ID NO: 1858199 - RNA, 19 nt, Salmonella typhimurium LT2
cgccagcgcugacaucauc

SEQ ID NO: 1858200 - RNA, 19 nt, Salmonella typhimurium LT2
cgccagcggacuccacgga

SEQ ID NO: 1858201 - RNA, 22 nt, Salmonella typhimurium LT2
cgccagcggccagcguaccugc

SEQ ID NO: 1858202 - RNA, 15 nt, Salmonella typhimurium LT2
cgccagcgcgguggc

SEQ ID NO: 1858203 - RNA, 22 nt, Salmonella typhimurium LT2
cgccagcgcgguuuccacaccu

SEQ ID NO: 1858204 - RNA, 21 nt, Salmonella typhimurium LT2
cgccagcgcgcguacccugcg

SEQ ID NO: 1858205 - RNA, 14 nt, Salmonella typhimurium LT2
cgccagccgcagcu

SEQ ID NO: 1858206 - RNA, 19 nt, Salmonella typhimurium LT2
cgccagccgcgccaucucc

SEQ ID NO: 1858207 - RNA, 20 nt, Salmonella typhimurium LT2
cgccagcgcauuaccgccgc

SEQ ID NO: 1858208 - RNA, 21 nt, Salmonella typhimurium LT2
cgccagcgcauuccccaccac

SEQ ID NO: 1858209 - RNA, 16 nt, Salmonella typhimurium LT2
cgccagcgccagcagc

SEQ ID NO: 1858210 - RNA, 15 nt, Salmonella typhimurium LT2
cgccagcgccucuuc

SEQ ID NO: 1858211 - RNA, 16 nt, Salmonella typhimurium LT2
cgccagcugcgcgcua

SEQ ID NO: 1858212 - RNA, 15 nt, Salmonella typhimurium LT2
cgccagcugcgcgcu

SEQ ID NO: 1858213 - RNA, 12 nt, Salmonella typhimurium LT2
cgccagcucugc

SEQ ID NO: 1858214 - RNA, 13 nt, Salmonella typhimurium LT2
cgccagcucaugc

SEQ ID NO: 1858215 - RNA, 21 nt, Salmonella typhimurium LT2
cgccagcucauuaauaaccca

SEQ ID NO: 1858216 - RNA, 20 nt, Salmonella typhimurium LT2
cgccagcguuucacuuucaa

SEQ ID NO: 1858217 - RNA, 18 nt, Salmonella typhimurium LT2
cgccagcuaauuuuacuu

SEQ ID NO: 1858218 - RNA, 18 nt, Salmonella typhimurium LT2
cgccagcgugcuuaaucc

SEQ ID NO: 1858219 - RNA, 23 nt, Salmonella typhimurium LT2
cgccagcgucuguuucaacacau

SEQ ID NO: 1858220 - RNA, 17 nt, Salmonella typhimurium LT2
cgccaggauaauaauga

SEQ ID NO: 1858221 - RNA, 22 nt, Salmonella typhimurium LT2
cgcauaauagcgccagaacugc

SEQ ID NO: 1858222 - RNA, 21 nt, Salmonella typhimurium LT2
cgcauaaugacguccaggccg

SEQ ID NO: 1858223 - RNA, 15 nt, Salmonella typhimurium LT2
cgcauacgcagcacu

SEQ ID NO: 1858224 - RNA, 19 nt, Salmonella typhimurium LT2
cgcauccacguaaauagag

SEQ ID NO: 1858225 - RNA, 13 nt, Salmonella typhimurium LT2
cgcauaccgcuuu

SEQ ID NO: 1858226 - RNA, 16 nt, Salmonella typhimurium LT2
cgcauccaguuguuua

SEQ ID NO: 1858227 - RNA, 13 nt, Salmonella typhimurium LT2
cgccaccacgccg

SEQ ID NO: 1858228 - RNA, 23 nt, Salmonella typhimurium LT2
cgcauccuguuuuuucagcgcgc

SEQ ID NO: 1858229 - RNA, 14 nt, Salmonella typhimurium LT2
cgccaccagcgcag

SEQ ID NO: 1858230 - RNA, 19 nt, Salmonella typhimurium LT2
cgccaccaggaacgagcug

SEQ ID NO: 1858231 - RNA, 15 nt, Salmonella typhimurium LT2
cgccacguucgcacc

SEQ ID NO: 1858232 - RNA, 15 nt, Salmonella typhimurium LT2
cgccacggucggcaa

SEQ ID NO: 1858233 - RNA, 20 nt, Salmonella typhimurium LT2
cgccacuucuuugaccagcg

SEQ ID NO: 1858234 - RNA, 13 nt, Salmonella typhimurium LT2
cgccacuuccagc

SEQ ID NO: 1858235 - RNA, 20 nt, Salmonella typhimurium LT2
cgccacuuccagcgcgccgu

SEQ ID NO: 1858236 - RNA, 19 nt, Salmonella typhimurium LT2
cgccacuuccagcgcgccg

SEQ ID NO: 1858237 - RNA, 17 nt, Salmonella typhimurium LT2
cgccaccuuucugcucc

SEQ ID NO: 1858238 - RNA, 22 nt, Salmonella typhimurium LT2
cgccaccugaauaacccgcagc

SEQ ID NO: 1858239 - RNA, 19 nt, Salmonella typhimurium LT2
cgccacgcccaacauaaac

SEQ ID NO: 1858240 - RNA, 22 nt, Salmonella typhimurium LT2
cgccacgcagauaucuuccagc

SEQ ID NO: 1858241 - RNA, 20 nt, Salmonella typhimurium LT2
cgccaccugcguggucaucc

SEQ ID NO: 1858242 - RNA, 19 nt, Salmonella typhimurium LT2
cgccagccagcucaccagc

SEQ ID NO: 1858243 - RNA, 13 nt, Salmonella typhimurium LT2
cgccagcauggcg

SEQ ID NO: 1858244 - RNA, 21 nt, Salmonella typhimurium LT2
cgccagccacaagagcagcaa

SEQ ID NO: 1858245 - RNA, 14 nt, Salmonella typhimurium LT2
cgccagcauuucaa

SEQ ID NO: 1858246 - RNA, 13 nt, Salmonella typhimurium LT2
cgccagcacgccu

SEQ ID NO: 1858247 - RNA, 20 nt, Salmonella typhimurium LT2
cgccagcaaugccgccgcca

SEQ ID NO: 1858248 - RNA, 19 nt, Salmonella typhimurium LT2
cgccagauaaucgccgcca

SEQ ID NO: 1858249 - RNA, 16 nt, Salmonella typhimurium LT2
cgccagauaaaucagc

SEQ ID NO: 1858250 - RNA, 15 nt, Salmonella typhimurium LT2
cgccagaucgugcca

SEQ ID NO: 1858251 - RNA, 22 nt, Salmonella typhimurium LT2
cgccagacacuggaaacagcca

SEQ ID NO: 1858252 - RNA, 16 nt, Salmonella typhimurium LT2
cgccagaauagcgcag

SEQ ID NO: 1858253 - RNA, 15 nt, Salmonella typhimurium LT2
cgccagacccagcgc

SEQ ID NO: 1858254 - RNA, 18 nt, Salmonella typhimurium LT2
cgccagacccgcaauaac

SEQ ID NO: 1858255 - RNA, 18 nt, Salmonella typhimurium LT2
cgccagaccgacgccaac

SEQ ID NO: 1858256 - RNA, 23 nt, Salmonella typhimurium LT2
cgccagacacuggaaacagccaa

SEQ ID NO: 1858257 - RNA, 21 nt, Salmonella typhimurium LT2
cgccagacucagccaggucug

SEQ ID NO: 1858258 - RNA, 22 nt, Salmonella typhimurium LT2
cgccagaccgcuuaacuccggc

SEQ ID NO: 1858259 - RNA, 21 nt, Salmonella typhimurium LT2
cgccagagcacgaaaagugug

SEQ ID NO: 1858260 - RNA, 16 nt, Salmonella typhimurium LT2
cgccagagcuucaggc

SEQ ID NO: 1858261 - RNA, 17 nt, Salmonella typhimurium LT2
cgccagaggcggcgcca

SEQ ID NO: 1858262 - RNA, 15 nt, Salmonella typhimurium LT2
cgcagcaaaaaauac

SEQ ID NO: 1858263 - RNA, 15 nt, Salmonella typhimurium LT2
cgcagcaagaacaga

SEQ ID NO: 1858264 - RNA, 18 nt, Salmonella typhimurium LT2
cgcagagauagccagcga

SEQ ID NO: 1858265 - RNA, 14 nt, Salmonella typhimurium LT2
cgcagacaguggcc

SEQ ID NO: 1858266 - RNA, 18 nt, Salmonella typhimurium LT2
cgcagacccgucaggguu

SEQ ID NO: 1858267 - RNA, 18 nt, Salmonella typhimurium LT2
cgcacugauagccgccag

SEQ ID NO: 1858268 - RNA, 22 nt, Salmonella typhimurium LT2
cgcacggcgcguccucacacug

SEQ ID NO: 1858269 - RNA, 15 nt, Salmonella typhimurium LT2
cgcacggucgcuucc

SEQ ID NO: 1858270 - RNA, 19 nt, Salmonella typhimurium LT2
cgcacgcguucacaacggc

SEQ ID NO: 1858271 - RNA, 19 nt, Salmonella typhimurium LT2
cgcaccgccagucaauaaa

SEQ ID NO: 1858272 - RNA, 16 nt, Salmonella typhimurium LT2
cgcaaucggcuuugac

SEQ ID NO: 1858273 - RNA, 13 nt, Salmonella typhimurium LT2
cgcaaucgguaaa

SEQ ID NO: 1858274 - RNA, 18 nt, Salmonella typhimurium LT2
cgcaaucuccgccgcuuu

SEQ ID NO: 1858275 - RNA, 22 nt, Salmonella typhimurium LT2
cgcaauuccugacugcgcgccu

SEQ ID NO: 1858276 - RNA, 14 nt, Salmonella typhimurium LT2
cgcacccgcgcagg

SEQ ID NO: 1858277 - RNA, 12 nt, Salmonella typhimurium LT2
cgcacccgccau

SEQ ID NO: 1858278 - RNA, 21 nt, Salmonella typhimurium LT2
cgcacccgccaucaugcccac

SEQ ID NO: 1858279 - RNA, 20 nt, Salmonella typhimurium LT2
cgcacccggcuuacaacauu

SEQ ID NO: 1858280 - RNA, 17 nt, Salmonella typhimurium LT2
cgcaccaguuccccaua

SEQ ID NO: 1858281 - RNA, 14 nt, Salmonella typhimurium LT2
cgcaaucacauaca

SEQ ID NO: 1858282 - RNA, 21 nt, Salmonella typhimurium LT2
cgcaaucacgcguuauacgca

SEQ ID NO: 1858283 - RNA, 18 nt, Salmonella typhimurium LT2
cgcaauagggggugacau

SEQ ID NO: 1858284 - RNA, 19 nt, Salmonella typhimurium LT2
cgcaauacagcccgccagc

SEQ ID NO: 1858285 - RNA, 23 nt, Salmonella typhimurium LT2
cgcaagcgcccuauuuggccugc

SEQ ID NO: 1858286 - RNA, 14 nt, Salmonella typhimurium LT2
cgcaagcgccaccc

SEQ ID NO: 1858287 - RNA, 19 nt, Salmonella typhimurium LT2
cgauuucgcuccacuggcc

SEQ ID NO: 1858288 - RNA, 11 nt, Salmonella typhimurium LT2
cgauuuccagc

SEQ ID NO: 1858289 - RNA, 22 nt, Salmonella typhimurium LT2
cgcagccccagcgccagccgcg

SEQ ID NO: 1858290 - RNA, 22 nt, Salmonella typhimurium LT2
cgcagccccauuugccgcgccu

SEQ ID NO: 1858291 - RNA, 13 nt, Salmonella typhimurium LT2
cgcagccccagcg

SEQ ID NO: 1858292 - RNA, 12 nt, Salmonella typhimurium LT2
cgcagccccagc

SEQ ID NO: 1858293 - RNA, 19 nt, Salmonella typhimurium LT2
cgcagcgacuucaggcgcu

SEQ ID NO: 1858294 - RNA, 15 nt, Salmonella typhimurium LT2
cgcagcgauauuucu

SEQ ID NO: 1858295 - RNA, 13 nt, Salmonella typhimurium LT2
cgcagcgcggcgc

SEQ ID NO: 1858296 - RNA, 22 nt, Salmonella typhimurium LT2
cgcagcgcgcugcaaaaugaug

SEQ ID NO: 1858297 - RNA, 18 nt, Salmonella typhimurium LT2
cgcagcgccaucaggccc

SEQ ID NO: 1858298 - RNA, 18 nt, Salmonella typhimurium LT2
cgcagcgccaucaggccu

SEQ ID NO: 1858299 - RNA, 20 nt, Salmonella typhimurium LT2
cgcagcauuuccgccgccuu

SEQ ID NO: 1858300 - RNA, 14 nt, Salmonella typhimurium LT2
cgcagccagcgccc

SEQ ID NO: 1858301 - RNA, 15 nt, Salmonella typhimurium LT2
cgcagccaguacgcg

SEQ ID NO: 1858302 - RNA, 14 nt, Salmonella typhimurium LT2
cgcagcaauucugc

SEQ ID NO: 1858303 - RNA, 24 nt, Salmonella typhimurium LT2
cgcagcaauucugcuggcugaucg

SEQ ID NO: 1858304 - RNA, 19 nt, Salmonella typhimurium LT2
cgcagcacuuucgcuucac

SEQ ID NO: 1858305 - RNA, 17 nt, Salmonella typhimurium LT2
cgcaguuuguggcgugu

SEQ ID NO: 1858306 - RNA, 17 nt, Salmonella typhimurium LT2
cgcaguugggcgcgcga

SEQ ID NO: 1858307 - RNA, 19 nt, Salmonella typhimurium LT2
cgcaguucauccacgcggg

SEQ ID NO: 1858308 - RNA, 14 nt, Salmonella typhimurium LT2
cgcaguucaauauu

SEQ ID NO: 1858309 - RNA, 16 nt, Salmonella typhimurium LT2
cgcaguucaauauuca

SEQ ID NO: 1858310 - RNA, 17 nt, Salmonella typhimurium LT2
cgcaguucgccaccagg

SEQ ID NO: 1858311 - RNA, 14 nt, Salmonella typhimurium LT2
cgcagguuuuacuu

SEQ ID NO: 1858312 - RNA, 16 nt, Salmonella typhimurium LT2
cgcaguaaacuccucu

SEQ ID NO: 1858313 - RNA, 14 nt, Salmonella typhimurium LT2
aaacgguauuucca

SEQ ID NO: 1858314 - RNA, 15 nt, Salmonella typhimurium LT2
cgcagguaaaaucca

SEQ ID NO: 1858315 - RNA, 12 nt, Salmonella typhimurium LT2
cgcagggcugcu

SEQ ID NO: 1858316 - RNA, 12 nt, Salmonella typhimurium LT2
cgaucaccacgc

SEQ ID NO: 1858317 - RNA, 17 nt, Salmonella typhimurium LT2
cgaucaccgcauagaua

SEQ ID NO: 1858318 - RNA, 22 nt, Salmonella typhimurium LT2
cgauauaagcgccgucauccgc

SEQ ID NO: 1858319 - RNA, 17 nt, Salmonella typhimurium LT2
cgauaggugacuuuccu

SEQ ID NO: 1858320 - RNA, 23 nt, Salmonella typhimurium LT2
cgauacuggcaguaaaaagaaag

SEQ ID NO: 1858321 - RNA, 16 nt, Salmonella typhimurium LT2
cgauauaaugccugga

SEQ ID NO: 1858322 - RNA, 16 nt, Salmonella typhimurium LT2
cgauaucgauaaucaa

SEQ ID NO: 1858323 - RNA, 14 nt, Salmonella typhimurium LT2
cgauaucaucuugc

SEQ ID NO: 1858324 - RNA, 13 nt, Salmonella typhimurium LT2
cgauaauaaugag

SEQ ID NO: 1858325 - RNA, 19 nt, Salmonella typhimurium LT2
cgauacgcacaucaauaaa

SEQ ID NO: 1858326 - RNA, 17 nt, Salmonella typhimurium LT2
cgauacggcccagaccc

SEQ ID NO: 1858327 - RNA, 18 nt, Salmonella typhimurium LT2
cgauaauauccagcacgc

SEQ ID NO: 1858328 - RNA, 14 nt, Salmonella typhimurium LT2
cgauaccaguaaua

SEQ ID NO: 1858329 - RNA, 18 nt, Salmonella typhimurium LT2
cgauaauaauuaccacgc

SEQ ID NO: 1858330 - RNA, 17 nt, Salmonella typhimurium LT2
cgacguccagcgcguga

SEQ ID NO: 1858331 - RNA, 14 nt, Salmonella typhimurium LT2
cgauaacgcagcgc

SEQ ID NO: 1858332 - RNA, 13 nt, Salmonella typhimurium LT2
cgacgucaauaaa

SEQ ID NO: 1858333 - RNA, 23 nt, Salmonella typhimurium LT2
cgaucgagucaggcgccagaguc

SEQ ID NO: 1858334 - RNA, 23 nt, Salmonella typhimurium LT2
cgaucgcuggacgucgucaccac

SEQ ID NO: 1858335 - RNA, 23 nt, Salmonella typhimurium LT2
cgauccccucuuccaucagccag

SEQ ID NO: 1858336 - RNA, 22 nt, Salmonella typhimurium LT2
cgaucccaauugaucggccagc

SEQ ID NO: 1858337 - RNA, 19 nt, Salmonella typhimurium LT2
cgaucccgggcgauaaacc

SEQ ID NO: 1858338 - RNA, 16 nt, Salmonella typhimurium LT2
cgauccgaagaacaga

SEQ ID NO: 1858339 - RNA, 21 nt, Salmonella typhimurium LT2
cgauccguuccggauauuuau

SEQ ID NO: 1858340 - RNA, 19 nt, Salmonella typhimurium LT2
cgaucagcgccaccacaaa

SEQ ID NO: 1858341 - RNA, 19 nt, Salmonella typhimurium LT2
cgaucagcgcauugagguu

SEQ ID NO: 1858342 - RNA, 13 nt, Salmonella typhimurium LT2
cgaucaggcaggu

SEQ ID NO: 1858343 - RNA, 15 nt, Salmonella typhimurium LT2
cgauccagccccagc

SEQ ID NO: 1858344 - RNA, 22 nt, Salmonella typhimurium LT2
cgaucaucaucccuagggugga

SEQ ID NO: 1858345 - RNA, 20 nt, Salmonella typhimurium LT2
cgaugacucauauuuaaacc

SEQ ID NO: 1858346 - RNA, 20 nt, Salmonella typhimurium LT2
cgaugagcgcgaaaucaaag

SEQ ID NO: 1858347 - RNA, 19 nt, Salmonella typhimurium LT2
cgaugagcgccagcaacag

SEQ ID NO: 1858348 - RNA, 17 nt, Salmonella typhimurium LT2
cgaugagauaauaaaug

SEQ ID NO: 1858349 - RNA, 19 nt, Salmonella typhimurium LT2
cgaugacgacuuuuugcug

SEQ ID NO: 1858350 - RNA, 14 nt, Salmonella typhimurium LT2
cgaugaaaaagagg

SEQ ID NO: 1858351 - RNA, 14 nt, Salmonella typhimurium LT2
cgaucucccagccg

SEQ ID NO: 1858352 - RNA, 17 nt, Salmonella typhimurium LT2
cgaucuacgguaucugc

SEQ ID NO: 1858353 - RNA, 18 nt, Salmonella typhimurium LT2
cgaucuauuucauaauaa

SEQ ID NO: 1858354 - RNA, 21 nt, Salmonella typhimurium LT2
cgaucucaagcgccgccgcau

SEQ ID NO: 1858355 - RNA, 15 nt, Salmonella typhimurium LT2
cgaucguccgccucc

SEQ ID NO: 1858356 - RNA, 19 nt, Salmonella typhimurium LT2
cgaucugguuguccaccag

SEQ ID NO: 1858357 - RNA, 20 nt, Salmonella typhimurium LT2
cgaucucguuuuugucucuu

SEQ ID NO: 1858358 - RNA, 22 nt, Salmonella typhimurium LT2
cgauuaaugcuccaauaaauau

SEQ ID NO: 1858359 - RNA, 21 nt, Salmonella typhimurium LT2
cgauuaaugcuccaauaaaua

SEQ ID NO: 1858360 - RNA, 15 nt, Salmonella typhimurium LT2
cgauguuugccacgc

SEQ ID NO: 1858361 - RNA, 16 nt, Salmonella typhimurium LT2
cgauuaacgcauguuc

SEQ ID NO: 1858362 - RNA, 12 nt, Salmonella typhimurium LT2
cgauuuauucuu

SEQ ID NO: 1858363 - RNA, 15 nt, Salmonella typhimurium LT2
cgauuuauccaccgc

SEQ ID NO: 1858364 - RNA, 16 nt, Salmonella typhimurium LT2
cgauucggacuaauac

SEQ ID NO: 1858365 - RNA, 18 nt, Salmonella typhimurium LT2
cgauguauuuauccacgc

SEQ ID NO: 1858366 - RNA, 21 nt, Salmonella typhimurium LT2
cgauggccgacauugaccagu

SEQ ID NO: 1858367 - RNA, 18 nt, Salmonella typhimurium LT2
cgaugccaugaacgaccc

SEQ ID NO: 1858368 - RNA, 22 nt, Salmonella typhimurium LT2
cgcucgcggaagcgaccggcgu

SEQ ID NO: 1858369 - RNA, 23 nt, Salmonella typhimurium LT2
cgcucgcuggugccaaucuccag

SEQ ID NO: 1858370 - RNA, 20 nt, Salmonella typhimurium LT2
cgcucgcuuacgcggcgcgc

SEQ ID NO: 1858371 - RNA, 21 nt, Salmonella typhimurium LT2
cgcucggcauacaccgccagc

SEQ ID NO: 1858372 - RNA, 13 nt, Salmonella typhimurium LT2
cgcucggccagau

SEQ ID NO: 1858373 - RNA, 20 nt, Salmonella typhimurium LT2
cgcucggcagcagcgcgccg

SEQ ID NO: 1858374 - RNA, 21 nt, Salmonella typhimurium LT2
cgcucgucgcgacguccgcca

SEQ ID NO: 1858375 - RNA, 15 nt, Salmonella typhimurium LT2
cgcucuuccgccagc

SEQ ID NO: 1858376 - RNA, 21 nt, Salmonella typhimurium LT2
cgcucuucgccaaucgccgcc

SEQ ID NO: 1858377 - RNA, 13 nt, Salmonella typhimurium LT2
cgcucugccuuuu

SEQ ID NO: 1858378 - RNA, 18 nt, Salmonella typhimurium LT2
cgcucuaucaccgcccgc

SEQ ID NO: 1858379 - RNA, 17 nt, Salmonella typhimurium LT2
cgcucuccgccgcgggc

SEQ ID NO: 1858380 - RNA, 22 nt, Salmonella typhimurium LT2
cgcucucgccacgcuccaucau

SEQ ID NO: 1858381 - RNA, 14 nt, Salmonella typhimurium LT2
cgcucuugccuggc

SEQ ID NO: 1858382 - RNA, 13 nt, Salmonella typhimurium LT2
cgcugaacaaccc

SEQ ID NO: 1858383 - RNA, 19 nt, Salmonella typhimurium LT2
cgcugaacgacuacugaaa

SEQ ID NO: 1858384 - RNA, 13 nt, Salmonella typhimurium LT2
cgcugaagcccgc

SEQ ID NO: 1858385 - RNA, 14 nt, Salmonella typhimurium LT2
cgcugaagcccgcg

SEQ ID NO: 1858386 - RNA, 16 nt, Salmonella typhimurium LT2
cgcugaccaucaacaa

SEQ ID NO: 1858387 - RNA, 13 nt, Salmonella typhimurium LT2
cgcugaagacugg

SEQ ID NO: 1858388 - RNA, 15 nt, Salmonella typhimurium LT2
cgcugacacgcgcag

SEQ ID NO: 1858389 - RNA, 20 nt, Salmonella typhimurium LT2
cgcuccguacgcgucacaau

SEQ ID NO: 1858390 - RNA, 19 nt, Salmonella typhimurium LT2
cgcucccggaaccgaccgc

SEQ ID NO: 1858391 - RNA, 15 nt, Salmonella typhimurium LT2
cgcucgccauaucuu

SEQ ID NO: 1858392 - RNA, 24 nt, Salmonella typhimurium LT2
cgcucgccagcauacgucugcgcu

SEQ ID NO: 1858393 - RNA, 19 nt, Salmonella typhimurium LT2
cgcucgacuggucgcagcc

SEQ ID NO: 1858394 - RNA, 15 nt, Salmonella typhimurium LT2
cgcucagucacuuca

SEQ ID NO: 1858395 - RNA, 15 nt, Salmonella typhimurium LT2
cgcucaugcgcgucc

SEQ ID NO: 1858396 - RNA, 16 nt, Salmonella typhimurium LT2
cgcuccagcaguucua

SEQ ID NO: 1858397 - RNA, 15 nt, Salmonella typhimurium LT2
cgcuccagcuggcug

SEQ ID NO: 1858398 - RNA, 19 nt, Salmonella typhimurium LT2
cgcuccacugauaguccau

SEQ ID NO: 1858399 - RNA, 14 nt, Salmonella typhimurium LT2
cgcuccaccgccgg

SEQ ID NO: 1858400 - RNA, 22 nt, Salmonella typhimurium LT2
cgcucaauuauuaaucuuuaca

SEQ ID NO: 1858401 - RNA, 13 nt, Salmonella typhimurium LT2
cgcucaauaauau

SEQ ID NO: 1858402 - RNA, 16 nt, Salmonella typhimurium LT2
cgcucaauaauauccu

SEQ ID NO: 1858403 - RNA, 18 nt, Salmonella typhimurium LT2
cgcucaacauugcucaua

SEQ ID NO: 1858404 - RNA, 21 nt, Salmonella typhimurium LT2
cgcucaagcgaaaaaauaauc

SEQ ID NO: 1858405 - RNA, 15 nt, Salmonella typhimurium LT2
cgcuauguucaugcu

SEQ ID NO: 1858406 - RNA, 19 nt, Salmonella typhimurium LT2
cgcuauuaccccgcggcau

SEQ ID NO: 1858407 - RNA, 20 nt, Salmonella typhimurium LT2
cgcuauuggaagaaauccca

SEQ ID NO: 1858408 - RNA, 21 nt, Salmonella typhimurium LT2
cgcucaacgcguucauccagc

SEQ ID NO: 1858409 - RNA, 21 nt, Salmonella typhimurium LT2
cgcucaaauaucccuucucau

SEQ ID NO: 1858410 - RNA, 16 nt, Salmonella typhimurium LT2
cgcucagccagaaacg

SEQ ID NO: 1858411 - RNA, 16 nt, Salmonella typhimurium LT2
cgcucacgauaacgca

SEQ ID NO: 1858412 - RNA, 15 nt, Salmonella typhimurium LT2
cgcucagauaacaua

SEQ ID NO: 1858413 - RNA, 21 nt, Salmonella typhimurium LT2
cgcucacgguuucuacuucca

SEQ ID NO: 1858414 - RNA, 16 nt, Salmonella typhimurium LT2
cgcucacuaccgccgc

SEQ ID NO: 1858415 - RNA, 16 nt, Salmonella typhimurium LT2
cgcucacuaccgcgau

SEQ ID NO: 1858416 - RNA, 17 nt, Salmonella typhimurium LT2
cgcucacugguugccca

SEQ ID NO: 1858417 - RNA, 21 nt, Salmonella typhimurium LT2
cgcucacugguugcccauggc

SEQ ID NO: 1858418 - RNA, 16 nt, Salmonella typhimurium LT2
cgcuacugccgccauc

SEQ ID NO: 1858419 - RNA, 14 nt, Salmonella typhimurium LT2
cgcuacguuuaucu

SEQ ID NO: 1858420 - RNA, 20 nt, Salmonella typhimurium LT2
cgcuacgcuuaucaggccua

SEQ ID NO: 1858421 - RNA, 14 nt, Salmonella typhimurium LT2
cgcuagccgcaucc

SEQ ID NO: 1858422 - RNA, 17 nt, Salmonella typhimurium LT2
cgcuaucugcuccgcca

SEQ ID NO: 1858423 - RNA, 19 nt, Salmonella typhimurium LT2
cgcuaucugcuccgccagc

SEQ ID NO: 1858424 - RNA, 16 nt, Salmonella typhimurium LT2
cgcuaugaugacuggu

SEQ ID NO: 1858425 - RNA, 17 nt, Salmonella typhimurium LT2
cgcuaucgaccagcacc

SEQ ID NO: 1858426 - RNA, 15 nt, Salmonella typhimurium LT2
cgcuaucgaccaccg

SEQ ID NO: 1858427 - RNA, 17 nt, Salmonella typhimurium LT2
cgcuaucagacugaucg

SEQ ID NO: 1858428 - RNA, 18 nt, Salmonella typhimurium LT2
cgcuauccaggccgucgg

SEQ ID NO: 1858429 - RNA, 14 nt, Salmonella typhimurium LT2
cgcuauauuccagc

SEQ ID NO: 1858430 - RNA, 21 nt, Salmonella typhimurium LT2
cgcuaucaacgccuccaggcu

SEQ ID NO: 1858431 - RNA, 15 nt, Salmonella typhimurium LT2
cgcuaucacagcggc

SEQ ID NO: 1858432 - RNA, 15 nt, Salmonella typhimurium LT2
cgcuauaggcgaccg

SEQ ID NO: 1858433 - RNA, 18 nt, Salmonella typhimurium LT2
cgcgucagcgccuccgcg

SEQ ID NO: 1858434 - RNA, 17 nt, Salmonella typhimurium LT2
cgcgucaucggcgcgcu

SEQ ID NO: 1858435 - RNA, 21 nt, Salmonella typhimurium LT2
cgcgucagugaauguccccug

SEQ ID NO: 1858436 - RNA, 18 nt, Salmonella typhimurium LT2
cgcgggccgcggcgcgca

SEQ ID NO: 1858437 - RNA, 15 nt, Salmonella typhimurium LT2
cgcguccagcccgcu

SEQ ID NO: 1858438 - RNA, 17 nt, Salmonella typhimurium LT2
cgcguccagcggcaagc

SEQ ID NO: 1858439 - RNA, 15 nt, Salmonella typhimurium LT2
cgcguccauuacucu

SEQ ID NO: 1858440 - RNA, 17 nt, Salmonella typhimurium LT2
cgcuaccuucuucccau

SEQ ID NO: 1858441 - RNA, 17 nt, Salmonella typhimurium LT2
cgcguuuaccgccgccg

SEQ ID NO: 1858442 - RNA, 15 nt, Salmonella typhimurium LT2
cgcguuuaucaccaa

SEQ ID NO: 1858443 - RNA, 19 nt, Salmonella typhimurium LT2
cgcguugccugaaaagggg

SEQ ID NO: 1858444 - RNA, 21 nt, Salmonella typhimurium LT2
cgcguuguugaucauaaauuc

SEQ ID NO: 1858445 - RNA, 14 nt, Salmonella typhimurium LT2
cgcguucgcgcagu

SEQ ID NO: 1858446 - RNA, 18 nt, Salmonella typhimurium LT2
cgcguucugaauaaauug

SEQ ID NO: 1858447 - RNA, 17 nt, Salmonella typhimurium LT2
cgcgugcucgcggcgga

SEQ ID NO: 1858448 - RNA, 14 nt, Salmonella typhimurium LT2
cgcugcgcaggcgu

SEQ ID NO: 1858449 - RNA, 23 nt, Salmonella typhimurium LT2
cgcugcgcauuagcaauaaucuc

SEQ ID NO: 1858450 - RNA, 18 nt, Salmonella typhimurium LT2
cgcugcgccugcugccag

SEQ ID NO: 1858451 - RNA, 16 nt, Salmonella typhimurium LT2
cgcuggcacaggaugu

SEQ ID NO: 1858452 - RNA, 23 nt, Salmonella typhimurium LT2
cgcuggaaguacgccucgcgcac

SEQ ID NO: 1858453 - RNA, 20 nt, Salmonella typhimurium LT2
cgcuggaaucauccaccaga

SEQ ID NO: 1858454 - RNA, 13 nt, Salmonella typhimurium LT2
cgcuggacauuaa

SEQ ID NO: 1858455 - RNA, 23 nt, Salmonella typhimurium LT2
cgcuggacgucgucaccacggug

SEQ ID NO: 1858456 - RNA, 22 nt, Salmonella typhimurium LT2
cgcugcuguaacagacgcaggc

SEQ ID NO: 1858457 - RNA, 14 nt, Salmonella typhimurium LT2
cgcugcuccggcuu

SEQ ID NO: 1858458 - RNA, 22 nt, Salmonella typhimurium LT2
cgcugcggcguggcgcauucca

SEQ ID NO: 1858459 - RNA, 20 nt, Salmonella typhimurium LT2
cgcugcgugcgcgccaccgg

SEQ ID NO: 1858460 - RNA, 20 nt, Salmonella typhimurium LT2
cgcugacgccagccagccgu

SEQ ID NO: 1858461 - RNA, 20 nt, Salmonella typhimurium LT2
cgcugacguuggccgccgga

SEQ ID NO: 1858462 - RNA, 12 nt, Salmonella typhimurium LT2
cgcugagaaaaa

SEQ ID NO: 1858463 - RNA, 14 nt, Salmonella typhimurium LT2
cgcugaugacgcgc

SEQ ID NO: 1858464 - RNA, 15 nt, Salmonella typhimurium LT2
cgcugcaaaucacca

SEQ ID NO: 1858465 - RNA, 14 nt, Salmonella typhimurium LT2
cgcugcaacccgcc

SEQ ID NO: 1858466 - RNA, 18 nt, Salmonella typhimurium LT2
cgcugcaacccgccgcca

SEQ ID NO: 1858467 - RNA, 19 nt, Salmonella typhimurium LT2
cgcugcaacccgccgccau

SEQ ID NO: 1858468 - RNA, 18 nt, Salmonella typhimurium LT2
cgcugaugugcggccugg

SEQ ID NO: 1858469 - RNA, 14 nt, Salmonella typhimurium LT2
cgcugcacaaucgc

SEQ ID NO: 1858470 - RNA, 18 nt, Salmonella typhimurium LT2
cgcugcacaaucgccagc

SEQ ID NO: 1858471 - RNA, 16 nt, Salmonella typhimurium LT2
cgcugcagauuuugcu

SEQ ID NO: 1858472 - RNA, 20 nt, Salmonella typhimurium LT2
cgcugcaucguuugcaguuc

SEQ ID NO: 1858473 - RNA, 22 nt, Salmonella typhimurium LT2
cgcugccacaauggcaggcagc

SEQ ID NO: 1858474 - RNA, 22 nt, Salmonella typhimurium LT2
cgcugucaccagcagcauuuca

SEQ ID NO: 1858475 - RNA, 16 nt, Salmonella typhimurium LT2
cgcugucaccagcagc

SEQ ID NO: 1858476 - RNA, 23 nt, Salmonella typhimurium LT2
cgcuguccagauagggccaggcg

SEQ ID NO: 1858477 - RNA, 21 nt, Salmonella typhimurium LT2
cgcugugacaggcgcuguucu

SEQ ID NO: 1858478 - RNA, 15 nt, Salmonella typhimurium LT2
cgcugucuauccacu

SEQ ID NO: 1858479 - RNA, 19 nt, Salmonella typhimurium LT2
cgcugucgcuaauccggcc

SEQ ID NO: 1858480 - RNA, 21 nt, Salmonella typhimurium LT2
cgcuggucagcagaaacuggc

SEQ ID NO: 1858481 - RNA, 16 nt, Salmonella typhimurium LT2
cgcuggugccaaucuc

SEQ ID NO: 1858482 - RNA, 15 nt, Salmonella typhimurium LT2
cgcugguuggcgcgc

SEQ ID NO: 1858483 - RNA, 16 nt, Salmonella typhimurium LT2
cgcuguaaaccggccc

SEQ ID NO: 1858484 - RNA, 18 nt, Salmonella typhimurium LT2
cgcuguaacuucacgcca

SEQ ID NO: 1858485 - RNA, 14 nt, Salmonella typhimurium LT2
cgcuggccuccagc

SEQ ID NO: 1858486 - RNA, 15 nt, Salmonella typhimurium LT2
cgcuggccuccagca

SEQ ID NO: 1858487 - RNA, 20 nt, Salmonella typhimurium LT2
cgcuggccuccagcacuucc

SEQ ID NO: 1858488 - RNA, 17 nt, Salmonella typhimurium LT2
cgcuuaacggcccaggc

SEQ ID NO: 1858489 - RNA, 20 nt, Salmonella typhimurium LT2
cgcuuaauggcgucaaucaa

SEQ ID NO: 1858490 - RNA, 16 nt, Salmonella typhimurium LT2
cgcuuacaguuuaucu

SEQ ID NO: 1858491 - RNA, 17 nt, Salmonella typhimurium LT2
cgcuuacaguuuaucug

SEQ ID NO: 1858492 - RNA, 18 nt, Salmonella typhimurium LT2
cgcuuacaguuuaucugc

SEQ ID NO: 1858493 - RNA, 22 nt, Salmonella typhimurium LT2
cgcuguucuuucucuauggugg

SEQ ID NO: 1858494 - RNA, 18 nt, Salmonella typhimurium LT2
cgcuuauuccuccgccga

SEQ ID NO: 1858495 - RNA, 17 nt, Salmonella typhimurium LT2
cgcuuagcuucccgcau

SEQ ID NO: 1858496 - RNA, 14 nt, Salmonella typhimurium LT2
cgcuucaccggcgu

SEQ ID NO: 1858497 - RNA, 22 nt, Salmonella typhimurium LT2
cgcuucaccuuucgccgccaga

SEQ ID NO: 1858498 - RNA, 16 nt, Salmonella typhimurium LT2
cgcuuacgcuccugcg

SEQ ID NO: 1858499 - RNA, 18 nt, Salmonella typhimurium LT2
cgcuuacucagccagaua

SEQ ID NO: 1858500 - RNA, 14 nt, Salmonella typhimurium LT2
cgcuuacgcggcgc

SEQ ID NO: 1858501 - RNA, 18 nt, Salmonella typhimurium LT2
cgcuuacgcggcgcgcuc

SEQ ID NO: 1858502 - RNA, 19 nt, Salmonella typhimurium LT2
cgcuuaccgggccuaccgc

SEQ ID NO: 1858503 - RNA, 19 nt, Salmonella typhimurium LT2
cgcuuaccgggcuuacagc

SEQ ID NO: 1858504 - RNA, 19 nt, Salmonella typhimurium LT2
cgcuucgcucccucaucaa

SEQ ID NO: 1858505 - RNA, 19 nt, Salmonella typhimurium LT2
cgcuucgugaaaaccuaaa

SEQ ID NO: 1858506 - RNA, 19 nt, Salmonella typhimurium LT2
cgcuucgucagcuccucgc

SEQ ID NO: 1858507 - RNA, 18 nt, Salmonella typhimurium LT2
cgcuucucccagccguca

SEQ ID NO: 1858508 - RNA, 19 nt, Salmonella typhimurium LT2
cgcuucgcuugcccggccu

SEQ ID NO: 1858509 - RNA, 19 nt, Salmonella typhimurium LT2
cgcuucggugaucuccucg

SEQ ID NO: 1858510 - RNA, 17 nt, Salmonella typhimurium LT2
cgcuucuucuaccaccu

SEQ ID NO: 1858511 - RNA, 21 nt, Salmonella typhimurium LT2
cgcuucuuccuuacguuuauu

SEQ ID NO: 1858512 - RNA, 14 nt, Salmonella typhimurium LT2
cgcggcccaaccac

SEQ ID NO: 1858513 - RNA, 20 nt, Salmonella typhimurium LT2
cgcggaucagacggcugacc

SEQ ID NO: 1858514 - RNA, 21 nt, Salmonella typhimurium LT2
cgcggcggacaacgcuccagc

SEQ ID NO: 1858515 - RNA, 14 nt, Salmonella typhimurium LT2
cgcggcgcucgcca

SEQ ID NO: 1858516 - RNA, 16 nt, Salmonella typhimurium LT2
cgcggcgucgccgccg

SEQ ID NO: 1858517 - RNA, 15 nt, Salmonella typhimurium LT2
cgcgcugccgcccuu

SEQ ID NO: 1858518 - RNA, 16 nt, Salmonella typhimurium LT2
cgcgcugcaaaaugau

SEQ ID NO: 1858519 - RNA, 17 nt, Salmonella typhimurium LT2
cgcgcucuuccgccagc

SEQ ID NO: 1858520 - RNA, 13 nt, Salmonella typhimurium LT2
cgcgcucggcagc

SEQ ID NO: 1858521 - RNA, 14 nt, Salmonella typhimurium LT2
cgcgcucggcagca

SEQ ID NO: 1858522 - RNA, 20 nt, Salmonella typhimurium LT2
cgcggaagcgaccggcguca

SEQ ID NO: 1858523 - RNA, 20 nt, Salmonella typhimurium LT2
cgcgcgugguaucgcggcag

SEQ ID NO: 1858524 - RNA, 19 nt, Salmonella typhimurium LT2
cgcgcuaauuuucagggug

SEQ ID NO: 1858525 - RNA, 13 nt, Salmonella typhimurium LT2
cgcgcucgccagc

SEQ ID NO: 1858526 - RNA, 15 nt, Salmonella typhimurium LT2
cgcgcucaccuccgc

SEQ ID NO: 1858527 - RNA, 20 nt, Salmonella typhimurium LT2
cgcgcaucccacaccacacg

SEQ ID NO: 1858528 - RNA, 14 nt, Salmonella typhimurium LT2
cgcgcauaccgcuu

SEQ ID NO: 1858529 - RNA, 12 nt, Salmonella typhimurium LT2
cgcgcagcugcc

SEQ ID NO: 1858530 - RNA, 11 nt, Salmonella typhimurium LT2
cgcgcauggca

SEQ ID NO: 1858531 - RNA, 12 nt, Salmonella typhimurium LT2
cgcgccaccauc

SEQ ID NO: 1858532 - RNA, 16 nt, Salmonella typhimurium LT2
cgcgccagccaauguc

SEQ ID NO: 1858533 - RNA, 21 nt, Salmonella typhimurium LT2
cgcgccagcauggucuccagc

SEQ ID NO: 1858534 - RNA, 19 nt, Salmonella typhimurium LT2
cgcgcaaucauuaccggac

SEQ ID NO: 1858535 - RNA, 15 nt, Salmonella typhimurium LT2
cgcgcaauuacucuu

SEQ ID NO: 1858536 - RNA, 22 nt, Salmonella typhimurium LT2
cgcgcaccauaauauaaggauc

SEQ ID NO: 1858537 - RNA, 23 nt, Salmonella typhimurium LT2
cgcgcagccagggaacuccagca

SEQ ID NO: 1858538 - RNA, 17 nt, Salmonella typhimurium LT2
cgcgaguauucgcgccc

SEQ ID NO: 1858539 - RNA, 13 nt, Salmonella typhimurium LT2
cgcgagugauccc

SEQ ID NO: 1858540 - RNA, 17 nt, Salmonella typhimurium LT2
cgcgagcgugaucucau

SEQ ID NO: 1858541 - RNA, 21 nt, Salmonella typhimurium LT2
cgcgcgaauaucgcugccggu

SEQ ID NO: 1858542 - RNA, 15 nt, Salmonella typhimurium LT2
cgcgccugcucccgc

SEQ ID NO: 1858543 - RNA, 15 nt, Salmonella typhimurium LT2
cgcgccugcugccug

SEQ ID NO: 1858544 - RNA, 20 nt, Salmonella typhimurium LT2
cgcgccuggaucugcgcauu

SEQ ID NO: 1858545 - RNA, 23 nt, Salmonella typhimurium LT2
cgcgccugccauagcaucaccag

SEQ ID NO: 1858546 - RNA, 23 nt, Salmonella typhimurium LT2
cgcgccuuccgggauagcacuac

SEQ ID NO: 1858547 - RNA, 13 nt, Salmonella typhimurium LT2
cgcgcgccagcgg

SEQ ID NO: 1858548 - RNA, 19 nt, Salmonella typhimurium LT2
cgcgccaggucucauagcg

SEQ ID NO: 1858549 - RNA, 18 nt, Salmonella typhimurium LT2
cgcgccaugcgcggcauc

SEQ ID NO: 1858550 - RNA, 23 nt, Salmonella typhimurium LT2
cgcgccgaagcugaccagacagu

SEQ ID NO: 1858551 - RNA, 14 nt, Salmonella typhimurium LT2
cgcgccgcagcgcc

SEQ ID NO: 1858552 - RNA, 15 nt, Salmonella typhimurium LT2
cgccucaucugcuuc

SEQ ID NO: 1858553 - RNA, 16 nt, Salmonella typhimurium LT2
cgccuccgacaacaag

SEQ ID NO: 1858554 - RNA, 16 nt, Salmonella typhimurium LT2
cgccuccggccugccu

SEQ ID NO: 1858555 - RNA, 21 nt, Salmonella typhimurium LT2
cgccuaacagcgccgcgccga

SEQ ID NO: 1858556 - RNA, 18 nt, Salmonella typhimurium LT2
cgccuauuuucucuucca

SEQ ID NO: 1858557 - RNA, 13 nt, Salmonella typhimurium LT2
cgccuauuuucug

SEQ ID NO: 1858558 - RNA, 20 nt, Salmonella typhimurium LT2
cgccguggcggugacuuccu

SEQ ID NO: 1858559 - RNA, 16 nt, Salmonella typhimurium LT2
cgccguuaccagcauc

SEQ ID NO: 1858560 - RNA, 19 nt, Salmonella typhimurium LT2
cgccggugccugccgccuc

SEQ ID NO: 1858561 - RNA, 20 nt, Salmonella typhimurium LT2
cgccgucaggcuugccgcgc

SEQ ID NO: 1858562 - RNA, 14 nt, Salmonella typhimurium LT2
cgccgucauaaaac

SEQ ID NO: 1858563 - RNA, 18 nt, Salmonella typhimurium LT2
cgccgucacguucgguac

SEQ ID NO: 1858564 - RNA, 17 nt, Salmonella typhimurium LT2
cgccgguuagcgccgcg

SEQ ID NO: 1858565 - RNA, 21 nt, Salmonella typhimurium LT2
cgccgguuagcgccgcguggc

SEQ ID NO: 1858566 - RNA, 12 nt, Salmonella typhimurium LT2
cgccggguuuug

SEQ ID NO: 1858567 - RNA, 13 nt, Salmonella typhimurium LT2
cgccggguuuugu

SEQ ID NO: 1858568 - RNA, 15 nt, Salmonella typhimurium LT2
cgccgccgacaggau

SEQ ID NO: 1858569 - RNA, 16 nt, Salmonella typhimurium LT2
cgcgaccagcgcacca

SEQ ID NO: 1858570 - RNA, 18 nt, Salmonella typhimurium LT2
cgcgaccagcgcaccaaa

SEQ ID NO: 1858571 - RNA, 16 nt, Salmonella typhimurium LT2
cgcgacgcccaccagu

SEQ ID NO: 1858572 - RNA, 21 nt, Salmonella typhimurium LT2
cgcgacgcccaccagucccug

SEQ ID NO: 1858573 - RNA, 20 nt, Salmonella typhimurium LT2
cgcgacucccaggcgcgcag

SEQ ID NO: 1858574 - RNA, 21 nt, Salmonella typhimurium LT2
cgcgacucccaggcgcgcagc

SEQ ID NO: 1858575 - RNA, 15 nt, Salmonella typhimurium LT2
cgcgacagcgcgcca

SEQ ID NO: 1858576 - RNA, 13 nt, Salmonella typhimurium LT2
cgcgacagcgcgc

SEQ ID NO: 1858577 - RNA, 16 nt, Salmonella typhimurium LT2
cgcgacagucgcagag

SEQ ID NO: 1858578 - RNA, 15 nt, Salmonella typhimurium LT2
cgcgaccacgccagc

SEQ ID NO: 1858579 - RNA, 15 nt, Salmonella typhimurium LT2
cgccuuauccggccu

SEQ ID NO: 1858580 - RNA, 16 nt, Salmonella typhimurium LT2
cgccuucagcgcgccc

SEQ ID NO: 1858581 - RNA, 18 nt, Salmonella typhimurium LT2
cgccuuauccggccugcc

SEQ ID NO: 1858582 - RNA, 17 nt, Salmonella typhimurium LT2
cgccuuauucgguuuau

SEQ ID NO: 1858583 - RNA, 13 nt, Salmonella typhimurium LT2
cgccuucgccggc

SEQ ID NO: 1858584 - RNA, 21 nt, Salmonella typhimurium LT2
cgccuucgauuaguccgucgg

SEQ ID NO: 1858585 - RNA, 13 nt, Salmonella typhimurium LT2
cgccuuccugcca

SEQ ID NO: 1858586 - RNA, 15 nt, Salmonella typhimurium LT2
cgccuuccugccagc

SEQ ID NO: 1858587 - RNA, 21 nt, Salmonella typhimurium LT2
cgccuuccggccacuccgcca

SEQ ID NO: 1858588 - RNA, 19 nt, Salmonella typhimurium LT2
cgccuuccgcaccgccagu

SEQ ID NO: 1858589 - RNA, 19 nt, Salmonella typhimurium LT2
cgcgacaaaaagcgcgccg

SEQ ID NO: 1858590 - RNA, 20 nt, Salmonella typhimurium LT2
cgcgaaucgacaauccgcca

SEQ ID NO: 1858591 - RNA, 18 nt, Salmonella typhimurium LT2
cgcgaacgccaggccaaa

SEQ ID NO: 1858592 - RNA, 16 nt, Salmonella typhimurium LT2
cgcgaacggcaucuac

SEQ ID NO: 1858593 - RNA, 19 nt, Salmonella typhimurium LT2
cgcgaacauuacauccuca

SEQ ID NO: 1858594 - RNA, 14 nt, Salmonella typhimurium LT2
cgccucgcucucuu

SEQ ID NO: 1858595 - RNA, 19 nt, Salmonella typhimurium LT2
cgccucgcugacgccagcc

SEQ ID NO: 1858596 - RNA, 20 nt, Salmonella typhimurium LT2
cgccucgcgcaccauaauau

SEQ ID NO: 1858597 - RNA, 19 nt, Salmonella typhimurium LT2
cgccucgcgauccgccagc

SEQ ID NO: 1858598 - RNA, 20 nt, Salmonella typhimurium LT2
cgccugaucguuacccgugc

SEQ ID NO: 1858599 - RNA, 20 nt, Salmonella typhimurium LT2
cgccugaugaaaggccauca

SEQ ID NO: 1858600 - RNA, 24 nt, Salmonella typhimurium LT2
cgccugacgcggacgccaccacag

SEQ ID NO: 1858601 - RNA, 17 nt, Salmonella typhimurium LT2
cgccugaagauacgcca

SEQ ID NO: 1858602 - RNA, 23 nt, Salmonella typhimurium LT2
cgccucuucgaccgucgcgcccu

SEQ ID NO: 1858603 - RNA, 24 nt, Salmonella typhimurium LT2
cgccugcaauguugaaucccacgc

SEQ ID NO: 1858604 - RNA, 16 nt, Salmonella typhimurium LT2
cgccugaugcuggcag

SEQ ID NO: 1858605 - RNA, 20 nt, Salmonella typhimurium LT2
cgccuggcuugcggguuuug

SEQ ID NO: 1858606 - RNA, 16 nt, Salmonella typhimurium LT2
cgccuggcgguaugaa

SEQ ID NO: 1858607 - RNA, 16 nt, Salmonella typhimurium LT2
cgccuggcguuaucau

SEQ ID NO: 1858608 - RNA, 21 nt, Salmonella typhimurium LT2
cgccugggcggcaacccgcuc

SEQ ID NO: 1858609 - RNA, 17 nt, Salmonella typhimurium LT2
cgccugggggggaaacc

SEQ ID NO: 1858610 - RNA, 20 nt, Salmonella typhimurium LT2
cgccugccgcgccgccgccu

SEQ ID NO: 1858611 - RNA, 23 nt, Salmonella typhimurium LT2
cgccugccggacggcggcugcga

SEQ ID NO: 1858612 - RNA, 21 nt, Salmonella typhimurium LT2
cgccuggcagaaguccccagc

SEQ ID NO: 1858613 - RNA, 12 nt, Salmonella typhimurium LT2
uuuuuuagcaua

SEQ ID NO: 1858614 - RNA, 19 nt, Salmonella typhimurium LT2
uuuuuuacuuucaaaauac

SEQ ID NO: 1858615 - RNA, 16 nt, Salmonella typhimurium LT2
uuuuugguucauacca

SEQ ID NO: 1858616 - RNA, 13 nt, Salmonella typhimurium LT2
uuuuuguauuccu

SEQ ID NO: 1858617 - RNA, 15 nt, Salmonella typhimurium LT2
uuuuuccgccgccgu

SEQ ID NO: 1858618 - RNA, 22 nt, Salmonella typhimurium LT2
uuuuuccguguggacccgcuua

SEQ ID NO: 1858619 - RNA, 12 nt, Salmonella typhimurium LT2
uuuuucuucagu

SEQ ID NO: 1858620 - RNA, 22 nt, Salmonella typhimurium LT2
uuuuugacgcuauaacugaagg

SEQ ID NO: 1858621 - RNA, 16 nt, Salmonella typhimurium LT2
uuuuugacuaaaguuu

SEQ ID NO: 1858622 - RNA, 13 nt, Salmonella typhimurium LT2
uuuuuggcuaagu

SEQ ID NO: 1858623 - RNA, 21 nt, Salmonella typhimurium LT2
uuuuugcgacacgcugcauau

SEQ ID NO: 1858624 - RNA, 22 nt, Salmonella typhimurium LT2
uuugugcccguuuuacaucuuu

SEQ ID NO: 1858625 - RNA, 13 nt, Salmonella typhimurium LT2
uuugugagacaaa

SEQ ID NO: 1858626 - RNA, 13 nt, Salmonella typhimurium LT2
uuugugaguucau

SEQ ID NO: 1858627 - RNA, 18 nt, Salmonella typhimurium LT2
uuugugaguucauaaaag

SEQ ID NO: 1858628 - RNA, 18 nt, Salmonella typhimurium LT2
uuugucugucggacucag

SEQ ID NO: 1858629 - RNA, 17 nt, Salmonella typhimurium LT2
uuugucucuucaugccu

SEQ ID NO: 1858630 - RNA, 18 nt, Salmonella typhimurium LT2
uuugucccuguuccaucu

SEQ ID NO: 1858631 - RNA, 22 nt, Salmonella typhimurium LT2
uuuguucagacacauucuguga

SEQ ID NO: 1858632 - RNA, 13 nt, Salmonella typhimurium LT2
uuuuaaaaguuag

SEQ ID NO: 1858633 - RNA, 14 nt, Salmonella typhimurium LT2
uuuuaaaaucagau

SEQ ID NO: 1858634 - RNA, 18 nt, Salmonella typhimurium LT2
uuuuaagcauccaggaag

SEQ ID NO: 1858635 - RNA, 17 nt, Salmonella typhimurium LT2
uuuuaagacuuuuuaau

SEQ ID NO: 1858636 - RNA, 18 nt, Salmonella typhimurium LT2
uuuuaagacuuuuuaauu

SEQ ID NO: 1858637 - RNA, 14 nt, Salmonella typhimurium LT2
uuuuaaccuucuac

SEQ ID NO: 1858638 - RNA, 12 nt, Salmonella typhimurium LT2
uuuuaaccguca

SEQ ID NO: 1858639 - RNA, 17 nt, Salmonella typhimurium LT2
uuuuaacgucaucacca

SEQ ID NO: 1858640 - RNA, 13 nt, Salmonella typhimurium LT2
uuuuaaauugaag

SEQ ID NO: 1858641 - RNA, 12 nt, Salmonella typhimurium LT2
uuuuaaauuccu

SEQ ID NO: 1858642 - RNA, 18 nt, Salmonella typhimurium LT2
uuugguuacuauuuuuca

SEQ ID NO: 1858643 - RNA, 15 nt, Salmonella typhimurium LT2
uuugguugccugcag

SEQ ID NO: 1858644 - RNA, 18 nt, Salmonella typhimurium LT2
uuuggcaaucaaauccaa

SEQ ID NO: 1858645 - RNA, 22 nt, Salmonella typhimurium LT2
uuuggcguacuuagguacuucc

SEQ ID NO: 1858646 - RNA, 11 nt, Salmonella typhimurium LT2
uuuggcugccg

SEQ ID NO: 1858647 - RNA, 17 nt, Salmonella typhimurium LT2
uuuguaaaauacauucu

SEQ ID NO: 1858648 - RNA, 19 nt, Salmonella typhimurium LT2
uuuguaaaauacauucucu

SEQ ID NO: 1858649 - RNA, 18 nt, Salmonella typhimurium LT2
uuuguaacauauuuuuau

SEQ ID NO: 1858650 - RNA, 17 nt, Salmonella typhimurium LT2
uuuguaacauauuuuua

SEQ ID NO: 1858651 - RNA, 14 nt, Salmonella typhimurium LT2
uuuguaacauauuu

SEQ ID NO: 1858652 - RNA, 15 nt, Salmonella typhimurium LT2
uuuguacagcuugcc

SEQ ID NO: 1858653 - RNA, 18 nt, Salmonella typhimurium LT2
uuuguacguauuuacaaa

SEQ ID NO: 1858654 - RNA, 22 nt, Salmonella typhimurium LT2
uuuguaauacaggcguguggca

SEQ ID NO: 1858655 - RNA, 15 nt, Salmonella typhimurium LT2
uuuguaacaggaacg

SEQ ID NO: 1858656 - RNA, 16 nt, Salmonella typhimurium LT2
uuuguaggccuaaaaa

SEQ ID NO: 1858657 - RNA, 16 nt, Salmonella typhimurium LT2
uuugucagagggccaa

SEQ ID NO: 1858658 - RNA, 20 nt, Salmonella typhimurium LT2
uuugcuggaaaaauaagagg

SEQ ID NO: 1858659 - RNA, 11 nt, Salmonella typhimurium LT2
uuugcugccac

SEQ ID NO: 1858660 - RNA, 19 nt, Salmonella typhimurium LT2
uuugcugcauuucuuguug

SEQ ID NO: 1858661 - RNA, 16 nt, Salmonella typhimurium LT2
uuugcgguuuuaauuu

SEQ ID NO: 1858662 - RNA, 19 nt, Salmonella typhimurium LT2
uuugcggcgucgccuggug

SEQ ID NO: 1858663 - RNA, 22 nt, Salmonella typhimurium LT2
uuugcggcguccaguacuuucu

SEQ ID NO: 1858664 - RNA, 20 nt, Salmonella typhimurium LT2
uuugcggaauaugagcacag

SEQ ID NO: 1858665 - RNA, 21 nt, Salmonella typhimurium LT2
uuugcgcucgcgccagaugcu

SEQ ID NO: 1858666 - RNA, 18 nt, Salmonella typhimurium LT2
uuugcuuccgccuucucg

SEQ ID NO: 1858667 - RNA, 14 nt, Salmonella typhimurium LT2
uuugcuucucgccu

SEQ ID NO: 1858668 - RNA, 16 nt, Salmonella typhimurium LT2
uuugcuuauccggccu

SEQ ID NO: 1858669 - RNA, 24 nt, Salmonella typhimurium LT2
uuuggcaggccucuaucuucucag

SEQ ID NO: 1858670 - RNA, 19 nt, Salmonella typhimurium LT2
uuuggcacgacuuuuccuu

SEQ ID NO: 1858671 - RNA, 19 nt, Salmonella typhimurium LT2
uuuuccagcauuucuucaa

SEQ ID NO: 1858672 - RNA, 12 nt, Salmonella typhimurium LT2
uuuuccagcuca

SEQ ID NO: 1858673 - RNA, 17 nt, Salmonella typhimurium LT2
uuuucaauuugugagac

SEQ ID NO: 1858674 - RNA, 11 nt, Salmonella typhimurium LT2
uuuucaauauc

SEQ ID NO: 1858675 - RNA, 19 nt, Salmonella typhimurium LT2
uuuucaacggcaucaauaa

SEQ ID NO: 1858676 - RNA, 21 nt, Salmonella typhimurium LT2
uuuucaacggcaucaauaauu

SEQ ID NO: 1858677 - RNA, 17 nt, Salmonella typhimurium LT2
uuuucaaccacggauaa

SEQ ID NO: 1858678 - RNA, 19 nt, Salmonella typhimurium LT2
uuuuauuuguguauuuuuu

SEQ ID NO: 1858679 - RNA, 19 nt, Salmonella typhimurium LT2
uuuuauuucaucuauuauu

SEQ ID NO: 1858680 - RNA, 21 nt, Salmonella typhimurium LT2
uuuuauucauauuauauguuu

SEQ ID NO: 1858681 - RNA, 16 nt, Salmonella typhimurium LT2
uuuuaugcguuuaauu

SEQ ID NO: 1858682 - RNA, 20 nt, Salmonella typhimurium LT2
uuuuaugcguuuaauugaau

SEQ ID NO: 1858683 - RNA, 14 nt, Salmonella typhimurium LT2
uuuucccauaaaag

SEQ ID NO: 1858684 - RNA, 15 nt, Salmonella typhimurium LT2
uuuucucaauacgau

SEQ ID NO: 1858685 - RNA, 21 nt, Salmonella typhimurium LT2
uuuucuaucgcaucagauaac

SEQ ID NO: 1858686 - RNA, 14 nt, Salmonella typhimurium LT2
uuuucguuccagag

SEQ ID NO: 1858687 - RNA, 14 nt, Salmonella typhimurium LT2
uuuugaaaucuugc

SEQ ID NO: 1858688 - RNA, 17 nt, Salmonella typhimurium LT2
uuuugauaaaucagcac

SEQ ID NO: 1858689 - RNA, 11 nt, Salmonella typhimurium LT2
uuuugaauaau

SEQ ID NO: 1858690 - RNA, 17 nt, Salmonella typhimurium LT2
uuuucuguaauucuccc

SEQ ID NO: 1858691 - RNA, 12 nt, Salmonella typhimurium LT2
uuuucucaucca

SEQ ID NO: 1858692 - RNA, 20 nt, Salmonella typhimurium LT2
uuuucugucguguccuugcc

SEQ ID NO: 1858693 - RNA, 14 nt, Salmonella typhimurium LT2
uuuuagcagugcaa

SEQ ID NO: 1858694 - RNA, 15 nt, Salmonella typhimurium LT2
uuuuacuuucauucc

SEQ ID NO: 1858695 - RNA, 14 nt, Salmonella typhimurium LT2
uuuuacuuuccaua

SEQ ID NO: 1858696 - RNA, 19 nt, Salmonella typhimurium LT2
uuuuagaacuaucugaaag

SEQ ID NO: 1858697 - RNA, 23 nt, Salmonella typhimurium LT2
uuuuaccccccaugaauuacagc

SEQ ID NO: 1858698 - RNA, 13 nt, Salmonella typhimurium LT2
uuuuacaucuuuc

SEQ ID NO: 1858699 - RNA, 16 nt, Salmonella typhimurium LT2
uuuuacauagugucua

SEQ ID NO: 1858700 - RNA, 18 nt, Salmonella typhimurium LT2
uuuuacaggcacuuacuc

SEQ ID NO: 1858701 - RNA, 17 nt, Salmonella typhimurium LT2
uuuuaauuuucuguaau

SEQ ID NO: 1858702 - RNA, 22 nt, Salmonella typhimurium LT2
uuuuaauuuaauaauaaauuuu

SEQ ID NO: 1858703 - RNA, 22 nt, Salmonella typhimurium LT2
uuuuaauguccagcagugucug

SEQ ID NO: 1858704 - RNA, 12 nt, Salmonella typhimurium LT2
uuuuaucagacu

SEQ ID NO: 1858705 - RNA, 20 nt, Salmonella typhimurium LT2
uuuuaucgaaguaauaaaaa

SEQ ID NO: 1858706 - RNA, 21 nt, Salmonella typhimurium LT2
uuuuaucgaaguaauaaaaaa

SEQ ID NO: 1858707 - RNA, 21 nt, Salmonella typhimurium LT2
uuuuaucugggucaggaacug

SEQ ID NO: 1858708 - RNA, 14 nt, Salmonella typhimurium LT2
uuuuaugaaggcuc

SEQ ID NO: 1858709 - RNA, 21 nt, Salmonella typhimurium LT2
uuuuaugaaggcucaaauuug

SEQ ID NO: 1858710 - RNA, 12 nt, Salmonella typhimurium LT2
uuuuaugccccu

SEQ ID NO: 1858711 - RNA, 20 nt, Salmonella typhimurium LT2
uuuuaggcacaucaauaaau

SEQ ID NO: 1858712 - RNA, 20 nt, Salmonella typhimurium LT2
uuuuagggcguaaauauaac

SEQ ID NO: 1858713 - RNA, 18 nt, Salmonella typhimurium LT2
uuuuauagucuaauaaca

SEQ ID NO: 1858714 - RNA, 14 nt, Salmonella typhimurium LT2
uuuuauaaauauag

SEQ ID NO: 1858715 - RNA, 18 nt, Salmonella typhimurium LT2
uugaagguauccagccag

SEQ ID NO: 1858716 - RNA, 23 nt, Salmonella typhimurium LT2
uugaagugguggcgaacaggcuc

SEQ ID NO: 1858717 - RNA, 17 nt, Salmonella typhimurium LT2
uugaagucccuuuuuua

SEQ ID NO: 1858718 - RNA, 12 nt, Salmonella typhimurium LT2
uugaaucugcag

SEQ ID NO: 1858719 - RNA, 18 nt, Salmonella typhimurium LT2
uugaccagauaaucaaac

SEQ ID NO: 1858720 - RNA, 14 nt, Salmonella typhimurium LT2
uugaccaucgccag

SEQ ID NO: 1858721 - RNA, 19 nt, Salmonella typhimurium LT2
uugaccagguugccagcgg

SEQ ID NO: 1858722 - RNA, 13 nt, Salmonella typhimurium LT2
uugacaugaaaaa

SEQ ID NO: 1858723 - RNA, 14 nt, Salmonella typhimurium LT2
uugacaugaaaaau

SEQ ID NO: 1858724 - RNA, 15 nt, Salmonella typhimurium LT2
uugaccaacaaucgc

SEQ ID NO: 1858725 - RNA, 13 nt, Salmonella typhimurium LT2
uucuuucacuguc

SEQ ID NO: 1858726 - RNA, 16 nt, Salmonella typhimurium LT2
uucuuucgccagaacc

SEQ ID NO: 1858727 - RNA, 16 nt, Salmonella typhimurium LT2
uucuuucauuuuaccu

SEQ ID NO: 1858728 - RNA, 15 nt, Salmonella typhimurium LT2
uucuuuaaucagauu

SEQ ID NO: 1858729 - RNA, 20 nt, Salmonella typhimurium LT2
uucuuuaagaacgguuggaa

SEQ ID NO: 1858730 - RNA, 20 nt, Salmonella typhimurium LT2
uucuucuuagaauagcauca

SEQ ID NO: 1858731 - RNA, 13 nt, Salmonella typhimurium LT2
uucuucuggcugc

SEQ ID NO: 1858732 - RNA, 15 nt, Salmonella typhimurium LT2
uugaaaucuugcugu

SEQ ID NO: 1858733 - RNA, 14 nt, Salmonella typhimurium LT2
uugaaaaggaaaac

SEQ ID NO: 1858734 - RNA, 19 nt, Salmonella typhimurium LT2
uugaaaaccauaauaaugc

SEQ ID NO: 1858735 - RNA, 21 nt, Salmonella typhimurium LT2
uugaaaaccauaauaaugcca

SEQ ID NO: 1858736 - RNA, 18 nt, Salmonella typhimurium LT2
uugacuggauuuuugacu

SEQ ID NO: 1858737 - RNA, 15 nt, Salmonella typhimurium LT2
uugagcagaucagca

SEQ ID NO: 1858738 - RNA, 20 nt, Salmonella typhimurium LT2
uugacugaaauuacgccaua

SEQ ID NO: 1858739 - RNA, 16 nt, Salmonella typhimurium LT2
uugacuacucccgucg

SEQ ID NO: 1858740 - RNA, 23 nt, Salmonella typhimurium LT2
uugauagcgacgcccauuagcau

SEQ ID NO: 1858741 - RNA, 14 nt, Salmonella typhimurium LT2
uugauacauuuuuu

SEQ ID NO: 1858742 - RNA, 18 nt, Salmonella typhimurium LT2
uugauaaggugaaugcgu

SEQ ID NO: 1858743 - RNA, 15 nt, Salmonella typhimurium LT2
uugagguaucaaccc

SEQ ID NO: 1858744 - RNA, 17 nt, Salmonella typhimurium LT2
uugauuaaucgucaucc

SEQ ID NO: 1858745 - RNA, 18 nt, Salmonella typhimurium LT2
uugaugcuaacgcccucu

SEQ ID NO: 1858746 - RNA, 23 nt, Salmonella typhimurium LT2
uugaucacgguacgcaucaccag

SEQ ID NO: 1858747 - RNA, 17 nt, Salmonella typhimurium LT2
uugaucauggggaacag

SEQ ID NO: 1858748 - RNA, 16 nt, Salmonella typhimurium LT2
uugaugccugcccguc

SEQ ID NO: 1858749 - RNA, 19 nt, Salmonella typhimurium LT2
uucuucgccgucauaaaac

SEQ ID NO: 1858750 - RNA, 12 nt, Salmonella typhimurium LT2
uucuucgcuuuc

SEQ ID NO: 1858751 - RNA, 18 nt, Salmonella typhimurium LT2
uucuucgucgucaucaca

SEQ ID NO: 1858752 - RNA, 15 nt, Salmonella typhimurium LT2
uucuucugccuuuuu

SEQ ID NO: 1858753 - RNA, 17 nt, Salmonella typhimurium LT2
uucuuaucccacagcgu

SEQ ID NO: 1858754 - RNA, 22 nt, Salmonella typhimurium LT2
uucuuaauacccauuucuucuu

SEQ ID NO: 1858755 - RNA, 20 nt, Salmonella typhimurium LT2
uucuguuuucgagccuugcc

SEQ ID NO: 1858756 - RNA, 13 nt, Salmonella typhimurium LT2
uucuguuccuaau

SEQ ID NO: 1858757 - RNA, 13 nt, Salmonella typhimurium LT2
uucugccuuuuuu

SEQ ID NO: 1858758 - RNA, 18 nt, Salmonella typhimurium LT2
uucugcgccagccagcuc

SEQ ID NO: 1858759 - RNA, 19 nt, Salmonella typhimurium LT2
uucugcgccauuuccagcc

SEQ ID NO: 1858760 - RNA, 15 nt, Salmonella typhimurium LT2
uucugcgccucagcc

SEQ ID NO: 1858761 - RNA, 14 nt, Salmonella typhimurium LT2
uucugcucaaugau

SEQ ID NO: 1858762 - RNA, 20 nt, Salmonella typhimurium LT2
uucuguccggaagacagcuu

SEQ ID NO: 1858763 - RNA, 20 nt, Salmonella typhimurium LT2
uucuguccugaguaaagccu

SEQ ID NO: 1858764 - RNA, 16 nt, Salmonella typhimurium LT2
uucugucagcguuuuu

SEQ ID NO: 1858765 - RNA, 17 nt, Salmonella typhimurium LT2
uucugucguguccuugc

SEQ ID NO: 1858766 - RNA, 18 nt, Salmonella typhimurium LT2
uucugucguguccuugcc

SEQ ID NO: 1858767 - RNA, 18 nt, Salmonella typhimurium LT2
uucugcucgggccagcuc

SEQ ID NO: 1858768 - RNA, 17 nt, Salmonella typhimurium LT2
uucuguaggcugugcaa

SEQ ID NO: 1858769 - RNA, 19 nt, Salmonella typhimurium LT2
uucugccaguucacgccgc

SEQ ID NO: 1858770 - RNA, 17 nt, Salmonella typhimurium LT2
uucugccagcagaagac

SEQ ID NO: 1858771 - RNA, 22 nt, Salmonella typhimurium LT2
uucugccaggcauaccuccucu

SEQ ID NO: 1858772 - RNA, 14 nt, Salmonella typhimurium LT2
uucugcacucgaug

SEQ ID NO: 1858773 - RNA, 23 nt, Salmonella typhimurium LT2
uucugcaggcgggugcgcagccc

SEQ ID NO: 1858774 - RNA, 13 nt, Salmonella typhimurium LT2
uucucuucugcug

SEQ ID NO: 1858775 - RNA, 14 nt, Salmonella typhimurium LT2
uucucuucuucuuu

SEQ ID NO: 1858776 - RNA, 20 nt, Salmonella typhimurium LT2
uucuccaggcgaauccccau

SEQ ID NO: 1858777 - RNA, 15 nt, Salmonella typhimurium LT2
uucuccaugccagaa

SEQ ID NO: 1858778 - RNA, 22 nt, Salmonella typhimurium LT2
uucucacagaaucaucaggcua

SEQ ID NO: 1858779 - RNA, 18 nt, Salmonella typhimurium LT2
uucucccgccagaugcag

SEQ ID NO: 1858780 - RNA, 13 nt, Salmonella typhimurium LT2
uucggcuccagau

SEQ ID NO: 1858781 - RNA, 16 nt, Salmonella typhimurium LT2
uucggcucagacagua

SEQ ID NO: 1858782 - RNA, 17 nt, Salmonella typhimurium LT2
uucggcuucaccgauuu

SEQ ID NO: 1858783 - RNA, 18 nt, Salmonella typhimurium LT2
uucgggcgcaugcugcca

SEQ ID NO: 1858784 - RNA, 17 nt, Salmonella typhimurium LT2
uucgguaguuccagaau

SEQ ID NO: 1858785 - RNA, 21 nt, Salmonella typhimurium LT2
uuaucaggccgacaaaugacg

SEQ ID NO: 1858786 - RNA, 11 nt, Salmonella typhimurium LT2
uuaucaggccu

SEQ ID NO: 1858787 - RNA, 22 nt, Salmonella typhimurium LT2
uuaucaggccaugcgcaagcgc

SEQ ID NO: 1858788 - RNA, 20 nt, Salmonella typhimurium LT2
uucgucaaugcugcuuugau

SEQ ID NO: 1858789 - RNA, 15 nt, Salmonella typhimurium LT2
uucucaaaggcuuug

SEQ ID NO: 1858790 - RNA, 15 nt, Salmonella typhimurium LT2
uucucaaaaacacca

SEQ ID NO: 1858791 - RNA, 13 nt, Salmonella typhimurium LT2
uucuauuaaauca

SEQ ID NO: 1858792 - RNA, 17 nt, Salmonella typhimurium LT2
uucuacucugcucgcca

SEQ ID NO: 1858793 - RNA, 14 nt, Salmonella typhimurium LT2
uucuacacagcgcg

SEQ ID NO: 1858794 - RNA, 15 nt, Salmonella typhimurium LT2
uucuaccgcuucuua

SEQ ID NO: 1858795 - RNA, 13 nt, Salmonella typhimurium LT2
uucuaccugcaau

SEQ ID NO: 1858796 - RNA, 14 nt, Salmonella typhimurium LT2
uuguuccagcagcu

SEQ ID NO: 1858797 - RNA, 13 nt, Salmonella typhimurium LT2
uuguucauaucga

SEQ ID NO: 1858798 - RNA, 15 nt, Salmonella typhimurium LT2
uuguucgcuucuucu

SEQ ID NO: 1858799 - RNA, 19 nt, Salmonella typhimurium LT2
uuguggcaauauuuuguag

SEQ ID NO: 1858800 - RNA, 23 nt, Salmonella typhimurium LT2
uugugccgacgucgcucccggca

SEQ ID NO: 1858801 - RNA, 23 nt, Salmonella typhimurium LT2
uugugcgcaagaaaaguuucgcu

SEQ ID NO: 1858802 - RNA, 13 nt, Salmonella typhimurium LT2
uugucccgccuug

SEQ ID NO: 1858803 - RNA, 12 nt, Salmonella typhimurium LT2
uugucccaggcc

SEQ ID NO: 1858804 - RNA, 15 nt, Salmonella typhimurium LT2
uuguccggccacgga

SEQ ID NO: 1858805 - RNA, 19 nt, Salmonella typhimurium LT2
uuguaucugucacuuaagu

SEQ ID NO: 1858806 - RNA, 19 nt, Salmonella typhimurium LT2
uugucauaaugucccugcc

SEQ ID NO: 1858807 - RNA, 21 nt, Salmonella typhimurium LT2
uugucauaaugucccugccac

SEQ ID NO: 1858808 - RNA, 13 nt, Salmonella typhimurium LT2
uuguccacaaacg

SEQ ID NO: 1858809 - RNA, 14 nt, Salmonella typhimurium LT2
uugucauugcccaa

SEQ ID NO: 1858810 - RNA, 17 nt, Salmonella typhimurium LT2
uuguacagcaauaaaag

SEQ ID NO: 1858811 - RNA, 20 nt, Salmonella typhimurium LT2
uuguaccuuuaccccucuuu

SEQ ID NO: 1858812 - RNA, 23 nt, Salmonella typhimurium LT2
uuguacuuuugccaggcggauaa

SEQ ID NO: 1858813 - RNA, 13 nt, Salmonella typhimurium LT2
uugguugaaccga

SEQ ID NO: 1858814 - RNA, 14 nt, Salmonella typhimurium LT2
uuguaauaauuuaa

SEQ ID NO: 1858815 - RNA, 16 nt, Salmonella typhimurium LT2
uuguaauaauuuaaaa

SEQ ID NO: 1858816 - RNA, 21 nt, Salmonella typhimurium LT2
uuguaauacaggcguguggca

SEQ ID NO: 1858817 - RNA, 17 nt, Salmonella typhimurium LT2
uuuacacaauucugauu

SEQ ID NO: 1858818 - RNA, 15 nt, Salmonella typhimurium LT2
uuuaauuuucuguaa

SEQ ID NO: 1858819 - RNA, 23 nt, Salmonella typhimurium LT2
uuuaauuccaccagcuuaucuga

SEQ ID NO: 1858820 - RNA, 21 nt, Salmonella typhimurium LT2
uuuaacgcaaccgucucacca

SEQ ID NO: 1858821 - RNA, 16 nt, Salmonella typhimurium LT2
uuuaaccucuuuuuca

SEQ ID NO: 1858822 - RNA, 14 nt, Salmonella typhimurium LT2
uuuaacuuaaauaa

SEQ ID NO: 1858823 - RNA, 15 nt, Salmonella typhimurium LT2
uuuaacuuaaauaaa

SEQ ID NO: 1858824 - RNA, 16 nt, Salmonella typhimurium LT2
uuuaaaauccggcugc

SEQ ID NO: 1858825 - RNA, 13 nt, Salmonella typhimurium LT2
uuuaaaaguacaa

SEQ ID NO: 1858826 - RNA, 12 nt, Salmonella typhimurium LT2
uuuaacagauag

SEQ ID NO: 1858827 - RNA, 20 nt, Salmonella typhimurium LT2
uuuaacagauaguuaauaau

SEQ ID NO: 1858828 - RNA, 13 nt, Salmonella typhimurium LT2
uuguuuaccccag

SEQ ID NO: 1858829 - RNA, 18 nt, Salmonella typhimurium LT2
uuguuuaccgcaauaaca

SEQ ID NO: 1858830 - RNA, 20 nt, Salmonella typhimurium LT2
uuguuggcugcacucagaaa

SEQ ID NO: 1858831 - RNA, 12 nt, Salmonella typhimurium LT2
uuguuuuuauua

SEQ ID NO: 1858832 - RNA, 21 nt, Salmonella typhimurium LT2
uugcuguuucagaauauguuu

SEQ ID NO: 1858833 - RNA, 12 nt, Salmonella typhimurium LT2
uugcuguuccag

SEQ ID NO: 1858834 - RNA, 18 nt, Salmonella typhimurium LT2
uugcugaaucugcggcug

SEQ ID NO: 1858835 - RNA, 17 nt, Salmonella typhimurium LT2
uugcugaagauaaaauu

SEQ ID NO: 1858836 - RNA, 23 nt, Salmonella typhimurium LT2
uugcuccagcagcgccaguuuuu

SEQ ID NO: 1858837 - RNA, 19 nt, Salmonella typhimurium LT2
uugcucaggcgcgaauaau

SEQ ID NO: 1858838 - RNA, 17 nt, Salmonella typhimurium LT2
uugcugagcagccagcc

SEQ ID NO: 1858839 - RNA, 21 nt, Salmonella typhimurium LT2
uugcugagccaucauuaccaa

SEQ ID NO: 1858840 - RNA, 19 nt, Salmonella typhimurium LT2
uugcugcccgccgccagcc

SEQ ID NO: 1858841 - RNA, 23 nt, Salmonella typhimurium LT2
uugcugccgauuggucaauaagu

SEQ ID NO: 1858842 - RNA, 22 nt, Salmonella typhimurium LT2
uuggaaaaccccaucccggcaa

SEQ ID NO: 1858843 - RNA, 13 nt, Salmonella typhimurium LT2
uugcuuuuuucca

SEQ ID NO: 1858844 - RNA, 12 nt, Salmonella typhimurium LT2
uuggcaggaucc

SEQ ID NO: 1858845 - RNA, 19 nt, Salmonella typhimurium LT2
uuggagauuucggcauuuu

SEQ ID NO: 1858846 - RNA, 23 nt, Salmonella typhimurium LT2
uuggcgagcaggaaccacaucgc

SEQ ID NO: 1858847 - RNA, 14 nt, Salmonella typhimurium LT2
uuggcgaucacaau

SEQ ID NO: 1858848 - RNA, 14 nt, Salmonella typhimurium LT2
uuggcgauuuccag

SEQ ID NO: 1858849 - RNA, 16 nt, Salmonella typhimurium LT2
uuggcgcgaaccguaa

SEQ ID NO: 1858850 - RNA, 14 nt, Salmonella typhimurium LT2
uuggcaucugucau

SEQ ID NO: 1858851 - RNA, 19 nt, Salmonella typhimurium LT2
uuggcauuucgcauuguca

SEQ ID NO: 1858852 - RNA, 19 nt, Salmonella typhimurium LT2
uuggcguaaaucaggccaa

SEQ ID NO: 1858853 - RNA, 22 nt, Salmonella typhimurium LT2
uuggcguacuuagguacuuccu

SEQ ID NO: 1858854 - RNA, 22 nt, Salmonella typhimurium LT2
uuggcucaauggguacgccaac

SEQ ID NO: 1858855 - RNA, 23 nt, Salmonella typhimurium LT2
uugggcgcgaaacugcugccgca

SEQ ID NO: 1858856 - RNA, 16 nt, Salmonella typhimurium LT2
uuggugggugaugacg

SEQ ID NO: 1858857 - RNA, 22 nt, Salmonella typhimurium LT2
uuggugugacagcaacaucuau

SEQ ID NO: 1858858 - RNA, 12 nt, Salmonella typhimurium LT2
uugccccuuccg

SEQ ID NO: 1858859 - RNA, 21 nt, Salmonella typhimurium LT2
uugccccauaauucaaccggc

SEQ ID NO: 1858860 - RNA, 22 nt, Salmonella typhimurium LT2
uugcccauggcaucaaucccgc

SEQ ID NO: 1858861 - RNA, 22 nt, Salmonella typhimurium LT2
uugccgcaauugguaauuaaag

SEQ ID NO: 1858862 - RNA, 22 nt, Salmonella typhimurium LT2
uugcccggccguuaccguggcg

SEQ ID NO: 1858863 - RNA, 21 nt, Salmonella typhimurium LT2
uugcccgcgcuucgcuauucc

SEQ ID NO: 1858864 - RNA, 12 nt, Salmonella typhimurium LT2
uugcauccaacu

SEQ ID NO: 1858865 - RNA, 17 nt, Salmonella typhimurium LT2
uugcauuuuaucuuuug

SEQ ID NO: 1858866 - RNA, 22 nt, Salmonella typhimurium LT2
uugccaaaaaaucagcaaucgc

SEQ ID NO: 1858867 - RNA, 15 nt, Salmonella typhimurium LT2
uugcacguucugcug

SEQ ID NO: 1858868 - RNA, 16 nt, Salmonella typhimurium LT2
uugcagacgugcaaua

SEQ ID NO: 1858869 - RNA, 21 nt, Salmonella typhimurium LT2
uugcagcaaauacagaugcug

SEQ ID NO: 1858870 - RNA, 22 nt, Salmonella typhimurium LT2
uugcagcagcgagauggcuuuu

SEQ ID NO: 1858871 - RNA, 14 nt, Salmonella typhimurium LT2
uugcguucccaguu

SEQ ID NO: 1858872 - RNA, 13 nt, Salmonella typhimurium LT2
uugcucaauuuuu

SEQ ID NO: 1858873 - RNA, 24 nt, Salmonella typhimurium LT2
uugcucacggcgauaccaguaaua

SEQ ID NO: 1858874 - RNA, 14 nt, Salmonella typhimurium LT2
uugcgcucugccag

SEQ ID NO: 1858875 - RNA, 15 nt, Salmonella typhimurium LT2
uugcgcugaaguaau

SEQ ID NO: 1858876 - RNA, 12 nt, Salmonella typhimurium LT2
uugcgucaugcg

SEQ ID NO: 1858877 - RNA, 14 nt, Salmonella typhimurium LT2
uugcguauuuuuau

SEQ ID NO: 1858878 - RNA, 14 nt, Salmonella typhimurium LT2
uugcgucaccgggc

SEQ ID NO: 1858879 - RNA, 14 nt, Salmonella typhimurium LT2
uugcguccauuaag

SEQ ID NO: 1858880 - RNA, 15 nt, Salmonella typhimurium LT2
uugcgaacaguuccg

SEQ ID NO: 1858881 - RNA, 19 nt, Salmonella typhimurium LT2
uugcgaaccgcacagauua

SEQ ID NO: 1858882 - RNA, 15 nt, Salmonella typhimurium LT2
uugccuuucagaucg

SEQ ID NO: 1858883 - RNA, 18 nt, Salmonella typhimurium LT2
uugcgaaguucauauggc

SEQ ID NO: 1858884 - RNA, 17 nt, Salmonella typhimurium LT2
uugcgacaaccuguagg

SEQ ID NO: 1858885 - RNA, 19 nt, Salmonella typhimurium LT2
uugcgacuguucaucaaag

SEQ ID NO: 1858886 - RNA, 14 nt, Salmonella typhimurium LT2
uugcgauacagcgu

SEQ ID NO: 1858887 - RNA, 16 nt, Salmonella typhimurium LT2
uugcgcgaccacgcca

SEQ ID NO: 1858888 - RNA, 20 nt, Salmonella typhimurium LT2
uugccgcgcggauucuccag

SEQ ID NO: 1858889 - RNA, 16 nt, Salmonella typhimurium LT2
uugccggagaccuuuu

SEQ ID NO: 1858890 - RNA, 21 nt, Salmonella typhimurium LT2
uugccggagagaugccgccag

SEQ ID NO: 1858891 - RNA, 15 nt, Salmonella typhimurium LT2
uugccgccgagcaga

SEQ ID NO: 1858892 - RNA, 17 nt, Salmonella typhimurium LT2
uuucugcgccucagcca

SEQ ID NO: 1858893 - RNA, 22 nt, Salmonella typhimurium LT2
uuucucugguuucccugccuca

SEQ ID NO: 1858894 - RNA, 18 nt, Salmonella typhimurium LT2
uuucucauuaaaaaaccg

SEQ ID NO: 1858895 - RNA, 19 nt, Salmonella typhimurium LT2
uuucucccgccagaugcag

SEQ ID NO: 1858896 - RNA, 17 nt, Salmonella typhimurium LT2
uuucucggcuuuccagc

SEQ ID NO: 1858897 - RNA, 19 nt, Salmonella typhimurium LT2
uuucucggcuuuccagcuc

SEQ ID NO: 1858898 - RNA, 20 nt, Salmonella typhimurium LT2
uuucguacgaacucuuucuu

SEQ ID NO: 1858899 - RNA, 22 nt, Salmonella typhimurium LT2
uuucguacgaacucuuucuuga

SEQ ID NO: 1858900 - RNA, 21 nt, Salmonella typhimurium LT2
uuucggugauuuccagaauca

SEQ ID NO: 1858901 - RNA, 21 nt, Salmonella typhimurium LT2
uuucgucagcacuucccacug

SEQ ID NO: 1858902 - RNA, 14 nt, Salmonella typhimurium LT2
uuucgucacuaacu

SEQ ID NO: 1858903 - RNA, 14 nt, Salmonella typhimurium LT2
uuucguucuuucug

SEQ ID NO: 1858904 - RNA, 16 nt, Salmonella typhimurium LT2
uuucguguaaaugacg

SEQ ID NO: 1858905 - RNA, 19 nt, Salmonella typhimurium LT2
uuucgcuugcggcugccag

SEQ ID NO: 1858906 - RNA, 16 nt, Salmonella typhimurium LT2
uuucgcuccacuggcc

SEQ ID NO: 1858907 - RNA, 20 nt, Salmonella typhimurium LT2
uuucgccguaaaacaacagc

SEQ ID NO: 1858908 - RNA, 15 nt, Salmonella typhimurium LT2
uuucgauuucauuca

SEQ ID NO: 1858909 - RNA, 13 nt, Salmonella typhimurium LT2
uuucuacaaaugu

SEQ ID NO: 1858910 - RNA, 16 nt, Salmonella typhimurium LT2
uuucuaguaugucuau

SEQ ID NO: 1858911 - RNA, 21 nt, Salmonella typhimurium LT2
uuucuaguaugucuaugauuu

SEQ ID NO: 1858912 - RNA, 18 nt, Salmonella typhimurium LT2
uuucccgcgugaacacca

SEQ ID NO: 1858913 - RNA, 15 nt, Salmonella typhimurium LT2
uuucccaggucacgc

SEQ ID NO: 1858914 - RNA, 13 nt, Salmonella typhimurium LT2
uuucccaguggcg

SEQ ID NO: 1858915 - RNA, 19 nt, Salmonella typhimurium LT2
uuuccccccuccaucaaau

SEQ ID NO: 1858916 - RNA, 19 nt, Salmonella typhimurium LT2
uuucccccuccauacccua

SEQ ID NO: 1858917 - RNA, 20 nt, Salmonella typhimurium LT2
uuucccaacuguauuuugaa

SEQ ID NO: 1858918 - RNA, 18 nt, Salmonella typhimurium LT2
uuuccgccugaucuuucu

SEQ ID NO: 1858919 - RNA, 17 nt, Salmonella typhimurium LT2
uuuccgcaucguuauca

SEQ ID NO: 1858920 - RNA, 17 nt, Salmonella typhimurium LT2
uuuccgccaugaaaaaa

SEQ ID NO: 1858921 - RNA, 14 nt, Salmonella typhimurium LT2
uuuccagugccgcc

SEQ ID NO: 1858922 - RNA, 20 nt, Salmonella typhimurium LT2
uuuccaguguuguucucuga

SEQ ID NO: 1858923 - RNA, 20 nt, Salmonella typhimurium LT2
uuuccaguugcggcaucaga

SEQ ID NO: 1858924 - RNA, 22 nt, Salmonella typhimurium LT2
uuuccauacauuuuuguaauaa

SEQ ID NO: 1858925 - RNA, 13 nt, Salmonella typhimurium LT2
uuuccauuuuuca

SEQ ID NO: 1858926 - RNA, 23 nt, Salmonella typhimurium LT2
uuuccagcacggcauaagccuca

SEQ ID NO: 1858927 - RNA, 20 nt, Salmonella typhimurium LT2
uuuccagccccuucgcuguc

SEQ ID NO: 1858928 - RNA, 18 nt, Salmonella typhimurium LT2
uuucgagcagaacuggcg

SEQ ID NO: 1858929 - RNA, 15 nt, Salmonella typhimurium LT2
uuucgcaaacugguc

SEQ ID NO: 1858930 - RNA, 21 nt, Salmonella typhimurium LT2
uuucgcaaacuggucgaggac

SEQ ID NO: 1858931 - RNA, 14 nt, Salmonella typhimurium LT2
uuucgcaacagcau

SEQ ID NO: 1858932 - RNA, 12 nt, Salmonella typhimurium LT2
uuucgccagcau

SEQ ID NO: 1858933 - RNA, 21 nt, Salmonella typhimurium LT2
uuucgaaacguucgcauccca

SEQ ID NO: 1858934 - RNA, 23 nt, Salmonella typhimurium LT2
uuuccggcuguuuugcuucuuca

SEQ ID NO: 1858935 - RNA, 18 nt, Salmonella typhimurium LT2
uuuccggcgggagcucua

SEQ ID NO: 1858936 - RNA, 23 nt, Salmonella typhimurium LT2
uuuccggcgucaaaaauaaaaaa

SEQ ID NO: 1858937 - RNA, 16 nt, Salmonella typhimurium LT2
uuuccgcugucuaucc

SEQ ID NO: 1858938 - RNA, 19 nt, Salmonella typhimurium LT2
uuuccggcagcgcauaagc

SEQ ID NO: 1858939 - RNA, 23 nt, Salmonella typhimurium LT2
uuuccggcgcaaucuuugccgca

SEQ ID NO: 1858940 - RNA, 17 nt, Salmonella typhimurium LT2
uuuccguauugcaaugc

SEQ ID NO: 1858941 - RNA, 13 nt, Salmonella typhimurium LT2
uuugcauaaauaa

SEQ ID NO: 1858942 - RNA, 18 nt, Salmonella typhimurium LT2
uuugcagcaacugauuca

SEQ ID NO: 1858943 - RNA, 15 nt, Salmonella typhimurium LT2
uuugcagcaaauaca

SEQ ID NO: 1858944 - RNA, 16 nt, Salmonella typhimurium LT2
uuugcagcaaauacag

SEQ ID NO: 1858945 - RNA, 17 nt, Salmonella typhimurium LT2
uuugcagcaaauacaga

SEQ ID NO: 1858946 - RNA, 20 nt, Salmonella typhimurium LT2
uuugcaccgcuaaaaaacag

SEQ ID NO: 1858947 - RNA, 19 nt, Salmonella typhimurium LT2
uuugcaccgcuaaaaaaca

SEQ ID NO: 1858948 - RNA, 13 nt, Salmonella typhimurium LT2
uuugcgacaucag

SEQ ID NO: 1858949 - RNA, 15 nt, Salmonella typhimurium LT2
uuugccuuucuuauu

SEQ ID NO: 1858950 - RNA, 21 nt, Salmonella typhimurium LT2
uuugccucuggccaguuucaa

SEQ ID NO: 1858951 - RNA, 23 nt, Salmonella typhimurium LT2
uuugcgccgccagugaggugaua

SEQ ID NO: 1858952 - RNA, 22 nt, Salmonella typhimurium LT2
uuugcgcccgcgaucgcuucca

SEQ ID NO: 1858953 - RNA, 19 nt, Salmonella typhimurium LT2
uuugccagacgggccaggc

SEQ ID NO: 1858954 - RNA, 20 nt, Salmonella typhimurium LT2
uuugccagauauucucccua

SEQ ID NO: 1858955 - RNA, 13 nt, Salmonella typhimurium LT2
uuugcauucgcuc

SEQ ID NO: 1858956 - RNA, 23 nt, Salmonella typhimurium LT2
uuugccgaauggcggcuucgcca

SEQ ID NO: 1858957 - RNA, 22 nt, Salmonella typhimurium LT2
uuugaugucgaggaaaaacaua

SEQ ID NO: 1858958 - RNA, 14 nt, Salmonella typhimurium LT2
uuugauggacacua

SEQ ID NO: 1858959 - RNA, 20 nt, Salmonella typhimurium LT2
uuugaucgcggucgcguuau

SEQ ID NO: 1858960 - RNA, 20 nt, Salmonella typhimurium LT2
uuugauccguuucagaaaga

SEQ ID NO: 1858961 - RNA, 19 nt, Salmonella typhimurium LT2
uuugaucccgcugaagacu

SEQ ID NO: 1858962 - RNA, 17 nt, Salmonella typhimurium LT2
uuugauaaacugcgcca

SEQ ID NO: 1858963 - RNA, 14 nt, Salmonella typhimurium LT2
uuugauaaaaacac

SEQ ID NO: 1858964 - RNA, 14 nt, Salmonella typhimurium LT2
uuugauacucugcu

SEQ ID NO: 1858965 - RNA, 15 nt, Salmonella typhimurium LT2
uuugauaagagaaaa

SEQ ID NO: 1858966 - RNA, 12 nt, Salmonella typhimurium LT2
uuugaggaaacc

SEQ ID NO: 1858967 - RNA, 15 nt, Salmonella typhimurium LT2
uuugagcagcgccau

SEQ ID NO: 1858968 - RNA, 17 nt, Salmonella typhimurium LT2
uuugagcagcgccaucu

SEQ ID NO: 1858969 - RNA, 22 nt, Salmonella typhimurium LT2
uuugacucgcuacgcucgcccu

SEQ ID NO: 1858970 - RNA, 13 nt, Salmonella typhimurium LT2
uuugaccucgccu

SEQ ID NO: 1858971 - RNA, 17 nt, Salmonella typhimurium LT2
uuugaccugaauccaga

SEQ ID NO: 1858972 - RNA, 14 nt, Salmonella typhimurium LT2
uuugacauugucau

SEQ ID NO: 1858973 - RNA, 12 nt, Salmonella typhimurium LT2
uuugacaacaaa

SEQ ID NO: 1858974 - RNA, 15 nt, Salmonella typhimurium LT2
uuugaacucuuucag

SEQ ID NO: 1858975 - RNA, 18 nt, Salmonella typhimurium LT2
uuugaacucuuucagacc

SEQ ID NO: 1858976 - RNA, 13 nt, Salmonella typhimurium LT2
uuucuucaucaaa

SEQ ID NO: 1858977 - RNA, 13 nt, Salmonella typhimurium LT2
uuucuucauccca

SEQ ID NO: 1858978 - RNA, 23 nt, Salmonella typhimurium LT2
uuucuucuuugcgcgucucuccc

SEQ ID NO: 1858979 - RNA, 12 nt, Salmonella typhimurium LT2
uuucuucucaac

SEQ ID NO: 1858980 - RNA, 22 nt, Salmonella typhimurium LT2
uuucuucucaacgccggaugac

SEQ ID NO: 1858981 - RNA, 14 nt, Salmonella typhimurium LT2
uuucuucuauuucu

SEQ ID NO: 1858982 - RNA, 23 nt, Salmonella typhimurium LT2
uuucuugccacuggccucccagu

SEQ ID NO: 1858983 - RNA, 14 nt, Salmonella typhimurium LT2
uuucuuucaucaaa

SEQ ID NO: 1858984 - RNA, 21 nt, Salmonella typhimurium LT2
uuucuucaagcguuuccagag

SEQ ID NO: 1858985 - RNA, 14 nt, Salmonella typhimurium LT2
uuucuguuaucagg

SEQ ID NO: 1858986 - RNA, 17 nt, Salmonella typhimurium LT2
uuucuguuaucaggcau

SEQ ID NO: 1858987 - RNA, 12 nt, Salmonella typhimurium LT2
uuucuguauuuu

SEQ ID NO: 1858988 - RNA, 20 nt, Salmonella typhimurium LT2
uuucuguguugcucaaaaaa

SEQ ID NO: 1858989 - RNA, 14 nt, Salmonella typhimurium LT2
uuucuguuccgaaa

SEQ ID NO: 1858990 - RNA, 15 nt, Salmonella typhimurium LT2
uuucuguuccgaaau

SEQ ID NO: 1858991 - RNA, 15 nt, Salmonella typhimurium LT2
uuucugggcaacuca

SEQ ID NO: 1858992 - RNA, 21 nt, Salmonella typhimurium LT2
uuuauuuuuuuacauuauucc

SEQ ID NO: 1858993 - RNA, 16 nt, Salmonella typhimurium LT2
uuucaaaaaagagaag

SEQ ID NO: 1858994 - RNA, 13 nt, Salmonella typhimurium LT2
uuucaaaaaagag

SEQ ID NO: 1858995 - RNA, 23 nt, Salmonella typhimurium LT2
uuuauuuggcucugaagcguaaa

SEQ ID NO: 1858996 - RNA, 14 nt, Salmonella typhimurium LT2
uuuauuuguauuau

SEQ ID NO: 1858997 - RNA, 19 nt, Salmonella typhimurium LT2
uuuauuuuuaauugcugaa

SEQ ID NO: 1858998 - RNA, 15 nt, Salmonella typhimurium LT2
uuuauuuuggcauuu

SEQ ID NO: 1858999 - RNA, 12 nt, Salmonella typhimurium LT2
uuuauuauuaca

SEQ ID NO: 1859000 - RNA, 15 nt, Salmonella typhimurium LT2
uuuauuauuacagga

SEQ ID NO: 1859001 - RNA, 20 nt, Salmonella typhimurium LT2
uuuauuucaucuauuauuuu

SEQ ID NO: 1859002 - RNA, 23 nt, Salmonella typhimurium LT2
uuuauugugcgcaagaaaaguuu

SEQ ID NO: 1859003 - RNA, 13 nt, Salmonella typhimurium LT2
uuuauugauuauu

SEQ ID NO: 1859004 - RNA, 14 nt, Salmonella typhimurium LT2
uuucaauuuccagu

SEQ ID NO: 1859005 - RNA, 18 nt, Salmonella typhimurium LT2
uuucaauuugugagacaa

SEQ ID NO: 1859006 - RNA, 19 nt, Salmonella typhimurium LT2
uuucacucgcauucuucag

SEQ ID NO: 1859007 - RNA, 24 nt, Salmonella typhimurium LT2
uuucaccgcgucguuacgcucguc

SEQ ID NO: 1859008 - RNA, 22 nt, Salmonella typhimurium LT2
uuucaacguuuuauuacgcuuc

SEQ ID NO: 1859009 - RNA, 20 nt, Salmonella typhimurium LT2
uuucaacagcacccaggcac

SEQ ID NO: 1859010 - RNA, 23 nt, Salmonella typhimurium LT2
uuucaacauauuuuucacacaua

SEQ ID NO: 1859011 - RNA, 23 nt, Salmonella typhimurium LT2
uuucaacccccucagcaaugauu

SEQ ID NO: 1859012 - RNA, 11 nt, Salmonella typhimurium LT2
uuucaauaaua

SEQ ID NO: 1859013 - RNA, 21 nt, Salmonella typhimurium LT2
uuucaauaaucccuucuuuua

SEQ ID NO: 1859014 - RNA, 19 nt, Salmonella typhimurium LT2
uuucaauauagccguggcu

SEQ ID NO: 1859015 - RNA, 16 nt, Salmonella typhimurium LT2
uuucaaucgccaccac

SEQ ID NO: 1859016 - RNA, 20 nt, Salmonella typhimurium LT2
uuucaauccuucuucugaaa

SEQ ID NO: 1859017 - RNA, 18 nt, Salmonella typhimurium LT2
uuucaauccuucuucuga

SEQ ID NO: 1859018 - RNA, 11 nt, Salmonella typhimurium LT2
uuucaguucaa

SEQ ID NO: 1859019 - RNA, 13 nt, Salmonella typhimurium LT2
uuucaguauuacu

SEQ ID NO: 1859020 - RNA, 12 nt, Salmonella typhimurium LT2
uuucagggcuua

SEQ ID NO: 1859021 - RNA, 19 nt, Salmonella typhimurium LT2
uuucaggcaaaaaaaaccg

SEQ ID NO: 1859022 - RNA, 20 nt, Salmonella typhimurium LT2
uuucaggcaccgguugcccc

SEQ ID NO: 1859023 - RNA, 18 nt, Salmonella typhimurium LT2
uuucagaucggcaaaagu

SEQ ID NO: 1859024 - RNA, 14 nt, Salmonella typhimurium LT2
uuucacuuccaugc

SEQ ID NO: 1859025 - RNA, 11 nt, Salmonella typhimurium LT2
uuucagcagcg

SEQ ID NO: 1859026 - RNA, 14 nt, Salmonella typhimurium LT2
uuucagcaagaagc

SEQ ID NO: 1859027 - RNA, 19 nt, Salmonella typhimurium LT2
uuucagccgcgcauagcug

SEQ ID NO: 1859028 - RNA, 14 nt, Salmonella typhimurium LT2
uuucagcauuaaga

SEQ ID NO: 1859029 - RNA, 18 nt, Salmonella typhimurium LT2
uuucagcucgcaggccau

SEQ ID NO: 1859030 - RNA, 16 nt, Salmonella typhimurium LT2
uuucagcucgcaggcc

SEQ ID NO: 1859031 - RNA, 12 nt, Salmonella typhimurium LT2
uuucagcgccag

SEQ ID NO: 1859032 - RNA, 23 nt, Salmonella typhimurium LT2
uuucagcucgcaggccauaaaac

SEQ ID NO: 1859033 - RNA, 14 nt, Salmonella typhimurium LT2
uuucauauuuuccu

SEQ ID NO: 1859034 - RNA, 13 nt, Salmonella typhimurium LT2
uuucaucuacgcu

SEQ ID NO: 1859035 - RNA, 21 nt, Salmonella typhimurium LT2
uuucaucuauuauuuuucuau

SEQ ID NO: 1859036 - RNA, 19 nt, Salmonella typhimurium LT2
uuucaucgccgauuccugc

SEQ ID NO: 1859037 - RNA, 16 nt, Salmonella typhimurium LT2
uuucaugauauucugu

SEQ ID NO: 1859038 - RNA, 14 nt, Salmonella typhimurium LT2
uuucauuacgcuuc

SEQ ID NO: 1859039 - RNA, 13 nt, Salmonella typhimurium LT2
uuucauuucugcc

SEQ ID NO: 1859040 - RNA, 20 nt, Salmonella typhimurium LT2
uuucauucagggaaucagcg

SEQ ID NO: 1859041 - RNA, 14 nt, Salmonella typhimurium LT2
uuucauuagccgcc

SEQ ID NO: 1859042 - RNA, 17 nt, Salmonella typhimurium LT2
uuucauuauaaaacuuc

SEQ ID NO: 1859043 - RNA, 22 nt, Salmonella typhimurium LT2
uuuccacaaucccggcaacugc

SEQ ID NO: 1859044 - RNA, 20 nt, Salmonella typhimurium LT2
uuuccacggucggucaagcu

SEQ ID NO: 1859045 - RNA, 23 nt, Salmonella typhimurium LT2
uuuccaaaauccagggaaaccau

SEQ ID NO: 1859046 - RNA, 15 nt, Salmonella typhimurium LT2
uuuaugcguuauaga

SEQ ID NO: 1859047 - RNA, 20 nt, Salmonella typhimurium LT2
uuuaugcaguuccguugcaa

SEQ ID NO: 1859048 - RNA, 22 nt, Salmonella typhimurium LT2
uuuaugacuggggcguuuuuua

SEQ ID NO: 1859049 - RNA, 22 nt, Salmonella typhimurium LT2
uuuauuacgcgcucucauaagc

SEQ ID NO: 1859050 - RNA, 19 nt, Salmonella typhimurium LT2
uuuauguguauagcuuuuc

SEQ ID NO: 1859051 - RNA, 15 nt, Salmonella typhimurium LT2
uuuauggcacaucag

SEQ ID NO: 1859052 - RNA, 20 nt, Salmonella typhimurium LT2
uuuauggccaaccagauuuu

SEQ ID NO: 1859053 - RNA, 15 nt, Salmonella typhimurium LT2
uuuaugggcauuuca

SEQ ID NO: 1859054 - RNA, 14 nt, Salmonella typhimurium LT2
uuuaugucaguaau

SEQ ID NO: 1859055 - RNA, 19 nt, Salmonella typhimurium LT2
uuuaugucaguaauauauu

SEQ ID NO: 1859056 - RNA, 11 nt, Salmonella typhimurium LT2
uuuauccagua

SEQ ID NO: 1859057 - RNA, 19 nt, Salmonella typhimurium LT2
uuuaucgaaguaauaaaaa

SEQ ID NO: 1859058 - RNA, 22 nt, Salmonella typhimurium LT2
uuuaucgaagugcgaaauuuaa

SEQ ID NO: 1859059 - RNA, 20 nt, Salmonella typhimurium LT2
uuuauccggcacgguaaacc

SEQ ID NO: 1859060 - RNA, 22 nt, Salmonella typhimurium LT2
uuuauccccgcuggcgcgggga

SEQ ID NO: 1859061 - RNA, 24 nt, Salmonella typhimurium LT2
uuuaucuauucagguuauuugccu

SEQ ID NO: 1859062 - RNA, 17 nt, Salmonella typhimurium LT2
uuuaucugcccuuucuu

SEQ ID NO: 1859063 - RNA, 21 nt, Salmonella typhimurium LT2
uuuaucugcgugaugcaucag

SEQ ID NO: 1859064 - RNA, 22 nt, Salmonella typhimurium LT2
uuuaucuuuaaauuucagggcu

SEQ ID NO: 1859065 - RNA, 18 nt, Salmonella typhimurium LT2
uuuaucuuuuacgcuguc

SEQ ID NO: 1859066 - RNA, 22 nt, Salmonella typhimurium LT2
uuuaucagaugugguauuuucu

SEQ ID NO: 1859067 - RNA, 11 nt, Salmonella typhimurium LT2
uuuaucagaag

SEQ ID NO: 1859068 - RNA, 15 nt, Salmonella typhimurium LT2
uuuaucacuauuacg

SEQ ID NO: 1859069 - RNA, 13 nt, Salmonella typhimurium LT2
uuuauaaaauuua

SEQ ID NO: 1859070 - RNA, 13 nt, Salmonella typhimurium LT2
uuuauaaaacuac

SEQ ID NO: 1859071 - RNA, 22 nt, Salmonella typhimurium LT2
uuuauaccgaaacagucacgcu

SEQ ID NO: 1859072 - RNA, 13 nt, Salmonella typhimurium LT2
uuuagcaccagac

SEQ ID NO: 1859073 - RNA, 16 nt, Salmonella typhimurium LT2
uuuagaaccaauagua

SEQ ID NO: 1859074 - RNA, 21 nt, Salmonella typhimurium LT2
uuuaguucagcauauuucuaa

SEQ ID NO: 1859075 - RNA, 13 nt, Salmonella typhimurium LT2
uuuaguuaucagg

SEQ ID NO: 1859076 - RNA, 11 nt, Salmonella typhimurium LT2
uuuagucguca

SEQ ID NO: 1859077 - RNA, 16 nt, Salmonella typhimurium LT2
uuuacuucuucaggcu

SEQ ID NO: 1859078 - RNA, 23 nt, Salmonella typhimurium LT2
uuuacuuaguaucauauuuucuu

SEQ ID NO: 1859079 - RNA, 14 nt, Salmonella typhimurium LT2
uuuacugacaauaa

SEQ ID NO: 1859080 - RNA, 17 nt, Salmonella typhimurium LT2
uuuacuauugccgauaa

SEQ ID NO: 1859081 - RNA, 18 nt, Salmonella typhimurium LT2
uuuacuccauucccagcu

SEQ ID NO: 1859082 - RNA, 14 nt, Salmonella typhimurium LT2
uuuacagccgccau

SEQ ID NO: 1859083 - RNA, 20 nt, Salmonella typhimurium LT2
uuuacggcccuaccauuacc

SEQ ID NO: 1859084 - RNA, 13 nt, Salmonella typhimurium LT2
uuuacggcaggcc

SEQ ID NO: 1859085 - RNA, 23 nt, Salmonella typhimurium LT2
uuuacgcccucaucggcaaacau

SEQ ID NO: 1859086 - RNA, 12 nt, Salmonella typhimurium LT2
ucaggcuuucca

SEQ ID NO: 1859087 - RNA, 22 nt, Salmonella typhimurium LT2
ucaggcucgucgccuuccagcg

SEQ ID NO: 1859088 - RNA, 14 nt, Salmonella typhimurium LT2
ucaggcuaaauggc

SEQ ID NO: 1859089 - RNA, 19 nt, Salmonella typhimurium LT2
ucagggcgaaaaugaucac

SEQ ID NO: 1859090 - RNA, 22 nt, Salmonella typhimurium LT2
ucagggcgaaaaugaucacuuc

SEQ ID NO: 1859091 - RNA, 17 nt, Salmonella typhimurium LT2
ucaggggcgaacccauc

SEQ ID NO: 1859092 - RNA, 17 nt, Salmonella typhimurium LT2
ucaggggcggguuuuuu

SEQ ID NO: 1859093 - RNA, 21 nt, Salmonella typhimurium LT2
ucagggcuuacucccugguga

SEQ ID NO: 1859094 - RNA, 20 nt, Salmonella typhimurium LT2
ucaggugaauaccaaagccc

SEQ ID NO: 1859095 - RNA, 19 nt, Salmonella typhimurium LT2
ucagguuaggcgcgauaau

SEQ ID NO: 1859096 - RNA, 21 nt, Salmonella typhimurium LT2
ucaggguuauuuccgcuggcc

SEQ ID NO: 1859097 - RNA, 15 nt, Salmonella typhimurium LT2
ucaggguuuucagga

SEQ ID NO: 1859098 - RNA, 17 nt, Salmonella typhimurium LT2
ucaggguuuucaggaag

SEQ ID NO: 1859099 - RNA, 17 nt, Salmonella typhimurium LT2
ucaggguuagcgauccu

SEQ ID NO: 1859100 - RNA, 20 nt, Salmonella typhimurium LT2
ucagggucuuauuucuccug

SEQ ID NO: 1859101 - RNA, 21 nt, Salmonella typhimurium LT2
ucaggguuuucuaccgcagcc

SEQ ID NO: 1859102 - RNA, 19 nt, Salmonella typhimurium LT2
ucagguaucccgccagcgg

SEQ ID NO: 1859103 - RNA, 16 nt, Salmonella typhimurium LT2
ucaggcacgugcauaa

SEQ ID NO: 1859104 - RNA, 18 nt, Salmonella typhimurium LT2
ucaggcacaaaaaacaaa

SEQ ID NO: 1859105 - RNA, 14 nt, Salmonella typhimurium LT2
ucaggcaaugucug

SEQ ID NO: 1859106 - RNA, 23 nt, Salmonella typhimurium LT2
ucaggcaaucuuuaacgcuggca

SEQ ID NO: 1859107 - RNA, 17 nt, Salmonella typhimurium LT2
ucaggcaauaaacauca

SEQ ID NO: 1859108 - RNA, 21 nt, Salmonella typhimurium LT2
ucaggcauguugcgcaaucac

SEQ ID NO: 1859109 - RNA, 23 nt, Salmonella typhimurium LT2
ucaggcaucgcugauaaaaacuc

SEQ ID NO: 1859110 - RNA, 23 nt, Salmonella typhimurium LT2
ucaggcacagaagcgccugucua

SEQ ID NO: 1859111 - RNA, 17 nt, Salmonella typhimurium LT2
ucaggcaggucugauaa

SEQ ID NO: 1859112 - RNA, 14 nt, Salmonella typhimurium LT2
ucaggcaaaaauaa

SEQ ID NO: 1859113 - RNA, 23 nt, Salmonella typhimurium LT2
ucaggcaaaaaucgucaucagau

SEQ ID NO: 1859114 - RNA, 22 nt, Salmonella typhimurium LT2
ucaggaggccugaauaaugacc

SEQ ID NO: 1859115 - RNA, 15 nt, Salmonella typhimurium LT2
ucaggaggccugaau

SEQ ID NO: 1859116 - RNA, 13 nt, Salmonella typhimurium LT2
ucaggaggccuga

SEQ ID NO: 1859117 - RNA, 14 nt, Salmonella typhimurium LT2
ucaggauauucgcc

SEQ ID NO: 1859118 - RNA, 23 nt, Salmonella typhimurium LT2
ucaggccuacgguuuuacaguua

SEQ ID NO: 1859119 - RNA, 16 nt, Salmonella typhimurium LT2
ucaggccuacaguuuc

SEQ ID NO: 1859120 - RNA, 23 nt, Salmonella typhimurium LT2
ucaggcgaccauccaccagaacc

SEQ ID NO: 1859121 - RNA, 16 nt, Salmonella typhimurium LT2
ucaggcgcauaucgcc

SEQ ID NO: 1859122 - RNA, 19 nt, Salmonella typhimurium LT2
ucaggcgauagccguccau

SEQ ID NO: 1859123 - RNA, 18 nt, Salmonella typhimurium LT2
ucaggccgccgcacaggc

SEQ ID NO: 1859124 - RNA, 15 nt, Salmonella typhimurium LT2
ucaggccagacugag

SEQ ID NO: 1859125 - RNA, 22 nt, Salmonella typhimurium LT2
ucaggccagacugagcaaacuc

SEQ ID NO: 1859126 - RNA, 20 nt, Salmonella typhimurium LT2
ucagcgcguuuuccaucauc

SEQ ID NO: 1859127 - RNA, 18 nt, Salmonella typhimurium LT2
ucagcguugucccgccuu

SEQ ID NO: 1859128 - RNA, 21 nt, Salmonella typhimurium LT2
ucagcguguuucaucucauca

SEQ ID NO: 1859129 - RNA, 20 nt, Salmonella typhimurium LT2
ucagcgugacguucaucauu

SEQ ID NO: 1859130 - RNA, 13 nt, Salmonella typhimurium LT2
ucagcgugccggu

SEQ ID NO: 1859131 - RNA, 22 nt, Salmonella typhimurium LT2
ucagcguaaaacuuuucugcgu

SEQ ID NO: 1859132 - RNA, 21 nt, Salmonella typhimurium LT2
uaucuucccgauaacugaagg

SEQ ID NO: 1859133 - RNA, 17 nt, Salmonella typhimurium LT2
ucagcgcagugaccagc

SEQ ID NO: 1859134 - RNA, 18 nt, Salmonella typhimurium LT2
uaucuuccacgguaaaac

SEQ ID NO: 1859135 - RNA, 20 nt, Salmonella typhimurium LT2
uaucuucaucgguaagcgca

SEQ ID NO: 1859136 - RNA, 14 nt, Salmonella typhimurium LT2
ucagcgccaccaca

SEQ ID NO: 1859137 - RNA, 21 nt, Salmonella typhimurium LT2
ucagcgccauccggcuuucuu

SEQ ID NO: 1859138 - RNA, 17 nt, Salmonella typhimurium LT2
ucagcgccagcgcugac

SEQ ID NO: 1859139 - RNA, 14 nt, Salmonella typhimurium LT2
ucagcgccagcccu

SEQ ID NO: 1859140 - RNA, 17 nt, Salmonella typhimurium LT2
ucagcgcgcuccagacc

SEQ ID NO: 1859141 - RNA, 10 nt, Salmonella typhimurium LT2
ucagcgcggc

SEQ ID NO: 1859142 - RNA, 19 nt, Salmonella typhimurium LT2
ucagcgcggcaaggauaac

SEQ ID NO: 1859143 - RNA, 17 nt, Salmonella typhimurium LT2
ucagcgcgccaauggcc

SEQ ID NO: 1859144 - RNA, 20 nt, Salmonella typhimurium LT2
ucaggacggcauaagccagc

SEQ ID NO: 1859145 - RNA, 13 nt, Salmonella typhimurium LT2
ucaggacaucaaa

SEQ ID NO: 1859146 - RNA, 21 nt, Salmonella typhimurium LT2
ucaggaaauucucagaaacaa

SEQ ID NO: 1859147 - RNA, 16 nt, Salmonella typhimurium LT2
ucaggaaaucuuccag

SEQ ID NO: 1859148 - RNA, 15 nt, Salmonella typhimurium LT2
ucaggaaaugaacca

SEQ ID NO: 1859149 - RNA, 14 nt, Salmonella typhimurium LT2
ucaggaaggagcaa

SEQ ID NO: 1859150 - RNA, 14 nt, Salmonella typhimurium LT2
ucaggaagaaagac

SEQ ID NO: 1859151 - RNA, 23 nt, Salmonella typhimurium LT2
ucaggaacgcggcgccgaagcag

SEQ ID NO: 1859152 - RNA, 21 nt, Salmonella typhimurium LT2
ucaggaaaaagggaauaauac

SEQ ID NO: 1859153 - RNA, 21 nt, Salmonella typhimurium LT2
ucaggaaacgcgccggaaggc

SEQ ID NO: 1859154 - RNA, 15 nt, Salmonella typhimurium LT2
ucaggaaagagaaaa

SEQ ID NO: 1859155 - RNA, 15 nt, Salmonella typhimurium LT2
ucagcuugucgguaa

SEQ ID NO: 1859156 - RNA, 15 nt, Salmonella typhimurium LT2
ucagcucagcaacaa

SEQ ID NO: 1859157 - RNA, 19 nt, Salmonella typhimurium LT2
ucagcugaacagucccacc

SEQ ID NO: 1859158 - RNA, 20 nt, Salmonella typhimurium LT2
ucagcugaacagucccacca

SEQ ID NO: 1859159 - RNA, 18 nt, Salmonella typhimurium LT2
ucagcugacaaugugccg

SEQ ID NO: 1859160 - RNA, 21 nt, Salmonella typhimurium LT2
ucagguucgggccaccuucca

SEQ ID NO: 1859161 - RNA, 20 nt, Salmonella typhimurium LT2
ucagguuuuuaagcugccca

SEQ ID NO: 1859162 - RNA, 21 nt, Salmonella typhimurium LT2
ucaguagccgccgcaggacag

SEQ ID NO: 1859163 - RNA, 17 nt, Salmonella typhimurium LT2
ucaguaccucgcauacu

SEQ ID NO: 1859164 - RNA, 23 nt, Salmonella typhimurium LT2
ucaguaugaucaugcccggcaaa

SEQ ID NO: 1859165 - RNA, 16 nt, Salmonella typhimurium LT2
ucagucacauacuucu

SEQ ID NO: 1859166 - RNA, 14 nt, Salmonella typhimurium LT2
ucagugaacacccu

SEQ ID NO: 1859167 - RNA, 13 nt, Salmonella typhimurium LT2
ucagugaacaccc

SEQ ID NO: 1859168 - RNA, 14 nt, Salmonella typhimurium LT2
ucaguggaaaacag

SEQ ID NO: 1859169 - RNA, 15 nt, Salmonella typhimurium LT2
ucaguggaaaacagc

SEQ ID NO: 1859170 - RNA, 17 nt, Salmonella typhimurium LT2
ucaguggcggcaaaaaa

SEQ ID NO: 1859171 - RNA, 22 nt, Salmonella typhimurium LT2
ucaguggcggcaaaaaauauag

SEQ ID NO: 1859172 - RNA, 17 nt, Salmonella typhimurium LT2
ucagugaacacccugcc

SEQ ID NO: 1859173 - RNA, 17 nt, Salmonella typhimurium LT2
ucagugaacguucacua

SEQ ID NO: 1859174 - RNA, 22 nt, Salmonella typhimurium LT2
ucaguucucgguauccagcucg

SEQ ID NO: 1859175 - RNA, 20 nt, Salmonella typhimurium LT2
ucaguugcguucccaguucc

SEQ ID NO: 1859176 - RNA, 14 nt, Salmonella typhimurium LT2
ucaguugguuagaa

SEQ ID NO: 1859177 - RNA, 14 nt, Salmonella typhimurium LT2
ucaguucagaaacg

SEQ ID NO: 1859178 - RNA, 12 nt, Salmonella typhimurium LT2
ucaguucaggaa

SEQ ID NO: 1859179 - RNA, 21 nt, Salmonella typhimurium LT2
ucaguguuuccauacauuuuu

SEQ ID NO: 1859180 - RNA, 21 nt, Salmonella typhimurium LT2
ucaguuaagcggggguaacaa

SEQ ID NO: 1859181 - RNA, 18 nt, Salmonella typhimurium LT2
ucaguuaugacagacagg

SEQ ID NO: 1859182 - RNA, 22 nt, Salmonella typhimurium LT2
ucaguuaugacagacaggccuu

SEQ ID NO: 1859183 - RNA, 18 nt, Salmonella typhimurium LT2
ucaguuuuggcaaucaca

SEQ ID NO: 1859184 - RNA, 17 nt, Salmonella typhimurium LT2
ucaguuugccuuuauuc

SEQ ID NO: 1859185 - RNA, 21 nt, Salmonella typhimurium LT2
ucauaaaaucaaucugcaugu

SEQ ID NO: 1859186 - RNA, 19 nt, Salmonella typhimurium LT2
ucauaacaccaauacguga

SEQ ID NO: 1859187 - RNA, 21 nt, Salmonella typhimurium LT2
ucauaaccgcagucuccggua

SEQ ID NO: 1859188 - RNA, 13 nt, Salmonella typhimurium LT2
ucaucaaauuauc

SEQ ID NO: 1859189 - RNA, 14 nt, Salmonella typhimurium LT2
ucaucaaucgcuuu

SEQ ID NO: 1859190 - RNA, 16 nt, Salmonella typhimurium LT2
ucaucaagagauaucc

SEQ ID NO: 1859191 - RNA, 20 nt, Salmonella typhimurium LT2
ucauauuguagguuuuccuc

SEQ ID NO: 1859192 - RNA, 13 nt, Salmonella typhimurium LT2
ucauauuccagcc

SEQ ID NO: 1859193 - RNA, 13 nt, Salmonella typhimurium LT2
ucauauuuauaca

SEQ ID NO: 1859194 - RNA, 21 nt, Salmonella typhimurium LT2
ucauauuuauacaucauccgu

SEQ ID NO: 1859195 - RNA, 11 nt, Salmonella typhimurium LT2
ucauauuugcu

SEQ ID NO: 1859196 - RNA, 13 nt, Salmonella typhimurium LT2
ucaucaaaaaggc

SEQ ID NO: 1859197 - RNA, 17 nt, Salmonella typhimurium LT2
ucauauaaucugaaaga

SEQ ID NO: 1859198 - RNA, 15 nt, Salmonella typhimurium LT2
ucauaugugccgaug

SEQ ID NO: 1859199 - RNA, 20 nt, Salmonella typhimurium LT2
ucauauucaagaacgguuua

SEQ ID NO: 1859200 - RNA, 21 nt, Salmonella typhimurium LT2
ucauauggaagcuguuaauuu

SEQ ID NO: 1859201 - RNA, 20 nt, Salmonella typhimurium LT2
ucauaaugucccugccacgc

SEQ ID NO: 1859202 - RNA, 16 nt, Salmonella typhimurium LT2
ucauaaugaauacgcu

SEQ ID NO: 1859203 - RNA, 13 nt, Salmonella typhimurium LT2
ucauacccuucca

SEQ ID NO: 1859204 - RNA, 17 nt, Salmonella typhimurium LT2
ucauaccaugauucaua

SEQ ID NO: 1859205 - RNA, 21 nt, Salmonella typhimurium LT2
ucauaccgagagcuacagugu

SEQ ID NO: 1859206 - RNA, 23 nt, Salmonella typhimurium LT2
ucauaaucgcgauacugccgccc

SEQ ID NO: 1859207 - RNA, 16 nt, Salmonella typhimurium LT2
ucauaauaaacugcau

SEQ ID NO: 1859208 - RNA, 17 nt, Salmonella typhimurium LT2
ucauaacgaccaaacaa

SEQ ID NO: 1859209 - RNA, 14 nt, Salmonella typhimurium LT2
ucauacgcuuucug

SEQ ID NO: 1859210 - RNA, 14 nt, Salmonella typhimurium LT2
ucauagugcgcgcg

SEQ ID NO: 1859211 - RNA, 20 nt, Salmonella typhimurium LT2
ucauagucgcuuuucauacu

SEQ ID NO: 1859212 - RNA, 19 nt, Salmonella typhimurium LT2
ucauccggguuaaaccagc

SEQ ID NO: 1859213 - RNA, 12 nt, Salmonella typhimurium LT2
ucauccggcguu

SEQ ID NO: 1859214 - RNA, 22 nt, Salmonella typhimurium LT2
ucaucccggcuuaaauuuuuaa

SEQ ID NO: 1859215 - RNA, 23 nt, Salmonella typhimurium LT2
ucaucccgguuugggcgcgaaac

SEQ ID NO: 1859216 - RNA, 17 nt, Salmonella typhimurium LT2
ucauccgagaccaggcg

SEQ ID NO: 1859217 - RNA, 18 nt, Salmonella typhimurium LT2
ucauccgcccgacaucaa

SEQ ID NO: 1859218 - RNA, 19 nt, Salmonella typhimurium LT2
ucaucccacuccaucgccu

SEQ ID NO: 1859219 - RNA, 19 nt, Salmonella typhimurium LT2
ucaucccacucaaucauug

SEQ ID NO: 1859220 - RNA, 19 nt, Salmonella typhimurium LT2
ucauccauugcuuccuuga

SEQ ID NO: 1859221 - RNA, 13 nt, Salmonella typhimurium LT2
ucauccagcgcgc

SEQ ID NO: 1859222 - RNA, 14 nt, Salmonella typhimurium LT2
ucauccagcagcau

SEQ ID NO: 1859223 - RNA, 13 nt, Salmonella typhimurium LT2
ucauccagcagca

SEQ ID NO: 1859224 - RNA, 16 nt, Salmonella typhimurium LT2
ucaucgaaccgggugc

SEQ ID NO: 1859225 - RNA, 16 nt, Salmonella typhimurium LT2
ucaucgaacgccgccu

SEQ ID NO: 1859226 - RNA, 21 nt, Salmonella typhimurium LT2
ucaucgaaggcaucuucagac

SEQ ID NO: 1859227 - RNA, 14 nt, Salmonella typhimurium LT2
ucaucgacaaauac

SEQ ID NO: 1859228 - RNA, 19 nt, Salmonella typhimurium LT2
ucaucgacuucaaugggaa

SEQ ID NO: 1859229 - RNA, 14 nt, Salmonella typhimurium LT2
ucaucgcgccuccc

SEQ ID NO: 1859230 - RNA, 13 nt, Salmonella typhimurium LT2
ucaucgccagccc

SEQ ID NO: 1859231 - RNA, 17 nt, Salmonella typhimurium LT2
ucaucgcaaauucugua

SEQ ID NO: 1859232 - RNA, 14 nt, Salmonella typhimurium LT2
ucaucgcauccagg

SEQ ID NO: 1859233 - RNA, 15 nt, Salmonella typhimurium LT2
ucauccacagaacgg

SEQ ID NO: 1859234 - RNA, 14 nt, Salmonella typhimurium LT2
ucaucauuuuccca

SEQ ID NO: 1859235 - RNA, 19 nt, Salmonella typhimurium LT2
ucaucauacugaagauaaa

SEQ ID NO: 1859236 - RNA, 16 nt, Salmonella typhimurium LT2
ucaucauauggcugga

SEQ ID NO: 1859237 - RNA, 14 nt, Salmonella typhimurium LT2
ucaucaguaacuga

SEQ ID NO: 1859238 - RNA, 16 nt, Salmonella typhimurium LT2
ucaucaucggcacagc

SEQ ID NO: 1859239 - RNA, 21 nt, Salmonella typhimurium LT2
ucaucaucucugucgaccauc

SEQ ID NO: 1859240 - RNA, 12 nt, Salmonella typhimurium LT2
ucaucaucuguu

SEQ ID NO: 1859241 - RNA, 11 nt, Salmonella typhimurium LT2
ucaucaucagg

SEQ ID NO: 1859242 - RNA, 16 nt, Salmonella typhimurium LT2
ucaucaccagcagcag

SEQ ID NO: 1859243 - RNA, 20 nt, Salmonella typhimurium LT2
ucaucacaucgcgcagcagg

SEQ ID NO: 1859244 - RNA, 16 nt, Salmonella typhimurium LT2
ucaucaccuccagcac

SEQ ID NO: 1859245 - RNA, 16 nt, Salmonella typhimurium LT2
ucaucagccugaaaga

SEQ ID NO: 1859246 - RNA, 19 nt, Salmonella typhimurium LT2
ucaucaggcaauaaacauc

SEQ ID NO: 1859247 - RNA, 12 nt, Salmonella typhimurium LT2
ucaucagcagca

SEQ ID NO: 1859248 - RNA, 15 nt, Salmonella typhimurium LT2
ucaucagcagcagcg

SEQ ID NO: 1859249 - RNA, 21 nt, Salmonella typhimurium LT2
ucaucaggccugcaaaccucu

SEQ ID NO: 1859250 - RNA, 20 nt, Salmonella typhimurium LT2
ucaucagaccgagacccagc

SEQ ID NO: 1859251 - RNA, 15 nt, Salmonella typhimurium LT2
ucaucagaagaagac

SEQ ID NO: 1859252 - RNA, 17 nt, Salmonella typhimurium LT2
ucaucuaucugcuucug

SEQ ID NO: 1859253 - RNA, 16 nt, Salmonella typhimurium LT2
ucaucucaagccccau

SEQ ID NO: 1859254 - RNA, 21 nt, Salmonella typhimurium LT2
ucaucgucugcgucuucuucc

SEQ ID NO: 1859255 - RNA, 23 nt, Salmonella typhimurium LT2
ucaucgcuuaacggcccaggcau

SEQ ID NO: 1859256 - RNA, 15 nt, Salmonella typhimurium LT2
ucaucggcucgacuu

SEQ ID NO: 1859257 - RNA, 20 nt, Salmonella typhimurium LT2
ucaucgucauuaaugccuaa

SEQ ID NO: 1859258 - RNA, 16 nt, Salmonella typhimurium LT2
ucaucgguguucacaa

SEQ ID NO: 1859259 - RNA, 22 nt, Salmonella typhimurium LT2
ucaucuguagcuucugucccag

SEQ ID NO: 1859260 - RNA, 15 nt, Salmonella typhimurium LT2
ucaucucccaggccg

SEQ ID NO: 1859261 - RNA, 23 nt, Salmonella typhimurium LT2
ucaucuucuuccggcugccagcc

SEQ ID NO: 1859262 - RNA, 14 nt, Salmonella typhimurium LT2
ucaucuucaucacu

SEQ ID NO: 1859263 - RNA, 17 nt, Salmonella typhimurium LT2
ucaucuuguccucauca

SEQ ID NO: 1859264 - RNA, 19 nt, Salmonella typhimurium LT2
ucaugccgaccagggcguc

SEQ ID NO: 1859265 - RNA, 21 nt, Salmonella typhimurium LT2
ucaugcaacuucaccucaguc

SEQ ID NO: 1859266 - RNA, 23 nt, Salmonella typhimurium LT2
ucaugcuguauaaacucagcaau

SEQ ID NO: 1859267 - RNA, 20 nt, Salmonella typhimurium LT2
ucaugcuuaucgccaaacca

SEQ ID NO: 1859268 - RNA, 16 nt, Salmonella typhimurium LT2
ucauggaacuuaucca

SEQ ID NO: 1859269 - RNA, 13 nt, Salmonella typhimurium LT2
ucaugcuaaaagc

SEQ ID NO: 1859270 - RNA, 14 nt, Salmonella typhimurium LT2
ucaugcuaaaacag

SEQ ID NO: 1859271 - RNA, 23 nt, Salmonella typhimurium LT2
ucaugcgcgucccggcagugcau

SEQ ID NO: 1859272 - RNA, 14 nt, Salmonella typhimurium LT2
ucaugaagcucaac

SEQ ID NO: 1859273 - RNA, 17 nt, Salmonella typhimurium LT2
ucaucuuuuacaggccg

SEQ ID NO: 1859274 - RNA, 20 nt, Salmonella typhimurium LT2
ucaugaucuuuccuuuuuca

SEQ ID NO: 1859275 - RNA, 19 nt, Salmonella typhimurium LT2
ucaugaucuuuccuuuuuc

SEQ ID NO: 1859276 - RNA, 17 nt, Salmonella typhimurium LT2
ucauucagaucaaaaau

SEQ ID NO: 1859277 - RNA, 15 nt, Salmonella typhimurium LT2
ucauuacugggucgc

SEQ ID NO: 1859278 - RNA, 14 nt, Salmonella typhimurium LT2
ucauuaucaauggc

SEQ ID NO: 1859279 - RNA, 20 nt, Salmonella typhimurium LT2
ucauucugcuuaccagaccg

SEQ ID NO: 1859280 - RNA, 19 nt, Salmonella typhimurium LT2
ucauugacgguggccgcca

SEQ ID NO: 1859281 - RNA, 15 nt, Salmonella typhimurium LT2
ucauucucuaccccu

SEQ ID NO: 1859282 - RNA, 20 nt, Salmonella typhimurium LT2
ucauucgguuaggaauagca

SEQ ID NO: 1859283 - RNA, 22 nt, Salmonella typhimurium LT2
ucauucgccucaaaacgggcag

SEQ ID NO: 1859284 - RNA, 19 nt, Salmonella typhimurium LT2
ucaugugcagcauccagcu

SEQ ID NO: 1859285 - RNA, 13 nt, Salmonella typhimurium LT2
ucaugugccgcga

SEQ ID NO: 1859286 - RNA, 16 nt, Salmonella typhimurium LT2
ucaugggcucaucaaa

SEQ ID NO: 1859287 - RNA, 13 nt, Salmonella typhimurium LT2
ucauggggaacag

SEQ ID NO: 1859288 - RNA, 19 nt, Salmonella typhimurium LT2
ucaugguagucaaauucca

SEQ ID NO: 1859289 - RNA, 18 nt, Salmonella typhimurium LT2
ucaugguacucaacauca

SEQ ID NO: 1859290 - RNA, 13 nt, Salmonella typhimurium LT2
ucaugguugaaaa

SEQ ID NO: 1859291 - RNA, 21 nt, Salmonella typhimurium LT2
ucauggcuuuuacccuucaug

SEQ ID NO: 1859292 - RNA, 16 nt, Salmonella typhimurium LT2
ucauggcuauuuugau

SEQ ID NO: 1859293 - RNA, 14 nt, Salmonella typhimurium LT2
ucauggcgaacucu

SEQ ID NO: 1859294 - RNA, 16 nt, Salmonella typhimurium LT2
ucauuaccaacguaaa

SEQ ID NO: 1859295 - RNA, 21 nt, Salmonella typhimurium LT2
ucauuaauuauacugucgcuc

SEQ ID NO: 1859296 - RNA, 19 nt, Salmonella typhimurium LT2
ucauuacgaaguuuaauuc

SEQ ID NO: 1859297 - RNA, 18 nt, Salmonella typhimurium LT2
ucauuaacguaggccgga

SEQ ID NO: 1859298 - RNA, 22 nt, Salmonella typhimurium LT2
ucauuaacgacaacuucuaauu

SEQ ID NO: 1859299 - RNA, 18 nt, Salmonella typhimurium LT2
uccaacauagcuaaauua

SEQ ID NO: 1859300 - RNA, 22 nt, Salmonella typhimurium LT2
uccaacauagcuaaauuaaaaa

SEQ ID NO: 1859301 - RNA, 17 nt, Salmonella typhimurium LT2
uccaaccgcugaccauc

SEQ ID NO: 1859302 - RNA, 22 nt, Salmonella typhimurium LT2
uccaacacaucgacaugcagau

SEQ ID NO: 1859303 - RNA, 17 nt, Salmonella typhimurium LT2
ucauuuuuuaauaucaa

SEQ ID NO: 1859304 - RNA, 16 nt, Salmonella typhimurium LT2
ucauugcguucaggcg

SEQ ID NO: 1859305 - RNA, 20 nt, Salmonella typhimurium LT2
ucauuggaagagacacgcug

SEQ ID NO: 1859306 - RNA, 18 nt, Salmonella typhimurium LT2
ucauuucugccugcuuca

SEQ ID NO: 1859307 - RNA, 12 nt, Salmonella typhimurium LT2
ucauuucuacaa

SEQ ID NO: 1859308 - RNA, 18 nt, Salmonella typhimurium LT2
ucauuugcaauggccccu

SEQ ID NO: 1859309 - RNA, 21 nt, Salmonella typhimurium LT2
ucauuuguacaaaaaauguga

SEQ ID NO: 1859310 - RNA, 24 nt, Salmonella typhimurium LT2
ucauuuuacugcguaaucuuuuca

SEQ ID NO: 1859311 - RNA, 21 nt, Salmonella typhimurium LT2
ucauuuucaugauauucuguc

SEQ ID NO: 1859312 - RNA, 20 nt, Salmonella typhimurium LT2
ucauuuuguugcuccagcau

SEQ ID NO: 1859313 - RNA, 17 nt, Salmonella typhimurium LT2
uccauagaaaucagcag

SEQ ID NO: 1859314 - RNA, 21 nt, Salmonella typhimurium LT2
uccauaccggacuccaggcaa

SEQ ID NO: 1859315 - RNA, 22 nt, Salmonella typhimurium LT2
uccauaccggacuccaggcaac

SEQ ID NO: 1859316 - RNA, 18 nt, Salmonella typhimurium LT2
uccauaccguuucaacug

SEQ ID NO: 1859317 - RNA, 13 nt, Salmonella typhimurium LT2
uccauacauccau

SEQ ID NO: 1859318 - RNA, 12 nt, Salmonella typhimurium LT2
uccauaaaauga

SEQ ID NO: 1859319 - RNA, 13 nt, Salmonella typhimurium LT2
uccaguuuuuucc

SEQ ID NO: 1859320 - RNA, 17 nt, Salmonella typhimurium LT2
uccaucagcgcuuugau

SEQ ID NO: 1859321 - RNA, 13 nt, Salmonella typhimurium LT2
uccaucagccagg

SEQ ID NO: 1859322 - RNA, 14 nt, Salmonella typhimurium LT2
uccaucagccaggc

SEQ ID NO: 1859323 - RNA, 23 nt, Salmonella typhimurium LT2
uccaucaguucggcgcgccagcc

SEQ ID NO: 1859324 - RNA, 13 nt, Salmonella typhimurium LT2
uccaucauuuccg

SEQ ID NO: 1859325 - RNA, 15 nt, Salmonella typhimurium LT2
uccaucgguucucug

SEQ ID NO: 1859326 - RNA, 14 nt, Salmonella typhimurium LT2
uccaucgaauaaag

SEQ ID NO: 1859327 - RNA, 19 nt, Salmonella typhimurium LT2
uccauauaacagaauaagc

SEQ ID NO: 1859328 - RNA, 13 nt, Salmonella typhimurium LT2
uccaucacuccuu

SEQ ID NO: 1859329 - RNA, 14 nt, Salmonella typhimurium LT2
uccaucaaaagcuu

SEQ ID NO: 1859330 - RNA, 16 nt, Salmonella typhimurium LT2
uccaguguuguucucu

SEQ ID NO: 1859331 - RNA, 11 nt, Salmonella typhimurium LT2
uccagugguga

SEQ ID NO: 1859332 - RNA, 14 nt, Salmonella typhimurium LT2
uccagucgcuccac

SEQ ID NO: 1859333 - RNA, 12 nt, Salmonella typhimurium LT2
uccagucccuga

SEQ ID NO: 1859334 - RNA, 22 nt, Salmonella typhimurium LT2
uccagucaggcucaauaugggc

SEQ ID NO: 1859335 - RNA, 13 nt, Salmonella typhimurium LT2
uccaguccugccc

SEQ ID NO: 1859336 - RNA, 18 nt, Salmonella typhimurium LT2
uccaguugcuuaccuugu

SEQ ID NO: 1859337 - RNA, 14 nt, Salmonella typhimurium LT2
uccaguugcauaca

SEQ ID NO: 1859338 - RNA, 16 nt, Salmonella typhimurium LT2
uccaguugcauacaua

SEQ ID NO: 1859339 - RNA, 19 nt, Salmonella typhimurium LT2
uccaguugcggcaucagau

SEQ ID NO: 1859340 - RNA, 17 nt, Salmonella typhimurium LT2
uccaguugcccucuuua

SEQ ID NO: 1859341 - RNA, 16 nt, Salmonella typhimurium LT2
uccaguugcuuaccuu

SEQ ID NO: 1859342 - RNA, 21 nt, Salmonella typhimurium LT2
uccaguucauaagucauccag

SEQ ID NO: 1859343 - RNA, 22 nt, Salmonella typhimurium LT2
uccaguucaucuacacgcacuu

SEQ ID NO: 1859344 - RNA, 13 nt, Salmonella typhimurium LT2
uccaguucgagcc

SEQ ID NO: 1859345 - RNA, 20 nt, Salmonella typhimurium LT2
uccaguucgcgauaggccuc

SEQ ID NO: 1859346 - RNA, 17 nt, Salmonella typhimurium LT2
uccagguaacauacaaa

SEQ ID NO: 1859347 - RNA, 16 nt, Salmonella typhimurium LT2
uccagguaacauacaa

SEQ ID NO: 1859348 - RNA, 21 nt, Salmonella typhimurium LT2
uccagggcugcuggccuucca

SEQ ID NO: 1859349 - RNA, 18 nt, Salmonella typhimurium LT2
uccagguuuuaguuucac

SEQ ID NO: 1859350 - RNA, 23 nt, Salmonella typhimurium LT2
uccagguugugguuaaacacauc

SEQ ID NO: 1859351 - RNA, 14 nt, Salmonella typhimurium LT2
uccaguaauuucag

SEQ ID NO: 1859352 - RNA, 16 nt, Salmonella typhimurium LT2
uccaguacuuucuuuu

SEQ ID NO: 1859353 - RNA, 21 nt, Salmonella typhimurium LT2
uccaguaccugacuuuuccau

SEQ ID NO: 1859354 - RNA, 15 nt, Salmonella typhimurium LT2
uccaguaauuuuucc

SEQ ID NO: 1859355 - RNA, 15 nt, Salmonella typhimurium LT2
uccagcgucgggccg

SEQ ID NO: 1859356 - RNA, 20 nt, Salmonella typhimurium LT2
uccagcgguagccagcgcag

SEQ ID NO: 1859357 - RNA, 14 nt, Salmonella typhimurium LT2
uccagcgugcagau

SEQ ID NO: 1859358 - RNA, 20 nt, Salmonella typhimurium LT2
uccagcuaaguuuguaaaau

SEQ ID NO: 1859359 - RNA, 16 nt, Salmonella typhimurium LT2
uccagcucauuuuuac

SEQ ID NO: 1859360 - RNA, 18 nt, Salmonella typhimurium LT2
uccagcucagggucccca

SEQ ID NO: 1859361 - RNA, 15 nt, Salmonella typhimurium LT2
uccagcucagggucc

SEQ ID NO: 1859362 - RNA, 19 nt, Salmonella typhimurium LT2
uccagcugcgacagcgaac

SEQ ID NO: 1859363 - RNA, 17 nt, Salmonella typhimurium LT2
uccagcuguaccaucac

SEQ ID NO: 1859364 - RNA, 19 nt, Salmonella typhimurium LT2
uccagcuguuuaagcgccu

SEQ ID NO: 1859365 - RNA, 15 nt, Salmonella typhimurium LT2
uccagcuucaucauc

SEQ ID NO: 1859366 - RNA, 14 nt, Salmonella typhimurium LT2
uccagcucuucuuc

SEQ ID NO: 1859367 - RNA, 20 nt, Salmonella typhimurium LT2
uccagcucuuugguccauaa

SEQ ID NO: 1859368 - RNA, 23 nt, Salmonella typhimurium LT2
uccagcucgucgaagcuuuucac

SEQ ID NO: 1859369 - RNA, 19 nt, Salmonella typhimurium LT2
uccagcuccagccgcugcc

SEQ ID NO: 1859370 - RNA, 15 nt, Salmonella typhimurium LT2
uccaggcgaaauaga

SEQ ID NO: 1859371 - RNA, 16 nt, Salmonella typhimurium LT2
uccaggcgaaauagac

SEQ ID NO: 1859372 - RNA, 13 nt, Salmonella typhimurium LT2
uccaggcgcugcu

SEQ ID NO: 1859373 - RNA, 19 nt, Salmonella typhimurium LT2
uccagggaaaccauguuga

SEQ ID NO: 1859374 - RNA, 24 nt, Salmonella typhimurium LT2
uccaggcucgauaaucaucacgcu

SEQ ID NO: 1859375 - RNA, 23 nt, Salmonella typhimurium LT2
uccaggccaagcgccuguucaac

SEQ ID NO: 1859376 - RNA, 19 nt, Salmonella typhimurium LT2
uccaggaggcaaaaugcca

SEQ ID NO: 1859377 - RNA, 23 nt, Salmonella typhimurium LT2
uccagcuugccgucgcaggcggc

SEQ ID NO: 1859378 - RNA, 19 nt, Salmonella typhimurium LT2
uccagcgccauaagacuac

SEQ ID NO: 1859379 - RNA, 16 nt, Salmonella typhimurium LT2
uccagcgccugcugca

SEQ ID NO: 1859380 - RNA, 22 nt, Salmonella typhimurium LT2
uccagcggccaguguacauagc

SEQ ID NO: 1859381 - RNA, 22 nt, Salmonella typhimurium LT2
uccagcgcguccuuauaaugcu

SEQ ID NO: 1859382 - RNA, 16 nt, Salmonella typhimurium LT2
uccagcggaacucauc

SEQ ID NO: 1859383 - RNA, 21 nt, Salmonella typhimurium LT2
uccagcggaacucaucaucaa

SEQ ID NO: 1859384 - RNA, 16 nt, Salmonella typhimurium LT2
uccagcgcguccuuau

SEQ ID NO: 1859385 - RNA, 19 nt, Salmonella typhimurium LT2
uccagcgaauccgugcgca

SEQ ID NO: 1859386 - RNA, 16 nt, Salmonella typhimurium LT2
uccagcgccagcucca

SEQ ID NO: 1859387 - RNA, 24 nt, Salmonella typhimurium LT2
uccagcgccaggauaucuuccacu

SEQ ID NO: 1859388 - RNA, 15 nt, Salmonella typhimurium LT2
uccagcaucagcaau

SEQ ID NO: 1859389 - RNA, 19 nt, Salmonella typhimurium LT2
uccagcaucauuuuuuaau

SEQ ID NO: 1859390 - RNA, 12 nt, Salmonella typhimurium LT2
uccagcaguguc

SEQ ID NO: 1859391 - RNA, 23 nt, Salmonella typhimurium LT2
uccagcccggcggauaaaucauc

SEQ ID NO: 1859392 - RNA, 18 nt, Salmonella typhimurium LT2
uccagccccuucgcuguc

SEQ ID NO: 1859393 - RNA, 14 nt, Salmonella typhimurium LT2
uccagccccuucgc

SEQ ID NO: 1859394 - RNA, 14 nt, Salmonella typhimurium LT2
uccagcaacagaag

SEQ ID NO: 1859395 - RNA, 16 nt, Salmonella typhimurium LT2
uccagcaaugauuuua

SEQ ID NO: 1859396 - RNA, 23 nt, Salmonella typhimurium LT2
uccagcaauucguugacgcuauc

SEQ ID NO: 1859397 - RNA, 22 nt, Salmonella typhimurium LT2
uccagaugacacuaucuccuuc

SEQ ID NO: 1859398 - RNA, 21 nt, Salmonella typhimurium LT2
uccagaugcgccagauucaug

SEQ ID NO: 1859399 - RNA, 20 nt, Salmonella typhimurium LT2
uccagcacggcauaagccuc

SEQ ID NO: 1859400 - RNA, 15 nt, Salmonella typhimurium LT2
uccagcacgcgcugc

SEQ ID NO: 1859401 - RNA, 22 nt, Salmonella typhimurium LT2
uccagcaccgcgaccaguucac

SEQ ID NO: 1859402 - RNA, 22 nt, Salmonella typhimurium LT2
uccagcacgauauccagcaccu

SEQ ID NO: 1859403 - RNA, 16 nt, Salmonella typhimurium LT2
uccagaaacaguuccg

SEQ ID NO: 1859404 - RNA, 12 nt, Salmonella typhimurium LT2
uccagacagcuu

SEQ ID NO: 1859405 - RNA, 18 nt, Salmonella typhimurium LT2
uccagacccagacaaccg

SEQ ID NO: 1859406 - RNA, 17 nt, Salmonella typhimurium LT2
uccagaauacgaauauu

SEQ ID NO: 1859407 - RNA, 18 nt, Salmonella typhimurium LT2
uccagauagggccaggcg

SEQ ID NO: 1859408 - RNA, 16 nt, Salmonella typhimurium LT2
uccagauagcgcugcg

SEQ ID NO: 1859409 - RNA, 12 nt, Salmonella typhimurium LT2
uccagaucuuca

SEQ ID NO: 1859410 - RNA, 14 nt, Salmonella typhimurium LT2
uccagaucuucaga

SEQ ID NO: 1859411 - RNA, 17 nt, Salmonella typhimurium LT2
uccagaggcauuauugc

SEQ ID NO: 1859412 - RNA, 18 nt, Salmonella typhimurium LT2
uccagaguacauucucuu

SEQ ID NO: 1859413 - RNA, 15 nt, Salmonella typhimurium LT2
uccagaguacauucu

SEQ ID NO: 1859414 - RNA, 19 nt, Salmonella typhimurium LT2
uccagagcgccguggaaaa

SEQ ID NO: 1859415 - RNA, 16 nt, Salmonella typhimurium LT2
uccacguuuuacuucc

SEQ ID NO: 1859416 - RNA, 15 nt, Salmonella typhimurium LT2
uccacgucuggguuu

SEQ ID NO: 1859417 - RNA, 18 nt, Salmonella typhimurium LT2
uccacugcaucucuucca

SEQ ID NO: 1859418 - RNA, 14 nt, Salmonella typhimurium LT2
uccacuucagcagc

SEQ ID NO: 1859419 - RNA, 22 nt, Salmonella typhimurium LT2
uccacuucagccagcugcuggc

SEQ ID NO: 1859420 - RNA, 13 nt, Salmonella typhimurium LT2
uccacuucaucag

SEQ ID NO: 1859421 - RNA, 23 nt, Salmonella typhimurium LT2
uccacuguccagaucuucccagu

SEQ ID NO: 1859422 - RNA, 19 nt, Salmonella typhimurium LT2
uccacugguaggcauccag

SEQ ID NO: 1859423 - RNA, 17 nt, Salmonella typhimurium LT2
uccacuuucagcggcuu

SEQ ID NO: 1859424 - RNA, 23 nt, Salmonella typhimurium LT2
uccacuuucucggcuuuccagcu

SEQ ID NO: 1859425 - RNA, 15 nt, Salmonella typhimurium LT2
uccacgccuggcagu

SEQ ID NO: 1859426 - RNA, 14 nt, Salmonella typhimurium LT2
uccacgcgcaccau

SEQ ID NO: 1859427 - RNA, 19 nt, Salmonella typhimurium LT2
uccaccuucucuuuaugcg

SEQ ID NO: 1859428 - RNA, 20 nt, Salmonella typhimurium LT2
uccaccuuaccuucauccug

SEQ ID NO: 1859429 - RNA, 17 nt, Salmonella typhimurium LT2
uccacgacagaacccgg

SEQ ID NO: 1859430 - RNA, 22 nt, Salmonella typhimurium LT2
uccacgccgaacgauugacccg

SEQ ID NO: 1859431 - RNA, 20 nt, Salmonella typhimurium LT2
uccacgcccugcuuuuucag

SEQ ID NO: 1859432 - RNA, 15 nt, Salmonella typhimurium LT2
uccaccagcggacgg

SEQ ID NO: 1859433 - RNA, 19 nt, Salmonella typhimurium LT2
uccaccagcccaucuuucg

SEQ ID NO: 1859434 - RNA, 18 nt, Salmonella typhimurium LT2
uccaccaggcaugcagcu

SEQ ID NO: 1859435 - RNA, 15 nt, Salmonella typhimurium LT2
uccaccauaguuucg

SEQ ID NO: 1859436 - RNA, 14 nt, Salmonella typhimurium LT2
uccacccaguucau

SEQ ID NO: 1859437 - RNA, 18 nt, Salmonella typhimurium LT2
uccaccccagcauuacca

SEQ ID NO: 1859438 - RNA, 14 nt, Salmonella typhimurium LT2
uccacccucccaga

SEQ ID NO: 1859439 - RNA, 18 nt, Salmonella typhimurium LT2
uccacccucgucagugaa

SEQ ID NO: 1859440 - RNA, 19 nt, Salmonella typhimurium LT2
uccaccgccagacgcccca

SEQ ID NO: 1859441 - RNA, 20 nt, Salmonella typhimurium LT2
uccacacguccauccgggua

SEQ ID NO: 1859442 - RNA, 17 nt, Salmonella typhimurium LT2
uccacacugacgcgcca

SEQ ID NO: 1859443 - RNA, 15 nt, Salmonella typhimurium LT2
uccacauaaaguagc

SEQ ID NO: 1859444 - RNA, 14 nt, Salmonella typhimurium LT2
uccacauuggcuuu

SEQ ID NO: 1859445 - RNA, 12 nt, Salmonella typhimurium LT2
uccaccaccucc

SEQ ID NO: 1859446 - RNA, 16 nt, Salmonella typhimurium LT2
uccaccacuugauucu

SEQ ID NO: 1859447 - RNA, 19 nt, Salmonella typhimurium LT2
uccaccaccuggugaaacu

SEQ ID NO: 1859448 - RNA, 17 nt, Salmonella typhimurium LT2
uccaaucucuuuugcgg

SEQ ID NO: 1859449 - RNA, 22 nt, Salmonella typhimurium LT2
uccacaaaaggauacagcgccg

SEQ ID NO: 1859450 - RNA, 12 nt, Salmonella typhimurium LT2
ucccccuggccc

SEQ ID NO: 1859451 - RNA, 14 nt, Salmonella typhimurium LT2
ucccccgcugaggc

SEQ ID NO: 1859452 - RNA, 17 nt, Salmonella typhimurium LT2
uccccccuuuuuugcug

SEQ ID NO: 1859453 - RNA, 22 nt, Salmonella typhimurium LT2
uccccccuuuuuugcuggcaag

SEQ ID NO: 1859454 - RNA, 14 nt, Salmonella typhimurium LT2
uccccgccgcggcg

SEQ ID NO: 1859455 - RNA, 13 nt, Salmonella typhimurium LT2
uccccauaucccg

SEQ ID NO: 1859456 - RNA, 15 nt, Salmonella typhimurium LT2
uccccaucccagacc

SEQ ID NO: 1859457 - RNA, 15 nt, Salmonella typhimurium LT2
ucccccaccaccauu

SEQ ID NO: 1859458 - RNA, 24 nt, Salmonella typhimurium LT2
ucccccagccgcagccaccccggc

SEQ ID NO: 1859459 - RNA, 16 nt, Salmonella typhimurium LT2
ucccccagauucugau

SEQ ID NO: 1859460 - RNA, 17 nt, Salmonella typhimurium LT2
ucccccagauucugaug

SEQ ID NO: 1859461 - RNA, 14 nt, Salmonella typhimurium LT2
ucccccagcacgcu

SEQ ID NO: 1859462 - RNA, 12 nt, Salmonella typhimurium LT2
ucccccacuucu

SEQ ID NO: 1859463 - RNA, 19 nt, Salmonella typhimurium LT2
uccccaggcgcuauuccca

SEQ ID NO: 1859464 - RNA, 14 nt, Salmonella typhimurium LT2
uccccaccacugau

SEQ ID NO: 1859465 - RNA, 18 nt, Salmonella typhimurium LT2
uccccaccacugauggcg

SEQ ID NO: 1859466 - RNA, 17 nt, Salmonella typhimurium LT2
uccccacuaccgccacu

SEQ ID NO: 1859467 - RNA, 22 nt, Salmonella typhimurium LT2
uccccacgccgaccaccagcuu

SEQ ID NO: 1859468 - RNA, 16 nt, Salmonella typhimurium LT2
ucccauacugcccagc

SEQ ID NO: 1859469 - RNA, 22 nt, Salmonella typhimurium LT2
ucccaucgcuuugcagaaaauc

SEQ ID NO: 1859470 - RNA, 18 nt, Salmonella typhimurium LT2
ucccauauuuuuucugcc

SEQ ID NO: 1859471 - RNA, 14 nt, Salmonella typhimurium LT2
ucccauccgggcca

SEQ ID NO: 1859472 - RNA, 19 nt, Salmonella typhimurium LT2
ucccaugacgacagguuua

SEQ ID NO: 1859473 - RNA, 20 nt, Salmonella typhimurium LT2
uccccacaggaucaccgcca

SEQ ID NO: 1859474 - RNA, 17 nt, Salmonella typhimurium LT2
ucccauugggccagcag

SEQ ID NO: 1859475 - RNA, 20 nt, Salmonella typhimurium LT2
ucccagucaucgucugcguc

SEQ ID NO: 1859476 - RNA, 14 nt, Salmonella typhimurium LT2
ucccaguggcgucg

SEQ ID NO: 1859477 - RNA, 19 nt, Salmonella typhimurium LT2
ucccaggccgccaccgccu

SEQ ID NO: 1859478 - RNA, 16 nt, Salmonella typhimurium LT2
ucccaggcgcgcagcu

SEQ ID NO: 1859479 - RNA, 14 nt, Salmonella typhimurium LT2
ucccagcugagcua

SEQ ID NO: 1859480 - RNA, 23 nt, Salmonella typhimurium LT2
ucccagccgggcaggaaaagcug

SEQ ID NO: 1859481 - RNA, 15 nt, Salmonella typhimurium LT2
ucccaggagauauca

SEQ ID NO: 1859482 - RNA, 19 nt, Salmonella typhimurium LT2
ucccaggagauaucaaaag

SEQ ID NO: 1859483 - RNA, 18 nt, Salmonella typhimurium LT2
ucccagcuaaaaagcugu

SEQ ID NO: 1859484 - RNA, 17 nt, Salmonella typhimurium LT2
ucccagauuaaaucauc

SEQ ID NO: 1859485 - RNA, 21 nt, Salmonella typhimurium LT2
ucccagaugaaaaaucggcaa

SEQ ID NO: 1859486 - RNA, 17 nt, Salmonella typhimurium LT2
uccaugccuuuggccug

SEQ ID NO: 1859487 - RNA, 22 nt, Salmonella typhimurium LT2
uccaugcgauacguaggccuga

SEQ ID NO: 1859488 - RNA, 17 nt, Salmonella typhimurium LT2
uccaucgguucucugcc

SEQ ID NO: 1859489 - RNA, 15 nt, Salmonella typhimurium LT2
uccaugagaagaaaa

SEQ ID NO: 1859490 - RNA, 16 nt, Salmonella typhimurium LT2
uccaugagaagaaaaa

SEQ ID NO: 1859491 - RNA, 17 nt, Salmonella typhimurium LT2
uccaugagaagaaaaag

SEQ ID NO: 1859492 - RNA, 19 nt, Salmonella typhimurium LT2
uccauguaaacuccauuaa

SEQ ID NO: 1859493 - RNA, 20 nt, Salmonella typhimurium LT2
uccauuaaauuacuuguuga

SEQ ID NO: 1859494 - RNA, 20 nt, Salmonella typhimurium LT2
uccauguuuccccuucuggu

SEQ ID NO: 1859495 - RNA, 15 nt, Salmonella typhimurium LT2
uccauucgucgagcu

SEQ ID NO: 1859496 - RNA, 22 nt, Salmonella typhimurium LT2
uccauugaaacggugccuacug

SEQ ID NO: 1859497 - RNA, 16 nt, Salmonella typhimurium LT2
uccauuccagaacgaa

SEQ ID NO: 1859498 - RNA, 14 nt, Salmonella typhimurium LT2
uccauucaucgauu

SEQ ID NO: 1859499 - RNA, 10 nt, Salmonella typhimurium LT2
uccauuuccu

SEQ ID NO: 1859500 - RNA, 20 nt, Salmonella typhimurium LT2
uccauuuuucgaucuucucc

SEQ ID NO: 1859501 - RNA, 12 nt, Salmonella typhimurium LT2
uccauuuuccua

SEQ ID NO: 1859502 - RNA, 18 nt, Salmonella typhimurium LT2
uccauuuuggggaaaaua

SEQ ID NO: 1859503 - RNA, 15 nt, Salmonella typhimurium LT2
ucccaacagcgagcu

SEQ ID NO: 1859504 - RNA, 16 nt, Salmonella typhimurium LT2
ucccaauaaucccaaa

SEQ ID NO: 1859505 - RNA, 13 nt, Salmonella typhimurium LT2
ucccaaugcuuuc

SEQ ID NO: 1859506 - RNA, 14 nt, Salmonella typhimurium LT2
ucccacaccacacg

SEQ ID NO: 1859507 - RNA, 20 nt, Salmonella typhimurium LT2
ucccacaacuguucuucgcu

SEQ ID NO: 1859508 - RNA, 19 nt, Salmonella typhimurium LT2
ucccacagcggaugguauu

SEQ ID NO: 1859509 - RNA, 21 nt, Salmonella typhimurium LT2
ucccacauccggcugaaaaau

SEQ ID NO: 1859510 - RNA, 15 nt, Salmonella typhimurium LT2
ucccacgcauagucc

SEQ ID NO: 1859511 - RNA, 12 nt, Salmonella typhimurium LT2
ucccaccaggag

SEQ ID NO: 1859512 - RNA, 21 nt, Salmonella typhimurium LT2
ucccaccauaaagcgaauaau

SEQ ID NO: 1859513 - RNA, 13 nt, Salmonella typhimurium LT2
ucccagacaaaau

SEQ ID NO: 1859514 - RNA, 22 nt, Salmonella typhimurium LT2
ucccacuuggcgaucaccagca

SEQ ID NO: 1859515 - RNA, 14 nt, Salmonella typhimurium LT2
ucccgauaaugacc

SEQ ID NO: 1859516 - RNA, 19 nt, Salmonella typhimurium LT2
ucccgaaaugguuccaggc

SEQ ID NO: 1859517 - RNA, 21 nt, Salmonella typhimurium LT2
ucccgacgaauaacaaaauga

SEQ ID NO: 1859518 - RNA, 13 nt, Salmonella typhimurium LT2
ucccgaucuucau

SEQ ID NO: 1859519 - RNA, 20 nt, Salmonella typhimurium LT2
ucccgcaaacuggccacagc

SEQ ID NO: 1859520 - RNA, 22 nt, Salmonella typhimurium LT2
ucccgcacgcuggcaucaauau

SEQ ID NO: 1859521 - RNA, 13 nt, Salmonella typhimurium LT2
ucccgccagcugc

SEQ ID NO: 1859522 - RNA, 16 nt, Salmonella typhimurium LT2
ucccgccacuguccug

SEQ ID NO: 1859523 - RNA, 19 nt, Salmonella typhimurium LT2
ucccgcauauuuuucuaau

SEQ ID NO: 1859524 - RNA, 11 nt, Salmonella typhimurium LT2
ucccgccgcca

SEQ ID NO: 1859525 - RNA, 12 nt, Salmonella typhimurium LT2
ucccgccgcgau

SEQ ID NO: 1859526 - RNA, 19 nt, Salmonella typhimurium LT2
ucccgccgagaaaauaccg

SEQ ID NO: 1859527 - RNA, 20 nt, Salmonella typhimurium LT2
ucccgccuaacccaccgaua

SEQ ID NO: 1859528 - RNA, 17 nt, Salmonella typhimurium LT2
ucccgccuugcggcgcc

SEQ ID NO: 1859529 - RNA, 18 nt, Salmonella typhimurium LT2
uccccuacggugugccug

SEQ ID NO: 1859530 - RNA, 16 nt, Salmonella typhimurium LT2
uccccgucucuuuauc

SEQ ID NO: 1859531 - RNA, 16 nt, Salmonella typhimurium LT2
uccccggccagcgcgc

SEQ ID NO: 1859532 - RNA, 18 nt, Salmonella typhimurium LT2
uccccuuuaggcggcgcc

SEQ ID NO: 1859533 - RNA, 18 nt, Salmonella typhimurium LT2
ucccgacacuuguaaguu

SEQ ID NO: 1859534 - RNA, 16 nt, Salmonella typhimurium LT2
uccccuuuuuucuguu

SEQ ID NO: 1859535 - RNA, 12 nt, Salmonella typhimurium LT2
uccccugcuccu

SEQ ID NO: 1859536 - RNA, 15 nt, Salmonella typhimurium LT2
uccccucuuccauca

SEQ ID NO: 1859537 - RNA, 16 nt, Salmonella typhimurium LT2
uccccucuuccaucag

SEQ ID NO: 1859538 - RNA, 21 nt, Salmonella typhimurium LT2
uccccucuuccaucagccagg

SEQ ID NO: 1859539 - RNA, 16 nt, Salmonella typhimurium LT2
uccccugcagaugcug

SEQ ID NO: 1859540 - RNA, 14 nt, Salmonella typhimurium LT2
uccccugcaggaau

SEQ ID NO: 1859541 - RNA, 13 nt, Salmonella typhimurium LT2
ucccgcgcggucg

SEQ ID NO: 1859542 - RNA, 21 nt, Salmonella typhimurium LT2
ucccgcguucgcgcaguucau

SEQ ID NO: 1859543 - RNA, 22 nt, Salmonella typhimurium LT2
ucccggcaccgaucaucccacc

SEQ ID NO: 1859544 - RNA, 22 nt, Salmonella typhimurium LT2
ucccggcuuaaauuuuuaauaa

SEQ ID NO: 1859545 - RNA, 18 nt, Salmonella typhimurium LT2
ucccggcguaauccagcu

SEQ ID NO: 1859546 - RNA, 15 nt, Salmonella typhimurium LT2
ucccggggauuucau

SEQ ID NO: 1859547 - RNA, 15 nt, Salmonella typhimurium LT2
ucccguaaaagaaga

SEQ ID NO: 1859548 - RNA, 14 nt, Salmonella typhimurium LT2
ucccgucccaccac

SEQ ID NO: 1859549 - RNA, 18 nt, Salmonella typhimurium LT2
ucccguagccugauaaau

SEQ ID NO: 1859550 - RNA, 20 nt, Salmonella typhimurium LT2
ucccguagcgucaacacgag

SEQ ID NO: 1859551 - RNA, 16 nt, Salmonella typhimurium LT2
ucccguaucuucaugu

SEQ ID NO: 1859552 - RNA, 23 nt, Salmonella typhimurium LT2
ucccuacugcuuagcucaucagc

SEQ ID NO: 1859553 - RNA, 19 nt, Salmonella typhimurium LT2
ucccuacucucgcaugggg

SEQ ID NO: 1859554 - RNA, 17 nt, Salmonella typhimurium LT2
ucccguuuuucauccag

SEQ ID NO: 1859555 - RNA, 17 nt, Salmonella typhimurium LT2
ucccuaagccggcaggc

SEQ ID NO: 1859556 - RNA, 13 nt, Salmonella typhimurium LT2
ucccguuucagug

SEQ ID NO: 1859557 - RNA, 17 nt, Salmonella typhimurium LT2
ucccucauauuuguauc

SEQ ID NO: 1859558 - RNA, 12 nt, Salmonella typhimurium LT2
ucccucaucaau

SEQ ID NO: 1859559 - RNA, 23 nt, Salmonella typhimurium LT2
ucccuauguaaagaaugaaaaaa

SEQ ID NO: 1859560 - RNA, 14 nt, Salmonella typhimurium LT2
ucccucgaaugcug

SEQ ID NO: 1859561 - RNA, 14 nt, Salmonella typhimurium LT2
ucccucguguacca

SEQ ID NO: 1859562 - RNA, 16 nt, Salmonella typhimurium LT2
ucccucuccagggcaa

SEQ ID NO: 1859563 - RNA, 13 nt, Salmonella typhimurium LT2
ucccugacgcgca

SEQ ID NO: 1859564 - RNA, 10 nt, Salmonella typhimurium LT2
ucccuggccg

SEQ ID NO: 1859565 - RNA, 16 nt, Salmonella typhimurium LT2
ucccugggccucgccc

SEQ ID NO: 1859566 - RNA, 21 nt, Salmonella typhimurium LT2
ucccuuccgccaccagguuca

SEQ ID NO: 1859567 - RNA, 18 nt, Salmonella typhimurium LT2
ucccuuccgccaccaggu

SEQ ID NO: 1859568 - RNA, 20 nt, Salmonella typhimurium LT2
ucccuuccgccaccagguuc

SEQ ID NO: 1859569 - RNA, 18 nt, Salmonella typhimurium LT2
ucccuucgaucaugccuu

SEQ ID NO: 1859570 - RNA, 19 nt, Salmonella typhimurium LT2
ucccuucgaucaugccuuu

SEQ ID NO: 1859571 - RNA, 17 nt, Salmonella typhimurium LT2
ucccuuccgccaccagg

SEQ ID NO: 1859572 - RNA, 13 nt, Salmonella typhimurium LT2
ucccuucccagcc

SEQ ID NO: 1859573 - RNA, 18 nt, Salmonella typhimurium LT2
ucccuuugacaaccugcc

SEQ ID NO: 1859574 - RNA, 21 nt, Salmonella typhimurium LT2
ucccuuugccccauagucaga

SEQ ID NO: 1859575 - RNA, 22 nt, Salmonella typhimurium LT2
ucccuuugguggaguuuucaua

SEQ ID NO: 1859576 - RNA, 14 nt, Salmonella typhimurium LT2
ucccuucuuuuacu

SEQ ID NO: 1859577 - RNA, 12 nt, Salmonella typhimurium LT2
ucccuucccagc

SEQ ID NO: 1859578 - RNA, 14 nt, Salmonella typhimurium LT2
ucccuugccagcgc

SEQ ID NO: 1859579 - RNA, 16 nt, Salmonella typhimurium LT2
ucccuuuacaggugca

SEQ ID NO: 1859580 - RNA, 15 nt, Salmonella typhimurium LT2
uccgacaauaaaaau

SEQ ID NO: 1859581 - RNA, 22 nt, Salmonella typhimurium LT2
uccgacagugaacggcauaauc

SEQ ID NO: 1859582 - RNA, 20 nt, Salmonella typhimurium LT2
uccgacgcguuucacaucgc

SEQ ID NO: 1859583 - RNA, 18 nt, Salmonella typhimurium LT2
uccgagacucaaagaaaa

SEQ ID NO: 1859584 - RNA, 12 nt, Salmonella typhimurium LT2
uccgacuucaug

SEQ ID NO: 1859585 - RNA, 18 nt, Salmonella typhimurium LT2
uccgauuucguucuuucu

SEQ ID NO: 1859586 - RNA, 12 nt, Salmonella typhimurium LT2
uccgcaaagugg

SEQ ID NO: 1859587 - RNA, 16 nt, Salmonella typhimurium LT2
ucgcggugaucccagg

SEQ ID NO: 1859588 - RNA, 14 nt, Salmonella typhimurium LT2
ucgcuaauaaauuc

SEQ ID NO: 1859589 - RNA, 21 nt, Salmonella typhimurium LT2
ucgcguuuuucugcccauuuc

SEQ ID NO: 1859590 - RNA, 14 nt, Salmonella typhimurium LT2
ucgcuauuccagag

SEQ ID NO: 1859591 - RNA, 14 nt, Salmonella typhimurium LT2
ucgcuauccagcag

SEQ ID NO: 1859592 - RNA, 13 nt, Salmonella typhimurium LT2
ucgcuauccagca

SEQ ID NO: 1859593 - RNA, 23 nt, Salmonella typhimurium LT2
ucgcuacaggcaaucggccaggu

SEQ ID NO: 1859594 - RNA, 19 nt, Salmonella typhimurium LT2
ucgcuaccuuuuuucagua

SEQ ID NO: 1859595 - RNA, 16 nt, Salmonella typhimurium LT2
ucgcucgcgccacgca

SEQ ID NO: 1859596 - RNA, 17 nt, Salmonella typhimurium LT2
ucgcucccucaucaaua

SEQ ID NO: 1859597 - RNA, 21 nt, Salmonella typhimurium LT2
ucgcucaauagcgauucauca

SEQ ID NO: 1859598 - RNA, 17 nt, Salmonella typhimurium LT2
ucgcucagguuguccag

SEQ ID NO: 1859599 - RNA, 16 nt, Salmonella typhimurium LT2
ucgcucaucucaagcc

SEQ ID NO: 1859600 - RNA, 13 nt, Salmonella typhimurium LT2
ucgcugauaaaaa

SEQ ID NO: 1859601 - RNA, 15 nt, Salmonella typhimurium LT2
ucgcugaaaaugacu

SEQ ID NO: 1859602 - RNA, 22 nt, Salmonella typhimurium LT2
ucgcucuccgccgcgggcagca

SEQ ID NO: 1859603 - RNA, 15 nt, Salmonella typhimurium LT2
ucgcugacgccagcc

SEQ ID NO: 1859604 - RNA, 20 nt, Salmonella typhimurium LT2
ucgcugacgccagccagccg

SEQ ID NO: 1859605 - RNA, 19 nt, Salmonella typhimurium LT2
ucgcuugcccagcauauua

SEQ ID NO: 1859606 - RNA, 14 nt, Salmonella typhimurium LT2
ucgcuuccagcgcc

SEQ ID NO: 1859607 - RNA, 18 nt, Salmonella typhimurium LT2
ucgcugcccagaugguua

SEQ ID NO: 1859608 - RNA, 14 nt, Salmonella typhimurium LT2
ucgcugccuugagu

SEQ ID NO: 1859609 - RNA, 18 nt, Salmonella typhimurium LT2
ucggaacgcgacucccag

SEQ ID NO: 1859610 - RNA, 20 nt, Salmonella typhimurium LT2
ucggaacucacuugucuucu

SEQ ID NO: 1859611 - RNA, 19 nt, Salmonella typhimurium LT2
ucggaaacuauccuggccu

SEQ ID NO: 1859612 - RNA, 20 nt, Salmonella typhimurium LT2
ucggaauaauguaaaaaaau

SEQ ID NO: 1859613 - RNA, 19 nt, Salmonella typhimurium LT2
ucggaagacuggcgcagca

SEQ ID NO: 1859614 - RNA, 19 nt, Salmonella typhimurium LT2
ucggcaccauucccacgca

SEQ ID NO: 1859615 - RNA, 19 nt, Salmonella typhimurium LT2
ucggcacagccaguaagaa

SEQ ID NO: 1859616 - RNA, 14 nt, Salmonella typhimurium LT2
ucggacuaauacuu

SEQ ID NO: 1859617 - RNA, 23 nt, Salmonella typhimurium LT2
ucggaccagaaccucacggagaa

SEQ ID NO: 1859618 - RNA, 19 nt, Salmonella typhimurium LT2
ucggcaagaauuucaauca

SEQ ID NO: 1859619 - RNA, 23 nt, Salmonella typhimurium LT2
ucgccgguagcuucagcggcgcg

SEQ ID NO: 1859620 - RNA, 17 nt, Salmonella typhimurium LT2
ucgccgggauaaaacac

SEQ ID NO: 1859621 - RNA, 20 nt, Salmonella typhimurium LT2
ucgccauaaagcuguaccug

SEQ ID NO: 1859622 - RNA, 16 nt, Salmonella typhimurium LT2
ucgccauaaagcugua

SEQ ID NO: 1859623 - RNA, 22 nt, Salmonella typhimurium LT2
ucgccgccgccagguuauccag

SEQ ID NO: 1859624 - RNA, 22 nt, Salmonella typhimurium LT2
ucgccgccgccgcgacugcuuc

SEQ ID NO: 1859625 - RNA, 16 nt, Salmonella typhimurium LT2
ucgccauacaucgcgu

SEQ ID NO: 1859626 - RNA, 18 nt, Salmonella typhimurium LT2
ucgccgcccaaccagccc

SEQ ID NO: 1859627 - RNA, 19 nt, Salmonella typhimurium LT2
ucgcgauacugccgcccau

SEQ ID NO: 1859628 - RNA, 18 nt, Salmonella typhimurium LT2
ucgcgaccggaucaauaa

SEQ ID NO: 1859629 - RNA, 17 nt, Salmonella typhimurium LT2
ucgcgaccaccaggaua

SEQ ID NO: 1859630 - RNA, 21 nt, Salmonella typhimurium LT2
ucgcgaauagugauaccagcc

SEQ ID NO: 1859631 - RNA, 16 nt, Salmonella typhimurium LT2
ucgccuauuuucucuu

SEQ ID NO: 1859632 - RNA, 19 nt, Salmonella typhimurium LT2
ucgccuaagcguucaucag

SEQ ID NO: 1859633 - RNA, 14 nt, Salmonella typhimurium LT2
ucgccugacaggag

SEQ ID NO: 1859634 - RNA, 16 nt, Salmonella typhimurium LT2
ucgccugacugaagac

SEQ ID NO: 1859635 - RNA, 18 nt, Salmonella typhimurium LT2
ucgccugacugaagacga

SEQ ID NO: 1859636 - RNA, 22 nt, Salmonella typhimurium LT2
ucgccugauauaaucgaaucgc

SEQ ID NO: 1859637 - RNA, 18 nt, Salmonella typhimurium LT2
ucgcgauccugaaaugcc

SEQ ID NO: 1859638 - RNA, 19 nt, Salmonella typhimurium LT2
ucgcgccaaaagaggcagc

SEQ ID NO: 1859639 - RNA, 23 nt, Salmonella typhimurium LT2
ucgcgccagcauggucuccagca

SEQ ID NO: 1859640 - RNA, 18 nt, Salmonella typhimurium LT2
ucgcgccaaaagaggcag

SEQ ID NO: 1859641 - RNA, 14 nt, Salmonella typhimurium LT2
ucgcgcuauaucag

SEQ ID NO: 1859642 - RNA, 17 nt, Salmonella typhimurium LT2
ucgcgcucuuccgccag

SEQ ID NO: 1859643 - RNA, 16 nt, Salmonella typhimurium LT2
ucgcgcguccacggcg

SEQ ID NO: 1859644 - RNA, 20 nt, Salmonella typhimurium LT2
ucgcgcggcgguucauccug

SEQ ID NO: 1859645 - RNA, 19 nt, Salmonella typhimurium LT2
ucgcggauaugcagcagcc

SEQ ID NO: 1859646 - RNA, 17 nt, Salmonella typhimurium LT2
ucgcggaauuucaggaa

SEQ ID NO: 1859647 - RNA, 19 nt, Salmonella typhimurium LT2
ucgcgcuguauaaucccgc

SEQ ID NO: 1859648 - RNA, 17 nt, Salmonella typhimurium LT2
ucgcggcugguacggcg

SEQ ID NO: 1859649 - RNA, 16 nt, Salmonella typhimurium LT2
ucgcggcgauuaauac

SEQ ID NO: 1859650 - RNA, 17 nt, Salmonella typhimurium LT2
ucgagcgaaagaacguu

SEQ ID NO: 1859651 - RNA, 13 nt, Salmonella typhimurium LT2
ucgagauuuuucu

SEQ ID NO: 1859652 - RNA, 20 nt, Salmonella typhimurium LT2
ucgagauaauccagccacag

SEQ ID NO: 1859653 - RNA, 17 nt, Salmonella typhimurium LT2
ucgaccuggugcucaau

SEQ ID NO: 1859654 - RNA, 17 nt, Salmonella typhimurium LT2
ucgaccuucaucucuuu

SEQ ID NO: 1859655 - RNA, 17 nt, Salmonella typhimurium LT2
ucgacguuuuccaucac

SEQ ID NO: 1859656 - RNA, 14 nt, Salmonella typhimurium LT2
ucgacguuuuucag

SEQ ID NO: 1859657 - RNA, 23 nt, Salmonella typhimurium LT2
ucgacuaaaggcagcgcgcuguc

SEQ ID NO: 1859658 - RNA, 16 nt, Salmonella typhimurium LT2
ucgacuggucgcagcc

SEQ ID NO: 1859659 - RNA, 18 nt, Salmonella typhimurium LT2
ucgacccccaccauguca

SEQ ID NO: 1859660 - RNA, 15 nt, Salmonella typhimurium LT2
ucgacaugggcggga

SEQ ID NO: 1859661 - RNA, 17 nt, Salmonella typhimurium LT2
ucgaccagcagcgggcu

SEQ ID NO: 1859662 - RNA, 19 nt, Salmonella typhimurium LT2
ucgaccagacgaauaaucu

SEQ ID NO: 1859663 - RNA, 13 nt, Salmonella typhimurium LT2
ucgaccagcaccu

SEQ ID NO: 1859664 - RNA, 15 nt, Salmonella typhimurium LT2
ucgacaggaguauag

SEQ ID NO: 1859665 - RNA, 18 nt, Salmonella typhimurium LT2
ucgacaguaccagcagaa

SEQ ID NO: 1859666 - RNA, 16 nt, Salmonella typhimurium LT2
ucgacaaacaccgagc

SEQ ID NO: 1859667 - RNA, 17 nt, Salmonella typhimurium LT2
ucgacaaacaccgagcc

SEQ ID NO: 1859668 - RNA, 21 nt, Salmonella typhimurium LT2
ucgacaaacaccgagccagaa

SEQ ID NO: 1859669 - RNA, 19 nt, Salmonella typhimurium LT2
ucgacaucuuggcgcugcc

SEQ ID NO: 1859670 - RNA, 16 nt, Salmonella typhimurium LT2
uccuguucguucaaau

SEQ ID NO: 1859671 - RNA, 20 nt, Salmonella typhimurium LT2
uccuguuuaagcccggccuu

SEQ ID NO: 1859672 - RNA, 15 nt, Salmonella typhimurium LT2
ucgaagaccuggccg

SEQ ID NO: 1859673 - RNA, 20 nt, Salmonella typhimurium LT2
ucgaagaauuccaccuuacc

SEQ ID NO: 1859674 - RNA, 19 nt, Salmonella typhimurium LT2
uccuguuuuuucagcgcgc

SEQ ID NO: 1859675 - RNA, 20 nt, Salmonella typhimurium LT2
ucgcauggggagaccccaca

SEQ ID NO: 1859676 - RNA, 21 nt, Salmonella typhimurium LT2
ucgcaggccaaacagcggcuc

SEQ ID NO: 1859677 - RNA, 16 nt, Salmonella typhimurium LT2
ucgcaggcggccaggc

SEQ ID NO: 1859678 - RNA, 12 nt, Salmonella typhimurium LT2
ucgcagcggcug

SEQ ID NO: 1859679 - RNA, 16 nt, Salmonella typhimurium LT2
ucgcagcccagcacau

SEQ ID NO: 1859680 - RNA, 14 nt, Salmonella typhimurium LT2
ucgcagaucgccug

SEQ ID NO: 1859681 - RNA, 17 nt, Salmonella typhimurium LT2
ucgcaaacggaauaaac

SEQ ID NO: 1859682 - RNA, 21 nt, Salmonella typhimurium LT2
ucgcaaagaaaucaacgaauu

SEQ ID NO: 1859683 - RNA, 19 nt, Salmonella typhimurium LT2
ucgccacgccaauaguuaa

SEQ ID NO: 1859684 - RNA, 15 nt, Salmonella typhimurium LT2
ucgccaccaggaacg

SEQ ID NO: 1859685 - RNA, 18 nt, Salmonella typhimurium LT2
ucgccaccgcauuuucag

SEQ ID NO: 1859686 - RNA, 13 nt, Salmonella typhimurium LT2
ucgccaccgcauu

SEQ ID NO: 1859687 - RNA, 19 nt, Salmonella typhimurium LT2
ucgccacaugcggcaggcu

SEQ ID NO: 1859688 - RNA, 16 nt, Salmonella typhimurium LT2
ucgccaaaccagaccc

SEQ ID NO: 1859689 - RNA, 18 nt, Salmonella typhimurium LT2
ucgccagcaacgcccaga

SEQ ID NO: 1859690 - RNA, 16 nt, Salmonella typhimurium LT2
ucgccagccccagccc

SEQ ID NO: 1859691 - RNA, 15 nt, Salmonella typhimurium LT2
ucgccagccccagcc

SEQ ID NO: 1859692 - RNA, 18 nt, Salmonella typhimurium LT2
ucgccagcccgaucaucu

SEQ ID NO: 1859693 - RNA, 19 nt, Salmonella typhimurium LT2
ucgccagccugaacaucuu

SEQ ID NO: 1859694 - RNA, 20 nt, Salmonella typhimurium LT2
ucgccaggaucgccgcugcg

SEQ ID NO: 1859695 - RNA, 15 nt, Salmonella typhimurium LT2
ucgccagcguuagca

SEQ ID NO: 1859696 - RNA, 23 nt, Salmonella typhimurium LT2
ucgauaaucgguagcacuuuaaa

SEQ ID NO: 1859697 - RNA, 16 nt, Salmonella typhimurium LT2
ucgauaauaaaauauu

SEQ ID NO: 1859698 - RNA, 22 nt, Salmonella typhimurium LT2
ucgauacucacgacuuucacca

SEQ ID NO: 1859699 - RNA, 17 nt, Salmonella typhimurium LT2
ucgauacuauaacgcuu

SEQ ID NO: 1859700 - RNA, 15 nt, Salmonella typhimurium LT2
ucgauuacagcaugu

SEQ ID NO: 1859701 - RNA, 16 nt, Salmonella typhimurium LT2
ucgauggccucaucau

SEQ ID NO: 1859702 - RNA, 13 nt, Salmonella typhimurium LT2
ucgauggccucau

SEQ ID NO: 1859703 - RNA, 17 nt, Salmonella typhimurium LT2
ucgaugauuuucaaacc

SEQ ID NO: 1859704 - RNA, 17 nt, Salmonella typhimurium LT2
uccugccagagacucuc

SEQ ID NO: 1859705 - RNA, 16 nt, Salmonella typhimurium LT2
uccugccgacaggcag

SEQ ID NO: 1859706 - RNA, 13 nt, Salmonella typhimurium LT2
uccugccgccgca

SEQ ID NO: 1859707 - RNA, 22 nt, Salmonella typhimurium LT2
uccugccgacaggcagguugcc

SEQ ID NO: 1859708 - RNA, 20 nt, Salmonella typhimurium LT2
uccugcccgccacccuccgg

SEQ ID NO: 1859709 - RNA, 16 nt, Salmonella typhimurium LT2
uccugcaacagaagag

SEQ ID NO: 1859710 - RNA, 14 nt, Salmonella typhimurium LT2
uccugcaaaaggaa

SEQ ID NO: 1859711 - RNA, 17 nt, Salmonella typhimurium LT2
uccugcaacagcaccag

SEQ ID NO: 1859712 - RNA, 19 nt, Salmonella typhimurium LT2
uccugcaacagcaccagca

SEQ ID NO: 1859713 - RNA, 20 nt, Salmonella typhimurium LT2
uccugauuaaguuuuuuuaa

SEQ ID NO: 1859714 - RNA, 21 nt, Salmonella typhimurium LT2
uccugauagccguaaauaauc

SEQ ID NO: 1859715 - RNA, 22 nt, Salmonella typhimurium LT2
uccugauauucccguuccagcu

SEQ ID NO: 1859716 - RNA, 13 nt, Salmonella typhimurium LT2
uccugauccggcu

SEQ ID NO: 1859717 - RNA, 16 nt, Salmonella typhimurium LT2
uccugauccggcuguu

SEQ ID NO: 1859718 - RNA, 13 nt, Salmonella typhimurium LT2
uccugagucacag

SEQ ID NO: 1859719 - RNA, 12 nt, Salmonella typhimurium LT2
uccugauaaccu

SEQ ID NO: 1859720 - RNA, 19 nt, Salmonella typhimurium LT2
uccugagcagacauauuuu

SEQ ID NO: 1859721 - RNA, 14 nt, Salmonella typhimurium LT2
uccugugucggcag

SEQ ID NO: 1859722 - RNA, 17 nt, Salmonella typhimurium LT2
uccugugucuuuuacac

SEQ ID NO: 1859723 - RNA, 12 nt, Salmonella typhimurium LT2
uccuguuccuga

SEQ ID NO: 1859724 - RNA, 17 nt, Salmonella typhimurium LT2
uccuguucauccacaga

SEQ ID NO: 1859725 - RNA, 18 nt, Salmonella typhimurium LT2
uccugguccggcagguag

SEQ ID NO: 1859726 - RNA, 22 nt, Salmonella typhimurium LT2
uccugggcaaaauagcccggcu

SEQ ID NO: 1859727 - RNA, 20 nt, Salmonella typhimurium LT2
uccuggcguaugcuuucagc

SEQ ID NO: 1859728 - RNA, 22 nt, Salmonella typhimurium LT2
uccuggcugucggcagaaccug

SEQ ID NO: 1859729 - RNA, 17 nt, Salmonella typhimurium LT2
uccugcgccagcaccau

SEQ ID NO: 1859730 - RNA, 23 nt, Salmonella typhimurium LT2
uccugcgccagcaccauggcuau

SEQ ID NO: 1859731 - RNA, 19 nt, Salmonella typhimurium LT2
uccucuuccgacaaaccuu

SEQ ID NO: 1859732 - RNA, 13 nt, Salmonella typhimurium LT2
uccucugaaaaau

SEQ ID NO: 1859733 - RNA, 14 nt, Salmonella typhimurium LT2
uccugaaccagcgg

SEQ ID NO: 1859734 - RNA, 21 nt, Salmonella typhimurium LT2
uccugaaccagcggcaccagc

SEQ ID NO: 1859735 - RNA, 16 nt, Salmonella typhimurium LT2
uccugaauugucccca

SEQ ID NO: 1859736 - RNA, 16 nt, Salmonella typhimurium LT2
uccugaauagcaggca

SEQ ID NO: 1859737 - RNA, 22 nt, Salmonella typhimurium LT2
uccugaauagcaggcaaaaaag

SEQ ID NO: 1859738 - RNA, 23 nt, Salmonella typhimurium LT2
uccugaccuuguagcacaaucug

SEQ ID NO: 1859739 - RNA, 18 nt, Salmonella typhimurium LT2
uccucucuuccuccugau

SEQ ID NO: 1859740 - RNA, 16 nt, Salmonella typhimurium LT2
uccucggacgaaaaau

SEQ ID NO: 1859741 - RNA, 21 nt, Salmonella typhimurium LT2
uccucaacagcgcggcaggcc

SEQ ID NO: 1859742 - RNA, 18 nt, Salmonella typhimurium LT2
uccucaaccugaggaaga

SEQ ID NO: 1859743 - RNA, 12 nt, Salmonella typhimurium LT2
uccucacgcccu

SEQ ID NO: 1859744 - RNA, 22 nt, Salmonella typhimurium LT2
uccucaccguagcuccagaccu

SEQ ID NO: 1859745 - RNA, 20 nt, Salmonella typhimurium LT2
uccucaauauuaucuucguc

SEQ ID NO: 1859746 - RNA, 13 nt, Salmonella typhimurium LT2
uccuaggacgaaa

SEQ ID NO: 1859747 - RNA, 20 nt, Salmonella typhimurium LT2
uccuaggacgaaaaaugaau

SEQ ID NO: 1859748 - RNA, 13 nt, Salmonella typhimurium LT2
uccucauacagcc

SEQ ID NO: 1859749 - RNA, 21 nt, Salmonella typhimurium LT2
uccucauuuuguugcuccagc

SEQ ID NO: 1859750 - RNA, 13 nt, Salmonella typhimurium LT2
uccuccagcggca

SEQ ID NO: 1859751 - RNA, 16 nt, Salmonella typhimurium LT2
uccuccagcgugcaga

SEQ ID NO: 1859752 - RNA, 13 nt, Salmonella typhimurium LT2
uccucauuauugc

SEQ ID NO: 1859753 - RNA, 15 nt, Salmonella typhimurium LT2
uccuccaucagcgcu

SEQ ID NO: 1859754 - RNA, 13 nt, Salmonella typhimurium LT2
uccuccaucaguu

SEQ ID NO: 1859755 - RNA, 17 nt, Salmonella typhimurium LT2
uccuacaccaccagccc

SEQ ID NO: 1859756 - RNA, 18 nt, Salmonella typhimurium LT2
uccguucaucggcauaca

SEQ ID NO: 1859757 - RNA, 16 nt, Salmonella typhimurium LT2
uccguucccaaugcuu

SEQ ID NO: 1859758 - RNA, 19 nt, Salmonella typhimurium LT2
uccguuaccccuuuuucaa

SEQ ID NO: 1859759 - RNA, 18 nt, Salmonella typhimurium LT2
uccguggcgauaaugacg

SEQ ID NO: 1859760 - RNA, 13 nt, Salmonella typhimurium LT2
uccguuuucaggu

SEQ ID NO: 1859761 - RNA, 13 nt, Salmonella typhimurium LT2
uccgugaccugcu

SEQ ID NO: 1859762 - RNA, 16 nt, Salmonella typhimurium LT2
uccgucuccggacguu

SEQ ID NO: 1859763 - RNA, 11 nt, Salmonella typhimurium LT2
uccgucucaga

SEQ ID NO: 1859764 - RNA, 15 nt, Salmonella typhimurium LT2
uccgucguguagccu

SEQ ID NO: 1859765 - RNA, 13 nt, Salmonella typhimurium LT2
uccguccucuuuc

SEQ ID NO: 1859766 - RNA, 12 nt, Salmonella typhimurium LT2
uccggcaggcaa

SEQ ID NO: 1859767 - RNA, 15 nt, Salmonella typhimurium LT2
uccggcagucgggcg

SEQ ID NO: 1859768 - RNA, 14 nt, Salmonella typhimurium LT2
uccggccaacagau

SEQ ID NO: 1859769 - RNA, 14 nt, Salmonella typhimurium LT2
uccggccagacagg

SEQ ID NO: 1859770 - RNA, 17 nt, Salmonella typhimurium LT2
uccggccagacaggcuu

SEQ ID NO: 1859771 - RNA, 19 nt, Salmonella typhimurium LT2
uccggcaacugccggggaa

SEQ ID NO: 1859772 - RNA, 19 nt, Salmonella typhimurium LT2
uccggcaagggucuuaacc

SEQ ID NO: 1859773 - RNA, 15 nt, Salmonella typhimurium LT2
uccggaucaucuuuu

SEQ ID NO: 1859774 - RNA, 18 nt, Salmonella typhimurium LT2
uccggacguacccaggcg

SEQ ID NO: 1859775 - RNA, 18 nt, Salmonella typhimurium LT2
uccggauggcguuccagc

SEQ ID NO: 1859776 - RNA, 19 nt, Salmonella typhimurium LT2
uccggaucgccgaagcggc

SEQ ID NO: 1859777 - RNA, 23 nt, Salmonella typhimurium LT2
uccggaugcgacuccaggaacag

SEQ ID NO: 1859778 - RNA, 19 nt, Salmonella typhimurium LT2
uccggcgggagcucuacca

SEQ ID NO: 1859779 - RNA, 15 nt, Salmonella typhimurium LT2
uccggcugaagcccc

SEQ ID NO: 1859780 - RNA, 15 nt, Salmonella typhimurium LT2
uccggcucguccagg

SEQ ID NO: 1859781 - RNA, 21 nt, Salmonella typhimurium LT2
uccggcgaauagucgccgcgg

SEQ ID NO: 1859782 - RNA, 16 nt, Salmonella typhimurium LT2
uccggccugcaggcaa

SEQ ID NO: 1859783 - RNA, 17 nt, Salmonella typhimurium LT2
uccggccugcaggcaac

SEQ ID NO: 1859784 - RNA, 21 nt, Salmonella typhimurium LT2
uccggccuauagcuaauggcu

SEQ ID NO: 1859785 - RNA, 22 nt, Salmonella typhimurium LT2
uccggccucuuuuuagcagcaa

SEQ ID NO: 1859786 - RNA, 20 nt, Salmonella typhimurium LT2
uccggccuacgcgucaauua

SEQ ID NO: 1859787 - RNA, 19 nt, Salmonella typhimurium LT2
uccggccuacaagccgccu

SEQ ID NO: 1859788 - RNA, 16 nt, Salmonella typhimurium LT2
uccgggauagcacuac

SEQ ID NO: 1859789 - RNA, 19 nt, Salmonella typhimurium LT2
uccggguauucaucggcac

SEQ ID NO: 1859790 - RNA, 15 nt, Salmonella typhimurium LT2
uccggggccagcgcc

SEQ ID NO: 1859791 - RNA, 17 nt, Salmonella typhimurium LT2
uccguauugagcagcgg

SEQ ID NO: 1859792 - RNA, 13 nt, Salmonella typhimurium LT2
uccguaucgugcu

SEQ ID NO: 1859793 - RNA, 19 nt, Salmonella typhimurium LT2
uccguaucguugaccguga

SEQ ID NO: 1859794 - RNA, 14 nt, Salmonella typhimurium LT2
uccgguuccagcgg

SEQ ID NO: 1859795 - RNA, 15 nt, Salmonella typhimurium LT2
uccggugcguuucau

SEQ ID NO: 1859796 - RNA, 22 nt, Salmonella typhimurium LT2
uccgguagguuuaaaccacucc

SEQ ID NO: 1859797 - RNA, 18 nt, Salmonella typhimurium LT2
uccggugaagguaauuuu

SEQ ID NO: 1859798 - RNA, 16 nt, Salmonella typhimurium LT2
uccggucauccagcgg

SEQ ID NO: 1859799 - RNA, 15 nt, Salmonella typhimurium LT2
uccgccacgcucgcu

SEQ ID NO: 1859800 - RNA, 13 nt, Salmonella typhimurium LT2
uccgccaccagcg

SEQ ID NO: 1859801 - RNA, 20 nt, Salmonella typhimurium LT2
uccgcagccagaaucagccg

SEQ ID NO: 1859802 - RNA, 12 nt, Salmonella typhimurium LT2
uccgcagagcug

SEQ ID NO: 1859803 - RNA, 22 nt, Salmonella typhimurium LT2
uccgcaucguucaacucgcuaa

SEQ ID NO: 1859804 - RNA, 21 nt, Salmonella typhimurium LT2
uccgcacgccugcauaaagga

SEQ ID NO: 1859805 - RNA, 17 nt, Salmonella typhimurium LT2
uccgcaccuucaucauu

SEQ ID NO: 1859806 - RNA, 16 nt, Salmonella typhimurium LT2
uccgcacgcgcgcccu

SEQ ID NO: 1859807 - RNA, 14 nt, Salmonella typhimurium LT2
uccgcacgcgcgcc

SEQ ID NO: 1859808 - RNA, 15 nt, Salmonella typhimurium LT2
uccgcaaucgcugcc

SEQ ID NO: 1859809 - RNA, 19 nt, Salmonella typhimurium LT2
uccgcaaucgcugccuuga

SEQ ID NO: 1859810 - RNA, 16 nt, Salmonella typhimurium LT2
uccgcaauuaauuuau

SEQ ID NO: 1859811 - RNA, 19 nt, Salmonella typhimurium LT2
uccgcccgccucaaaccag

SEQ ID NO: 1859812 - RNA, 14 nt, Salmonella typhimurium LT2
uccgccgcgggcag

SEQ ID NO: 1859813 - RNA, 23 nt, Salmonella typhimurium LT2
uccgccgggauaauauugccauu

SEQ ID NO: 1859814 - RNA, 16 nt, Salmonella typhimurium LT2
uccgccaugaaaaaaa

SEQ ID NO: 1859815 - RNA, 15 nt, Salmonella typhimurium LT2
uccgccaugguuggg

SEQ ID NO: 1859816 - RNA, 15 nt, Salmonella typhimurium LT2
uccgccauccggcac

SEQ ID NO: 1859817 - RNA, 18 nt, Salmonella typhimurium LT2
uccgcccaggaacaugac

SEQ ID NO: 1859818 - RNA, 14 nt, Salmonella typhimurium LT2
uccgccauaucccc

SEQ ID NO: 1859819 - RNA, 20 nt, Salmonella typhimurium LT2
uccgccauaaacgguuucag

SEQ ID NO: 1859820 - RNA, 20 nt, Salmonella typhimurium LT2
uccgccauaacggcugucca

SEQ ID NO: 1859821 - RNA, 17 nt, Salmonella typhimurium LT2
uccgccauagccuaccc

SEQ ID NO: 1859822 - RNA, 13 nt, Salmonella typhimurium LT2
uccgccagcgccu

SEQ ID NO: 1859823 - RNA, 13 nt, Salmonella typhimurium LT2
uccgccagagcuu

SEQ ID NO: 1859824 - RNA, 18 nt, Salmonella typhimurium LT2
uccgccagcaaugccgcc

SEQ ID NO: 1859825 - RNA, 16 nt, Salmonella typhimurium LT2
uccgccagcaacacuu

SEQ ID NO: 1859826 - RNA, 17 nt, Salmonella typhimurium LT2
uccgccuggaacccagg

SEQ ID NO: 1859827 - RNA, 22 nt, Salmonella typhimurium LT2
uccgccuggaacccaggcaccu

SEQ ID NO: 1859828 - RNA, 17 nt, Salmonella typhimurium LT2
uccgccugaucuuucug

SEQ ID NO: 1859829 - RNA, 21 nt, Salmonella typhimurium LT2
uccgccugaucuuucugguaa

SEQ ID NO: 1859830 - RNA, 13 nt, Salmonella typhimurium LT2
uccgcgaugugua

SEQ ID NO: 1859831 - RNA, 23 nt, Salmonella typhimurium LT2
uccgcgagagaaaaaaauccagu

SEQ ID NO: 1859832 - RNA, 15 nt, Salmonella typhimurium LT2
uccgcgcauccugca

SEQ ID NO: 1859833 - RNA, 20 nt, Salmonella typhimurium LT2
uccgcgcugaugguuucggc

SEQ ID NO: 1859834 - RNA, 22 nt, Salmonella typhimurium LT2
uccgcguaaugguguccacaag

SEQ ID NO: 1859835 - RNA, 20 nt, Salmonella typhimurium LT2
uccgcuaccugcgagcugua

SEQ ID NO: 1859836 - RNA, 23 nt, Salmonella typhimurium LT2
uccgcuaccgcuuugacaacaaa

SEQ ID NO: 1859837 - RNA, 23 nt, Salmonella typhimurium LT2
uccgcguuagcaaguccgggcug

SEQ ID NO: 1859838 - RNA, 20 nt, Salmonella typhimurium LT2
uccgcuauuaccaguaauga

SEQ ID NO: 1859839 - RNA, 12 nt, Salmonella typhimurium LT2
ucucaucaaaaa

SEQ ID NO: 1859840 - RNA, 20 nt, Salmonella typhimurium LT2
ucucagcggagugcugagac

SEQ ID NO: 1859841 - RNA, 23 nt, Salmonella typhimurium LT2
ucucaggguguuuuuauacaucc

SEQ ID NO: 1859842 - RNA, 15 nt, Salmonella typhimurium LT2
ucuccaccgccuggc

SEQ ID NO: 1859843 - RNA, 22 nt, Salmonella typhimurium LT2
ucuccccauuugaacucuucca

SEQ ID NO: 1859844 - RNA, 17 nt, Salmonella typhimurium LT2
ucuccggucaucaccag

SEQ ID NO: 1859845 - RNA, 22 nt, Salmonella typhimurium LT2
ucuccaugccaucggccagcag

SEQ ID NO: 1859846 - RNA, 12 nt, Salmonella typhimurium LT2
ucucccagcuga

SEQ ID NO: 1859847 - RNA, 22 nt, Salmonella typhimurium LT2
ucuccucacgcccugaagggcg

SEQ ID NO: 1859848 - RNA, 18 nt, Salmonella typhimurium LT2
ucuccuacaccaccagcc

SEQ ID NO: 1859849 - RNA, 21 nt, Salmonella typhimurium LT2
ucuccuguaaugaggcaaauc

SEQ ID NO: 1859850 - RNA, 15 nt, Salmonella typhimurium LT2
ucuccguuguugcac

SEQ ID NO: 1859851 - RNA, 13 nt, Salmonella typhimurium LT2
ucucaccgcccag

SEQ ID NO: 1859852 - RNA, 18 nt, Salmonella typhimurium LT2
ucucaccgcccaggccag

SEQ ID NO: 1859853 - RNA, 23 nt, Salmonella typhimurium LT2
ucucaaugccacgccguagcugc

SEQ ID NO: 1859854 - RNA, 17 nt, Salmonella typhimurium LT2
ucucacagaaucaucag

SEQ ID NO: 1859855 - RNA, 15 nt, Salmonella typhimurium LT2
ucuauuucauaauaa

SEQ ID NO: 1859856 - RNA, 18 nt, Salmonella typhimurium LT2
ucucaacauaauaaagcc

SEQ ID NO: 1859857 - RNA, 21 nt, Salmonella typhimurium LT2
ucucaaacuauuuuuagcccu

SEQ ID NO: 1859858 - RNA, 18 nt, Salmonella typhimurium LT2
ucuauucguucucugaau

SEQ ID NO: 1859859 - RNA, 17 nt, Salmonella typhimurium LT2
ucuauucuugugcuuac

SEQ ID NO: 1859860 - RNA, 16 nt, Salmonella typhimurium LT2
ucuauguucaguaaga

SEQ ID NO: 1859861 - RNA, 15 nt, Salmonella typhimurium LT2
ucuauuaaaauaaau

SEQ ID NO: 1859862 - RNA, 19 nt, Salmonella typhimurium LT2
ucuaucuguuuuaauuccu

SEQ ID NO: 1859863 - RNA, 22 nt, Salmonella typhimurium LT2
ucuaucacuucaauguuagcau

SEQ ID NO: 1859864 - RNA, 13 nt, Salmonella typhimurium LT2
ucuaucaccgccu

SEQ ID NO: 1859865 - RNA, 21 nt, Salmonella typhimurium LT2
ucuauccacuggguaaggcgc

SEQ ID NO: 1859866 - RNA, 15 nt, Salmonella typhimurium LT2
ucuauccaauaauaa

SEQ ID NO: 1859867 - RNA, 19 nt, Salmonella typhimurium LT2
ucuauccggaggccuucuu

SEQ ID NO: 1859868 - RNA, 18 nt, Salmonella typhimurium LT2
ucuauagcggucaaaaua

SEQ ID NO: 1859869 - RNA, 13 nt, Salmonella typhimurium LT2
ucuauauauucuu

SEQ ID NO: 1859870 - RNA, 22 nt, Salmonella typhimurium LT2
ucuacuuuucggguguccacuc

SEQ ID NO: 1859871 - RNA, 19 nt, Salmonella typhimurium LT2
ucuaccgcuucgcgcgcca

SEQ ID NO: 1859872 - RNA, 14 nt, Salmonella typhimurium LT2
ucuacgguaucugc

SEQ ID NO: 1859873 - RNA, 12 nt, Salmonella typhimurium LT2
ucuacacuuugc

SEQ ID NO: 1859874 - RNA, 18 nt, Salmonella typhimurium LT2
ucuacacuuugcgccgcc

SEQ ID NO: 1859875 - RNA, 17 nt, Salmonella typhimurium LT2
ucuacaaguucagcagg

SEQ ID NO: 1859876 - RNA, 19 nt, Salmonella typhimurium LT2
ucuaccauugauaccaaua

SEQ ID NO: 1859877 - RNA, 19 nt, Salmonella typhimurium LT2
ucuacccaggucgccgaug

SEQ ID NO: 1859878 - RNA, 21 nt, Salmonella typhimurium LT2
ucuaacgcaacggaaggaaau

SEQ ID NO: 1859879 - RNA, 23 nt, Salmonella typhimurium LT2
ucuaauucccaguaaccuauuuu

SEQ ID NO: 1859880 - RNA, 21 nt, Salmonella typhimurium LT2
ucuaauuaaaaagagaaaaaa

SEQ ID NO: 1859881 - RNA, 15 nt, Salmonella typhimurium LT2
ucuaacauaaugaau

SEQ ID NO: 1859882 - RNA, 20 nt, Salmonella typhimurium LT2
ucuaaauuucgcguuuuucu

SEQ ID NO: 1859883 - RNA, 12 nt, Salmonella typhimurium LT2
ucguugcgccug

SEQ ID NO: 1859884 - RNA, 13 nt, Salmonella typhimurium LT2
ucguuucuacaau

SEQ ID NO: 1859885 - RNA, 15 nt, Salmonella typhimurium LT2
ucguuugcaguuccg

SEQ ID NO: 1859886 - RNA, 16 nt, Salmonella typhimurium LT2
ucguguuaccagcaac

SEQ ID NO: 1859887 - RNA, 16 nt, Salmonella typhimurium LT2
ucguguuguccggcca

SEQ ID NO: 1859888 - RNA, 16 nt, Salmonella typhimurium LT2
ucggcaugccacuggg

SEQ ID NO: 1859889 - RNA, 17 nt, Salmonella typhimurium LT2
ucggcaggaacagauac

SEQ ID NO: 1859890 - RNA, 20 nt, Salmonella typhimurium LT2
ucggcaggacuuaaaaacaa

SEQ ID NO: 1859891 - RNA, 16 nt, Salmonella typhimurium LT2
ucggcagucacuuuca

SEQ ID NO: 1859892 - RNA, 23 nt, Salmonella typhimurium LT2
ucggcauacaccgccagcgucug

SEQ ID NO: 1859893 - RNA, 12 nt, Salmonella typhimurium LT2
ucgguugaacca

SEQ ID NO: 1859894 - RNA, 11 nt, Salmonella typhimurium LT2
ucgguucugcg

SEQ ID NO: 1859895 - RNA, 16 nt, Salmonella typhimurium LT2
ucgguuuauccccgcu

SEQ ID NO: 1859896 - RNA, 21 nt, Salmonella typhimurium LT2
ucgguuuauccccgcuggcgc

SEQ ID NO: 1859897 - RNA, 18 nt, Salmonella typhimurium LT2
ucguagccaccaucuuuu

SEQ ID NO: 1859898 - RNA, 21 nt, Salmonella typhimurium LT2
ucgucaaacaguucagacacc

SEQ ID NO: 1859899 - RNA, 13 nt, Salmonella typhimurium LT2
ucgucacagaccc

SEQ ID NO: 1859900 - RNA, 12 nt, Salmonella typhimurium LT2
ucgucaccagca

SEQ ID NO: 1859901 - RNA, 18 nt, Salmonella typhimurium LT2
ucgucacgcgcaaagcug

SEQ ID NO: 1859902 - RNA, 16 nt, Salmonella typhimurium LT2
ucgucacgguuuaucc

SEQ ID NO: 1859903 - RNA, 21 nt, Salmonella typhimurium LT2
ucgucacgguuuauccccgcu

SEQ ID NO: 1859904 - RNA, 23 nt, Salmonella typhimurium LT2
ucgucauagugagcgacuucaaa

SEQ ID NO: 1859905 - RNA, 22 nt, Salmonella typhimurium LT2
ucgucagccgugagcagaucgu

SEQ ID NO: 1859906 - RNA, 17 nt, Salmonella typhimurium LT2
ucgugcaguaaugccuc

SEQ ID NO: 1859907 - RNA, 19 nt, Salmonella typhimurium LT2
ucgugccagugaugcgcgg

SEQ ID NO: 1859908 - RNA, 21 nt, Salmonella typhimurium LT2
ucgugccagacucuugcucuu

SEQ ID NO: 1859909 - RNA, 14 nt, Salmonella typhimurium LT2
ucgugcgccccagg

SEQ ID NO: 1859910 - RNA, 14 nt, Salmonella typhimurium LT2
ucguggccacacuu

SEQ ID NO: 1859911 - RNA, 15 nt, Salmonella typhimurium LT2
ucguguaaaugacgc

SEQ ID NO: 1859912 - RNA, 15 nt, Salmonella typhimurium LT2
ucgucauuaaugccu

SEQ ID NO: 1859913 - RNA, 18 nt, Salmonella typhimurium LT2
ucgucaugcucgcuuucc

SEQ ID NO: 1859914 - RNA, 12 nt, Salmonella typhimurium LT2
ucguccugcaau

SEQ ID NO: 1859915 - RNA, 13 nt, Salmonella typhimurium LT2
ucgucgaagcuuu

SEQ ID NO: 1859916 - RNA, 23 nt, Salmonella typhimurium LT2
ucgucuuguguggagguuucuuc

SEQ ID NO: 1859917 - RNA, 14 nt, Salmonella typhimurium LT2
ucgucuucaucuuc

SEQ ID NO: 1859918 - RNA, 20 nt, Salmonella typhimurium LT2
ucgucugguaucugucaugc

SEQ ID NO: 1859919 - RNA, 16 nt, Salmonella typhimurium LT2
ucgucugacgcuugca

SEQ ID NO: 1859920 - RNA, 16 nt, Salmonella typhimurium LT2
ucgucugcgucuucuu

SEQ ID NO: 1859921 - RNA, 19 nt, Salmonella typhimurium LT2
ucgucugcgucuucuucca

SEQ ID NO: 1859922 - RNA, 19 nt, Salmonella typhimurium LT2
ucuuccguuuuacacggcg

SEQ ID NO: 1859923 - RNA, 16 nt, Salmonella typhimurium LT2
ucuuccgguuucaacu

SEQ ID NO: 1859924 - RNA, 12 nt, Salmonella typhimurium LT2
ucuuccggcgug

SEQ ID NO: 1859925 - RNA, 16 nt, Salmonella typhimurium LT2
ucuuccggcugccagc

SEQ ID NO: 1859926 - RNA, 18 nt, Salmonella typhimurium LT2
ucuuccgccugauaaaac

SEQ ID NO: 1859927 - RNA, 21 nt, Salmonella typhimurium LT2
ucuuccgacagggcccuucgu

SEQ ID NO: 1859928 - RNA, 19 nt, Salmonella typhimurium LT2
ucuucauggucggacggac

SEQ ID NO: 1859929 - RNA, 19 nt, Salmonella typhimurium LT2
ucuuaauuccucagaaucc

SEQ ID NO: 1859930 - RNA, 12 nt, Salmonella typhimurium LT2
ucuuacauaaga

SEQ ID NO: 1859931 - RNA, 20 nt, Salmonella typhimurium LT2
ucuucaguuccgccagacuc

SEQ ID NO: 1859932 - RNA, 14 nt, Salmonella typhimurium LT2
ucuucaguaaccag

SEQ ID NO: 1859933 - RNA, 16 nt, Salmonella typhimurium LT2
ucuucaguaauuucga

SEQ ID NO: 1859934 - RNA, 21 nt, Salmonella typhimurium LT2
ucuucgauaaagggaugggca

SEQ ID NO: 1859935 - RNA, 14 nt, Salmonella typhimurium LT2
ucuucgaucgccug

SEQ ID NO: 1859936 - RNA, 17 nt, Salmonella typhimurium LT2
ucuucgaucgccuggcg

SEQ ID NO: 1859937 - RNA, 16 nt, Salmonella typhimurium LT2
ucuucgaugagaugcg

SEQ ID NO: 1859938 - RNA, 14 nt, Salmonella typhimurium LT2
ucuucgacacauuu

SEQ ID NO: 1859939 - RNA, 22 nt, Salmonella typhimurium LT2
ucuucgcuggcggaaagaagca

SEQ ID NO: 1859940 - RNA, 22 nt, Salmonella typhimurium LT2
ucuucgcgguaacgcaacucau

SEQ ID NO: 1859941 - RNA, 17 nt, Salmonella typhimurium LT2
ucuucgcgguagauucu

SEQ ID NO: 1859942 - RNA, 23 nt, Salmonella typhimurium LT2
ucuucguaggcaacaauuucuac

SEQ ID NO: 1859943 - RNA, 16 nt, Salmonella typhimurium LT2
ucuucuaccaccuuau

SEQ ID NO: 1859944 - RNA, 13 nt, Salmonella typhimurium LT2
ucuucuaccaccu

SEQ ID NO: 1859945 - RNA, 15 nt, Salmonella typhimurium LT2
ucuugccacuggccu

SEQ ID NO: 1859946 - RNA, 13 nt, Salmonella typhimurium LT2
ucuugccacuggc

SEQ ID NO: 1859947 - RNA, 14 nt, Salmonella typhimurium LT2
ucuugcgccagcgc

SEQ ID NO: 1859948 - RNA, 15 nt, Salmonella typhimurium LT2
ucuugucaggcaaaa

SEQ ID NO: 1859949 - RNA, 21 nt, Salmonella typhimurium LT2
ucuugucaggcaaaaauaacu

SEQ ID NO: 1859950 - RNA, 14 nt, Salmonella typhimurium LT2
ucuuguaggcccga

SEQ ID NO: 1859951 - RNA, 13 nt, Salmonella typhimurium LT2
ucuuuaacaccuu

SEQ ID NO: 1859952 - RNA, 14 nt, Salmonella typhimurium LT2
ucuuuaacaccuuu

SEQ ID NO: 1859953 - RNA, 14 nt, Salmonella typhimurium LT2
ucuuuaaauuucag

SEQ ID NO: 1859954 - RNA, 21 nt, Salmonella typhimurium LT2
ucuuuagcgcuaauuccuguc

SEQ ID NO: 1859955 - RNA, 16 nt, Salmonella typhimurium LT2
ucuuuacgcagcaaga

SEQ ID NO: 1859956 - RNA, 22 nt, Salmonella typhimurium LT2
ucuuuacgcagcaagaacagag

SEQ ID NO: 1859957 - RNA, 15 nt, Salmonella typhimurium LT2
ucuugauaucaucau

SEQ ID NO: 1859958 - RNA, 15 nt, Salmonella typhimurium LT2
ucuucuuuuccugau

SEQ ID NO: 1859959 - RNA, 15 nt, Salmonella typhimurium LT2
ucuucuuucgguucg

SEQ ID NO: 1859960 - RNA, 19 nt, Salmonella typhimurium LT2
ucuucuucgcguuuuucga

SEQ ID NO: 1859961 - RNA, 19 nt, Salmonella typhimurium LT2
ucuucuucgcucucgccac

SEQ ID NO: 1859962 - RNA, 15 nt, Salmonella typhimurium LT2
ucuucucuucuucaa

SEQ ID NO: 1859963 - RNA, 17 nt, Salmonella typhimurium LT2
ucuucugccuuuuuuaa

SEQ ID NO: 1859964 - RNA, 11 nt, Salmonella typhimurium LT2
ucugacaucag

SEQ ID NO: 1859965 - RNA, 13 nt, Salmonella typhimurium LT2
ucugacccgcgaa

SEQ ID NO: 1859966 - RNA, 19 nt, Salmonella typhimurium LT2
ucugaugccugaaggcgcu

SEQ ID NO: 1859967 - RNA, 14 nt, Salmonella typhimurium LT2
ucugaugccugaag

SEQ ID NO: 1859968 - RNA, 20 nt, Salmonella typhimurium LT2
ucugaguauacagacagcag

SEQ ID NO: 1859969 - RNA, 24 nt, Salmonella typhimurium LT2
ucugauaacgcaggcgauagcccc

SEQ ID NO: 1859970 - RNA, 12 nt, Salmonella typhimurium LT2
ucugauaagucc

SEQ ID NO: 1859971 - RNA, 14 nt, Salmonella typhimurium LT2
ucucgccaaaucau

SEQ ID NO: 1859972 - RNA, 21 nt, Salmonella typhimurium LT2
ucugaacaaucgccugacuga

SEQ ID NO: 1859973 - RNA, 22 nt, Salmonella typhimurium LT2
ucugaacaaucgccugacugaa

SEQ ID NO: 1859974 - RNA, 14 nt, Salmonella typhimurium LT2
ucucgcucgcccgc

SEQ ID NO: 1859975 - RNA, 20 nt, Salmonella typhimurium LT2
ucucgcguggacgcuuuuau

SEQ ID NO: 1859976 - RNA, 16 nt, Salmonella typhimurium LT2
ucugccugcagaccca

SEQ ID NO: 1859977 - RNA, 20 nt, Salmonella typhimurium LT2
ucugccuuuuuuaauccagg

SEQ ID NO: 1859978 - RNA, 14 nt, Salmonella typhimurium LT2
ucugccugcagacc

SEQ ID NO: 1859979 - RNA, 22 nt, Salmonella typhimurium LT2
ucugccccaaccguuuugcaau

SEQ ID NO: 1859980 - RNA, 17 nt, Salmonella typhimurium LT2
ucugcauguaguaagcc

SEQ ID NO: 1859981 - RNA, 20 nt, Salmonella typhimurium LT2
ucugcaugccgcaggccgga

SEQ ID NO: 1859982 - RNA, 17 nt, Salmonella typhimurium LT2
ucugccaguagcugcuc

SEQ ID NO: 1859983 - RNA, 16 nt, Salmonella typhimurium LT2
ucugccagcagcggcg

SEQ ID NO: 1859984 - RNA, 22 nt, Salmonella typhimurium LT2
ucugccacaauuugcagauuua

SEQ ID NO: 1859985 - RNA, 21 nt, Salmonella typhimurium LT2
ucugcaggcgggugcgcagcc

SEQ ID NO: 1859986 - RNA, 21 nt, Salmonella typhimurium LT2
ucuguuucaguucggagauca

SEQ ID NO: 1859987 - RNA, 22 nt, Salmonella typhimurium LT2
ucuguuucaguucggagaucag

SEQ ID NO: 1859988 - RNA, 23 nt, Salmonella typhimurium LT2
ucuguggccgcgcauguuugccu

SEQ ID NO: 1859989 - RNA, 19 nt, Salmonella typhimurium LT2
ucuguuucaacacauccag

SEQ ID NO: 1859990 - RNA, 17 nt, Salmonella typhimurium LT2
ucuguauaaauaaaauu

SEQ ID NO: 1859991 - RNA, 20 nt, Salmonella typhimurium LT2
ucuggucagcgaugacgccu

SEQ ID NO: 1859992 - RNA, 15 nt, Salmonella typhimurium LT2
ucugguaucgagugg

SEQ ID NO: 1859993 - RNA, 19 nt, Salmonella typhimurium LT2
ucuggugaugauuacucuu

SEQ ID NO: 1859994 - RNA, 20 nt, Salmonella typhimurium LT2
ucugguacggccaccaggcc

SEQ ID NO: 1859995 - RNA, 16 nt, Salmonella typhimurium LT2
ucugguacauacuguu

SEQ ID NO: 1859996 - RNA, 17 nt, Salmonella typhimurium LT2
ucuggccaauuuuucac

SEQ ID NO: 1859997 - RNA, 15 nt, Salmonella typhimurium LT2
ucuggccaguuucaa

SEQ ID NO: 1859998 - RNA, 21 nt, Salmonella typhimurium LT2
ucuggccgcgaugguuacucc

SEQ ID NO: 1859999 - RNA, 14 nt, Salmonella typhimurium LT2
ucuggcgaggcgcc

SEQ ID NO: 1860000 - RNA, 17 nt, Salmonella typhimurium LT2
ucuggauagucuucaag

SEQ ID NO: 1860001 - RNA, 22 nt, Salmonella typhimurium LT2
ucuggaugcguucaaagaucuc

SEQ ID NO: 1860002 - RNA, 16 nt, Salmonella typhimurium LT2
ucuggauugcagagaa

SEQ ID NO: 1860003 - RNA, 21 nt, Salmonella typhimurium LT2
ucugcugugccgggaaaagga

SEQ ID NO: 1860004 - RNA, 13 nt, Salmonella typhimurium LT2
ucugcgccaccag

SEQ ID NO: 1860005 - RNA, 20 nt, Salmonella typhimurium LT2
ugggaucgacucauccagca

SEQ ID NO: 1860006 - RNA, 18 nt, Salmonella typhimurium LT2
uggcuuuuaagguuaauu

SEQ ID NO: 1860007 - RNA, 15 nt, Salmonella typhimurium LT2
uggcggaauugguag

SEQ ID NO: 1860008 - RNA, 18 nt, Salmonella typhimurium LT2
uggcggagaucuccagau

SEQ ID NO: 1860009 - RNA, 14 nt, Salmonella typhimurium LT2
uggcggagccaaaa

SEQ ID NO: 1860010 - RNA, 18 nt, Salmonella typhimurium LT2
uggcuuucuaccugcaau

SEQ ID NO: 1860011 - RNA, 22 nt, Salmonella typhimurium LT2
ugggcaggagaugaccugccca

SEQ ID NO: 1860012 - RNA, 12 nt, Salmonella typhimurium LT2
ugggcagaaacg

SEQ ID NO: 1860013 - RNA, 23 nt, Salmonella typhimurium LT2
uggguauagagcaaucuggcagu

SEQ ID NO: 1860014 - RNA, 19 nt, Salmonella typhimurium LT2
ugggucacgauaaccaggu

SEQ ID NO: 1860015 - RNA, 13 nt, Salmonella typhimurium LT2
ugggucagugguc

SEQ ID NO: 1860016 - RNA, 18 nt, Salmonella typhimurium LT2
uggucuccgccuggaacc

SEQ ID NO: 1860017 - RNA, 18 nt, Salmonella typhimurium LT2
uggucuaucgcuucuccc

SEQ ID NO: 1860018 - RNA, 21 nt, Salmonella typhimurium LT2
uggucgucagccgugagcaga

SEQ ID NO: 1860019 - RNA, 17 nt, Salmonella typhimurium LT2
ugguccggcagguagua

SEQ ID NO: 1860020 - RNA, 14 nt, Salmonella typhimurium LT2
uggucgguauuauc

SEQ ID NO: 1860021 - RNA, 19 nt, Salmonella typhimurium LT2
uggucgcagcccagcacau

SEQ ID NO: 1860022 - RNA, 15 nt, Salmonella typhimurium LT2
uggugugcauggugu

SEQ ID NO: 1860023 - RNA, 15 nt, Salmonella typhimurium LT2
ugguguugguacaca

SEQ ID NO: 1860024 - RNA, 20 nt, Salmonella typhimurium LT2
ugguguucagauggccgaug

SEQ ID NO: 1860025 - RNA, 16 nt, Salmonella typhimurium LT2
ugguguccccugcagg

SEQ ID NO: 1860026 - RNA, 16 nt, Salmonella typhimurium LT2
ugguggauauccagca

SEQ ID NO: 1860027 - RNA, 19 nt, Salmonella typhimurium LT2
uggugagguugagauccug

SEQ ID NO: 1860028 - RNA, 17 nt, Salmonella typhimurium LT2
uggugauccagcguagc

SEQ ID NO: 1860029 - RNA, 16 nt, Salmonella typhimurium LT2
ugguauaggccaggcu

SEQ ID NO: 1860030 - RNA, 15 nt, Salmonella typhimurium LT2
ugguacuuuucaucc

SEQ ID NO: 1860031 - RNA, 16 nt, Salmonella typhimurium LT2
ugguacguccauccgc

SEQ ID NO: 1860032 - RNA, 14 nt, Salmonella typhimurium LT2
ugguacguccaucc

SEQ ID NO: 1860033 - RNA, 15 nt, Salmonella typhimurium LT2
uggucaggcuaaaug

SEQ ID NO: 1860034 - RNA, 12 nt, Salmonella typhimurium LT2
uggucagcgcaa

SEQ ID NO: 1860035 - RNA, 12 nt, Salmonella typhimurium LT2
uggucagcgcgc

SEQ ID NO: 1860036 - RNA, 15 nt, Salmonella typhimurium LT2
ugguaucgcggcagc

SEQ ID NO: 1860037 - RNA, 16 nt, Salmonella typhimurium LT2
uggguugccauauuuu

SEQ ID NO: 1860038 - RNA, 23 nt, Salmonella typhimurium LT2
ugguaaaauuauugugagaaaag

SEQ ID NO: 1860039 - RNA, 14 nt, Salmonella typhimurium LT2
ugguaaaaaaguga

SEQ ID NO: 1860040 - RNA, 15 nt, Salmonella typhimurium LT2
ugguaaaacgcuggc

SEQ ID NO: 1860041 - RNA, 13 nt, Salmonella typhimurium LT2
uguauuaaaggau

SEQ ID NO: 1860042 - RNA, 19 nt, Salmonella typhimurium LT2
uguauuaucccggccgcgc

SEQ ID NO: 1860043 - RNA, 14 nt, Salmonella typhimurium LT2
uguaucauuuugau

SEQ ID NO: 1860044 - RNA, 16 nt, Salmonella typhimurium LT2
uguaucacguuuuuua

SEQ ID NO: 1860045 - RNA, 12 nt, Salmonella typhimurium LT2
uguauaauuauu

SEQ ID NO: 1860046 - RNA, 23 nt, Salmonella typhimurium LT2
uguagcaaccucggcuugcuuca

SEQ ID NO: 1860047 - RNA, 14 nt, Salmonella typhimurium LT2
uguagaugaacucg

SEQ ID NO: 1860048 - RNA, 15 nt, Salmonella typhimurium LT2
uguagauacugauau

SEQ ID NO: 1860049 - RNA, 18 nt, Salmonella typhimurium LT2
uguagcggcaacagcacc

SEQ ID NO: 1860050 - RNA, 21 nt, Salmonella typhimurium LT2
uguagcgcuuuuuccagcgca

SEQ ID NO: 1860051 - RNA, 13 nt, Salmonella typhimurium LT2
uguagcaguggag

SEQ ID NO: 1860052 - RNA, 21 nt, Salmonella typhimurium LT2
uguaggccugauaagcguagc

SEQ ID NO: 1860053 - RNA, 15 nt, Salmonella typhimurium LT2
uguauaaauaaaauu

SEQ ID NO: 1860054 - RNA, 20 nt, Salmonella typhimurium LT2
uguaguuuuucggcaguggc

SEQ ID NO: 1860055 - RNA, 12 nt, Salmonella typhimurium LT2
uguaguuuuuug

SEQ ID NO: 1860056 - RNA, 15 nt, Salmonella typhimurium LT2
uguaaagaaugaaaa

SEQ ID NO: 1860057 - RNA, 21 nt, Salmonella typhimurium LT2
uguaaaacgguaugaaacaua

SEQ ID NO: 1860058 - RNA, 15 nt, Salmonella typhimurium LT2
ugguuauauuacuga

SEQ ID NO: 1860059 - RNA, 17 nt, Salmonella typhimurium LT2
ugguuauccagcaggua

SEQ ID NO: 1860060 - RNA, 15 nt, Salmonella typhimurium LT2
ugguucaaaaugccc

SEQ ID NO: 1860061 - RNA, 23 nt, Salmonella typhimurium LT2
ugguucaaaaugcccgcauugcg

SEQ ID NO: 1860062 - RNA, 12 nt, Salmonella typhimurium LT2
uguaaaaaugcu

SEQ ID NO: 1860063 - RNA, 13 nt, Salmonella typhimurium LT2
uguaaaaaugccu

SEQ ID NO: 1860064 - RNA, 14 nt, Salmonella typhimurium LT2
ugguuauccagcag

SEQ ID NO: 1860065 - RNA, 22 nt, Salmonella typhimurium LT2
uguaaagucggccauuuuuuua

SEQ ID NO: 1860066 - RNA, 22 nt, Salmonella typhimurium LT2
uguaaaggccucgcacccugcg

SEQ ID NO: 1860067 - RNA, 17 nt, Salmonella typhimurium LT2
uguaaauauugaguuca

SEQ ID NO: 1860068 - RNA, 16 nt, Salmonella typhimurium LT2
uguaaccaaagcacca

SEQ ID NO: 1860069 - RNA, 21 nt, Salmonella typhimurium LT2
uguaccaccacgccuuucacg

SEQ ID NO: 1860070 - RNA, 15 nt, Salmonella typhimurium LT2
uguaccaacugcugc

SEQ ID NO: 1860071 - RNA, 15 nt, Salmonella typhimurium LT2
uguacuccugguagg

SEQ ID NO: 1860072 - RNA, 19 nt, Salmonella typhimurium LT2
uguacucugauccuacccg

SEQ ID NO: 1860073 - RNA, 19 nt, Salmonella typhimurium LT2
uguaccugauccagcucuu

SEQ ID NO: 1860074 - RNA, 13 nt, Salmonella typhimurium LT2
uguacgcccagcc

SEQ ID NO: 1860075 - RNA, 16 nt, Salmonella typhimurium LT2
uguacgcuggcucuug

SEQ ID NO: 1860076 - RNA, 17 nt, Salmonella typhimurium LT2
uguacggcguuucgagu

SEQ ID NO: 1860077 - RNA, 13 nt, Salmonella typhimurium LT2
uguacgacuggau

SEQ ID NO: 1860078 - RNA, 20 nt, Salmonella typhimurium LT2
uguaccugauccagcucuuc

SEQ ID NO: 1860079 - RNA, 18 nt, Salmonella typhimurium LT2
uggcccuucagacgcauc

SEQ ID NO: 1860080 - RNA, 22 nt, Salmonella typhimurium LT2
uggccgauaugaauaauuucgg

SEQ ID NO: 1860081 - RNA, 14 nt, Salmonella typhimurium LT2
uggccgccagagag

SEQ ID NO: 1860082 - RNA, 17 nt, Salmonella typhimurium LT2
uggcccagcuaaaccac

SEQ ID NO: 1860083 - RNA, 20 nt, Salmonella typhimurium LT2
uggccaugccuaaaccgaca

SEQ ID NO: 1860084 - RNA, 16 nt, Salmonella typhimurium LT2
uggcccgcacugccga

SEQ ID NO: 1860085 - RNA, 13 nt, Salmonella typhimurium LT2
uggccccauucac

SEQ ID NO: 1860086 - RNA, 21 nt, Salmonella typhimurium LT2
uggcccgcuuuuuuuauucag

SEQ ID NO: 1860087 - RNA, 13 nt, Salmonella typhimurium LT2
uggccaaauaacc

SEQ ID NO: 1860088 - RNA, 14 nt, Salmonella typhimurium LT2
uggccaaucagcgg

SEQ ID NO: 1860089 - RNA, 13 nt, Salmonella typhimurium LT2
uggcauuucgcau

SEQ ID NO: 1860090 - RNA, 20 nt, Salmonella typhimurium LT2
uggcauugccggaaaccaac

SEQ ID NO: 1860091 - RNA, 19 nt, Salmonella typhimurium LT2
uggccaucuuccagcauca

SEQ ID NO: 1860092 - RNA, 13 nt, Salmonella typhimurium LT2
uggccaguuucaa

SEQ ID NO: 1860093 - RNA, 15 nt, Salmonella typhimurium LT2
uggccaggaauaaag

SEQ ID NO: 1860094 - RNA, 22 nt, Salmonella typhimurium LT2
uggccaccuuuacgguggccuu

SEQ ID NO: 1860095 - RNA, 21 nt, Salmonella typhimurium LT2
uggccaaucagcggguauugc

SEQ ID NO: 1860096 - RNA, 23 nt, Salmonella typhimurium LT2
uggccaccagcacaauggucagc

SEQ ID NO: 1860097 - RNA, 22 nt, Salmonella typhimurium LT2
uggccaccagcuuaucaggaug

SEQ ID NO: 1860098 - RNA, 17 nt, Salmonella typhimurium LT2
uggccggcccgcuucau

SEQ ID NO: 1860099 - RNA, 16 nt, Salmonella typhimurium LT2
uggccugcuuaaacag

SEQ ID NO: 1860100 - RNA, 16 nt, Salmonella typhimurium LT2
uggccucccaguuccc

SEQ ID NO: 1860101 - RNA, 14 nt, Salmonella typhimurium LT2
uggccuccagcacu

SEQ ID NO: 1860102 - RNA, 16 nt, Salmonella typhimurium LT2
uggccuacgugcucac

SEQ ID NO: 1860103 - RNA, 22 nt, Salmonella typhimurium LT2
uggcgaggcuuuguccuuugcu

SEQ ID NO: 1860104 - RNA, 16 nt, Salmonella typhimurium LT2
uggcgauauccgugcc

SEQ ID NO: 1860105 - RNA, 16 nt, Salmonella typhimurium LT2
uggcgaucacaauuac

SEQ ID NO: 1860106 - RNA, 15 nt, Salmonella typhimurium LT2
uggcgaucaccagca

SEQ ID NO: 1860107 - RNA, 14 nt, Salmonella typhimurium LT2
uggcgaucaggcag

SEQ ID NO: 1860108 - RNA, 13 nt, Salmonella typhimurium LT2
uggcgaauacugu

SEQ ID NO: 1860109 - RNA, 21 nt, Salmonella typhimurium LT2
uggcgaauaaaauucagcgca

SEQ ID NO: 1860110 - RNA, 16 nt, Salmonella typhimurium LT2
uggcgaacucuuccag

SEQ ID NO: 1860111 - RNA, 18 nt, Salmonella typhimurium LT2
uggcgaacucuuccagau

SEQ ID NO: 1860112 - RNA, 17 nt, Salmonella typhimurium LT2
uggcgaccggcagccgu

SEQ ID NO: 1860113 - RNA, 21 nt, Salmonella typhimurium LT2
uggcgacgcaggcgccuuauc

SEQ ID NO: 1860114 - RNA, 18 nt, Salmonella typhimurium LT2
uggcgacgccuucaguca

SEQ ID NO: 1860115 - RNA, 16 nt, Salmonella typhimurium LT2
uggcgagcagaaaaag

SEQ ID NO: 1860116 - RNA, 17 nt, Salmonella typhimurium LT2
uggcgagauauaaaacg

SEQ ID NO: 1860117 - RNA, 22 nt, Salmonella typhimurium LT2
uggcgagacgacuaccggccau

SEQ ID NO: 1860118 - RNA, 20 nt, Salmonella typhimurium LT2
uggcgcacaguacgcggccg

SEQ ID NO: 1860119 - RNA, 13 nt, Salmonella typhimurium LT2
uggcgauuuccag

SEQ ID NO: 1860120 - RNA, 16 nt, Salmonella typhimurium LT2
uggcgcaggccaggcg

SEQ ID NO: 1860121 - RNA, 12 nt, Salmonella typhimurium LT2
uggcgcagcgcu

SEQ ID NO: 1860122 - RNA, 17 nt, Salmonella typhimurium LT2
uggcgccuuuuggcagc

SEQ ID NO: 1860123 - RNA, 14 nt, Salmonella typhimurium LT2
uggcgcgaaaacag

SEQ ID NO: 1860124 - RNA, 17 nt, Salmonella typhimurium LT2
uggaguagauguagcug

SEQ ID NO: 1860125 - RNA, 17 nt, Salmonella typhimurium LT2
uggaggaacagcgccgu

SEQ ID NO: 1860126 - RNA, 16 nt, Salmonella typhimurium LT2
uggaggacgucuguca

SEQ ID NO: 1860127 - RNA, 15 nt, Salmonella typhimurium LT2
uggacuaugcuccag

SEQ ID NO: 1860128 - RNA, 16 nt, Salmonella typhimurium LT2
uggacggcaucaggaa

SEQ ID NO: 1860129 - RNA, 13 nt, Salmonella typhimurium LT2
uggacggcaucag

SEQ ID NO: 1860130 - RNA, 14 nt, Salmonella typhimurium LT2
uggacgucaugccg

SEQ ID NO: 1860131 - RNA, 17 nt, Salmonella typhimurium LT2
uggacgggaucucgcac

SEQ ID NO: 1860132 - RNA, 16 nt, Salmonella typhimurium LT2
uggauacguuccagca

SEQ ID NO: 1860133 - RNA, 18 nt, Salmonella typhimurium LT2
uggauagaguuaaaaggu

SEQ ID NO: 1860134 - RNA, 15 nt, Salmonella typhimurium LT2
uggauagucuucaag

SEQ ID NO: 1860135 - RNA, 15 nt, Salmonella typhimurium LT2
uggauaaauaggcug

SEQ ID NO: 1860136 - RNA, 18 nt, Salmonella typhimurium LT2
uggauaaagccaauggug

SEQ ID NO: 1860137 - RNA, 18 nt, Salmonella typhimurium LT2
uggauaaggcgugagcca

SEQ ID NO: 1860138 - RNA, 16 nt, Salmonella typhimurium LT2
uggaucccccuggccc

SEQ ID NO: 1860139 - RNA, 14 nt, Salmonella typhimurium LT2
uggaucggcuugcc

SEQ ID NO: 1860140 - RNA, 23 nt, Salmonella typhimurium LT2
uggaucaggcgcuugcgccgcca

SEQ ID NO: 1860141 - RNA, 20 nt, Salmonella typhimurium LT2
uggaucacuuuugccgucag

SEQ ID NO: 1860142 - RNA, 22 nt, Salmonella typhimurium LT2
uggauggucucuucgcuggcgg

SEQ ID NO: 1860143 - RNA, 20 nt, Salmonella typhimurium LT2
uggcagggacaacgcauugc

SEQ ID NO: 1860144 - RNA, 20 nt, Salmonella typhimurium LT2
uggcauauuugccccuuccg

SEQ ID NO: 1860145 - RNA, 16 nt, Salmonella typhimurium LT2
uggcagccucguccug

SEQ ID NO: 1860146 - RNA, 23 nt, Salmonella typhimurium LT2
uggcagcgccugacggcgcuguc

SEQ ID NO: 1860147 - RNA, 18 nt, Salmonella typhimurium LT2
uggcagcggcaguaaauu

SEQ ID NO: 1860148 - RNA, 15 nt, Salmonella typhimurium LT2
uggcagauaaaccac

SEQ ID NO: 1860149 - RNA, 16 nt, Salmonella typhimurium LT2
uggcagaauaaaacag

SEQ ID NO: 1860150 - RNA, 13 nt, Salmonella typhimurium LT2
uggcacuggcagc

SEQ ID NO: 1860151 - RNA, 13 nt, Salmonella typhimurium LT2
uggcacuuucaga

SEQ ID NO: 1860152 - RNA, 20 nt, Salmonella typhimurium LT2
uggcacuuuccgguuuccau

SEQ ID NO: 1860153 - RNA, 17 nt, Salmonella typhimurium LT2
uggcacacgucuaccca

SEQ ID NO: 1860154 - RNA, 15 nt, Salmonella typhimurium LT2
uggcaaggguaugaa

SEQ ID NO: 1860155 - RNA, 23 nt, Salmonella typhimurium LT2
uggcaaucauaccgucagauucu

SEQ ID NO: 1860156 - RNA, 21 nt, Salmonella typhimurium LT2
uggcaaucauaccgucagauu

SEQ ID NO: 1860157 - RNA, 20 nt, Salmonella typhimurium LT2
uggcaagaaccgcuuuuccu

SEQ ID NO: 1860158 - RNA, 17 nt, Salmonella typhimurium LT2
uggcaagcgcuaagcaa

SEQ ID NO: 1860159 - RNA, 13 nt, Salmonella typhimurium LT2
uggcaaacugccg

SEQ ID NO: 1860160 - RNA, 18 nt, Salmonella typhimurium LT2
uggcaacaaagccugcug

SEQ ID NO: 1860161 - RNA, 16 nt, Salmonella typhimurium LT2
uggcaaaacgcaucca

SEQ ID NO: 1860162 - RNA, 17 nt, Salmonella typhimurium LT2
uggcaaaacgcauccag

SEQ ID NO: 1860163 - RNA, 18 nt, Salmonella typhimurium LT2
uggcaaaaacaccuaacc

SEQ ID NO: 1860164 - RNA, 18 nt, Salmonella typhimurium LT2
uggauuuuugacuaaagu

SEQ ID NO: 1860165 - RNA, 21 nt, Salmonella typhimurium LT2
uggauuuuccguuaagcugga

SEQ ID NO: 1860166 - RNA, 15 nt, Salmonella typhimurium LT2
uggauuccuggcuug

SEQ ID NO: 1860167 - RNA, 22 nt, Salmonella typhimurium LT2
uggauuuauggcacaucaggca

SEQ ID NO: 1860168 - RNA, 12 nt, Salmonella typhimurium LT2
uguuugaugagg

SEQ ID NO: 1860169 - RNA, 20 nt, Salmonella typhimurium LT2
uguuugcugagaauuuccag

SEQ ID NO: 1860170 - RNA, 15 nt, Salmonella typhimurium LT2
uguuucugcuggccu

SEQ ID NO: 1860171 - RNA, 10 nt, Salmonella typhimurium LT2
uguuucugcg

SEQ ID NO: 1860172 - RNA, 17 nt, Salmonella typhimurium LT2
uguuucucuuccgccag

SEQ ID NO: 1860173 - RNA, 17 nt, Salmonella typhimurium LT2
uguuucuguauuuucua

SEQ ID NO: 1860174 - RNA, 13 nt, Salmonella typhimurium LT2
uguuuggugcuga

SEQ ID NO: 1860175 - RNA, 14 nt, Salmonella typhimurium LT2
uguuuuaccuguuu

SEQ ID NO: 1860176 - RNA, 16 nt, Salmonella typhimurium LT2
uguuuucagcaaauaa

SEQ ID NO: 1860177 - RNA, 21 nt, Salmonella typhimurium LT2
uguuuucgagccuugccgcaa

SEQ ID NO: 1860178 - RNA, 19 nt, Salmonella typhimurium LT2
uguuuaccaagcaccgcca

SEQ ID NO: 1860179 - RNA, 21 nt, Salmonella typhimurium LT2
uguuuaccaugcgccaugagu

SEQ ID NO: 1860180 - RNA, 17 nt, Salmonella typhimurium LT2
uguuuaaugcuuucaau

SEQ ID NO: 1860181 - RNA, 19 nt, Salmonella typhimurium LT2
uguuuaagcgccuccacaa

SEQ ID NO: 1860182 - RNA, 15 nt, Salmonella typhimurium LT2
uguuuaaaaucaacg

SEQ ID NO: 1860183 - RNA, 16 nt, Salmonella typhimurium LT2
uguuuaugacccugcg

SEQ ID NO: 1860184 - RNA, 19 nt, Salmonella typhimurium LT2
uguuucaccucauuuuuag

SEQ ID NO: 1860185 - RNA, 15 nt, Salmonella typhimurium LT2
uguuucaguucggag

SEQ ID NO: 1860186 - RNA, 18 nt, Salmonella typhimurium LT2
uguuucagcaccucuuug

SEQ ID NO: 1860187 - RNA, 13 nt, Salmonella typhimurium LT2
uguuuccagugca

SEQ ID NO: 1860188 - RNA, 14 nt, Salmonella typhimurium LT2
uuaaacguuauuca

SEQ ID NO: 1860189 - RNA, 19 nt, Salmonella typhimurium LT2
uuaaagccaauccagaaua

SEQ ID NO: 1860190 - RNA, 22 nt, Salmonella typhimurium LT2
uuaaagcgcucaagcggcacca

SEQ ID NO: 1860191 - RNA, 22 nt, Salmonella typhimurium LT2
uuaaaaucggggucuuccagca

SEQ ID NO: 1860192 - RNA, 11 nt, Salmonella typhimurium LT2
uuaaaaugacc

SEQ ID NO: 1860193 - RNA, 23 nt, Salmonella typhimurium LT2
uuaaaauucagacugcgcauuaa

SEQ ID NO: 1860194 - RNA, 17 nt, Salmonella typhimurium LT2
uuaaaauaaaucggcau

SEQ ID NO: 1860195 - RNA, 21 nt, Salmonella typhimurium LT2
uuaaaaguacaaugcaaagaa

SEQ ID NO: 1860196 - RNA, 15 nt, Salmonella typhimurium LT2
uuaaaagagaaaaag

SEQ ID NO: 1860197 - RNA, 16 nt, Salmonella typhimurium LT2
uuaaaagagaaaaaga

SEQ ID NO: 1860198 - RNA, 17 nt, Salmonella typhimurium LT2
uuaaaacgcacgcuguc

SEQ ID NO: 1860199 - RNA, 11 nt, Salmonella typhimurium LT2
uuaaaaccauu

SEQ ID NO: 1860200 - RNA, 18 nt, Salmonella typhimurium LT2
uuaaaaaaggcagaagaa

SEQ ID NO: 1860201 - RNA, 13 nt, Salmonella typhimurium LT2
uuaaaaacaucau

SEQ ID NO: 1860202 - RNA, 13 nt, Salmonella typhimurium LT2
uuaaaaagagaaa

SEQ ID NO: 1860203 - RNA, 16 nt, Salmonella typhimurium LT2
uuaaaaagagaaaaaa

SEQ ID NO: 1860204 - RNA, 12 nt, Salmonella typhimurium LT2
uuaaaaauaacg

SEQ ID NO: 1860205 - RNA, 15 nt, Salmonella typhimurium LT2
uguuuuuauacaucc

SEQ ID NO: 1860206 - RNA, 17 nt, Salmonella typhimurium LT2
uguuaucuacaguguaa

SEQ ID NO: 1860207 - RNA, 22 nt, Salmonella typhimurium LT2
uguucagcgcagaagcagacug

SEQ ID NO: 1860208 - RNA, 16 nt, Salmonella typhimurium LT2
uguucacaucgcucag

SEQ ID NO: 1860209 - RNA, 18 nt, Salmonella typhimurium LT2
uguuccggaugcgggccg

SEQ ID NO: 1860210 - RNA, 21 nt, Salmonella typhimurium LT2
uguuccggcgucgcguucagc

SEQ ID NO: 1860211 - RNA, 16 nt, Salmonella typhimurium LT2
uguuccugcgggaaca

SEQ ID NO: 1860212 - RNA, 23 nt, Salmonella typhimurium LT2
uguucuaaaaaguucauguaagu

SEQ ID NO: 1860213 - RNA, 22 nt, Salmonella typhimurium LT2
uguuccuggacguggguuucaa

SEQ ID NO: 1860214 - RNA, 14 nt, Salmonella typhimurium LT2
uguuccaccugcgg

SEQ ID NO: 1860215 - RNA, 16 nt, Salmonella typhimurium LT2
uguuccagggcuucca

SEQ ID NO: 1860216 - RNA, 15 nt, Salmonella typhimurium LT2
uguucagcacccaga

SEQ ID NO: 1860217 - RNA, 21 nt, Salmonella typhimurium LT2
uguucccgacggcaggcggca

SEQ ID NO: 1860218 - RNA, 12 nt, Salmonella typhimurium LT2
uguugcuccaaa

SEQ ID NO: 1860219 - RNA, 13 nt, Salmonella typhimurium LT2
uguugcuccagca

SEQ ID NO: 1860220 - RNA, 13 nt, Salmonella typhimurium LT2
uguugcuggcagg

SEQ ID NO: 1860221 - RNA, 22 nt, Salmonella typhimurium LT2
uguugcaauaaaauauccucca

SEQ ID NO: 1860222 - RNA, 18 nt, Salmonella typhimurium LT2
uguucuccucugaaaaau

SEQ ID NO: 1860223 - RNA, 13 nt, Salmonella typhimurium LT2
uguugguuuaaac

SEQ ID NO: 1860224 - RNA, 14 nt, Salmonella typhimurium LT2
uguuguacagcaau

SEQ ID NO: 1860225 - RNA, 18 nt, Salmonella typhimurium LT2
uguugucgagguuauaaa

SEQ ID NO: 1860226 - RNA, 17 nt, Salmonella typhimurium LT2
uguuguccggccacgga

SEQ ID NO: 1860227 - RNA, 15 nt, Salmonella typhimurium LT2
ugugccgucauccag

SEQ ID NO: 1860228 - RNA, 16 nt, Salmonella typhimurium LT2
ugugccuguaaauguu

SEQ ID NO: 1860229 - RNA, 21 nt, Salmonella typhimurium LT2
ugugcgcuaaaaccaaugcgu

SEQ ID NO: 1860230 - RNA, 20 nt, Salmonella typhimurium LT2
ugugaggaaagcgaaaauaa

SEQ ID NO: 1860231 - RNA, 18 nt, Salmonella typhimurium LT2
ugugcauaucuggcgagg

SEQ ID NO: 1860232 - RNA, 20 nt, Salmonella typhimurium LT2
ugugcagccaguuagcuuca

SEQ ID NO: 1860233 - RNA, 11 nt, Salmonella typhimurium LT2
ugucaccagca

SEQ ID NO: 1860234 - RNA, 12 nt, Salmonella typhimurium LT2
ugucaccaauaa

SEQ ID NO: 1860235 - RNA, 19 nt, Salmonella typhimurium LT2
ugucacuauucuuaucauu

SEQ ID NO: 1860236 - RNA, 18 nt, Salmonella typhimurium LT2
ugucagaagaagguaaaa

SEQ ID NO: 1860237 - RNA, 14 nt, Salmonella typhimurium LT2
ugucagaauuuccc

SEQ ID NO: 1860238 - RNA, 17 nt, Salmonella typhimurium LT2
ugucagaauuuccccag

SEQ ID NO: 1860239 - RNA, 20 nt, Salmonella typhimurium LT2
ugucagaauuuccccaguua

SEQ ID NO: 1860240 - RNA, 20 nt, Salmonella typhimurium LT2
ugugagacaaaaaagcugcg

SEQ ID NO: 1860241 - RNA, 12 nt, Salmonella typhimurium LT2
ugugagccauaa

SEQ ID NO: 1860242 - RNA, 14 nt, Salmonella typhimurium LT2
ugugacggcauguc

SEQ ID NO: 1860243 - RNA, 13 nt, Salmonella typhimurium LT2
ugugcguggcgcc

SEQ ID NO: 1860244 - RNA, 19 nt, Salmonella typhimurium LT2
ugugcguauucagcgcagu

SEQ ID NO: 1860245 - RNA, 15 nt, Salmonella typhimurium LT2
ugugcuccaccagcc

SEQ ID NO: 1860246 - RNA, 13 nt, Salmonella typhimurium LT2
uguggccugcuua

SEQ ID NO: 1860247 - RNA, 19 nt, Salmonella typhimurium LT2
uguggccugcuuaaacaga

SEQ ID NO: 1860248 - RNA, 20 nt, Salmonella typhimurium LT2
ugugggaagggcgaagggcc

SEQ ID NO: 1860249 - RNA, 17 nt, Salmonella typhimurium LT2
ugugucuuuuacacuga

SEQ ID NO: 1860250 - RNA, 20 nt, Salmonella typhimurium LT2
uguggucgcggcucaccagc

SEQ ID NO: 1860251 - RNA, 18 nt, Salmonella typhimurium LT2
uuacccgggccaucuuuu

SEQ ID NO: 1860252 - RNA, 12 nt, Salmonella typhimurium LT2
uuaccgccgccg

SEQ ID NO: 1860253 - RNA, 14 nt, Salmonella typhimurium LT2
uuaccgcccgcuuc

SEQ ID NO: 1860254 - RNA, 15 nt, Salmonella typhimurium LT2
uuaccgccagcggcg

SEQ ID NO: 1860255 - RNA, 14 nt, Salmonella typhimurium LT2
uuaccgggcaucug

SEQ ID NO: 1860256 - RNA, 16 nt, Salmonella typhimurium LT2
uuaccguucaggcaaa

SEQ ID NO: 1860257 - RNA, 16 nt, Salmonella typhimurium LT2
uuaccguugcaucaug

SEQ ID NO: 1860258 - RNA, 17 nt, Salmonella typhimurium LT2
uuaccguuugucuucug

SEQ ID NO: 1860259 - RNA, 19 nt, Salmonella typhimurium LT2
uuaccuacgcgauaaaaaa

SEQ ID NO: 1860260 - RNA, 22 nt, Salmonella typhimurium LT2
uuaccugcgcaaucaugacaga

SEQ ID NO: 1860261 - RNA, 16 nt, Salmonella typhimurium LT2
uuacaauguacagaau

SEQ ID NO: 1860262 - RNA, 17 nt, Salmonella typhimurium LT2
uuacaccccacuauuca

SEQ ID NO: 1860263 - RNA, 19 nt, Salmonella typhimurium LT2
uuacaggccggacaggcga

SEQ ID NO: 1860264 - RNA, 19 nt, Salmonella typhimurium LT2
uuacaggcaucuuccagcg

SEQ ID NO: 1860265 - RNA, 13 nt, Salmonella typhimurium LT2
uuaccacuuugcg

SEQ ID NO: 1860266 - RNA, 21 nt, Salmonella typhimurium LT2
uuaccaauauuaauguauuau

SEQ ID NO: 1860267 - RNA, 14 nt, Salmonella typhimurium LT2
uuacaguuuaucug

SEQ ID NO: 1860268 - RNA, 18 nt, Salmonella typhimurium LT2
uuacaguuuaucugcgug

SEQ ID NO: 1860269 - RNA, 16 nt, Salmonella typhimurium LT2
uuaauccggucaucca

SEQ ID NO: 1860270 - RNA, 22 nt, Salmonella typhimurium LT2
uuaaucccuugcuggcgacggc

SEQ ID NO: 1860271 - RNA, 14 nt, Salmonella typhimurium LT2
uuaauguccagcag

SEQ ID NO: 1860272 - RNA, 14 nt, Salmonella typhimurium LT2
uuaaucgucauccc

SEQ ID NO: 1860273 - RNA, 15 nt, Salmonella typhimurium LT2
uuaaucgucaucccg

SEQ ID NO: 1860274 - RNA, 15 nt, Salmonella typhimurium LT2
uuaaucgcuucaauc

SEQ ID NO: 1860275 - RNA, 20 nt, Salmonella typhimurium LT2
uuaauuccuggcguaugcuu

SEQ ID NO: 1860276 - RNA, 12 nt, Salmonella typhimurium LT2
uuaauucgucag

SEQ ID NO: 1860277 - RNA, 21 nt, Salmonella typhimurium LT2
uuaauucguccccagcgaucc

SEQ ID NO: 1860278 - RNA, 20 nt, Salmonella typhimurium LT2
uuaauguuaggaguaaauaa

SEQ ID NO: 1860279 - RNA, 21 nt, Salmonella typhimurium LT2
uuaauugcugaagauaaaauu

SEQ ID NO: 1860280 - RNA, 20 nt, Salmonella typhimurium LT2
uuaauugccugacgaaaacc

SEQ ID NO: 1860281 - RNA, 21 nt, Salmonella typhimurium LT2
uuaauuuuuagcuaacucuau

SEQ ID NO: 1860282 - RNA, 14 nt, Salmonella typhimurium LT2
uuaauuuucuuuua

SEQ ID NO: 1860283 - RNA, 16 nt, Salmonella typhimurium LT2
uuaaucagcgcugucg

SEQ ID NO: 1860284 - RNA, 13 nt, Salmonella typhimurium LT2
uuaaucauaaaac

SEQ ID NO: 1860285 - RNA, 18 nt, Salmonella typhimurium LT2
uuaaucaagcccagcuca

SEQ ID NO: 1860286 - RNA, 21 nt, Salmonella typhimurium LT2
uuaaucacaaugucaucaaga

SEQ ID NO: 1860287 - RNA, 15 nt, Salmonella typhimurium LT2
uuaauacaucagaaa

SEQ ID NO: 1860288 - RNA, 13 nt, Salmonella typhimurium LT2
uuaagaagucugu

SEQ ID NO: 1860289 - RNA, 15 nt, Salmonella typhimurium LT2
uuaaggauauauacu

SEQ ID NO: 1860290 - RNA, 17 nt, Salmonella typhimurium LT2
uuaagacuuuuuaauuc

SEQ ID NO: 1860291 - RNA, 22 nt, Salmonella typhimurium LT2
uuaacuccuucuaauuccagga

SEQ ID NO: 1860292 - RNA, 13 nt, Salmonella typhimurium LT2
uuagcgaaacagu

SEQ ID NO: 1860293 - RNA, 23 nt, Salmonella typhimurium LT2
uuagcgcuaauuccuguccauug

SEQ ID NO: 1860294 - RNA, 18 nt, Salmonella typhimurium LT2
uuagcuggccaaucagcg

SEQ ID NO: 1860295 - RNA, 14 nt, Salmonella typhimurium LT2
uuagcuucagcaaa

SEQ ID NO: 1860296 - RNA, 12 nt, Salmonella typhimurium LT2
uuagcuuccagc

SEQ ID NO: 1860297 - RNA, 17 nt, Salmonella typhimurium LT2
uuagcgguacucuuuuu

SEQ ID NO: 1860298 - RNA, 14 nt, Salmonella typhimurium LT2
uuagcuaacucuau

SEQ ID NO: 1860299 - RNA, 22 nt, Salmonella typhimurium LT2
uuagcccuuucauuucugccug

SEQ ID NO: 1860300 - RNA, 18 nt, Salmonella typhimurium LT2
uuagcccaggccaauggc

SEQ ID NO: 1860301 - RNA, 19 nt, Salmonella typhimurium LT2
uuagccaggugacuuugcc

SEQ ID NO: 1860302 - RNA, 15 nt, Salmonella typhimurium LT2
uuagcaugacaauaa

SEQ ID NO: 1860303 - RNA, 21 nt, Salmonella typhimurium LT2
uuagcaacacagacuuugcac

SEQ ID NO: 1860304 - RNA, 10 nt, Salmonella typhimurium LT2
uuagcagcaa

SEQ ID NO: 1860305 - RNA, 13 nt, Salmonella typhimurium LT2
uuagcagcaauaa

SEQ ID NO: 1860306 - RNA, 18 nt, Salmonella typhimurium LT2
uuagauauaguuuuucaa

SEQ ID NO: 1860307 - RNA, 13 nt, Salmonella typhimurium LT2
uuacgaaaagguc

SEQ ID NO: 1860308 - RNA, 16 nt, Salmonella typhimurium LT2
uuaccuuguucuucca

SEQ ID NO: 1860309 - RNA, 17 nt, Salmonella typhimurium LT2
uuaccuuguucuuccau

SEQ ID NO: 1860310 - RNA, 22 nt, Salmonella typhimurium LT2
uuacgaccgcagaaacagauag

SEQ ID NO: 1860311 - RNA, 20 nt, Salmonella typhimurium LT2
uuacuuccggcgaugccacc

SEQ ID NO: 1860312 - RNA, 14 nt, Salmonella typhimurium LT2
uuauaaauuuuuua

SEQ ID NO: 1860313 - RNA, 22 nt, Salmonella typhimurium LT2
uuauacgccuauuuucugcucg

SEQ ID NO: 1860314 - RNA, 13 nt, Salmonella typhimurium LT2
uuauaguccacuu

SEQ ID NO: 1860315 - RNA, 22 nt, Salmonella typhimurium LT2
uuauauaaaaaaugguuuuauu

SEQ ID NO: 1860316 - RNA, 23 nt, Salmonella typhimurium LT2
uuauacuugcugcuaugaaaaau

SEQ ID NO: 1860317 - RNA, 21 nt, Salmonella typhimurium LT2
uuauaggugucagauccuuca

SEQ ID NO: 1860318 - RNA, 15 nt, Salmonella typhimurium LT2
uuauacucaaaaaau

SEQ ID NO: 1860319 - RNA, 12 nt, Salmonella typhimurium LT2
uuauauaaaaau

SEQ ID NO: 1860320 - RNA, 16 nt, Salmonella typhimurium LT2
uuauauuacugacuau

SEQ ID NO: 1860321 - RNA, 24 nt, Salmonella typhimurium LT2
uuaucacccugaauuucaauaauc

SEQ ID NO: 1860322 - RNA, 20 nt, Salmonella typhimurium LT2
uuaucaaaccaguuuuucau

SEQ ID NO: 1860323 - RNA, 19 nt, Salmonella typhimurium LT2
uuauauuggcuggccugcu

SEQ ID NO: 1860324 - RNA, 11 nt, Salmonella typhimurium LT2
uuaguguccuu

SEQ ID NO: 1860325 - RNA, 12 nt, Salmonella typhimurium LT2
uuagugaaauac

SEQ ID NO: 1860326 - RNA, 16 nt, Salmonella typhimurium LT2
uuagguucuucaaugc

SEQ ID NO: 1860327 - RNA, 20 nt, Salmonella typhimurium LT2
uuaguaccgaacagccaggc

SEQ ID NO: 1860328 - RNA, 15 nt, Salmonella typhimurium LT2
uuaguagguggccca

SEQ ID NO: 1860329 - RNA, 20 nt, Salmonella typhimurium LT2
ugcuggucagcaacgccucc

SEQ ID NO: 1860330 - RNA, 19 nt, Salmonella typhimurium LT2
ugcuggcgaaccaccagcc

SEQ ID NO: 1860331 - RNA, 18 nt, Salmonella typhimurium LT2
ugcugucgguuaacacca

SEQ ID NO: 1860332 - RNA, 20 nt, Salmonella typhimurium LT2
ugcugugccaguaccgccgc

SEQ ID NO: 1860333 - RNA, 21 nt, Salmonella typhimurium LT2
ugcuguccgggcguuucagcu

SEQ ID NO: 1860334 - RNA, 18 nt, Salmonella typhimurium LT2
ugcugucgcccauugaaa

SEQ ID NO: 1860335 - RNA, 14 nt, Salmonella typhimurium LT2
ugcugcgcuuucca

SEQ ID NO: 1860336 - RNA, 17 nt, Salmonella typhimurium LT2
ugcugaccuuaauccag

SEQ ID NO: 1860337 - RNA, 20 nt, Salmonella typhimurium LT2
ugcugcgcaacgagugcuca

SEQ ID NO: 1860338 - RNA, 18 nt, Salmonella typhimurium LT2
ugcugacaaucugcugga

SEQ ID NO: 1860339 - RNA, 16 nt, Salmonella typhimurium LT2
ugcugacaaucugcug

SEQ ID NO: 1860340 - RNA, 17 nt, Salmonella typhimurium LT2
ugcugcguaaccgccag

SEQ ID NO: 1860341 - RNA, 20 nt, Salmonella typhimurium LT2
ugcuucguggcaaucagcaa

SEQ ID NO: 1860342 - RNA, 12 nt, Salmonella typhimurium LT2
ugcuucucgccu

SEQ ID NO: 1860343 - RNA, 15 nt, Salmonella typhimurium LT2
ugcuucgauggccuc

SEQ ID NO: 1860344 - RNA, 21 nt, Salmonella typhimurium LT2
ugcuuccgaccgcagcgaaga

SEQ ID NO: 1860345 - RNA, 15 nt, Salmonella typhimurium LT2
ugcuuccgccuucuc

SEQ ID NO: 1860346 - RNA, 13 nt, Salmonella typhimurium LT2
ugcuuccagcucc

SEQ ID NO: 1860347 - RNA, 14 nt, Salmonella typhimurium LT2
ugcuuccagcucca

SEQ ID NO: 1860348 - RNA, 22 nt, Salmonella typhimurium LT2
ugcuucaugcacaaaacccgca

SEQ ID NO: 1860349 - RNA, 19 nt, Salmonella typhimurium LT2
ugcuuaccuuguucuucca

SEQ ID NO: 1860350 - RNA, 21 nt, Salmonella typhimurium LT2
ugcuuaagccagccaaagcug

SEQ ID NO: 1860351 - RNA, 17 nt, Salmonella typhimurium LT2
ugcuuaaugcucugcug

SEQ ID NO: 1860352 - RNA, 19 nt, Salmonella typhimurium LT2
ugcuuucgcgauaaucaac

SEQ ID NO: 1860353 - RNA, 15 nt, Salmonella typhimurium LT2
uggaaauguucucag

SEQ ID NO: 1860354 - RNA, 19 nt, Salmonella typhimurium LT2
uggaaauaaucuguagauu

SEQ ID NO: 1860355 - RNA, 21 nt, Salmonella typhimurium LT2
uggaaauaccgguaaucaagc

SEQ ID NO: 1860356 - RNA, 23 nt, Salmonella typhimurium LT2
uggaaaggcuuuuuaaucaaaau

SEQ ID NO: 1860357 - RNA, 21 nt, Salmonella typhimurium LT2
uggaaacagccaaucauaaac

SEQ ID NO: 1860358 - RNA, 16 nt, Salmonella typhimurium LT2
ugcuuuuuauuuuucu

SEQ ID NO: 1860359 - RNA, 18 nt, Salmonella typhimurium LT2
uggaaccagguuuccaga

SEQ ID NO: 1860360 - RNA, 23 nt, Salmonella typhimurium LT2
uggaacagauguuuacgcugcuc

SEQ ID NO: 1860361 - RNA, 14 nt, Salmonella typhimurium LT2
uggaagaaaauaua

SEQ ID NO: 1860362 - RNA, 19 nt, Salmonella typhimurium LT2
uggaagcuacaggucgacg

SEQ ID NO: 1860363 - RNA, 12 nt, Salmonella typhimurium LT2
uggaagacuuca

SEQ ID NO: 1860364 - RNA, 22 nt, Salmonella typhimurium LT2
uggaagguauucaucgugccag

SEQ ID NO: 1860365 - RNA, 23 nt, Salmonella typhimurium LT2
uggaaguagucgcgaaugcgcaa

SEQ ID NO: 1860366 - RNA, 14 nt, Salmonella typhimurium LT2
uggaagcuguuaau

SEQ ID NO: 1860367 - RNA, 20 nt, Salmonella typhimurium LT2
uggaaggcuucggucagauc

SEQ ID NO: 1860368 - RNA, 21 nt, Salmonella typhimurium LT2
uggaaggcuucggucagaucc

SEQ ID NO: 1860369 - RNA, 20 nt, Salmonella typhimurium LT2
uggaaguugaagaaaaaccc

SEQ ID NO: 1860370 - RNA, 18 nt, Salmonella typhimurium LT2
uggaauaaacgguaagag

SEQ ID NO: 1860371 - RNA, 16 nt, Salmonella typhimurium LT2
uggaauacaaacccag

SEQ ID NO: 1860372 - RNA, 16 nt, Salmonella typhimurium LT2
uggaauguucuccucu

SEQ ID NO: 1860373 - RNA, 14 nt, Salmonella typhimurium LT2
uggaaugagcaucu

SEQ ID NO: 1860374 - RNA, 23 nt, Salmonella typhimurium LT2
uggacaacauuucgcacccuguc

SEQ ID NO: 1860375 - RNA, 20 nt, Salmonella typhimurium LT2
uggacagggucgauucccag

SEQ ID NO: 1860376 - RNA, 13 nt, Salmonella typhimurium LT2
ugcucccacagcu

SEQ ID NO: 1860377 - RNA, 20 nt, Salmonella typhimurium LT2
ugcuccaguuguuccagcag

SEQ ID NO: 1860378 - RNA, 20 nt, Salmonella typhimurium LT2
ugcuccaucaucgccagcuu

SEQ ID NO: 1860379 - RNA, 17 nt, Salmonella typhimurium LT2
ugcuccagcgccugcug

SEQ ID NO: 1860380 - RNA, 15 nt, Salmonella typhimurium LT2
ugcucagcgaccguc

SEQ ID NO: 1860381 - RNA, 17 nt, Salmonella typhimurium LT2
ugcucuaccaacugagc

SEQ ID NO: 1860382 - RNA, 19 nt, Salmonella typhimurium LT2
ugcucuaccaacugagcua

SEQ ID NO: 1860383 - RNA, 15 nt, Salmonella typhimurium LT2
ugcucuugcggcugc

SEQ ID NO: 1860384 - RNA, 17 nt, Salmonella typhimurium LT2
ugcucuugucagaagaa

SEQ ID NO: 1860385 - RNA, 12 nt, Salmonella typhimurium LT2
ugcuacgcgcca

SEQ ID NO: 1860386 - RNA, 21 nt, Salmonella typhimurium LT2
ugcuauaugcaggcauaaaaa

SEQ ID NO: 1860387 - RNA, 19 nt, Salmonella typhimurium LT2
ugcuaucaaacugaaaauc

SEQ ID NO: 1860388 - RNA, 14 nt, Salmonella typhimurium LT2
ugcuaucaaacuga

SEQ ID NO: 1860389 - RNA, 12 nt, Salmonella typhimurium LT2
ugcuaucaggau

SEQ ID NO: 1860390 - RNA, 23 nt, Salmonella typhimurium LT2
ugcuaguagcggaauaucuuccc

SEQ ID NO: 1860391 - RNA, 23 nt, Salmonella typhimurium LT2
ugcuaugccugaaagcaaguauc

SEQ ID NO: 1860392 - RNA, 14 nt, Salmonella typhimurium LT2
ugcuauucagcagu

SEQ ID NO: 1860393 - RNA, 24 nt, Salmonella typhimurium LT2
ugcucaccgguaaaaguauguauu

SEQ ID NO: 1860394 - RNA, 21 nt, Salmonella typhimurium LT2
ugcucaacauacgggcuuuug

SEQ ID NO: 1860395 - RNA, 17 nt, Salmonella typhimurium LT2
ugcucaaccacgauaac

SEQ ID NO: 1860396 - RNA, 18 nt, Salmonella typhimurium LT2
ugcggcaauggcucaggc

SEQ ID NO: 1860397 - RNA, 19 nt, Salmonella typhimurium LT2
ugcggcacgagcacugugg

SEQ ID NO: 1860398 - RNA, 23 nt, Salmonella typhimurium LT2
ugcggcacacagccaaaauaugc

SEQ ID NO: 1860399 - RNA, 21 nt, Salmonella typhimurium LT2
ugcggcaauggccgcagcgcc

SEQ ID NO: 1860400 - RNA, 23 nt, Salmonella typhimurium LT2
ugcggcaauggccgcagcgccau

SEQ ID NO: 1860401 - RNA, 14 nt, Salmonella typhimurium LT2
ugcggcaagcgcgc

SEQ ID NO: 1860402 - RNA, 22 nt, Salmonella typhimurium LT2
ugcgcuucgaugcguucaaaaa

SEQ ID NO: 1860403 - RNA, 17 nt, Salmonella typhimurium LT2
ugcgcuucgaugcguuc

SEQ ID NO: 1860404 - RNA, 16 nt, Salmonella typhimurium LT2
ugcggcuucagcgaca

SEQ ID NO: 1860405 - RNA, 15 nt, Salmonella typhimurium LT2
ugcggcuuacccuga

SEQ ID NO: 1860406 - RNA, 19 nt, Salmonella typhimurium LT2
ugcggcuguguucauccca

SEQ ID NO: 1860407 - RNA, 20 nt, Salmonella typhimurium LT2
ugcggcuauauaaaaucggg

SEQ ID NO: 1860408 - RNA, 23 nt, Salmonella typhimurium LT2
ugcggcggggauaaucagcagcg

SEQ ID NO: 1860409 - RNA, 17 nt, Salmonella typhimurium LT2
ugcggcuauauaaaauc

SEQ ID NO: 1860410 - RNA, 15 nt, Salmonella typhimurium LT2
ugcggcgugcggcug

SEQ ID NO: 1860411 - RNA, 15 nt, Salmonella typhimurium LT2
ugcgcuccugcuccc

SEQ ID NO: 1860412 - RNA, 19 nt, Salmonella typhimurium LT2
ugcgccaacugcauuucau

SEQ ID NO: 1860413 - RNA, 14 nt, Salmonella typhimurium LT2
ugcgccaaaucggu

SEQ ID NO: 1860414 - RNA, 20 nt, Salmonella typhimurium LT2
ugcgcugucaccagcagcau

SEQ ID NO: 1860415 - RNA, 13 nt, Salmonella typhimurium LT2
ugcgcugucagca

SEQ ID NO: 1860416 - RNA, 15 nt, Salmonella typhimurium LT2
ugcgcugucaccagc

SEQ ID NO: 1860417 - RNA, 18 nt, Salmonella typhimurium LT2
ugcgcugguuggcgcgcu

SEQ ID NO: 1860418 - RNA, 14 nt, Salmonella typhimurium LT2
ugcgcugucaccag

SEQ ID NO: 1860419 - RNA, 19 nt, Salmonella typhimurium LT2
ugcgcuggaacugaucgug

SEQ ID NO: 1860420 - RNA, 14 nt, Salmonella typhimurium LT2
ugcgcuggaacgcg

SEQ ID NO: 1860421 - RNA, 14 nt, Salmonella typhimurium LT2
ugcggcuuuuucac

SEQ ID NO: 1860422 - RNA, 17 nt, Salmonella typhimurium LT2
ugcggcuuuaaguuuuu

SEQ ID NO: 1860423 - RNA, 16 nt, Salmonella typhimurium LT2
ugcgggacgcaucauc

SEQ ID NO: 1860424 - RNA, 16 nt, Salmonella typhimurium LT2
ugcgggagaucggcug

SEQ ID NO: 1860425 - RNA, 19 nt, Salmonella typhimurium LT2
ugcgggagcuguucuuaua

SEQ ID NO: 1860426 - RNA, 20 nt, Salmonella typhimurium LT2
ugcggguguccguuccugcc

SEQ ID NO: 1860427 - RNA, 16 nt, Salmonella typhimurium LT2
ugcguagcaccaguac

SEQ ID NO: 1860428 - RNA, 21 nt, Salmonella typhimurium LT2
ugcguaccugcggcgcuuugc

SEQ ID NO: 1860429 - RNA, 14 nt, Salmonella typhimurium LT2
ugcgguagcgccga

SEQ ID NO: 1860430 - RNA, 15 nt, Salmonella typhimurium LT2
ugcgguaaauaaugc

SEQ ID NO: 1860431 - RNA, 18 nt, Salmonella typhimurium LT2
ugcgucggcaccauuccc

SEQ ID NO: 1860432 - RNA, 19 nt, Salmonella typhimurium LT2
ugcgucggguggcaucuga

SEQ ID NO: 1860433 - RNA, 17 nt, Salmonella typhimurium LT2
ugcgucgagcgccguca

SEQ ID NO: 1860434 - RNA, 22 nt, Salmonella typhimurium LT2
ugcguuccgcucagcgucacuc

SEQ ID NO: 1860435 - RNA, 19 nt, Salmonella typhimurium LT2
ugcgucgcgcuuucaaucg

SEQ ID NO: 1860436 - RNA, 15 nt, Salmonella typhimurium LT2
ugcgucgcuuccugu

SEQ ID NO: 1860437 - RNA, 15 nt, Salmonella typhimurium LT2
ugcguaucguaagcc

SEQ ID NO: 1860438 - RNA, 15 nt, Salmonella typhimurium LT2
ugcguaucgcccacc

SEQ ID NO: 1860439 - RNA, 13 nt, Salmonella typhimurium LT2
ugcguauuuccac

SEQ ID NO: 1860440 - RNA, 15 nt, Salmonella typhimurium LT2
ugcguauuuuuauuu

SEQ ID NO: 1860441 - RNA, 21 nt, Salmonella typhimurium LT2
ugcguauuuuucguaagccgc

SEQ ID NO: 1860442 - RNA, 19 nt, Salmonella typhimurium LT2
ugcgucaaaauaagcaccg

SEQ ID NO: 1860443 - RNA, 15 nt, Salmonella typhimurium LT2
ugcgucaccgggcug

SEQ ID NO: 1860444 - RNA, 21 nt, Salmonella typhimurium LT2
ugcgucacgauaguuuuaaua

SEQ ID NO: 1860445 - RNA, 20 nt, Salmonella typhimurium LT2
ugccacuggguuucccauug

SEQ ID NO: 1860446 - RNA, 16 nt, Salmonella typhimurium LT2
ugccacucgauuccca

SEQ ID NO: 1860447 - RNA, 14 nt, Salmonella typhimurium LT2
ugccaccagcgcca

SEQ ID NO: 1860448 - RNA, 20 nt, Salmonella typhimurium LT2
ugccaccagccuaaaaacag

SEQ ID NO: 1860449 - RNA, 21 nt, Salmonella typhimurium LT2
ugccacauuuaugucgggugg

SEQ ID NO: 1860450 - RNA, 13 nt, Salmonella typhimurium LT2
ugccaaucuccag

SEQ ID NO: 1860451 - RNA, 15 nt, Salmonella typhimurium LT2
ugccaaucuccagca

SEQ ID NO: 1860452 - RNA, 17 nt, Salmonella typhimurium LT2
ugccaaguaacacggcg

SEQ ID NO: 1860453 - RNA, 16 nt, Salmonella typhimurium LT2
ugcaguaagugagucc

SEQ ID NO: 1860454 - RNA, 21 nt, Salmonella typhimurium LT2
ugccaagcguaguacguucca

SEQ ID NO: 1860455 - RNA, 23 nt, Salmonella typhimurium LT2
ugccaguaguugaauaaccucaa

SEQ ID NO: 1860456 - RNA, 13 nt, Salmonella typhimurium LT2
ugccagugaaaaa

SEQ ID NO: 1860457 - RNA, 21 nt, Salmonella typhimurium LT2
ugccauacuuuuccagcgccu

SEQ ID NO: 1860458 - RNA, 14 nt, Salmonella typhimurium LT2
ugccauauuuucca

SEQ ID NO: 1860459 - RNA, 16 nt, Salmonella typhimurium LT2
ugccauauuuuccagu

SEQ ID NO: 1860460 - RNA, 20 nt, Salmonella typhimurium LT2
ugcccaaauaaaagccgcca

SEQ ID NO: 1860461 - RNA, 15 nt, Salmonella typhimurium LT2
ugcccacccgggccg

SEQ ID NO: 1860462 - RNA, 17 nt, Salmonella typhimurium LT2
ugcccaccgauuucagc

SEQ ID NO: 1860463 - RNA, 17 nt, Salmonella typhimurium LT2
ugccagauuuuccaggc

SEQ ID NO: 1860464 - RNA, 15 nt, Salmonella typhimurium LT2
ugccagcacagcggu

SEQ ID NO: 1860465 - RNA, 13 nt, Salmonella typhimurium LT2
ugccagcaccagc

SEQ ID NO: 1860466 - RNA, 12 nt, Salmonella typhimurium LT2
ugccagcaccag

SEQ ID NO: 1860467 - RNA, 16 nt, Salmonella typhimurium LT2
ugccagcaccagcagu

SEQ ID NO: 1860468 - RNA, 13 nt, Salmonella typhimurium LT2
ugccagcacuaac

SEQ ID NO: 1860469 - RNA, 18 nt, Salmonella typhimurium LT2
ugccagcagauuuucauc

SEQ ID NO: 1860470 - RNA, 20 nt, Salmonella typhimurium LT2
ugccagcagauuuucauccg

SEQ ID NO: 1860471 - RNA, 14 nt, Salmonella typhimurium LT2
ugccagcauuaacc

SEQ ID NO: 1860472 - RNA, 20 nt, Salmonella typhimurium LT2
ugccagcucaaaucgcggcg

SEQ ID NO: 1860473 - RNA, 19 nt, Salmonella typhimurium LT2
ugccagcucguuauuuccg

SEQ ID NO: 1860474 - RNA, 18 nt, Salmonella typhimurium LT2
ugccaggaagucagcuuc

SEQ ID NO: 1860475 - RNA, 19 nt, Salmonella typhimurium LT2
ugccaggcauaccuccucu

SEQ ID NO: 1860476 - RNA, 11 nt, Salmonella typhimurium LT2
ugccaggcauu

SEQ ID NO: 1860477 - RNA, 23 nt, Salmonella typhimurium LT2
ugcccaguuuacccagcgaaugc

SEQ ID NO: 1860478 - RNA, 13 nt, Salmonella typhimurium LT2
ugcccaguuuacc

SEQ ID NO: 1860479 - RNA, 12 nt, Salmonella typhimurium LT2
ugcccagcgcga

SEQ ID NO: 1860480 - RNA, 15 nt, Salmonella typhimurium LT2
ugcccauuuccugca

SEQ ID NO: 1860481 - RNA, 19 nt, Salmonella typhimurium LT2
ugcccauuuccugcauuaa

SEQ ID NO: 1860482 - RNA, 20 nt, Salmonella typhimurium LT2
ugcccauuucagcauuaaga

SEQ ID NO: 1860483 - RNA, 13 nt, Salmonella typhimurium LT2
ugcccauuccgcc

SEQ ID NO: 1860484 - RNA, 18 nt, Salmonella typhimurium LT2
ugcccauucuucgucguc

SEQ ID NO: 1860485 - RNA, 21 nt, Salmonella typhimurium LT2
ugccccuuccgccacggcuuu

SEQ ID NO: 1860486 - RNA, 20 nt, Salmonella typhimurium LT2
ugcccgccaggguaucauca

SEQ ID NO: 1860487 - RNA, 14 nt, Salmonella typhimurium LT2
ugcccgccagcggg

SEQ ID NO: 1860488 - RNA, 13 nt, Salmonella typhimurium LT2
ugcccuuucuuau

SEQ ID NO: 1860489 - RNA, 14 nt, Salmonella typhimurium LT2
ugcccuuucuuaug

SEQ ID NO: 1860490 - RNA, 23 nt, Salmonella typhimurium LT2
ugcccuuuuugcauucgcuccuc

SEQ ID NO: 1860491 - RNA, 19 nt, Salmonella typhimurium LT2
ugcccuucuaccgucagca

SEQ ID NO: 1860492 - RNA, 15 nt, Salmonella typhimurium LT2
ugcccuuccagcucu

SEQ ID NO: 1860493 - RNA, 17 nt, Salmonella typhimurium LT2
ugcccuuaaauccggcc

SEQ ID NO: 1860494 - RNA, 18 nt, Salmonella typhimurium LT2
ugcccuuaaauccggccu

SEQ ID NO: 1860495 - RNA, 21 nt, Salmonella typhimurium LT2
ugcccgguuaaggggcaggcg

SEQ ID NO: 1860496 - RNA, 19 nt, Salmonella typhimurium LT2
ugcccgguggcgcugcgcu

SEQ ID NO: 1860497 - RNA, 19 nt, Salmonella typhimurium LT2
ugcccggcgcggcaucauc

SEQ ID NO: 1860498 - RNA, 16 nt, Salmonella typhimurium LT2
ugccgaugacucccag

SEQ ID NO: 1860499 - RNA, 14 nt, Salmonella typhimurium LT2
ugccgaugaaauaa

SEQ ID NO: 1860500 - RNA, 15 nt, Salmonella typhimurium LT2
ugccgaugaaauaau

SEQ ID NO: 1860501 - RNA, 23 nt, Salmonella typhimurium LT2
ugccgaugaucccggcgccgccg

SEQ ID NO: 1860502 - RNA, 22 nt, Salmonella typhimurium LT2
ugccgauuccaugcccaguuca

SEQ ID NO: 1860503 - RNA, 15 nt, Salmonella typhimurium LT2
ugccgauuuucuaug

SEQ ID NO: 1860504 - RNA, 22 nt, Salmonella typhimurium LT2
ugccgcaacagaaacuucugca

SEQ ID NO: 1860505 - RNA, 13 nt, Salmonella typhimurium LT2
ugccgacaggcag

SEQ ID NO: 1860506 - RNA, 18 nt, Salmonella typhimurium LT2
ugccgaccgcucggaagu

SEQ ID NO: 1860507 - RNA, 19 nt, Salmonella typhimurium LT2
ugccgaagaaagcuaucgc

SEQ ID NO: 1860508 - RNA, 22 nt, Salmonella typhimurium LT2
ugccgacaaagagcuccccacg

SEQ ID NO: 1860509 - RNA, 12 nt, Salmonella typhimurium LT2
ugcgcacucaga

SEQ ID NO: 1860510 - RNA, 22 nt, Salmonella typhimurium LT2
ugcgcagccacggcgcacacgc

SEQ ID NO: 1860511 - RNA, 24 nt, Salmonella typhimurium LT2
ugcgcagccacggcgcacacgccc

SEQ ID NO: 1860512 - RNA, 15 nt, Salmonella typhimurium LT2
ugcgcacgccagcgg

SEQ ID NO: 1860513 - RNA, 20 nt, Salmonella typhimurium LT2
ugcgcagccccagcgccagc

SEQ ID NO: 1860514 - RNA, 18 nt, Salmonella typhimurium LT2
ugcgcagcguuuccagac

SEQ ID NO: 1860515 - RNA, 23 nt, Salmonella typhimurium LT2
ugcgaucguaaucacccgcuucc

SEQ ID NO: 1860516 - RNA, 19 nt, Salmonella typhimurium LT2
ugcgaucuccuuuaaugaa

SEQ ID NO: 1860517 - RNA, 17 nt, Salmonella typhimurium LT2
ugcgaugaucuugcuca

SEQ ID NO: 1860518 - RNA, 14 nt, Salmonella typhimurium LT2
ugcgauacagcgua

SEQ ID NO: 1860519 - RNA, 19 nt, Salmonella typhimurium LT2
ugcgaguuaucuuuuauuu

SEQ ID NO: 1860520 - RNA, 19 nt, Salmonella typhimurium LT2
ugcgauagcugguaaauaa

SEQ ID NO: 1860521 - RNA, 18 nt, Salmonella typhimurium LT2
ugcgcaacguuucuuuca

SEQ ID NO: 1860522 - RNA, 22 nt, Salmonella typhimurium LT2
ugcgcaacguuucuuucaucag

SEQ ID NO: 1860523 - RNA, 20 nt, Salmonella typhimurium LT2
ugcgcaaggccguuauccag

SEQ ID NO: 1860524 - RNA, 13 nt, Salmonella typhimurium LT2
ugcgcaagaaaag

SEQ ID NO: 1860525 - RNA, 16 nt, Salmonella typhimurium LT2
ugcgaauaacaucauc

SEQ ID NO: 1860526 - RNA, 18 nt, Salmonella typhimurium LT2
ugcgaauaacaucauccg

SEQ ID NO: 1860527 - RNA, 24 nt, Salmonella typhimurium LT2
ugcgaauaaucgccggacggcgca

SEQ ID NO: 1860528 - RNA, 13 nt, Salmonella typhimurium LT2
ugcgaagguggcg

SEQ ID NO: 1860529 - RNA, 15 nt, Salmonella typhimurium LT2
ugcgaagguggcgga

SEQ ID NO: 1860530 - RNA, 17 nt, Salmonella typhimurium LT2
ugcgaagguuaagaggg

SEQ ID NO: 1860531 - RNA, 21 nt, Salmonella typhimurium LT2
ugcgaacgauaccauccccuu

SEQ ID NO: 1860532 - RNA, 14 nt, Salmonella typhimurium LT2
ugcgaaccgcacag

SEQ ID NO: 1860533 - RNA, 19 nt, Salmonella typhimurium LT2
ugcgaaagccucuuccgcc

SEQ ID NO: 1860534 - RNA, 14 nt, Salmonella typhimurium LT2
ugcgaaagccucuu

SEQ ID NO: 1860535 - RNA, 11 nt, Salmonella typhimurium LT2
ugcgagaaaaa

SEQ ID NO: 1860536 - RNA, 22 nt, Salmonella typhimurium LT2
ugcgacgcgcucaccuccgcca

SEQ ID NO: 1860537 - RNA, 21 nt, Salmonella typhimurium LT2
ugcgaccacggguagagcuuu

SEQ ID NO: 1860538 - RNA, 15 nt, Salmonella typhimurium LT2
ugcgacaucagccag

SEQ ID NO: 1860539 - RNA, 21 nt, Salmonella typhimurium LT2
ugcgacaucagccagccgcca

SEQ ID NO: 1860540 - RNA, 12 nt, Salmonella typhimurium LT2
ugcgagaaaaag

SEQ ID NO: 1860541 - RNA, 17 nt, Salmonella typhimurium LT2
ugcgacuccaggaacag

SEQ ID NO: 1860542 - RNA, 18 nt, Salmonella typhimurium LT2
ugcgacugaaaaucaaaa

SEQ ID NO: 1860543 - RNA, 21 nt, Salmonella typhimurium LT2
ugcgagacggcggaaagggcc

SEQ ID NO: 1860544 - RNA, 16 nt, Salmonella typhimurium LT2
ugcgagcgucagucac

SEQ ID NO: 1860545 - RNA, 18 nt, Salmonella typhimurium LT2
ugcgagcaguucagcagc

SEQ ID NO: 1860546 - RNA, 17 nt, Salmonella typhimurium LT2
ugcgaggucaccgggcg

SEQ ID NO: 1860547 - RNA, 15 nt, Salmonella typhimurium LT2
ugcgaggucugguca

SEQ ID NO: 1860548 - RNA, 18 nt, Salmonella typhimurium LT2
ugcgagucgucaguucca

SEQ ID NO: 1860549 - RNA, 18 nt, Salmonella typhimurium LT2
ugccguccggcaucacaa

SEQ ID NO: 1860550 - RNA, 21 nt, Salmonella typhimurium LT2
ugccgucgcaggcggccaggc

SEQ ID NO: 1860551 - RNA, 14 nt, Salmonella typhimurium LT2
ugccgucacagaga

SEQ ID NO: 1860552 - RNA, 20 nt, Salmonella typhimurium LT2
ugccgucaacacgcagaccc

SEQ ID NO: 1860553 - RNA, 13 nt, Salmonella typhimurium LT2
ugccguagcgcau

SEQ ID NO: 1860554 - RNA, 16 nt, Salmonella typhimurium LT2
ugccgggaaaacggcc

SEQ ID NO: 1860555 - RNA, 20 nt, Salmonella typhimurium LT2
ugccgcccagggaaagauca

SEQ ID NO: 1860556 - RNA, 20 nt, Salmonella typhimurium LT2
ugccgccauucgcuuccgcc

SEQ ID NO: 1860557 - RNA, 15 nt, Salmonella typhimurium LT2
ugccgccauuuuauc

SEQ ID NO: 1860558 - RNA, 21 nt, Salmonella typhimurium LT2
ugccgccaguuguucaacaug

SEQ ID NO: 1860559 - RNA, 22 nt, Salmonella typhimurium LT2
ugccggauggcggcugaugccc

SEQ ID NO: 1860560 - RNA, 21 nt, Salmonella typhimurium LT2
ugccgccggcuucuuccggcc

SEQ ID NO: 1860561 - RNA, 16 nt, Salmonella typhimurium LT2
ugccuugcgaauggag

SEQ ID NO: 1860562 - RNA, 21 nt, Salmonella typhimurium LT2
ugccuuguuucgucaauauuu

SEQ ID NO: 1860563 - RNA, 12 nt, Salmonella typhimurium LT2
ugccuuucagau

SEQ ID NO: 1860564 - RNA, 16 nt, Salmonella typhimurium LT2
ugccuuauucacagcg

SEQ ID NO: 1860565 - RNA, 14 nt, Salmonella typhimurium LT2
ugccugccgccucc

SEQ ID NO: 1860566 - RNA, 22 nt, Salmonella typhimurium LT2
ugccugccgucgcggcuuucag

SEQ ID NO: 1860567 - RNA, 18 nt, Salmonella typhimurium LT2
ugccugucgucaccugua

SEQ ID NO: 1860568 - RNA, 18 nt, Salmonella typhimurium LT2
ugccuguguaucgcccug

SEQ ID NO: 1860569 - RNA, 16 nt, Salmonella typhimurium LT2
ugccucacccugaaau

SEQ ID NO: 1860570 - RNA, 15 nt, Salmonella typhimurium LT2
ugccucacccugaaa

SEQ ID NO: 1860571 - RNA, 19 nt, Salmonella typhimurium LT2
ugccucauuaaaaaaacau

SEQ ID NO: 1860572 - RNA, 20 nt, Salmonella typhimurium LT2
ugccugacgaaaacccgcca

SEQ ID NO: 1860573 - RNA, 22 nt, Salmonella typhimurium LT2
ugccugacgaaaacccgccacc

SEQ ID NO: 1860574 - RNA, 15 nt, Salmonella typhimurium LT2
ugccugacgccacca

SEQ ID NO: 1860575 - RNA, 15 nt, Salmonella typhimurium LT2
ugccugaccggcauu

SEQ ID NO: 1860576 - RNA, 18 nt, Salmonella typhimurium LT2
ugccugaccggcauuuuc

SEQ ID NO: 1860577 - RNA, 15 nt, Salmonella typhimurium LT2
ugccugccgccucca

SEQ ID NO: 1860578 - RNA, 21 nt, Salmonella typhimurium LT2
ugccugccggauuuuucauag

SEQ ID NO: 1860579 - RNA, 15 nt, Salmonella typhimurium LT2
ugccugccgcagaag

SEQ ID NO: 1860580 - RNA, 17 nt, Salmonella typhimurium LT2
ugaaucucuucccagcg

SEQ ID NO: 1860581 - RNA, 18 nt, Salmonella typhimurium LT2
ugaaucucuucccagcga

SEQ ID NO: 1860582 - RNA, 19 nt, Salmonella typhimurium LT2
ugaaucucuucccagcgaa

SEQ ID NO: 1860583 - RNA, 12 nt, Salmonella typhimurium LT2
ugaaugacuguc

SEQ ID NO: 1860584 - RNA, 13 nt, Salmonella typhimurium LT2
ugaaugacugucc

SEQ ID NO: 1860585 - RNA, 22 nt, Salmonella typhimurium LT2
ugaaugacuguccacgacagaa

SEQ ID NO: 1860586 - RNA, 16 nt, Salmonella typhimurium LT2
ugaaugagcaaugaga

SEQ ID NO: 1860587 - RNA, 15 nt, Salmonella typhimurium LT2
ugaaugaguaaccag

SEQ ID NO: 1860588 - RNA, 15 nt, Salmonella typhimurium LT2
ugaaucgccgucagu

SEQ ID NO: 1860589 - RNA, 18 nt, Salmonella typhimurium LT2
ugaauauggccagucccc

SEQ ID NO: 1860590 - RNA, 19 nt, Salmonella typhimurium LT2
ugaauaugguucuccguca

SEQ ID NO: 1860591 - RNA, 22 nt, Salmonella typhimurium LT2
ugaauaucgagcggcaguagca

SEQ ID NO: 1860592 - RNA, 21 nt, Salmonella typhimurium LT2
ugaauauauuggcaggauccc

SEQ ID NO: 1860593 - RNA, 19 nt, Salmonella typhimurium LT2
ucuuucaauccuucuucug

SEQ ID NO: 1860594 - RNA, 19 nt, Salmonella typhimurium LT2
ugaauaccagcggcaaaca

SEQ ID NO: 1860595 - RNA, 18 nt, Salmonella typhimurium LT2
ugaauaccuucacaaaaa

SEQ ID NO: 1860596 - RNA, 16 nt, Salmonella typhimurium LT2
ugaauaauuucuucuu

SEQ ID NO: 1860597 - RNA, 12 nt, Salmonella typhimurium LT2
ugaaugccaucc

SEQ ID NO: 1860598 - RNA, 19 nt, Salmonella typhimurium LT2
ugaaugccccagcgcugcu

SEQ ID NO: 1860599 - RNA, 22 nt, Salmonella typhimurium LT2
ugaauuuaauggucuuaaaugc

SEQ ID NO: 1860600 - RNA, 18 nt, Salmonella typhimurium LT2
ugaauugccauuguucgc

SEQ ID NO: 1860601 - RNA, 11 nt, Salmonella typhimurium LT2
ugacaauaagu

SEQ ID NO: 1860602 - RNA, 14 nt, Salmonella typhimurium LT2
ugacaacaaaaaga

SEQ ID NO: 1860603 - RNA, 14 nt, Salmonella typhimurium LT2
ugacaacaaaucca

SEQ ID NO: 1860604 - RNA, 17 nt, Salmonella typhimurium LT2
ugacaacuauugcugcc

SEQ ID NO: 1860605 - RNA, 11 nt, Salmonella typhimurium LT2
ugacacagcgu

SEQ ID NO: 1860606 - RNA, 15 nt, Salmonella typhimurium LT2
ugacacagaggaaua

SEQ ID NO: 1860607 - RNA, 15 nt, Salmonella typhimurium LT2
ugacacaucaccucc

SEQ ID NO: 1860608 - RNA, 18 nt, Salmonella typhimurium LT2
ugacaccacggcaauaaa

SEQ ID NO: 1860609 - RNA, 16 nt, Salmonella typhimurium LT2
ugacaaaaauuaaaac

SEQ ID NO: 1860610 - RNA, 16 nt, Salmonella typhimurium LT2
ugacaaauaaaauaag

SEQ ID NO: 1860611 - RNA, 22 nt, Salmonella typhimurium LT2
ugacaaauaaaauaagcaauua

SEQ ID NO: 1860612 - RNA, 18 nt, Salmonella typhimurium LT2
ugaccaagcgucagcaug

SEQ ID NO: 1860613 - RNA, 20 nt, Salmonella typhimurium LT2
ugaccaaggcaaaguauccc

SEQ ID NO: 1860614 - RNA, 22 nt, Salmonella typhimurium LT2
ugaccaguuguuccgcgcugau

SEQ ID NO: 1860615 - RNA, 17 nt, Salmonella typhimurium LT2
ugaccaucaaauaauac

SEQ ID NO: 1860616 - RNA, 18 nt, Salmonella typhimurium LT2
ugaccacgacgaccgcca

SEQ ID NO: 1860617 - RNA, 14 nt, Salmonella typhimurium LT2
ugaccacgccgccg

SEQ ID NO: 1860618 - RNA, 18 nt, Salmonella typhimurium LT2
ugaccacgccgccgcguc

SEQ ID NO: 1860619 - RNA, 13 nt, Salmonella typhimurium LT2
ugaccaccgcauc

SEQ ID NO: 1860620 - RNA, 14 nt, Salmonella typhimurium LT2
ugacacggaacaac

SEQ ID NO: 1860621 - RNA, 14 nt, Salmonella typhimurium LT2
ugacacucauccag

SEQ ID NO: 1860622 - RNA, 21 nt, Salmonella typhimurium LT2
ugacacuauauugcgaauaaa

SEQ ID NO: 1860623 - RNA, 15 nt, Salmonella typhimurium LT2
ugacacuaucuccuu

SEQ ID NO: 1860624 - RNA, 23 nt, Salmonella typhimurium LT2
ugacacuaucuccuuccggcuuu

SEQ ID NO: 1860625 - RNA, 13 nt, Salmonella typhimurium LT2
ugacacucaucca

SEQ ID NO: 1860626 - RNA, 22 nt, Salmonella typhimurium LT2
ugacagacaggccuucuucaua

SEQ ID NO: 1860627 - RNA, 21 nt, Salmonella typhimurium LT2
ugacagcaaguugcgccacug

SEQ ID NO: 1860628 - RNA, 19 nt, Salmonella typhimurium LT2
ugacagcacaauuccggcc

SEQ ID NO: 1860629 - RNA, 21 nt, Salmonella typhimurium LT2
ugacaggggguugcucuuucu

SEQ ID NO: 1860630 - RNA, 14 nt, Salmonella typhimurium LT2
ugaccuacaggccg

SEQ ID NO: 1860631 - RNA, 13 nt, Salmonella typhimurium LT2
ugaccucauccau

SEQ ID NO: 1860632 - RNA, 15 nt, Salmonella typhimurium LT2
ugacgacuaaaaaaa

SEQ ID NO: 1860633 - RNA, 17 nt, Salmonella typhimurium LT2
ugaccugaauccagacu

SEQ ID NO: 1860634 - RNA, 16 nt, Salmonella typhimurium LT2
ugacgcucuccuccaa

SEQ ID NO: 1860635 - RNA, 19 nt, Salmonella typhimurium LT2
ugacgauacgucauaucau

SEQ ID NO: 1860636 - RNA, 18 nt, Salmonella typhimurium LT2
ugacgauaucaucuugcu

SEQ ID NO: 1860637 - RNA, 15 nt, Salmonella typhimurium LT2
ugacgauaugcugcc

SEQ ID NO: 1860638 - RNA, 13 nt, Salmonella typhimurium LT2
ugacccagacaaa

SEQ ID NO: 1860639 - RNA, 13 nt, Salmonella typhimurium LT2
ugacccagcgcga

SEQ ID NO: 1860640 - RNA, 19 nt, Salmonella typhimurium LT2
ugaccgguaagcccauggc

SEQ ID NO: 1860641 - RNA, 14 nt, Salmonella typhimurium LT2
ugaccgucauccac

SEQ ID NO: 1860642 - RNA, 14 nt, Salmonella typhimurium LT2
ugaccguccccagc

SEQ ID NO: 1860643 - RNA, 18 nt, Salmonella typhimurium LT2
ugaccgguaagcccaugg

SEQ ID NO: 1860644 - RNA, 21 nt, Salmonella typhimurium LT2
ugacugccguauaauccagcu

SEQ ID NO: 1860645 - RNA, 13 nt, Salmonella typhimurium LT2
ugacugcugucau

SEQ ID NO: 1860646 - RNA, 22 nt, Salmonella typhimurium LT2
ugacugguaaaacgauauugcc

SEQ ID NO: 1860647 - RNA, 19 nt, Salmonella typhimurium LT2
ugacugguuuguugcgucu

SEQ ID NO: 1860648 - RNA, 16 nt, Salmonella typhimurium LT2
ugacggcgcugucacu

SEQ ID NO: 1860649 - RNA, 22 nt, Salmonella typhimurium LT2
ugacggcgcuuuaaacauauaa

SEQ ID NO: 1860650 - RNA, 20 nt, Salmonella typhimurium LT2
ugacucaaaaagaggaaagc

SEQ ID NO: 1860651 - RNA, 14 nt, Salmonella typhimurium LT2
ugacggaaaccagc

SEQ ID NO: 1860652 - RNA, 16 nt, Salmonella typhimurium LT2
ugacggaaaccagcau

SEQ ID NO: 1860653 - RNA, 14 nt, Salmonella typhimurium LT2
ugacgcuuugcauu

SEQ ID NO: 1860654 - RNA, 17 nt, Salmonella typhimurium LT2
ugacgcuuuugugcccg

SEQ ID NO: 1860655 - RNA, 15 nt, Salmonella typhimurium LT2
ugagaaaaggaagaa

SEQ ID NO: 1860656 - RNA, 23 nt, Salmonella typhimurium LT2
ugagaaaaggaagaauaaauaac

SEQ ID NO: 1860657 - RNA, 14 nt, Salmonella typhimurium LT2
ugagaaaagcagag

SEQ ID NO: 1860658 - RNA, 12 nt, Salmonella typhimurium LT2
ugagaagaaaaa

SEQ ID NO: 1860659 - RNA, 12 nt, Salmonella typhimurium LT2
ugacuuuuacgc

SEQ ID NO: 1860660 - RNA, 21 nt, Salmonella typhimurium LT2
ugacuuuuuucaaccucacug

SEQ ID NO: 1860661 - RNA, 21 nt, Salmonella typhimurium LT2
ugacuuuaccgguuucaaucc

SEQ ID NO: 1860662 - RNA, 12 nt, Salmonella typhimurium LT2
ugacuuuccagu

SEQ ID NO: 1860663 - RNA, 14 nt, Salmonella typhimurium LT2
ugagccagugagcg

SEQ ID NO: 1860664 - RNA, 20 nt, Salmonella typhimurium LT2
ugagcagaucagcacgcgcc

SEQ ID NO: 1860665 - RNA, 17 nt, Salmonella typhimurium LT2
ugagcagccagcccagc

SEQ ID NO: 1860666 - RNA, 19 nt, Salmonella typhimurium LT2
ugagcagacauauuuucaa

SEQ ID NO: 1860667 - RNA, 18 nt, Salmonella typhimurium LT2
ugagaucgguaauuucca

SEQ ID NO: 1860668 - RNA, 21 nt, Salmonella typhimurium LT2
ugagauauuuugucaggccgc

SEQ ID NO: 1860669 - RNA, 19 nt, Salmonella typhimurium LT2
ugagaugcaggccaagcag

SEQ ID NO: 1860670 - RNA, 21 nt, Salmonella typhimurium LT2
ugagaugcaggccaagcagcg

SEQ ID NO: 1860671 - RNA, 20 nt, Salmonella typhimurium LT2
ugagauugauaaucagcaag

SEQ ID NO: 1860672 - RNA, 14 nt, Salmonella typhimurium LT2
ugagauuacugcgu

SEQ ID NO: 1860673 - RNA, 14 nt, Salmonella typhimurium LT2
ugagaagggcagau

SEQ ID NO: 1860674 - RNA, 20 nt, Salmonella typhimurium LT2
ugagauaauuuaugauuuua

SEQ ID NO: 1860675 - RNA, 18 nt, Salmonella typhimurium LT2
ugagauauggcacuuuca

SEQ ID NO: 1860676 - RNA, 21 nt, Salmonella typhimurium LT2
ugaggccguuuuuuuguuuua

SEQ ID NO: 1860677 - RNA, 14 nt, Salmonella typhimurium LT2
ugaggcaagaggga

SEQ ID NO: 1860678 - RNA, 22 nt, Salmonella typhimurium LT2
ugaggauugccgccuugguugc

SEQ ID NO: 1860679 - RNA, 17 nt, Salmonella typhimurium LT2
ugaggcgacaaucucac

SEQ ID NO: 1860680 - RNA, 12 nt, Salmonella typhimurium LT2
ugaggcgcagcc

SEQ ID NO: 1860681 - RNA, 17 nt, Salmonella typhimurium LT2
ugaggcguugcuccagc

SEQ ID NO: 1860682 - RNA, 19 nt, Salmonella typhimurium LT2
ugaggcuuugagcgucagc

SEQ ID NO: 1860683 - RNA, 20 nt, Salmonella typhimurium LT2
ugagguggccgagaggcuga

SEQ ID NO: 1860684 - RNA, 20 nt, Salmonella typhimurium LT2
ugagguuaaucuucagggcg

SEQ ID NO: 1860685 - RNA, 19 nt, Salmonella typhimurium LT2
ugaguaaagagaucaauuu

SEQ ID NO: 1860686 - RNA, 13 nt, Salmonella typhimurium LT2
ugaguaaauaaaa

SEQ ID NO: 1860687 - RNA, 20 nt, Salmonella typhimurium LT2
ugagguugagauccugaucc

SEQ ID NO: 1860688 - RNA, 19 nt, Salmonella typhimurium LT2
ugaggagucauugcuaugc

SEQ ID NO: 1860689 - RNA, 16 nt, Salmonella typhimurium LT2
ugaggaugguagaggu

SEQ ID NO: 1860690 - RNA, 13 nt, Salmonella typhimurium LT2
ugagcucuuucug

SEQ ID NO: 1860691 - RNA, 15 nt, Salmonella typhimurium LT2
ugagcucucuuccag

SEQ ID NO: 1860692 - RNA, 19 nt, Salmonella typhimurium LT2
ugagcggcucauccagcaa

SEQ ID NO: 1860693 - RNA, 13 nt, Salmonella typhimurium LT2
ugagcuauuucag

SEQ ID NO: 1860694 - RNA, 14 nt, Salmonella typhimurium LT2
ugagcuauuucagu

SEQ ID NO: 1860695 - RNA, 15 nt, Salmonella typhimurium LT2
ugagcuauuucagug

SEQ ID NO: 1860696 - RNA, 18 nt, Salmonella typhimurium LT2
ugagcggcucauccagca

SEQ ID NO: 1860697 - RNA, 23 nt, Salmonella typhimurium LT2
ugagcguuacgccaucagggacg

SEQ ID NO: 1860698 - RNA, 19 nt, Salmonella typhimurium LT2
ugagcguuacgggaacaga

SEQ ID NO: 1860699 - RNA, 14 nt, Salmonella typhimurium LT2
ugagcgucgccaga

SEQ ID NO: 1860700 - RNA, 19 nt, Salmonella typhimurium LT2
ugagcgugaucgucuccug

SEQ ID NO: 1860701 - RNA, 13 nt, Salmonella typhimurium LT2
ugagcguggcgua

SEQ ID NO: 1860702 - RNA, 18 nt, Salmonella typhimurium LT2
ugcaggccaagcagcgcc

SEQ ID NO: 1860703 - RNA, 15 nt, Salmonella typhimurium LT2
ugcaggccggaacga

SEQ ID NO: 1860704 - RNA, 18 nt, Salmonella typhimurium LT2
ugcaggcauaaaaaagag

SEQ ID NO: 1860705 - RNA, 18 nt, Salmonella typhimurium LT2
ugcagggaauaagcaccc

SEQ ID NO: 1860706 - RNA, 13 nt, Salmonella typhimurium LT2
ugcaggaaggucu

SEQ ID NO: 1860707 - RNA, 20 nt, Salmonella typhimurium LT2
ugcaggacagacagacguug

SEQ ID NO: 1860708 - RNA, 16 nt, Salmonella typhimurium LT2
ugcagcucgcacugau

SEQ ID NO: 1860709 - RNA, 14 nt, Salmonella typhimurium LT2
ugcagcguuuccag

SEQ ID NO: 1860710 - RNA, 15 nt, Salmonella typhimurium LT2
ugcagcguuuccagc

SEQ ID NO: 1860711 - RNA, 18 nt, Salmonella typhimurium LT2
ugcagcuccacaaauagc

SEQ ID NO: 1860712 - RNA, 16 nt, Salmonella typhimurium LT2
ugcagcgcuguccaga

SEQ ID NO: 1860713 - RNA, 13 nt, Salmonella typhimurium LT2
ugcagcgcagcgg

SEQ ID NO: 1860714 - RNA, 21 nt, Salmonella typhimurium LT2
ugcagcgccuggcgguaugaa

SEQ ID NO: 1860715 - RNA, 16 nt, Salmonella typhimurium LT2
ugcagcgccgccugua

SEQ ID NO: 1860716 - RNA, 17 nt, Salmonella typhimurium LT2
ugcagcagcuucgccag

SEQ ID NO: 1860717 - RNA, 23 nt, Salmonella typhimurium LT2
ugcagcaacugauucaaaaggug

SEQ ID NO: 1860718 - RNA, 24 nt, Salmonella typhimurium LT2
ugcagcaagcggcugucaucaaug

SEQ ID NO: 1860719 - RNA, 14 nt, Salmonella typhimurium LT2
ugcagccaggccau

SEQ ID NO: 1860720 - RNA, 12 nt, Salmonella typhimurium LT2
ugcagccaggcc

SEQ ID NO: 1860721 - RNA, 14 nt, Salmonella typhimurium LT2
ugcagaugcugcug

SEQ ID NO: 1860722 - RNA, 15 nt, Salmonella typhimurium LT2
ugcagauuuugcucc

SEQ ID NO: 1860723 - RNA, 12 nt, Salmonella typhimurium LT2
ugcagcaaauac

SEQ ID NO: 1860724 - RNA, 18 nt, Salmonella typhimurium LT2
ugcagaccuuuccaggau

SEQ ID NO: 1860725 - RNA, 21 nt, Salmonella typhimurium LT2
ugcaauaaaauauccuccacc

SEQ ID NO: 1860726 - RNA, 13 nt, Salmonella typhimurium LT2
ugcaaagaaaaac

SEQ ID NO: 1860727 - RNA, 13 nt, Salmonella typhimurium LT2
ugcaauggcaacg

SEQ ID NO: 1860728 - RNA, 18 nt, Salmonella typhimurium LT2
ugcaaucuuuacccggcg

SEQ ID NO: 1860729 - RNA, 16 nt, Salmonella typhimurium LT2
ugcacaaucgccagcc

SEQ ID NO: 1860730 - RNA, 23 nt, Salmonella typhimurium LT2
ugcacaauuuuagccgcaucuuc

SEQ ID NO: 1860731 - RNA, 22 nt, Salmonella typhimurium LT2
ugcacaccccgcgccgcugaga

SEQ ID NO: 1860732 - RNA, 15 nt, Salmonella typhimurium LT2
ugcacaaaauacugu

SEQ ID NO: 1860733 - RNA, 16 nt, Salmonella typhimurium LT2
ugcacaaaauacuguu

SEQ ID NO: 1860734 - RNA, 15 nt, Salmonella typhimurium LT2
ugcacaauaccaaua

SEQ ID NO: 1860735 - RNA, 17 nt, Salmonella typhimurium LT2
ugcacggcgucauccac

SEQ ID NO: 1860736 - RNA, 17 nt, Salmonella typhimurium LT2
ugcacugguagaaaaac

SEQ ID NO: 1860737 - RNA, 21 nt, Salmonella typhimurium LT2
ugcacuucgccgggauaaaac

SEQ ID NO: 1860738 - RNA, 23 nt, Salmonella typhimurium LT2
ugcacuucgccgggauaaaacac

SEQ ID NO: 1860739 - RNA, 15 nt, Salmonella typhimurium LT2
ugcagaacaccgcgu

SEQ ID NO: 1860740 - RNA, 16 nt, Salmonella typhimurium LT2
ugcagaaaggcgugca

SEQ ID NO: 1860741 - RNA, 19 nt, Salmonella typhimurium LT2
ugcacauguuucagcaccu

SEQ ID NO: 1860742 - RNA, 12 nt, Salmonella typhimurium LT2
ugcaccaaaucc

SEQ ID NO: 1860743 - RNA, 16 nt, Salmonella typhimurium LT2
ugcacgaacugcugcc

SEQ ID NO: 1860744 - RNA, 13 nt, Salmonella typhimurium LT2
ugcacagucugca

SEQ ID NO: 1860745 - RNA, 18 nt, Salmonella typhimurium LT2
ugcacaucgccauuaaaa

SEQ ID NO: 1860746 - RNA, 14 nt, Salmonella typhimurium LT2
ugaguguuacucuu

SEQ ID NO: 1860747 - RNA, 14 nt, Salmonella typhimurium LT2
ugaguguaauacuc

SEQ ID NO: 1860748 - RNA, 20 nt, Salmonella typhimurium LT2
ugauauaccguccagacucc

SEQ ID NO: 1860749 - RNA, 18 nt, Salmonella typhimurium LT2
ugauauacgaagcgccau

SEQ ID NO: 1860750 - RNA, 20 nt, Salmonella typhimurium LT2
ugauauagccuucaauaagu

SEQ ID NO: 1860751 - RNA, 23 nt, Salmonella typhimurium LT2
ugagugcaaucuuuacccggcgc

SEQ ID NO: 1860752 - RNA, 23 nt, Salmonella typhimurium LT2
ugauauugcguaagcagcugcuu

SEQ ID NO: 1860753 - RNA, 18 nt, Salmonella typhimurium LT2
ugauauugcauaggggca

SEQ ID NO: 1860754 - RNA, 16 nt, Salmonella typhimurium LT2
ugauaucgccccagaa

SEQ ID NO: 1860755 - RNA, 23 nt, Salmonella typhimurium LT2
ugaucagcaaaauaguguugaau

SEQ ID NO: 1860756 - RNA, 23 nt, Salmonella typhimurium LT2
ugaucacgguacgcaucaccagg

SEQ ID NO: 1860757 - RNA, 17 nt, Salmonella typhimurium LT2
ugauccuccugcagacu

SEQ ID NO: 1860758 - RNA, 23 nt, Salmonella typhimurium LT2
ugauccgcccccuccaguagcag

SEQ ID NO: 1860759 - RNA, 11 nt, Salmonella typhimurium LT2
ugaucccacca

SEQ ID NO: 1860760 - RNA, 12 nt, Salmonella typhimurium LT2
ugaucccaccag

SEQ ID NO: 1860761 - RNA, 20 nt, Salmonella typhimurium LT2
ugaugcaucagaacaaacuu

SEQ ID NO: 1860762 - RNA, 16 nt, Salmonella typhimurium LT2
ugaugcaucagaacaa

SEQ ID NO: 1860763 - RNA, 13 nt, Salmonella typhimurium LT2
ugaugagaggcga

SEQ ID NO: 1860764 - RNA, 16 nt, Salmonella typhimurium LT2
ugaugauuuaugaaua

SEQ ID NO: 1860765 - RNA, 22 nt, Salmonella typhimurium LT2
ugaugauuaaugcugcaccaca

SEQ ID NO: 1860766 - RNA, 23 nt, Salmonella typhimurium LT2
ugaugauuacucuucauucaugc

SEQ ID NO: 1860767 - RNA, 23 nt, Salmonella typhimurium LT2
ugaugcguuguaccguuuuccag

SEQ ID NO: 1860768 - RNA, 19 nt, Salmonella typhimurium LT2
ugauggagguuguuuuauu

SEQ ID NO: 1860769 - RNA, 16 nt, Salmonella typhimurium LT2
ugaugcuuuuuacauu

SEQ ID NO: 1860770 - RNA, 13 nt, Salmonella typhimurium LT2
ugaugcuugcucg

SEQ ID NO: 1860771 - RNA, 16 nt, Salmonella typhimurium LT2
ugaucgaauucauuac

SEQ ID NO: 1860772 - RNA, 12 nt, Salmonella typhimurium LT2
ugaucgaauuca

SEQ ID NO: 1860773 - RNA, 14 nt, Salmonella typhimurium LT2
ugaucgaaaaugcg

SEQ ID NO: 1860774 - RNA, 17 nt, Salmonella typhimurium LT2
ugaucgauccgcaucag

SEQ ID NO: 1860775 - RNA, 20 nt, Salmonella typhimurium LT2
ugaugacgcgcaggccguca

SEQ ID NO: 1860776 - RNA, 14 nt, Salmonella typhimurium LT2
ugcaaaaaaagaaa

SEQ ID NO: 1860777 - RNA, 18 nt, Salmonella typhimurium LT2
ugcaaaaaaggccagagg

SEQ ID NO: 1860778 - RNA, 14 nt, Salmonella typhimurium LT2
ugcaaacccaucuc

SEQ ID NO: 1860779 - RNA, 16 nt, Salmonella typhimurium LT2
ugauuuggaggccgga

SEQ ID NO: 1860780 - RNA, 21 nt, Salmonella typhimurium LT2
ugauuuuaacaucaccuuuca

SEQ ID NO: 1860781 - RNA, 15 nt, Salmonella typhimurium LT2
ugauucgcuggccuc

SEQ ID NO: 1860782 - RNA, 22 nt, Salmonella typhimurium LT2
ugauucgcccguuguccgccag

SEQ ID NO: 1860783 - RNA, 16 nt, Salmonella typhimurium LT2
ugauucuacucugcuc

SEQ ID NO: 1860784 - RNA, 20 nt, Salmonella typhimurium LT2
ugauuuaauucgauaauuuc

SEQ ID NO: 1860785 - RNA, 18 nt, Salmonella typhimurium LT2
ugauggcgcuaagccagc

SEQ ID NO: 1860786 - RNA, 20 nt, Salmonella typhimurium LT2
ugauggcgcgacgcuuauca

SEQ ID NO: 1860787 - RNA, 20 nt, Salmonella typhimurium LT2
ugauggcgcugcgcuuauca

SEQ ID NO: 1860788 - RNA, 17 nt, Salmonella typhimurium LT2
ugauggcgcagcgccau

SEQ ID NO: 1860789 - RNA, 19 nt, Salmonella typhimurium LT2
ugauggcgcagcgccauca

SEQ ID NO: 1860790 - RNA, 13 nt, Salmonella typhimurium LT2
ugauguagucgcu

SEQ ID NO: 1860791 - RNA, 17 nt, Salmonella typhimurium LT2
ugauuaaaagucaacug

SEQ ID NO: 1860792 - RNA, 21 nt, Salmonella typhimurium LT2
ugauguugugacgaaaaaaga

SEQ ID NO: 1860793 - RNA, 18 nt, Salmonella typhimurium LT2
gaccgccgagcccgaggc

SEQ ID NO: 1860794 - RNA, 23 nt, Salmonella typhimurium LT2
gaccgcuuuagccaguagcuggu

SEQ ID NO: 1860795 - RNA, 16 nt, Salmonella typhimurium LT2
gaccgcgcucaccgcc

SEQ ID NO: 1860796 - RNA, 19 nt, Salmonella typhimurium LT2
gaccggcagccguuuuccg

SEQ ID NO: 1860797 - RNA, 19 nt, Salmonella typhimurium LT2
gaccgguaagcccauggca

SEQ ID NO: 1860798 - RNA, 19 nt, Salmonella typhimurium LT2
gaccgucuuugucaagcac

SEQ ID NO: 1860799 - RNA, 20 nt, Salmonella typhimurium LT2
gaccgucgcgcccuccucca

SEQ ID NO: 1860800 - RNA, 15 nt, Salmonella typhimurium LT2
gaccguuucaaagaa

SEQ ID NO: 1860801 - RNA, 12 nt, Salmonella typhimurium LT2
gaccuacaaauu

SEQ ID NO: 1860802 - RNA, 18 nt, Salmonella typhimurium LT2
gaccuggugcucaaucag

SEQ ID NO: 1860803 - RNA, 22 nt, Salmonella typhimurium LT2
gaccugcugguuauuauccauc

SEQ ID NO: 1860804 - RNA, 21 nt, Salmonella typhimurium LT2
gaccugccgcgccugauucau

SEQ ID NO: 1860805 - RNA, 22 nt, Salmonella typhimurium LT2
gaccugcauuucccauccgccg

SEQ ID NO: 1860806 - RNA, 20 nt, Salmonella typhimurium LT2
gaccugcagcuccgcaauuu

SEQ ID NO: 1860807 - RNA, 21 nt, Salmonella typhimurium LT2
gaccucuucuuugagcucccg

SEQ ID NO: 1860808 - RNA, 19 nt, Salmonella typhimurium LT2
gacccugagcucaaacgua

SEQ ID NO: 1860809 - RNA, 17 nt, Salmonella typhimurium LT2
gacccguggcugcgccu

SEQ ID NO: 1860810 - RNA, 21 nt, Salmonella typhimurium LT2
gacccguggcugcgccugcgc

SEQ ID NO: 1860811 - RNA, 16 nt, Salmonella typhimurium LT2
gacccggcguuuucag

SEQ ID NO: 1860812 - RNA, 19 nt, Salmonella typhimurium LT2
gacccgcuuccaguuuugc

SEQ ID NO: 1860813 - RNA, 18 nt, Salmonella typhimurium LT2
gaccgagacccagcgcga

SEQ ID NO: 1860814 - RNA, 22 nt, Salmonella typhimurium LT2
gaccgauagagacugccgccgu

SEQ ID NO: 1860815 - RNA, 16 nt, Salmonella typhimurium LT2
gaccgaucucaugcaa

SEQ ID NO: 1860816 - RNA, 16 nt, Salmonella typhimurium LT2
gaccgauauagccacu

SEQ ID NO: 1860817 - RNA, 18 nt, Salmonella typhimurium LT2
gaccgauauagccacuca

SEQ ID NO: 1860818 - RNA, 23 nt, Salmonella typhimurium LT2
gaccgcaaaccgaauucguccac

SEQ ID NO: 1860819 - RNA, 13 nt, Salmonella typhimurium LT2
gaccgcaaaccga

SEQ ID NO: 1860820 - RNA, 14 nt, Salmonella typhimurium LT2
gacccgaaguggug

SEQ ID NO: 1860821 - RNA, 16 nt, Salmonella typhimurium LT2
gacccccaccauguca

SEQ ID NO: 1860822 - RNA, 12 nt, Salmonella typhimurium LT2
gacccccuccuu

SEQ ID NO: 1860823 - RNA, 18 nt, Salmonella typhimurium LT2
gaccccggccucgcccgc

SEQ ID NO: 1860824 - RNA, 14 nt, Salmonella typhimurium LT2
gaccccgccaggcg

SEQ ID NO: 1860825 - RNA, 22 nt, Salmonella typhimurium LT2
gaccccgccaucagacaggcau

SEQ ID NO: 1860826 - RNA, 12 nt, Salmonella typhimurium LT2
gacccauuuuaa

SEQ ID NO: 1860827 - RNA, 19 nt, Salmonella typhimurium LT2
gacccagcgcgaauuugcc

SEQ ID NO: 1860828 - RNA, 16 nt, Salmonella typhimurium LT2
gacccacuaacugccg

SEQ ID NO: 1860829 - RNA, 21 nt, Salmonella typhimurium LT2
gacccagauugccgauauaca

SEQ ID NO: 1860830 - RNA, 21 nt, Salmonella typhimurium LT2
gaccaugcgugguaaagaagc

SEQ ID NO: 1860831 - RNA, 22 nt, Salmonella typhimurium LT2
gaccaugcgugguaaagaagcc

SEQ ID NO: 1860832 - RNA, 19 nt, Salmonella typhimurium LT2
gaccauauucacgcagcuu

SEQ ID NO: 1860833 - RNA, 19 nt, Salmonella typhimurium LT2
gaccauacgcagcauuucg

SEQ ID NO: 1860834 - RNA, 12 nt, Salmonella typhimurium LT2
gaccauccacca

SEQ ID NO: 1860835 - RNA, 23 nt, Salmonella typhimurium LT2
gaccauccacgggcuaaaugccc

SEQ ID NO: 1860836 - RNA, 19 nt, Salmonella typhimurium LT2
gaccauaaauagccgaccg

SEQ ID NO: 1860837 - RNA, 19 nt, Salmonella typhimurium LT2
gaccauaguccaugcccaa

SEQ ID NO: 1860838 - RNA, 21 nt, Salmonella typhimurium LT2
gacgcgacuuuuuucacccag

SEQ ID NO: 1860839 - RNA, 14 nt, Salmonella typhimurium LT2
gacgcgaagcggcg

SEQ ID NO: 1860840 - RNA, 22 nt, Salmonella typhimurium LT2
gacgcgaauugcgaguaaccuu

SEQ ID NO: 1860841 - RNA, 16 nt, Salmonella typhimurium LT2
gacgccuuagccugaa

SEQ ID NO: 1860842 - RNA, 13 nt, Salmonella typhimurium LT2
gacgcgcaggccg

SEQ ID NO: 1860843 - RNA, 20 nt, Salmonella typhimurium LT2
gacgcgccacuuccagcgcg

SEQ ID NO: 1860844 - RNA, 16 nt, Salmonella typhimurium LT2
gacgcgcuccagcaac

SEQ ID NO: 1860845 - RNA, 15 nt, Salmonella typhimurium LT2
gacgcgcuagcuuca

SEQ ID NO: 1860846 - RNA, 20 nt, Salmonella typhimurium LT2
gacgccguucaaagccgcca

SEQ ID NO: 1860847 - RNA, 20 nt, Salmonella typhimurium LT2
gacgccucguuugcugagca

SEQ ID NO: 1860848 - RNA, 16 nt, Salmonella typhimurium LT2
gacgcauuuggguuca

SEQ ID NO: 1860849 - RNA, 20 nt, Salmonella typhimurium LT2
gacgcauuuuuccguauugc

SEQ ID NO: 1860850 - RNA, 16 nt, Salmonella typhimurium LT2
gacgccaaacccgcca

SEQ ID NO: 1860851 - RNA, 20 nt, Salmonella typhimurium LT2
gacgcaggcgcaaaaaauau

SEQ ID NO: 1860852 - RNA, 17 nt, Salmonella typhimurium LT2
gacgcaucuuuuucccg

SEQ ID NO: 1860853 - RNA, 14 nt, Salmonella typhimurium LT2
gacgcccaaccagu

SEQ ID NO: 1860854 - RNA, 20 nt, Salmonella typhimurium LT2
gacgccagauaaucacgcca

SEQ ID NO: 1860855 - RNA, 18 nt, Salmonella typhimurium LT2
gacgccgaccccggcggg

SEQ ID NO: 1860856 - RNA, 23 nt, Salmonella typhimurium LT2
gacggcgaaucaauuuacgcacu

SEQ ID NO: 1860857 - RNA, 15 nt, Salmonella typhimurium LT2
gacggcgagcguucc

SEQ ID NO: 1860858 - RNA, 23 nt, Salmonella typhimurium LT2
gacggcagucgcuacaaccagcg

SEQ ID NO: 1860859 - RNA, 20 nt, Salmonella typhimurium LT2
gacggcagcgccauccggca

SEQ ID NO: 1860860 - RNA, 20 nt, Salmonella typhimurium LT2
gacggcaggcggcaaucagc

SEQ ID NO: 1860861 - RNA, 21 nt, Salmonella typhimurium LT2
gacgcuuugcauuaucgaugc

SEQ ID NO: 1860862 - RNA, 20 nt, Salmonella typhimurium LT2
gacggcaucggcaucuuccu

SEQ ID NO: 1860863 - RNA, 16 nt, Salmonella typhimurium LT2
gacggcauaagccagc

SEQ ID NO: 1860864 - RNA, 22 nt, Salmonella typhimurium LT2
gacggacucgcgcagaaucagc

SEQ ID NO: 1860865 - RNA, 20 nt, Salmonella typhimurium LT2
gacggacgcagaccaaaauc

SEQ ID NO: 1860866 - RNA, 11 nt, Salmonella typhimurium LT2
gacggaagagu

SEQ ID NO: 1860867 - RNA, 18 nt, Salmonella typhimurium LT2
gacggagaugaucguuuc

SEQ ID NO: 1860868 - RNA, 16 nt, Salmonella typhimurium LT2
gacgcuggcacuggca

SEQ ID NO: 1860869 - RNA, 19 nt, Salmonella typhimurium LT2
gacgcugcgcuuauccggc

SEQ ID NO: 1860870 - RNA, 12 nt, Salmonella typhimurium LT2
gacgcugguugu

SEQ ID NO: 1860871 - RNA, 15 nt, Salmonella typhimurium LT2
gacgcuucagagcag

SEQ ID NO: 1860872 - RNA, 14 nt, Salmonella typhimurium LT2
gacggaaaccagau

SEQ ID NO: 1860873 - RNA, 13 nt, Salmonella typhimurium LT2
gacggaaaccagc

SEQ ID NO: 1860874 - RNA, 14 nt, Salmonella typhimurium LT2
gacggaaaccagca

SEQ ID NO: 1860875 - RNA, 14 nt, Salmonella typhimurium LT2
gacgcugaugaaaa

SEQ ID NO: 1860876 - RNA, 16 nt, Salmonella typhimurium LT2
gacgcugcaacucucc

SEQ ID NO: 1860877 - RNA, 18 nt, Salmonella typhimurium LT2
gacgcugaaccuuccauu

SEQ ID NO: 1860878 - RNA, 18 nt, Salmonella typhimurium LT2
gacgcucuuuggagauuu

SEQ ID NO: 1860879 - RNA, 15 nt, Salmonella typhimurium LT2
gacgcugagagaacu

SEQ ID NO: 1860880 - RNA, 18 nt, Salmonella typhimurium LT2
gacgcuauaacugaaggg

SEQ ID NO: 1860881 - RNA, 14 nt, Salmonella typhimurium LT2
gacgcguuccacuu

SEQ ID NO: 1860882 - RNA, 13 nt, Salmonella typhimurium LT2
gacgcguggugaa

SEQ ID NO: 1860883 - RNA, 16 nt, Salmonella typhimurium LT2
gacgacccuguguagu

SEQ ID NO: 1860884 - RNA, 18 nt, Salmonella typhimurium LT2
gacgacaucgcucaaaac

SEQ ID NO: 1860885 - RNA, 17 nt, Salmonella typhimurium LT2
gacgacaucuuuuccug

SEQ ID NO: 1860886 - RNA, 17 nt, Salmonella typhimurium LT2
gacgaauaauccuuccu

SEQ ID NO: 1860887 - RNA, 16 nt, Salmonella typhimurium LT2
gacgaaaaaucuggcg

SEQ ID NO: 1860888 - RNA, 16 nt, Salmonella typhimurium LT2
gacgcagaccaaaauc

SEQ ID NO: 1860889 - RNA, 12 nt, Salmonella typhimurium LT2
gacgcagcagcu

SEQ ID NO: 1860890 - RNA, 18 nt, Salmonella typhimurium LT2
gacgcagcagcuccccgc

SEQ ID NO: 1860891 - RNA, 21 nt, Salmonella typhimurium LT2
gacgcagacgucaacaccucc

SEQ ID NO: 1860892 - RNA, 16 nt, Salmonella typhimurium LT2
gacgcaacucacgcca

SEQ ID NO: 1860893 - RNA, 20 nt, Salmonella typhimurium LT2
gacgcaauagaguaaugaca

SEQ ID NO: 1860894 - RNA, 13 nt, Salmonella typhimurium LT2
gacgcaagcaucg

SEQ ID NO: 1860895 - RNA, 13 nt, Salmonella typhimurium LT2
gacgaugauaaua

SEQ ID NO: 1860896 - RNA, 18 nt, Salmonella typhimurium LT2
gacgaugaugagauacgu

SEQ ID NO: 1860897 - RNA, 20 nt, Salmonella typhimurium LT2
gacgauggaaagaacacagg

SEQ ID NO: 1860898 - RNA, 13 nt, Salmonella typhimurium LT2
gacgauaaccgga

SEQ ID NO: 1860899 - RNA, 21 nt, Salmonella typhimurium LT2
gacgauacucagccccaggcc

SEQ ID NO: 1860900 - RNA, 13 nt, Salmonella typhimurium LT2
gacgauagucagc

SEQ ID NO: 1860901 - RNA, 14 nt, Salmonella typhimurium LT2
gacgaucgauccag

SEQ ID NO: 1860902 - RNA, 13 nt, Salmonella typhimurium LT2
gacgauacaccuu

SEQ ID NO: 1860903 - RNA, 16 nt, Salmonella typhimurium LT2
gacgagcgaaaaacug

SEQ ID NO: 1860904 - RNA, 21 nt, Salmonella typhimurium LT2
gacgagcgcgucagcgccucc

SEQ ID NO: 1860905 - RNA, 18 nt, Salmonella typhimurium LT2
gacgacuucacccgcggg

SEQ ID NO: 1860906 - RNA, 14 nt, Salmonella typhimurium LT2
gacacaucaucgcu

SEQ ID NO: 1860907 - RNA, 19 nt, Salmonella typhimurium LT2
gacacagcguacaauggca

SEQ ID NO: 1860908 - RNA, 22 nt, Salmonella typhimurium LT2
gacaauuuugauaagagaaaau

SEQ ID NO: 1860909 - RNA, 13 nt, Salmonella typhimurium LT2
gacacccgcagcc

SEQ ID NO: 1860910 - RNA, 14 nt, Salmonella typhimurium LT2
gacacaucaccucc

SEQ ID NO: 1860911 - RNA, 13 nt, Salmonella typhimurium LT2
gacaccacgcagg

SEQ ID NO: 1860912 - RNA, 13 nt, Salmonella typhimurium LT2
gacaccagcccug

SEQ ID NO: 1860913 - RNA, 19 nt, Salmonella typhimurium LT2
gacaccagcgauaaacgcc

SEQ ID NO: 1860914 - RNA, 22 nt, Salmonella typhimurium LT2
gacaccagcgauaaacgccagc

SEQ ID NO: 1860915 - RNA, 11 nt, Salmonella typhimurium LT2
gacacucaucc

SEQ ID NO: 1860916 - RNA, 18 nt, Salmonella typhimurium LT2
gacacuaucacagaugac

SEQ ID NO: 1860917 - RNA, 13 nt, Salmonella typhimurium LT2
gacacuauuuuuc

SEQ ID NO: 1860918 - RNA, 15 nt, Salmonella typhimurium LT2
gacacguuaauuauu

SEQ ID NO: 1860919 - RNA, 21 nt, Salmonella typhimurium LT2
gacacgcucauaaauugcagc

SEQ ID NO: 1860920 - RNA, 17 nt, Salmonella typhimurium LT2
gacagcgccauccggca

SEQ ID NO: 1860921 - RNA, 23 nt, Salmonella typhimurium LT2
gacagcgaacaguguaaacgcca

SEQ ID NO: 1860922 - RNA, 15 nt, Salmonella typhimurium LT2
gacagcccgccagca

SEQ ID NO: 1860923 - RNA, 12 nt, Salmonella typhimurium LT2
gacagcgcgccc

SEQ ID NO: 1860924 - RNA, 18 nt, Salmonella typhimurium LT2
gacagcgcgcccagcagg

SEQ ID NO: 1860925 - RNA, 14 nt, Salmonella typhimurium LT2
gacaggaguauagc

SEQ ID NO: 1860926 - RNA, 19 nt, Salmonella typhimurium LT2
gacagagcucgucaaaaau

SEQ ID NO: 1860927 - RNA, 16 nt, Salmonella typhimurium LT2
gacagagaaccugaac

SEQ ID NO: 1860928 - RNA, 18 nt, Salmonella typhimurium LT2
gacagaacugauuuccgg

SEQ ID NO: 1860929 - RNA, 18 nt, Salmonella typhimurium LT2
gacagaacuuggcuuccu

SEQ ID NO: 1860930 - RNA, 14 nt, Salmonella typhimurium LT2
gacagaccacagau

SEQ ID NO: 1860931 - RNA, 23 nt, Salmonella typhimurium LT2
gacacuugcgcaucgcaucaggg

SEQ ID NO: 1860932 - RNA, 23 nt, Salmonella typhimurium LT2
gacagaacguucaaaacgacugg

SEQ ID NO: 1860933 - RNA, 16 nt, Salmonella typhimurium LT2
gacagaaaaaauagua

SEQ ID NO: 1860934 - RNA, 22 nt, Salmonella typhimurium LT2
gacagcaaguugcgccacugcc

SEQ ID NO: 1860935 - RNA, 13 nt, Salmonella typhimurium LT2
gacagcaaugagc

SEQ ID NO: 1860936 - RNA, 14 nt, Salmonella typhimurium LT2
gacagcaaugagca

SEQ ID NO: 1860937 - RNA, 17 nt, Salmonella typhimurium LT2
gacagauaacaccagcg

SEQ ID NO: 1860938 - RNA, 18 nt, Salmonella typhimurium LT2
gacaauaaacuggcugug

SEQ ID NO: 1860939 - RNA, 17 nt, Salmonella typhimurium LT2
gacaaguauaugucuga

SEQ ID NO: 1860940 - RNA, 19 nt, Salmonella typhimurium LT2
gacaauaacggccucaauu

SEQ ID NO: 1860941 - RNA, 16 nt, Salmonella typhimurium LT2
gacaaucaaucuggcc

SEQ ID NO: 1860942 - RNA, 20 nt, Salmonella typhimurium LT2
gacaaugaagcauaaaaaga

SEQ ID NO: 1860943 - RNA, 21 nt, Salmonella typhimurium LT2
gacaaugacgguuuauaugcu

SEQ ID NO: 1860944 - RNA, 15 nt, Salmonella typhimurium LT2
gacaaugaucagacg

SEQ ID NO: 1860945 - RNA, 15 nt, Salmonella typhimurium LT2
gacaacgcgccgcgg

SEQ ID NO: 1860946 - RNA, 14 nt, Salmonella typhimurium LT2
gacaacgaccagug

SEQ ID NO: 1860947 - RNA, 23 nt, Salmonella typhimurium LT2
gacaacguaaacggcagccgcca

SEQ ID NO: 1860948 - RNA, 11 nt, Salmonella typhimurium LT2
gacaaccagcg

SEQ ID NO: 1860949 - RNA, 15 nt, Salmonella typhimurium LT2
gacaaccagcgaaau

SEQ ID NO: 1860950 - RNA, 22 nt, Salmonella typhimurium LT2
gacaaccagcgaaaugacagcc

SEQ ID NO: 1860951 - RNA, 22 nt, Salmonella typhimurium LT2
gacaaccccaaacaccaacaaa

SEQ ID NO: 1860952 - RNA, 23 nt, Salmonella typhimurium LT2
gacaacccgucaccgccagugca

SEQ ID NO: 1860953 - RNA, 13 nt, Salmonella typhimurium LT2
gacaagcugcgcc

SEQ ID NO: 1860954 - RNA, 21 nt, Salmonella typhimurium LT2
gacaacuucuaauuuuuccag

SEQ ID NO: 1860955 - RNA, 17 nt, Salmonella typhimurium LT2
gacaagaaucacguaau

SEQ ID NO: 1860956 - RNA, 18 nt, Salmonella typhimurium LT2
gacaaacagcgcgcccgc

SEQ ID NO: 1860957 - RNA, 19 nt, Salmonella typhimurium LT2
gacaaacaccgagccagaa

SEQ ID NO: 1860958 - RNA, 21 nt, Salmonella typhimurium LT2
gacaaaauaaagugaaauaaa

SEQ ID NO: 1860959 - RNA, 17 nt, Salmonella typhimurium LT2
gacaaagcucaccugcu

SEQ ID NO: 1860960 - RNA, 16 nt, Salmonella typhimurium LT2
gacaaagagcucccca

SEQ ID NO: 1860961 - RNA, 16 nt, Salmonella typhimurium LT2
gacaacaacaucugug

SEQ ID NO: 1860962 - RNA, 16 nt, Salmonella typhimurium LT2
gacaaauuguuuaaaa

SEQ ID NO: 1860963 - RNA, 13 nt, Salmonella typhimurium LT2
gacaaauuauaaa

SEQ ID NO: 1860964 - RNA, 21 nt, Salmonella typhimurium LT2
gaauuuuccgccgugauucau

SEQ ID NO: 1860965 - RNA, 19 nt, Salmonella typhimurium LT2
gacaaaagauuuaucaauu

SEQ ID NO: 1860966 - RNA, 13 nt, Salmonella typhimurium LT2
gacaaaaauacca

SEQ ID NO: 1860967 - RNA, 17 nt, Salmonella typhimurium LT2
gacaaaaagugaaaaaa

SEQ ID NO: 1860968 - RNA, 22 nt, Salmonella typhimurium LT2
gaauuuguugguuuaaacucug

SEQ ID NO: 1860969 - RNA, 15 nt, Salmonella typhimurium LT2
gaauuuguugguuua

SEQ ID NO: 1860970 - RNA, 20 nt, Salmonella typhimurium LT2
cuuuguaaauacugaacuau

SEQ ID NO: 1860971 - RNA, 22 nt, Salmonella typhimurium LT2
gaccaccgcgcuagugccgcca

SEQ ID NO: 1860972 - RNA, 13 nt, Salmonella typhimurium LT2
gaccaccgcgcua

SEQ ID NO: 1860973 - RNA, 19 nt, Salmonella typhimurium LT2
gaccaccaggauaauggug

SEQ ID NO: 1860974 - RNA, 16 nt, Salmonella typhimurium LT2
gaccaccgcaucggca

SEQ ID NO: 1860975 - RNA, 15 nt, Salmonella typhimurium LT2
gaccacccgcggcca

SEQ ID NO: 1860976 - RNA, 13 nt, Salmonella typhimurium LT2
gaccacgccagcc

SEQ ID NO: 1860977 - RNA, 17 nt, Salmonella typhimurium LT2
gaccacgccagccagcc

SEQ ID NO: 1860978 - RNA, 18 nt, Salmonella typhimurium LT2
gaccacgacgccggagac

SEQ ID NO: 1860979 - RNA, 13 nt, Salmonella typhimurium LT2
gaccaacagcauc

SEQ ID NO: 1860980 - RNA, 15 nt, Salmonella typhimurium LT2
gaccaacagcaucac

SEQ ID NO: 1860981 - RNA, 18 nt, Salmonella typhimurium LT2
gaccaacuuuuguagaga

SEQ ID NO: 1860982 - RNA, 13 nt, Salmonella typhimurium LT2
gaccaagcgucag

SEQ ID NO: 1860983 - RNA, 15 nt, Salmonella typhimurium LT2
gaccaaaaucaaacu

SEQ ID NO: 1860984 - RNA, 23 nt, Salmonella typhimurium LT2
gaccaaaauggcaaguaaaauaa

SEQ ID NO: 1860985 - RNA, 12 nt, Salmonella typhimurium LT2
gaccaauauccg

SEQ ID NO: 1860986 - RNA, 17 nt, Salmonella typhimurium LT2
gaccaagcgucagcaug

SEQ ID NO: 1860987 - RNA, 20 nt, Salmonella typhimurium LT2
gaccaaugacgcuauccgca

SEQ ID NO: 1860988 - RNA, 20 nt, Salmonella typhimurium LT2
gaccaaugcuggcaggcgcg

SEQ ID NO: 1860989 - RNA, 22 nt, Salmonella typhimurium LT2
gaccagcguaccgucucggccu

SEQ ID NO: 1860990 - RNA, 22 nt, Salmonella typhimurium LT2
gaccagcguuggugccgccaga

SEQ ID NO: 1860991 - RNA, 21 nt, Salmonella typhimurium LT2
gaccagcgcaaacaacccggc

SEQ ID NO: 1860992 - RNA, 18 nt, Salmonella typhimurium LT2
gaccagcgacgaugaaau

SEQ ID NO: 1860993 - RNA, 21 nt, Salmonella typhimurium LT2
gaccagcaaaaagaaucgcca

SEQ ID NO: 1860994 - RNA, 23 nt, Salmonella typhimurium LT2
gaccagcaaaaagaaucgccagg

SEQ ID NO: 1860995 - RNA, 11 nt, Salmonella typhimurium LT2
gaccagcaccu

SEQ ID NO: 1860996 - RNA, 15 nt, Salmonella typhimurium LT2
gaccagguacagcuu

SEQ ID NO: 1860997 - RNA, 14 nt, Salmonella typhimurium LT2
gaccaggguuaaaa

SEQ ID NO: 1860998 - RNA, 17 nt, Salmonella typhimurium LT2
gaccaguaagagaacaa

SEQ ID NO: 1860999 - RNA, 20 nt, Salmonella typhimurium LT2
gaccaguuguaaucggcgcc

SEQ ID NO: 1861000 - RNA, 18 nt, Salmonella typhimurium LT2
gaccaguucaccggcggc

SEQ ID NO: 1861001 - RNA, 16 nt, Salmonella typhimurium LT2
gaccaguuauucggca

SEQ ID NO: 1861002 - RNA, 12 nt, Salmonella typhimurium LT2
gacauucccugc

SEQ ID NO: 1861003 - RNA, 15 nt, Salmonella typhimurium LT2
gacauggcgaccggg

SEQ ID NO: 1861004 - RNA, 17 nt, Salmonella typhimurium LT2
gacauggcaauggcuuc

SEQ ID NO: 1861005 - RNA, 15 nt, Salmonella typhimurium LT2
gacauggaguuccag

SEQ ID NO: 1861006 - RNA, 14 nt, Salmonella typhimurium LT2
gacauuaauucagu

SEQ ID NO: 1861007 - RNA, 19 nt, Salmonella typhimurium LT2
gacauuaacgaugccuuau

SEQ ID NO: 1861008 - RNA, 19 nt, Salmonella typhimurium LT2
gacaugagauaaugcuuuc

SEQ ID NO: 1861009 - RNA, 12 nt, Salmonella typhimurium LT2
gacaugcagauc

SEQ ID NO: 1861010 - RNA, 22 nt, Salmonella typhimurium LT2
gacaucacguucgcgcauaccu

SEQ ID NO: 1861011 - RNA, 20 nt, Salmonella typhimurium LT2
gacaucaauagcaagggcaa

SEQ ID NO: 1861012 - RNA, 18 nt, Salmonella typhimurium LT2
gacauccagcauuucgac

SEQ ID NO: 1861013 - RNA, 19 nt, Salmonella typhimurium LT2
gacaucaucgaccuuaauu

SEQ ID NO: 1861014 - RNA, 14 nt, Salmonella typhimurium LT2
gacauccgccaucc

SEQ ID NO: 1861015 - RNA, 23 nt, Salmonella typhimurium LT2
gacauccucuucauaacgacauu

SEQ ID NO: 1861016 - RNA, 13 nt, Salmonella typhimurium LT2
gacaucggcacgc

SEQ ID NO: 1861017 - RNA, 18 nt, Salmonella typhimurium LT2
gacaguacgaucaugaau

SEQ ID NO: 1861018 - RNA, 16 nt, Salmonella typhimurium LT2
gacaguaccagcagaa

SEQ ID NO: 1861019 - RNA, 15 nt, Salmonella typhimurium LT2
gacagguguuaaugu

SEQ ID NO: 1861020 - RNA, 21 nt, Salmonella typhimurium LT2
gacagggucgcaauaccggcg

SEQ ID NO: 1861021 - RNA, 17 nt, Salmonella typhimurium LT2
gacaggcacaacaauau

SEQ ID NO: 1861022 - RNA, 18 nt, Salmonella typhimurium LT2
gacaggcggcagcuuacu

SEQ ID NO: 1861023 - RNA, 15 nt, Salmonella typhimurium LT2
gacauaaucaugaac

SEQ ID NO: 1861024 - RNA, 15 nt, Salmonella typhimurium LT2
gacauaagaguccau

SEQ ID NO: 1861025 - RNA, 21 nt, Salmonella typhimurium LT2
gacaguuuuuugucuguaaaa

SEQ ID NO: 1861026 - RNA, 14 nt, Salmonella typhimurium LT2
gacuucuucuacca

SEQ ID NO: 1861027 - RNA, 18 nt, Salmonella typhimurium LT2
gacuucaacgcaggcgaa

SEQ ID NO: 1861028 - RNA, 20 nt, Salmonella typhimurium LT2
gacuuccgcacgcgcgcccu

SEQ ID NO: 1861029 - RNA, 11 nt, Salmonella typhimurium LT2
gacuguccacg

SEQ ID NO: 1861030 - RNA, 18 nt, Salmonella typhimurium LT2
gacugucuuguuuuucug

SEQ ID NO: 1861031 - RNA, 17 nt, Salmonella typhimurium LT2
gacuguucagcugacaa

SEQ ID NO: 1861032 - RNA, 12 nt, Salmonella typhimurium LT2
gacuguugaaag

SEQ ID NO: 1861033 - RNA, 23 nt, Salmonella typhimurium LT2
gacuguuucauuacucguccuuc

SEQ ID NO: 1861034 - RNA, 22 nt, Salmonella typhimurium LT2
gacuuaaaguacuucacaauca

SEQ ID NO: 1861035 - RNA, 17 nt, Salmonella typhimurium LT2
gacuuacgcagcauuag

SEQ ID NO: 1861036 - RNA, 14 nt, Salmonella typhimurium LT2
gacuggucgcccgg

SEQ ID NO: 1861037 - RNA, 22 nt, Salmonella typhimurium LT2
gacuggcugagcucacuuuuug

SEQ ID NO: 1861038 - RNA, 21 nt, Salmonella typhimurium LT2
gacuggcgccgucacguucgg

SEQ ID NO: 1861039 - RNA, 21 nt, Salmonella typhimurium LT2
gacuggcuaaacaauuugccc

SEQ ID NO: 1861040 - RNA, 20 nt, Salmonella typhimurium LT2
gacuuuaaacgucaugcugu

SEQ ID NO: 1861041 - RNA, 23 nt, Salmonella typhimurium LT2
gacuuuacaccccacuauucagu

SEQ ID NO: 1861042 - RNA, 21 nt, Salmonella typhimurium LT2
gacuuugcccuuuuugcauuc

SEQ ID NO: 1861043 - RNA, 20 nt, Salmonella typhimurium LT2
gagaaaaagcaauaauccgc

SEQ ID NO: 1861044 - RNA, 22 nt, Salmonella typhimurium LT2
gagaaaaacgaccaggaucaga

SEQ ID NO: 1861045 - RNA, 23 nt, Salmonella typhimurium LT2
gagaaaucaacgaaaucagagac

SEQ ID NO: 1861046 - RNA, 20 nt, Salmonella typhimurium LT2
gagaaaucaacgaaaucaga

SEQ ID NO: 1861047 - RNA, 11 nt, Salmonella typhimurium LT2
gagaaaucaac

SEQ ID NO: 1861048 - RNA, 23 nt, Salmonella typhimurium LT2
gagaaauuuaggucaaaaaagcg

SEQ ID NO: 1861049 - RNA, 16 nt, Salmonella typhimurium LT2
gagaacagguaguuac

SEQ ID NO: 1861050 - RNA, 14 nt, Salmonella typhimurium LT2
gagaaccugaacaa

SEQ ID NO: 1861051 - RNA, 15 nt, Salmonella typhimurium LT2
gagaaaauagaggaa

SEQ ID NO: 1861052 - RNA, 21 nt, Salmonella typhimurium LT2
gagaaaaguuggcauaaugaa

SEQ ID NO: 1861053 - RNA, 20 nt, Salmonella typhimurium LT2
gacuuuuugaaaucacgcca

SEQ ID NO: 1861054 - RNA, 16 nt, Salmonella typhimurium LT2
gagaaaacgcggccug

SEQ ID NO: 1861055 - RNA, 12 nt, Salmonella typhimurium LT2
gagaaaauaccg

SEQ ID NO: 1861056 - RNA, 19 nt, Salmonella typhimurium LT2
gagaaaauaccgcacauca

SEQ ID NO: 1861057 - RNA, 13 nt, Salmonella typhimurium LT2
gagaaagcugcgc

SEQ ID NO: 1861058 - RNA, 16 nt, Salmonella typhimurium LT2
gagacgcgaaacgaaa

SEQ ID NO: 1861059 - RNA, 16 nt, Salmonella typhimurium LT2
gagacgccgcccaaug

SEQ ID NO: 1861060 - RNA, 22 nt, Salmonella typhimurium LT2
gagacguucauuucuuccagca

SEQ ID NO: 1861061 - RNA, 14 nt, Salmonella typhimurium LT2
gagagaaacaacac

SEQ ID NO: 1861062 - RNA, 13 nt, Salmonella typhimurium LT2
gagacugauaaug

SEQ ID NO: 1861063 - RNA, 21 nt, Salmonella typhimurium LT2
gagagcgauaaacucagcgcc

SEQ ID NO: 1861064 - RNA, 15 nt, Salmonella typhimurium LT2
gagagcgucaugaaa

SEQ ID NO: 1861065 - RNA, 16 nt, Salmonella typhimurium LT2
gagagcgggccguggc

SEQ ID NO: 1861066 - RNA, 22 nt, Salmonella typhimurium LT2
gagagacguucauuucuuccag

SEQ ID NO: 1861067 - RNA, 15 nt, Salmonella typhimurium LT2
gagagaugccgccag

SEQ ID NO: 1861068 - RNA, 21 nt, Salmonella typhimurium LT2
gagagaugccgccaguugggc

SEQ ID NO: 1861069 - RNA, 15 nt, Salmonella typhimurium LT2
gagagcagcgccagc

SEQ ID NO: 1861070 - RNA, 23 nt, Salmonella typhimurium LT2
gagagaguugagccagauaguga

SEQ ID NO: 1861071 - RNA, 13 nt, Salmonella typhimurium LT2
gagagcaucaucu

SEQ ID NO: 1861072 - RNA, 20 nt, Salmonella typhimurium LT2
gagagcaguacgccaaaaaa

SEQ ID NO: 1861073 - RNA, 16 nt, Salmonella typhimurium LT2
gagaagcgcgccugcc

SEQ ID NO: 1861074 - RNA, 22 nt, Salmonella typhimurium LT2
gagaagcccggccacagcgcca

SEQ ID NO: 1861075 - RNA, 15 nt, Salmonella typhimurium LT2
gagaagcuuuuucuu

SEQ ID NO: 1861076 - RNA, 23 nt, Salmonella typhimurium LT2
gagaagccuuuuuucaccaguuu

SEQ ID NO: 1861077 - RNA, 15 nt, Salmonella typhimurium LT2
gagaaggucagucca

SEQ ID NO: 1861078 - RNA, 20 nt, Salmonella typhimurium LT2
gagaacgccgggccugccag

SEQ ID NO: 1861079 - RNA, 14 nt, Salmonella typhimurium LT2
gagaacgagaaacu

SEQ ID NO: 1861080 - RNA, 15 nt, Salmonella typhimurium LT2
gagaauggaugugaa

SEQ ID NO: 1861081 - RNA, 23 nt, Salmonella typhimurium LT2
gagaauggucgguauuaucaaug

SEQ ID NO: 1861082 - RNA, 13 nt, Salmonella typhimurium LT2
gagaauuuuuagc

SEQ ID NO: 1861083 - RNA, 17 nt, Salmonella typhimurium LT2
gagaaugcgagcaaaac

SEQ ID NO: 1861084 - RNA, 21 nt, Salmonella typhimurium LT2
gagacauugguuucaugcauc

SEQ ID NO: 1861085 - RNA, 17 nt, Salmonella typhimurium LT2
gagacagagaaccugaa

SEQ ID NO: 1861086 - RNA, 21 nt, Salmonella typhimurium LT2
gagacagagaaccugaacaau

SEQ ID NO: 1861087 - RNA, 16 nt, Salmonella typhimurium LT2
gagacagagaaccuga

SEQ ID NO: 1861088 - RNA, 19 nt, Salmonella typhimurium LT2
gacucuguggccgcgcaug

SEQ ID NO: 1861089 - RNA, 18 nt, Salmonella typhimurium LT2
gacucugaagcgggaaag

SEQ ID NO: 1861090 - RNA, 21 nt, Salmonella typhimurium LT2
gacucuauagcggucaaaaua

SEQ ID NO: 1861091 - RNA, 15 nt, Salmonella typhimurium LT2
gacucguugggugag

SEQ ID NO: 1861092 - RNA, 14 nt, Salmonella typhimurium LT2
gacugaaaaucaaa

SEQ ID NO: 1861093 - RNA, 19 nt, Salmonella typhimurium LT2
gacugaaaaucaaaaacau

SEQ ID NO: 1861094 - RNA, 20 nt, Salmonella typhimurium LT2
gacugaguauuggcaagaau

SEQ ID NO: 1861095 - RNA, 14 nt, Salmonella typhimurium LT2
gacugacaaugacg

SEQ ID NO: 1861096 - RNA, 14 nt, Salmonella typhimurium LT2
gacugauaggcuca

SEQ ID NO: 1861097 - RNA, 19 nt, Salmonella typhimurium LT2
gacugccuaacuggaaaaa

SEQ ID NO: 1861098 - RNA, 21 nt, Salmonella typhimurium LT2
gacugccuaacuggaaaaaga

SEQ ID NO: 1861099 - RNA, 23 nt, Salmonella typhimurium LT2
gacuggcccugccggaaaaugcg

SEQ ID NO: 1861100 - RNA, 13 nt, Salmonella typhimurium LT2
gacugcgcgcggu

SEQ ID NO: 1861101 - RNA, 13 nt, Salmonella typhimurium LT2
gacucagggugac

SEQ ID NO: 1861102 - RNA, 16 nt, Salmonella typhimurium LT2
gacucauaaugucucc

SEQ ID NO: 1861103 - RNA, 20 nt, Salmonella typhimurium LT2
gacucaccccuucuuuaucu

SEQ ID NO: 1861104 - RNA, 23 nt, Salmonella typhimurium LT2
gacucaccgcuaaucccagcgcg

SEQ ID NO: 1861105 - RNA, 19 nt, Salmonella typhimurium LT2
gacucaugcgccuucugcu

SEQ ID NO: 1861106 - RNA, 16 nt, Salmonella typhimurium LT2
gacucauccagcaucg

SEQ ID NO: 1861107 - RNA, 15 nt, Salmonella typhimurium LT2
gacucauuacgccac

SEQ ID NO: 1861108 - RNA, 17 nt, Salmonella typhimurium LT2
gacucauucagcaacug

SEQ ID NO: 1861109 - RNA, 20 nt, Salmonella typhimurium LT2
gacuccacggaaucacggca

SEQ ID NO: 1861110 - RNA, 13 nt, Salmonella typhimurium LT2
gacuccccugcag

SEQ ID NO: 1861111 - RNA, 14 nt, Salmonella typhimurium LT2
gacuccccugcaga

SEQ ID NO: 1861112 - RNA, 22 nt, Salmonella typhimurium LT2
gacuccggauagagaucuuccg

SEQ ID NO: 1861113 - RNA, 19 nt, Salmonella typhimurium LT2
gacuccucaaccgacgcga

SEQ ID NO: 1861114 - RNA, 23 nt, Salmonella typhimurium LT2
gacuccugacagguauggugcuc

SEQ ID NO: 1861115 - RNA, 22 nt, Salmonella typhimurium LT2
gacucgaaccaacgacccccac

SEQ ID NO: 1861116 - RNA, 23 nt, Salmonella typhimurium LT2
gacucgaaccaacgacccccacc

SEQ ID NO: 1861117 - RNA, 22 nt, Salmonella typhimurium LT2
gacucgaaccaucgacccccac

SEQ ID NO: 1861118 - RNA, 15 nt, Salmonella typhimurium LT2
gacuacguucaucag

SEQ ID NO: 1861119 - RNA, 19 nt, Salmonella typhimurium LT2
gacuacgguaaaccaggcc

SEQ ID NO: 1861120 - RNA, 13 nt, Salmonella typhimurium LT2
gacuacugaaaag

SEQ ID NO: 1861121 - RNA, 16 nt, Salmonella typhimurium LT2
gacuagacagccucuc

SEQ ID NO: 1861122 - RNA, 23 nt, Salmonella typhimurium LT2
gacucaaaaagaggaaagcguaa

SEQ ID NO: 1861123 - RNA, 19 nt, Salmonella typhimurium LT2
gacucaccagcacgcaggc

SEQ ID NO: 1861124 - RNA, 16 nt, Salmonella typhimurium LT2
gacuauuggaaucgcu

SEQ ID NO: 1861125 - RNA, 18 nt, Salmonella typhimurium LT2
gacuauccagccagggau

SEQ ID NO: 1861126 - RNA, 18 nt, Salmonella typhimurium LT2
gacuauccguccucuuuc

SEQ ID NO: 1861127 - RNA, 17 nt, Salmonella typhimurium LT2
gacguguuugaugacgu

SEQ ID NO: 1861128 - RNA, 18 nt, Salmonella typhimurium LT2
gacguuaacgccgccauc

SEQ ID NO: 1861129 - RNA, 18 nt, Salmonella typhimurium LT2
gacgugccuuccaucggc

SEQ ID NO: 1861130 - RNA, 19 nt, Salmonella typhimurium LT2
gacguggggguucaagucc

SEQ ID NO: 1861131 - RNA, 20 nt, Salmonella typhimurium LT2
gacgucgacgccuuucuuca

SEQ ID NO: 1861132 - RNA, 22 nt, Salmonella typhimurium LT2
gacgucgacgccuuucuucacg

SEQ ID NO: 1861133 - RNA, 17 nt, Salmonella typhimurium LT2
gacgguaccugaagcca

SEQ ID NO: 1861134 - RNA, 21 nt, Salmonella typhimurium LT2
gacggucggguggagaucgac

SEQ ID NO: 1861135 - RNA, 23 nt, Salmonella typhimurium LT2
gacggugauguuggcccggacgc

SEQ ID NO: 1861136 - RNA, 16 nt, Salmonella typhimurium LT2
gacgguuguuuuucag

SEQ ID NO: 1861137 - RNA, 23 nt, Salmonella typhimurium LT2
gacguaacgguguuucaucuuca

SEQ ID NO: 1861138 - RNA, 22 nt, Salmonella typhimurium LT2
gacgggcaagguuaugcagcau

SEQ ID NO: 1861139 - RNA, 23 nt, Salmonella typhimurium LT2
gacgggggcgaucagcaggucag

SEQ ID NO: 1861140 - RNA, 15 nt, Salmonella typhimurium LT2
gacggggcgcgugcg

SEQ ID NO: 1861141 - RNA, 21 nt, Salmonella typhimurium LT2
gacgggaaaucucccuggcag

SEQ ID NO: 1861142 - RNA, 20 nt, Salmonella typhimurium LT2
gacgggaaaucucccuggca

SEQ ID NO: 1861143 - RNA, 19 nt, Salmonella typhimurium LT2
gacggcguaagucgcgcau

SEQ ID NO: 1861144 - RNA, 12 nt, Salmonella typhimurium LT2
gagcugcugcuu

SEQ ID NO: 1861145 - RNA, 13 nt, Salmonella typhimurium LT2
gagcucucuucca

SEQ ID NO: 1861146 - RNA, 15 nt, Salmonella typhimurium LT2
gagcugacggggcgc

SEQ ID NO: 1861147 - RNA, 21 nt, Salmonella typhimurium LT2
gagcugacggagcaaaucguc

SEQ ID NO: 1861148 - RNA, 18 nt, Salmonella typhimurium LT2
gagcuaaucacccacuuc

SEQ ID NO: 1861149 - RNA, 18 nt, Salmonella typhimurium LT2
gagcucccgguucgccgc

SEQ ID NO: 1861150 - RNA, 20 nt, Salmonella typhimurium LT2
gagcucaaaaaagccaugcc

SEQ ID NO: 1861151 - RNA, 21 nt, Salmonella typhimurium LT2
gagcgguuuuuuuguggccug

SEQ ID NO: 1861152 - RNA, 13 nt, Salmonella typhimurium LT2
gagcguauccagc

SEQ ID NO: 1861153 - RNA, 17 nt, Salmonella typhimurium LT2
gagcgucucauccggca

SEQ ID NO: 1861154 - RNA, 21 nt, Salmonella typhimurium LT2
gagcgucuuuuauccccacua

SEQ ID NO: 1861155 - RNA, 15 nt, Salmonella typhimurium LT2
gagcguucaaaauca

SEQ ID NO: 1861156 - RNA, 17 nt, Salmonella typhimurium LT2
gagcguucaaaaucaaa

SEQ ID NO: 1861157 - RNA, 22 nt, Salmonella typhimurium LT2
gagcggcgacuagucgcccgcu

SEQ ID NO: 1861158 - RNA, 19 nt, Salmonella typhimurium LT2
gagcggauaauccgccacu

SEQ ID NO: 1861159 - RNA, 20 nt, Salmonella typhimurium LT2
gagcgggccguggccaggaa

SEQ ID NO: 1861160 - RNA, 16 nt, Salmonella typhimurium LT2
gagcgggccgucaggc

SEQ ID NO: 1861161 - RNA, 17 nt, Salmonella typhimurium LT2
gagccuguuccagcugc

SEQ ID NO: 1861162 - RNA, 14 nt, Salmonella typhimurium LT2
gagccgucgccggc

SEQ ID NO: 1861163 - RNA, 17 nt, Salmonella typhimurium LT2
gagccgucgcuaucaau

SEQ ID NO: 1861164 - RNA, 21 nt, Salmonella typhimurium LT2
gagcgacgguuuuauccccuu

SEQ ID NO: 1861165 - RNA, 15 nt, Salmonella typhimurium LT2
gagcgacgcccugcc

SEQ ID NO: 1861166 - RNA, 23 nt, Salmonella typhimurium LT2
gagcgaacggcuuuccagcagcc

SEQ ID NO: 1861167 - RNA, 16 nt, Salmonella typhimurium LT2
gagcgaauccagcgcc

SEQ ID NO: 1861168 - RNA, 15 nt, Salmonella typhimurium LT2
gagcgcauccggcca

SEQ ID NO: 1861169 - RNA, 21 nt, Salmonella typhimurium LT2
gagcgcaucaaauacgcgcgc

SEQ ID NO: 1861170 - RNA, 14 nt, Salmonella typhimurium LT2
gagcgcauccggca

SEQ ID NO: 1861171 - RNA, 23 nt, Salmonella typhimurium LT2
gagcgcaaucaagcucaccacca

SEQ ID NO: 1861172 - RNA, 22 nt, Salmonella typhimurium LT2
gagcgcagcgacuucaggcgcu

SEQ ID NO: 1861173 - RNA, 13 nt, Salmonella typhimurium LT2
gagcgcgcuggca

SEQ ID NO: 1861174 - RNA, 14 nt, Salmonella typhimurium LT2
gagcgcgcucugcc

SEQ ID NO: 1861175 - RNA, 15 nt, Salmonella typhimurium LT2
gagcgcgaaaucaaa

SEQ ID NO: 1861176 - RNA, 15 nt, Salmonella typhimurium LT2
gagcgcgucagcgcc

SEQ ID NO: 1861177 - RNA, 22 nt, Salmonella typhimurium LT2
gagcgcgucagcgccuccgcgu

SEQ ID NO: 1861178 - RNA, 17 nt, Salmonella typhimurium LT2
gagcgcguccagacguu

SEQ ID NO: 1861179 - RNA, 12 nt, Salmonella typhimurium LT2
gagcgcggcggc

SEQ ID NO: 1861180 - RNA, 21 nt, Salmonella typhimurium LT2
gaggcauggcgauuacccagu

SEQ ID NO: 1861181 - RNA, 15 nt, Salmonella typhimurium LT2
gaggccucuccucga

SEQ ID NO: 1861182 - RNA, 16 nt, Salmonella typhimurium LT2
gaggcgcagccgccau

SEQ ID NO: 1861183 - RNA, 20 nt, Salmonella typhimurium LT2
gaggcgauagcgaacggcga

SEQ ID NO: 1861184 - RNA, 20 nt, Salmonella typhimurium LT2
gaggaguaguuaaaaaaggu

SEQ ID NO: 1861185 - RNA, 21 nt, Salmonella typhimurium LT2
gaggagucauugcuaugccug

SEQ ID NO: 1861186 - RNA, 14 nt, Salmonella typhimurium LT2
gaggaucaguaaca

SEQ ID NO: 1861187 - RNA, 12 nt, Salmonella typhimurium LT2
gaggcagcagga

SEQ ID NO: 1861188 - RNA, 16 nt, Salmonella typhimurium LT2
gaggaugcuccgccag

SEQ ID NO: 1861189 - RNA, 15 nt, Salmonella typhimurium LT2
gaggaugccugcgca

SEQ ID NO: 1861190 - RNA, 23 nt, Salmonella typhimurium LT2
gaggauugccgccuugguugccg

SEQ ID NO: 1861191 - RNA, 18 nt, Salmonella typhimurium LT2
gagcugugguucguucaa

SEQ ID NO: 1861192 - RNA, 21 nt, Salmonella typhimurium LT2
gagcugugguucguucaacgu

SEQ ID NO: 1861193 - RNA, 16 nt, Salmonella typhimurium LT2
gagcuggugcgcgacu

SEQ ID NO: 1861194 - RNA, 19 nt, Salmonella typhimurium LT2
gagcugcgcuuuuucauca

SEQ ID NO: 1861195 - RNA, 13 nt, Salmonella typhimurium LT2
gagcuggcggcgg

SEQ ID NO: 1861196 - RNA, 17 nt, Salmonella typhimurium LT2
gaggagcgcggcggcgc

SEQ ID NO: 1861197 - RNA, 21 nt, Salmonella typhimurium LT2
gaggagcgcggcggcgcggag

SEQ ID NO: 1861198 - RNA, 18 nt, Salmonella typhimurium LT2
gaggacgucugucagaac

SEQ ID NO: 1861199 - RNA, 18 nt, Salmonella typhimurium LT2
gaggacccguggcugcgc

SEQ ID NO: 1861200 - RNA, 21 nt, Salmonella typhimurium LT2
gaggacgcacucucaaacuau

SEQ ID NO: 1861201 - RNA, 19 nt, Salmonella typhimurium LT2
gaggaaauucuggcgcagc

SEQ ID NO: 1861202 - RNA, 18 nt, Salmonella typhimurium LT2
gaggaaaaagccgccgug

SEQ ID NO: 1861203 - RNA, 14 nt, Salmonella typhimurium LT2
gagcuuuuuuuugc

SEQ ID NO: 1861204 - RNA, 12 nt, Salmonella typhimurium LT2
gagcuuuuccug

SEQ ID NO: 1861205 - RNA, 24 nt, Salmonella typhimurium LT2
gaggaacuguucagccagcaaggc

SEQ ID NO: 1861206 - RNA, 17 nt, Salmonella typhimurium LT2
gagcagaacaaguucuu

SEQ ID NO: 1861207 - RNA, 16 nt, Salmonella typhimurium LT2
gagcagcaacccugcc

SEQ ID NO: 1861208 - RNA, 11 nt, Salmonella typhimurium LT2
gagcagcagga

SEQ ID NO: 1861209 - RNA, 22 nt, Salmonella typhimurium LT2
gagcagcaggacguugccgccc

SEQ ID NO: 1861210 - RNA, 18 nt, Salmonella typhimurium LT2
gagcagaucgcggcaaug

SEQ ID NO: 1861211 - RNA, 14 nt, Salmonella typhimurium LT2
gagcaaugggaagg

SEQ ID NO: 1861212 - RNA, 15 nt, Salmonella typhimurium LT2
gagcaaugggaagga

SEQ ID NO: 1861213 - RNA, 20 nt, Salmonella typhimurium LT2
gagcaaugggaaggaaaaua

SEQ ID NO: 1861214 - RNA, 13 nt, Salmonella typhimurium LT2
gagcacagcccau

SEQ ID NO: 1861215 - RNA, 17 nt, Salmonella typhimurium LT2
gagcaaggccaaauagg

SEQ ID NO: 1861216 - RNA, 14 nt, Salmonella typhimurium LT2
gagcaaucaguuca

SEQ ID NO: 1861217 - RNA, 17 nt, Salmonella typhimurium LT2
gagcaaaaccagacgcc

SEQ ID NO: 1861218 - RNA, 15 nt, Salmonella typhimurium LT2
gagcaaaacacagcu

SEQ ID NO: 1861219 - RNA, 15 nt, Salmonella typhimurium LT2
gagauucaauaacgu

SEQ ID NO: 1861220 - RNA, 20 nt, Salmonella typhimurium LT2
gagcaaaccgacccaaaaau

SEQ ID NO: 1861221 - RNA, 13 nt, Salmonella typhimurium LT2
gagcaaaccgcaa

SEQ ID NO: 1861222 - RNA, 15 nt, Salmonella typhimurium LT2
gagcaaacucaauga

SEQ ID NO: 1861223 - RNA, 19 nt, Salmonella typhimurium LT2
gagcaaaggaucgcaacca

SEQ ID NO: 1861224 - RNA, 15 nt, Salmonella typhimurium LT2
gagauaauuuaugau

SEQ ID NO: 1861225 - RNA, 20 nt, Salmonella typhimurium LT2
gagauaaugcuuucgccagc

SEQ ID NO: 1861226 - RNA, 21 nt, Salmonella typhimurium LT2
gagaucgacaaaccacugcug

SEQ ID NO: 1861227 - RNA, 22 nt, Salmonella typhimurium LT2
gagaucgacaacaacaucugug

SEQ ID NO: 1861228 - RNA, 20 nt, Salmonella typhimurium LT2
gagauguuuuaccaguacaa

SEQ ID NO: 1861229 - RNA, 16 nt, Salmonella typhimurium LT2
gagaugucccaccgcc

SEQ ID NO: 1861230 - RNA, 20 nt, Salmonella typhimurium LT2
gagaucgguaauuuccacgc

SEQ ID NO: 1861231 - RNA, 21 nt, Salmonella typhimurium LT2
gagaucgguaauuuccacgcc

SEQ ID NO: 1861232 - RNA, 18 nt, Salmonella typhimurium LT2
gagaucgguaauuuccac

SEQ ID NO: 1861233 - RNA, 13 nt, Salmonella typhimurium LT2
gagaucggcgcuc

SEQ ID NO: 1861234 - RNA, 18 nt, Salmonella typhimurium LT2
gagaucgcuucaaucccc

SEQ ID NO: 1861235 - RNA, 19 nt, Salmonella typhimurium LT2
gagaucuuuccauuucagc

SEQ ID NO: 1861236 - RNA, 21 nt, Salmonella typhimurium LT2
gagaucuuuccauuucagccc

SEQ ID NO: 1861237 - RNA, 22 nt, Salmonella typhimurium LT2
gagaugaccgaguuccagucca

SEQ ID NO: 1861238 - RNA, 17 nt, Salmonella typhimurium LT2
gagaugcaggccaagca

SEQ ID NO: 1861239 - RNA, 22 nt, Salmonella typhimurium LT2
gagaugcaggccaagcagcgcc

SEQ ID NO: 1861240 - RNA, 20 nt, Salmonella typhimurium LT2
gagcaggcccccuucaucgu

SEQ ID NO: 1861241 - RNA, 17 nt, Salmonella typhimurium LT2
gagcaggacgcgcgcga

SEQ ID NO: 1861242 - RNA, 16 nt, Salmonella typhimurium LT2
gagcaggaaccacauc

SEQ ID NO: 1861243 - RNA, 19 nt, Salmonella typhimurium LT2
gagcagcgccagcgacaga

SEQ ID NO: 1861244 - RNA, 19 nt, Salmonella typhimurium LT2
gagcagucguugcgccugu

SEQ ID NO: 1861245 - RNA, 20 nt, Salmonella typhimurium LT2
gagcagucguugcgccuguu

SEQ ID NO: 1861246 - RNA, 19 nt, Salmonella typhimurium LT2
gagcagguuacucuuccac

SEQ ID NO: 1861247 - RNA, 16 nt, Salmonella typhimurium LT2
gagcaguacgccaaaa

SEQ ID NO: 1861248 - RNA, 11 nt, Salmonella typhimurium LT2
gagcaucaaac

SEQ ID NO: 1861249 - RNA, 15 nt, Salmonella typhimurium LT2
gagcauaaaaaucau

SEQ ID NO: 1861250 - RNA, 20 nt, Salmonella typhimurium LT2
gagcaucuccagcgcauugc

SEQ ID NO: 1861251 - RNA, 19 nt, Salmonella typhimurium LT2
gagccacuauccagucagc

SEQ ID NO: 1861252 - RNA, 14 nt, Salmonella typhimurium LT2
gagccacuauccag

SEQ ID NO: 1861253 - RNA, 18 nt, Salmonella typhimurium LT2
gagccagaugucgccaga

SEQ ID NO: 1861254 - RNA, 22 nt, Salmonella typhimurium LT2
gagccagccugaggaugauacu

SEQ ID NO: 1861255 - RNA, 22 nt, Salmonella typhimurium LT2
gagccauaacaacuauuuuucc

SEQ ID NO: 1861256 - RNA, 22 nt, Salmonella typhimurium LT2
gagccaucggcaaacgccgccu

SEQ ID NO: 1861257 - RNA, 23 nt, Salmonella typhimurium LT2
gagccaguguucccugcgcugga

SEQ ID NO: 1861258 - RNA, 15 nt, Salmonella typhimurium LT2
gagccauuaaugcag

SEQ ID NO: 1861259 - RNA, 22 nt, Salmonella typhimurium LT2
gagccgauacgcgggccgcggc

SEQ ID NO: 1861260 - RNA, 21 nt, Salmonella typhimurium LT2
gauguuaaaggucagaagcug

SEQ ID NO: 1861261 - RNA, 16 nt, Salmonella typhimurium LT2
gauguugcguauuuuu

SEQ ID NO: 1861262 - RNA, 18 nt, Salmonella typhimurium LT2
gauuaaugcuccaauaaa

SEQ ID NO: 1861263 - RNA, 20 nt, Salmonella typhimurium LT2
gauuaaugcugcaccacacc

SEQ ID NO: 1861264 - RNA, 12 nt, Salmonella typhimurium LT2
gauuaauuuaau

SEQ ID NO: 1861265 - RNA, 14 nt, Salmonella typhimurium LT2
gaugugaauccagg

SEQ ID NO: 1861266 - RNA, 17 nt, Salmonella typhimurium LT2
gauggcuuucuaccugc

SEQ ID NO: 1861267 - RNA, 17 nt, Salmonella typhimurium LT2
gauggcguuccagcauu

SEQ ID NO: 1861268 - RNA, 22 nt, Salmonella typhimurium LT2
gauggcguuccagcauuuccug

SEQ ID NO: 1861269 - RNA, 22 nt, Salmonella typhimurium LT2
gauggcgucugauugcgcccuc

SEQ ID NO: 1861270 - RNA, 17 nt, Salmonella typhimurium LT2
gauggcguuuagcuggc

SEQ ID NO: 1861271 - RNA, 17 nt, Salmonella typhimurium LT2
gauggcuaauauccagc

SEQ ID NO: 1861272 - RNA, 21 nt, Salmonella typhimurium LT2
gauucaauauugaacauuuuu

SEQ ID NO: 1861273 - RNA, 14 nt, Salmonella typhimurium LT2
gauucacuuucuug

SEQ ID NO: 1861274 - RNA, 23 nt, Salmonella typhimurium LT2
gauucacuuucuugccacuggcc

SEQ ID NO: 1861275 - RNA, 20 nt, Salmonella typhimurium LT2
gauucaaaaggugagaaaaa

SEQ ID NO: 1861276 - RNA, 21 nt, Salmonella typhimurium LT2
gauuaggcaagcugguaaaug

SEQ ID NO: 1861277 - RNA, 22 nt, Salmonella typhimurium LT2
gauucaacguuucgcuaucgcc

SEQ ID NO: 1861278 - RNA, 16 nt, Salmonella typhimurium LT2
gauuagcucauacgcu

SEQ ID NO: 1861279 - RNA, 19 nt, Salmonella typhimurium LT2
gauuauacuugcugcuaug

SEQ ID NO: 1861280 - RNA, 21 nt, Salmonella typhimurium LT2
gauuccauuuuugcggauggc

SEQ ID NO: 1861281 - RNA, 23 nt, Salmonella typhimurium LT2
gauucaugguacucaacaucauu

SEQ ID NO: 1861282 - RNA, 16 nt, Salmonella typhimurium LT2
gauuccgucaugguga

SEQ ID NO: 1861283 - RNA, 18 nt, Salmonella typhimurium LT2
gauuccccaaucccacca

SEQ ID NO: 1861284 - RNA, 17 nt, Salmonella typhimurium LT2
gauuuuccguuaagcug

SEQ ID NO: 1861285 - RNA, 20 nt, Salmonella typhimurium LT2
gauuuucccuucugaaauga

SEQ ID NO: 1861286 - RNA, 13 nt, Salmonella typhimurium LT2
gauuuucuuuaau

SEQ ID NO: 1861287 - RNA, 18 nt, Salmonella typhimurium LT2
gauuuuuuaauucauaua

SEQ ID NO: 1861288 - RNA, 21 nt, Salmonella typhimurium LT2
gauuuccgggcguacuucuuu

SEQ ID NO: 1861289 - RNA, 17 nt, Salmonella typhimurium LT2
gauuuggcugccgagca

SEQ ID NO: 1861290 - RNA, 21 nt, Salmonella typhimurium LT2
gauuuggcugccgagcagauc

SEQ ID NO: 1861291 - RNA, 15 nt, Salmonella typhimurium LT2
gauuucuuaauuccu

SEQ ID NO: 1861292 - RNA, 15 nt, Salmonella typhimurium LT2
gauuucgcaacagca

SEQ ID NO: 1861293 - RNA, 20 nt, Salmonella typhimurium LT2
gauugccccccagccauaau

SEQ ID NO: 1861294 - RNA, 18 nt, Salmonella typhimurium LT2
gauugucuuaaauaugaa

SEQ ID NO: 1861295 - RNA, 24 nt, Salmonella typhimurium LT2
gauuucaugcggugcaugaauauc

SEQ ID NO: 1861296 - RNA, 21 nt, Salmonella typhimurium LT2
gauuuauguaccgucaucgcc

SEQ ID NO: 1861297 - RNA, 15 nt, Salmonella typhimurium LT2
gauuuagcguaaaua

SEQ ID NO: 1861298 - RNA, 18 nt, Salmonella typhimurium LT2
gauugcagagaaguguac

SEQ ID NO: 1861299 - RNA, 23 nt, Salmonella typhimurium LT2
gauugcagagaaguguacaaaca

SEQ ID NO: 1861300 - RNA, 13 nt, Salmonella typhimurium LT2
gauucuaucuguu

SEQ ID NO: 1861301 - RNA, 21 nt, Salmonella typhimurium LT2
gaugcggcaaaaauccuucuu

SEQ ID NO: 1861302 - RNA, 22 nt, Salmonella typhimurium LT2
gaugcgcguuuagcgccagcag

SEQ ID NO: 1861303 - RNA, 16 nt, Salmonella typhimurium LT2
gaugcgcuauaaaaau

SEQ ID NO: 1861304 - RNA, 18 nt, Salmonella typhimurium LT2
gaugccugccgggccugc

SEQ ID NO: 1861305 - RNA, 12 nt, Salmonella typhimurium LT2
gaugccuggcag

SEQ ID NO: 1861306 - RNA, 14 nt, Salmonella typhimurium LT2
gaugcgccauccca

SEQ ID NO: 1861307 - RNA, 18 nt, Salmonella typhimurium LT2
gaugcugaauagccagcc

SEQ ID NO: 1861308 - RNA, 18 nt, Salmonella typhimurium LT2
gaugcugccugccugaag

SEQ ID NO: 1861309 - RNA, 13 nt, Salmonella typhimurium LT2
gaugcggccaggg

SEQ ID NO: 1861310 - RNA, 21 nt, Salmonella typhimurium LT2
gaugcugcgcaucuggggcgc

SEQ ID NO: 1861311 - RNA, 15 nt, Salmonella typhimurium LT2
gauggccgacuaaaa

SEQ ID NO: 1861312 - RNA, 19 nt, Salmonella typhimurium LT2
gaugcacgccacauugacc

SEQ ID NO: 1861313 - RNA, 13 nt, Salmonella typhimurium LT2
gaugcaaauguca

SEQ ID NO: 1861314 - RNA, 23 nt, Salmonella typhimurium LT2
gaugcaaaugucagaucguaugc

SEQ ID NO: 1861315 - RNA, 19 nt, Salmonella typhimurium LT2
gaugauuggccuccaccgu

SEQ ID NO: 1861316 - RNA, 16 nt, Salmonella typhimurium LT2
gaugauuuaaaaguac

SEQ ID NO: 1861317 - RNA, 21 nt, Salmonella typhimurium LT2
gaugauguuuaccugcaaaaa

SEQ ID NO: 1861318 - RNA, 14 nt, Salmonella typhimurium LT2
gaugacgcuccuga

SEQ ID NO: 1861319 - RNA, 18 nt, Salmonella typhimurium LT2
gaugagcucaaauaugau

SEQ ID NO: 1861320 - RNA, 21 nt, Salmonella typhimurium LT2
gaugacccauuuauuuucgga

SEQ ID NO: 1861321 - RNA, 20 nt, Salmonella typhimurium LT2
gaugacccccagauagcccu

SEQ ID NO: 1861322 - RNA, 20 nt, Salmonella typhimurium LT2
gaugaccaguuaagcaaaaa

SEQ ID NO: 1861323 - RNA, 12 nt, Salmonella typhimurium LT2
gaucucucccug

SEQ ID NO: 1861324 - RNA, 17 nt, Salmonella typhimurium LT2
gaucucgauauucacac

SEQ ID NO: 1861325 - RNA, 16 nt, Salmonella typhimurium LT2
gaucucauggagcugc

SEQ ID NO: 1861326 - RNA, 14 nt, Salmonella typhimurium LT2
gaucuauauauucu

SEQ ID NO: 1861327 - RNA, 17 nt, Salmonella typhimurium LT2
gaucuauauauucuucu

SEQ ID NO: 1861328 - RNA, 16 nt, Salmonella typhimurium LT2
gaucccaggccggcau

SEQ ID NO: 1861329 - RNA, 21 nt, Salmonella typhimurium LT2
gaucguuauuaagcagacugc

SEQ ID NO: 1861330 - RNA, 21 nt, Salmonella typhimurium LT2
gaucguucaccgcacugacgu

SEQ ID NO: 1861331 - RNA, 20 nt, Salmonella typhimurium LT2
gaugaaccauaucaaacagg

SEQ ID NO: 1861332 - RNA, 12 nt, Salmonella typhimurium LT2
gaugaacaggcg

SEQ ID NO: 1861333 - RNA, 22 nt, Salmonella typhimurium LT2
gaugaaauaaacgaccacucuu

SEQ ID NO: 1861334 - RNA, 15 nt, Salmonella typhimurium LT2
gaucuuuccuuuuuc

SEQ ID NO: 1861335 - RNA, 23 nt, Salmonella typhimurium LT2
gaucuuugccgcgcggauucucc

SEQ ID NO: 1861336 - RNA, 13 nt, Salmonella typhimurium LT2
gaucuuugccgcg

SEQ ID NO: 1861337 - RNA, 14 nt, Salmonella typhimurium LT2
gaucuuuuugcucc

SEQ ID NO: 1861338 - RNA, 19 nt, Salmonella typhimurium LT2
gaucuuaucuuucagcgcc

SEQ ID NO: 1861339 - RNA, 12 nt, Salmonella typhimurium LT2
gaucuucauccc

SEQ ID NO: 1861340 - RNA, 19 nt, Salmonella typhimurium LT2
gaucuuauaugagcgggcc

SEQ ID NO: 1861341 - RNA, 20 nt, Salmonella typhimurium LT2
gaucugcuugagcaggcaga

SEQ ID NO: 1861342 - RNA, 21 nt, Salmonella typhimurium LT2
gaucaccucuuccagcgucag

SEQ ID NO: 1861343 - RNA, 13 nt, Salmonella typhimurium LT2
gaucaccagcgca

SEQ ID NO: 1861344 - RNA, 15 nt, Salmonella typhimurium LT2
gauauucaagcuguu

SEQ ID NO: 1861345 - RNA, 14 nt, Salmonella typhimurium LT2
gauauuauuaaaau

SEQ ID NO: 1861346 - RNA, 21 nt, Salmonella typhimurium LT2
gauauuuuguuuuaaauucaa

SEQ ID NO: 1861347 - RNA, 18 nt, Salmonella typhimurium LT2
gauauuuuucuugagcug

SEQ ID NO: 1861348 - RNA, 22 nt, Salmonella typhimurium LT2
gauauuuuagggcguaaauaua

SEQ ID NO: 1861349 - RNA, 18 nt, Salmonella typhimurium LT2
gauauuuucaccuccacg

SEQ ID NO: 1861350 - RNA, 15 nt, Salmonella typhimurium LT2
gauauuuucaggcac

SEQ ID NO: 1861351 - RNA, 13 nt, Salmonella typhimurium LT2
gauauucgcuggu

SEQ ID NO: 1861352 - RNA, 23 nt, Salmonella typhimurium LT2
gauauucguccaccuaaagaggg

SEQ ID NO: 1861353 - RNA, 13 nt, Salmonella typhimurium LT2
gauauuccauacg

SEQ ID NO: 1861354 - RNA, 13 nt, Salmonella typhimurium LT2
gauccagcgggcc

SEQ ID NO: 1861355 - RNA, 22 nt, Salmonella typhimurium LT2
gauccagcgauugacgguuugu

SEQ ID NO: 1861356 - RNA, 19 nt, Salmonella typhimurium LT2
gaucaucccgagauuguca

SEQ ID NO: 1861357 - RNA, 15 nt, Salmonella typhimurium LT2
gaucaucauggcuga

SEQ ID NO: 1861358 - RNA, 12 nt, Salmonella typhimurium LT2
gaucaucuuuua

SEQ ID NO: 1861359 - RNA, 23 nt, Salmonella typhimurium LT2
gaucaucuucacuucacaaacaa

SEQ ID NO: 1861360 - RNA, 21 nt, Salmonella typhimurium LT2
gaucacuuuugggccgcgcag

SEQ ID NO: 1861361 - RNA, 21 nt, Salmonella typhimurium LT2
gaucacuuccgccaccacgcc

SEQ ID NO: 1861362 - RNA, 15 nt, Salmonella typhimurium LT2
gaucagaccaucggc

SEQ ID NO: 1861363 - RNA, 19 nt, Salmonella typhimurium LT2
gaucaucacgaaauaacgc

SEQ ID NO: 1861364 - RNA, 13 nt, Salmonella typhimurium LT2
gaucaucagcacg

SEQ ID NO: 1861365 - RNA, 14 nt, Salmonella typhimurium LT2
gaucaguuugccuu

SEQ ID NO: 1861366 - RNA, 15 nt, Salmonella typhimurium LT2
gaucagcagaacaaa

SEQ ID NO: 1861367 - RNA, 13 nt, Salmonella typhimurium LT2
gaucagcaaaaua

SEQ ID NO: 1861368 - RNA, 22 nt, Salmonella typhimurium LT2
gauaggcgcgucauaaccgcag

SEQ ID NO: 1861369 - RNA, 21 nt, Salmonella typhimurium LT2
gauaggcucaauaugccaggc

SEQ ID NO: 1861370 - RNA, 17 nt, Salmonella typhimurium LT2
gauaggagacgccgccc

SEQ ID NO: 1861371 - RNA, 14 nt, Salmonella typhimurium LT2
gauagggccaggcg

SEQ ID NO: 1861372 - RNA, 17 nt, Salmonella typhimurium LT2
gauagccauuucugccu

SEQ ID NO: 1861373 - RNA, 18 nt, Salmonella typhimurium LT2
gauagccauuucugccug

SEQ ID NO: 1861374 - RNA, 17 nt, Salmonella typhimurium LT2
gauagcccauccagcac

SEQ ID NO: 1861375 - RNA, 18 nt, Salmonella typhimurium LT2
gauagcccugaucccaca

SEQ ID NO: 1861376 - RNA, 17 nt, Salmonella typhimurium LT2
gauagccugccagcacc

SEQ ID NO: 1861377 - RNA, 22 nt, Salmonella typhimurium LT2
gauagccugccagcaccagcag

SEQ ID NO: 1861378 - RNA, 14 nt, Salmonella typhimurium LT2
gauagcgauuuuug

SEQ ID NO: 1861379 - RNA, 16 nt, Salmonella typhimurium LT2
gauagcgagcaagacu

SEQ ID NO: 1861380 - RNA, 13 nt, Salmonella typhimurium LT2
gauagccuuccac

SEQ ID NO: 1861381 - RNA, 18 nt, Salmonella typhimurium LT2
gauagcgcggaauaucaa

SEQ ID NO: 1861382 - RNA, 15 nt, Salmonella typhimurium LT2
gauagcgucaacgcu

SEQ ID NO: 1861383 - RNA, 22 nt, Salmonella typhimurium LT2
gauagcugguaaauaacgggcg

SEQ ID NO: 1861384 - RNA, 20 nt, Salmonella typhimurium LT2
gauagugucgccauaaauca

SEQ ID NO: 1861385 - RNA, 18 nt, Salmonella typhimurium LT2
gauaguuuuaauaucuau

SEQ ID NO: 1861386 - RNA, 19 nt, Salmonella typhimurium LT2
gauaguguucgcggcuggu

SEQ ID NO: 1861387 - RNA, 14 nt, Salmonella typhimurium LT2
gauaguuaauaaug

SEQ ID NO: 1861388 - RNA, 15 nt, Salmonella typhimurium LT2
gauaguuaauaaugg

SEQ ID NO: 1861389 - RNA, 23 nt, Salmonella typhimurium LT2
gauauagaguccagccauaauca

SEQ ID NO: 1861390 - RNA, 17 nt, Salmonella typhimurium LT2
gauauaacccucauccc

SEQ ID NO: 1861391 - RNA, 17 nt, Salmonella typhimurium LT2
gauauaaccgucuucau

SEQ ID NO: 1861392 - RNA, 18 nt, Salmonella typhimurium LT2
gauauaacgugccgacca

SEQ ID NO: 1861393 - RNA, 22 nt, Salmonella typhimurium LT2
gauaccggaggagugcgccagu

SEQ ID NO: 1861394 - RNA, 15 nt, Salmonella typhimurium LT2
gauaccggauugcuc

SEQ ID NO: 1861395 - RNA, 14 nt, Salmonella typhimurium LT2
gauaccgccagccc

SEQ ID NO: 1861396 - RNA, 22 nt, Salmonella typhimurium LT2
gauaagguguuuacgccgccau

SEQ ID NO: 1861397 - RNA, 23 nt, Salmonella typhimurium LT2
gauaagucccggaccgauugacu

SEQ ID NO: 1861398 - RNA, 19 nt, Salmonella typhimurium LT2
gauaaggucgcuauccagc

SEQ ID NO: 1861399 - RNA, 18 nt, Salmonella typhimurium LT2
gauaaggcgcuuguaaau

SEQ ID NO: 1861400 - RNA, 23 nt, Salmonella typhimurium LT2
gauaagguaacgcgaaaaaaaga

SEQ ID NO: 1861401 - RNA, 21 nt, Salmonella typhimurium LT2
gauaagccugcgcgccugcug

SEQ ID NO: 1861402 - RNA, 20 nt, Salmonella typhimurium LT2
gauaagcaccguaaacggcu

SEQ ID NO: 1861403 - RNA, 18 nt, Salmonella typhimurium LT2
gauaagcacuauuauauu

SEQ ID NO: 1861404 - RNA, 14 nt, Salmonella typhimurium LT2
gauaagcacaggcc

SEQ ID NO: 1861405 - RNA, 13 nt, Salmonella typhimurium LT2
gauacguuccagc

SEQ ID NO: 1861406 - RNA, 14 nt, Salmonella typhimurium LT2
gauacgucaucaug

SEQ ID NO: 1861407 - RNA, 20 nt, Salmonella typhimurium LT2
gauacgucauaucauccagc

SEQ ID NO: 1861408 - RNA, 24 nt, Salmonella typhimurium LT2
gauaccuaucggaagaaaacgcaa

SEQ ID NO: 1861409 - RNA, 20 nt, Salmonella typhimurium LT2
gauacuccauugucggcagc

SEQ ID NO: 1861410 - RNA, 17 nt, Salmonella typhimurium LT2
gauacguucaucuuccu

SEQ ID NO: 1861411 - RNA, 16 nt, Salmonella typhimurium LT2
gauagaaguuaugcau

SEQ ID NO: 1861412 - RNA, 19 nt, Salmonella typhimurium LT2
gauagaaccacgcaaaggc

SEQ ID NO: 1861413 - RNA, 19 nt, Salmonella typhimurium LT2
gauagacggcugaauguuc

SEQ ID NO: 1861414 - RNA, 12 nt, Salmonella typhimurium LT2
gauagcauuuuu

SEQ ID NO: 1861415 - RNA, 15 nt, Salmonella typhimurium LT2
gauagccagaaugac

SEQ ID NO: 1861416 - RNA, 22 nt, Salmonella typhimurium LT2
gagggguuucaauuccacaggc

SEQ ID NO: 1861417 - RNA, 15 nt, Salmonella typhimurium LT2
gagggauuaucuuua

SEQ ID NO: 1861418 - RNA, 14 nt, Salmonella typhimurium LT2
gaggcuuuacgaug

SEQ ID NO: 1861419 - RNA, 21 nt, Salmonella typhimurium LT2
gaggcuuuacgaugagcaaag

SEQ ID NO: 1861420 - RNA, 17 nt, Salmonella typhimurium LT2
gaggcuaaucaggaaga

SEQ ID NO: 1861421 - RNA, 21 nt, Salmonella typhimurium LT2
gagguggaauacaaacccagg

SEQ ID NO: 1861422 - RNA, 14 nt, Salmonella typhimurium LT2
gagguggugccugu

SEQ ID NO: 1861423 - RNA, 16 nt, Salmonella typhimurium LT2
gagguguauguaacug

SEQ ID NO: 1861424 - RNA, 16 nt, Salmonella typhimurium LT2
gaggugaauaaauccu

SEQ ID NO: 1861425 - RNA, 20 nt, Salmonella typhimurium LT2
gaggugcucucccagcugag

SEQ ID NO: 1861426 - RNA, 15 nt, Salmonella typhimurium LT2
gaggugcucucccag

SEQ ID NO: 1861427 - RNA, 17 nt, Salmonella typhimurium LT2
gaggucguccucuggcc

SEQ ID NO: 1861428 - RNA, 16 nt, Salmonella typhimurium LT2
gaguaaauaaaucagc

SEQ ID NO: 1861429 - RNA, 12 nt, Salmonella typhimurium LT2
gaguaaauaaaa

SEQ ID NO: 1861430 - RNA, 16 nt, Salmonella typhimurium LT2
gagguuucuucaucaa

SEQ ID NO: 1861431 - RNA, 13 nt, Salmonella typhimurium LT2
gagguuucuucau

SEQ ID NO: 1861432 - RNA, 21 nt, Salmonella typhimurium LT2
gagguuccaggcacucaaccu

SEQ ID NO: 1861433 - RNA, 19 nt, Salmonella typhimurium LT2
gagguuaaucuucagggcg

SEQ ID NO: 1861434 - RNA, 19 nt, Salmonella typhimurium LT2
gagguucgccucccucacc

SEQ ID NO: 1861435 - RNA, 18 nt, Salmonella typhimurium LT2
gaguaauccguagccaac

SEQ ID NO: 1861436 - RNA, 16 nt, Salmonella typhimurium LT2
gaguaaugaaaccgaa

SEQ ID NO: 1861437 - RNA, 23 nt, Salmonella typhimurium LT2
gaguaaugaaaccgaauccuuug

SEQ ID NO: 1861438 - RNA, 20 nt, Salmonella typhimurium LT2
gaguaaguuucgcugcacuu

SEQ ID NO: 1861439 - RNA, 17 nt, Salmonella typhimurium LT2
gaguaaucacuaacuag

SEQ ID NO: 1861440 - RNA, 13 nt, Salmonella typhimurium LT2
gauaagagaaaau

SEQ ID NO: 1861441 - RNA, 23 nt, Salmonella typhimurium LT2
gauaacuuccuuugccuuucuua

SEQ ID NO: 1861442 - RNA, 13 nt, Salmonella typhimurium LT2
gauaacucuucau

SEQ ID NO: 1861443 - RNA, 20 nt, Salmonella typhimurium LT2
gauaacugaagguuuuuccc

SEQ ID NO: 1861444 - RNA, 12 nt, Salmonella typhimurium LT2
gauaaccaauca

SEQ ID NO: 1861445 - RNA, 11 nt, Salmonella typhimurium LT2
gauaacaauau

SEQ ID NO: 1861446 - RNA, 20 nt, Salmonella typhimurium LT2
gauaacaccagcgauccaga

SEQ ID NO: 1861447 - RNA, 20 nt, Salmonella typhimurium LT2
gauaaagaccggcacaaccg

SEQ ID NO: 1861448 - RNA, 13 nt, Salmonella typhimurium LT2
gauaaaucaucau

SEQ ID NO: 1861449 - RNA, 15 nt, Salmonella typhimurium LT2
gauaaaucaucaucg

SEQ ID NO: 1861450 - RNA, 17 nt, Salmonella typhimurium LT2
gauaaauugcggcauga

SEQ ID NO: 1861451 - RNA, 11 nt, Salmonella typhimurium LT2
gauaaauguuu

SEQ ID NO: 1861452 - RNA, 15 nt, Salmonella typhimurium LT2
gauaaauguuuaucu

SEQ ID NO: 1861453 - RNA, 15 nt, Salmonella typhimurium LT2
gauaaaccaggcagc

SEQ ID NO: 1861454 - RNA, 18 nt, Salmonella typhimurium LT2
gauaaacagguaaaacaa

SEQ ID NO: 1861455 - RNA, 14 nt, Salmonella typhimurium LT2
gauaaacagcagcg

SEQ ID NO: 1861456 - RNA, 17 nt, Salmonella typhimurium LT2
gaguuuuuuauggcaga

SEQ ID NO: 1861457 - RNA, 22 nt, Salmonella typhimurium LT2
gaguaguguaauaccacugccc

SEQ ID NO: 1861458 - RNA, 18 nt, Salmonella typhimurium LT2
gagucgauaaaucgccac

SEQ ID NO: 1861459 - RNA, 21 nt, Salmonella typhimurium LT2
gagucgacugguaggccugau

SEQ ID NO: 1861460 - RNA, 11 nt, Salmonella typhimurium LT2
gagugaacacg

SEQ ID NO: 1861461 - RNA, 20 nt, Salmonella typhimurium LT2
gagugaccucaugggcccgc

SEQ ID NO: 1861462 - RNA, 17 nt, Salmonella typhimurium LT2
gagugacgggcuggcgc

SEQ ID NO: 1861463 - RNA, 23 nt, Salmonella typhimurium LT2
gaguuggcauucgaauccuccug

SEQ ID NO: 1861464 - RNA, 21 nt, Salmonella typhimurium LT2
gcagaauuucuacacagcgcg

SEQ ID NO: 1861465 - RNA, 19 nt, Salmonella typhimurium LT2
gcagaauuaacucaucaca

SEQ ID NO: 1861466 - RNA, 23 nt, Salmonella typhimurium LT2
gcagaauuaacucaucacagcca

SEQ ID NO: 1861467 - RNA, 15 nt, Salmonella typhimurium LT2
gcagacacugccacc

SEQ ID NO: 1861468 - RNA, 21 nt, Salmonella typhimurium LT2
gcagacccacuuucagcuccg

SEQ ID NO: 1861469 - RNA, 23 nt, Salmonella typhimurium LT2
gcagacccgucaggguuuucagg

SEQ ID NO: 1861470 - RNA, 22 nt, Salmonella typhimurium LT2
gcagacaugaccgcacagcaga

SEQ ID NO: 1861471 - RNA, 19 nt, Salmonella typhimurium LT2
gcagacgaaaaugcgccuu

SEQ ID NO: 1861472 - RNA, 15 nt, Salmonella typhimurium LT2
gcagacggagaugau

SEQ ID NO: 1861473 - RNA, 13 nt, Salmonella typhimurium LT2
gcagacgccgcgg

SEQ ID NO: 1861474 - RNA, 21 nt, Salmonella typhimurium LT2
gcagacugacgaaacacugau

SEQ ID NO: 1861475 - RNA, 18 nt, Salmonella typhimurium LT2
gcagacuuuagccauucc

SEQ ID NO: 1861476 - RNA, 18 nt, Salmonella typhimurium LT2
gcagacuuucugacaggu

SEQ ID NO: 1861477 - RNA, 16 nt, Salmonella typhimurium LT2
gcagagcggggagacu

SEQ ID NO: 1861478 - RNA, 15 nt, Salmonella typhimurium LT2
gcagauaaaccacgc

SEQ ID NO: 1861479 - RNA, 14 nt, Salmonella typhimurium LT2
gcagauaacaggca

SEQ ID NO: 1861480 - RNA, 20 nt, Salmonella typhimurium LT2
gcagaaaaagcccccaucac

SEQ ID NO: 1861481 - RNA, 16 nt, Salmonella typhimurium LT2
gcagaaaaaucagcau

SEQ ID NO: 1861482 - RNA, 20 nt, Salmonella typhimurium LT2
gcagaaaaagucauuuucau

SEQ ID NO: 1861483 - RNA, 22 nt, Salmonella typhimurium LT2
gcagaaaccggggagcuauccc

SEQ ID NO: 1861484 - RNA, 15 nt, Salmonella typhimurium LT2
gcagaaaggcgugca

SEQ ID NO: 1861485 - RNA, 22 nt, Salmonella typhimurium LT2
gcagaacaaacagaccgccaug

SEQ ID NO: 1861486 - RNA, 20 nt, Salmonella typhimurium LT2
gcagaagcgcggcucuggcg

SEQ ID NO: 1861487 - RNA, 20 nt, Salmonella typhimurium LT2
gcagaagccggucaugccug

SEQ ID NO: 1861488 - RNA, 13 nt, Salmonella typhimurium LT2
gcacuuuaaacca

SEQ ID NO: 1861489 - RNA, 17 nt, Salmonella typhimurium LT2
gcacuugagaaauuauu

SEQ ID NO: 1861490 - RNA, 16 nt, Salmonella typhimurium LT2
gcagcaggcaaggcau

SEQ ID NO: 1861491 - RNA, 13 nt, Salmonella typhimurium LT2
gcagccacgccga

SEQ ID NO: 1861492 - RNA, 17 nt, Salmonella typhimurium LT2
gcagccacggcgcacac

SEQ ID NO: 1861493 - RNA, 16 nt, Salmonella typhimurium LT2
gcagccagaacucauc

SEQ ID NO: 1861494 - RNA, 13 nt, Salmonella typhimurium LT2
gcagccacucccg

SEQ ID NO: 1861495 - RNA, 16 nt, Salmonella typhimurium LT2
gcagccagcccagcgc

SEQ ID NO: 1861496 - RNA, 17 nt, Salmonella typhimurium LT2
gcagccagcccagcgca

SEQ ID NO: 1861497 - RNA, 14 nt, Salmonella typhimurium LT2
gcagccagcccagc

SEQ ID NO: 1861498 - RNA, 18 nt, Salmonella typhimurium LT2
gcagccccggcauccagu

SEQ ID NO: 1861499 - RNA, 17 nt, Salmonella typhimurium LT2
gcagccaugccagcgcg

SEQ ID NO: 1861500 - RNA, 14 nt, Salmonella typhimurium LT2
gcagccucguccug

SEQ ID NO: 1861501 - RNA, 19 nt, Salmonella typhimurium LT2
gcagccuaguucugcgcca

SEQ ID NO: 1861502 - RNA, 21 nt, Salmonella typhimurium LT2
gcagcgaaacgacguccacac

SEQ ID NO: 1861503 - RNA, 15 nt, Salmonella typhimurium LT2
gcagccuggcggcuu

SEQ ID NO: 1861504 - RNA, 14 nt, Salmonella typhimurium LT2
gcagccgccaccac

SEQ ID NO: 1861505 - RNA, 17 nt, Salmonella typhimurium LT2
gcagccgccauccggca

SEQ ID NO: 1861506 - RNA, 19 nt, Salmonella typhimurium LT2
gcagccgguauccagcgcg

SEQ ID NO: 1861507 - RNA, 22 nt, Salmonella typhimurium LT2
gcagaugcccgcagaucugucg

SEQ ID NO: 1861508 - RNA, 14 nt, Salmonella typhimurium LT2
gcagaucgccugga

SEQ ID NO: 1861509 - RNA, 15 nt, Salmonella typhimurium LT2
gcagauccuggcgcu

SEQ ID NO: 1861510 - RNA, 18 nt, Salmonella typhimurium LT2
gcagaucgcgggcaauca

SEQ ID NO: 1861511 - RNA, 18 nt, Salmonella typhimurium LT2
gcagaucguagcguuuug

SEQ ID NO: 1861512 - RNA, 23 nt, Salmonella typhimurium LT2
gcagaucugucgccaugaccugg

SEQ ID NO: 1861513 - RNA, 21 nt, Salmonella typhimurium LT2
gcagauccgcgauaucaauca

SEQ ID NO: 1861514 - RNA, 23 nt, Salmonella typhimurium LT2
gcagcaacguuuguaacagcagg

SEQ ID NO: 1861515 - RNA, 15 nt, Salmonella typhimurium LT2
gcagcaagaacagag

SEQ ID NO: 1861516 - RNA, 17 nt, Salmonella typhimurium LT2
gcagaugguauaaauca

SEQ ID NO: 1861517 - RNA, 18 nt, Salmonella typhimurium LT2
gcagcaccgguuuuuccg

SEQ ID NO: 1861518 - RNA, 19 nt, Salmonella typhimurium LT2
gcagcaaugugcgccagga

SEQ ID NO: 1861519 - RNA, 18 nt, Salmonella typhimurium LT2
gcagcacaaucagcgcgg

SEQ ID NO: 1861520 - RNA, 20 nt, Salmonella typhimurium LT2
gcagcaauacgcccgcccgc

SEQ ID NO: 1861521 - RNA, 15 nt, Salmonella typhimurium LT2
gcagcagcuccccgc

SEQ ID NO: 1861522 - RNA, 18 nt, Salmonella typhimurium LT2
gcagcagcuccccgccgc

SEQ ID NO: 1861523 - RNA, 18 nt, Salmonella typhimurium LT2
gcagcaccucaauaugaa

SEQ ID NO: 1861524 - RNA, 20 nt, Salmonella typhimurium LT2
gcaggcucucgguaguggca

SEQ ID NO: 1861525 - RNA, 24 nt, Salmonella typhimurium LT2
gcaggcuugcccauucgccgacgc

SEQ ID NO: 1861526 - RNA, 19 nt, Salmonella typhimurium LT2
gcaggcggcaaucagcgcc

SEQ ID NO: 1861527 - RNA, 20 nt, Salmonella typhimurium LT2
gcaggcgcgaccucaucaaa

SEQ ID NO: 1861528 - RNA, 23 nt, Salmonella typhimurium LT2
gcaggaucuccagaucgccacga

SEQ ID NO: 1861529 - RNA, 14 nt, Salmonella typhimurium LT2
gcaggaugaaugac

SEQ ID NO: 1861530 - RNA, 19 nt, Salmonella typhimurium LT2
gcaggagggagguucgccu

SEQ ID NO: 1861531 - RNA, 21 nt, Salmonella typhimurium LT2
gcaggauuuguaucacaauca

SEQ ID NO: 1861532 - RNA, 19 nt, Salmonella typhimurium LT2
gcaggccggcagccugccg

SEQ ID NO: 1861533 - RNA, 14 nt, Salmonella typhimurium LT2
gcagcuccagagcg

SEQ ID NO: 1861534 - RNA, 15 nt, Salmonella typhimurium LT2
gcagcuccccgccgc

SEQ ID NO: 1861535 - RNA, 17 nt, Salmonella typhimurium LT2
gcagcuccccgccgcgg

SEQ ID NO: 1861536 - RNA, 19 nt, Salmonella typhimurium LT2
gcagcucgauaaucccggc

SEQ ID NO: 1861537 - RNA, 16 nt, Salmonella typhimurium LT2
gcagcguuggccgccu

SEQ ID NO: 1861538 - RNA, 14 nt, Salmonella typhimurium LT2
gcaggacagcgaca

SEQ ID NO: 1861539 - RNA, 12 nt, Salmonella typhimurium LT2
gcaggacccgag

SEQ ID NO: 1861540 - RNA, 15 nt, Salmonella typhimurium LT2
gcaggacuuaaaaac

SEQ ID NO: 1861541 - RNA, 18 nt, Salmonella typhimurium LT2
gcaggacuuaaaaacaaa

SEQ ID NO: 1861542 - RNA, 23 nt, Salmonella typhimurium LT2
gcaggacguugccgcccaccugc

SEQ ID NO: 1861543 - RNA, 15 nt, Salmonella typhimurium LT2
gcaggaacggcagga

SEQ ID NO: 1861544 - RNA, 21 nt, Salmonella typhimurium LT2
gcagcuucaucauucauccag

SEQ ID NO: 1861545 - RNA, 15 nt, Salmonella typhimurium LT2
gcagcuuaucuuuuu

SEQ ID NO: 1861546 - RNA, 14 nt, Salmonella typhimurium LT2
gcaggaaccacauc

SEQ ID NO: 1861547 - RNA, 14 nt, Salmonella typhimurium LT2
gcaggaacagauac

SEQ ID NO: 1861548 - RNA, 22 nt, Salmonella typhimurium LT2
gcaguaacuucagcaucaucuc

SEQ ID NO: 1861549 - RNA, 17 nt, Salmonella typhimurium LT2
gcaguacacgcaucggg

SEQ ID NO: 1861550 - RNA, 14 nt, Salmonella typhimurium LT2
gcaguaagccagcg

SEQ ID NO: 1861551 - RNA, 16 nt, Salmonella typhimurium LT2
gcagugaccagcauca

SEQ ID NO: 1861552 - RNA, 14 nt, Salmonella typhimurium LT2
gcaguguuaaucuc

SEQ ID NO: 1861553 - RNA, 21 nt, Salmonella typhimurium LT2
gcagugucaaauuguacuuuu

SEQ ID NO: 1861554 - RNA, 18 nt, Salmonella typhimurium LT2
gcaguugggcgcgcgacu

SEQ ID NO: 1861555 - RNA, 17 nt, Salmonella typhimurium LT2
gcaguugcagcguacgg

SEQ ID NO: 1861556 - RNA, 18 nt, Salmonella typhimurium LT2
gcaguucguacuccugca

SEQ ID NO: 1861557 - RNA, 19 nt, Salmonella typhimurium LT2
gcauaaccgcgcguaaauc

SEQ ID NO: 1861558 - RNA, 18 nt, Salmonella typhimurium LT2
gcauaaccgcagcgcggc

SEQ ID NO: 1861559 - RNA, 16 nt, Salmonella typhimurium LT2
gcauacaaagcagaua

SEQ ID NO: 1861560 - RNA, 13 nt, Salmonella typhimurium LT2
gcauaaauaaugc

SEQ ID NO: 1861561 - RNA, 15 nt, Salmonella typhimurium LT2
gcauaaagaacgugu

SEQ ID NO: 1861562 - RNA, 12 nt, Salmonella typhimurium LT2
gcauaaauaaua

SEQ ID NO: 1861563 - RNA, 13 nt, Salmonella typhimurium LT2
gcauaacccgccg

SEQ ID NO: 1861564 - RNA, 18 nt, Salmonella typhimurium LT2
gcaggguauugccgagcg

SEQ ID NO: 1861565 - RNA, 19 nt, Salmonella typhimurium LT2
gcaggguauuugcgcccgc

SEQ ID NO: 1861566 - RNA, 20 nt, Salmonella typhimurium LT2
gcaggguauuugcgcccgcg

SEQ ID NO: 1861567 - RNA, 20 nt, Salmonella typhimurium LT2
gcagggcgauauccagcgcc

SEQ ID NO: 1861568 - RNA, 18 nt, Salmonella typhimurium LT2
gcaggguuugaccucauc

SEQ ID NO: 1861569 - RNA, 22 nt, Salmonella typhimurium LT2
gcagguaguaaccccaguagcc

SEQ ID NO: 1861570 - RNA, 16 nt, Salmonella typhimurium LT2
gcagguggaucugaau

SEQ ID NO: 1861571 - RNA, 21 nt, Salmonella typhimurium LT2
gcacgaugcauaugcacagcg

SEQ ID NO: 1861572 - RNA, 17 nt, Salmonella typhimurium LT2
gcacgaacauaccggag

SEQ ID NO: 1861573 - RNA, 13 nt, Salmonella typhimurium LT2
gcacgaaauguag

SEQ ID NO: 1861574 - RNA, 22 nt, Salmonella typhimurium LT2
gcacgaacauaccggagccugg

SEQ ID NO: 1861575 - RNA, 16 nt, Salmonella typhimurium LT2
gcacgacacaaaagca

SEQ ID NO: 1861576 - RNA, 17 nt, Salmonella typhimurium LT2
gcacgacacaaaagcau

SEQ ID NO: 1861577 - RNA, 17 nt, Salmonella typhimurium LT2
gcacgacagagaucagg

SEQ ID NO: 1861578 - RNA, 17 nt, Salmonella typhimurium LT2
gcaccguggaagcggaa

SEQ ID NO: 1861579 - RNA, 15 nt, Salmonella typhimurium LT2
gcaccguuccgccac

SEQ ID NO: 1861580 - RNA, 21 nt, Salmonella typhimurium LT2
gcaccucaauaugaaauucuu

SEQ ID NO: 1861581 - RNA, 15 nt, Salmonella typhimurium LT2
gcaccugcucaggcu

SEQ ID NO: 1861582 - RNA, 21 nt, Salmonella typhimurium LT2
gcaccccucuucuuuaagaac

SEQ ID NO: 1861583 - RNA, 12 nt, Salmonella typhimurium LT2
gcacccgccauc

SEQ ID NO: 1861584 - RNA, 20 nt, Salmonella typhimurium LT2
gcacccgccaucaugcccac

SEQ ID NO: 1861585 - RNA, 16 nt, Salmonella typhimurium LT2
gcaccgcuaaaaaaca

SEQ ID NO: 1861586 - RNA, 20 nt, Salmonella typhimurium LT2
gcaccgcuaaaaaacaggcg

SEQ ID NO: 1861587 - RNA, 20 nt, Salmonella typhimurium LT2
gcaccgcgaccaguucaccg

SEQ ID NO: 1861588 - RNA, 15 nt, Salmonella typhimurium LT2
gcacccggagagaaa

SEQ ID NO: 1861589 - RNA, 18 nt, Salmonella typhimurium LT2
gcacccuucgcuauccau

SEQ ID NO: 1861590 - RNA, 14 nt, Salmonella typhimurium LT2
gcacagcgccauga

SEQ ID NO: 1861591 - RNA, 21 nt, Salmonella typhimurium LT2
gcacauccauguacuccuggu

SEQ ID NO: 1861592 - RNA, 21 nt, Salmonella typhimurium LT2
gcacagguacaggccgccgcc

SEQ ID NO: 1861593 - RNA, 18 nt, Salmonella typhimurium LT2
gcacacgaaauccaaaca

SEQ ID NO: 1861594 - RNA, 21 nt, Salmonella typhimurium LT2
gcacagauuacaaggaaugau

SEQ ID NO: 1861595 - RNA, 12 nt, Salmonella typhimurium LT2
gcacagcccaua

SEQ ID NO: 1861596 - RNA, 20 nt, Salmonella typhimurium LT2
gcaaugaagcaagugcugga

SEQ ID NO: 1861597 - RNA, 18 nt, Salmonella typhimurium LT2
gcaaugccuaccggcggc

SEQ ID NO: 1861598 - RNA, 15 nt, Salmonella typhimurium LT2
gcaaugccccgccgc

SEQ ID NO: 1861599 - RNA, 16 nt, Salmonella typhimurium LT2
gcaaugcgaauaacau

SEQ ID NO: 1861600 - RNA, 15 nt, Salmonella typhimurium LT2
gcacaacccaaaggc

SEQ ID NO: 1861601 - RNA, 12 nt, Salmonella typhimurium LT2
gcacaaccagcg

SEQ ID NO: 1861602 - RNA, 14 nt, Salmonella typhimurium LT2
gcacaaccagcggc

SEQ ID NO: 1861603 - RNA, 20 nt, Salmonella typhimurium LT2
gcacaaagcguucggccugc

SEQ ID NO: 1861604 - RNA, 15 nt, Salmonella typhimurium LT2
gcacacccugcagac

SEQ ID NO: 1861605 - RNA, 20 nt, Salmonella typhimurium LT2
gcacaccggccauugccgcg

SEQ ID NO: 1861606 - RNA, 14 nt, Salmonella typhimurium LT2
gcaccauggcggcg

SEQ ID NO: 1861607 - RNA, 19 nt, Salmonella typhimurium LT2
gcaccauuaucgcgccgga

SEQ ID NO: 1861608 - RNA, 16 nt, Salmonella typhimurium LT2
gcaccaguucacuccu

SEQ ID NO: 1861609 - RNA, 20 nt, Salmonella typhimurium LT2
gcaccaguucacuccuaaga

SEQ ID NO: 1861610 - RNA, 20 nt, Salmonella typhimurium LT2
gcaccaguuccccauacuga

SEQ ID NO: 1861611 - RNA, 14 nt, Salmonella typhimurium LT2
gcacauucagagcg

SEQ ID NO: 1861612 - RNA, 13 nt, Salmonella typhimurium LT2
gcacauuacaggc

SEQ ID NO: 1861613 - RNA, 19 nt, Salmonella typhimurium LT2
gcacauguuucagcaccuc

SEQ ID NO: 1861614 - RNA, 19 nt, Salmonella typhimurium LT2
gcacaugauggugacuguc

SEQ ID NO: 1861615 - RNA, 14 nt, Salmonella typhimurium LT2
gcacaucggcagga

SEQ ID NO: 1861616 - RNA, 21 nt, Salmonella typhimurium LT2
gcaaggagacgcccgucacca

SEQ ID NO: 1861617 - RNA, 22 nt, Salmonella typhimurium LT2
gcaacuguuuuaccaaaucaau

SEQ ID NO: 1861618 - RNA, 21 nt, Salmonella typhimurium LT2
gcaacuguuuuaccaaaucaa

SEQ ID NO: 1861619 - RNA, 18 nt, Salmonella typhimurium LT2
gcaacuguugcgccagca

SEQ ID NO: 1861620 - RNA, 19 nt, Salmonella typhimurium LT2
gcaagaaucacgccgauga

SEQ ID NO: 1861621 - RNA, 18 nt, Salmonella typhimurium LT2
gcaacgugaacugcgccu

SEQ ID NO: 1861622 - RNA, 14 nt, Salmonella typhimurium LT2
gcaacgucgacccg

SEQ ID NO: 1861623 - RNA, 14 nt, Salmonella typhimurium LT2
gcaacgugaacugc

SEQ ID NO: 1861624 - RNA, 15 nt, Salmonella typhimurium LT2
gcaacguccgcagcc

SEQ ID NO: 1861625 - RNA, 19 nt, Salmonella typhimurium LT2
gcaacguccucuuucgaca

SEQ ID NO: 1861626 - RNA, 16 nt, Salmonella typhimurium LT2
gcaacguuuuccugcg

SEQ ID NO: 1861627 - RNA, 11 nt, Salmonella typhimurium LT2
gcaacugcgcc

SEQ ID NO: 1861628 - RNA, 17 nt, Salmonella typhimurium LT2
gcaacugauuaaucugc

SEQ ID NO: 1861629 - RNA, 16 nt, Salmonella typhimurium LT2
gcaauaaaagcaacau

SEQ ID NO: 1861630 - RNA, 20 nt, Salmonella typhimurium LT2
gcaauaaaguuuauuugaau

SEQ ID NO: 1861631 - RNA, 19 nt, Salmonella typhimurium LT2
gcaauaacacaggcggcgc

SEQ ID NO: 1861632 - RNA, 18 nt, Salmonella typhimurium LT2
gcaaguugcgccacugcc

SEQ ID NO: 1861633 - RNA, 15 nt, Salmonella typhimurium LT2
gcaagggaaucucuu

SEQ ID NO: 1861634 - RNA, 20 nt, Salmonella typhimurium LT2
gcaaucgccugcaacgcuuu

SEQ ID NO: 1861635 - RNA, 21 nt, Salmonella typhimurium LT2
gcaaucgcugccuugagugac

SEQ ID NO: 1861636 - RNA, 13 nt, Salmonella typhimurium LT2
gcaaucgcuggcg

SEQ ID NO: 1861637 - RNA, 14 nt, Salmonella typhimurium LT2
gcaaucgccugaau

SEQ ID NO: 1861638 - RNA, 18 nt, Salmonella typhimurium LT2
gcaaucgggccugcuccg

SEQ ID NO: 1861639 - RNA, 17 nt, Salmonella typhimurium LT2
gcaauaauuaggggcau

SEQ ID NO: 1861640 - RNA, 23 nt, Salmonella typhimurium LT2
gcaaaacggauaauaucuuucuc

SEQ ID NO: 1861641 - RNA, 19 nt, Salmonella typhimurium LT2
gcaaaacgcauccagcgca

SEQ ID NO: 1861642 - RNA, 11 nt, Salmonella typhimurium LT2
gcaacaacagu

SEQ ID NO: 1861643 - RNA, 20 nt, Salmonella typhimurium LT2
gcaacaacaaacacaaucac

SEQ ID NO: 1861644 - RNA, 17 nt, Salmonella typhimurium LT2
gcaacaagcaucauuaa

SEQ ID NO: 1861645 - RNA, 13 nt, Salmonella typhimurium LT2
gcaacaacaggcc

SEQ ID NO: 1861646 - RNA, 19 nt, Salmonella typhimurium LT2
gcaacacggugcggcauua

SEQ ID NO: 1861647 - RNA, 17 nt, Salmonella typhimurium LT2
gcaacagacuauccagg

SEQ ID NO: 1861648 - RNA, 17 nt, Salmonella typhimurium LT2
gcaacacgauccccauc

SEQ ID NO: 1861649 - RNA, 18 nt, Salmonella typhimurium LT2
gcaacaugaaagggaaac

SEQ ID NO: 1861650 - RNA, 13 nt, Salmonella typhimurium LT2
gcaaccaaagccg

SEQ ID NO: 1861651 - RNA, 23 nt, Salmonella typhimurium LT2
gcaaccaaagccggcgccauuuc

SEQ ID NO: 1861652 - RNA, 16 nt, Salmonella typhimurium LT2
gcaaccauuaccgcca

SEQ ID NO: 1861653 - RNA, 18 nt, Salmonella typhimurium LT2
gcaaccaacgcccaacug

SEQ ID NO: 1861654 - RNA, 17 nt, Salmonella typhimurium LT2
gcaacauaaauaaacag

SEQ ID NO: 1861655 - RNA, 14 nt, Salmonella typhimurium LT2
gcaacauagcaucg

SEQ ID NO: 1861656 - RNA, 16 nt, Salmonella typhimurium LT2
gcaacaugcccaccgg

SEQ ID NO: 1861657 - RNA, 22 nt, Salmonella typhimurium LT2
gcaacagggugauuucgcccgc

SEQ ID NO: 1861658 - RNA, 14 nt, Salmonella typhimurium LT2
gcaacgccuuccug

SEQ ID NO: 1861659 - RNA, 18 nt, Salmonella typhimurium LT2
gcaacgccguacuccagc

SEQ ID NO: 1861660 - RNA, 21 nt, Salmonella typhimurium LT2
gcaacgaucccuaauaaaaua

SEQ ID NO: 1861661 - RNA, 22 nt, Salmonella typhimurium LT2
gcaacgcuuuagugccgccauu

SEQ ID NO: 1861662 - RNA, 17 nt, Salmonella typhimurium LT2
gcaacggccagcgcagg

SEQ ID NO: 1861663 - RNA, 20 nt, Salmonella typhimurium LT2
gcaacgggcaguccggcggc

SEQ ID NO: 1861664 - RNA, 19 nt, Salmonella typhimurium LT2
gcaacggccagcgcaggcu

SEQ ID NO: 1861665 - RNA, 16 nt, Salmonella typhimurium LT2
gcaacgggacggcggc

SEQ ID NO: 1861666 - RNA, 21 nt, Salmonella typhimurium LT2
gcaacgagaacccacuuugcu

SEQ ID NO: 1861667 - RNA, 19 nt, Salmonella typhimurium LT2
gcaaccgguacucuuccag

SEQ ID NO: 1861668 - RNA, 23 nt, Salmonella typhimurium LT2
gcaaccuccgcaccuucaucauu

SEQ ID NO: 1861669 - RNA, 13 nt, Salmonella typhimurium LT2
gcaacccauacag

SEQ ID NO: 1861670 - RNA, 15 nt, Salmonella typhimurium LT2
gcaacccgccgccau

SEQ ID NO: 1861671 - RNA, 14 nt, Salmonella typhimurium LT2
gcaaccgccugcac

SEQ ID NO: 1861672 - RNA, 18 nt, Salmonella typhimurium LT2
gccccuguuucgcccgcu

SEQ ID NO: 1861673 - RNA, 18 nt, Salmonella typhimurium LT2
gcccgaccacgcccagcu

SEQ ID NO: 1861674 - RNA, 21 nt, Salmonella typhimurium LT2
gcccgaccagagauaccuuug

SEQ ID NO: 1861675 - RNA, 15 nt, Salmonella typhimurium LT2
gccccuggcaacuug

SEQ ID NO: 1861676 - RNA, 17 nt, Salmonella typhimurium LT2
gccccggucaacgcgcc

SEQ ID NO: 1861677 - RNA, 20 nt, Salmonella typhimurium LT2
gccccuggcgcgccagcucu

SEQ ID NO: 1861678 - RNA, 21 nt, Salmonella typhimurium LT2
gccccgggcgaccacccgcgg

SEQ ID NO: 1861679 - RNA, 14 nt, Salmonella typhimurium LT2
gccccggcgcgcgc

SEQ ID NO: 1861680 - RNA, 16 nt, Salmonella typhimurium LT2
gcccgcauucgcggca

SEQ ID NO: 1861681 - RNA, 12 nt, Salmonella typhimurium LT2
gcccgccagcac

SEQ ID NO: 1861682 - RNA, 16 nt, Salmonella typhimurium LT2
gcccgcagcaaaaaau

SEQ ID NO: 1861683 - RNA, 22 nt, Salmonella typhimurium LT2
gcccgcagcaaaaaauaccccg

SEQ ID NO: 1861684 - RNA, 15 nt, Salmonella typhimurium LT2
gcccgagcgcuggca

SEQ ID NO: 1861685 - RNA, 15 nt, Salmonella typhimurium LT2
gcccgacgccgcggc

SEQ ID NO: 1861686 - RNA, 18 nt, Salmonella typhimurium LT2
gcccgccgccugaugcug

SEQ ID NO: 1861687 - RNA, 13 nt, Salmonella typhimurium LT2
gcccgccgccagc

SEQ ID NO: 1861688 - RNA, 16 nt, Salmonella typhimurium LT2
gcccggguaaugcugc

SEQ ID NO: 1861689 - RNA, 21 nt, Salmonella typhimurium LT2
gcccggcguucucccgggccg

SEQ ID NO: 1861690 - RNA, 11 nt, Salmonella typhimurium LT2
gcccgggcgcu

SEQ ID NO: 1861691 - RNA, 11 nt, Salmonella typhimurium LT2
gcccggcggcg

SEQ ID NO: 1861692 - RNA, 11 nt, Salmonella typhimurium LT2
gcccggccagu

SEQ ID NO: 1861693 - RNA, 21 nt, Salmonella typhimurium LT2
gcccgcguugcgccaagcgcc

SEQ ID NO: 1861694 - RNA, 18 nt, Salmonella typhimurium LT2
gcccuaaaaauagcacca

SEQ ID NO: 1861695 - RNA, 17 nt, Salmonella typhimurium LT2
gcccguucucgccgcgu

SEQ ID NO: 1861696 - RNA, 18 nt, Salmonella typhimurium LT2
gcccguucucgccgcguu

SEQ ID NO: 1861697 - RNA, 19 nt, Salmonella typhimurium LT2
gcccugaagggcggcugga

SEQ ID NO: 1861698 - RNA, 19 nt, Salmonella typhimurium LT2
gcccucuuccagcgccaaa

SEQ ID NO: 1861699 - RNA, 19 nt, Salmonella typhimurium LT2
gcccucuuuaucaaacaaa

SEQ ID NO: 1861700 - RNA, 16 nt, Salmonella typhimurium LT2
gcccugaagggcggcu

SEQ ID NO: 1861701 - RNA, 15 nt, Salmonella typhimurium LT2
gcccugcguuccgcu

SEQ ID NO: 1861702 - RNA, 17 nt, Salmonella typhimurium LT2
gcccaucaauaccagcc

SEQ ID NO: 1861703 - RNA, 20 nt, Salmonella typhimurium LT2
gcccaucaauaccagcccca

SEQ ID NO: 1861704 - RNA, 14 nt, Salmonella typhimurium LT2
gcccauaccagcgc

SEQ ID NO: 1861705 - RNA, 16 nt, Salmonella typhimurium LT2
gcccauaccagcgcgg

SEQ ID NO: 1861706 - RNA, 17 nt, Salmonella typhimurium LT2
gcccauagcaaaguacu

SEQ ID NO: 1861707 - RNA, 17 nt, Salmonella typhimurium LT2
gcccaucagcgccagcc

SEQ ID NO: 1861708 - RNA, 20 nt, Salmonella typhimurium LT2
gcccaucagcgccagcccug

SEQ ID NO: 1861709 - RNA, 17 nt, Salmonella typhimurium LT2
gcccaucaucaucggca

SEQ ID NO: 1861710 - RNA, 13 nt, Salmonella typhimurium LT2
gcccauccagcac

SEQ ID NO: 1861711 - RNA, 16 nt, Salmonella typhimurium LT2
gcccauccagagcagu

SEQ ID NO: 1861712 - RNA, 21 nt, Salmonella typhimurium LT2
gcccaucgcgccaugauucau

SEQ ID NO: 1861713 - RNA, 14 nt, Salmonella typhimurium LT2
gcccaucgccacag

SEQ ID NO: 1861714 - RNA, 15 nt, Salmonella typhimurium LT2
gcccaucgccacagc

SEQ ID NO: 1861715 - RNA, 20 nt, Salmonella typhimurium LT2
gcccagguagaaucccacca

SEQ ID NO: 1861716 - RNA, 20 nt, Salmonella typhimurium LT2
gcccagcuaaaccacggaau

SEQ ID NO: 1861717 - RNA, 19 nt, Salmonella typhimurium LT2
gcccaguccuuccggcgag

SEQ ID NO: 1861718 - RNA, 16 nt, Salmonella typhimurium LT2
gcccacucauccagca

SEQ ID NO: 1861719 - RNA, 18 nt, Salmonella typhimurium LT2
gcccagaaagaucagcag

SEQ ID NO: 1861720 - RNA, 15 nt, Salmonella typhimurium LT2
gcccagcuauuuuuc

SEQ ID NO: 1861721 - RNA, 13 nt, Salmonella typhimurium LT2
gcccaggcccacg

SEQ ID NO: 1861722 - RNA, 15 nt, Salmonella typhimurium LT2
gcccagcgcgguggc

SEQ ID NO: 1861723 - RNA, 16 nt, Salmonella typhimurium LT2
gcccagcacgucgcgc

SEQ ID NO: 1861724 - RNA, 15 nt, Salmonella typhimurium LT2
gcccauggcaucaau

SEQ ID NO: 1861725 - RNA, 14 nt, Salmonella typhimurium LT2
gcccaucgccgccu

SEQ ID NO: 1861726 - RNA, 15 nt, Salmonella typhimurium LT2
gcccaucggcacacu

SEQ ID NO: 1861727 - RNA, 19 nt, Salmonella typhimurium LT2
gcccaugauggugaacaga

SEQ ID NO: 1861728 - RNA, 17 nt, Salmonella typhimurium LT2
gcccaugaucaggcgac

SEQ ID NO: 1861729 - RNA, 14 nt, Salmonella typhimurium LT2
gcccauuccgccug

SEQ ID NO: 1861730 - RNA, 15 nt, Salmonella typhimurium LT2
gcccauugaaaucgc

SEQ ID NO: 1861731 - RNA, 15 nt, Salmonella typhimurium LT2
gcccauuugcgagaa

SEQ ID NO: 1861732 - RNA, 13 nt, Salmonella typhimurium LT2
gcccauuucagca

SEQ ID NO: 1861733 - RNA, 18 nt, Salmonella typhimurium LT2
gcccauugucaucaguau

SEQ ID NO: 1861734 - RNA, 18 nt, Salmonella typhimurium LT2
gccccaacagaccgcugu

SEQ ID NO: 1861735 - RNA, 16 nt, Salmonella typhimurium LT2
gccccacauuggaaaa

SEQ ID NO: 1861736 - RNA, 13 nt, Salmonella typhimurium LT2
gccccaacgcgcu

SEQ ID NO: 1861737 - RNA, 18 nt, Salmonella typhimurium LT2
gccccaaccguuuugcaa

SEQ ID NO: 1861738 - RNA, 12 nt, Salmonella typhimurium LT2
gccccagcacca

SEQ ID NO: 1861739 - RNA, 21 nt, Salmonella typhimurium LT2
gccccagcaugagccagcccu

SEQ ID NO: 1861740 - RNA, 18 nt, Salmonella typhimurium LT2
gccccagcaugagccagc

SEQ ID NO: 1861741 - RNA, 18 nt, Salmonella typhimurium LT2
gccccagcagcagccggu

SEQ ID NO: 1861742 - RNA, 15 nt, Salmonella typhimurium LT2
gccccagcgccagcu

SEQ ID NO: 1861743 - RNA, 23 nt, Salmonella typhimurium LT2
gccccaggcuauccagcucaccg

SEQ ID NO: 1861744 - RNA, 19 nt, Salmonella typhimurium LT2
gcccccaugccgccugccg

SEQ ID NO: 1861745 - RNA, 15 nt, Salmonella typhimurium LT2
gcccccaugccgccu

SEQ ID NO: 1861746 - RNA, 13 nt, Salmonella typhimurium LT2
gcccccaguuccu

SEQ ID NO: 1861747 - RNA, 16 nt, Salmonella typhimurium LT2
gcccccaguuccugcu

SEQ ID NO: 1861748 - RNA, 15 nt, Salmonella typhimurium LT2
gccccccgcacagca

SEQ ID NO: 1861749 - RNA, 16 nt, Salmonella typhimurium LT2
gcccccccuaagccua

SEQ ID NO: 1861750 - RNA, 19 nt, Salmonella typhimurium LT2
gccccauuugccgcgccug

SEQ ID NO: 1861751 - RNA, 21 nt, Salmonella typhimurium LT2
gcccccaaauugaccucaugc

SEQ ID NO: 1861752 - RNA, 17 nt, Salmonella typhimurium LT2
gccccgccacagccgca

SEQ ID NO: 1861753 - RNA, 13 nt, Salmonella typhimurium LT2
gcccccucggcag

SEQ ID NO: 1861754 - RNA, 16 nt, Salmonella typhimurium LT2
gcccccuccagccagc

SEQ ID NO: 1861755 - RNA, 20 nt, Salmonella typhimurium LT2
gcccccuccagccagcgcca

SEQ ID NO: 1861756 - RNA, 18 nt, Salmonella typhimurium LT2
gccagcagggucaggaac

SEQ ID NO: 1861757 - RNA, 14 nt, Salmonella typhimurium LT2
gccagcagcauaaa

SEQ ID NO: 1861758 - RNA, 22 nt, Salmonella typhimurium LT2
gccagcgguugcggagaucauc

SEQ ID NO: 1861759 - RNA, 13 nt, Salmonella typhimurium LT2
gccagcgggcgga

SEQ ID NO: 1861760 - RNA, 14 nt, Salmonella typhimurium LT2
gccagcgccaauac

SEQ ID NO: 1861761 - RNA, 15 nt, Salmonella typhimurium LT2
gccagcgccaguacu

SEQ ID NO: 1861762 - RNA, 19 nt, Salmonella typhimurium LT2
gccagggcaucgcgcgaga

SEQ ID NO: 1861763 - RNA, 18 nt, Salmonella typhimurium LT2
gccagggcggaagcagau

SEQ ID NO: 1861764 - RNA, 17 nt, Salmonella typhimurium LT2
gccagggcgcagguuuu

SEQ ID NO: 1861765 - RNA, 21 nt, Salmonella typhimurium LT2
gccagggaacuccagcagggc

SEQ ID NO: 1861766 - RNA, 22 nt, Salmonella typhimurium LT2
gccaggcccgguggcgccgcgc

SEQ ID NO: 1861767 - RNA, 20 nt, Salmonella typhimurium LT2
gccaggcccguuccuuaguu

SEQ ID NO: 1861768 - RNA, 22 nt, Salmonella typhimurium LT2
gccagguauugagcgaaacagg

SEQ ID NO: 1861769 - RNA, 19 nt, Salmonella typhimurium LT2
gccaggaagucagcuuccu

SEQ ID NO: 1861770 - RNA, 22 nt, Salmonella typhimurium LT2
gccaggaaccgccgaugcacaa

SEQ ID NO: 1861771 - RNA, 21 nt, Salmonella typhimurium LT2
gccaggcauugauaaagcgcu

SEQ ID NO: 1861772 - RNA, 16 nt, Salmonella typhimurium LT2
gccaggccacggcugu

SEQ ID NO: 1861773 - RNA, 18 nt, Salmonella typhimurium LT2
gccaggcauaccuccucu

SEQ ID NO: 1861774 - RNA, 20 nt, Salmonella typhimurium LT2
gccagcucaugcgcggcggg

SEQ ID NO: 1861775 - RNA, 18 nt, Salmonella typhimurium LT2
gccagcucaugcgcggcg

SEQ ID NO: 1861776 - RNA, 21 nt, Salmonella typhimurium LT2
gccaguuaagcaacugauuaa

SEQ ID NO: 1861777 - RNA, 15 nt, Salmonella typhimurium LT2
gccaguucacgccgc

SEQ ID NO: 1861778 - RNA, 19 nt, Salmonella typhimurium LT2
gccaguucauucgccacca

SEQ ID NO: 1861779 - RNA, 23 nt, Salmonella typhimurium LT2
gccaguucauucgccaccaggcu

SEQ ID NO: 1861780 - RNA, 15 nt, Salmonella typhimurium LT2
gccaguuccgccacg

SEQ ID NO: 1861781 - RNA, 15 nt, Salmonella typhimurium LT2
gccaguuuguaacca

SEQ ID NO: 1861782 - RNA, 21 nt, Salmonella typhimurium LT2
gccauaaaccccgauaaacca

SEQ ID NO: 1861783 - RNA, 18 nt, Salmonella typhimurium LT2
gccauaaagcuguaccug

SEQ ID NO: 1861784 - RNA, 17 nt, Salmonella typhimurium LT2
gccaguuuagggaucau

SEQ ID NO: 1861785 - RNA, 21 nt, Salmonella typhimurium LT2
gccaguuguccgcuggucagc

SEQ ID NO: 1861786 - RNA, 16 nt, Salmonella typhimurium LT2
gccaguucuuguaguu

SEQ ID NO: 1861787 - RNA, 18 nt, Salmonella typhimurium LT2
gccagucuuccauuacaa

SEQ ID NO: 1861788 - RNA, 19 nt, Salmonella typhimurium LT2
gccagugcauagcagcgcc

SEQ ID NO: 1861789 - RNA, 20 nt, Salmonella typhimurium LT2
gccagugcauagcagcgccc

SEQ ID NO: 1861790 - RNA, 20 nt, Salmonella typhimurium LT2
gccaguagauggcgcuaaaa

SEQ ID NO: 1861791 - RNA, 14 nt, Salmonella typhimurium LT2
gccaguccgcccgc

SEQ ID NO: 1861792 - RNA, 22 nt, Salmonella typhimurium LT2
gccaguagcgggggccggccgc

SEQ ID NO: 1861793 - RNA, 15 nt, Salmonella typhimurium LT2
gccagucgccaggca

SEQ ID NO: 1861794 - RNA, 16 nt, Salmonella typhimurium LT2
gccauauaugaaaucg

SEQ ID NO: 1861795 - RNA, 18 nt, Salmonella typhimurium LT2
gccauaucggcacugcuu

SEQ ID NO: 1861796 - RNA, 16 nt, Salmonella typhimurium LT2
gccauauucucuggcg

SEQ ID NO: 1861797 - RNA, 19 nt, Salmonella typhimurium LT2
gccauccacggccccgggc

SEQ ID NO: 1861798 - RNA, 20 nt, Salmonella typhimurium LT2
gccauccagcaccaggcgag

SEQ ID NO: 1861799 - RNA, 16 nt, Salmonella typhimurium LT2
gccaucccugacaaua

SEQ ID NO: 1861800 - RNA, 15 nt, Salmonella typhimurium LT2
gccauccgacaacau

SEQ ID NO: 1861801 - RNA, 21 nt, Salmonella typhimurium LT2
gccauaacggcuguccauccg

SEQ ID NO: 1861802 - RNA, 18 nt, Salmonella typhimurium LT2
gccauaacaacuauuuuu

SEQ ID NO: 1861803 - RNA, 18 nt, Salmonella typhimurium LT2
gccauaaucgcguuuucc

SEQ ID NO: 1861804 - RNA, 19 nt, Salmonella typhimurium LT2
gccauaaucgcguuuuccu

SEQ ID NO: 1861805 - RNA, 23 nt, Salmonella typhimurium LT2
gccauaaucaguacugcgcccgc

SEQ ID NO: 1861806 - RNA, 13 nt, Salmonella typhimurium LT2
gccauagcgggca

SEQ ID NO: 1861807 - RNA, 17 nt, Salmonella typhimurium LT2
gccauacuuacugcugu

SEQ ID NO: 1861808 - RNA, 16 nt, Salmonella typhimurium LT2
gccaugaugagcgcca

SEQ ID NO: 1861809 - RNA, 12 nt, Salmonella typhimurium LT2
gccaugauucau

SEQ ID NO: 1861810 - RNA, 21 nt, Salmonella typhimurium LT2
gccaugaucgccgccaucggc

SEQ ID NO: 1861811 - RNA, 14 nt, Salmonella typhimurium LT2
gccaugcauaugaa

SEQ ID NO: 1861812 - RNA, 15 nt, Salmonella typhimurium LT2
gccaugccagcaguu

SEQ ID NO: 1861813 - RNA, 17 nt, Salmonella typhimurium LT2
gccaugcccggcggcgg

SEQ ID NO: 1861814 - RNA, 18 nt, Salmonella typhimurium LT2
gccaugcccggcggcggc

SEQ ID NO: 1861815 - RNA, 14 nt, Salmonella typhimurium LT2
gccaucgcggcgca

SEQ ID NO: 1861816 - RNA, 20 nt, Salmonella typhimurium LT2
gccaucggcaaacgccgccu

SEQ ID NO: 1861817 - RNA, 21 nt, Salmonella typhimurium LT2
gccaucggcuaagccaaaaau

SEQ ID NO: 1861818 - RNA, 21 nt, Salmonella typhimurium LT2
gccaucggcauaacccgccgc

SEQ ID NO: 1861819 - RNA, 16 nt, Salmonella typhimurium LT2
gccaucggccagcagg

SEQ ID NO: 1861820 - RNA, 17 nt, Salmonella typhimurium LT2
gccaucgggcaauggca

SEQ ID NO: 1861821 - RNA, 17 nt, Salmonella typhimurium LT2
gccaucgggcauuucag

SEQ ID NO: 1861822 - RNA, 11 nt, Salmonella typhimurium LT2
gccauccggca

SEQ ID NO: 1861823 - RNA, 20 nt, Salmonella typhimurium LT2
gccauccggcacuacagcgu

SEQ ID NO: 1861824 - RNA, 20 nt, Salmonella typhimurium LT2
gccacggagcauaauuuucc

SEQ ID NO: 1861825 - RNA, 15 nt, Salmonella typhimurium LT2
gccacggauggccuc

SEQ ID NO: 1861826 - RNA, 19 nt, Salmonella typhimurium LT2
gccacgcucgcuggugcca

SEQ ID NO: 1861827 - RNA, 16 nt, Salmonella typhimurium LT2
gccacgccgcccgcgu

SEQ ID NO: 1861828 - RNA, 16 nt, Salmonella typhimurium LT2
gccacggucggcaaug

SEQ ID NO: 1861829 - RNA, 22 nt, Salmonella typhimurium LT2
gccacguugucggcucauccag

SEQ ID NO: 1861830 - RNA, 16 nt, Salmonella typhimurium LT2
gccacuagcucagcug

SEQ ID NO: 1861831 - RNA, 17 nt, Salmonella typhimurium LT2
gccacuagcucagcugg

SEQ ID NO: 1861832 - RNA, 12 nt, Salmonella typhimurium LT2
gccacuauccag

SEQ ID NO: 1861833 - RNA, 19 nt, Salmonella typhimurium LT2
gccagacagauaacaccag

SEQ ID NO: 1861834 - RNA, 19 nt, Salmonella typhimurium LT2
gccacugcauuacucgccu

SEQ ID NO: 1861835 - RNA, 23 nt, Salmonella typhimurium LT2
gccagaaauugccguacagauug

SEQ ID NO: 1861836 - RNA, 13 nt, Salmonella typhimurium LT2
gccagaagcccgg

SEQ ID NO: 1861837 - RNA, 22 nt, Salmonella typhimurium LT2
gccagaagagaauggccagcac

SEQ ID NO: 1861838 - RNA, 15 nt, Salmonella typhimurium LT2
gccagaugcagcggc

SEQ ID NO: 1861839 - RNA, 21 nt, Salmonella typhimurium LT2
gccagaugcccguaaagcucg

SEQ ID NO: 1861840 - RNA, 18 nt, Salmonella typhimurium LT2
gccagauaaagcagcgac

SEQ ID NO: 1861841 - RNA, 17 nt, Salmonella typhimurium LT2
gccagauaaucgccgcc

SEQ ID NO: 1861842 - RNA, 21 nt, Salmonella typhimurium LT2
gccagauaaucgccgccagcu

SEQ ID NO: 1861843 - RNA, 14 nt, Salmonella typhimurium LT2
gccagaugauagug

SEQ ID NO: 1861844 - RNA, 21 nt, Salmonella typhimurium LT2
gccagauaguaaugcucaacu

SEQ ID NO: 1861845 - RNA, 23 nt, Salmonella typhimurium LT2
gcauaccaaguuuggcaaucaaa

SEQ ID NO: 1861846 - RNA, 15 nt, Salmonella typhimurium LT2
gcauacagcuuuuac

SEQ ID NO: 1861847 - RNA, 13 nt, Salmonella typhimurium LT2
gcauaccuucaca

SEQ ID NO: 1861848 - RNA, 18 nt, Salmonella typhimurium LT2
gccacaggcggcaugggu

SEQ ID NO: 1861849 - RNA, 18 nt, Salmonella typhimurium LT2
gcauagcuguuccgcaac

SEQ ID NO: 1861850 - RNA, 23 nt, Salmonella typhimurium LT2
gcauagccggauaauuuauccag

SEQ ID NO: 1861851 - RNA, 19 nt, Salmonella typhimurium LT2
gccacaucguuggccgcca

SEQ ID NO: 1861852 - RNA, 16 nt, Salmonella typhimurium LT2
gccacaugcggcaggc

SEQ ID NO: 1861853 - RNA, 14 nt, Salmonella typhimurium LT2
gccacgccaauagu

SEQ ID NO: 1861854 - RNA, 15 nt, Salmonella typhimurium LT2
gccacgcccacgcug

SEQ ID NO: 1861855 - RNA, 21 nt, Salmonella typhimurium LT2
gccacgccaucggcuaagcca

SEQ ID NO: 1861856 - RNA, 22 nt, Salmonella typhimurium LT2
gccacgccgaggcauucagcca

SEQ ID NO: 1861857 - RNA, 14 nt, Salmonella typhimurium LT2
gccacgcccgccgc

SEQ ID NO: 1861858 - RNA, 14 nt, Salmonella typhimurium LT2
gccacgccgcccgc

SEQ ID NO: 1861859 - RNA, 12 nt, Salmonella typhimurium LT2
gccacgccgccc

SEQ ID NO: 1861860 - RNA, 19 nt, Salmonella typhimurium LT2
gccacgagccuucuggcca

SEQ ID NO: 1861861 - RNA, 20 nt, Salmonella typhimurium LT2
gccacgcagauaucuuccag

SEQ ID NO: 1861862 - RNA, 21 nt, Salmonella typhimurium LT2
gccaccuuugacgccugcauc

SEQ ID NO: 1861863 - RNA, 16 nt, Salmonella typhimurium LT2
gccacgaccugcaguu

SEQ ID NO: 1861864 - RNA, 22 nt, Salmonella typhimurium LT2
gccaccuuaaucgacuucaugc

SEQ ID NO: 1861865 - RNA, 12 nt, Salmonella typhimurium LT2
gccaccuuccag

SEQ ID NO: 1861866 - RNA, 13 nt, Salmonella typhimurium LT2
gccaccuuccagg

SEQ ID NO: 1861867 - RNA, 15 nt, Salmonella typhimurium LT2
gccaccguaacuaaa

SEQ ID NO: 1861868 - RNA, 15 nt, Salmonella typhimurium LT2
gccaccgccagcagu

SEQ ID NO: 1861869 - RNA, 13 nt, Salmonella typhimurium LT2
gccaccgccagcc

SEQ ID NO: 1861870 - RNA, 16 nt, Salmonella typhimurium LT2
gccaccgcauuuucag

SEQ ID NO: 1861871 - RNA, 15 nt, Salmonella typhimurium LT2
gccaccgggcauggc

SEQ ID NO: 1861872 - RNA, 21 nt, Salmonella typhimurium LT2
gccaccgggcaacacacgcuu

SEQ ID NO: 1861873 - RNA, 21 nt, Salmonella typhimurium LT2
gccgccauucgcuuccgccgg

SEQ ID NO: 1861874 - RNA, 20 nt, Salmonella typhimurium LT2
gccgccauccggcacaguau

SEQ ID NO: 1861875 - RNA, 14 nt, Salmonella typhimurium LT2
gccgcccaaccagc

SEQ ID NO: 1861876 - RNA, 24 nt, Salmonella typhimurium LT2
gccgccauuuuaucgacacuauuu

SEQ ID NO: 1861877 - RNA, 23 nt, Salmonella typhimurium LT2
gccgccagcucgucggccagcgc

SEQ ID NO: 1861878 - RNA, 22 nt, Salmonella typhimurium LT2
gccgccaguaauuuuucuccca

SEQ ID NO: 1861879 - RNA, 17 nt, Salmonella typhimurium LT2
gccgccauaacgccggc

SEQ ID NO: 1861880 - RNA, 20 nt, Salmonella typhimurium LT2
gccgccaucaggcaugaccu

SEQ ID NO: 1861881 - RNA, 15 nt, Salmonella typhimurium LT2
gccgccccaaaucuc

SEQ ID NO: 1861882 - RNA, 12 nt, Salmonella typhimurium LT2
gccgcccaucaa

SEQ ID NO: 1861883 - RNA, 22 nt, Salmonella typhimurium LT2
gccgcccaucaauaccagcccc

SEQ ID NO: 1861884 - RNA, 19 nt, Salmonella typhimurium LT2
gccgcccaucgccacagcg

SEQ ID NO: 1861885 - RNA, 14 nt, Salmonella typhimurium LT2
gccgcccagcgaac

SEQ ID NO: 1861886 - RNA, 23 nt, Salmonella typhimurium LT2
gccgcccgcaugguaaacgcauc

SEQ ID NO: 1861887 - RNA, 18 nt, Salmonella typhimurium LT2
gccgccuccagcauacug

SEQ ID NO: 1861888 - RNA, 15 nt, Salmonella typhimurium LT2
gccgccugaugcugg

SEQ ID NO: 1861889 - RNA, 22 nt, Salmonella typhimurium LT2
gccgccugcacggcgucaucca

SEQ ID NO: 1861890 - RNA, 14 nt, Salmonella typhimurium LT2
gccgccugaugcug

SEQ ID NO: 1861891 - RNA, 11 nt, Salmonella typhimurium LT2
gccgccgcagg

SEQ ID NO: 1861892 - RNA, 18 nt, Salmonella typhimurium LT2
gccgccgcaccacugcug

SEQ ID NO: 1861893 - RNA, 22 nt, Salmonella typhimurium LT2
gccgccgggaucagcggcugca

SEQ ID NO: 1861894 - RNA, 21 nt, Salmonella typhimurium LT2
gccgccguaacgugcuccagc

SEQ ID NO: 1861895 - RNA, 15 nt, Salmonella typhimurium LT2
gccgccguccaggcc

SEQ ID NO: 1861896 - RNA, 17 nt, Salmonella typhimurium LT2
gccgccaaagcgcccga

SEQ ID NO: 1861897 - RNA, 13 nt, Salmonella typhimurium LT2
gccgcauuuuucc

SEQ ID NO: 1861898 - RNA, 14 nt, Salmonella typhimurium LT2
gccgccaaagcgcc

SEQ ID NO: 1861899 - RNA, 18 nt, Salmonella typhimurium LT2
gccgcauccuguuuuuuc

SEQ ID NO: 1861900 - RNA, 17 nt, Salmonella typhimurium LT2
gccgcagcuccaugucu

SEQ ID NO: 1861901 - RNA, 12 nt, Salmonella typhimurium LT2
gccgcaggccau

SEQ ID NO: 1861902 - RNA, 16 nt, Salmonella typhimurium LT2
gccgcagcggcucgcg

SEQ ID NO: 1861903 - RNA, 21 nt, Salmonella typhimurium LT2
gccgcacuucacgcuccuuga

SEQ ID NO: 1861904 - RNA, 21 nt, Salmonella typhimurium LT2
gccgauggccgacauugacca

SEQ ID NO: 1861905 - RNA, 16 nt, Salmonella typhimurium LT2
gccgauagcggcggcg

SEQ ID NO: 1861906 - RNA, 22 nt, Salmonella typhimurium LT2
gccgauauugcggccuuccuga

SEQ ID NO: 1861907 - RNA, 20 nt, Salmonella typhimurium LT2
gccgauauugcggccuuccu

SEQ ID NO: 1861908 - RNA, 16 nt, Salmonella typhimurium LT2
gccgauauugccuuca

SEQ ID NO: 1861909 - RNA, 17 nt, Salmonella typhimurium LT2
gcccuggguugcccaaa

SEQ ID NO: 1861910 - RNA, 14 nt, Salmonella typhimurium LT2
gccgaugccgccga

SEQ ID NO: 1861911 - RNA, 18 nt, Salmonella typhimurium LT2
gccgaugacucccagucc

SEQ ID NO: 1861912 - RNA, 21 nt, Salmonella typhimurium LT2
gccgaugaucccggcgccgcc

SEQ ID NO: 1861913 - RNA, 18 nt, Salmonella typhimurium LT2
gccgggcauaaacuaauc

SEQ ID NO: 1861914 - RNA, 13 nt, Salmonella typhimurium LT2
gccgggccgccga

SEQ ID NO: 1861915 - RNA, 17 nt, Salmonella typhimurium LT2
gccgggccugagcgcgc

SEQ ID NO: 1861916 - RNA, 14 nt, Salmonella typhimurium LT2
gccggggcgcuggc

SEQ ID NO: 1861917 - RNA, 13 nt, Salmonella typhimurium LT2
gccggggcgcugg

SEQ ID NO: 1861918 - RNA, 16 nt, Salmonella typhimurium LT2
gccgggcuugagcccg

SEQ ID NO: 1861919 - RNA, 16 nt, Salmonella typhimurium LT2
gccggcuucuuccggc

SEQ ID NO: 1861920 - RNA, 19 nt, Salmonella typhimurium LT2
gccgcuuuuuccgccgccg

SEQ ID NO: 1861921 - RNA, 21 nt, Salmonella typhimurium LT2
gccgcuuuuuccgccgccgug

SEQ ID NO: 1861922 - RNA, 14 nt, Salmonella typhimurium LT2
gccggaaaaaggcc

SEQ ID NO: 1861923 - RNA, 17 nt, Salmonella typhimurium LT2
gccggaaagaauaaucg

SEQ ID NO: 1861924 - RNA, 22 nt, Salmonella typhimurium LT2
gccggaaagaauaaucgccgcc

SEQ ID NO: 1861925 - RNA, 17 nt, Salmonella typhimurium LT2
gccggaaacuggcguca

SEQ ID NO: 1861926 - RNA, 23 nt, Salmonella typhimurium LT2
gccggaaaggauauaagcgccau

SEQ ID NO: 1861927 - RNA, 17 nt, Salmonella typhimurium LT2
gccgcugucgccagaau

SEQ ID NO: 1861928 - RNA, 16 nt, Salmonella typhimurium LT2
gccggacgccacgcuc

SEQ ID NO: 1861929 - RNA, 14 nt, Salmonella typhimurium LT2
gccggacggcggcu

SEQ ID NO: 1861930 - RNA, 17 nt, Salmonella typhimurium LT2
gccggacggcggcugcg

SEQ ID NO: 1861931 - RNA, 14 nt, Salmonella typhimurium LT2
gccggacaggcgac

SEQ ID NO: 1861932 - RNA, 17 nt, Salmonella typhimurium LT2
gccggacaguucgccaa

SEQ ID NO: 1861933 - RNA, 20 nt, Salmonella typhimurium LT2
gccggacaguucgccaacgc

SEQ ID NO: 1861934 - RNA, 21 nt, Salmonella typhimurium LT2
gccggacagagugucuacacu

SEQ ID NO: 1861935 - RNA, 23 nt, Salmonella typhimurium LT2
gccggcaucauucugcaggcggg

SEQ ID NO: 1861936 - RNA, 19 nt, Salmonella typhimurium LT2
gccggcaucauucugcagg

SEQ ID NO: 1861937 - RNA, 17 nt, Salmonella typhimurium LT2
gccggauaaggcgcagc

SEQ ID NO: 1861938 - RNA, 13 nt, Salmonella typhimurium LT2
gccggauaaggca

SEQ ID NO: 1861939 - RNA, 23 nt, Salmonella typhimurium LT2
gccggauaauuuauccaguaacg

SEQ ID NO: 1861940 - RNA, 13 nt, Salmonella typhimurium LT2
gccggauagcgcu

SEQ ID NO: 1861941 - RNA, 15 nt, Salmonella typhimurium LT2
gccggauaagacgcg

SEQ ID NO: 1861942 - RNA, 22 nt, Salmonella typhimurium LT2
gccggauaagacgcgcagcggc

SEQ ID NO: 1861943 - RNA, 13 nt, Salmonella typhimurium LT2
gccgcgcccagca

SEQ ID NO: 1861944 - RNA, 17 nt, Salmonella typhimurium LT2
gccgcgccaccgggccg

SEQ ID NO: 1861945 - RNA, 20 nt, Salmonella typhimurium LT2
gccgcggugauccuccugca

SEQ ID NO: 1861946 - RNA, 16 nt, Salmonella typhimurium LT2
gccgcguuucucgccg

SEQ ID NO: 1861947 - RNA, 14 nt, Salmonella typhimurium LT2
gccgcugagaaaaa

SEQ ID NO: 1861948 - RNA, 20 nt, Salmonella typhimurium LT2
gccgcugagaaaaagcgaag

SEQ ID NO: 1861949 - RNA, 17 nt, Salmonella typhimurium LT2
gccgcuggcgaccagcc

SEQ ID NO: 1861950 - RNA, 17 nt, Salmonella typhimurium LT2
gccucguccugcaauuu

SEQ ID NO: 1861951 - RNA, 15 nt, Salmonella typhimurium LT2
gccucguuugcugag

SEQ ID NO: 1861952 - RNA, 17 nt, Salmonella typhimurium LT2
gccucguuugcugagca

SEQ ID NO: 1861953 - RNA, 19 nt, Salmonella typhimurium LT2
gccucggcgcccagcgugc

SEQ ID NO: 1861954 - RNA, 11 nt, Salmonella typhimurium LT2
gccucgcugac

SEQ ID NO: 1861955 - RNA, 21 nt, Salmonella typhimurium LT2
gccucgcugacgccagccagc

SEQ ID NO: 1861956 - RNA, 15 nt, Salmonella typhimurium LT2
gccucgcucaccggc

SEQ ID NO: 1861957 - RNA, 17 nt, Salmonella typhimurium LT2
gccucgcgcaccccggc

SEQ ID NO: 1861958 - RNA, 20 nt, Salmonella typhimurium LT2
gccuccauuuuggggaaaau

SEQ ID NO: 1861959 - RNA, 13 nt, Salmonella typhimurium LT2
gccuccccugccg

SEQ ID NO: 1861960 - RNA, 18 nt, Salmonella typhimurium LT2
gccuccgcguagcccagc

SEQ ID NO: 1861961 - RNA, 16 nt, Salmonella typhimurium LT2
gccuccgaagagaccu

SEQ ID NO: 1861962 - RNA, 20 nt, Salmonella typhimurium LT2
gccuccggaugacgccgcuu

SEQ ID NO: 1861963 - RNA, 20 nt, Salmonella typhimurium LT2
gccucgaccccuucgccuuc

SEQ ID NO: 1861964 - RNA, 14 nt, Salmonella typhimurium LT2
gccucaucugcuuc

SEQ ID NO: 1861965 - RNA, 16 nt, Salmonella typhimurium LT2
gccucauuaaaaaaac

SEQ ID NO: 1861966 - RNA, 20 nt, Salmonella typhimurium LT2
gccucaucgacagacuucac

SEQ ID NO: 1861967 - RNA, 16 nt, Salmonella typhimurium LT2
gccucauccgcugaca

SEQ ID NO: 1861968 - RNA, 18 nt, Salmonella typhimurium LT2
gccuccagcacuuccuga

SEQ ID NO: 1861969 - RNA, 22 nt, Salmonella typhimurium LT2
gccuccagacuggcgaccgcca

SEQ ID NO: 1861970 - RNA, 11 nt, Salmonella typhimurium LT2
gccucauugau

SEQ ID NO: 1861971 - RNA, 21 nt, Salmonella typhimurium LT2
gccgugccugacguccacgga

SEQ ID NO: 1861972 - RNA, 21 nt, Salmonella typhimurium LT2
gccgugcccagcaucccgcug

SEQ ID NO: 1861973 - RNA, 12 nt, Salmonella typhimurium LT2
gccgugauucau

SEQ ID NO: 1861974 - RNA, 13 nt, Salmonella typhimurium LT2
gccgugaucccaa

SEQ ID NO: 1861975 - RNA, 17 nt, Salmonella typhimurium LT2
gccgucguucagccagc

SEQ ID NO: 1861976 - RNA, 19 nt, Salmonella typhimurium LT2
gccguguugugugccgcgc

SEQ ID NO: 1861977 - RNA, 12 nt, Salmonella typhimurium LT2
gccguggcuggc

SEQ ID NO: 1861978 - RNA, 15 nt, Salmonella typhimurium LT2
gccggguaaacgcag

SEQ ID NO: 1861979 - RNA, 21 nt, Salmonella typhimurium LT2
gccggguauugugccccgcgc

SEQ ID NO: 1861980 - RNA, 12 nt, Salmonella typhimurium LT2
gccggguuaaaa

SEQ ID NO: 1861981 - RNA, 17 nt, Salmonella typhimurium LT2
gccgucgucaccgccgc

SEQ ID NO: 1861982 - RNA, 21 nt, Salmonella typhimurium LT2
gccgguaaucgaucccgccgc

SEQ ID NO: 1861983 - RNA, 16 nt, Salmonella typhimurium LT2
gccuauguuaugcaca

SEQ ID NO: 1861984 - RNA, 18 nt, Salmonella typhimurium LT2
gccuauuuucucuuccac

SEQ ID NO: 1861985 - RNA, 21 nt, Salmonella typhimurium LT2
gccucaaccaacggcgcuggc

SEQ ID NO: 1861986 - RNA, 14 nt, Salmonella typhimurium LT2
gccuagcgcgcgca

SEQ ID NO: 1861987 - RNA, 12 nt, Salmonella typhimurium LT2
gccuaucgccau

SEQ ID NO: 1861988 - RNA, 18 nt, Salmonella typhimurium LT2
gccuacgugcucacggca

SEQ ID NO: 1861989 - RNA, 20 nt, Salmonella typhimurium LT2
gccuacgugcucucaacaua

SEQ ID NO: 1861990 - RNA, 15 nt, Salmonella typhimurium LT2
gccuacgacagcgcu

SEQ ID NO: 1861991 - RNA, 14 nt, Salmonella typhimurium LT2
gccuagaugaauga

SEQ ID NO: 1861992 - RNA, 15 nt, Salmonella typhimurium LT2
gccuagaugaaugac

SEQ ID NO: 1861993 - RNA, 23 nt, Salmonella typhimurium LT2
gccuagaugaaugacuguccacg

SEQ ID NO: 1861994 - RNA, 20 nt, Salmonella typhimurium LT2
gccuacaccguuucugaucu

SEQ ID NO: 1861995 - RNA, 15 nt, Salmonella typhimurium LT2
gccuacacaucaucu

SEQ ID NO: 1861996 - RNA, 15 nt, Salmonella typhimurium LT2
gccuaaugagccaga

SEQ ID NO: 1861997 - RNA, 12 nt, Salmonella typhimurium LT2
gccuacaaagcc

SEQ ID NO: 1861998 - RNA, 15 nt, Salmonella typhimurium LT2
gccuaccugccgcca

SEQ ID NO: 1861999 - RNA, 17 nt, Salmonella typhimurium LT2
gccuacccuuucacccg

SEQ ID NO: 1862000 - RNA, 20 nt, Salmonella typhimurium LT2
gccuacccuuucacccgcgc

SEQ ID NO: 1862001 - RNA, 22 nt, Salmonella typhimurium LT2
gccuaccgauaaaucaaacgca

SEQ ID NO: 1862002 - RNA, 15 nt, Salmonella typhimurium LT2
gccuacccgcgugcg

SEQ ID NO: 1862003 - RNA, 16 nt, Salmonella typhimurium LT2
gccuaagaccagcacc

SEQ ID NO: 1862004 - RNA, 17 nt, Salmonella typhimurium LT2
gccuaacuggaaaaaga

SEQ ID NO: 1862005 - RNA, 15 nt, Salmonella typhimurium LT2
gccuaacgccagcau

SEQ ID NO: 1862006 - RNA, 12 nt, Salmonella typhimurium LT2
gccuaagcccac

SEQ ID NO: 1862007 - RNA, 18 nt, Salmonella typhimurium LT2
gccuaagcccaccaucag

SEQ ID NO: 1862008 - RNA, 22 nt, Salmonella typhimurium LT2
gccguugcgucaaugcccggca

SEQ ID NO: 1862009 - RNA, 21 nt, Salmonella typhimurium LT2
gccugccagauccaacacauc

SEQ ID NO: 1862010 - RNA, 13 nt, Salmonella typhimurium LT2
gccugccagcacc

SEQ ID NO: 1862011 - RNA, 21 nt, Salmonella typhimurium LT2
gccugcaguuuugcauucugc

SEQ ID NO: 1862012 - RNA, 19 nt, Salmonella typhimurium LT2
gccugcauaaacgcggcca

SEQ ID NO: 1862013 - RNA, 22 nt, Salmonella typhimurium LT2
gccugcauaaaggaguaacaga

SEQ ID NO: 1862014 - RNA, 18 nt, Salmonella typhimurium LT2
gccugcaugucuucaugu

SEQ ID NO: 1862015 - RNA, 12 nt, Salmonella typhimurium LT2
gccugcagaccc

SEQ ID NO: 1862016 - RNA, 13 nt, Salmonella typhimurium LT2
gccugcagaccca

SEQ ID NO: 1862017 - RNA, 19 nt, Salmonella typhimurium LT2
gccugcagauuauuucacu

SEQ ID NO: 1862018 - RNA, 23 nt, Salmonella typhimurium LT2
gccugccguaaacaggcaggccc

SEQ ID NO: 1862019 - RNA, 22 nt, Salmonella typhimurium LT2
gccugccgucuuuuagcaucag

SEQ ID NO: 1862020 - RNA, 16 nt, Salmonella typhimurium LT2
gccugccgcgccgccg

SEQ ID NO: 1862021 - RNA, 19 nt, Salmonella typhimurium LT2
gccugccgcauguccccag

SEQ ID NO: 1862022 - RNA, 17 nt, Salmonella typhimurium LT2
gccugccgcagcggcuc

SEQ ID NO: 1862023 - RNA, 18 nt, Salmonella typhimurium LT2
gccugccugguaagcaga

SEQ ID NO: 1862024 - RNA, 16 nt, Salmonella typhimurium LT2
gccugcgaaacagggc

SEQ ID NO: 1862025 - RNA, 16 nt, Salmonella typhimurium LT2
gccugccgcaucugac

SEQ ID NO: 1862026 - RNA, 15 nt, Salmonella typhimurium LT2
gccugccguuuuuaa

SEQ ID NO: 1862027 - RNA, 14 nt, Salmonella typhimurium LT2
gccugcgaagauga

SEQ ID NO: 1862028 - RNA, 16 nt, Salmonella typhimurium LT2
gccugcgaucuguguc

SEQ ID NO: 1862029 - RNA, 15 nt, Salmonella typhimurium LT2
gccugcgccagcgcc

SEQ ID NO: 1862030 - RNA, 17 nt, Salmonella typhimurium LT2
gccugauuucccaguug

SEQ ID NO: 1862031 - RNA, 13 nt, Salmonella typhimurium LT2
gccugauuucuga

SEQ ID NO: 1862032 - RNA, 17 nt, Salmonella typhimurium LT2
gccugauggcgcugcgc

SEQ ID NO: 1862033 - RNA, 19 nt, Salmonella typhimurium LT2
gccugauggcgcugcgcuu

SEQ ID NO: 1862034 - RNA, 22 nt, Salmonella typhimurium LT2
gccugauggcgcuacgcuuauc

SEQ ID NO: 1862035 - RNA, 15 nt, Salmonella typhimurium LT2
gccugaucuuucugg

SEQ ID NO: 1862036 - RNA, 17 nt, Salmonella typhimurium LT2
gccugaugacgcugcgc

SEQ ID NO: 1862037 - RNA, 16 nt, Salmonella typhimurium LT2
gccugaucuuucuggu

SEQ ID NO: 1862038 - RNA, 21 nt, Salmonella typhimurium LT2
gccugaugaaaggccaucaca

SEQ ID NO: 1862039 - RNA, 13 nt, Salmonella typhimurium LT2
gccugauggcgcu

SEQ ID NO: 1862040 - RNA, 18 nt, Salmonella typhimurium LT2
gccugaucgcgcagacag

SEQ ID NO: 1862041 - RNA, 21 nt, Salmonella typhimurium LT2
gccugacgaccauugccaaug

SEQ ID NO: 1862042 - RNA, 20 nt, Salmonella typhimurium LT2
gccugacgaaaaucauccag

SEQ ID NO: 1862043 - RNA, 21 nt, Salmonella typhimurium LT2
gccugacgaaaaucauccagu

SEQ ID NO: 1862044 - RNA, 17 nt, Salmonella typhimurium LT2
gccugacagcaaugagc

SEQ ID NO: 1862045 - RNA, 18 nt, Salmonella typhimurium LT2
gccugacggcgcugucac

SEQ ID NO: 1862046 - RNA, 22 nt, Salmonella typhimurium LT2
gccugauaagcgcagcgccauc

SEQ ID NO: 1862047 - RNA, 23 nt, Salmonella typhimurium LT2
gccugauaaaaaaacgccgccuu

SEQ ID NO: 1862048 - RNA, 15 nt, Salmonella typhimurium LT2
gccugauaaauaugc

SEQ ID NO: 1862049 - RNA, 13 nt, Salmonella typhimurium LT2
gccugagcuuucc

SEQ ID NO: 1862050 - RNA, 15 nt, Salmonella typhimurium LT2
gccugagcgccagcg

SEQ ID NO: 1862051 - RNA, 18 nt, Salmonella typhimurium LT2
gccugagcgccagcgugc

SEQ ID NO: 1862052 - RNA, 21 nt, Salmonella typhimurium LT2
gccucuuuuuucgccacgcca

SEQ ID NO: 1862053 - RNA, 23 nt, Salmonella typhimurium LT2
gccugaaaauagcgccauugcga

SEQ ID NO: 1862054 - RNA, 20 nt, Salmonella typhimurium LT2
gccucuuuuuagcagcaaua

SEQ ID NO: 1862055 - RNA, 19 nt, Salmonella typhimurium LT2
gccucuuuuuucgccacgc

SEQ ID NO: 1862056 - RNA, 22 nt, Salmonella typhimurium LT2
gccugaaugcagaccucugcuu

SEQ ID NO: 1862057 - RNA, 13 nt, Salmonella typhimurium LT2
gccugaauaauga

SEQ ID NO: 1862058 - RNA, 21 nt, Salmonella typhimurium LT2
gccucuucuggcucccgcagc

SEQ ID NO: 1862059 - RNA, 22 nt, Salmonella typhimurium LT2
gccucuucuaaaucauaccagc

SEQ ID NO: 1862060 - RNA, 13 nt, Salmonella typhimurium LT2
gccucucccgaac

SEQ ID NO: 1862061 - RNA, 15 nt, Salmonella typhimurium LT2
gccucuccucgaugc

SEQ ID NO: 1862062 - RNA, 14 nt, Salmonella typhimurium LT2
gccucuaucuucuc

SEQ ID NO: 1862063 - RNA, 18 nt, Salmonella typhimurium LT2
gccucucguaagagaggc

SEQ ID NO: 1862064 - RNA, 18 nt, Salmonella typhimurium LT2
gccuguuagggcgcggcu

SEQ ID NO: 1862065 - RNA, 13 nt, Salmonella typhimurium LT2
gccuguucaucag

SEQ ID NO: 1862066 - RNA, 15 nt, Salmonella typhimurium LT2
gccugucuauuguuu

SEQ ID NO: 1862067 - RNA, 16 nt, Salmonella typhimurium LT2
gccugucguacuccag

SEQ ID NO: 1862068 - RNA, 20 nt, Salmonella typhimurium LT2
gccugucgccgucaauguca

SEQ ID NO: 1862069 - RNA, 21 nt, Salmonella typhimurium LT2
gccuguacuugcgccgccauc

SEQ ID NO: 1862070 - RNA, 17 nt, Salmonella typhimurium LT2
gccuguaaugccgccug

SEQ ID NO: 1862071 - RNA, 16 nt, Salmonella typhimurium LT2
gccugguaagcgcagc

SEQ ID NO: 1862072 - RNA, 18 nt, Salmonella typhimurium LT2
gccuguaccgcuucccgc

SEQ ID NO: 1862073 - RNA, 19 nt, Salmonella typhimurium LT2
gccuguaccgggcagacau

SEQ ID NO: 1862074 - RNA, 17 nt, Salmonella typhimurium LT2
gccuggcggcuuccugu

SEQ ID NO: 1862075 - RNA, 20 nt, Salmonella typhimurium LT2
gccuggugcgggucaaaagc

SEQ ID NO: 1862076 - RNA, 21 nt, Salmonella typhimurium LT2
gccugcgcuggaaucauccac

SEQ ID NO: 1862077 - RNA, 20 nt, Salmonella typhimurium LT2
gccugcggauuuuucgccag

SEQ ID NO: 1862078 - RNA, 21 nt, Salmonella typhimurium LT2
gccugcgcucauauacccugc

SEQ ID NO: 1862079 - RNA, 23 nt, Salmonella typhimurium LT2
gccugcgcuuugugcuccaccag

SEQ ID NO: 1862080 - RNA, 15 nt, Salmonella typhimurium LT2
gccugcgucgcccca

SEQ ID NO: 1862081 - RNA, 20 nt, Salmonella typhimurium LT2
gccugcgguaaucgccgcga

SEQ ID NO: 1862082 - RNA, 14 nt, Salmonella typhimurium LT2
gccugcugccugca

SEQ ID NO: 1862083 - RNA, 18 nt, Salmonella typhimurium LT2
gccugcuuuaacgcgcca

SEQ ID NO: 1862084 - RNA, 16 nt, Salmonella typhimurium LT2
gccugcuuugaccugu

SEQ ID NO: 1862085 - RNA, 18 nt, Salmonella typhimurium LT2
gccugcuuugaccuguuu

SEQ ID NO: 1862086 - RNA, 17 nt, Salmonella typhimurium LT2
gccugcuuaaacagaau

SEQ ID NO: 1862087 - RNA, 18 nt, Salmonella typhimurium LT2
gccugcuuaaacagaauu

SEQ ID NO: 1862088 - RNA, 13 nt, Salmonella typhimurium LT2
gcgggcuggcugg

SEQ ID NO: 1862089 - RNA, 12 nt, Salmonella typhimurium LT2
gcgggcauuuuu

SEQ ID NO: 1862090 - RNA, 13 nt, Salmonella typhimurium LT2
gcgggucaaaagc

SEQ ID NO: 1862091 - RNA, 15 nt, Salmonella typhimurium LT2
gcggguccgcggagg

SEQ ID NO: 1862092 - RNA, 17 nt, Salmonella typhimurium LT2
gcggcuguguucauccc

SEQ ID NO: 1862093 - RNA, 15 nt, Salmonella typhimurium LT2
gcggcuguucaccac

SEQ ID NO: 1862094 - RNA, 14 nt, Salmonella typhimurium LT2
gcggcuuacccuga

SEQ ID NO: 1862095 - RNA, 22 nt, Salmonella typhimurium LT2
gcggcugaaccacccugaaaag

SEQ ID NO: 1862096 - RNA, 13 nt, Salmonella typhimurium LT2
gcggcuucaauac

SEQ ID NO: 1862097 - RNA, 12 nt, Salmonella typhimurium LT2
gcgggcagcagc

SEQ ID NO: 1862098 - RNA, 21 nt, Salmonella typhimurium LT2
gcgggcagcagcagcagcaga

SEQ ID NO: 1862099 - RNA, 21 nt, Salmonella typhimurium LT2
gcgggcagacaaaacauaucc

SEQ ID NO: 1862100 - RNA, 18 nt, Salmonella typhimurium LT2
gcgggcaaccuucaaguu

SEQ ID NO: 1862101 - RNA, 14 nt, Salmonella typhimurium LT2
gcggguucuuucuu

SEQ ID NO: 1862102 - RNA, 15 nt, Salmonella typhimurium LT2
gcggucaaacuugug

SEQ ID NO: 1862103 - RNA, 16 nt, Salmonella typhimurium LT2
gcgguauccuccugcc

SEQ ID NO: 1862104 - RNA, 17 nt, Salmonella typhimurium LT2
gcgguggauggcuuccg

SEQ ID NO: 1862105 - RNA, 13 nt, Salmonella typhimurium LT2
gcgguggauacgu

SEQ ID NO: 1862106 - RNA, 19 nt, Salmonella typhimurium LT2
gcguacuuucgccaguuca

SEQ ID NO: 1862107 - RNA, 15 nt, Salmonella typhimurium LT2
gcguaccgcgcgccc

SEQ ID NO: 1862108 - RNA, 21 nt, Salmonella typhimurium LT2
gcguaccgcuaucgccaaacu

SEQ ID NO: 1862109 - RNA, 22 nt, Salmonella typhimurium LT2
gcguaccggccacaauugccag

SEQ ID NO: 1862110 - RNA, 20 nt, Salmonella typhimurium LT2
gcguaccagaaacagcgcgc

SEQ ID NO: 1862111 - RNA, 21 nt, Salmonella typhimurium LT2
gcguaauccggccuggcgcag

SEQ ID NO: 1862112 - RNA, 14 nt, Salmonella typhimurium LT2
gcguaauccagcuu

SEQ ID NO: 1862113 - RNA, 19 nt, Salmonella typhimurium LT2
gcguaauaugggcacaacc

SEQ ID NO: 1862114 - RNA, 22 nt, Salmonella typhimurium LT2
gcguaauuuugccacccacuuc

SEQ ID NO: 1862115 - RNA, 17 nt, Salmonella typhimurium LT2
gcguaauuuuuccaguu

SEQ ID NO: 1862116 - RNA, 18 nt, Salmonella typhimurium LT2
gcguacaauggcaggcau

SEQ ID NO: 1862117 - RNA, 23 nt, Salmonella typhimurium LT2
gcgguuacagucuuuggaguaga

SEQ ID NO: 1862118 - RNA, 16 nt, Salmonella typhimurium LT2
gcgguucaggccggau

SEQ ID NO: 1862119 - RNA, 16 nt, Salmonella typhimurium LT2
gcguaaagauuagaau

SEQ ID NO: 1862120 - RNA, 14 nt, Salmonella typhimurium LT2
gcguaacgccacau

SEQ ID NO: 1862121 - RNA, 19 nt, Salmonella typhimurium LT2
gcgguuuucaauaauaaaa

SEQ ID NO: 1862122 - RNA, 23 nt, Salmonella typhimurium LT2
gcgguuuaccgugaagcccggcg

SEQ ID NO: 1862123 - RNA, 20 nt, Salmonella typhimurium LT2
gcgguuucaggccagacuga

SEQ ID NO: 1862124 - RNA, 21 nt, Salmonella typhimurium LT2
gcgguuugacgacuuuaucaa

SEQ ID NO: 1862125 - RNA, 19 nt, Salmonella typhimurium LT2
gcggcgcgauaugucucuc

SEQ ID NO: 1862126 - RNA, 13 nt, Salmonella typhimurium LT2
gcggcgcgcccgg

SEQ ID NO: 1862127 - RNA, 14 nt, Salmonella typhimurium LT2
gcggcgcgcccggc

SEQ ID NO: 1862128 - RNA, 18 nt, Salmonella typhimurium LT2
gcggcgcucgccagcccg

SEQ ID NO: 1862129 - RNA, 18 nt, Salmonella typhimurium LT2
gcggcgcucaauguggcu

SEQ ID NO: 1862130 - RNA, 15 nt, Salmonella typhimurium LT2
gcggcgacaucgcca

SEQ ID NO: 1862131 - RNA, 21 nt, Salmonella typhimurium LT2
gcggccuucgcagaucgccug

SEQ ID NO: 1862132 - RNA, 22 nt, Salmonella typhimurium LT2
gcggccuucgcagaucgccugg

SEQ ID NO: 1862133 - RNA, 16 nt, Salmonella typhimurium LT2
gcggccuuuauccagc

SEQ ID NO: 1862134 - RNA, 20 nt, Salmonella typhimurium LT2
gcggcgaaauauuaucgcca

SEQ ID NO: 1862135 - RNA, 14 nt, Salmonella typhimurium LT2
gcggccuccuggcu

SEQ ID NO: 1862136 - RNA, 20 nt, Salmonella typhimurium LT2
gcggccuccggcgcgaacgg

SEQ ID NO: 1862137 - RNA, 23 nt, Salmonella typhimurium LT2
gcggcccgggagaacgccgggcc

SEQ ID NO: 1862138 - RNA, 22 nt, Salmonella typhimurium LT2
gcggcaggauccccaucccaau

SEQ ID NO: 1862139 - RNA, 18 nt, Salmonella typhimurium LT2
gcggcaggccggcagccu

SEQ ID NO: 1862140 - RNA, 18 nt, Salmonella typhimurium LT2
gcggcauacuuucgcgcg

SEQ ID NO: 1862141 - RNA, 21 nt, Salmonella typhimurium LT2
gcggcauaaauccggugcguu

SEQ ID NO: 1862142 - RNA, 21 nt, Salmonella typhimurium LT2
gcggcagucccaaugcggaaa

SEQ ID NO: 1862143 - RNA, 16 nt, Salmonella typhimurium LT2
gcgcuguacgccucuu

SEQ ID NO: 1862144 - RNA, 23 nt, Salmonella typhimurium LT2
gcgcuguauaaucccgcggcgga

SEQ ID NO: 1862145 - RNA, 16 nt, Salmonella typhimurium LT2
gcgcugucaccagcag

SEQ ID NO: 1862146 - RNA, 17 nt, Salmonella typhimurium LT2
gcgcugucaccagcagc

SEQ ID NO: 1862147 - RNA, 15 nt, Salmonella typhimurium LT2
gcgcugucugccggc

SEQ ID NO: 1862148 - RNA, 21 nt, Salmonella typhimurium LT2
gcggcagcacgagcauccaga

SEQ ID NO: 1862149 - RNA, 19 nt, Salmonella typhimurium LT2
gcggcagaauuaacucauc

SEQ ID NO: 1862150 - RNA, 24 nt, Salmonella typhimurium LT2
gcggcacugcucuuuaacaauuua

SEQ ID NO: 1862151 - RNA, 13 nt, Salmonella typhimurium LT2
gcggccagcgggc

SEQ ID NO: 1862152 - RNA, 14 nt, Salmonella typhimurium LT2
gcggccaucacgcu

SEQ ID NO: 1862153 - RNA, 20 nt, Salmonella typhimurium LT2
gcggccaugaucgccgccau

SEQ ID NO: 1862154 - RNA, 16 nt, Salmonella typhimurium LT2
gcggccaugaucgccg

SEQ ID NO: 1862155 - RNA, 12 nt, Salmonella typhimurium LT2
gcggccagcaug

SEQ ID NO: 1862156 - RNA, 20 nt, Salmonella typhimurium LT2
gcggccagaaccugcucggc

SEQ ID NO: 1862157 - RNA, 22 nt, Salmonella typhimurium LT2
gcggcauuggcguuaccggcag

SEQ ID NO: 1862158 - RNA, 16 nt, Salmonella typhimurium LT2
gcggcaucagccugca

SEQ ID NO: 1862159 - RNA, 16 nt, Salmonella typhimurium LT2
gcggccaaaucgucag

SEQ ID NO: 1862160 - RNA, 19 nt, Salmonella typhimurium LT2
gcggcaucucgccaaacca

SEQ ID NO: 1862161 - RNA, 16 nt, Salmonella typhimurium LT2
gcggcaugauccacca

SEQ ID NO: 1862162 - RNA, 11 nt, Salmonella typhimurium LT2
gcucgcuggug

SEQ ID NO: 1862163 - RNA, 16 nt, Salmonella typhimurium LT2
gcucgcuuaucuggcc

SEQ ID NO: 1862164 - RNA, 12 nt, Salmonella typhimurium LT2
gcucgcggcgga

SEQ ID NO: 1862165 - RNA, 17 nt, Salmonella typhimurium LT2
gcucgcguaacagcggu

SEQ ID NO: 1862166 - RNA, 17 nt, Salmonella typhimurium LT2
gcucgcgcagauagagc

SEQ ID NO: 1862167 - RNA, 19 nt, Salmonella typhimurium LT2
gcucgccguuuuuuaaccg

SEQ ID NO: 1862168 - RNA, 19 nt, Salmonella typhimurium LT2
gcucgccugugcccgcggu

SEQ ID NO: 1862169 - RNA, 13 nt, Salmonella typhimurium LT2
gcucgccagcgca

SEQ ID NO: 1862170 - RNA, 22 nt, Salmonella typhimurium LT2
gcuccgccagcaaugccgccgc

SEQ ID NO: 1862171 - RNA, 15 nt, Salmonella typhimurium LT2
gcuccgccagcaaug

SEQ ID NO: 1862172 - RNA, 14 nt, Salmonella typhimurium LT2
gcuccgggccguga

SEQ ID NO: 1862173 - RNA, 22 nt, Salmonella typhimurium LT2
gcuccgggcgguucggcugccc

SEQ ID NO: 1862174 - RNA, 17 nt, Salmonella typhimurium LT2
gcuccgguaucgccggc

SEQ ID NO: 1862175 - RNA, 12 nt, Salmonella typhimurium LT2
gcuccgcacggu

SEQ ID NO: 1862176 - RNA, 17 nt, Salmonella typhimurium LT2
gcuccguccugugucuu

SEQ ID NO: 1862177 - RNA, 20 nt, Salmonella typhimurium LT2
gcuccaguuguuccagcagc

SEQ ID NO: 1862178 - RNA, 21 nt, Salmonella typhimurium LT2
gcuccaguuguuccagcagcu

SEQ ID NO: 1862179 - RNA, 16 nt, Salmonella typhimurium LT2
gcuccaguuucgccag

SEQ ID NO: 1862180 - RNA, 17 nt, Salmonella typhimurium LT2
gcuccaguuucgccagc

SEQ ID NO: 1862181 - RNA, 19 nt, Salmonella typhimurium LT2
gcuccauagaaaucagcag

SEQ ID NO: 1862182 - RNA, 15 nt, Salmonella typhimurium LT2
gcuccauagaaauca

SEQ ID NO: 1862183 - RNA, 12 nt, Salmonella typhimurium LT2
gcucaauuuuuu

SEQ ID NO: 1862184 - RNA, 14 nt, Salmonella typhimurium LT2
gcucaauuuuuuuc

SEQ ID NO: 1862185 - RNA, 15 nt, Salmonella typhimurium LT2
gcucaauguggcuua

SEQ ID NO: 1862186 - RNA, 21 nt, Salmonella typhimurium LT2
gcucaauaucuuccuggcgcu

SEQ ID NO: 1862187 - RNA, 17 nt, Salmonella typhimurium LT2
gcuagugccgccaggca

SEQ ID NO: 1862188 - RNA, 15 nt, Salmonella typhimurium LT2
gcuaguauauuaaau

SEQ ID NO: 1862189 - RNA, 23 nt, Salmonella typhimurium LT2
gcuagcugugguugcccgcaggc

SEQ ID NO: 1862190 - RNA, 13 nt, Salmonella typhimurium LT2
gcuagcuucaggu

SEQ ID NO: 1862191 - RNA, 13 nt, Salmonella typhimurium LT2
gcuacugcaucug

SEQ ID NO: 1862192 - RNA, 21 nt, Salmonella typhimurium LT2
gcuacuuuauaaaucaggaaa

SEQ ID NO: 1862193 - RNA, 21 nt, Salmonella typhimurium LT2
gcucacugguugcccauggca

SEQ ID NO: 1862194 - RNA, 19 nt, Salmonella typhimurium LT2
gcucagaccauauucacgc

SEQ ID NO: 1862195 - RNA, 18 nt, Salmonella typhimurium LT2
gcucacuuuucuuuccug

SEQ ID NO: 1862196 - RNA, 13 nt, Salmonella typhimurium LT2
gcucaggaucaau

SEQ ID NO: 1862197 - RNA, 19 nt, Salmonella typhimurium LT2
gcucaggagcgccugacag

SEQ ID NO: 1862198 - RNA, 13 nt, Salmonella typhimurium LT2
gcucagccaggcg

SEQ ID NO: 1862199 - RNA, 21 nt, Salmonella typhimurium LT2
gcucagccaggcgcggcgcgc

SEQ ID NO: 1862200 - RNA, 19 nt, Salmonella typhimurium LT2
gcucaccacgucauccggc

SEQ ID NO: 1862201 - RNA, 15 nt, Salmonella typhimurium LT2
gcucaccgacuccuc

SEQ ID NO: 1862202 - RNA, 18 nt, Salmonella typhimurium LT2
gcucaccgacuccucaac

SEQ ID NO: 1862203 - RNA, 15 nt, Salmonella typhimurium LT2
gcucauuauuuggau

SEQ ID NO: 1862204 - RNA, 17 nt, Salmonella typhimurium LT2
gcucauuuuauccaaca

SEQ ID NO: 1862205 - RNA, 13 nt, Salmonella typhimurium LT2
gcucauuucccaa

SEQ ID NO: 1862206 - RNA, 22 nt, Salmonella typhimurium LT2
gcucauuugcggcgucgccugg

SEQ ID NO: 1862207 - RNA, 16 nt, Salmonella typhimurium LT2
gcucauuucagcgagu

SEQ ID NO: 1862208 - RNA, 17 nt, Salmonella typhimurium LT2
gcuccagcgccagcucc

SEQ ID NO: 1862209 - RNA, 18 nt, Salmonella typhimurium LT2
gcuccagcgccugcugca

SEQ ID NO: 1862210 - RNA, 21 nt, Salmonella typhimurium LT2
gcuccagcgccugcugcaacg

SEQ ID NO: 1862211 - RNA, 12 nt, Salmonella typhimurium LT2
gcuccagccgcu

SEQ ID NO: 1862212 - RNA, 14 nt, Salmonella typhimurium LT2
gcuccagcaucaca

SEQ ID NO: 1862213 - RNA, 9 nt, Salmonella typhimurium LT2
gcuccagca

SEQ ID NO: 1862214 - RNA, 13 nt, Salmonella typhimurium LT2
gcuccagagcgcc

SEQ ID NO: 1862215 - RNA, 13 nt, Salmonella typhimurium LT2
gcucauccagcaa

SEQ ID NO: 1862216 - RNA, 14 nt, Salmonella typhimurium LT2
gcucauccagcagc

SEQ ID NO: 1862217 - RNA, 15 nt, Salmonella typhimurium LT2
gcucauccagcagca

SEQ ID NO: 1862218 - RNA, 17 nt, Salmonella typhimurium LT2
gcucauaccgccgccca

SEQ ID NO: 1862219 - RNA, 17 nt, Salmonella typhimurium LT2
gcucauaacccuccugc

SEQ ID NO: 1862220 - RNA, 19 nt, Salmonella typhimurium LT2
gcucauaacccuccugccu

SEQ ID NO: 1862221 - RNA, 22 nt, Salmonella typhimurium LT2
gcucaucaaacagcggcacuuc

SEQ ID NO: 1862222 - RNA, 18 nt, Salmonella typhimurium LT2
gcucaguccagccgccgc

SEQ ID NO: 1862223 - RNA, 16 nt, Salmonella typhimurium LT2
gcucagucacuucaac

SEQ ID NO: 1862224 - RNA, 18 nt, Salmonella typhimurium LT2
gcucagucacuucaaccu

SEQ ID NO: 1862225 - RNA, 20 nt, Salmonella typhimurium LT2
gcucagucacuucaaccuuu

SEQ ID NO: 1862226 - RNA, 22 nt, Salmonella typhimurium LT2
gcucagguucgggccaccuucc

SEQ ID NO: 1862227 - RNA, 15 nt, Salmonella typhimurium LT2
gcucaguugguuaga

SEQ ID NO: 1862228 - RNA, 22 nt, Salmonella typhimurium LT2
gcucagguaggugauaagcagg

SEQ ID NO: 1862229 - RNA, 23 nt, Salmonella typhimurium LT2
gcucagggucagaauacagaauc

SEQ ID NO: 1862230 - RNA, 16 nt, Salmonella typhimurium LT2
gcucagggcauccgcc

SEQ ID NO: 1862231 - RNA, 19 nt, Salmonella typhimurium LT2
gcucaggcgcgaauaaugc

SEQ ID NO: 1862232 - RNA, 20 nt, Salmonella typhimurium LT2
gcuaaucaggacaucaaagg

SEQ ID NO: 1862233 - RNA, 17 nt, Salmonella typhimurium LT2
gcuaaucaggaagaaag

SEQ ID NO: 1862234 - RNA, 19 nt, Salmonella typhimurium LT2
gcuaaucaggaagaaagac

SEQ ID NO: 1862235 - RNA, 18 nt, Salmonella typhimurium LT2
gcuaaugaggaaaaagcc

SEQ ID NO: 1862236 - RNA, 17 nt, Salmonella typhimurium LT2
gcuaacgggcugaccgc

SEQ ID NO: 1862237 - RNA, 17 nt, Salmonella typhimurium LT2
gcuaagcaacaguucac

SEQ ID NO: 1862238 - RNA, 22 nt, Salmonella typhimurium LT2
gcuaagggcaccagcaacacau

SEQ ID NO: 1862239 - RNA, 14 nt, Salmonella typhimurium LT2
gcuaaagcaucggg

SEQ ID NO: 1862240 - RNA, 18 nt, Salmonella typhimurium LT2
gcuaaagccuaccaccuc

SEQ ID NO: 1862241 - RNA, 19 nt, Salmonella typhimurium LT2
gcuaaagcgacuuauccgg

SEQ ID NO: 1862242 - RNA, 18 nt, Salmonella typhimurium LT2
gcuaaacguagcauuucc

SEQ ID NO: 1862243 - RNA, 22 nt, Salmonella typhimurium LT2
gcuaaaccacucguucccgcgc

SEQ ID NO: 1862244 - RNA, 16 nt, Salmonella typhimurium LT2
gcuaaccuguucagcc

SEQ ID NO: 1862245 - RNA, 18 nt, Salmonella typhimurium LT2
gcuaaccagcgagcuaca

SEQ ID NO: 1862246 - RNA, 23 nt, Salmonella typhimurium LT2
gcuaaaugacaaauagaagccac

SEQ ID NO: 1862247 - RNA, 15 nt, Salmonella typhimurium LT2
gcuaaaucagugaug

SEQ ID NO: 1862248 - RNA, 18 nt, Salmonella typhimurium LT2
gcuaccagcgcggcgcca

SEQ ID NO: 1862249 - RNA, 17 nt, Salmonella typhimurium LT2
gcuacagacgcauuaaa

SEQ ID NO: 1862250 - RNA, 16 nt, Salmonella typhimurium LT2
gcuaauggcuuauugg

SEQ ID NO: 1862251 - RNA, 14 nt, Salmonella typhimurium LT2
gcuaaugauuaucu

SEQ ID NO: 1862252 - RNA, 21 nt, Salmonella typhimurium LT2
gcuacaaccagcgcggccaga

SEQ ID NO: 1862253 - RNA, 18 nt, Salmonella typhimurium LT2
gcuaauuuccccccagac

SEQ ID NO: 1862254 - RNA, 15 nt, Salmonella typhimurium LT2
gcuacgcuuaucggg

SEQ ID NO: 1862255 - RNA, 15 nt, Salmonella typhimurium LT2
gcuacggcucccucg

SEQ ID NO: 1862256 - RNA, 16 nt, Salmonella typhimurium LT2
gcuacgauaaagcugg

SEQ ID NO: 1862257 - RNA, 16 nt, Salmonella typhimurium LT2
gcuaccguccaaauca

SEQ ID NO: 1862258 - RNA, 17 nt, Salmonella typhimurium LT2
gcguaucguaagccacu

SEQ ID NO: 1862259 - RNA, 15 nt, Salmonella typhimurium LT2
gcguauagccaggca

SEQ ID NO: 1862260 - RNA, 18 nt, Salmonella typhimurium LT2
gcguaugacgcacacggc

SEQ ID NO: 1862261 - RNA, 16 nt, Salmonella typhimurium LT2
gcgucugacagcgcgc

SEQ ID NO: 1862262 - RNA, 15 nt, Salmonella typhimurium LT2
gcgucuggagcgugc

SEQ ID NO: 1862263 - RNA, 23 nt, Salmonella typhimurium LT2
gcgugaacgucuuauccggccug

SEQ ID NO: 1862264 - RNA, 14 nt, Salmonella typhimurium LT2
gcgugaacacaccc

SEQ ID NO: 1862265 - RNA, 13 nt, Salmonella typhimurium LT2
gcgucuucuucca

SEQ ID NO: 1862266 - RNA, 22 nt, Salmonella typhimurium LT2
gcgucuucuuccacuucagcca

SEQ ID NO: 1862267 - RNA, 17 nt, Salmonella typhimurium LT2
gcguuauuugcauuuuc

SEQ ID NO: 1862268 - RNA, 16 nt, Salmonella typhimurium LT2
gcguuaucuguaauug

SEQ ID NO: 1862269 - RNA, 23 nt, Salmonella typhimurium LT2
gcguuaucgcuaauucucccugc

SEQ ID NO: 1862270 - RNA, 24 nt, Salmonella typhimurium LT2
gcgugguaucucgucgccagggcg

SEQ ID NO: 1862271 - RNA, 19 nt, Salmonella typhimurium LT2
gcgugguaucgcggcagcg

SEQ ID NO: 1862272 - RNA, 21 nt, Salmonella typhimurium LT2
gcgugguggauauccagcaua

SEQ ID NO: 1862273 - RNA, 18 nt, Salmonella typhimurium LT2
gcgugguuuccggcagcu

SEQ ID NO: 1862274 - RNA, 15 nt, Salmonella typhimurium LT2
gcguuagccuaaaug

SEQ ID NO: 1862275 - RNA, 18 nt, Salmonella typhimurium LT2
gcguuacgggaacagaau

SEQ ID NO: 1862276 - RNA, 15 nt, Salmonella typhimurium LT2
gcguuugccgccuug

SEQ ID NO: 1862277 - RNA, 18 nt, Salmonella typhimurium LT2
gcguuucuagaugaugau

SEQ ID NO: 1862278 - RNA, 16 nt, Salmonella typhimurium LT2
gcguuuucucauucuc

SEQ ID NO: 1862279 - RNA, 19 nt, Salmonella typhimurium LT2
gcguuuuaucucuuuugcu

SEQ ID NO: 1862280 - RNA, 15 nt, Salmonella typhimurium LT2
gcguuugcgccgcca

SEQ ID NO: 1862281 - RNA, 18 nt, Salmonella typhimurium LT2
gcguuuuacguacccgcu

SEQ ID NO: 1862282 - RNA, 13 nt, Salmonella typhimurium LT2
gcguucuuccacu

SEQ ID NO: 1862283 - RNA, 19 nt, Salmonella typhimurium LT2
gcguucugcgccauuucca

SEQ ID NO: 1862284 - RNA, 20 nt, Salmonella typhimurium LT2
gcguugaauuccaucggcau

SEQ ID NO: 1862285 - RNA, 19 nt, Salmonella typhimurium LT2
gcguugagcguguccucug

SEQ ID NO: 1862286 - RNA, 14 nt, Salmonella typhimurium LT2
gcguuucgccgcca

SEQ ID NO: 1862287 - RNA, 13 nt, Salmonella typhimurium LT2
gcgcgccagcgcc

SEQ ID NO: 1862288 - RNA, 16 nt, Salmonella typhimurium LT2
gcgcgccacgcaugga

SEQ ID NO: 1862289 - RNA, 16 nt, Salmonella typhimurium LT2
gcgcgccagcguggcu

SEQ ID NO: 1862290 - RNA, 14 nt, Salmonella typhimurium LT2
gcgcgccagcgcca

SEQ ID NO: 1862291 - RNA, 12 nt, Salmonella typhimurium LT2
gcgcgccagcgc

SEQ ID NO: 1862292 - RNA, 20 nt, Salmonella typhimurium LT2
gcgcgccaauccaugccggc

SEQ ID NO: 1862293 - RNA, 18 nt, Salmonella typhimurium LT2
gcgcgccaaacggcagcu

SEQ ID NO: 1862294 - RNA, 17 nt, Salmonella typhimurium LT2
gcgcgauauccaccuga

SEQ ID NO: 1862295 - RNA, 17 nt, Salmonella typhimurium LT2
gcgcgacugcgcgcggu

SEQ ID NO: 1862296 - RNA, 17 nt, Salmonella typhimurium LT2
gcgccguugaaaucggu

SEQ ID NO: 1862297 - RNA, 21 nt, Salmonella typhimurium LT2
gcgccguucggaguugauggu

SEQ ID NO: 1862298 - RNA, 15 nt, Salmonella typhimurium LT2
gcgccuagcgcgcgc

SEQ ID NO: 1862299 - RNA, 23 nt, Salmonella typhimurium LT2
gcgcgaaaucaaagaccuccgcc

SEQ ID NO: 1862300 - RNA, 17 nt, Salmonella typhimurium LT2
gcgccuaccgccauaga

SEQ ID NO: 1862301 - RNA, 22 nt, Salmonella typhimurium LT2
gcgcgacauccgcuuuugguuu

SEQ ID NO: 1862302 - RNA, 18 nt, Salmonella typhimurium LT2
gcgcgaauuugccccaga

SEQ ID NO: 1862303 - RNA, 23 nt, Salmonella typhimurium LT2
gcgcgaauuuuauuaagcaggcc

SEQ ID NO: 1862304 - RNA, 23 nt, Salmonella typhimurium LT2
gcgcgaacgccuuauccggccug

SEQ ID NO: 1862305 - RNA, 20 nt, Salmonella typhimurium LT2
gcgcggccagaaugcccagc

SEQ ID NO: 1862306 - RNA, 13 nt, Salmonella typhimurium LT2
gcgcggccagcgc

SEQ ID NO: 1862307 - RNA, 14 nt, Salmonella typhimurium LT2
gcgcggcacaggcg

SEQ ID NO: 1862308 - RNA, 11 nt, Salmonella typhimurium LT2
gcgcggcagca

SEQ ID NO: 1862309 - RNA, 23 nt, Salmonella typhimurium LT2
gcgcggcaggccuuucggcagcg

SEQ ID NO: 1862310 - RNA, 22 nt, Salmonella typhimurium LT2
gcgcggcggacaacgcuccagc

SEQ ID NO: 1862311 - RNA, 20 nt, Salmonella typhimurium LT2
gcgcggccuuugccuucgcc

SEQ ID NO: 1862312 - RNA, 15 nt, Salmonella typhimurium LT2
gcgcgcugccgcccu

SEQ ID NO: 1862313 - RNA, 15 nt, Salmonella typhimurium LT2
gcgcgccgcgcagca

SEQ ID NO: 1862314 - RNA, 11 nt, Salmonella typhimurium LT2
gcgcgccgcgc

SEQ ID NO: 1862315 - RNA, 12 nt, Salmonella typhimurium LT2
gcgcgccgccug

SEQ ID NO: 1862316 - RNA, 14 nt, Salmonella typhimurium LT2
gcgcgccgccugcu

SEQ ID NO: 1862317 - RNA, 14 nt, Salmonella typhimurium LT2
gcgcgccgcccugc

SEQ ID NO: 1862318 - RNA, 12 nt, Salmonella typhimurium LT2
gcgcgccgcagc

SEQ ID NO: 1862319 - RNA, 13 nt, Salmonella typhimurium LT2
gcgcgccgccaac

SEQ ID NO: 1862320 - RNA, 14 nt, Salmonella typhimurium LT2
gcgcgcugccgccc

SEQ ID NO: 1862321 - RNA, 14 nt, Salmonella typhimurium LT2
gcgcggggaacacg

SEQ ID NO: 1862322 - RNA, 16 nt, Salmonella typhimurium LT2
gcgcguccuuauaaug

SEQ ID NO: 1862323 - RNA, 17 nt, Salmonella typhimurium LT2
gcgcguccuuauaaugc

SEQ ID NO: 1862324 - RNA, 13 nt, Salmonella typhimurium LT2
gcgcguggcaaau

SEQ ID NO: 1862325 - RNA, 17 nt, Salmonella typhimurium LT2
gcgcuagcuggcagggg

SEQ ID NO: 1862326 - RNA, 14 nt, Salmonella typhimurium LT2
gcgcuacauacugc

SEQ ID NO: 1862327 - RNA, 13 nt, Salmonella typhimurium LT2
gcgcuaccagcgc

SEQ ID NO: 1862328 - RNA, 23 nt, Salmonella typhimurium LT2
gcgcguugacgauuuuuaagcug

SEQ ID NO: 1862329 - RNA, 19 nt, Salmonella typhimurium LT2
gcgcucaggaucgccgggu

SEQ ID NO: 1862330 - RNA, 11 nt, Salmonella typhimurium LT2
gcgcucaggca

SEQ ID NO: 1862331 - RNA, 21 nt, Salmonella typhimurium LT2
gcgcucaccuccgccaccagc

SEQ ID NO: 1862332 - RNA, 22 nt, Salmonella typhimurium LT2
gcgcucaccuccgccaccagcg

SEQ ID NO: 1862333 - RNA, 15 nt, Salmonella typhimurium LT2
gcgcucaccgccgga

SEQ ID NO: 1862334 - RNA, 14 nt, Salmonella typhimurium LT2
gcgcucaaaugguc

SEQ ID NO: 1862335 - RNA, 23 nt, Salmonella typhimurium LT2
gcgcuauucccaggcaaaugauu

SEQ ID NO: 1862336 - RNA, 17 nt, Salmonella typhimurium LT2
gcgcuaucgguaucaug

SEQ ID NO: 1862337 - RNA, 13 nt, Salmonella typhimurium LT2
gcgcuaucuucaa

SEQ ID NO: 1862338 - RNA, 23 nt, Salmonella typhimurium LT2
gcgcuagcuucagguguuagugu

SEQ ID NO: 1862339 - RNA, 23 nt, Salmonella typhimurium LT2
gcgcuaucaauauucaugcuuuc

SEQ ID NO: 1862340 - RNA, 15 nt, Salmonella typhimurium LT2
gcgcugauuuguuau

SEQ ID NO: 1862341 - RNA, 16 nt, Salmonella typhimurium LT2
gcgcugaugugcggcc

SEQ ID NO: 1862342 - RNA, 17 nt, Salmonella typhimurium LT2
gcgcugaugugcggccu

SEQ ID NO: 1862343 - RNA, 17 nt, Salmonella typhimurium LT2
gcgcucuaucgccgccc

SEQ ID NO: 1862344 - RNA, 16 nt, Salmonella typhimurium LT2
gcgcucugccaguagc

SEQ ID NO: 1862345 - RNA, 22 nt, Salmonella typhimurium LT2
gcgcucuaucaccgcccgccgg

SEQ ID NO: 1862346 - RNA, 18 nt, Salmonella typhimurium LT2
gcgcugcacaaucgccag

SEQ ID NO: 1862347 - RNA, 22 nt, Salmonella typhimurium LT2
gcgcugccgucaaugccgggca

SEQ ID NO: 1862348 - RNA, 21 nt, Salmonella typhimurium LT2
gcgcugcgcgauucgcccggc

SEQ ID NO: 1862349 - RNA, 22 nt, Salmonella typhimurium LT2
gcgcugcgcuuaccgggccuac

SEQ ID NO: 1862350 - RNA, 20 nt, Salmonella typhimurium LT2
gcgcuggggguaggauaaaa

SEQ ID NO: 1862351 - RNA, 22 nt, Salmonella typhimurium LT2
gcgcuccaccaaccaggcaaac

SEQ ID NO: 1862352 - RNA, 19 nt, Salmonella typhimurium LT2
gcgcuccagaccaccagcg

SEQ ID NO: 1862353 - RNA, 18 nt, Salmonella typhimurium LT2
gcgcucguaggccagcgc

SEQ ID NO: 1862354 - RNA, 17 nt, Salmonella typhimurium LT2
gcgccgccaacgccaac

SEQ ID NO: 1862355 - RNA, 17 nt, Salmonella typhimurium LT2
gcgccgcacaucggcag

SEQ ID NO: 1862356 - RNA, 17 nt, Salmonella typhimurium LT2
gcgccgcaaugccgccu

SEQ ID NO: 1862357 - RNA, 16 nt, Salmonella typhimurium LT2
gcgccgauaaucggcg

SEQ ID NO: 1862358 - RNA, 12 nt, Salmonella typhimurium LT2
gcgccgagagaa

SEQ ID NO: 1862359 - RNA, 18 nt, Salmonella typhimurium LT2
gcgccgacguuaucgccg

SEQ ID NO: 1862360 - RNA, 19 nt, Salmonella typhimurium LT2
gcgccgacaucgccaccgc

SEQ ID NO: 1862361 - RNA, 20 nt, Salmonella typhimurium LT2
gcgccgacaaauccuccggc

SEQ ID NO: 1862362 - RNA, 16 nt, Salmonella typhimurium LT2
gcgccgacaaucggcg

SEQ ID NO: 1862363 - RNA, 17 nt, Salmonella typhimurium LT2
gcgccggugaucccacc

SEQ ID NO: 1862364 - RNA, 15 nt, Salmonella typhimurium LT2
gcgccgugcccagca

SEQ ID NO: 1862365 - RNA, 19 nt, Salmonella typhimurium LT2
gcgccgucuggagcgauga

SEQ ID NO: 1862366 - RNA, 21 nt, Salmonella typhimurium LT2
gcgccgucaggcuugccgcgc

SEQ ID NO: 1862367 - RNA, 15 nt, Salmonella typhimurium LT2
gcgccguccauaaug

SEQ ID NO: 1862368 - RNA, 19 nt, Salmonella typhimurium LT2
gcgccggaucgggcuucca

SEQ ID NO: 1862369 - RNA, 16 nt, Salmonella typhimurium LT2
gcgccggauuuaccag

SEQ ID NO: 1862370 - RNA, 18 nt, Salmonella typhimurium LT2
gcgccggaucgggcuucc

SEQ ID NO: 1862371 - RNA, 23 nt, Salmonella typhimurium LT2
gcgccggauauguuugacaagca

SEQ ID NO: 1862372 - RNA, 11 nt, Salmonella typhimurium LT2
gcgccgccauc

SEQ ID NO: 1862373 - RNA, 17 nt, Salmonella typhimurium LT2
gcgcccgagcgacgccc

SEQ ID NO: 1862374 - RNA, 15 nt, Salmonella typhimurium LT2
gcgcccgccaccagc

SEQ ID NO: 1862375 - RNA, 21 nt, Salmonella typhimurium LT2
gcgcccgccaccagcacagcc

SEQ ID NO: 1862376 - RNA, 13 nt, Salmonella typhimurium LT2
gcgccccggcggc

SEQ ID NO: 1862377 - RNA, 12 nt, Salmonella typhimurium LT2
gcgcccccagca

SEQ ID NO: 1862378 - RNA, 14 nt, Salmonella typhimurium LT2
gcgcccccaguucc

SEQ ID NO: 1862379 - RNA, 23 nt, Salmonella typhimurium LT2
gcgccccagcaugagccagcccu

SEQ ID NO: 1862380 - RNA, 16 nt, Salmonella typhimurium LT2
gcgcccauccgcccac

SEQ ID NO: 1862381 - RNA, 20 nt, Salmonella typhimurium LT2
gcgcccauuccgccugccgc

SEQ ID NO: 1862382 - RNA, 23 nt, Salmonella typhimurium LT2
gcgcccaguuucuucaggccagc

SEQ ID NO: 1862383 - RNA, 18 nt, Salmonella typhimurium LT2
gcgcccucauuccccauu

SEQ ID NO: 1862384 - RNA, 12 nt, Salmonella typhimurium LT2
gcgcccgcgcgc

SEQ ID NO: 1862385 - RNA, 20 nt, Salmonella typhimurium LT2
gcgccauuccugccgccgca

SEQ ID NO: 1862386 - RNA, 20 nt, Salmonella typhimurium LT2
gcgccauuaaaaaaggcagc

SEQ ID NO: 1862387 - RNA, 15 nt, Salmonella typhimurium LT2
gcgccaugcuuuccg

SEQ ID NO: 1862388 - RNA, 14 nt, Salmonella typhimurium LT2
gcgccaugcgcggc

SEQ ID NO: 1862389 - RNA, 16 nt, Salmonella typhimurium LT2
gcgcccaacaaacgcu

SEQ ID NO: 1862390 - RNA, 18 nt, Salmonella typhimurium LT2
gcgccagcguaguuucac

SEQ ID NO: 1862391 - RNA, 22 nt, Salmonella typhimurium LT2
gcgccagcucaucgggcgaagc

SEQ ID NO: 1862392 - RNA, 14 nt, Salmonella typhimurium LT2
gcgccagcucauua

SEQ ID NO: 1862393 - RNA, 17 nt, Salmonella typhimurium LT2
gcgccacuuuuccggca

SEQ ID NO: 1862394 - RNA, 16 nt, Salmonella typhimurium LT2
gcgccacuucacuggc

SEQ ID NO: 1862395 - RNA, 22 nt, Salmonella typhimurium LT2
gcgccacuuccagcgcgccguc

SEQ ID NO: 1862396 - RNA, 15 nt, Salmonella typhimurium LT2
gcgccacuuccagcg

SEQ ID NO: 1862397 - RNA, 20 nt, Salmonella typhimurium LT2
gcgccagcgaccaccguccc

SEQ ID NO: 1862398 - RNA, 14 nt, Salmonella typhimurium LT2
gcgccagccuuccc

SEQ ID NO: 1862399 - RNA, 12 nt, Salmonella typhimurium LT2
gcgccagccgcu

SEQ ID NO: 1862400 - RNA, 20 nt, Salmonella typhimurium LT2
gcgccagccgcuuaauguua

SEQ ID NO: 1862401 - RNA, 21 nt, Salmonella typhimurium LT2
gcgccagccgcgccaucuccu

SEQ ID NO: 1862402 - RNA, 14 nt, Salmonella typhimurium LT2
gcgauagagaguuc

SEQ ID NO: 1862403 - RNA, 20 nt, Salmonella typhimurium LT2
gcgauagagaguuccuccug

SEQ ID NO: 1862404 - RNA, 22 nt, Salmonella typhimurium LT2
gcgauccacaaucgucgugccu

SEQ ID NO: 1862405 - RNA, 14 nt, Salmonella typhimurium LT2
gcgauccagcccca

SEQ ID NO: 1862406 - RNA, 13 nt, Salmonella typhimurium LT2
gcgauagcugcug

SEQ ID NO: 1862407 - RNA, 15 nt, Salmonella typhimurium LT2
gcgaggucgagcuca

SEQ ID NO: 1862408 - RNA, 22 nt, Salmonella typhimurium LT2
gcgaucccaauugaucggccag

SEQ ID NO: 1862409 - RNA, 22 nt, Salmonella typhimurium LT2
gcgauccagccccagcgccagc

SEQ ID NO: 1862410 - RNA, 22 nt, Salmonella typhimurium LT2
gcgauccagccgcaguugccag

SEQ ID NO: 1862411 - RNA, 12 nt, Salmonella typhimurium LT2
gcgaugccacca

SEQ ID NO: 1862412 - RNA, 22 nt, Salmonella typhimurium LT2
gcgaugccaccagccuaaaaac

SEQ ID NO: 1862413 - RNA, 12 nt, Salmonella typhimurium LT2
gcgaugagcgcc

SEQ ID NO: 1862414 - RNA, 17 nt, Salmonella typhimurium LT2
gcgaugaccaucaaaua

SEQ ID NO: 1862415 - RNA, 14 nt, Salmonella typhimurium LT2
gcgaucgcgccagc

SEQ ID NO: 1862416 - RNA, 15 nt, Salmonella typhimurium LT2
gcgagccuucaacaa

SEQ ID NO: 1862417 - RNA, 14 nt, Salmonella typhimurium LT2
gcgagcgauagaga

SEQ ID NO: 1862418 - RNA, 19 nt, Salmonella typhimurium LT2
gcgagcgcauacgcugucc

SEQ ID NO: 1862419 - RNA, 22 nt, Salmonella typhimurium LT2
gcgaggcaacagauacggcgcg

SEQ ID NO: 1862420 - RNA, 14 nt, Salmonella typhimurium LT2
gcgaggccaacggc

SEQ ID NO: 1862421 - RNA, 17 nt, Salmonella typhimurium LT2
gcgacugcuucgcuggc

SEQ ID NO: 1862422 - RNA, 15 nt, Salmonella typhimurium LT2
gcgagagaaaaaaau

SEQ ID NO: 1862423 - RNA, 16 nt, Salmonella typhimurium LT2
gcgagaguuugugaug

SEQ ID NO: 1862424 - RNA, 23 nt, Salmonella typhimurium LT2
gcgagauaaccaucgcgcagcca

SEQ ID NO: 1862425 - RNA, 19 nt, Salmonella typhimurium LT2
gcgacgaucagcgccacgc

SEQ ID NO: 1862426 - RNA, 18 nt, Salmonella typhimurium LT2
gcgacgacacggcgcaga

SEQ ID NO: 1862427 - RNA, 22 nt, Salmonella typhimurium LT2
gcgacgacuucacccgcgggcg

SEQ ID NO: 1862428 - RNA, 14 nt, Salmonella typhimurium LT2
gcgcaauaugguau

SEQ ID NO: 1862429 - RNA, 21 nt, Salmonella typhimurium LT2
gcgcaaucgggccugcuccgu

SEQ ID NO: 1862430 - RNA, 15 nt, Salmonella typhimurium LT2
gcgcaaugccgccga

SEQ ID NO: 1862431 - RNA, 14 nt, Salmonella typhimurium LT2
gcgcacgcgcgcgc

SEQ ID NO: 1862432 - RNA, 12 nt, Salmonella typhimurium LT2
gcgcaauguuca

SEQ ID NO: 1862433 - RNA, 17 nt, Salmonella typhimurium LT2
gcgcacggcgcguccuc

SEQ ID NO: 1862434 - RNA, 15 nt, Salmonella typhimurium LT2
gcgcacggcgcgucc

SEQ ID NO: 1862435 - RNA, 22 nt, Salmonella typhimurium LT2
gcgcagcgcuuuugccgcgccc

SEQ ID NO: 1862436 - RNA, 15 nt, Salmonella typhimurium LT2
gcgcagcgcgcgacc

SEQ ID NO: 1862437 - RNA, 21 nt, Salmonella typhimurium LT2
gcgcagcgcgcgacccagcgc

SEQ ID NO: 1862438 - RNA, 13 nt, Salmonella typhimurium LT2
gcgcagccccagc

SEQ ID NO: 1862439 - RNA, 15 nt, Salmonella typhimurium LT2
gcgaugugccuguaa

SEQ ID NO: 1862440 - RNA, 18 nt, Salmonella typhimurium LT2
gcgauggucauuccagcu

SEQ ID NO: 1862441 - RNA, 18 nt, Salmonella typhimurium LT2
gcgaugguccccgguccu

SEQ ID NO: 1862442 - RNA, 18 nt, Salmonella typhimurium LT2
gcgcaaacgcgugcuggu

SEQ ID NO: 1862443 - RNA, 20 nt, Salmonella typhimurium LT2
gcgcaaacaguacgcccgcu

SEQ ID NO: 1862444 - RNA, 16 nt, Salmonella typhimurium LT2
gcgcaaaagcgcgccc

SEQ ID NO: 1862445 - RNA, 12 nt, Salmonella typhimurium LT2
gcgcaaagcugc

SEQ ID NO: 1862446 - RNA, 22 nt, Salmonella typhimurium LT2
gcgcaaacuucgcauuuuuauc

SEQ ID NO: 1862447 - RNA, 18 nt, Salmonella typhimurium LT2
gcgcaaccgacgggcgcu

SEQ ID NO: 1862448 - RNA, 21 nt, Salmonella typhimurium LT2
gcgcaauaaauucgaaauaaa

SEQ ID NO: 1862449 - RNA, 18 nt, Salmonella typhimurium LT2
gcgcaauauaaucgccca

SEQ ID NO: 1862450 - RNA, 20 nt, Salmonella typhimurium LT2
gccuuuuuuaauccaggaau

SEQ ID NO: 1862451 - RNA, 20 nt, Salmonella typhimurium LT2
gccuuuuugcagcgcggcca

SEQ ID NO: 1862452 - RNA, 18 nt, Salmonella typhimurium LT2
gccuuuuuuaauccagga

SEQ ID NO: 1862453 - RNA, 17 nt, Salmonella typhimurium LT2
gccuuuuuuaauccagg

SEQ ID NO: 1862454 - RNA, 21 nt, Salmonella typhimurium LT2
gcgaaaucaaagaccuccgcc

SEQ ID NO: 1862455 - RNA, 16 nt, Salmonella typhimurium LT2
gcgaaaucaaaaggcg

SEQ ID NO: 1862456 - RNA, 20 nt, Salmonella typhimurium LT2
gcgaaccggaccagcacaaa

SEQ ID NO: 1862457 - RNA, 22 nt, Salmonella typhimurium LT2
gcgaacagacguuacaucuccu

SEQ ID NO: 1862458 - RNA, 20 nt, Salmonella typhimurium LT2
gcgaacggcuuuccagcagc

SEQ ID NO: 1862459 - RNA, 18 nt, Salmonella typhimurium LT2
gccuuuucccccagcauc

SEQ ID NO: 1862460 - RNA, 21 nt, Salmonella typhimurium LT2
gccuuuucccccagcaucuua

SEQ ID NO: 1862461 - RNA, 21 nt, Salmonella typhimurium LT2
gccuuuucguacauguccaga

SEQ ID NO: 1862462 - RNA, 16 nt, Salmonella typhimurium LT2
gccuuuuuaaauauua

SEQ ID NO: 1862463 - RNA, 16 nt, Salmonella typhimurium LT2
gccuuuuucaacagca

SEQ ID NO: 1862464 - RNA, 17 nt, Salmonella typhimurium LT2
gccuuuuucaacagcac

SEQ ID NO: 1862465 - RNA, 22 nt, Salmonella typhimurium LT2
gccuuuuucaacagcacccagg

SEQ ID NO: 1862466 - RNA, 15 nt, Salmonella typhimurium LT2
gccuuuggccuggag

SEQ ID NO: 1862467 - RNA, 14 nt, Salmonella typhimurium LT2
gccuuuuauaauaa

SEQ ID NO: 1862468 - RNA, 21 nt, Salmonella typhimurium LT2
gccuuuuaucaaugcacugac

SEQ ID NO: 1862469 - RNA, 13 nt, Salmonella typhimurium LT2
gccuuuauccagc

SEQ ID NO: 1862470 - RNA, 18 nt, Salmonella typhimurium LT2
gccuuuaugcaguuccgu

SEQ ID NO: 1862471 - RNA, 20 nt, Salmonella typhimurium LT2
gccuuucacgcguucaauau

SEQ ID NO: 1862472 - RNA, 17 nt, Salmonella typhimurium LT2
gccuuucagaucggcaa

SEQ ID NO: 1862473 - RNA, 17 nt, Salmonella typhimurium LT2
gccuuucagaugguuug

SEQ ID NO: 1862474 - RNA, 12 nt, Salmonella typhimurium LT2
gccuuucaccca

SEQ ID NO: 1862475 - RNA, 14 nt, Salmonella typhimurium LT2
gccuuucgcgcugc

SEQ ID NO: 1862476 - RNA, 18 nt, Salmonella typhimurium LT2
gcgaagggccagagaaag

SEQ ID NO: 1862477 - RNA, 14 nt, Salmonella typhimurium LT2
gcgaaggccagcac

SEQ ID NO: 1862478 - RNA, 17 nt, Salmonella typhimurium LT2
gcgaauuugccccagau

SEQ ID NO: 1862479 - RNA, 21 nt, Salmonella typhimurium LT2
gcgaauuuuauuaagcaggcc

SEQ ID NO: 1862480 - RNA, 15 nt, Salmonella typhimurium LT2
gcgacaaacagcgcc

SEQ ID NO: 1862481 - RNA, 19 nt, Salmonella typhimurium LT2
gcgacacgcgcgcugcgcc

SEQ ID NO: 1862482 - RNA, 23 nt, Salmonella typhimurium LT2
gcgacacgcgcgcugcgccugga

SEQ ID NO: 1862483 - RNA, 10 nt, Salmonella typhimurium LT2
gcgacaagaa

SEQ ID NO: 1862484 - RNA, 11 nt, Salmonella typhimurium LT2
gcgacaaauga

SEQ ID NO: 1862485 - RNA, 15 nt, Salmonella typhimurium LT2
gcgacaccacgcagg

SEQ ID NO: 1862486 - RNA, 15 nt, Salmonella typhimurium LT2
gcgaccucaucaaac

SEQ ID NO: 1862487 - RNA, 22 nt, Salmonella typhimurium LT2
gcgacccguuuuuuauucuccc

SEQ ID NO: 1862488 - RNA, 21 nt, Salmonella typhimurium LT2
gcgaccaguuauucggcauau

SEQ ID NO: 1862489 - RNA, 20 nt, Salmonella typhimurium LT2
gcgacagacgcuuaucgccg

SEQ ID NO: 1862490 - RNA, 18 nt, Salmonella typhimurium LT2
gccuucuucgcaaucucc

SEQ ID NO: 1862491 - RNA, 15 nt, Salmonella typhimurium LT2
gccuucugcgcccgc

SEQ ID NO: 1862492 - RNA, 20 nt, Salmonella typhimurium LT2
gccuucguuauaaggccugc

SEQ ID NO: 1862493 - RNA, 13 nt, Salmonella typhimurium LT2
gccuugacaggaa

SEQ ID NO: 1862494 - RNA, 18 nt, Salmonella typhimurium LT2
gccuugcgacauguugua

SEQ ID NO: 1862495 - RNA, 21 nt, Salmonella typhimurium LT2
gccuugcuggccuguucaagu

SEQ ID NO: 1862496 - RNA, 12 nt, Salmonella typhimurium LT2
gccuguuagggc

SEQ ID NO: 1862497 - RNA, 14 nt, Salmonella typhimurium LT2
gccuuacccggccu

SEQ ID NO: 1862498 - RNA, 13 nt, Salmonella typhimurium LT2
gccuucaauaagu

SEQ ID NO: 1862499 - RNA, 19 nt, Salmonella typhimurium LT2
gccuuaucaggccuguggu

SEQ ID NO: 1862500 - RNA, 22 nt, Salmonella typhimurium LT2
gccuuauccggccuacaacuca

SEQ ID NO: 1862501 - RNA, 15 nt, Salmonella typhimurium LT2
gccuucaggcaucag

SEQ ID NO: 1862502 - RNA, 22 nt, Salmonella typhimurium LT2
gccuucacgcauucuuuuuucu

SEQ ID NO: 1862503 - RNA, 20 nt, Salmonella typhimurium LT2
gccuucacacugcgccgcca

SEQ ID NO: 1862504 - RNA, 14 nt, Salmonella typhimurium LT2
gccuucaccccuuc

SEQ ID NO: 1862505 - RNA, 16 nt, Salmonella typhimurium LT2
gccuuccagaaauaaa

SEQ ID NO: 1862506 - RNA, 13 nt, Salmonella typhimurium LT2
gccuucagguuuu

SEQ ID NO: 1862507 - RNA, 16 nt, Salmonella typhimurium LT2
gccuuccgcaccgcca

SEQ ID NO: 1862508 - RNA, 15 nt, Salmonella typhimurium LT2
gccuucgccuucacg

SEQ ID NO: 1862509 - RNA, 20 nt, Salmonella typhimurium LT2
gugcgccguccugcaaggca

SEQ ID NO: 1862510 - RNA, 22 nt, Salmonella typhimurium LT2
gugcgcggucauaucuggacgg

SEQ ID NO: 1862511 - RNA, 13 nt, Salmonella typhimurium LT2
gugcgcgcgggcg

SEQ ID NO: 1862512 - RNA, 16 nt, Salmonella typhimurium LT2
gugcggcaaccaccag

SEQ ID NO: 1862513 - RNA, 17 nt, Salmonella typhimurium LT2
gugcgcugugacaggcg

SEQ ID NO: 1862514 - RNA, 18 nt, Salmonella typhimurium LT2
gugcgccccuugcagcaa

SEQ ID NO: 1862515 - RNA, 22 nt, Salmonella typhimurium LT2
gugcgagauaaccaucgcgcag

SEQ ID NO: 1862516 - RNA, 17 nt, Salmonella typhimurium LT2
gugcgccguccugcaag

SEQ ID NO: 1862517 - RNA, 21 nt, Salmonella typhimurium LT2
gugcgccgcgagugcaggauc

SEQ ID NO: 1862518 - RNA, 21 nt, Salmonella typhimurium LT2
gugcgacaucgacaaaauagu

SEQ ID NO: 1862519 - RNA, 14 nt, Salmonella typhimurium LT2
gugccuuccgcaau

SEQ ID NO: 1862520 - RNA, 13 nt, Salmonella typhimurium LT2
gugccgcgcuggu

SEQ ID NO: 1862521 - RNA, 16 nt, Salmonella typhimurium LT2
gugcugagacgccugc

SEQ ID NO: 1862522 - RNA, 19 nt, Salmonella typhimurium LT2
gugcugauugucagcaguu

SEQ ID NO: 1862523 - RNA, 22 nt, Salmonella typhimurium LT2
gugcuauacaguaaaacgccaa

SEQ ID NO: 1862524 - RNA, 14 nt, Salmonella typhimurium LT2
gugcuacgggcgcu

SEQ ID NO: 1862525 - RNA, 16 nt, Salmonella typhimurium LT2
gugcuacgccugccug

SEQ ID NO: 1862526 - RNA, 17 nt, Salmonella typhimurium LT2
gugcuacgccugccugc

SEQ ID NO: 1862527 - RNA, 20 nt, Salmonella typhimurium LT2
gugcuacgggcgcugucgcc

SEQ ID NO: 1862528 - RNA, 22 nt, Salmonella typhimurium LT2
gugcucaaccacgauaaccaga

SEQ ID NO: 1862529 - RNA, 16 nt, Salmonella typhimurium LT2
gugcucaaucgccugc

SEQ ID NO: 1862530 - RNA, 22 nt, Salmonella typhimurium LT2
gugcucauccaacugcgccuga

SEQ ID NO: 1862531 - RNA, 23 nt, Salmonella typhimurium LT2
gugcuccagcgccugcugcaacg

SEQ ID NO: 1862532 - RNA, 12 nt, Salmonella typhimurium LT2
gugcuccgccgg

SEQ ID NO: 1862533 - RNA, 13 nt, Salmonella typhimurium LT2
gugcguucuucca

SEQ ID NO: 1862534 - RNA, 17 nt, Salmonella typhimurium LT2
gugcgucauccggcgcu

SEQ ID NO: 1862535 - RNA, 15 nt, Salmonella typhimurium LT2
gugaugcgccagcca

SEQ ID NO: 1862536 - RNA, 14 nt, Salmonella typhimurium LT2
gugaugcaucagaa

SEQ ID NO: 1862537 - RNA, 17 nt, Salmonella typhimurium LT2
gugauggguauuagaau

SEQ ID NO: 1862538 - RNA, 15 nt, Salmonella typhimurium LT2
gugauggguauuaga

SEQ ID NO: 1862539 - RNA, 16 nt, Salmonella typhimurium LT2
gugauggguauuagaa

SEQ ID NO: 1862540 - RNA, 15 nt, Salmonella typhimurium LT2
gugaugcuuuuuaca

SEQ ID NO: 1862541 - RNA, 17 nt, Salmonella typhimurium LT2
gugcaauauuaauguca

SEQ ID NO: 1862542 - RNA, 12 nt, Salmonella typhimurium LT2
gugcaagcaccu

SEQ ID NO: 1862543 - RNA, 18 nt, Salmonella typhimurium LT2
gugauggugcagccccgg

SEQ ID NO: 1862544 - RNA, 13 nt, Salmonella typhimurium LT2
gugauggugcagc

SEQ ID NO: 1862545 - RNA, 17 nt, Salmonella typhimurium LT2
gugccaccagccggagc

SEQ ID NO: 1862546 - RNA, 22 nt, Salmonella typhimurium LT2
gugccagaaacaagaagcacga

SEQ ID NO: 1862547 - RNA, 17 nt, Salmonella typhimurium LT2
gugccacuccgccagua

SEQ ID NO: 1862548 - RNA, 20 nt, Salmonella typhimurium LT2
gugcauucccugaaacaggu

SEQ ID NO: 1862549 - RNA, 20 nt, Salmonella typhimurium LT2
gugcauuauuuuagugaaaa

SEQ ID NO: 1862550 - RNA, 18 nt, Salmonella typhimurium LT2
gugcccgcgguuugacug

SEQ ID NO: 1862551 - RNA, 22 nt, Salmonella typhimurium LT2
gugcccggggugagcaaaggca

SEQ ID NO: 1862552 - RNA, 18 nt, Salmonella typhimurium LT2
gugccgccauucgcuucc

SEQ ID NO: 1862553 - RNA, 14 nt, Salmonella typhimurium LT2
gugcccguuuuaca

SEQ ID NO: 1862554 - RNA, 11 nt, Salmonella typhimurium LT2
guggcaaauac

SEQ ID NO: 1862555 - RNA, 14 nt, Salmonella typhimurium LT2
guggcaaaauccaa

SEQ ID NO: 1862556 - RNA, 16 nt, Salmonella typhimurium LT2
gugcuuccagcuccau

SEQ ID NO: 1862557 - RNA, 17 nt, Salmonella typhimurium LT2
gugcuugcguuucuaga

SEQ ID NO: 1862558 - RNA, 19 nt, Salmonella typhimurium LT2
guggaucucgucgccggug

SEQ ID NO: 1862559 - RNA, 20 nt, Salmonella typhimurium LT2
guggcgcaguuuacgcagcg

SEQ ID NO: 1862560 - RNA, 11 nt, Salmonella typhimurium LT2
guggcgcuggg

SEQ ID NO: 1862561 - RNA, 16 nt, Salmonella typhimurium LT2
guggcgcuccagccgu

SEQ ID NO: 1862562 - RNA, 15 nt, Salmonella typhimurium LT2
guggcggaauuggua

SEQ ID NO: 1862563 - RNA, 14 nt, Salmonella typhimurium LT2
guggcggacgggug

SEQ ID NO: 1862564 - RNA, 14 nt, Salmonella typhimurium LT2
guggcggcaaaaaa

SEQ ID NO: 1862565 - RNA, 21 nt, Salmonella typhimurium LT2
guggcgaagcucagccaggcg

SEQ ID NO: 1862566 - RNA, 20 nt, Salmonella typhimurium LT2
guggcgacgcguggcaucuu

SEQ ID NO: 1862567 - RNA, 22 nt, Salmonella typhimurium LT2
guggcgaucagcggcgccgcaa

SEQ ID NO: 1862568 - RNA, 16 nt, Salmonella typhimurium LT2
guggccaucuuccagc

SEQ ID NO: 1862569 - RNA, 16 nt, Salmonella typhimurium LT2
guggcccagcgcggug

SEQ ID NO: 1862570 - RNA, 18 nt, Salmonella typhimurium LT2
guggcgaacaggcucagc

SEQ ID NO: 1862571 - RNA, 22 nt, Salmonella typhimurium LT2
gugguaaagaagccgccgccau

SEQ ID NO: 1862572 - RNA, 13 nt, Salmonella typhimurium LT2
gugggucugcggc

SEQ ID NO: 1862573 - RNA, 22 nt, Salmonella typhimurium LT2
guggggaauguauuucagacuu

SEQ ID NO: 1862574 - RNA, 18 nt, Salmonella typhimurium LT2
guggggccuaaugagcca

SEQ ID NO: 1862575 - RNA, 17 nt, Salmonella typhimurium LT2
guggggcuaagugagca

SEQ ID NO: 1862576 - RNA, 22 nt, Salmonella typhimurium LT2
guggucauauugucgcgcccgu

SEQ ID NO: 1862577 - RNA, 23 nt, Salmonella typhimurium LT2
guggugcaagcaccuuauccggc

SEQ ID NO: 1862578 - RNA, 20 nt, Salmonella typhimurium LT2
gugguggauauccagcauaa

SEQ ID NO: 1862579 - RNA, 16 nt, Salmonella typhimurium LT2
gugguuuccggcagcu

SEQ ID NO: 1862580 - RNA, 17 nt, Salmonella typhimurium LT2
gugguuaacagcgcagg

SEQ ID NO: 1862581 - RNA, 19 nt, Salmonella typhimurium LT2
guguugguacacagcacaa

SEQ ID NO: 1862582 - RNA, 19 nt, Salmonella typhimurium LT2
guguuucaucucaucaaug

SEQ ID NO: 1862583 - RNA, 13 nt, Salmonella typhimurium LT2
guguuugccagac

SEQ ID NO: 1862584 - RNA, 22 nt, Salmonella typhimurium LT2
guguuggaugaaccauaucaaa

SEQ ID NO: 1862585 - RNA, 13 nt, Salmonella typhimurium LT2
guguugcucaaaa

SEQ ID NO: 1862586 - RNA, 14 nt, Salmonella typhimurium LT2
guguucguaaagca

SEQ ID NO: 1862587 - RNA, 21 nt, Salmonella typhimurium LT2
guguacacaauugccaugguu

SEQ ID NO: 1862588 - RNA, 19 nt, Salmonella typhimurium LT2
guguaccagcaacgccagc

SEQ ID NO: 1862589 - RNA, 16 nt, Salmonella typhimurium LT2
gugugcagccaguuag

SEQ ID NO: 1862590 - RNA, 20 nt, Salmonella typhimurium LT2
guuacgcacgccagauaaau

SEQ ID NO: 1862591 - RNA, 21 nt, Salmonella typhimurium LT2
guuacgcacgccagauaaauc

SEQ ID NO: 1862592 - RNA, 12 nt, Salmonella typhimurium LT2
guuacgcaucug

SEQ ID NO: 1862593 - RNA, 19 nt, Salmonella typhimurium LT2
guuaccucguuucacgucc

SEQ ID NO: 1862594 - RNA, 17 nt, Salmonella typhimurium LT2
guuacaggcuccaggua

SEQ ID NO: 1862595 - RNA, 15 nt, Salmonella typhimurium LT2
guuaccguauggucg

SEQ ID NO: 1862596 - RNA, 23 nt, Salmonella typhimurium LT2
guuacaggacauuuggggcuggc

SEQ ID NO: 1862597 - RNA, 16 nt, Salmonella typhimurium LT2
guuacucuuccaccau

SEQ ID NO: 1862598 - RNA, 14 nt, Salmonella typhimurium LT2
guuacucuuccucc

SEQ ID NO: 1862599 - RNA, 20 nt, Salmonella typhimurium LT2
guuacucuuccuccccaggc

SEQ ID NO: 1862600 - RNA, 13 nt, Salmonella typhimurium LT2
guuacgcgccacg

SEQ ID NO: 1862601 - RNA, 16 nt, Salmonella typhimurium LT2
guuacgcgcugcaaau

SEQ ID NO: 1862602 - RNA, 17 nt, Salmonella typhimurium LT2
guuacgcggucuuuuaa

SEQ ID NO: 1862603 - RNA, 14 nt, Salmonella typhimurium LT2
guuacggaaaaaau

SEQ ID NO: 1862604 - RNA, 23 nt, Salmonella typhimurium LT2
guuacggcugaagcugccguccc

SEQ ID NO: 1862605 - RNA, 16 nt, Salmonella typhimurium LT2
guuacgggaacagaau

SEQ ID NO: 1862606 - RNA, 12 nt, Salmonella typhimurium LT2
guuaaauaccag

SEQ ID NO: 1862607 - RNA, 17 nt, Salmonella typhimurium LT2
guuaaagccgguuucau

SEQ ID NO: 1862608 - RNA, 11 nt, Salmonella typhimurium LT2
guuaauacuga

SEQ ID NO: 1862609 - RNA, 12 nt, Salmonella typhimurium LT2
guuaauucuauu

SEQ ID NO: 1862610 - RNA, 15 nt, Salmonella typhimurium LT2
guucgccagugacaa

SEQ ID NO: 1862611 - RNA, 14 nt, Salmonella typhimurium LT2
guucgccauccaga

SEQ ID NO: 1862612 - RNA, 20 nt, Salmonella typhimurium LT2
guucgcaaccuaaccaaaca

SEQ ID NO: 1862613 - RNA, 21 nt, Salmonella typhimurium LT2
guuccugcgggaacagauaaa

SEQ ID NO: 1862614 - RNA, 22 nt, Salmonella typhimurium LT2
guuccugcgggaacagauaaau

SEQ ID NO: 1862615 - RNA, 20 nt, Salmonella typhimurium LT2
guuccuggcaaagcgucaug

SEQ ID NO: 1862616 - RNA, 23 nt, Salmonella typhimurium LT2
guucggaccagaaccucacggag

SEQ ID NO: 1862617 - RNA, 13 nt, Salmonella typhimurium LT2
guucgcggcuggu

SEQ ID NO: 1862618 - RNA, 19 nt, Salmonella typhimurium LT2
guucgccuucguuauaagg

SEQ ID NO: 1862619 - RNA, 15 nt, Salmonella typhimurium LT2
guucgcggcaaacac

SEQ ID NO: 1862620 - RNA, 22 nt, Salmonella typhimurium LT2
guuccccaacagcgaccacgcc

SEQ ID NO: 1862621 - RNA, 16 nt, Salmonella typhimurium LT2
guucccgacggcaggc

SEQ ID NO: 1862622 - RNA, 20 nt, Salmonella typhimurium LT2
guucccgauuccgugucuga

SEQ ID NO: 1862623 - RNA, 14 nt, Salmonella typhimurium LT2
guuccaaucucuuu

SEQ ID NO: 1862624 - RNA, 23 nt, Salmonella typhimurium LT2
guucccagcgggaacaucacgga

SEQ ID NO: 1862625 - RNA, 20 nt, Salmonella typhimurium LT2
guuccaccgucuaucgugga

SEQ ID NO: 1862626 - RNA, 20 nt, Salmonella typhimurium LT2
guucagaaauguauucuccc

SEQ ID NO: 1862627 - RNA, 16 nt, Salmonella typhimurium LT2
guucacuccuaagaga

SEQ ID NO: 1862628 - RNA, 20 nt, Salmonella typhimurium LT2
guuagauuagguacguacau

SEQ ID NO: 1862629 - RNA, 19 nt, Salmonella typhimurium LT2
guuagauauaguuuuucaa

SEQ ID NO: 1862630 - RNA, 23 nt, Salmonella typhimurium LT2
guuagcauagacgaucagcgcau

SEQ ID NO: 1862631 - RNA, 15 nt, Salmonella typhimurium LT2
guucacguaaucgcc

SEQ ID NO: 1862632 - RNA, 19 nt, Salmonella typhimurium LT2
guucaggcacgugcauaaa

SEQ ID NO: 1862633 - RNA, 12 nt, Salmonella typhimurium LT2
guucaguuucaa

SEQ ID NO: 1862634 - RNA, 14 nt, Salmonella typhimurium LT2
guucaguucuuccc

SEQ ID NO: 1862635 - RNA, 18 nt, Salmonella typhimurium LT2
guucauaagucauccaga

SEQ ID NO: 1862636 - RNA, 16 nt, Salmonella typhimurium LT2
guucauugcuuucuug

SEQ ID NO: 1862637 - RNA, 14 nt, Salmonella typhimurium LT2
guucauggcaaaag

SEQ ID NO: 1862638 - RNA, 21 nt, Salmonella typhimurium LT2
guucauggcaaaagacauucc

SEQ ID NO: 1862639 - RNA, 14 nt, Salmonella typhimurium LT2
guucaugugcucgu

SEQ ID NO: 1862640 - RNA, 13 nt, Salmonella typhimurium LT2
guucuuucauuuu

SEQ ID NO: 1862641 - RNA, 13 nt, Salmonella typhimurium LT2
guucuuucaccau

SEQ ID NO: 1862642 - RNA, 21 nt, Salmonella typhimurium LT2
guucgucccugcaacgccugc

SEQ ID NO: 1862643 - RNA, 22 nt, Salmonella typhimurium LT2
guugaacauuucaucuaucugc

SEQ ID NO: 1862644 - RNA, 16 nt, Salmonella typhimurium LT2
guucuuuuuaaaacac

SEQ ID NO: 1862645 - RNA, 20 nt, Salmonella typhimurium LT2
guugaaaaaacgggcccgcg

SEQ ID NO: 1862646 - RNA, 22 nt, Salmonella typhimurium LT2
guugaccaacaaucgccccagg

SEQ ID NO: 1862647 - RNA, 14 nt, Salmonella typhimurium LT2
guugauaccggagg

SEQ ID NO: 1862648 - RNA, 17 nt, Salmonella typhimurium LT2
guugaucguaaaaugaa

SEQ ID NO: 1862649 - RNA, 13 nt, Salmonella typhimurium LT2
guugaucgccauc

SEQ ID NO: 1862650 - RNA, 21 nt, Salmonella typhimurium LT2
guugagcguguccucugcugc

SEQ ID NO: 1862651 - RNA, 18 nt, Salmonella typhimurium LT2
guugagcaaugggaagga

SEQ ID NO: 1862652 - RNA, 14 nt, Salmonella typhimurium LT2
guugacgcuucaag

SEQ ID NO: 1862653 - RNA, 18 nt, Salmonella typhimurium LT2
guugacugcgcuccgacu

SEQ ID NO: 1862654 - RNA, 23 nt, Salmonella typhimurium LT2
guugcaauaaaauauccuccacc

SEQ ID NO: 1862655 - RNA, 23 nt, Salmonella typhimurium LT2
guugaucucauuguauuucucaa

SEQ ID NO: 1862656 - RNA, 20 nt, Salmonella typhimurium LT2
guugcacccgaacaacaaua

SEQ ID NO: 1862657 - RNA, 14 nt, Salmonella typhimurium LT2
guugcgucauauaa

SEQ ID NO: 1862658 - RNA, 22 nt, Salmonella typhimurium LT2
guugcgucauauaauccugcgg

SEQ ID NO: 1862659 - RNA, 14 nt, Salmonella typhimurium LT2
guugcuccagcauc

SEQ ID NO: 1862660 - RNA, 12 nt, Salmonella typhimurium LT2
guugcucaggua

SEQ ID NO: 1862661 - RNA, 15 nt, Salmonella typhimurium LT2
guugcuauugaaaaa

SEQ ID NO: 1862662 - RNA, 21 nt, Salmonella typhimurium LT2
guugcuccuguaagucaggua

SEQ ID NO: 1862663 - RNA, 21 nt, Salmonella typhimurium LT2
guugcgacuguucaucaaaga

SEQ ID NO: 1862664 - RNA, 17 nt, Salmonella typhimurium LT2
guugcgccaagcgccuc

SEQ ID NO: 1862665 - RNA, 13 nt, Salmonella typhimurium LT2
guugccuuccuga

SEQ ID NO: 1862666 - RNA, 16 nt, Salmonella typhimurium LT2
guugcgaauaaacaca

SEQ ID NO: 1862667 - RNA, 23 nt, Salmonella typhimurium LT2
guugcgaacuugccggaacgcga

SEQ ID NO: 1862668 - RNA, 18 nt, Salmonella typhimurium LT2
guugccaugauccaucuc

SEQ ID NO: 1862669 - RNA, 19 nt, Salmonella typhimurium LT2
guugcauucccuacgccca

SEQ ID NO: 1862670 - RNA, 19 nt, Salmonella typhimurium LT2
guugccaggguucaaccug

SEQ ID NO: 1862671 - RNA, 21 nt, Salmonella typhimurium LT2
guugccggagaccuuuuucau

SEQ ID NO: 1862672 - RNA, 20 nt, Salmonella typhimurium LT2
guugccugcgucauccccag

SEQ ID NO: 1862673 - RNA, 17 nt, Salmonella typhimurium LT2
guugccugauggcgcug

SEQ ID NO: 1862674 - RNA, 17 nt, Salmonella typhimurium LT2
guugccgaugacuccca

SEQ ID NO: 1862675 - RNA, 20 nt, Salmonella typhimurium LT2
guugccgcccguuuuuucca

SEQ ID NO: 1862676 - RNA, 22 nt, Salmonella typhimurium LT2
guugccgcccguuuuuuccagu

SEQ ID NO: 1862677 - RNA, 12 nt, Salmonella typhimurium LT2
guugcccggcgc

SEQ ID NO: 1862678 - RNA, 19 nt, Salmonella typhimurium LT2
guuggcgacauacgcgcuc

SEQ ID NO: 1862679 - RNA, 22 nt, Salmonella typhimurium LT2
guuggccugauaucggcugcug

SEQ ID NO: 1862680 - RNA, 14 nt, Salmonella typhimurium LT2
guuggcauaaugaa

SEQ ID NO: 1862681 - RNA, 20 nt, Salmonella typhimurium LT2
guuggaugaaccauaucaaa

SEQ ID NO: 1862682 - RNA, 21 nt, Salmonella typhimurium LT2
guugcuuaccuuguucuucca

SEQ ID NO: 1862683 - RNA, 14 nt, Salmonella typhimurium LT2
guugcugcaaaaga

SEQ ID NO: 1862684 - RNA, 23 nt, Salmonella typhimurium LT2
guugguauugcgaaacggcagcg

SEQ ID NO: 1862685 - RNA, 17 nt, Salmonella typhimurium LT2
guuggcguaccaucagc

SEQ ID NO: 1862686 - RNA, 15 nt, Salmonella typhimurium LT2
guuggcgauuuccag

SEQ ID NO: 1862687 - RNA, 16 nt, Salmonella typhimurium LT2
guuucccucauauuug

SEQ ID NO: 1862688 - RNA, 18 nt, Salmonella typhimurium LT2
guuucccucuuaauuuug

SEQ ID NO: 1862689 - RNA, 19 nt, Salmonella typhimurium LT2
guuucccccuccauacccu

SEQ ID NO: 1862690 - RNA, 21 nt, Salmonella typhimurium LT2
guuucccccuccauacccuau

SEQ ID NO: 1862691 - RNA, 19 nt, Salmonella typhimurium LT2
guuuccguuuguaacauau

SEQ ID NO: 1862692 - RNA, 22 nt, Salmonella typhimurium LT2
guuucgaguucggcaaucugcu

SEQ ID NO: 1862693 - RNA, 19 nt, Salmonella typhimurium LT2
guuuaucucaucgacuuca

SEQ ID NO: 1862694 - RNA, 19 nt, Salmonella typhimurium LT2
guuuaugguaaucacacaa

SEQ ID NO: 1862695 - RNA, 21 nt, Salmonella typhimurium LT2
guuucccaacaaugccacgcc

SEQ ID NO: 1862696 - RNA, 13 nt, Salmonella typhimurium LT2
guuugaccagcaa

SEQ ID NO: 1862697 - RNA, 13 nt, Salmonella typhimurium LT2
guuucgccaggcc

SEQ ID NO: 1862698 - RNA, 14 nt, Salmonella typhimurium LT2
guuucgccagcgcg

SEQ ID NO: 1862699 - RNA, 19 nt, Salmonella typhimurium LT2
guuucucuuccgccagcgc

SEQ ID NO: 1862700 - RNA, 21 nt, Salmonella typhimurium LT2
guuucucgccgguagccagcc

SEQ ID NO: 1862701 - RNA, 17 nt, Salmonella typhimurium LT2
guuuagcgccagcagca

SEQ ID NO: 1862702 - RNA, 21 nt, Salmonella typhimurium LT2
guuuacgagugcguucuucca

SEQ ID NO: 1862703 - RNA, 22 nt, Salmonella typhimurium LT2
guuuacgauacguuugaaauga

SEQ ID NO: 1862704 - RNA, 17 nt, Salmonella typhimurium LT2
guuuauauaaaaauagc

SEQ ID NO: 1862705 - RNA, 16 nt, Salmonella typhimurium LT2
guuuaccugcaaaaac

SEQ ID NO: 1862706 - RNA, 15 nt, Salmonella typhimurium LT2
guuguaguuaucgcc

SEQ ID NO: 1862707 - RNA, 15 nt, Salmonella typhimurium LT2
guuguacuuguugcu

SEQ ID NO: 1862708 - RNA, 21 nt, Salmonella typhimurium LT2
guuguuuuauuaccuccugca

SEQ ID NO: 1862709 - RNA, 18 nt, Salmonella typhimurium LT2
guuguuuggguaacacaa

SEQ ID NO: 1862710 - RNA, 24 nt, Salmonella typhimurium LT2
guuguuugaucccgcugaagacug

SEQ ID NO: 1862711 - RNA, 13 nt, Salmonella typhimurium LT2
guuguuucaccaa

SEQ ID NO: 1862712 - RNA, 12 nt, Salmonella typhimurium LT2
guuguucugggu

SEQ ID NO: 1862713 - RNA, 21 nt, Salmonella typhimurium LT2
uaaaaaccaggcgaaaauagg

SEQ ID NO: 1862714 - RNA, 20 nt, Salmonella typhimurium LT2
uaaaaaccauuuauaaaaua

SEQ ID NO: 1862715 - RNA, 20 nt, Salmonella typhimurium LT2
uaaaaaccagaacuuccaga

SEQ ID NO: 1862716 - RNA, 22 nt, Salmonella typhimurium LT2
guuugaggaaaccuuucuucuc

SEQ ID NO: 1862717 - RNA, 21 nt, Salmonella typhimurium LT2
guuugaggaaaccuuucuucu

SEQ ID NO: 1862718 - RNA, 15 nt, Salmonella typhimurium LT2
guuugaucauggcuc

SEQ ID NO: 1862719 - RNA, 13 nt, Salmonella typhimurium LT2
uaaaaauaauuga

SEQ ID NO: 1862720 - RNA, 16 nt, Salmonella typhimurium LT2
uaaaaauaauugauaa

SEQ ID NO: 1862721 - RNA, 11 nt, Salmonella typhimurium LT2
uaaaaauaacg

SEQ ID NO: 1862722 - RNA, 18 nt, Salmonella typhimurium LT2
uaaaaauaccguuagcau

SEQ ID NO: 1862723 - RNA, 19 nt, Salmonella typhimurium LT2
uaaaaauaccguuagcaua

SEQ ID NO: 1862724 - RNA, 18 nt, Salmonella typhimurium LT2
uaaaaagcacaucaggaa

SEQ ID NO: 1862725 - RNA, 19 nt, Salmonella typhimurium LT2
uaaaaagcacaucaggaaa

SEQ ID NO: 1862726 - RNA, 13 nt, Salmonella typhimurium LT2
uaaaaagaacaag

SEQ ID NO: 1862727 - RNA, 16 nt, Salmonella typhimurium LT2
uaaaaagagaaaaaau

SEQ ID NO: 1862728 - RNA, 10 nt, Salmonella typhimurium LT2
uaaaaaggaa

SEQ ID NO: 1862729 - RNA, 16 nt, Salmonella typhimurium LT2
uaaaaagcugcauaau

SEQ ID NO: 1862730 - RNA, 11 nt, Salmonella typhimurium LT2
uaaaaaggaaa

SEQ ID NO: 1862731 - RNA, 21 nt, Salmonella typhimurium LT2
uaaaaagggggagucgguacu

SEQ ID NO: 1862732 - RNA, 21 nt, Salmonella typhimurium LT2
uaaaaaggugagcgcaaugcu

SEQ ID NO: 1862733 - RNA, 16 nt, Salmonella typhimurium LT2
uaaaagagaaaaagaa

SEQ ID NO: 1862734 - RNA, 15 nt, Salmonella typhimurium LT2
uaaaacugccaucaa

SEQ ID NO: 1862735 - RNA, 22 nt, Salmonella typhimurium LT2
uaaaaccgccgcccaucaauac

SEQ ID NO: 1862736 - RNA, 20 nt, Salmonella typhimurium LT2
uaaaaccauugcuaaaaaua

SEQ ID NO: 1862737 - RNA, 13 nt, Salmonella typhimurium LT2
uaaaacccaauaa

SEQ ID NO: 1862738 - RNA, 16 nt, Salmonella typhimurium LT2
uaaaacggcucaucag

SEQ ID NO: 1862739 - RNA, 12 nt, Salmonella typhimurium LT2
uaaaaaugcgcu

SEQ ID NO: 1862740 - RNA, 21 nt, Salmonella typhimurium LT2
uaaaacaagucagcguuacug

SEQ ID NO: 1862741 - RNA, 15 nt, Salmonella typhimurium LT2
uaaacacguuaucug

SEQ ID NO: 1862742 - RNA, 17 nt, Salmonella typhimurium LT2
uaaacacguuaucugac

SEQ ID NO: 1862743 - RNA, 23 nt, Salmonella typhimurium LT2
uaaaauuauuggcuuuguaaaua

SEQ ID NO: 1862744 - RNA, 16 nt, Salmonella typhimurium LT2
uaaaauuauauucuaa

SEQ ID NO: 1862745 - RNA, 15 nt, Salmonella typhimurium LT2
uaaaauuauccacaa

SEQ ID NO: 1862746 - RNA, 19 nt, Salmonella typhimurium LT2
uaaaauuguaauaauuuaa

SEQ ID NO: 1862747 - RNA, 22 nt, Salmonella typhimurium LT2
uaaaauuguaauaauuuaaaau

SEQ ID NO: 1862748 - RNA, 19 nt, Salmonella typhimurium LT2
uaaaauccggcugccugcc

SEQ ID NO: 1862749 - RNA, 22 nt, Salmonella typhimurium LT2
uaaaauccggggcgguuuauac

SEQ ID NO: 1862750 - RNA, 23 nt, Salmonella typhimurium LT2
uaaaaucggggucuuccagcaga

SEQ ID NO: 1862751 - RNA, 19 nt, Salmonella typhimurium LT2
uaaaaucggguggccuaac

SEQ ID NO: 1862752 - RNA, 19 nt, Salmonella typhimurium LT2
uaaaaucgucccuuuuccc

SEQ ID NO: 1862753 - RNA, 20 nt, Salmonella typhimurium LT2
uaaaaucgucccuuuucccc

SEQ ID NO: 1862754 - RNA, 15 nt, Salmonella typhimurium LT2
uaaaauaacuauaau

SEQ ID NO: 1862755 - RNA, 20 nt, Salmonella typhimurium LT2
uaaaauaagcaauuacuauu

SEQ ID NO: 1862756 - RNA, 17 nt, Salmonella typhimurium LT2
uaaaagggaguauuaau

SEQ ID NO: 1862757 - RNA, 22 nt, Salmonella typhimurium LT2
uaaaauauacccguguggcugu

SEQ ID NO: 1862758 - RNA, 14 nt, Salmonella typhimurium LT2
uaaaucguguggcu

SEQ ID NO: 1862759 - RNA, 14 nt, Salmonella typhimurium LT2
uaaauccgccagug

SEQ ID NO: 1862760 - RNA, 17 nt, Salmonella typhimurium LT2
uaaaucaggccaagcaa

SEQ ID NO: 1862761 - RNA, 12 nt, Salmonella typhimurium LT2
uaaaucaucauc

SEQ ID NO: 1862762 - RNA, 13 nt, Salmonella typhimurium LT2
uaaaucaucaucg

SEQ ID NO: 1862763 - RNA, 19 nt, Salmonella typhimurium LT2
uaaaucauuuguacaaaaa

SEQ ID NO: 1862764 - RNA, 21 nt, Salmonella typhimurium LT2
uaaaucauuuguacaaaaaau

SEQ ID NO: 1862765 - RNA, 15 nt, Salmonella typhimurium LT2
uaaauaccacaacaa

SEQ ID NO: 1862766 - RNA, 18 nt, Salmonella typhimurium LT2
uaaauaccacaacaagaa

SEQ ID NO: 1862767 - RNA, 23 nt, Salmonella typhimurium LT2
uaaauaccaggcacuugagaaau

SEQ ID NO: 1862768 - RNA, 17 nt, Salmonella typhimurium LT2
uaaauacgccgccagca

SEQ ID NO: 1862769 - RNA, 15 nt, Salmonella typhimurium LT2
uaaauaccuuauuca

SEQ ID NO: 1862770 - RNA, 19 nt, Salmonella typhimurium LT2
uaaagugaguguuacucuu

SEQ ID NO: 1862771 - RNA, 21 nt, Salmonella typhimurium LT2
uaaaguuauacagcaccugcu

SEQ ID NO: 1862772 - RNA, 16 nt, Salmonella typhimurium LT2
uaaaguacuuucuccu

SEQ ID NO: 1862773 - RNA, 20 nt, Salmonella typhimurium LT2
uaaaggcggaaaucagcaca

SEQ ID NO: 1862774 - RNA, 23 nt, Salmonella typhimurium LT2
uaaaggcggaaaucagcacaaag

SEQ ID NO: 1862775 - RNA, 23 nt, Salmonella typhimurium LT2
uaaagggaaggucauuaucaaug

SEQ ID NO: 1862776 - RNA, 13 nt, Salmonella typhimurium LT2
uaaaccaggccag

SEQ ID NO: 1862777 - RNA, 19 nt, Salmonella typhimurium LT2
uaaacccccuggccggaaa

SEQ ID NO: 1862778 - RNA, 22 nt, Salmonella typhimurium LT2
uaaaccgaaaggguauacaaaa

SEQ ID NO: 1862779 - RNA, 12 nt, Salmonella typhimurium LT2
uaaacagcagcg

SEQ ID NO: 1862780 - RNA, 22 nt, Salmonella typhimurium LT2
uaaacagauaagcgucugcaau

SEQ ID NO: 1862781 - RNA, 16 nt, Salmonella typhimurium LT2
uaaacaguuccgcaaa

SEQ ID NO: 1862782 - RNA, 19 nt, Salmonella typhimurium LT2
uaaacaguuccgcaaagcc

SEQ ID NO: 1862783 - RNA, 23 nt, Salmonella typhimurium LT2
uaaacuacuggcugguuucuccg

SEQ ID NO: 1862784 - RNA, 15 nt, Salmonella typhimurium LT2
uaaacgcuuuuucaa

SEQ ID NO: 1862785 - RNA, 22 nt, Salmonella typhimurium LT2
uaaacggcagccgccaccacaa

SEQ ID NO: 1862786 - RNA, 20 nt, Salmonella typhimurium LT2
uaaacgccagcccuuccagc

SEQ ID NO: 1862787 - RNA, 13 nt, Salmonella typhimurium LT2
uaaacgccugcac

SEQ ID NO: 1862788 - RNA, 12 nt, Salmonella typhimurium LT2
uaaacgccggau

SEQ ID NO: 1862789 - RNA, 18 nt, Salmonella typhimurium LT2
uaaacucaucuuuauuca

SEQ ID NO: 1862790 - RNA, 17 nt, Salmonella typhimurium LT2
uaaacuccauuaaauua

SEQ ID NO: 1862791 - RNA, 17 nt, Salmonella typhimurium LT2
uaaacucaaucaggcua

SEQ ID NO: 1862792 - RNA, 14 nt, Salmonella typhimurium LT2
uaaacucagcgcca

SEQ ID NO: 1862793 - RNA, 15 nt, Salmonella typhimurium LT2
uaaacuggcgcacag

SEQ ID NO: 1862794 - RNA, 23 nt, Salmonella typhimurium LT2
uaaagauuagcguuuuuaucuuu

SEQ ID NO: 1862795 - RNA, 20 nt, Salmonella typhimurium LT2
uaaagauuuuuauuaaaauu

SEQ ID NO: 1862796 - RNA, 18 nt, Salmonella typhimurium LT2
uaaagauagccaccggca

SEQ ID NO: 1862797 - RNA, 17 nt, Salmonella typhimurium LT2
uaaagauaaauaaaaaa

SEQ ID NO: 1862798 - RNA, 21 nt, Salmonella typhimurium LT2
uaaagauaaauaaaaaauuau

SEQ ID NO: 1862799 - RNA, 16 nt, Salmonella typhimurium LT2
uaaacuguuuccaguu

SEQ ID NO: 1862800 - RNA, 17 nt, Salmonella typhimurium LT2
uaacaacuguuuuucac

SEQ ID NO: 1862801 - RNA, 22 nt, Salmonella typhimurium LT2
uaacaacuccagcaaaucaauu

SEQ ID NO: 1862802 - RNA, 17 nt, Salmonella typhimurium LT2
uaacaccggcaaauagc

SEQ ID NO: 1862803 - RNA, 20 nt, Salmonella typhimurium LT2
uaacaccuuuaucaauagau

SEQ ID NO: 1862804 - RNA, 16 nt, Salmonella typhimurium LT2
uaaaugcauagcccca

SEQ ID NO: 1862805 - RNA, 19 nt, Salmonella typhimurium LT2
uaacagcuugaucaucagg

SEQ ID NO: 1862806 - RNA, 15 nt, Salmonella typhimurium LT2
uaacaggcaauuucc

SEQ ID NO: 1862807 - RNA, 17 nt, Salmonella typhimurium LT2
uaacagacgcaggccgu

SEQ ID NO: 1862808 - RNA, 18 nt, Salmonella typhimurium LT2
uaacagcuugaucaucag

SEQ ID NO: 1862809 - RNA, 18 nt, Salmonella typhimurium LT2
uaaccaacaggaggaucg

SEQ ID NO: 1862810 - RNA, 18 nt, Salmonella typhimurium LT2
uaaccaaacagacacuuu

SEQ ID NO: 1862811 - RNA, 17 nt, Salmonella typhimurium LT2
uaacaucaccuuucauu

SEQ ID NO: 1862812 - RNA, 11 nt, Salmonella typhimurium LT2
uaacaucagcc

SEQ ID NO: 1862813 - RNA, 19 nt, Salmonella typhimurium LT2
uaaccagacgguuuauccc

SEQ ID NO: 1862814 - RNA, 21 nt, Salmonella typhimurium LT2
uaaccagaaaaccgacagcaa

SEQ ID NO: 1862815 - RNA, 23 nt, Salmonella typhimurium LT2
uaaccaccggcgcgccagcgcau

SEQ ID NO: 1862816 - RNA, 17 nt, Salmonella typhimurium LT2
uaaccacgauaaagaca

SEQ ID NO: 1862817 - RNA, 18 nt, Salmonella typhimurium LT2
uaaccaauuaaauuauuu

SEQ ID NO: 1862818 - RNA, 15 nt, Salmonella typhimurium LT2
uaacuggcaaucaug

SEQ ID NO: 1862819 - RNA, 16 nt, Salmonella typhimurium LT2
uaacuggacaacauuu

SEQ ID NO: 1862820 - RNA, 20 nt, Salmonella typhimurium LT2
uaacuggacaacauuucgca

SEQ ID NO: 1862821 - RNA, 13 nt, Salmonella typhimurium LT2
uaacuggaaaaag

SEQ ID NO: 1862822 - RNA, 12 nt, Salmonella typhimurium LT2
uaacugcugcuc

SEQ ID NO: 1862823 - RNA, 21 nt, Salmonella typhimurium LT2
uaacuggaaaaagaccaauac

SEQ ID NO: 1862824 - RNA, 11 nt, Salmonella typhimurium LT2
uaacugcggua

SEQ ID NO: 1862825 - RNA, 19 nt, Salmonella typhimurium LT2
uaacugccuuauccggccu

SEQ ID NO: 1862826 - RNA, 23 nt, Salmonella typhimurium LT2
uaacugccggguuaaaaacgcca

SEQ ID NO: 1862827 - RNA, 21 nt, Salmonella typhimurium LT2
uaacugcccguuacgcauuuc

SEQ ID NO: 1862828 - RNA, 18 nt, Salmonella typhimurium LT2
uaacugcccguuacgcau

SEQ ID NO: 1862829 - RNA, 19 nt, Salmonella typhimurium LT2
uaacucuuccgcaaucaca

SEQ ID NO: 1862830 - RNA, 13 nt, Salmonella typhimurium LT2
uaacucuucaucg

SEQ ID NO: 1862831 - RNA, 15 nt, Salmonella typhimurium LT2
uaacucucucuguaa

SEQ ID NO: 1862832 - RNA, 19 nt, Salmonella typhimurium LT2
uaacucucucuguaauaau

SEQ ID NO: 1862833 - RNA, 17 nt, Salmonella typhimurium LT2
uaacugaagguuuuucc

SEQ ID NO: 1862834 - RNA, 23 nt, Salmonella typhimurium LT2
uaacugcaccuuuuuuuccagcg

SEQ ID NO: 1862835 - RNA, 23 nt, Salmonella typhimurium LT2
uaacugacgaccgggggcuggcc

SEQ ID NO: 1862836 - RNA, 22 nt, Salmonella typhimurium LT2
uaacuccuucuaauuccaggau

SEQ ID NO: 1862837 - RNA, 18 nt, Salmonella typhimurium LT2
uaacucaauagcggcgcu

SEQ ID NO: 1862838 - RNA, 17 nt, Salmonella typhimurium LT2
uaacguuuaaugucacc

SEQ ID NO: 1862839 - RNA, 19 nt, Salmonella typhimurium LT2
uaacguacagguugugcau

SEQ ID NO: 1862840 - RNA, 19 nt, Salmonella typhimurium LT2
uaacguuuguagaugaacu

SEQ ID NO: 1862841 - RNA, 12 nt, Salmonella typhimurium LT2
uaacguuucaug

SEQ ID NO: 1862842 - RNA, 16 nt, Salmonella typhimurium LT2
uaacuaaaauacucac

SEQ ID NO: 1862843 - RNA, 15 nt, Salmonella typhimurium LT2
uaacuaaacucaucu

SEQ ID NO: 1862844 - RNA, 22 nt, Salmonella typhimurium LT2
uaacggcugacgcccaucagca

SEQ ID NO: 1862845 - RNA, 23 nt, Salmonella typhimurium LT2
uaacggcgacaggcacaacaaua

SEQ ID NO: 1862846 - RNA, 20 nt, Salmonella typhimurium LT2
uaacggcgcgaaagcgccuu

SEQ ID NO: 1862847 - RNA, 20 nt, Salmonella typhimurium LT2
uaacgggugaucuuuauaaa

SEQ ID NO: 1862848 - RNA, 13 nt, Salmonella typhimurium LT2
uaacgcgccaucu

SEQ ID NO: 1862849 - RNA, 13 nt, Salmonella typhimurium LT2
uaaccucuuuuuc

SEQ ID NO: 1862850 - RNA, 15 nt, Salmonella typhimurium LT2
uaaccuuaaaaggcg

SEQ ID NO: 1862851 - RNA, 23 nt, Salmonella typhimurium LT2
uaaccuucuaccccgugauucac

SEQ ID NO: 1862852 - RNA, 16 nt, Salmonella typhimurium LT2
uaaccuuauauauguu

SEQ ID NO: 1862853 - RNA, 18 nt, Salmonella typhimurium LT2
uaacgcauacauucuguu

SEQ ID NO: 1862854 - RNA, 21 nt, Salmonella typhimurium LT2
uaaccuucuucguuaugaaug

SEQ ID NO: 1862855 - RNA, 18 nt, Salmonella typhimurium LT2
uaaccucuauaguaaauu

SEQ ID NO: 1862856 - RNA, 16 nt, Salmonella typhimurium LT2
uaaccucuauaguaaa

SEQ ID NO: 1862857 - RNA, 18 nt, Salmonella typhimurium LT2
uaacccaugggcggccug

SEQ ID NO: 1862858 - RNA, 15 nt, Salmonella typhimurium LT2
uaagcuuauccugcc

SEQ ID NO: 1862859 - RNA, 13 nt, Salmonella typhimurium LT2
uaagcuuauaaac

SEQ ID NO: 1862860 - RNA, 18 nt, Salmonella typhimurium LT2
uaaggaaacgaaagcuca

SEQ ID NO: 1862861 - RNA, 16 nt, Salmonella typhimurium LT2
uaagcuauguuuuuau

SEQ ID NO: 1862862 - RNA, 19 nt, Salmonella typhimurium LT2
uaagcuauuucuguauaau

SEQ ID NO: 1862863 - RNA, 16 nt, Salmonella typhimurium LT2
uaagcgacagcgccau

SEQ ID NO: 1862864 - RNA, 18 nt, Salmonella typhimurium LT2
uaagccuggcauaacauu

SEQ ID NO: 1862865 - RNA, 16 nt, Salmonella typhimurium LT2
uaagccgucauaaaau

SEQ ID NO: 1862866 - RNA, 14 nt, Salmonella typhimurium LT2
uaagcgcucaggca

SEQ ID NO: 1862867 - RNA, 13 nt, Salmonella typhimurium LT2
uaagcgccgcuga

SEQ ID NO: 1862868 - RNA, 15 nt, Salmonella typhimurium LT2
uaagcgcagcgccau

SEQ ID NO: 1862869 - RNA, 19 nt, Salmonella typhimurium LT2
uaagcggcggaccagcgug

SEQ ID NO: 1862870 - RNA, 17 nt, Salmonella typhimurium LT2
uaagcguuacggaaaaa

SEQ ID NO: 1862871 - RNA, 16 nt, Salmonella typhimurium LT2
uaagccgauugaauaa

SEQ ID NO: 1862872 - RNA, 21 nt, Salmonella typhimurium LT2
uaagccagcccugccaccagc

SEQ ID NO: 1862873 - RNA, 16 nt, Salmonella typhimurium LT2
uaagccacugcccaga

SEQ ID NO: 1862874 - RNA, 23 nt, Salmonella typhimurium LT2
uaagcauuagcgccauccggcac

SEQ ID NO: 1862875 - RNA, 14 nt, Salmonella typhimurium LT2
uaagcacaggccau

SEQ ID NO: 1862876 - RNA, 13 nt, Salmonella typhimurium LT2
uaagcacaccauu

SEQ ID NO: 1862877 - RNA, 18 nt, Salmonella typhimurium LT2
uaagcaccggcgggcuga

SEQ ID NO: 1862878 - RNA, 20 nt, Salmonella typhimurium LT2
uaagcagcugcuuaacuucu

SEQ ID NO: 1862879 - RNA, 13 nt, Salmonella typhimurium LT2
uaagcauccccac

SEQ ID NO: 1862880 - RNA, 23 nt, Salmonella typhimurium LT2
uaagauucccccgcaugaaaugc

SEQ ID NO: 1862881 - RNA, 12 nt, Salmonella typhimurium LT2
uaagauguuuua

SEQ ID NO: 1862882 - RNA, 14 nt, Salmonella typhimurium LT2
uaagaugcggaugc

SEQ ID NO: 1862883 - RNA, 18 nt, Salmonella typhimurium LT2
uaagaugcggaugccgca

SEQ ID NO: 1862884 - RNA, 14 nt, Salmonella typhimurium LT2
uaagcaagcgccau

SEQ ID NO: 1862885 - RNA, 14 nt, Salmonella typhimurium LT2
uaagcaauauggcu

SEQ ID NO: 1862886 - RNA, 18 nt, Salmonella typhimurium LT2
uaagcaaaggcgguuuua

SEQ ID NO: 1862887 - RNA, 21 nt, Salmonella typhimurium LT2
uaagaaacugcuguagcacau

SEQ ID NO: 1862888 - RNA, 15 nt, Salmonella typhimurium LT2
uaagaaguaaacaga

SEQ ID NO: 1862889 - RNA, 15 nt, Salmonella typhimurium LT2
uaacuucagcaucau

SEQ ID NO: 1862890 - RNA, 22 nt, Salmonella typhimurium LT2
uaacuuaaacgccggauuccag

SEQ ID NO: 1862891 - RNA, 15 nt, Salmonella typhimurium LT2
uaacuucugcaggga

SEQ ID NO: 1862892 - RNA, 18 nt, Salmonella typhimurium LT2
uaacuucuccuccaucag

SEQ ID NO: 1862893 - RNA, 11 nt, Salmonella typhimurium LT2
uaagagaacaa

SEQ ID NO: 1862894 - RNA, 21 nt, Salmonella typhimurium LT2
uaagaaugcgcgucaggccag

SEQ ID NO: 1862895 - RNA, 21 nt, Salmonella typhimurium LT2
uaagaaucagaugcucaucaa

SEQ ID NO: 1862896 - RNA, 21 nt, Salmonella typhimurium LT2
uaagaauaucggcgucgacgu

SEQ ID NO: 1862897 - RNA, 19 nt, Salmonella typhimurium LT2
uaagaauucguccagauga

SEQ ID NO: 1862898 - RNA, 14 nt, Salmonella typhimurium LT2
uaagagacugacaa

SEQ ID NO: 1862899 - RNA, 17 nt, Salmonella typhimurium LT2
uaagagccuaucccacc

SEQ ID NO: 1862900 - RNA, 15 nt, Salmonella typhimurium LT2
uauagccaggcagau

SEQ ID NO: 1862901 - RNA, 15 nt, Salmonella typhimurium LT2
uauagccauuuuuug

SEQ ID NO: 1862902 - RNA, 13 nt, Salmonella typhimurium LT2
uauagcccacgca

SEQ ID NO: 1862903 - RNA, 14 nt, Salmonella typhimurium LT2
uauagauauuaaac

SEQ ID NO: 1862904 - RNA, 19 nt, Salmonella typhimurium LT2
uauagagcgccauauugcu

SEQ ID NO: 1862905 - RNA, 19 nt, Salmonella typhimurium LT2
uauagagcaaucuggcagu

SEQ ID NO: 1862906 - RNA, 17 nt, Salmonella typhimurium LT2
uauacgccuauuuucug

SEQ ID NO: 1862907 - RNA, 16 nt, Salmonella typhimurium LT2
uauacccguguggcug

SEQ ID NO: 1862908 - RNA, 20 nt, Salmonella typhimurium LT2
uauaccacgucugaagaagu

SEQ ID NO: 1862909 - RNA, 15 nt, Salmonella typhimurium LT2
uauaccagcgucagc

SEQ ID NO: 1862910 - RNA, 21 nt, Salmonella typhimurium LT2
uauacauauggaugaggaucg

SEQ ID NO: 1862911 - RNA, 14 nt, Salmonella typhimurium LT2
uauaccaugccgcc

SEQ ID NO: 1862912 - RNA, 21 nt, Salmonella typhimurium LT2
uauaccaugccgccauuuuau

SEQ ID NO: 1862913 - RNA, 15 nt, Salmonella typhimurium LT2
uauacucaaaaaauc

SEQ ID NO: 1862914 - RNA, 15 nt, Salmonella typhimurium LT2
uauacuuauugaucc

SEQ ID NO: 1862915 - RNA, 13 nt, Salmonella typhimurium LT2
uauacuucaucag

SEQ ID NO: 1862916 - RNA, 17 nt, Salmonella typhimurium LT2
uauacagcaccugcuca

SEQ ID NO: 1862917 - RNA, 20 nt, Salmonella typhimurium LT2
uauaauugcccgcaaucucu

SEQ ID NO: 1862918 - RNA, 14 nt, Salmonella typhimurium LT2
uauaauuauuuguu

SEQ ID NO: 1862919 - RNA, 13 nt, Salmonella typhimurium LT2
uauaauaauaucc

SEQ ID NO: 1862920 - RNA, 16 nt, Salmonella typhimurium LT2
uagucggcaaugcucu

SEQ ID NO: 1862921 - RNA, 19 nt, Salmonella typhimurium LT2
uagucgcuccccauaaaaa

SEQ ID NO: 1862922 - RNA, 21 nt, Salmonella typhimurium LT2
uaggucagguuuaauguugcc

SEQ ID NO: 1862923 - RNA, 21 nt, Salmonella typhimurium LT2
uagguaagauauuuuguuuua

SEQ ID NO: 1862924 - RNA, 22 nt, Salmonella typhimurium LT2
uagucuccugccgaugaaauaa

SEQ ID NO: 1862925 - RNA, 12 nt, Salmonella typhimurium LT2
uagugucacaaa

SEQ ID NO: 1862926 - RNA, 23 nt, Salmonella typhimurium LT2
uaguggcagaguccagcggcagc

SEQ ID NO: 1862927 - RNA, 17 nt, Salmonella typhimurium LT2
uaguguucgcggcuggu

SEQ ID NO: 1862928 - RNA, 14 nt, Salmonella typhimurium LT2
uaguggauggccca

SEQ ID NO: 1862929 - RNA, 20 nt, Salmonella typhimurium LT2
uaguuauacauuuuuuucuu

SEQ ID NO: 1862930 - RNA, 12 nt, Salmonella typhimurium LT2
uauaaaucaaua

SEQ ID NO: 1862931 - RNA, 14 nt, Salmonella typhimurium LT2
uaguuucuauuaaa

SEQ ID NO: 1862932 - RNA, 24 nt, Salmonella typhimurium LT2
uaguuuauugagauaauuuaugau

SEQ ID NO: 1862933 - RNA, 22 nt, Salmonella typhimurium LT2
uaguuuccgccgcgguauucau

SEQ ID NO: 1862934 - RNA, 16 nt, Salmonella typhimurium LT2
uaucaggugcgagagc

SEQ ID NO: 1862935 - RNA, 14 nt, Salmonella typhimurium LT2
uaucaggccgacaa

SEQ ID NO: 1862936 - RNA, 21 nt, Salmonella typhimurium LT2
uaucaggcaugauuuucuuca

SEQ ID NO: 1862937 - RNA, 20 nt, Salmonella typhimurium LT2
uaucaggccgacaaaugacg

SEQ ID NO: 1862938 - RNA, 19 nt, Salmonella typhimurium LT2
uaucaccaaguagacagag

SEQ ID NO: 1862939 - RNA, 17 nt, Salmonella typhimurium LT2
uaucagcgcguuuucca

SEQ ID NO: 1862940 - RNA, 16 nt, Salmonella typhimurium LT2
uaucagccgccaguaa

SEQ ID NO: 1862941 - RNA, 14 nt, Salmonella typhimurium LT2
uaucagcuugccgu

SEQ ID NO: 1862942 - RNA, 15 nt, Salmonella typhimurium LT2
uaucaagccuacacc

SEQ ID NO: 1862943 - RNA, 13 nt, Salmonella typhimurium LT2
uauauuggcuggc

SEQ ID NO: 1862944 - RNA, 23 nt, Salmonella typhimurium LT2
uauauugcgaauaaaacugccau

SEQ ID NO: 1862945 - RNA, 17 nt, Salmonella typhimurium LT2
uaucaauagaucuuaau

SEQ ID NO: 1862946 - RNA, 19 nt, Salmonella typhimurium LT2
uaucacacugacaauaaag

SEQ ID NO: 1862947 - RNA, 17 nt, Salmonella typhimurium LT2
uauauucguccuuuauc

SEQ ID NO: 1862948 - RNA, 23 nt, Salmonella typhimurium LT2
uauauucugggcuuacuuuccaa

SEQ ID NO: 1862949 - RNA, 15 nt, Salmonella typhimurium LT2
uauauucuucuuaga

SEQ ID NO: 1862950 - RNA, 15 nt, Salmonella typhimurium LT2
uauauuccagccagg

SEQ ID NO: 1862951 - RNA, 23 nt, Salmonella typhimurium LT2
uauaugagcgggccgucaggccc

SEQ ID NO: 1862952 - RNA, 14 nt, Salmonella typhimurium LT2
uauaugagcgggcc

SEQ ID NO: 1862953 - RNA, 17 nt, Salmonella typhimurium LT2
uauauguuucuguauuu

SEQ ID NO: 1862954 - RNA, 12 nt, Salmonella typhimurium LT2
uauaggccaggc

SEQ ID NO: 1862955 - RNA, 18 nt, Salmonella typhimurium LT2
uauauacccaaaauaauu

SEQ ID NO: 1862956 - RNA, 14 nt, Salmonella typhimurium LT2
uauagccugcuggg

SEQ ID NO: 1862957 - RNA, 22 nt, Salmonella typhimurium LT2
uauagcggucaaaauauaacuu

SEQ ID NO: 1862958 - RNA, 16 nt, Salmonella typhimurium LT2
uaucgaaguaauaaaa

SEQ ID NO: 1862959 - RNA, 22 nt, Salmonella typhimurium LT2
uaucgaaguaauaaaaaacaac

SEQ ID NO: 1862960 - RNA, 18 nt, Salmonella typhimurium LT2
uaucgacacuauuuuuca

SEQ ID NO: 1862961 - RNA, 22 nt, Salmonella typhimurium LT2
uaucgaaauagcggugaacuug

SEQ ID NO: 1862962 - RNA, 14 nt, Salmonella typhimurium LT2
uauccccgcuggcg

SEQ ID NO: 1862963 - RNA, 14 nt, Salmonella typhimurium LT2
uauccaguugauga

SEQ ID NO: 1862964 - RNA, 20 nt, Salmonella typhimurium LT2
uaucccaucgacuuaaaaga

SEQ ID NO: 1862965 - RNA, 18 nt, Salmonella typhimurium LT2
uaucccuuccucauuauu

SEQ ID NO: 1862966 - RNA, 19 nt, Salmonella typhimurium LT2
uauccgacugaccagaccg

SEQ ID NO: 1862967 - RNA, 14 nt, Salmonella typhimurium LT2
uauccaggcgggca

SEQ ID NO: 1862968 - RNA, 12 nt, Salmonella typhimurium LT2
uauccagcagcc

SEQ ID NO: 1862969 - RNA, 20 nt, Salmonella typhimurium LT2
uauccagcgcguaaauaccu

SEQ ID NO: 1862970 - RNA, 15 nt, Salmonella typhimurium LT2
uauccagcgcaggca

SEQ ID NO: 1862971 - RNA, 15 nt, Salmonella typhimurium LT2
uauccagcagccagg

SEQ ID NO: 1862972 - RNA, 17 nt, Salmonella typhimurium LT2
uaucuaugguaauuuaa

SEQ ID NO: 1862973 - RNA, 20 nt, Salmonella typhimurium LT2
uaucuaugguaauuuaaagu

SEQ ID NO: 1862974 - RNA, 17 nt, Salmonella typhimurium LT2
uaucugaccaugccagc

SEQ ID NO: 1862975 - RNA, 14 nt, Salmonella typhimurium LT2
uaucugaugaacua

SEQ ID NO: 1862976 - RNA, 12 nt, Salmonella typhimurium LT2
uaucuuauaaau

SEQ ID NO: 1862977 - RNA, 16 nt, Salmonella typhimurium LT2
uaucgauaucugccug

SEQ ID NO: 1862978 - RNA, 14 nt, Salmonella typhimurium LT2
uaucgaugcuuauu

SEQ ID NO: 1862979 - RNA, 13 nt, Salmonella typhimurium LT2
uaucgauaaucaa

SEQ ID NO: 1862980 - RNA, 23 nt, Salmonella typhimurium LT2
uaucgacguuguucgcuucuucu

SEQ ID NO: 1862981 - RNA, 18 nt, Salmonella typhimurium LT2
uagccguucaugcacucg

SEQ ID NO: 1862982 - RNA, 23 nt, Salmonella typhimurium LT2
uagccucggucgagcuuuugcug

SEQ ID NO: 1862983 - RNA, 18 nt, Salmonella typhimurium LT2
uagccugaacgccggaac

SEQ ID NO: 1862984 - RNA, 19 nt, Salmonella typhimurium LT2
uagccugccagcaacccac

SEQ ID NO: 1862985 - RNA, 21 nt, Salmonella typhimurium LT2
uagccuuccuggggaacagaa

SEQ ID NO: 1862986 - RNA, 18 nt, Salmonella typhimurium LT2
uagccuuccaccgucuug

SEQ ID NO: 1862987 - RNA, 19 nt, Salmonella typhimurium LT2
uagcgaaacugccuaaauu

SEQ ID NO: 1862988 - RNA, 15 nt, Salmonella typhimurium LT2
uagcgaaacaguugg

SEQ ID NO: 1862989 - RNA, 14 nt, Salmonella typhimurium LT2
uagcgaaacugccu

SEQ ID NO: 1862990 - RNA, 13 nt, Salmonella typhimurium LT2
uagccuuuuucgc

SEQ ID NO: 1862991 - RNA, 24 nt, Salmonella typhimurium LT2
uagccuugacgcaauagaguaaug

SEQ ID NO: 1862992 - RNA, 20 nt, Salmonella typhimurium LT2
uagccagcgauccugcggca

SEQ ID NO: 1862993 - RNA, 21 nt, Salmonella typhimurium LT2
uagccagcgcagcguggccuu

SEQ ID NO: 1862994 - RNA, 20 nt, Salmonella typhimurium LT2
uagccagccugaacgggugg

SEQ ID NO: 1862995 - RNA, 17 nt, Salmonella typhimurium LT2
uagccauauaugaaauc

SEQ ID NO: 1862996 - RNA, 17 nt, Salmonella typhimurium LT2
uagccaauaacgucugg

SEQ ID NO: 1862997 - RNA, 19 nt, Salmonella typhimurium LT2
uagccgcgcgucagcgugu

SEQ ID NO: 1862998 - RNA, 21 nt, Salmonella typhimurium LT2
uagccgcgcgccgccucuuca

SEQ ID NO: 1862999 - RNA, 12 nt, Salmonella typhimurium LT2
uagccgcgcgcc

SEQ ID NO: 1863000 - RNA, 16 nt, Salmonella typhimurium LT2
uagcagugcaaaggcc

SEQ ID NO: 1863001 - RNA, 14 nt, Salmonella typhimurium LT2
uagcaccaggccaa

SEQ ID NO: 1863002 - RNA, 12 nt, Salmonella typhimurium LT2
uagcaucaccag

SEQ ID NO: 1863003 - RNA, 13 nt, Salmonella typhimurium LT2
uagcaucaucaaa

SEQ ID NO: 1863004 - RNA, 16 nt, Salmonella typhimurium LT2
uagcauuuuuacucag

SEQ ID NO: 1863005 - RNA, 20 nt, Salmonella typhimurium LT2
uagccaaaagcgccacgcgu

SEQ ID NO: 1863006 - RNA, 17 nt, Salmonella typhimurium LT2
uagcauaacguuuccuu

SEQ ID NO: 1863007 - RNA, 14 nt, Salmonella typhimurium LT2
uagauauuccccac

SEQ ID NO: 1863008 - RNA, 21 nt, Salmonella typhimurium LT2
uagauauuaaacguuauucau

SEQ ID NO: 1863009 - RNA, 14 nt, Salmonella typhimurium LT2
uagcaaugaagcaa

SEQ ID NO: 1863010 - RNA, 14 nt, Salmonella typhimurium LT2
uagcaagggcaagg

SEQ ID NO: 1863011 - RNA, 16 nt, Salmonella typhimurium LT2
uagcaagguauguauu

SEQ ID NO: 1863012 - RNA, 13 nt, Salmonella typhimurium LT2
uagcucagcgcgg

SEQ ID NO: 1863013 - RNA, 15 nt, Salmonella typhimurium LT2
uagcuaaugauuauc

SEQ ID NO: 1863014 - RNA, 16 nt, Salmonella typhimurium LT2
uagcuaaauuaaaaau

SEQ ID NO: 1863015 - RNA, 13 nt, Salmonella typhimurium LT2
uagcguuuuccag

SEQ ID NO: 1863016 - RNA, 19 nt, Salmonella typhimurium LT2
uagcguuuaaaaagcugca

SEQ ID NO: 1863017 - RNA, 14 nt, Salmonella typhimurium LT2
uagcguuuuccagc

SEQ ID NO: 1863018 - RNA, 13 nt, Salmonella typhimurium LT2
uagcguugauaug

SEQ ID NO: 1863019 - RNA, 20 nt, Salmonella typhimurium LT2
uagcgagaaggcuuuuccau

SEQ ID NO: 1863020 - RNA, 13 nt, Salmonella typhimurium LT2
uagcgauacugac

SEQ ID NO: 1863021 - RNA, 17 nt, Salmonella typhimurium LT2
uagcugcggcucgccaa

SEQ ID NO: 1863022 - RNA, 16 nt, Salmonella typhimurium LT2
uagcugccgcccggcg

SEQ ID NO: 1863023 - RNA, 12 nt, Salmonella typhimurium LT2
uagcugcgcgcc

SEQ ID NO: 1863024 - RNA, 21 nt, Salmonella typhimurium LT2
uagcucggcaaagcccaucac

SEQ ID NO: 1863025 - RNA, 10 nt, Salmonella typhimurium LT2
uagcuuugca

SEQ ID NO: 1863026 - RNA, 14 nt, Salmonella typhimurium LT2
uagggcagggugcc

SEQ ID NO: 1863027 - RNA, 12 nt, Salmonella typhimurium LT2
uaggccggauaa

SEQ ID NO: 1863028 - RNA, 20 nt, Salmonella typhimurium LT2
uaggccggauaagcgugagc

SEQ ID NO: 1863029 - RNA, 17 nt, Salmonella typhimurium LT2
uaggccggauaaggcgu

SEQ ID NO: 1863030 - RNA, 16 nt, Salmonella typhimurium LT2
uaggccggauaaggug

SEQ ID NO: 1863031 - RNA, 18 nt, Salmonella typhimurium LT2
uaggccugauaagcguag

SEQ ID NO: 1863032 - RNA, 13 nt, Salmonella typhimurium LT2
uaggccugauaag

SEQ ID NO: 1863033 - RNA, 18 nt, Salmonella typhimurium LT2
uaggauauccugcucgcc

SEQ ID NO: 1863034 - RNA, 17 nt, Salmonella typhimurium LT2
uaggaucugaaaggcgu

SEQ ID NO: 1863035 - RNA, 12 nt, Salmonella typhimurium LT2
uaggauaaaauc

SEQ ID NO: 1863036 - RNA, 17 nt, Salmonella typhimurium LT2
uaggauaacuuuuacca

SEQ ID NO: 1863037 - RNA, 20 nt, Salmonella typhimurium LT2
uagaccagcgccggagcaaa

SEQ ID NO: 1863038 - RNA, 22 nt, Salmonella typhimurium LT2
uagaccuguuccaugacguuca

SEQ ID NO: 1863039 - RNA, 22 nt, Salmonella typhimurium LT2
uagacaguuuuuucguuccaga

SEQ ID NO: 1863040 - RNA, 20 nt, Salmonella typhimurium LT2
uagacagcggcuaauuuauu

SEQ ID NO: 1863041 - RNA, 13 nt, Salmonella typhimurium LT2
uagacaucaaaau

SEQ ID NO: 1863042 - RNA, 14 nt, Salmonella typhimurium LT2
uagacaaugcaggc

SEQ ID NO: 1863043 - RNA, 15 nt, Salmonella typhimurium LT2
uagacggccugcaaa

SEQ ID NO: 1863044 - RNA, 18 nt, Salmonella typhimurium LT2
uagacgcgcuagcuucag

SEQ ID NO: 1863045 - RNA, 21 nt, Salmonella typhimurium LT2
uagacuguugaaagccccggc

SEQ ID NO: 1863046 - RNA, 12 nt, Salmonella typhimurium LT2
uagagaaaucaa

SEQ ID NO: 1863047 - RNA, 18 nt, Salmonella typhimurium LT2
uagagcugacggagcaaa

SEQ ID NO: 1863048 - RNA, 21 nt, Salmonella typhimurium LT2
uagagcaaucuggcaguauaa

SEQ ID NO: 1863049 - RNA, 13 nt, Salmonella typhimurium LT2
uagaguuaaaagg

SEQ ID NO: 1863050 - RNA, 23 nt, Salmonella typhimurium LT2
uagauaccuacuuuauuuuucgc

SEQ ID NO: 1863051 - RNA, 14 nt, Salmonella typhimurium LT2
uagaaccacuuauu

SEQ ID NO: 1863052 - RNA, 16 nt, Salmonella typhimurium LT2
uacuauagauauuaaa

SEQ ID NO: 1863053 - RNA, 15 nt, Salmonella typhimurium LT2
uacuaucccauuuuu

SEQ ID NO: 1863054 - RNA, 20 nt, Salmonella typhimurium LT2
uagaagcucaugugcagcau

SEQ ID NO: 1863055 - RNA, 24 nt, Salmonella typhimurium LT2
uagaacuuccaacuaaagcgaauu

SEQ ID NO: 1863056 - RNA, 21 nt, Salmonella typhimurium LT2
uagaauagcaucaauuucucu

SEQ ID NO: 1863057 - RNA, 18 nt, Salmonella typhimurium LT2
uagaaucccaccaauugc

SEQ ID NO: 1863058 - RNA, 13 nt, Salmonella typhimurium LT2
uagaaucuauuau

SEQ ID NO: 1863059 - RNA, 20 nt, Salmonella typhimurium LT2
uagaaugaauuucuucaucc

SEQ ID NO: 1863060 - RNA, 11 nt, Salmonella typhimurium LT2
uagacaaacag

SEQ ID NO: 1863061 - RNA, 17 nt, Salmonella typhimurium LT2
uacagaaaaccggcaaa

SEQ ID NO: 1863062 - RNA, 14 nt, Salmonella typhimurium LT2
uacagacacggucg

SEQ ID NO: 1863063 - RNA, 12 nt, Salmonella typhimurium LT2
uacagacaucau

SEQ ID NO: 1863064 - RNA, 12 nt, Salmonella typhimurium LT2
uacacagcacaa

SEQ ID NO: 1863065 - RNA, 14 nt, Salmonella typhimurium LT2
uacacaaucaucga

SEQ ID NO: 1863066 - RNA, 15 nt, Salmonella typhimurium LT2
uacacaagcuaaaaa

SEQ ID NO: 1863067 - RNA, 16 nt, Salmonella typhimurium LT2
uacagccgaagccauu

SEQ ID NO: 1863068 - RNA, 17 nt, Salmonella typhimurium LT2
uacagcaauaaaaggaa

SEQ ID NO: 1863069 - RNA, 17 nt, Salmonella typhimurium LT2
uacagcaauaugacugg

SEQ ID NO: 1863070 - RNA, 15 nt, Salmonella typhimurium LT2
uacagcgcagcccau

SEQ ID NO: 1863071 - RNA, 20 nt, Salmonella typhimurium LT2
uacagccuuguuuaccgcaa

SEQ ID NO: 1863072 - RNA, 22 nt, Salmonella typhimurium LT2
uacagcgagcuauccggcaaca

SEQ ID NO: 1863073 - RNA, 21 nt, Salmonella typhimurium LT2
uacagccgacuauuccgcaaa

SEQ ID NO: 1863074 - RNA, 19 nt, Salmonella typhimurium LT2
uaauuguggaaauaagagu

SEQ ID NO: 1863075 - RNA, 20 nt, Salmonella typhimurium LT2
uacaacaauugugaugcauu

SEQ ID NO: 1863076 - RNA, 21 nt, Salmonella typhimurium LT2
uacaaauuacacaauaucaau

SEQ ID NO: 1863077 - RNA, 17 nt, Salmonella typhimurium LT2
uacaaaucucagggugu

SEQ ID NO: 1863078 - RNA, 18 nt, Salmonella typhimurium LT2
uacaacucagcguaacug

SEQ ID NO: 1863079 - RNA, 22 nt, Salmonella typhimurium LT2
uacaacgacuacguucaucagg

SEQ ID NO: 1863080 - RNA, 21 nt, Salmonella typhimurium LT2
uacaacgacuacguucaucag

SEQ ID NO: 1863081 - RNA, 16 nt, Salmonella typhimurium LT2
uacaauauugcgcgcu

SEQ ID NO: 1863082 - RNA, 15 nt, Salmonella typhimurium LT2
uaccaacguaaauua

SEQ ID NO: 1863083 - RNA, 14 nt, Salmonella typhimurium LT2
uaccaacugagcua

SEQ ID NO: 1863084 - RNA, 16 nt, Salmonella typhimurium LT2
uaccaacugcugcgua

SEQ ID NO: 1863085 - RNA, 15 nt, Salmonella typhimurium LT2
uaccaaauauuucuu

SEQ ID NO: 1863086 - RNA, 19 nt, Salmonella typhimurium LT2
uaccaaacccuuuggcaaa

SEQ ID NO: 1863087 - RNA, 14 nt, Salmonella typhimurium LT2
uaccaaacagcaga

SEQ ID NO: 1863088 - RNA, 21 nt, Salmonella typhimurium LT2
uaccaaagucaucaauugcca

SEQ ID NO: 1863089 - RNA, 19 nt, Salmonella typhimurium LT2
uaccaaagcccgcaaacag

SEQ ID NO: 1863090 - RNA, 18 nt, Salmonella typhimurium LT2
uaccaauauuaauguauu

SEQ ID NO: 1863091 - RNA, 22 nt, Salmonella typhimurium LT2
uaccacaaauuuugauaaaaac

SEQ ID NO: 1863092 - RNA, 14 nt, Salmonella typhimurium LT2
uaccacaacaagaa

SEQ ID NO: 1863093 - RNA, 17 nt, Salmonella typhimurium LT2
uaccaauucccagaccc

SEQ ID NO: 1863094 - RNA, 14 nt, Salmonella typhimurium LT2
uaccaauacccagc

SEQ ID NO: 1863095 - RNA, 15 nt, Salmonella typhimurium LT2
uaccaauacccagcg

SEQ ID NO: 1863096 - RNA, 17 nt, Salmonella typhimurium LT2
uaccaauacccagcgcc

SEQ ID NO: 1863097 - RNA, 14 nt, Salmonella typhimurium LT2
uacauuuuuuucuu

SEQ ID NO: 1863098 - RNA, 17 nt, Salmonella typhimurium LT2
uacauuauugcacauaa

SEQ ID NO: 1863099 - RNA, 16 nt, Salmonella typhimurium LT2
uacauucaaacggcug

SEQ ID NO: 1863100 - RNA, 19 nt, Salmonella typhimurium LT2
uacaugaaaaauagacaca

SEQ ID NO: 1863101 - RNA, 20 nt, Salmonella typhimurium LT2
uacaucuuauuucaccggac

SEQ ID NO: 1863102 - RNA, 18 nt, Salmonella typhimurium LT2
uacaucuuccauuuuggu

SEQ ID NO: 1863103 - RNA, 17 nt, Salmonella typhimurium LT2
uacaucguaaagcacca

SEQ ID NO: 1863104 - RNA, 15 nt, Salmonella typhimurium LT2
uacaucgccacuacc

SEQ ID NO: 1863105 - RNA, 14 nt, Salmonella typhimurium LT2
uacauccagcuaua

SEQ ID NO: 1863106 - RNA, 19 nt, Salmonella typhimurium LT2
uacaggcaaucggccaggu

SEQ ID NO: 1863107 - RNA, 23 nt, Salmonella typhimurium LT2
uacagggcggcaggaugaaugac

SEQ ID NO: 1863108 - RNA, 23 nt, Salmonella typhimurium LT2
uacagggcguuuuauaagccgcu

SEQ ID NO: 1863109 - RNA, 20 nt, Salmonella typhimurium LT2
uacaggcccgauaagcgcug

SEQ ID NO: 1863110 - RNA, 18 nt, Salmonella typhimurium LT2
uacaggcgcaguugaaaa

SEQ ID NO: 1863111 - RNA, 18 nt, Salmonella typhimurium LT2
uacaggcguguggcauaa

SEQ ID NO: 1863112 - RNA, 15 nt, Salmonella typhimurium LT2
uacaucaauaaacau

SEQ ID NO: 1863113 - RNA, 22 nt, Salmonella typhimurium LT2
uacauaucauuaugucauagca

SEQ ID NO: 1863114 - RNA, 20 nt, Salmonella typhimurium LT2
uaccggcgcgcgccagcucg

SEQ ID NO: 1863115 - RNA, 18 nt, Salmonella typhimurium LT2
uaccggcgcucagccaga

SEQ ID NO: 1863116 - RNA, 17 nt, Salmonella typhimurium LT2
uaccggcgguaauuuac

SEQ ID NO: 1863117 - RNA, 18 nt, Salmonella typhimurium LT2
uaccggcaacgccgggaa

SEQ ID NO: 1863118 - RNA, 14 nt, Salmonella typhimurium LT2
uaccggcacaccgg

SEQ ID NO: 1863119 - RNA, 14 nt, Salmonella typhimurium LT2
uaccggcaccagca

SEQ ID NO: 1863120 - RNA, 17 nt, Salmonella typhimurium LT2
uaccggcaccagcaaug

SEQ ID NO: 1863121 - RNA, 19 nt, Salmonella typhimurium LT2
uaccgucagccacuucuuc

SEQ ID NO: 1863122 - RNA, 14 nt, Salmonella typhimurium LT2
uaccgucagcacca

SEQ ID NO: 1863123 - RNA, 20 nt, Salmonella typhimurium LT2
uaccgugugcagugacagag

SEQ ID NO: 1863124 - RNA, 17 nt, Salmonella typhimurium LT2
uaccgaacagccaggcu

SEQ ID NO: 1863125 - RNA, 22 nt, Salmonella typhimurium LT2
uaccggacgacuguagauaccu

SEQ ID NO: 1863126 - RNA, 17 nt, Salmonella typhimurium LT2
uaccgauagcgcggaau

SEQ ID NO: 1863127 - RNA, 19 nt, Salmonella typhimurium LT2
uaccgauaauuaagccggu

SEQ ID NO: 1863128 - RNA, 16 nt, Salmonella typhimurium LT2
uaccucuuauccggcu

SEQ ID NO: 1863129 - RNA, 16 nt, Salmonella typhimurium LT2
uaccugaagccauccu

SEQ ID NO: 1863130 - RNA, 19 nt, Salmonella typhimurium LT2
uaccucuuucgccgcuuua

SEQ ID NO: 1863131 - RNA, 14 nt, Salmonella typhimurium LT2
uaccugaaaccagg

SEQ ID NO: 1863132 - RNA, 22 nt, Salmonella typhimurium LT2
uaccugauccagcucuucuucg

SEQ ID NO: 1863133 - RNA, 19 nt, Salmonella typhimurium LT2
uaccugauccagcucuucu

SEQ ID NO: 1863134 - RNA, 19 nt, Salmonella typhimurium LT2
uaccugccugucuuuucuc

SEQ ID NO: 1863135 - RNA, 11 nt, Salmonella typhimurium LT2
uaccugccugu

SEQ ID NO: 1863136 - RNA, 13 nt, Salmonella typhimurium LT2
uaccuccucucuu

SEQ ID NO: 1863137 - RNA, 18 nt, Salmonella typhimurium LT2
uaccuccucucuuccucc

SEQ ID NO: 1863138 - RNA, 22 nt, Salmonella typhimurium LT2
uaccucagguaucauaugugcc

SEQ ID NO: 1863139 - RNA, 20 nt, Salmonella typhimurium LT2
uaccuauuuuaaauucccag

SEQ ID NO: 1863140 - RNA, 21 nt, Salmonella typhimurium LT2
uaccucaaaaaccaguugcca

SEQ ID NO: 1863141 - RNA, 15 nt, Salmonella typhimurium LT2
uaccucaaauauuga

SEQ ID NO: 1863142 - RNA, 22 nt, Salmonella typhimurium LT2
uaccguuucaacugccccuugu

SEQ ID NO: 1863143 - RNA, 18 nt, Salmonella typhimurium LT2
uaccaguacaacaauugu

SEQ ID NO: 1863144 - RNA, 18 nt, Salmonella typhimurium LT2
uaccaguacaauuucugg

SEQ ID NO: 1863145 - RNA, 14 nt, Salmonella typhimurium LT2
uaccaccacgccuu

SEQ ID NO: 1863146 - RNA, 14 nt, Salmonella typhimurium LT2
uaccaugauucaua

SEQ ID NO: 1863147 - RNA, 21 nt, Salmonella typhimurium LT2
uacccgcacgcuuucuucguu

SEQ ID NO: 1863148 - RNA, 14 nt, Salmonella typhimurium LT2
uacccgcacgcuuu

SEQ ID NO: 1863149 - RNA, 20 nt, Salmonella typhimurium LT2
uacccauuucuucuucaagc

SEQ ID NO: 1863150 - RNA, 20 nt, Salmonella typhimurium LT2
uacccggccuacacaucauc

SEQ ID NO: 1863151 - RNA, 15 nt, Salmonella typhimurium LT2
uacccgcguuuucuc

SEQ ID NO: 1863152 - RNA, 14 nt, Salmonella typhimurium LT2
uaccgaacaaugug

SEQ ID NO: 1863153 - RNA, 17 nt, Salmonella typhimurium LT2
uaccgaacaaugugcgg

SEQ ID NO: 1863154 - RNA, 21 nt, Salmonella typhimurium LT2
uacccagcgccaacgccacug

SEQ ID NO: 1863155 - RNA, 18 nt, Salmonella typhimurium LT2
uacccaguuuaccaaaca

SEQ ID NO: 1863156 - RNA, 20 nt, Salmonella typhimurium LT2
uacgccacgguaauuuacaa

SEQ ID NO: 1863157 - RNA, 14 nt, Salmonella typhimurium LT2
uacgccaagcugca

SEQ ID NO: 1863158 - RNA, 16 nt, Salmonella typhimurium LT2
uacgccagcagacagg

SEQ ID NO: 1863159 - RNA, 19 nt, Salmonella typhimurium LT2
uacgccagcagacagguga

SEQ ID NO: 1863160 - RNA, 15 nt, Salmonella typhimurium LT2
uacgccagccuaucg

SEQ ID NO: 1863161 - RNA, 22 nt, Salmonella typhimurium LT2
uacgcccagccgugaaugguca

SEQ ID NO: 1863162 - RNA, 12 nt, Salmonella typhimurium LT2
uacgcaaaucac

SEQ ID NO: 1863163 - RNA, 22 nt, Salmonella typhimurium LT2
uacgccaaaaaaggcagccagg

SEQ ID NO: 1863164 - RNA, 24 nt, Salmonella typhimurium LT2
uacgccuaaauuuaacucguccug

SEQ ID NO: 1863165 - RNA, 14 nt, Salmonella typhimurium LT2
uacgccucuuucag

SEQ ID NO: 1863166 - RNA, 20 nt, Salmonella typhimurium LT2
uacgccuugagcaaaacaca

SEQ ID NO: 1863167 - RNA, 18 nt, Salmonella typhimurium LT2
uacgcccgugacgccagg

SEQ ID NO: 1863168 - RNA, 20 nt, Salmonella typhimurium LT2
uacgcccaucaguccgcaaa

SEQ ID NO: 1863169 - RNA, 15 nt, Salmonella typhimurium LT2
uacgccgccgcccag

SEQ ID NO: 1863170 - RNA, 13 nt, Salmonella typhimurium LT2
uacgccgccgccc

SEQ ID NO: 1863171 - RNA, 20 nt, Salmonella typhimurium LT2
uacgccgccgcccagauguu

SEQ ID NO: 1863172 - RNA, 14 nt, Salmonella typhimurium LT2
uacgccggcaucau

SEQ ID NO: 1863173 - RNA, 21 nt, Salmonella typhimurium LT2
uacgagauuaacguuuguaga

SEQ ID NO: 1863174 - RNA, 18 nt, Salmonella typhimurium LT2
uacgagaaccaacugcca

SEQ ID NO: 1863175 - RNA, 16 nt, Salmonella typhimurium LT2
uacgaccgcagaaaca

SEQ ID NO: 1863176 - RNA, 16 nt, Salmonella typhimurium LT2
uacgacugcacccauc

SEQ ID NO: 1863177 - RNA, 20 nt, Salmonella typhimurium LT2
uacgacugcacccaucuuua

SEQ ID NO: 1863178 - RNA, 21 nt, Salmonella typhimurium LT2
uacgacucaauacauucagua

SEQ ID NO: 1863179 - RNA, 19 nt, Salmonella typhimurium LT2
uacgacacccgauacacgc

SEQ ID NO: 1863180 - RNA, 14 nt, Salmonella typhimurium LT2
uaccugguauuauu

SEQ ID NO: 1863181 - RNA, 16 nt, Salmonella typhimurium LT2
uacgggucugaauagc

SEQ ID NO: 1863182 - RNA, 18 nt, Salmonella typhimurium LT2
uacgcucauaaaaaagaa

SEQ ID NO: 1863183 - RNA, 20 nt, Salmonella typhimurium LT2
uacgcugaagauuuuuauuc

SEQ ID NO: 1863184 - RNA, 21 nt, Salmonella typhimurium LT2
uacgcucuugacguguuucau

SEQ ID NO: 1863185 - RNA, 14 nt, Salmonella typhimurium LT2
uacguaauaaaauu

SEQ ID NO: 1863186 - RNA, 23 nt, Salmonella typhimurium LT2
uacgugccgccguuuugucuaua

SEQ ID NO: 1863187 - RNA, 21 nt, Salmonella typhimurium LT2
uacguaacugcgguaaauaau

SEQ ID NO: 1863188 - RNA, 21 nt, Salmonella typhimurium LT2
uacuaaucucacccauagaua

SEQ ID NO: 1863189 - RNA, 14 nt, Salmonella typhimurium LT2
uacguugcggcgcg

SEQ ID NO: 1863190 - RNA, 23 nt, Salmonella typhimurium LT2
uacguuggagaggaauuguccac

SEQ ID NO: 1863191 - RNA, 16 nt, Salmonella typhimurium LT2
uacuaaauaggcggca

SEQ ID NO: 1863192 - RNA, 18 nt, Salmonella typhimurium LT2
uaauacggagcaaaaaac

SEQ ID NO: 1863193 - RNA, 19 nt, Salmonella typhimurium LT2
uaauacggagcaaaaaacg

SEQ ID NO: 1863194 - RNA, 22 nt, Salmonella typhimurium LT2
uaauacgcgaugagauaauaaa

SEQ ID NO: 1863195 - RNA, 17 nt, Salmonella typhimurium LT2
uaauacgacucaauaca

SEQ ID NO: 1863196 - RNA, 21 nt, Salmonella typhimurium LT2
uaauacccgaugagacaaaac

SEQ ID NO: 1863197 - RNA, 13 nt, Salmonella typhimurium LT2
uaauacugccgca

SEQ ID NO: 1863198 - RNA, 18 nt, Salmonella typhimurium LT2
uaauacacgcgacaaugc

SEQ ID NO: 1863199 - RNA, 16 nt, Salmonella typhimurium LT2
uaauacaggccagcau

SEQ ID NO: 1863200 - RNA, 12 nt, Salmonella typhimurium LT2
uaauacaggcca

SEQ ID NO: 1863201 - RNA, 17 nt, Salmonella typhimurium LT2
uaauaaugccaaaaugg

SEQ ID NO: 1863202 - RNA, 22 nt, Salmonella typhimurium LT2
uaauaauugagcgcaaaacgcu

SEQ ID NO: 1863203 - RNA, 21 nt, Salmonella typhimurium LT2
uaauaauugcgguggcgcaaa

SEQ ID NO: 1863204 - RNA, 13 nt, Salmonella typhimurium LT2
uaauaauuuaaaa

SEQ ID NO: 1863205 - RNA, 15 nt, Salmonella typhimurium LT2
uaauaauuuaaaauu

SEQ ID NO: 1863206 - RNA, 11 nt, Salmonella typhimurium LT2
uaauaauuuaa

SEQ ID NO: 1863207 - RNA, 13 nt, Salmonella typhimurium LT2
uaauaauaaauuu

SEQ ID NO: 1863208 - RNA, 13 nt, Salmonella typhimurium LT2
uaauaauauccuu

SEQ ID NO: 1863209 - RNA, 21 nt, Salmonella typhimurium LT2
uaauaacggcgacaggcacaa

SEQ ID NO: 1863210 - RNA, 13 nt, Salmonella typhimurium LT2
uaauaacacaaua

SEQ ID NO: 1863211 - RNA, 14 nt, Salmonella typhimurium LT2
uaauaaccagcccc

SEQ ID NO: 1863212 - RNA, 13 nt, Salmonella typhimurium LT2
uaauaaaauaacu

SEQ ID NO: 1863213 - RNA, 14 nt, Salmonella typhimurium LT2
uaauaaaauauuau

SEQ ID NO: 1863214 - RNA, 13 nt, Salmonella typhimurium LT2
uaauaaaaauacc

SEQ ID NO: 1863215 - RNA, 15 nt, Salmonella typhimurium LT2
uaauaaauuuucauu

SEQ ID NO: 1863216 - RNA, 19 nt, Salmonella typhimurium LT2
uaaguuuaugguaaucaca

SEQ ID NO: 1863217 - RNA, 16 nt, Salmonella typhimurium LT2
uaaguucaaacucauu

SEQ ID NO: 1863218 - RNA, 14 nt, Salmonella typhimurium LT2
uaaguugaccacac

SEQ ID NO: 1863219 - RNA, 21 nt, Salmonella typhimurium LT2
uaaguucgcaacaugaauuaa

SEQ ID NO: 1863220 - RNA, 21 nt, Salmonella typhimurium LT2
uaaguuacuaaaaguaaauaa

SEQ ID NO: 1863221 - RNA, 13 nt, Salmonella typhimurium LT2
uaagucaugagcu

SEQ ID NO: 1863222 - RNA, 17 nt, Salmonella typhimurium LT2
uaagguugccugccaga

SEQ ID NO: 1863223 - RNA, 21 nt, Salmonella typhimurium LT2
uaaggucgcuauccagcagua

SEQ ID NO: 1863224 - RNA, 15 nt, Salmonella typhimurium LT2
uaaguacggcaaaaa

SEQ ID NO: 1863225 - RNA, 21 nt, Salmonella typhimurium LT2
uaaguacggcaaaaauauuga

SEQ ID NO: 1863226 - RNA, 21 nt, Salmonella typhimurium LT2
uaaguacaagggccgccgcca

SEQ ID NO: 1863227 - RNA, 14 nt, Salmonella typhimurium LT2
uaaguaaguugauc

SEQ ID NO: 1863228 - RNA, 12 nt, Salmonella typhimurium LT2
uaaggcguucac

SEQ ID NO: 1863229 - RNA, 18 nt, Salmonella typhimurium LT2
uaaggcgauucaacagga

SEQ ID NO: 1863230 - RNA, 15 nt, Salmonella typhimurium LT2
uaaggcccuggcuca

SEQ ID NO: 1863231 - RNA, 22 nt, Salmonella typhimurium LT2
uaaggggcaggcgucaaaacag

SEQ ID NO: 1863232 - RNA, 19 nt, Salmonella typhimurium LT2
uaaggccugccguccugau

SEQ ID NO: 1863233 - RNA, 12 nt, Salmonella typhimurium LT2
uaaggcagccau

SEQ ID NO: 1863234 - RNA, 16 nt, Salmonella typhimurium LT2
uaaggcaaacaaggca

SEQ ID NO: 1863235 - RNA, 23 nt, Salmonella typhimurium LT2
uaaggaucggaagacuggcgcag

SEQ ID NO: 1863236 - RNA, 14 nt, Salmonella typhimurium LT2
uaaggaucggaaga

SEQ ID NO: 1863237 - RNA, 21 nt, Salmonella typhimurium LT2
uaaggacauucagcacgcuuu

SEQ ID NO: 1863238 - RNA, 12 nt, Salmonella typhimurium LT2
uaaucagcagcg

SEQ ID NO: 1863239 - RNA, 15 nt, Salmonella typhimurium LT2
uaaucagcaucaccu

SEQ ID NO: 1863240 - RNA, 18 nt, Salmonella typhimurium LT2
uaaucaggagggcugccc

SEQ ID NO: 1863241 - RNA, 19 nt, Salmonella typhimurium LT2
uaauccacauccaaccgcu

SEQ ID NO: 1863242 - RNA, 16 nt, Salmonella typhimurium LT2
uaauauuaagcagcuu

SEQ ID NO: 1863243 - RNA, 20 nt, Salmonella typhimurium LT2
uaauauuaagcagcuuaucg

SEQ ID NO: 1863244 - RNA, 13 nt, Salmonella typhimurium LT2
uaauauuaucagc

SEQ ID NO: 1863245 - RNA, 18 nt, Salmonella typhimurium LT2
uaauaugccagcucaaau

SEQ ID NO: 1863246 - RNA, 17 nt, Salmonella typhimurium LT2
uaauaugcgcaaucacc

SEQ ID NO: 1863247 - RNA, 19 nt, Salmonella typhimurium LT2
uaauccaggaauuuuccca

SEQ ID NO: 1863248 - RNA, 18 nt, Salmonella typhimurium LT2
uaauccaggaauuuuccc

SEQ ID NO: 1863249 - RNA, 21 nt, Salmonella typhimurium LT2
uaaucgcgauacugccgccca

SEQ ID NO: 1863250 - RNA, 17 nt, Salmonella typhimurium LT2
uaaucggcgucauuuua

SEQ ID NO: 1863251 - RNA, 15 nt, Salmonella typhimurium LT2
uaaucgcuucaauca

SEQ ID NO: 1863252 - RNA, 19 nt, Salmonella typhimurium LT2
uaaucggcguggggcaggc

SEQ ID NO: 1863253 - RNA, 16 nt, Salmonella typhimurium LT2
uaaucucacaaauauc

SEQ ID NO: 1863254 - RNA, 13 nt, Salmonella typhimurium LT2
uaaucuacaaacg

SEQ ID NO: 1863255 - RNA, 23 nt, Salmonella typhimurium LT2
uaaucguuagcgagguucccgcc

SEQ ID NO: 1863256 - RNA, 15 nt, Salmonella typhimurium LT2
uaaucguguaaucuu

SEQ ID NO: 1863257 - RNA, 17 nt, Salmonella typhimurium LT2
uaaucgucccacaugaa

SEQ ID NO: 1863258 - RNA, 19 nt, Salmonella typhimurium LT2
uaaucgucccacaugaacu

SEQ ID NO: 1863259 - RNA, 21 nt, Salmonella typhimurium LT2
uaaucgucccacaugaacucg

SEQ ID NO: 1863260 - RNA, 19 nt, Salmonella typhimurium LT2
uaaucugucgcuaaagcac

SEQ ID NO: 1863261 - RNA, 12 nt, Salmonella typhimurium LT2
uaaucugaaaga

SEQ ID NO: 1863262 - RNA, 11 nt, Salmonella typhimurium LT2
uaaugcuuuug

SEQ ID NO: 1863263 - RNA, 18 nt, Salmonella typhimurium LT2
uaauggcagaauaaaaca

SEQ ID NO: 1863264 - RNA, 17 nt, Salmonella typhimurium LT2
uaauguaaaaaaauaaa

SEQ ID NO: 1863265 - RNA, 18 nt, Salmonella typhimurium LT2
uaauguaaaaaaauaaaa

SEQ ID NO: 1863266 - RNA, 14 nt, Salmonella typhimurium LT2
uaaugucccugcca

SEQ ID NO: 1863267 - RNA, 16 nt, Salmonella typhimurium LT2
uaaugcuaucccaggc

SEQ ID NO: 1863268 - RNA, 14 nt, Salmonella typhimurium LT2
uaaugcucaacucu

SEQ ID NO: 1863269 - RNA, 15 nt, Salmonella typhimurium LT2
uaaugcuuuaaaugc

SEQ ID NO: 1863270 - RNA, 16 nt, Salmonella typhimurium LT2
uaaugcugcaccacac

SEQ ID NO: 1863271 - RNA, 15 nt, Salmonella typhimurium LT2
uaaugcugccagcau

SEQ ID NO: 1863272 - RNA, 20 nt, Salmonella typhimurium LT2
uaaucuugagucgggccugc

SEQ ID NO: 1863273 - RNA, 15 nt, Salmonella typhimurium LT2
uaaucuugcgauagc

SEQ ID NO: 1863274 - RNA, 17 nt, Salmonella typhimurium LT2
uaauguuaggaguaaau

SEQ ID NO: 1863275 - RNA, 16 nt, Salmonella typhimurium LT2
uaaugucuggugcagc

SEQ ID NO: 1863276 - RNA, 16 nt, Salmonella typhimurium LT2
uaauuaaauuuucgcu

SEQ ID NO: 1863277 - RNA, 16 nt, Salmonella typhimurium LT2
uaauuggcauccagca

SEQ ID NO: 1863278 - RNA, 21 nt, Salmonella typhimurium LT2
uaauugccauuacgauaaaug

SEQ ID NO: 1863279 - RNA, 23 nt, Salmonella typhimurium LT2
uaauugcccccuuuuuauucaua

SEQ ID NO: 1863280 - RNA, 15 nt, Salmonella typhimurium LT2
uaauuccgcaucauu

SEQ ID NO: 1863281 - RNA, 13 nt, Salmonella typhimurium LT2
uaauuagagacau

SEQ ID NO: 1863282 - RNA, 20 nt, Salmonella typhimurium LT2
ggcucaucaaacagcggcac

SEQ ID NO: 1863283 - RNA, 13 nt, Salmonella typhimurium LT2
ggcucauauuauc

SEQ ID NO: 1863284 - RNA, 23 nt, Salmonella typhimurium LT2
ggcucauuuuauccaacagcgca

SEQ ID NO: 1863285 - RNA, 14 nt, Salmonella typhimurium LT2
ggcuauccucaacu

SEQ ID NO: 1863286 - RNA, 18 nt, Salmonella typhimurium LT2
ggcucaauaugccaggca

SEQ ID NO: 1863287 - RNA, 18 nt, Salmonella typhimurium LT2
ggcucaauacccuuuucu

SEQ ID NO: 1863288 - RNA, 23 nt, Salmonella typhimurium LT2
ggcucagacaguagcggcgaggc

SEQ ID NO: 1863289 - RNA, 12 nt, Salmonella typhimurium LT2
ggcucaaauugg

SEQ ID NO: 1863290 - RNA, 15 nt, Salmonella typhimurium LT2
ggcuccuuuuuugua

SEQ ID NO: 1863291 - RNA, 17 nt, Salmonella typhimurium LT2
ggcucgcagaugcccgc

SEQ ID NO: 1863292 - RNA, 16 nt, Salmonella typhimurium LT2
ggcucccacucuucca

SEQ ID NO: 1863293 - RNA, 14 nt, Salmonella typhimurium LT2
ggcucccgcagcca

SEQ ID NO: 1863294 - RNA, 16 nt, Salmonella typhimurium LT2
ggcucccuuuacaggu

SEQ ID NO: 1863295 - RNA, 18 nt, Salmonella typhimurium LT2
ggcuccagcgccagcucc

SEQ ID NO: 1863296 - RNA, 21 nt, Salmonella typhimurium LT2
ggcuccauagggcagggugcc

SEQ ID NO: 1863297 - RNA, 13 nt, Salmonella typhimurium LT2
ggcucguuuuugu

SEQ ID NO: 1863298 - RNA, 19 nt, Salmonella typhimurium LT2
ggcucuaaauuagcucccg

SEQ ID NO: 1863299 - RNA, 22 nt, Salmonella typhimurium LT2
ggcucuuuuuuuauagcaaacu

SEQ ID NO: 1863300 - RNA, 11 nt, Salmonella typhimurium LT2
ggcugaagcgg

SEQ ID NO: 1863301 - RNA, 16 nt, Salmonella typhimurium LT2
ggcugaaccaggccgg

SEQ ID NO: 1863302 - RNA, 18 nt, Salmonella typhimurium LT2
ggcugaggccgcucgcca

SEQ ID NO: 1863303 - RNA, 21 nt, Salmonella typhimurium LT2
ggcugcaaagcaucugccggc

SEQ ID NO: 1863304 - RNA, 16 nt, Salmonella typhimurium LT2
ggcugauuauauaaca

SEQ ID NO: 1863305 - RNA, 21 nt, Salmonella typhimurium LT2
ggcugcacccggagagaaaca

SEQ ID NO: 1863306 - RNA, 22 nt, Salmonella typhimurium LT2
ggcugcguaaaaucagcauccu

SEQ ID NO: 1863307 - RNA, 15 nt, Salmonella typhimurium LT2
ggcugccagccagcg

SEQ ID NO: 1863308 - RNA, 18 nt, Salmonella typhimurium LT2
ggcugcgaugccaucaga

SEQ ID NO: 1863309 - RNA, 21 nt, Salmonella typhimurium LT2
ggcugccugccggauuuuuca

SEQ ID NO: 1863310 - RNA, 19 nt, Salmonella typhimurium LT2
ggcuggauaaccguacggc

SEQ ID NO: 1863311 - RNA, 17 nt, Salmonella typhimurium LT2
ggcuggaaagcucuuca

SEQ ID NO: 1863312 - RNA, 12 nt, Salmonella typhimurium LT2
ggcuggccacug

SEQ ID NO: 1863313 - RNA, 16 nt, Salmonella typhimurium LT2
ggcugguaagagagcc

SEQ ID NO: 1863314 - RNA, 21 nt, Salmonella typhimurium LT2
ggcugguaacaguccguggca

SEQ ID NO: 1863315 - RNA, 19 nt, Salmonella typhimurium LT2
ggcuuacgguuguuucagc

SEQ ID NO: 1863316 - RNA, 16 nt, Salmonella typhimurium LT2
ggcuuaauacagcaac

SEQ ID NO: 1863317 - RNA, 15 nt, Salmonella typhimurium LT2
ggcuucggucagauc

SEQ ID NO: 1863318 - RNA, 23 nt, Salmonella typhimurium LT2
ggcuucggcaauuuccggcgacg

SEQ ID NO: 1863319 - RNA, 13 nt, Salmonella typhimurium LT2
ggcuuuaaugcuu

SEQ ID NO: 1863320 - RNA, 22 nt, Salmonella typhimurium LT2
ggcuuuaguuuccgguaaauca

SEQ ID NO: 1863321 - RNA, 16 nt, Salmonella typhimurium LT2
gggcguauagccaggc

SEQ ID NO: 1863322 - RNA, 21 nt, Salmonella typhimurium LT2
gggcgucaaaaucccggcugg

SEQ ID NO: 1863323 - RNA, 12 nt, Salmonella typhimurium LT2
gggcguccugcc

SEQ ID NO: 1863324 - RNA, 19 nt, Salmonella typhimurium LT2
gggcguuucagcuuccagu

SEQ ID NO: 1863325 - RNA, 18 nt, Salmonella typhimurium LT2
ggggaagggugagaaccu

SEQ ID NO: 1863326 - RNA, 22 nt, Salmonella typhimurium LT2
ggggaacggcagacagccgcgg

SEQ ID NO: 1863327 - RNA, 23 nt, Salmonella typhimurium LT2
gggcuuuugagucgcauccagug

SEQ ID NO: 1863328 - RNA, 16 nt, Salmonella typhimurium LT2
gggccgcucagcaucg

SEQ ID NO: 1863329 - RNA, 22 nt, Salmonella typhimurium LT2
gggcgcaaaaucgcaaacgcca

SEQ ID NO: 1863330 - RNA, 23 nt, Salmonella typhimurium LT2
gggcgauaaaccagccccacggu

SEQ ID NO: 1863331 - RNA, 20 nt, Salmonella typhimurium LT2
gggcgauacuggcaguaaaa

SEQ ID NO: 1863332 - RNA, 13 nt, Salmonella typhimurium LT2
gggcgaugcgcga

SEQ ID NO: 1863333 - RNA, 15 nt, Salmonella typhimurium LT2
gggcgauaaaccagc

SEQ ID NO: 1863334 - RNA, 13 nt, Salmonella typhimurium LT2
gggcgauaaacca

SEQ ID NO: 1863335 - RNA, 19 nt, Salmonella typhimurium LT2
gggcgcgacaauaugacca

SEQ ID NO: 1863336 - RNA, 12 nt, Salmonella typhimurium LT2
gggaaagggggg

SEQ ID NO: 1863337 - RNA, 18 nt, Salmonella typhimurium LT2
gggaaacggauucucuaa

SEQ ID NO: 1863338 - RNA, 15 nt, Salmonella typhimurium LT2
gggaaacgagcgcgg

SEQ ID NO: 1863339 - RNA, 17 nt, Salmonella typhimurium LT2
gggaaaugagaaaagga

SEQ ID NO: 1863340 - RNA, 19 nt, Salmonella typhimurium LT2
gggaacacaaucacugcgg

SEQ ID NO: 1863341 - RNA, 21 nt, Salmonella typhimurium LT2
gggaguaugcggucaaaagcu

SEQ ID NO: 1863342 - RNA, 21 nt, Salmonella typhimurium LT2
gggaggcaggcaacaugacca

SEQ ID NO: 1863343 - RNA, 13 nt, Salmonella typhimurium LT2
gggauauaaaauu

SEQ ID NO: 1863344 - RNA, 23 nt, Salmonella typhimurium LT2
gggcccguggcccaggcccgggu

SEQ ID NO: 1863345 - RNA, 16 nt, Salmonella typhimurium LT2
gggccacucuccagca

SEQ ID NO: 1863346 - RNA, 16 nt, Salmonella typhimurium LT2
gggcauucccagaaag

SEQ ID NO: 1863347 - RNA, 12 nt, Salmonella typhimurium LT2
gggcaggcgugu

SEQ ID NO: 1863348 - RNA, 22 nt, Salmonella typhimurium LT2
gggcaguaaauuaaacagcugu

SEQ ID NO: 1863349 - RNA, 17 nt, Salmonella typhimurium LT2
gggcauaaaaaagccga

SEQ ID NO: 1863350 - RNA, 14 nt, Salmonella typhimurium LT2
ggguaugaauuuuu

SEQ ID NO: 1863351 - RNA, 23 nt, Salmonella typhimurium LT2
ggguaugcgcaaaucaaaaggca

SEQ ID NO: 1863352 - RNA, 14 nt, Salmonella typhimurium LT2
ggguauggcgccaa

SEQ ID NO: 1863353 - RNA, 18 nt, Salmonella typhimurium LT2
gggugcgccgcagcgccu

SEQ ID NO: 1863354 - RNA, 15 nt, Salmonella typhimurium LT2
gggugaaagggugcg

SEQ ID NO: 1863355 - RNA, 17 nt, Salmonella typhimurium LT2
ggguucaaguccccccc

SEQ ID NO: 1863356 - RNA, 11 nt, Salmonella typhimurium LT2
ggguucaucca

SEQ ID NO: 1863357 - RNA, 14 nt, Salmonella typhimurium LT2
gguaaaaauaucug

SEQ ID NO: 1863358 - RNA, 14 nt, Salmonella typhimurium LT2
gguaaauaccaggc

SEQ ID NO: 1863359 - RNA, 14 nt, Salmonella typhimurium LT2
gguaaauacgcugc

SEQ ID NO: 1863360 - RNA, 18 nt, Salmonella typhimurium LT2
gguaaauacgcugcggcc

SEQ ID NO: 1863361 - RNA, 23 nt, Salmonella typhimurium LT2
gguaaaucgcauuuuuaagcugg

SEQ ID NO: 1863362 - RNA, 17 nt, Salmonella typhimurium LT2
gguaaacacgacgcugc

SEQ ID NO: 1863363 - RNA, 15 nt, Salmonella typhimurium LT2
gguaaaccaggccag

SEQ ID NO: 1863364 - RNA, 14 nt, Salmonella typhimurium LT2
gguaagcaauaugg

SEQ ID NO: 1863365 - RNA, 13 nt, Salmonella typhimurium LT2
gguaagauguucu

SEQ ID NO: 1863366 - RNA, 21 nt, Salmonella typhimurium LT2
gguaacguuacuugauggaaa

SEQ ID NO: 1863367 - RNA, 23 nt, Salmonella typhimurium LT2
gguaagcccauggcaggcagcac

SEQ ID NO: 1863368 - RNA, 14 nt, Salmonella typhimurium LT2
gguaacgcgaaaaa

SEQ ID NO: 1863369 - RNA, 20 nt, Salmonella typhimurium LT2
gguagacccggcauugaaac

SEQ ID NO: 1863370 - RNA, 22 nt, Salmonella typhimurium LT2
gguagacgcgcuagcuucaggu

SEQ ID NO: 1863371 - RNA, 14 nt, Salmonella typhimurium LT2
gguagacgcgcuag

SEQ ID NO: 1863372 - RNA, 11 nt, Salmonella typhimurium LT2
gguagaaaaac

SEQ ID NO: 1863373 - RNA, 13 nt, Salmonella typhimurium LT2
gguacuuucucca

SEQ ID NO: 1863374 - RNA, 23 nt, Salmonella typhimurium LT2
gguacuugacgucgccauaucca

SEQ ID NO: 1863375 - RNA, 22 nt, Salmonella typhimurium LT2
gguacgacuuauucaaucaauu

SEQ ID NO: 1863376 - RNA, 13 nt, Salmonella typhimurium LT2
gguacgcuccagg

SEQ ID NO: 1863377 - RNA, 21 nt, Salmonella typhimurium LT2
gguacccggucccuggcuggu

SEQ ID NO: 1863378 - RNA, 15 nt, Salmonella typhimurium LT2
gguacagaugcugua

SEQ ID NO: 1863379 - RNA, 22 nt, Salmonella typhimurium LT2
gguaauacuaaucucacccaua

SEQ ID NO: 1863380 - RNA, 18 nt, Salmonella typhimurium LT2
gguaaguacggcaaaaau

SEQ ID NO: 1863381 - RNA, 19 nt, Salmonella typhimurium LT2
gguaaguacggcaaaaaua

SEQ ID NO: 1863382 - RNA, 17 nt, Salmonella typhimurium LT2
gguaauuaaaggcagcg

SEQ ID NO: 1863383 - RNA, 14 nt, Salmonella typhimurium LT2
gguagucacggaga

SEQ ID NO: 1863384 - RNA, 16 nt, Salmonella typhimurium LT2
gguauaaucagcauca

SEQ ID NO: 1863385 - RNA, 15 nt, Salmonella typhimurium LT2
gguauacaaaaaaga

SEQ ID NO: 1863386 - RNA, 18 nt, Salmonella typhimurium LT2
gguaucguugcggcgcag

SEQ ID NO: 1863387 - RNA, 21 nt, Salmonella typhimurium LT2
gguaggugauaagcaggaagg

SEQ ID NO: 1863388 - RNA, 18 nt, Salmonella typhimurium LT2
gguaggcggauaaggcgc

SEQ ID NO: 1863389 - RNA, 21 nt, Salmonella typhimurium LT2
ggucagcauuucauccauuaa

SEQ ID NO: 1863390 - RNA, 12 nt, Salmonella typhimurium LT2
gguaugaaacau

SEQ ID NO: 1863391 - RNA, 16 nt, Salmonella typhimurium LT2
gguaugaaacauauau

SEQ ID NO: 1863392 - RNA, 16 nt, Salmonella typhimurium LT2
gguaugaacgggaacc

SEQ ID NO: 1863393 - RNA, 22 nt, Salmonella typhimurium LT2
gguaugaauuuuuuccacccgc

SEQ ID NO: 1863394 - RNA, 23 nt, Salmonella typhimurium LT2
gguauuauccgccgcaaacucca

SEQ ID NO: 1863395 - RNA, 15 nt, Salmonella typhimurium LT2
gguauucaucggcac

SEQ ID NO: 1863396 - RNA, 22 nt, Salmonella typhimurium LT2
gguggucaucgcggccagcaug

SEQ ID NO: 1863397 - RNA, 11 nt, Salmonella typhimurium LT2
gguggugcucu

SEQ ID NO: 1863398 - RNA, 21 nt, Salmonella typhimurium LT2
gguggugcucuaaccaacuga

SEQ ID NO: 1863399 - RNA, 20 nt, Salmonella typhimurium LT2
gguggucaucgcggccagca

SEQ ID NO: 1863400 - RNA, 21 nt, Salmonella typhimurium LT2
gguggucacgccauuaucgaa

SEQ ID NO: 1863401 - RNA, 20 nt, Salmonella typhimurium LT2
gguggcgcaguuuacgcagc

SEQ ID NO: 1863402 - RNA, 18 nt, Salmonella typhimurium LT2
gguggcggaauugguaga

SEQ ID NO: 1863403 - RNA, 18 nt, Salmonella typhimurium LT2
gguggaucccccuggccc

SEQ ID NO: 1863404 - RNA, 21 nt, Salmonella typhimurium LT2
ggugcuccagcccgaaaggac

SEQ ID NO: 1863405 - RNA, 18 nt, Salmonella typhimurium LT2
ggugcguggcgcugggcc

SEQ ID NO: 1863406 - RNA, 14 nt, Salmonella typhimurium LT2
ggugauccuccugc

SEQ ID NO: 1863407 - RNA, 15 nt, Salmonella typhimurium LT2
ggugauccuccugca

SEQ ID NO: 1863408 - RNA, 18 nt, Salmonella typhimurium LT2
ggugcaagcaccuuaucc

SEQ ID NO: 1863409 - RNA, 23 nt, Salmonella typhimurium LT2
ggugaucuggccaauuuuucaca

SEQ ID NO: 1863410 - RNA, 17 nt, Salmonella typhimurium LT2
ggugccgaaaucaucaa

SEQ ID NO: 1863411 - RNA, 15 nt, Salmonella typhimurium LT2
ggugcgcagccccag

SEQ ID NO: 1863412 - RNA, 16 nt, Salmonella typhimurium LT2
ggugcgccccagcaug

SEQ ID NO: 1863413 - RNA, 12 nt, Salmonella typhimurium LT2
ggucgccagcau

SEQ ID NO: 1863414 - RNA, 15 nt, Salmonella typhimurium LT2
ggucgauaaauagcu

SEQ ID NO: 1863415 - RNA, 14 nt, Salmonella typhimurium LT2
ggucagcggcgcgc

SEQ ID NO: 1863416 - RNA, 18 nt, Salmonella typhimurium LT2
ggucagcguaccagcggu

SEQ ID NO: 1863417 - RNA, 13 nt, Salmonella typhimurium LT2
ggucaggccagcc

SEQ ID NO: 1863418 - RNA, 20 nt, Salmonella typhimurium LT2
ggucagcuuuucagcccagg

SEQ ID NO: 1863419 - RNA, 13 nt, Salmonella typhimurium LT2
ggucaggcuaaau

SEQ ID NO: 1863420 - RNA, 17 nt, Salmonella typhimurium LT2
ggucgaccaccugcugu

SEQ ID NO: 1863421 - RNA, 23 nt, Salmonella typhimurium LT2
ggucaguacgcgcguauccgccg

SEQ ID NO: 1863422 - RNA, 21 nt, Salmonella typhimurium LT2
ggucgacaugcgcaugugagu

SEQ ID NO: 1863423 - RNA, 22 nt, Salmonella typhimurium LT2
ggugaagcauccgggauauaaa

SEQ ID NO: 1863424 - RNA, 21 nt, Salmonella typhimurium LT2
ggugacgauacggcccagacc

SEQ ID NO: 1863425 - RNA, 14 nt, Salmonella typhimurium LT2
ggugauagcccguu

SEQ ID NO: 1863426 - RNA, 13 nt, Salmonella typhimurium LT2
ggugauagcgcgc

SEQ ID NO: 1863427 - RNA, 22 nt, Salmonella typhimurium LT2
ggugauauuuuagccaucccgg

SEQ ID NO: 1863428 - RNA, 17 nt, Salmonella typhimurium LT2
ggugacggaaaccagca

SEQ ID NO: 1863429 - RNA, 16 nt, Salmonella typhimurium LT2
ggugacggaaaccagc

SEQ ID NO: 1863430 - RNA, 20 nt, Salmonella typhimurium LT2
ggucuguaugacaacauaaa

SEQ ID NO: 1863431 - RNA, 20 nt, Salmonella typhimurium LT2
ggucuucuuucagguuccac

SEQ ID NO: 1863432 - RNA, 13 nt, Salmonella typhimurium LT2
ggucgucagccgu

SEQ ID NO: 1863433 - RNA, 21 nt, Salmonella typhimurium LT2
ggucguacuaaagagcgccug

SEQ ID NO: 1863434 - RNA, 16 nt, Salmonella typhimurium LT2
guaagcccuuacaaaa

SEQ ID NO: 1863435 - RNA, 23 nt, Salmonella typhimurium LT2
guaagcccauggcaggcagcaca

SEQ ID NO: 1863436 - RNA, 15 nt, Salmonella typhimurium LT2
guaagccuggcauaa

SEQ ID NO: 1863437 - RNA, 18 nt, Salmonella typhimurium LT2
guaagcggcggaccagcg

SEQ ID NO: 1863438 - RNA, 23 nt, Salmonella typhimurium LT2
guaagcggguauacuuaacccug

SEQ ID NO: 1863439 - RNA, 22 nt, Salmonella typhimurium LT2
guaagcgcccguccaugaguag

SEQ ID NO: 1863440 - RNA, 17 nt, Salmonella typhimurium LT2
guaagcgcccguccaug

SEQ ID NO: 1863441 - RNA, 15 nt, Salmonella typhimurium LT2
guaagcgcagcgcca

SEQ ID NO: 1863442 - RNA, 13 nt, Salmonella typhimurium LT2
guaagguccaggg

SEQ ID NO: 1863443 - RNA, 16 nt, Salmonella typhimurium LT2
guaagguccagggaau

SEQ ID NO: 1863444 - RNA, 18 nt, Salmonella typhimurium LT2
guaaggugaaauacccgc

SEQ ID NO: 1863445 - RNA, 21 nt, Salmonella typhimurium LT2
guaagggaggugcucucccag

SEQ ID NO: 1863446 - RNA, 22 nt, Salmonella typhimurium LT2
guaagggaggugcucucccagc

SEQ ID NO: 1863447 - RNA, 22 nt, Salmonella typhimurium LT2
guaagcuggaaccugaguuccc

SEQ ID NO: 1863448 - RNA, 15 nt, Salmonella typhimurium LT2
guaaggcgugccgcc

SEQ ID NO: 1863449 - RNA, 15 nt, Salmonella typhimurium LT2
guaauauuaaaacca

SEQ ID NO: 1863450 - RNA, 22 nt, Salmonella typhimurium LT2
guaauaugugcgccacgcagcg

SEQ ID NO: 1863451 - RNA, 15 nt, Salmonella typhimurium LT2
guaauaacugacaga

SEQ ID NO: 1863452 - RNA, 16 nt, Salmonella typhimurium LT2
guaauaacugacagac

SEQ ID NO: 1863453 - RNA, 21 nt, Salmonella typhimurium LT2
guaauaucgcggguuuuauca

SEQ ID NO: 1863454 - RNA, 19 nt, Salmonella typhimurium LT2
guaauaaagaaggguuuug

SEQ ID NO: 1863455 - RNA, 17 nt, Salmonella typhimurium LT2
guaaguacggcaaaaau

SEQ ID NO: 1863456 - RNA, 19 nt, Salmonella typhimurium LT2
guaaguuuaugguaaucac

SEQ ID NO: 1863457 - RNA, 14 nt, Salmonella typhimurium LT2
guaagcacaacgca

SEQ ID NO: 1863458 - RNA, 16 nt, Salmonella typhimurium LT2
guaagagcuggucgga

SEQ ID NO: 1863459 - RNA, 15 nt, Salmonella typhimurium LT2
guaacuucagcauca

SEQ ID NO: 1863460 - RNA, 17 nt, Salmonella typhimurium LT2
guaacuucagcaucauc

SEQ ID NO: 1863461 - RNA, 22 nt, Salmonella typhimurium LT2
guaagaauuauuaccaaugagc

SEQ ID NO: 1863462 - RNA, 17 nt, Salmonella typhimurium LT2
guaagaauaacaaucug

SEQ ID NO: 1863463 - RNA, 21 nt, Salmonella typhimurium LT2
guaacugcaccuuuuuuucca

SEQ ID NO: 1863464 - RNA, 23 nt, Salmonella typhimurium LT2
guaacugcaccuuuuuuuccagc

SEQ ID NO: 1863465 - RNA, 18 nt, Salmonella typhimurium LT2
guaacugcgguaaauaau

SEQ ID NO: 1863466 - RNA, 18 nt, Salmonella typhimurium LT2
guaacucuauaucgacag

SEQ ID NO: 1863467 - RNA, 13 nt, Salmonella typhimurium LT2
guaacuuauccac

SEQ ID NO: 1863468 - RNA, 15 nt, Salmonella typhimurium LT2
guaacucaucgccag

SEQ ID NO: 1863469 - RNA, 17 nt, Salmonella typhimurium LT2
guaacgggugaucuuua

SEQ ID NO: 1863470 - RNA, 21 nt, Salmonella typhimurium LT2
guaacgggugaucuuuauaaa

SEQ ID NO: 1863471 - RNA, 16 nt, Salmonella typhimurium LT2
guaacggaugaaagcc

SEQ ID NO: 1863472 - RNA, 17 nt, Salmonella typhimurium LT2
guaacguaaauacccag

SEQ ID NO: 1863473 - RNA, 15 nt, Salmonella typhimurium LT2
guaaccuauuuuaaa

SEQ ID NO: 1863474 - RNA, 16 nt, Salmonella typhimurium LT2
guaaccuauuuuaaaa

SEQ ID NO: 1863475 - RNA, 17 nt, Salmonella typhimurium LT2
guaaccccugcccgcga

SEQ ID NO: 1863476 - RNA, 17 nt, Salmonella typhimurium LT2
guaacccgauacccuga

SEQ ID NO: 1863477 - RNA, 23 nt, Salmonella typhimurium LT2
guaaccaccacugauuccagagc

SEQ ID NO: 1863478 - RNA, 15 nt, Salmonella typhimurium LT2
guaaaggcgaccggg

SEQ ID NO: 1863479 - RNA, 16 nt, Salmonella typhimurium LT2
guaaaguuauucacgu

SEQ ID NO: 1863480 - RNA, 18 nt, Salmonella typhimurium LT2
guaaauagagaaaucaac

SEQ ID NO: 1863481 - RNA, 13 nt, Salmonella typhimurium LT2
guaaauacccagg

SEQ ID NO: 1863482 - RNA, 15 nt, Salmonella typhimurium LT2
guaaauauugauuaa

SEQ ID NO: 1863483 - RNA, 22 nt, Salmonella typhimurium LT2
guaaaucauuuguacaaaaaau

SEQ ID NO: 1863484 - RNA, 19 nt, Salmonella typhimurium LT2
guaaaucauuuguacaaaa

SEQ ID NO: 1863485 - RNA, 17 nt, Salmonella typhimurium LT2
guaaaucagaauaccgc

SEQ ID NO: 1863486 - RNA, 17 nt, Salmonella typhimurium LT2
guaaaucaaccugcuga

SEQ ID NO: 1863487 - RNA, 15 nt, Salmonella typhimurium LT2
guaaaucaauuuuaa

SEQ ID NO: 1863488 - RNA, 22 nt, Salmonella typhimurium LT2
guaaauuuguuuaaucauaaaa

SEQ ID NO: 1863489 - RNA, 22 nt, Salmonella typhimurium LT2
guaacaccuguaacgucacauu

SEQ ID NO: 1863490 - RNA, 14 nt, Salmonella typhimurium LT2
guaacacaaaaucc

SEQ ID NO: 1863491 - RNA, 21 nt, Salmonella typhimurium LT2
guaacacaaaaucccuggcaa

SEQ ID NO: 1863492 - RNA, 20 nt, Salmonella typhimurium LT2
guaacaggaacgagccgaua

SEQ ID NO: 1863493 - RNA, 13 nt, Salmonella typhimurium LT2
guaacagcaggac

SEQ ID NO: 1863494 - RNA, 22 nt, Salmonella typhimurium LT2
guaacagacgcaucuuuuuccc

SEQ ID NO: 1863495 - RNA, 17 nt, Salmonella typhimurium LT2
guaaauuccuuguuuua

SEQ ID NO: 1863496 - RNA, 19 nt, Salmonella typhimurium LT2
guaaaucugaaauaaaagc

SEQ ID NO: 1863497 - RNA, 14 nt, Salmonella typhimurium LT2
guaaauuauuuaca

SEQ ID NO: 1863498 - RNA, 16 nt, Salmonella typhimurium LT2
guaaaccccuucacca

SEQ ID NO: 1863499 - RNA, 15 nt, Salmonella typhimurium LT2
guaaacgcgaccagc

SEQ ID NO: 1863500 - RNA, 15 nt, Salmonella typhimurium LT2
guaaacgcuuuuuca

SEQ ID NO: 1863501 - RNA, 16 nt, Salmonella typhimurium LT2
guaaaccauuucuccu

SEQ ID NO: 1863502 - RNA, 19 nt, Salmonella typhimurium LT2
guaaaccauuucuccugca

SEQ ID NO: 1863503 - RNA, 14 nt, Salmonella typhimurium LT2
guaaaccaggccag

SEQ ID NO: 1863504 - RNA, 15 nt, Salmonella typhimurium LT2
guaaacagacaauua

SEQ ID NO: 1863505 - RNA, 15 nt, Salmonella typhimurium LT2
guaaacaggcaggcc

SEQ ID NO: 1863506 - RNA, 18 nt, Salmonella typhimurium LT2
guaaagcagugcaguauu

SEQ ID NO: 1863507 - RNA, 14 nt, Salmonella typhimurium LT2
guaaagcauggcug

SEQ ID NO: 1863508 - RNA, 14 nt, Salmonella typhimurium LT2
guaaagcagugcag

SEQ ID NO: 1863509 - RNA, 16 nt, Salmonella typhimurium LT2
guaaagauuuuuauua

SEQ ID NO: 1863510 - RNA, 23 nt, Salmonella typhimurium LT2
guaaagauuaauaauugagcgca

SEQ ID NO: 1863511 - RNA, 16 nt, Salmonella typhimurium LT2
guaaagaagccgccgc

SEQ ID NO: 1863512 - RNA, 17 nt, Salmonella typhimurium LT2
guaaagauuagaauagc

SEQ ID NO: 1863513 - RNA, 23 nt, Salmonella typhimurium LT2
guaaacggugcgauuaucccagu

SEQ ID NO: 1863514 - RNA, 15 nt, Salmonella typhimurium LT2
guaaacggaaccaaa

SEQ ID NO: 1863515 - RNA, 19 nt, Salmonella typhimurium LT2
guaaacggcgcugaaaggc

SEQ ID NO: 1863516 - RNA, 21 nt, Salmonella typhimurium LT2
gguuaaacacauccggcggcg

SEQ ID NO: 1863517 - RNA, 18 nt, Salmonella typhimurium LT2
gguguuuacgccgccauc

SEQ ID NO: 1863518 - RNA, 20 nt, Salmonella typhimurium LT2
ggugugccgcuugccaguac

SEQ ID NO: 1863519 - RNA, 21 nt, Salmonella typhimurium LT2
gguuaacauaugggcaaaaac

SEQ ID NO: 1863520 - RNA, 19 nt, Salmonella typhimurium LT2
gguuaacccgguuuauccc

SEQ ID NO: 1863521 - RNA, 23 nt, Salmonella typhimurium LT2
gguuaacccgguuuauccccgcu

SEQ ID NO: 1863522 - RNA, 18 nt, Salmonella typhimurium LT2
gguuaacgucagauuuuc

SEQ ID NO: 1863523 - RNA, 15 nt, Salmonella typhimurium LT2
guaaaaguauguauu

SEQ ID NO: 1863524 - RNA, 12 nt, Salmonella typhimurium LT2
gguuaacucuuu

SEQ ID NO: 1863525 - RNA, 15 nt, Salmonella typhimurium LT2
gguuaacgucagauu

SEQ ID NO: 1863526 - RNA, 22 nt, Salmonella typhimurium LT2
guaaaauucacuacuaaauccu

SEQ ID NO: 1863527 - RNA, 14 nt, Salmonella typhimurium LT2
guaaaauugccgcc

SEQ ID NO: 1863528 - RNA, 16 nt, Salmonella typhimurium LT2
guaaaauggacuuccg

SEQ ID NO: 1863529 - RNA, 15 nt, Salmonella typhimurium LT2
guaaaaucagcagcg

SEQ ID NO: 1863530 - RNA, 13 nt, Salmonella typhimurium LT2
guaaucgccguau

SEQ ID NO: 1863531 - RNA, 15 nt, Salmonella typhimurium LT2
guaauggcauaacgc

SEQ ID NO: 1863532 - RNA, 17 nt, Salmonella typhimurium LT2
guaauggccaccagcac

SEQ ID NO: 1863533 - RNA, 17 nt, Salmonella typhimurium LT2
guaauggccuacacacu

SEQ ID NO: 1863534 - RNA, 22 nt, Salmonella typhimurium LT2
guaaugcucgcccagaauuucc

SEQ ID NO: 1863535 - RNA, 17 nt, Salmonella typhimurium LT2
guaaucucccacccgcg

SEQ ID NO: 1863536 - RNA, 20 nt, Salmonella typhimurium LT2
guacauguccagaucuucac

SEQ ID NO: 1863537 - RNA, 17 nt, Salmonella typhimurium LT2
guaaugguauugcgaua

SEQ ID NO: 1863538 - RNA, 12 nt, Salmonella typhimurium LT2
guaauggucagc

SEQ ID NO: 1863539 - RNA, 15 nt, Salmonella typhimurium LT2
guaccaauacccagc

SEQ ID NO: 1863540 - RNA, 23 nt, Salmonella typhimurium LT2
guaccauaccggugcgccccagc

SEQ ID NO: 1863541 - RNA, 17 nt, Salmonella typhimurium LT2
guaccauugagcucucu

SEQ ID NO: 1863542 - RNA, 16 nt, Salmonella typhimurium LT2
guaccauugcccauuc

SEQ ID NO: 1863543 - RNA, 18 nt, Salmonella typhimurium LT2
guaccgaacagccaggcu

SEQ ID NO: 1863544 - RNA, 16 nt, Salmonella typhimurium LT2
guacccuguauuuuuu

SEQ ID NO: 1863545 - RNA, 15 nt, Salmonella typhimurium LT2
guaccggauuuagcg

SEQ ID NO: 1863546 - RNA, 13 nt, Salmonella typhimurium LT2
guaccgggcagac

SEQ ID NO: 1863547 - RNA, 18 nt, Salmonella typhimurium LT2
guaccgcuugggccaccu

SEQ ID NO: 1863548 - RNA, 18 nt, Salmonella typhimurium LT2
guacuccgccauccggca

SEQ ID NO: 1863549 - RNA, 15 nt, Salmonella typhimurium LT2
guagacgaccaggga

SEQ ID NO: 1863550 - RNA, 20 nt, Salmonella typhimurium LT2
guaccuaccguaauacuucc

SEQ ID NO: 1863551 - RNA, 15 nt, Salmonella typhimurium LT2
guacgcuccagggcu

SEQ ID NO: 1863552 - RNA, 21 nt, Salmonella typhimurium LT2
guaggccugauaagcgcagcg

SEQ ID NO: 1863553 - RNA, 14 nt, Salmonella typhimurium LT2
guaggccuaaaaau

SEQ ID NO: 1863554 - RNA, 13 nt, Salmonella typhimurium LT2
guagcgcgcgcua

SEQ ID NO: 1863555 - RNA, 21 nt, Salmonella typhimurium LT2
guagcgucucaucaaaaaggc

SEQ ID NO: 1863556 - RNA, 16 nt, Salmonella typhimurium LT2
guagcguucaucaaua

SEQ ID NO: 1863557 - RNA, 14 nt, Salmonella typhimurium LT2
guagcucagcugga

SEQ ID NO: 1863558 - RNA, 12 nt, Salmonella typhimurium LT2
guagaucaccag

SEQ ID NO: 1863559 - RNA, 19 nt, Salmonella typhimurium LT2
guagaguaacccuucagcu

SEQ ID NO: 1863560 - RNA, 18 nt, Salmonella typhimurium LT2
guagugaggcugguugug

SEQ ID NO: 1863561 - RNA, 19 nt, Salmonella typhimurium LT2
guagugcuucucuucaaac

SEQ ID NO: 1863562 - RNA, 15 nt, Salmonella typhimurium LT2
guaguaauauuaaaa

SEQ ID NO: 1863563 - RNA, 14 nt, Salmonella typhimurium LT2
guaguacaggguuu

SEQ ID NO: 1863564 - RNA, 13 nt, Salmonella typhimurium LT2
guaguaaauagga

SEQ ID NO: 1863565 - RNA, 19 nt, Salmonella typhimurium LT2
guagguuccgacaauaaaa

SEQ ID NO: 1863566 - RNA, 15 nt, Salmonella typhimurium LT2
guaguguaauaccac

SEQ ID NO: 1863567 - RNA, 20 nt, Salmonella typhimurium LT2
guaguguuuaagcgucaggc

SEQ ID NO: 1863568 - RNA, 15 nt, Salmonella typhimurium LT2
guaguuaaaaaaggu

SEQ ID NO: 1863569 - RNA, 23 nt, Salmonella typhimurium LT2
guauaaaucacgcugaaaaccgc

SEQ ID NO: 1863570 - RNA, 18 nt, Salmonella typhimurium LT2
guauaaauuuccgcagcc

SEQ ID NO: 1863571 - RNA, 18 nt, Salmonella typhimurium LT2
guauaaauaaaauuguua

SEQ ID NO: 1863572 - RNA, 14 nt, Salmonella typhimurium LT2
guauaaucagcauc

SEQ ID NO: 1863573 - RNA, 19 nt, Salmonella typhimurium LT2
guauaacuggucauccccg

SEQ ID NO: 1863574 - RNA, 17 nt, Salmonella typhimurium LT2
gucgccccaaucgccag

SEQ ID NO: 1863575 - RNA, 11 nt, Salmonella typhimurium LT2
gucgccgccgu

SEQ ID NO: 1863576 - RNA, 15 nt, Salmonella typhimurium LT2
gucgccauccaccag

SEQ ID NO: 1863577 - RNA, 12 nt, Salmonella typhimurium LT2
gucgccaggcaa

SEQ ID NO: 1863578 - RNA, 13 nt, Salmonella typhimurium LT2
gucgcauccggcu

SEQ ID NO: 1863579 - RNA, 20 nt, Salmonella typhimurium LT2
gucgcauccggcuacgggcg

SEQ ID NO: 1863580 - RNA, 22 nt, Salmonella typhimurium LT2
gucgccgcgcccagcagcagaa

SEQ ID NO: 1863581 - RNA, 18 nt, Salmonella typhimurium LT2
gucgccggggcgcuggcg

SEQ ID NO: 1863582 - RNA, 20 nt, Salmonella typhimurium LT2
gucgccgucuggggaaaccu

SEQ ID NO: 1863583 - RNA, 14 nt, Salmonella typhimurium LT2
gucgcggcuuucag

SEQ ID NO: 1863584 - RNA, 15 nt, Salmonella typhimurium LT2
gucgcggcuuucagc

SEQ ID NO: 1863585 - RNA, 16 nt, Salmonella typhimurium LT2
gucgcgcgccgccugc

SEQ ID NO: 1863586 - RNA, 16 nt, Salmonella typhimurium LT2
gucgccugcugcugga

SEQ ID NO: 1863587 - RNA, 19 nt, Salmonella typhimurium LT2
guccuuacggacguggggg

SEQ ID NO: 1863588 - RNA, 18 nt, Salmonella typhimurium LT2
guccugguguguaaauuu

SEQ ID NO: 1863589 - RNA, 17 nt, Salmonella typhimurium LT2
guccuugcgaagaccgc

SEQ ID NO: 1863590 - RNA, 20 nt, Salmonella typhimurium LT2
gucgcagcggcggucugcgc

SEQ ID NO: 1863591 - RNA, 16 nt, Salmonella typhimurium LT2
gucgauuuugccuuca

SEQ ID NO: 1863592 - RNA, 17 nt, Salmonella typhimurium LT2
gucgauuuccggcggca

SEQ ID NO: 1863593 - RNA, 19 nt, Salmonella typhimurium LT2
gucauugggagcaaagcuc

SEQ ID NO: 1863594 - RNA, 14 nt, Salmonella typhimurium LT2
guccauauucaguu

SEQ ID NO: 1863595 - RNA, 13 nt, Salmonella typhimurium LT2
gucauuuuuucaa

SEQ ID NO: 1863596 - RNA, 21 nt, Salmonella typhimurium LT2
guccaucaggcuuugcgccau

SEQ ID NO: 1863597 - RNA, 19 nt, Salmonella typhimurium LT2
guccccagcguaccacgcc

SEQ ID NO: 1863598 - RNA, 18 nt, Salmonella typhimurium LT2
guccccauaccccgcgcc

SEQ ID NO: 1863599 - RNA, 15 nt, Salmonella typhimurium LT2
guccccugcaggaau

SEQ ID NO: 1863600 - RNA, 23 nt, Salmonella typhimurium LT2
gucccaucguaacgccgucgaca

SEQ ID NO: 1863601 - RNA, 12 nt, Salmonella typhimurium LT2
gucccaggccag

SEQ ID NO: 1863602 - RNA, 16 nt, Salmonella typhimurium LT2
gucccaggccagaugc

SEQ ID NO: 1863603 - RNA, 20 nt, Salmonella typhimurium LT2
gucccagcacaaucccggca

SEQ ID NO: 1863604 - RNA, 22 nt, Salmonella typhimurium LT2
guccaugcaugacgcaggcgca

SEQ ID NO: 1863605 - RNA, 20 nt, Salmonella typhimurium LT2
guccgcaaagacaacgacca

SEQ ID NO: 1863606 - RNA, 20 nt, Salmonella typhimurium LT2
guccguuaccccuuuuucaa

SEQ ID NO: 1863607 - RNA, 19 nt, Salmonella typhimurium LT2
guccggcgaauuucaucag

SEQ ID NO: 1863608 - RNA, 20 nt, Salmonella typhimurium LT2
guccggcauccaaccgaaca

SEQ ID NO: 1863609 - RNA, 15 nt, Salmonella typhimurium LT2
guccggaagacagcu

SEQ ID NO: 1863610 - RNA, 14 nt, Salmonella typhimurium LT2
guccugauccggcu

SEQ ID NO: 1863611 - RNA, 20 nt, Salmonella typhimurium LT2
guccugcgcgacgcccacca

SEQ ID NO: 1863612 - RNA, 22 nt, Salmonella typhimurium LT2
guccuggaaagaaggcuugguu

SEQ ID NO: 1863613 - RNA, 13 nt, Salmonella typhimurium LT2
guccucuggcccg

SEQ ID NO: 1863614 - RNA, 14 nt, Salmonella typhimurium LT2
guccugaauuucac

SEQ ID NO: 1863615 - RNA, 22 nt, Salmonella typhimurium LT2
guccucuauuuuuuuauauucg

SEQ ID NO: 1863616 - RNA, 18 nt, Salmonella typhimurium LT2
guccuaggacgaaaaaug

SEQ ID NO: 1863617 - RNA, 21 nt, Salmonella typhimurium LT2
guccuaggacgaaaaaugaau

SEQ ID NO: 1863618 - RNA, 20 nt, Salmonella typhimurium LT2
guccguuuucaacgccgcgc

SEQ ID NO: 1863619 - RNA, 18 nt, Salmonella typhimurium LT2
guccguuuucgcccccag

SEQ ID NO: 1863620 - RNA, 11 nt, Salmonella typhimurium LT2
gucaaaaauaa

SEQ ID NO: 1863621 - RNA, 13 nt, Salmonella typhimurium LT2
gucaaaaaaggac

SEQ ID NO: 1863622 - RNA, 20 nt, Salmonella typhimurium LT2
gucaaaaccaaacagcgaca

SEQ ID NO: 1863623 - RNA, 14 nt, Salmonella typhimurium LT2
gucaaaacgcccau

SEQ ID NO: 1863624 - RNA, 20 nt, Salmonella typhimurium LT2
guauaucuuucuuaucccac

SEQ ID NO: 1863625 - RNA, 19 nt, Salmonella typhimurium LT2
guauaauuucaggcugcuc

SEQ ID NO: 1863626 - RNA, 23 nt, Salmonella typhimurium LT2
gucaaugacuuuuuugccaauau

SEQ ID NO: 1863627 - RNA, 17 nt, Salmonella typhimurium LT2
gucaaugccgggcagac

SEQ ID NO: 1863628 - RNA, 17 nt, Salmonella typhimurium LT2
gucaagaucgcgcagca

SEQ ID NO: 1863629 - RNA, 17 nt, Salmonella typhimurium LT2
gucaacacgcagaccca

SEQ ID NO: 1863630 - RNA, 22 nt, Salmonella typhimurium LT2
gucaacgaggugaauaaauccu

SEQ ID NO: 1863631 - RNA, 21 nt, Salmonella typhimurium LT2
gucaacguccaguucguucug

SEQ ID NO: 1863632 - RNA, 15 nt, Salmonella typhimurium LT2
gucaacgugaaaaau

SEQ ID NO: 1863633 - RNA, 17 nt, Salmonella typhimurium LT2
gucaacugcucuaccaa

SEQ ID NO: 1863634 - RNA, 19 nt, Salmonella typhimurium LT2
gucagaucguaugcgccug

SEQ ID NO: 1863635 - RNA, 21 nt, Salmonella typhimurium LT2
gucagauuauggcuacaccuu

SEQ ID NO: 1863636 - RNA, 18 nt, Salmonella typhimurium LT2
gucagacaccagcccugg

SEQ ID NO: 1863637 - RNA, 23 nt, Salmonella typhimurium LT2
gucacuucaaccuuuaucuguug

SEQ ID NO: 1863638 - RNA, 13 nt, Salmonella typhimurium LT2
gucacuggcggcg

SEQ ID NO: 1863639 - RNA, 18 nt, Salmonella typhimurium LT2
gucacuccggcugcacca

SEQ ID NO: 1863640 - RNA, 21 nt, Salmonella typhimurium LT2
gucacucacauucauugccgc

SEQ ID NO: 1863641 - RNA, 18 nt, Salmonella typhimurium LT2
gucacgcgcaaagcugcg

SEQ ID NO: 1863642 - RNA, 14 nt, Salmonella typhimurium LT2
gucacggaucuucu

SEQ ID NO: 1863643 - RNA, 17 nt, Salmonella typhimurium LT2
gucacccgcguaucauu

SEQ ID NO: 1863644 - RNA, 18 nt, Salmonella typhimurium LT2
gucacaaagcccaccgcg

SEQ ID NO: 1863645 - RNA, 12 nt, Salmonella typhimurium LT2
gucacaacagcc

SEQ ID NO: 1863646 - RNA, 19 nt, Salmonella typhimurium LT2
gucaggccgccgcacaggc

SEQ ID NO: 1863647 - RNA, 20 nt, Salmonella typhimurium LT2
gucaggccgccgcacaggcg

SEQ ID NO: 1863648 - RNA, 15 nt, Salmonella typhimurium LT2
gucaggcagaaauaa

SEQ ID NO: 1863649 - RNA, 11 nt, Salmonella typhimurium LT2
gucaggcagca

SEQ ID NO: 1863650 - RNA, 20 nt, Salmonella typhimurium LT2
gucaggccauuaauauuuua

SEQ ID NO: 1863651 - RNA, 13 nt, Salmonella typhimurium LT2
gucagcuuccugu

SEQ ID NO: 1863652 - RNA, 14 nt, Salmonella typhimurium LT2
gucaggaaacuggc

SEQ ID NO: 1863653 - RNA, 13 nt, Salmonella typhimurium LT2
gucaggcaaaaau

SEQ ID NO: 1863654 - RNA, 15 nt, Salmonella typhimurium LT2
gucaggcaaaaauaa

SEQ ID NO: 1863655 - RNA, 21 nt, Salmonella typhimurium LT2
gucagcgggguucggaccaga

SEQ ID NO: 1863656 - RNA, 16 nt, Salmonella typhimurium LT2
gucagcgcggcuucca

SEQ ID NO: 1863657 - RNA, 16 nt, Salmonella typhimurium LT2
gucagcggagaguuga

SEQ ID NO: 1863658 - RNA, 13 nt, Salmonella typhimurium LT2
gucagcaagauua

SEQ ID NO: 1863659 - RNA, 15 nt, Salmonella typhimurium LT2
gucagcaauuaacaa

SEQ ID NO: 1863660 - RNA, 15 nt, Salmonella typhimurium LT2
gucagcagaaacugg

SEQ ID NO: 1863661 - RNA, 15 nt, Salmonella typhimurium LT2
gucagcaguuuuauc

SEQ ID NO: 1863662 - RNA, 11 nt, Salmonella typhimurium LT2
gucagcaggcg

SEQ ID NO: 1863663 - RNA, 16 nt, Salmonella typhimurium LT2
gucagcauuucaucca

SEQ ID NO: 1863664 - RNA, 22 nt, Salmonella typhimurium LT2
gucaugaaaagcuauauuuaua

SEQ ID NO: 1863665 - RNA, 14 nt, Salmonella typhimurium LT2
gucaucugccaguu

SEQ ID NO: 1863666 - RNA, 19 nt, Salmonella typhimurium LT2
gucauagucggcgccaaag

SEQ ID NO: 1863667 - RNA, 13 nt, Salmonella typhimurium LT2
gucauaccaugau

SEQ ID NO: 1863668 - RNA, 16 nt, Salmonella typhimurium LT2
gucauaaguguuuuaa

SEQ ID NO: 1863669 - RNA, 14 nt, Salmonella typhimurium LT2
gucaguucgccacg

SEQ ID NO: 1863670 - RNA, 17 nt, Salmonella typhimurium LT2
gucaugacgcuggaagu

SEQ ID NO: 1863671 - RNA, 18 nt, Salmonella typhimurium LT2
gucaugagcuauuucagu

SEQ ID NO: 1863672 - RNA, 21 nt, Salmonella typhimurium LT2
gucaucucuauuucacuggcg

SEQ ID NO: 1863673 - RNA, 14 nt, Salmonella typhimurium LT2
gucauuaaaaccgc

SEQ ID NO: 1863674 - RNA, 19 nt, Salmonella typhimurium LT2
gucauuacgguauuuauca

SEQ ID NO: 1863675 - RNA, 14 nt, Salmonella typhimurium LT2
gucaguuccauaau

SEQ ID NO: 1863676 - RNA, 12 nt, Salmonella typhimurium LT2
gucaguuccaua

SEQ ID NO: 1863677 - RNA, 14 nt, Salmonella typhimurium LT2
gucaguggaaaaca

SEQ ID NO: 1863678 - RNA, 17 nt, Salmonella typhimurium LT2
gucagugcuacaggcgg

SEQ ID NO: 1863679 - RNA, 17 nt, Salmonella typhimurium LT2
gucagucccgcacuuuc

SEQ ID NO: 1863680 - RNA, 17 nt, Salmonella typhimurium LT2
gucaguagcguucucuc

SEQ ID NO: 1863681 - RNA, 13 nt, Salmonella typhimurium LT2
gucagucacauac

SEQ ID NO: 1863682 - RNA, 15 nt, Salmonella typhimurium LT2
gucagguaagcccuu

SEQ ID NO: 1863683 - RNA, 18 nt, Salmonella typhimurium LT2
gucaggguuuucaggaag

SEQ ID NO: 1863684 - RNA, 21 nt, Salmonella typhimurium LT2
gucaggguuuucaggaaggag

SEQ ID NO: 1863685 - RNA, 20 nt, Salmonella typhimurium LT2
gucaggugggaccaccgcgc

SEQ ID NO: 1863686 - RNA, 22 nt, Salmonella typhimurium LT2
ggcggauuccaguagcgcgccc

SEQ ID NO: 1863687 - RNA, 19 nt, Salmonella typhimurium LT2
ggcggcaagggagugaguc

SEQ ID NO: 1863688 - RNA, 13 nt, Salmonella typhimurium LT2
ggcggcaaauaaa

SEQ ID NO: 1863689 - RNA, 12 nt, Salmonella typhimurium LT2
ggcggcaaaaaa

SEQ ID NO: 1863690 - RNA, 21 nt, Salmonella typhimurium LT2
ggcggauacagcggcgcgcca

SEQ ID NO: 1863691 - RNA, 18 nt, Salmonella typhimurium LT2
ggcggcccacucauccag

SEQ ID NO: 1863692 - RNA, 18 nt, Salmonella typhimurium LT2
ggcggcccauucgcccaa

SEQ ID NO: 1863693 - RNA, 22 nt, Salmonella typhimurium LT2
ggcggcaguggacuaugcucca

SEQ ID NO: 1863694 - RNA, 14 nt, Salmonella typhimurium LT2
ggcggcacgcaggc

SEQ ID NO: 1863695 - RNA, 21 nt, Salmonella typhimurium LT2
ggcggcgauacuccgacggcg

SEQ ID NO: 1863696 - RNA, 23 nt, Salmonella typhimurium LT2
ggcggcgcgaccauaaugaccca

SEQ ID NO: 1863697 - RNA, 14 nt, Salmonella typhimurium LT2
ggcggcgcgcugcc

SEQ ID NO: 1863698 - RNA, 16 nt, Salmonella typhimurium LT2
ggcgcguccagccagc

SEQ ID NO: 1863699 - RNA, 20 nt, Salmonella typhimurium LT2
ggcgcgggcgagauguuuua

SEQ ID NO: 1863700 - RNA, 18 nt, Salmonella typhimurium LT2
ggcgcgcuaucaagauaa

SEQ ID NO: 1863701 - RNA, 15 nt, Salmonella typhimurium LT2
ggcgcgcguggcuuc

SEQ ID NO: 1863702 - RNA, 21 nt, Salmonella typhimurium LT2
ggcgcggaaagccuucaucau

SEQ ID NO: 1863703 - RNA, 11 nt, Salmonella typhimurium LT2
ggcgcgcuggc

SEQ ID NO: 1863704 - RNA, 14 nt, Salmonella typhimurium LT2
ggcggaaaauagcg

SEQ ID NO: 1863705 - RNA, 18 nt, Salmonella typhimurium LT2
ggcggaaaugcggguccu

SEQ ID NO: 1863706 - RNA, 22 nt, Salmonella typhimurium LT2
ggcggaaccauuuuccccagaa

SEQ ID NO: 1863707 - RNA, 15 nt, Salmonella typhimurium LT2
ggcgcuucggcgcca

SEQ ID NO: 1863708 - RNA, 17 nt, Salmonella typhimurium LT2
ggcgcugucgccacgca

SEQ ID NO: 1863709 - RNA, 23 nt, Salmonella typhimurium LT2
ggcgcuuuacaugccgcucuccg

SEQ ID NO: 1863710 - RNA, 20 nt, Salmonella typhimurium LT2
ggcgcugcuggcagcgcuga

SEQ ID NO: 1863711 - RNA, 23 nt, Salmonella typhimurium LT2
ggcgcugcgcuuaccgggccuac

SEQ ID NO: 1863712 - RNA, 23 nt, Salmonella typhimurium LT2
ggcgcugccgucaaugccgggca

SEQ ID NO: 1863713 - RNA, 15 nt, Salmonella typhimurium LT2
ggcgcugcgcgcauc

SEQ ID NO: 1863714 - RNA, 19 nt, Salmonella typhimurium LT2
ggcgcugcgccaucaggca

SEQ ID NO: 1863715 - RNA, 14 nt, Salmonella typhimurium LT2
ggcgcuauucccag

SEQ ID NO: 1863716 - RNA, 22 nt, Salmonella typhimurium LT2
ggcgcuaucgccuccagacugg

SEQ ID NO: 1863717 - RNA, 21 nt, Salmonella typhimurium LT2
ggcgcugaacgcauacaggcu

SEQ ID NO: 1863718 - RNA, 14 nt, Salmonella typhimurium LT2
ggcgguaugaaagc

SEQ ID NO: 1863719 - RNA, 22 nt, Salmonella typhimurium LT2
ggcggucagcuuuucagcccag

SEQ ID NO: 1863720 - RNA, 20 nt, Salmonella typhimurium LT2
ggcgguaaauacgcggcacg

SEQ ID NO: 1863721 - RNA, 16 nt, Salmonella typhimurium LT2
ggcggggcggaaccug

SEQ ID NO: 1863722 - RNA, 17 nt, Salmonella typhimurium LT2
ggcggggucaaaaaagg

SEQ ID NO: 1863723 - RNA, 14 nt, Salmonella typhimurium LT2
ggcggcuuggcugu

SEQ ID NO: 1863724 - RNA, 22 nt, Salmonella typhimurium LT2
ggcgucauagccgcgcgucagc

SEQ ID NO: 1863725 - RNA, 17 nt, Salmonella typhimurium LT2
ggcgucagcauggugug

SEQ ID NO: 1863726 - RNA, 17 nt, Salmonella typhimurium LT2
ggcguagccgccgagcg

SEQ ID NO: 1863727 - RNA, 18 nt, Salmonella typhimurium LT2
ggcguauuccauacagaa

SEQ ID NO: 1863728 - RNA, 19 nt, Salmonella typhimurium LT2
ggcguagucagcgacgcga

SEQ ID NO: 1863729 - RNA, 21 nt, Salmonella typhimurium LT2
ggcguaaaagcgauaaagaca

SEQ ID NO: 1863730 - RNA, 22 nt, Salmonella typhimurium LT2
ggcgguuuuuuuauccauuuca

SEQ ID NO: 1863731 - RNA, 18 nt, Salmonella typhimurium LT2
ggcgguuauccgccagcg

SEQ ID NO: 1863732 - RNA, 22 nt, Salmonella typhimurium LT2
ggcggugaggggggauugacuc

SEQ ID NO: 1863733 - RNA, 17 nt, Salmonella typhimurium LT2
ggcguguugaaguccuc

SEQ ID NO: 1863734 - RNA, 19 nt, Salmonella typhimurium LT2
ggcguguugaaguccucua

SEQ ID NO: 1863735 - RNA, 17 nt, Salmonella typhimurium LT2
ggcgugucgccggggcg

SEQ ID NO: 1863736 - RNA, 21 nt, Salmonella typhimurium LT2
ggcguguuguaaaacgcgccc

SEQ ID NO: 1863737 - RNA, 12 nt, Salmonella typhimurium LT2
ggcguguaacug

SEQ ID NO: 1863738 - RNA, 16 nt, Salmonella typhimurium LT2
ggcgucuuaaugcucu

SEQ ID NO: 1863739 - RNA, 14 nt, Salmonella typhimurium LT2
ggcgucgccugugc

SEQ ID NO: 1863740 - RNA, 18 nt, Salmonella typhimurium LT2
ggcguuaucuugacauga

SEQ ID NO: 1863741 - RNA, 13 nt, Salmonella typhimurium LT2
ggcguucaacacc

SEQ ID NO: 1863742 - RNA, 21 nt, Salmonella typhimurium LT2
ggcguuccgcacauaaucacc

SEQ ID NO: 1863743 - RNA, 13 nt, Salmonella typhimurium LT2
ggcguuccgcaca

SEQ ID NO: 1863744 - RNA, 19 nt, Salmonella typhimurium LT2
ggcguucugcgccauuucc

SEQ ID NO: 1863745 - RNA, 21 nt, Salmonella typhimurium LT2
ggcguuucagcuuccaguuau

SEQ ID NO: 1863746 - RNA, 16 nt, Salmonella typhimurium LT2
ggcguuuugcgcgcca

SEQ ID NO: 1863747 - RNA, 16 nt, Salmonella typhimurium LT2
ggcguuuuccagcgcg

SEQ ID NO: 1863748 - RNA, 12 nt, Salmonella typhimurium LT2
ggcuacccauga

SEQ ID NO: 1863749 - RNA, 21 nt, Salmonella typhimurium LT2
ggcuacguacacagucaaaca

SEQ ID NO: 1863750 - RNA, 14 nt, Salmonella typhimurium LT2
ggcuacggcucccu

SEQ ID NO: 1863751 - RNA, 13 nt, Salmonella typhimurium LT2
ggcuacccagaca

SEQ ID NO: 1863752 - RNA, 18 nt, Salmonella typhimurium LT2
ggcuaacgcgccuccggc

SEQ ID NO: 1863753 - RNA, 18 nt, Salmonella typhimurium LT2
ggcuaaguugaccacacc

SEQ ID NO: 1863754 - RNA, 15 nt, Salmonella typhimurium LT2
ggcuaucuucuuccg

SEQ ID NO: 1863755 - RNA, 18 nt, Salmonella typhimurium LT2
ggcuaugcucccccccuu

SEQ ID NO: 1863756 - RNA, 21 nt, Salmonella typhimurium LT2
ggcuauguagcgcugaagccc

SEQ ID NO: 1863757 - RNA, 23 nt, Salmonella typhimurium LT2
ggcuauaaccgucgcccguccgc

SEQ ID NO: 1863758 - RNA, 15 nt, Salmonella typhimurium LT2
ggcgaacaggcucag

SEQ ID NO: 1863759 - RNA, 14 nt, Salmonella typhimurium LT2
ggcgaacaggcuca

SEQ ID NO: 1863760 - RNA, 14 nt, Salmonella typhimurium LT2
ggcgaacagcccca

SEQ ID NO: 1863761 - RNA, 16 nt, Salmonella typhimurium LT2
ggcgaacucggucagg

SEQ ID NO: 1863762 - RNA, 17 nt, Salmonella typhimurium LT2
ggcgaacgcuggcuggg

SEQ ID NO: 1863763 - RNA, 20 nt, Salmonella typhimurium LT2
ggcgaacgcuuucugcgucc

SEQ ID NO: 1863764 - RNA, 18 nt, Salmonella typhimurium LT2
ggcgaacuucauccacgc

SEQ ID NO: 1863765 - RNA, 17 nt, Salmonella typhimurium LT2
ggcgaaaagcuggcuga

SEQ ID NO: 1863766 - RNA, 14 nt, Salmonella typhimurium LT2
ggcgaaagaaaauu

SEQ ID NO: 1863767 - RNA, 13 nt, Salmonella typhimurium LT2
ggcgaaagaaaau

SEQ ID NO: 1863768 - RNA, 12 nt, Salmonella typhimurium LT2
ggcgaaauagac

SEQ ID NO: 1863769 - RNA, 23 nt, Salmonella typhimurium LT2
ggcgaaaacgacguagcucgccc

SEQ ID NO: 1863770 - RNA, 12 nt, Salmonella typhimurium LT2
ggcgaaaaacca

SEQ ID NO: 1863771 - RNA, 19 nt, Salmonella typhimurium LT2
ggcgaccaguuuagcuaaa

SEQ ID NO: 1863772 - RNA, 13 nt, Salmonella typhimurium LT2
ggcgacagccgcg

SEQ ID NO: 1863773 - RNA, 14 nt, Salmonella typhimurium LT2
ggcgacagccgcgu

SEQ ID NO: 1863774 - RNA, 20 nt, Salmonella typhimurium LT2
ggcgacagggauauuccaua

SEQ ID NO: 1863775 - RNA, 17 nt, Salmonella typhimurium LT2
ggcgaagcucagccagg

SEQ ID NO: 1863776 - RNA, 16 nt, Salmonella typhimurium LT2
ggcgaauccuaaacuc

SEQ ID NO: 1863777 - RNA, 15 nt, Salmonella typhimurium LT2
ggcgaauagucgccg

SEQ ID NO: 1863778 - RNA, 21 nt, Salmonella typhimurium LT2
ggcgaauauagcuaaugcaau

SEQ ID NO: 1863779 - RNA, 18 nt, Salmonella typhimurium LT2
ggcgaauaaauucuucau

SEQ ID NO: 1863780 - RNA, 22 nt, Salmonella typhimurium LT2
ggcgacgguacaaaccccaccc

SEQ ID NO: 1863781 - RNA, 18 nt, Salmonella typhimurium LT2
ggcgacggcggucgccgc

SEQ ID NO: 1863782 - RNA, 19 nt, Salmonella typhimurium LT2
ggcgacgcgauagcgcagc

SEQ ID NO: 1863783 - RNA, 16 nt, Salmonella typhimurium LT2
ggcgacgcuuucaccu

SEQ ID NO: 1863784 - RNA, 16 nt, Salmonella typhimurium LT2
ggcgagcgaugcugcu

SEQ ID NO: 1863785 - RNA, 17 nt, Salmonella typhimurium LT2
ggcgacuaucgccgccc

SEQ ID NO: 1863786 - RNA, 21 nt, Salmonella typhimurium LT2
ggcgacucauuacgccacguu

SEQ ID NO: 1863787 - RNA, 18 nt, Salmonella typhimurium LT2
ggcgacuggaacaggcca

SEQ ID NO: 1863788 - RNA, 22 nt, Salmonella typhimurium LT2
ggcgagagaauuaacagcgcga

SEQ ID NO: 1863789 - RNA, 19 nt, Salmonella typhimurium LT2
ggccugauaagcacaggcc

SEQ ID NO: 1863790 - RNA, 18 nt, Salmonella typhimurium LT2
ggccugauaagcgcagcg

SEQ ID NO: 1863791 - RNA, 12 nt, Salmonella typhimurium LT2
ggccugcuccgu

SEQ ID NO: 1863792 - RNA, 18 nt, Salmonella typhimurium LT2
ggccugcuuaaacagaau

SEQ ID NO: 1863793 - RNA, 19 nt, Salmonella typhimurium LT2
ggccugcuuaaacagaauu

SEQ ID NO: 1863794 - RNA, 13 nt, Salmonella typhimurium LT2
ggccugcugcaga

SEQ ID NO: 1863795 - RNA, 21 nt, Salmonella typhimurium LT2
ggccugcugcagacugccggc

SEQ ID NO: 1863796 - RNA, 23 nt, Salmonella typhimurium LT2
ggccuguuuuuuauuuuuucgca

SEQ ID NO: 1863797 - RNA, 15 nt, Salmonella typhimurium LT2
ggccuucaaucagca

SEQ ID NO: 1863798 - RNA, 17 nt, Salmonella typhimurium LT2
ggccuggcugagaaaaa

SEQ ID NO: 1863799 - RNA, 16 nt, Salmonella typhimurium LT2
ggccuguaccgcuucc

SEQ ID NO: 1863800 - RNA, 23 nt, Salmonella typhimurium LT2
ggccugugccugacagcaaugag

SEQ ID NO: 1863801 - RNA, 22 nt, Salmonella typhimurium LT2
ggccugugacguuaacgcagca

SEQ ID NO: 1863802 - RNA, 16 nt, Salmonella typhimurium LT2
ggccugucuccgcagc

SEQ ID NO: 1863803 - RNA, 19 nt, Salmonella typhimurium LT2
ggccuacucuugagccaga

SEQ ID NO: 1863804 - RNA, 15 nt, Salmonella typhimurium LT2
ggccguuuucccggc

SEQ ID NO: 1863805 - RNA, 13 nt, Salmonella typhimurium LT2
ggccuaaaaauag

SEQ ID NO: 1863806 - RNA, 23 nt, Salmonella typhimurium LT2
ggccguuggcuuuaugcacgccg

SEQ ID NO: 1863807 - RNA, 13 nt, Salmonella typhimurium LT2
ggccuacaagccg

SEQ ID NO: 1863808 - RNA, 18 nt, Salmonella typhimurium LT2
ggccucuuuuuagcagca

SEQ ID NO: 1863809 - RNA, 13 nt, Salmonella typhimurium LT2
ggccucuccucga

SEQ ID NO: 1863810 - RNA, 17 nt, Salmonella typhimurium LT2
ggccucuaucuucucag

SEQ ID NO: 1863811 - RNA, 14 nt, Salmonella typhimurium LT2
ggccucauccgcau

SEQ ID NO: 1863812 - RNA, 18 nt, Salmonella typhimurium LT2
ggccuccugacgaagggc

SEQ ID NO: 1863813 - RNA, 18 nt, Salmonella typhimurium LT2
ggccuccgcguaucucag

SEQ ID NO: 1863814 - RNA, 21 nt, Salmonella typhimurium LT2
ggccucgcgcucaagcgaaaa

SEQ ID NO: 1863815 - RNA, 15 nt, Salmonella typhimurium LT2
ggcgccucgcgcggc

SEQ ID NO: 1863816 - RNA, 15 nt, Salmonella typhimurium LT2
ggcgccugcggcagg

SEQ ID NO: 1863817 - RNA, 17 nt, Salmonella typhimurium LT2
ggcgccugcggcaggca

SEQ ID NO: 1863818 - RNA, 13 nt, Salmonella typhimurium LT2
ggcgcgaaagcgc

SEQ ID NO: 1863819 - RNA, 18 nt, Salmonella typhimurium LT2
ggcgcgaaaacagcuggc

SEQ ID NO: 1863820 - RNA, 17 nt, Salmonella typhimurium LT2
ggcgccuuucgcgcugc

SEQ ID NO: 1863821 - RNA, 19 nt, Salmonella typhimurium LT2
ggcgcgaauacucgcgcug

SEQ ID NO: 1863822 - RNA, 22 nt, Salmonella typhimurium LT2
ggcgcacaguacgcggccgccg

SEQ ID NO: 1863823 - RNA, 20 nt, Salmonella typhimurium LT2
ggcgcaacguuugccagcgu

SEQ ID NO: 1863824 - RNA, 16 nt, Salmonella typhimurium LT2
ggcgcagcgcccagca

SEQ ID NO: 1863825 - RNA, 21 nt, Salmonella typhimurium LT2
ggcgcacgcgucaucggcgcg

SEQ ID NO: 1863826 - RNA, 20 nt, Salmonella typhimurium LT2
ggcgcaggcauuaaaaaaac

SEQ ID NO: 1863827 - RNA, 17 nt, Salmonella typhimurium LT2
ggcgcaguucgccacca

SEQ ID NO: 1863828 - RNA, 15 nt, Salmonella typhimurium LT2
ggcgcaucggucucc

SEQ ID NO: 1863829 - RNA, 16 nt, Salmonella typhimurium LT2
ggcgccaaucaccgcc

SEQ ID NO: 1863830 - RNA, 21 nt, Salmonella typhimurium LT2
ggcgcauuuucggcagcgcga

SEQ ID NO: 1863831 - RNA, 13 nt, Salmonella typhimurium LT2
ggcgcaugcugcc

SEQ ID NO: 1863832 - RNA, 14 nt, Salmonella typhimurium LT2
ggcgauagccccag

SEQ ID NO: 1863833 - RNA, 17 nt, Salmonella typhimurium LT2
ggcgauagccccaguaa

SEQ ID NO: 1863834 - RNA, 17 nt, Salmonella typhimurium LT2
ggcgauagcgccccaaa

SEQ ID NO: 1863835 - RNA, 13 nt, Salmonella typhimurium LT2
ggcgaucagcagg

SEQ ID NO: 1863836 - RNA, 16 nt, Salmonella typhimurium LT2
ggcgaucagacgcugg

SEQ ID NO: 1863837 - RNA, 13 nt, Salmonella typhimurium LT2
ggcgauaccagua

SEQ ID NO: 1863838 - RNA, 20 nt, Salmonella typhimurium LT2
ggcgauguaacgccuuugcc

SEQ ID NO: 1863839 - RNA, 19 nt, Salmonella typhimurium LT2
ggcgauucaucgacaaaua

SEQ ID NO: 1863840 - RNA, 19 nt, Salmonella typhimurium LT2
ggcgcaaacaguacgcccg

SEQ ID NO: 1863841 - RNA, 14 nt, Salmonella typhimurium LT2
ggcgcaaaaaauau

SEQ ID NO: 1863842 - RNA, 20 nt, Salmonella typhimurium LT2
ggcgaugauaguguccacuu

SEQ ID NO: 1863843 - RNA, 21 nt, Salmonella typhimurium LT2
ggccggauaaggcgcuagccg

SEQ ID NO: 1863844 - RNA, 18 nt, Salmonella typhimurium LT2
ggccggauaagcgcagcg

SEQ ID NO: 1863845 - RNA, 19 nt, Salmonella typhimurium LT2
ggccggcaccagccaggaa

SEQ ID NO: 1863846 - RNA, 22 nt, Salmonella typhimurium LT2
ggccgcucgccauaucuucuac

SEQ ID NO: 1863847 - RNA, 16 nt, Salmonella typhimurium LT2
ggccgcucuauuugca

SEQ ID NO: 1863848 - RNA, 21 nt, Salmonella typhimurium LT2
ggccgcuuugcgaacagcgca

SEQ ID NO: 1863849 - RNA, 20 nt, Salmonella typhimurium LT2
ggccgcgugcucgcggcgga

SEQ ID NO: 1863850 - RNA, 15 nt, Salmonella typhimurium LT2
ggccgcgcugcgccu

SEQ ID NO: 1863851 - RNA, 14 nt, Salmonella typhimurium LT2
ggccgucggcgcca

SEQ ID NO: 1863852 - RNA, 19 nt, Salmonella typhimurium LT2
ggccgucaaaccggcgguc

SEQ ID NO: 1863853 - RNA, 17 nt, Salmonella typhimurium LT2
ggccggcuucuccacca

SEQ ID NO: 1863854 - RNA, 16 nt, Salmonella typhimurium LT2
ggccggguccgcccgg

SEQ ID NO: 1863855 - RNA, 14 nt, Salmonella typhimurium LT2
ggccgagaggcuga

SEQ ID NO: 1863856 - RNA, 21 nt, Salmonella typhimurium LT2
ggccgcaguuuuccagcgccu

SEQ ID NO: 1863857 - RNA, 22 nt, Salmonella typhimurium LT2
ggccgcaguuuuccagcgccuc

SEQ ID NO: 1863858 - RNA, 12 nt, Salmonella typhimurium LT2
ggccgccagcgc

SEQ ID NO: 1863859 - RNA, 20 nt, Salmonella typhimurium LT2
ggcccgauaagcgccgcgcc

SEQ ID NO: 1863860 - RNA, 18 nt, Salmonella typhimurium LT2
ggcccgguaagcgcagcg

SEQ ID NO: 1863861 - RNA, 21 nt, Salmonella typhimurium LT2
ggcccgguggcgccgcgccac

SEQ ID NO: 1863862 - RNA, 15 nt, Salmonella typhimurium LT2
ggcccguugccuggc

SEQ ID NO: 1863863 - RNA, 21 nt, Salmonella typhimurium LT2
ggcccguagggugaggaguga

SEQ ID NO: 1863864 - RNA, 15 nt, Salmonella typhimurium LT2
ggcccgucagagcga

SEQ ID NO: 1863865 - RNA, 14 nt, Salmonella typhimurium LT2
ggccgaaaccgcuc

SEQ ID NO: 1863866 - RNA, 19 nt, Salmonella typhimurium LT2
ggccgaaaccgcucacggu

SEQ ID NO: 1863867 - RNA, 22 nt, Salmonella typhimurium LT2
ggccaaugccgccuuuaucgac

SEQ ID NO: 1863868 - RNA, 20 nt, Salmonella typhimurium LT2
ggccaauguacguaaaacca

SEQ ID NO: 1863869 - RNA, 18 nt, Salmonella typhimurium LT2
ggccacagcgccagacac

SEQ ID NO: 1863870 - RNA, 23 nt, Salmonella typhimurium LT2
ggccacaucguuacccaucaccu

SEQ ID NO: 1863871 - RNA, 14 nt, Salmonella typhimurium LT2
ggccacagcgccag

SEQ ID NO: 1863872 - RNA, 19 nt, Salmonella typhimurium LT2
ggccagaaccugcucggcu

SEQ ID NO: 1863873 - RNA, 17 nt, Salmonella typhimurium LT2
ggccacucuccagcauc

SEQ ID NO: 1863874 - RNA, 16 nt, Salmonella typhimurium LT2
ggccagcgcaggcugg

SEQ ID NO: 1863875 - RNA, 23 nt, Salmonella typhimurium LT2
ggccagcgacucgguaaccaucc

SEQ ID NO: 1863876 - RNA, 18 nt, Salmonella typhimurium LT2
ggccaucucaauaaucuc

SEQ ID NO: 1863877 - RNA, 21 nt, Salmonella typhimurium LT2
ggccaucgacgaaauggugug

SEQ ID NO: 1863878 - RNA, 17 nt, Salmonella typhimurium LT2
ggccaguagcgggggcc

SEQ ID NO: 1863879 - RNA, 15 nt, Salmonella typhimurium LT2
ggccaguauuggccu

SEQ ID NO: 1863880 - RNA, 22 nt, Salmonella typhimurium LT2
ggccaguauuggccucggggcg

SEQ ID NO: 1863881 - RNA, 20 nt, Salmonella typhimurium LT2
ggcccaaucaacgcauuaua

SEQ ID NO: 1863882 - RNA, 18 nt, Salmonella typhimurium LT2
ggccaucugaucgcugag

SEQ ID NO: 1863883 - RNA, 17 nt, Salmonella typhimurium LT2
ggccagcguaccugcgg

SEQ ID NO: 1863884 - RNA, 20 nt, Salmonella typhimurium LT2
ggccagcguggaugaacuca

SEQ ID NO: 1863885 - RNA, 21 nt, Salmonella typhimurium LT2
ggccaacauagcggcaaggaa

SEQ ID NO: 1863886 - RNA, 22 nt, Salmonella typhimurium LT2
ggccaacauagcggcaaggaaa

SEQ ID NO: 1863887 - RNA, 20 nt, Salmonella typhimurium LT2
ggccaaaacccaccagcagg

SEQ ID NO: 1863888 - RNA, 20 nt, Salmonella typhimurium LT2
ggccaaacccugcgccacaa

SEQ ID NO: 1863889 - RNA, 19 nt, Salmonella typhimurium LT2
ggcauuucacuuaauacuc

SEQ ID NO: 1863890 - RNA, 22 nt, Salmonella typhimurium LT2
ggcauuucaccgccaauaacgg

SEQ ID NO: 1863891 - RNA, 14 nt, Salmonella typhimurium LT2
ggccaaauaaccca

SEQ ID NO: 1863892 - RNA, 17 nt, Salmonella typhimurium LT2
ggccaaagggagcagac

SEQ ID NO: 1863893 - RNA, 17 nt, Salmonella typhimurium LT2
ggcaucucuggcggcgu

SEQ ID NO: 1863894 - RNA, 14 nt, Salmonella typhimurium LT2
ggcaucuuaaacca

SEQ ID NO: 1863895 - RNA, 21 nt, Salmonella typhimurium LT2
ggcaucuuaaaccaggcuuag

SEQ ID NO: 1863896 - RNA, 15 nt, Salmonella typhimurium LT2
ggcaugaagaaaaua

SEQ ID NO: 1863897 - RNA, 20 nt, Salmonella typhimurium LT2
ggcaugaagcagcaggcagg

SEQ ID NO: 1863898 - RNA, 23 nt, Salmonella typhimurium LT2
ggcaugaaaauaugaugcuaucu

SEQ ID NO: 1863899 - RNA, 14 nt, Salmonella typhimurium LT2
ggcaucgucggcga

SEQ ID NO: 1863900 - RNA, 20 nt, Salmonella typhimurium LT2
ggcaugaucuauccaauaau

SEQ ID NO: 1863901 - RNA, 22 nt, Salmonella typhimurium LT2
ggcaugaucuauccaauaauaa

SEQ ID NO: 1863902 - RNA, 17 nt, Salmonella typhimurium LT2
ggcauucaguuucuucg

SEQ ID NO: 1863903 - RNA, 18 nt, Salmonella typhimurium LT2
ggcauucgaauccuccug

SEQ ID NO: 1863904 - RNA, 20 nt, Salmonella typhimurium LT2
ggcauugccggaaaccaacc

SEQ ID NO: 1863905 - RNA, 10 nt, Salmonella typhimurium LT2
ggcagaaccu

SEQ ID NO: 1863906 - RNA, 23 nt, Salmonella typhimurium LT2
ggcacuuuccgguuuccauggca

SEQ ID NO: 1863907 - RNA, 15 nt, Salmonella typhimurium LT2
ggcagggcagcgagc

SEQ ID NO: 1863908 - RNA, 23 nt, Salmonella typhimurium LT2
ggcagggaacacccgcccgguuu

SEQ ID NO: 1863909 - RNA, 15 nt, Salmonella typhimurium LT2
ggcaguguuucccaa

SEQ ID NO: 1863910 - RNA, 22 nt, Salmonella typhimurium LT2
ggcaguuuauggcgggcguccu

SEQ ID NO: 1863911 - RNA, 16 nt, Salmonella typhimurium LT2
ggcaucaauaaaauca

SEQ ID NO: 1863912 - RNA, 22 nt, Salmonella typhimurium LT2
ggcauaaauaaaccgaaagggu

SEQ ID NO: 1863913 - RNA, 12 nt, Salmonella typhimurium LT2
ggcauaaacgcc

SEQ ID NO: 1863914 - RNA, 17 nt, Salmonella typhimurium LT2
ggcaucagccgccaucc

SEQ ID NO: 1863915 - RNA, 22 nt, Salmonella typhimurium LT2
ggaccaagaucggagauauaaa

SEQ ID NO: 1863916 - RNA, 16 nt, Salmonella typhimurium LT2
ggacauucagcacgcu

SEQ ID NO: 1863917 - RNA, 20 nt, Salmonella typhimurium LT2
ggacagcgacacuccgcgca

SEQ ID NO: 1863918 - RNA, 17 nt, Salmonella typhimurium LT2
ggacagaaaaaauagua

SEQ ID NO: 1863919 - RNA, 17 nt, Salmonella typhimurium LT2
ggaccggcaaucgccug

SEQ ID NO: 1863920 - RNA, 18 nt, Salmonella typhimurium LT2
ggaccggcaaucgccugc

SEQ ID NO: 1863921 - RNA, 12 nt, Salmonella typhimurium LT2
ggacccugacca

SEQ ID NO: 1863922 - RNA, 23 nt, Salmonella typhimurium LT2
ggaccuguguauucugcgccagc

SEQ ID NO: 1863923 - RNA, 23 nt, Salmonella typhimurium LT2
ggacgaaaaaugaauaccaaguc

SEQ ID NO: 1863924 - RNA, 18 nt, Salmonella typhimurium LT2
ggaauaaaggucacauca

SEQ ID NO: 1863925 - RNA, 20 nt, Salmonella typhimurium LT2
ggaaguuaccgcgccaggcg

SEQ ID NO: 1863926 - RNA, 16 nt, Salmonella typhimurium LT2
ggaaguuuugcuggaa

SEQ ID NO: 1863927 - RNA, 15 nt, Salmonella typhimurium LT2
ggaagucagcuuccu

SEQ ID NO: 1863928 - RNA, 13 nt, Salmonella typhimurium LT2
gcucgguggcggu

SEQ ID NO: 1863929 - RNA, 15 nt, Salmonella typhimurium LT2
gcucggcgucauccc

SEQ ID NO: 1863930 - RNA, 15 nt, Salmonella typhimurium LT2
ggaauacguaauacc

SEQ ID NO: 1863931 - RNA, 14 nt, Salmonella typhimurium LT2
ggaauaauuaaauc

SEQ ID NO: 1863932 - RNA, 19 nt, Salmonella typhimurium LT2
ggaauacccagcucagcuu

SEQ ID NO: 1863933 - RNA, 18 nt, Salmonella typhimurium LT2
ggaaugauagggaaggcu

SEQ ID NO: 1863934 - RNA, 16 nt, Salmonella typhimurium LT2
ggacaacgcuccagca

SEQ ID NO: 1863935 - RNA, 20 nt, Salmonella typhimurium LT2
ggacgagcgcgucagcgccu

SEQ ID NO: 1863936 - RNA, 23 nt, Salmonella typhimurium LT2
ggacgauagccaugcccggcggc

SEQ ID NO: 1863937 - RNA, 19 nt, Salmonella typhimurium LT2
ggacgcagcucauacccuu

SEQ ID NO: 1863938 - RNA, 23 nt, Salmonella typhimurium LT2
ggacugauacagccaaaucagca

SEQ ID NO: 1863939 - RNA, 21 nt, Salmonella typhimurium LT2
ggacugccuaacuggaaaaag

SEQ ID NO: 1863940 - RNA, 18 nt, Salmonella typhimurium LT2
ggacuccugacgcugaga

SEQ ID NO: 1863941 - RNA, 13 nt, Salmonella typhimurium LT2
ggacugggcugau

SEQ ID NO: 1863942 - RNA, 17 nt, Salmonella typhimurium LT2
ggagaaaacgcggccug

SEQ ID NO: 1863943 - RNA, 14 nt, Salmonella typhimurium LT2
ggagaaaacgcggc

SEQ ID NO: 1863944 - RNA, 15 nt, Salmonella typhimurium LT2
ggacuuuaaacguca

SEQ ID NO: 1863945 - RNA, 23 nt, Salmonella typhimurium LT2
ggagaucgacaacaacaucugug

SEQ ID NO: 1863946 - RNA, 19 nt, Salmonella typhimurium LT2
ggagauugccccccagcca

SEQ ID NO: 1863947 - RNA, 22 nt, Salmonella typhimurium LT2
ggagagguuagcgcagggggga

SEQ ID NO: 1863948 - RNA, 14 nt, Salmonella typhimurium LT2
ggagauauacaucu

SEQ ID NO: 1863949 - RNA, 19 nt, Salmonella typhimurium LT2
ggagauaagcugggcguca

SEQ ID NO: 1863950 - RNA, 16 nt, Salmonella typhimurium LT2
ggaggccugaauaaug

SEQ ID NO: 1863951 - RNA, 23 nt, Salmonella typhimurium LT2
ggaguaguguaauaccacugccc

SEQ ID NO: 1863952 - RNA, 18 nt, Salmonella typhimurium LT2
ggagucaaguuagccccc

SEQ ID NO: 1863953 - RNA, 19 nt, Salmonella typhimurium LT2
ggagucaaguuagcccccg

SEQ ID NO: 1863954 - RNA, 15 nt, Salmonella typhimurium LT2
ggagucauugcuaug

SEQ ID NO: 1863955 - RNA, 15 nt, Salmonella typhimurium LT2
ggcaccgguuuuuga

SEQ ID NO: 1863956 - RNA, 21 nt, Salmonella typhimurium LT2
ggcacaaccuggcuugccggg

SEQ ID NO: 1863957 - RNA, 14 nt, Salmonella typhimurium LT2
ggcacaauagcgcu

SEQ ID NO: 1863958 - RNA, 19 nt, Salmonella typhimurium LT2
ggcacaauagcgcuaaaca

SEQ ID NO: 1863959 - RNA, 19 nt, Salmonella typhimurium LT2
ggcacaaccuggcuugccg

SEQ ID NO: 1863960 - RNA, 21 nt, Salmonella typhimurium LT2
ggcaauucgcguucagaaaug

SEQ ID NO: 1863961 - RNA, 13 nt, Salmonella typhimurium LT2
ggcaauuaacauu

SEQ ID NO: 1863962 - RNA, 19 nt, Salmonella typhimurium LT2
ggcaauuucacugucgcca

SEQ ID NO: 1863963 - RNA, 23 nt, Salmonella typhimurium LT2
ggcaauuucacugucgccaggcc

SEQ ID NO: 1863964 - RNA, 14 nt, Salmonella typhimurium LT2
ggcaauggcagauu

SEQ ID NO: 1863965 - RNA, 14 nt, Salmonella typhimurium LT2
ggcaaguaaaauaa

SEQ ID NO: 1863966 - RNA, 21 nt, Salmonella typhimurium LT2
ggcaauacuucguuauacccc

SEQ ID NO: 1863967 - RNA, 12 nt, Salmonella typhimurium LT2
ggcaauccauca

SEQ ID NO: 1863968 - RNA, 20 nt, Salmonella typhimurium LT2
ggcaauccauuaaugccgca

SEQ ID NO: 1863969 - RNA, 19 nt, Salmonella typhimurium LT2
ggcaaugaccgcaauuaaa

SEQ ID NO: 1863970 - RNA, 14 nt, Salmonella typhimurium LT2
ggcaaucggccagg

SEQ ID NO: 1863971 - RNA, 15 nt, Salmonella typhimurium LT2
ggcaaucggccaggu

SEQ ID NO: 1863972 - RNA, 13 nt, Salmonella typhimurium LT2
ggcaagcugaugu

SEQ ID NO: 1863973 - RNA, 16 nt, Salmonella typhimurium LT2
ggcaagcugauguuca

SEQ ID NO: 1863974 - RNA, 13 nt, Salmonella typhimurium LT2
ggcaagccagcau

SEQ ID NO: 1863975 - RNA, 20 nt, Salmonella typhimurium LT2
ggcaagacccgaaccugcga

SEQ ID NO: 1863976 - RNA, 19 nt, Salmonella typhimurium LT2
ggcaagauuaaccagcagu

SEQ ID NO: 1863977 - RNA, 23 nt, Salmonella typhimurium LT2
ggcaagauaagccgucauaaaau

SEQ ID NO: 1863978 - RNA, 16 nt, Salmonella typhimurium LT2
ggcaaaggaaugcuuu

SEQ ID NO: 1863979 - RNA, 11 nt, Salmonella typhimurium LT2
ggcaaauagcg

SEQ ID NO: 1863980 - RNA, 18 nt, Salmonella typhimurium LT2
ggcaaaguaucccuuccu

SEQ ID NO: 1863981 - RNA, 20 nt, Salmonella typhimurium LT2
ggauuuaaaccgccccgacu

SEQ ID NO: 1863982 - RNA, 12 nt, Salmonella typhimurium LT2
ggauuugcugcg

SEQ ID NO: 1863983 - RNA, 17 nt, Salmonella typhimurium LT2
ggauuuuaaauugguua

SEQ ID NO: 1863984 - RNA, 11 nt, Salmonella typhimurium LT2
ggauuuuaaau

SEQ ID NO: 1863985 - RNA, 20 nt, Salmonella typhimurium LT2
ggauuuuccguuaagcugga

SEQ ID NO: 1863986 - RNA, 19 nt, Salmonella typhimurium LT2
ggcaacggccagcgcaggc

SEQ ID NO: 1863987 - RNA, 20 nt, Salmonella typhimurium LT2
ggcaacggccagcgcaggcu

SEQ ID NO: 1863988 - RNA, 23 nt, Salmonella typhimurium LT2
ggcaacgccguacuccagcccau

SEQ ID NO: 1863989 - RNA, 20 nt, Salmonella typhimurium LT2
ggcaacgccagagcgucuca

SEQ ID NO: 1863990 - RNA, 16 nt, Salmonella typhimurium LT2
ggcaacgccgccagcu

SEQ ID NO: 1863991 - RNA, 17 nt, Salmonella typhimurium LT2
ggcaaccuucgacgagg

SEQ ID NO: 1863992 - RNA, 17 nt, Salmonella typhimurium LT2
ggcaacccgcuccagaa

SEQ ID NO: 1863993 - RNA, 14 nt, Salmonella typhimurium LT2
ggcaacauaaauaa

SEQ ID NO: 1863994 - RNA, 15 nt, Salmonella typhimurium LT2
ggcaacaugaccagc

SEQ ID NO: 1863995 - RNA, 16 nt, Salmonella typhimurium LT2
ggcaaccaccagcagu

SEQ ID NO: 1863996 - RNA, 16 nt, Salmonella typhimurium LT2
ggaugauacugcucau

SEQ ID NO: 1863997 - RNA, 22 nt, Salmonella typhimurium LT2
ggaucaacggugggguccgauu

SEQ ID NO: 1863998 - RNA, 14 nt, Salmonella typhimurium LT2
ggaucucaccacug

SEQ ID NO: 1863999 - RNA, 15 nt, Salmonella typhimurium LT2
ggauggccucugcca

SEQ ID NO: 1864000 - RNA, 15 nt, Salmonella typhimurium LT2
ggauggccugcucga

SEQ ID NO: 1864001 - RNA, 16 nt, Salmonella typhimurium LT2
ggauguuuucagcauu

SEQ ID NO: 1864002 - RNA, 14 nt, Salmonella typhimurium LT2
ggauuggucugauu

SEQ ID NO: 1864003 - RNA, 21 nt, Salmonella typhimurium LT2
ggauuggauaaaucggucauu

SEQ ID NO: 1864004 - RNA, 15 nt, Salmonella typhimurium LT2
cucuuggucauaaua

SEQ ID NO: 1864005 - RNA, 15 nt, Salmonella typhimurium LT2
cucuuggguuauuuc

SEQ ID NO: 1864006 - RNA, 13 nt, Salmonella typhimurium LT2
cucuuuaacaauu

SEQ ID NO: 1864007 - RNA, 13 nt, Salmonella typhimurium LT2
cucuucuuuuaau

SEQ ID NO: 1864008 - RNA, 20 nt, Salmonella typhimurium LT2
cucuugcacaauacuuuuug

SEQ ID NO: 1864009 - RNA, 16 nt, Salmonella typhimurium LT2
cucuugcgagcgucag

SEQ ID NO: 1864010 - RNA, 21 nt, Salmonella typhimurium LT2
cucuucguucauccgucuggc

SEQ ID NO: 1864011 - RNA, 21 nt, Salmonella typhimurium LT2
cucuucggcggcccauucgcc

SEQ ID NO: 1864012 - RNA, 22 nt, Salmonella typhimurium LT2
cucuucgcuccagucgucgcua

SEQ ID NO: 1864013 - RNA, 14 nt, Salmonella typhimurium LT2
cucuuccuccugau

SEQ ID NO: 1864014 - RNA, 18 nt, Salmonella typhimurium LT2
cucuuccgguacacgcag

SEQ ID NO: 1864015 - RNA, 13 nt, Salmonella typhimurium LT2
cucuuccgccagc

SEQ ID NO: 1864016 - RNA, 17 nt, Salmonella typhimurium LT2
cucuuccaucagccagg

SEQ ID NO: 1864017 - RNA, 15 nt, Salmonella typhimurium LT2
cucuuccagcgccaa

SEQ ID NO: 1864018 - RNA, 20 nt, Salmonella typhimurium LT2
cucuuccgcgguccagccgg

SEQ ID NO: 1864019 - RNA, 13 nt, Salmonella typhimurium LT2
cucugcuuuuuca

SEQ ID NO: 1864020 - RNA, 18 nt, Salmonella typhimurium LT2
cucuucacccuucuucug

SEQ ID NO: 1864021 - RNA, 22 nt, Salmonella typhimurium LT2
cucuucaguaagaguaccauuc

SEQ ID NO: 1864022 - RNA, 18 nt, Salmonella typhimurium LT2
cucuucagcguccggaaa

SEQ ID NO: 1864023 - RNA, 18 nt, Salmonella typhimurium LT2
cucuuaccgcuaaaauac

SEQ ID NO: 1864024 - RNA, 15 nt, Salmonella typhimurium LT2
cugaaauaaaagcaa

SEQ ID NO: 1864025 - RNA, 23 nt, Salmonella typhimurium LT2
cugaacauacuuucucuccuuca

SEQ ID NO: 1864026 - RNA, 17 nt, Salmonella typhimurium LT2
cugaacuauaggaaaau

SEQ ID NO: 1864027 - RNA, 19 nt, Salmonella typhimurium LT2
cugaacgggugguuucccu

SEQ ID NO: 1864028 - RNA, 16 nt, Salmonella typhimurium LT2
cugaacgguuuauacc

SEQ ID NO: 1864029 - RNA, 15 nt, Salmonella typhimurium LT2
cugaacguaguuggu

SEQ ID NO: 1864030 - RNA, 20 nt, Salmonella typhimurium LT2
cugaacgccgcguuuuagca

SEQ ID NO: 1864031 - RNA, 18 nt, Salmonella typhimurium LT2
cugaacgcccggcgcgac

SEQ ID NO: 1864032 - RNA, 22 nt, Salmonella typhimurium LT2
cugaagagcgacuaagaggugc

SEQ ID NO: 1864033 - RNA, 18 nt, Salmonella typhimurium LT2
cugaagaaaaggaauacc

SEQ ID NO: 1864034 - RNA, 19 nt, Salmonella typhimurium LT2
cugaagcagugugaugcgu

SEQ ID NO: 1864035 - RNA, 17 nt, Salmonella typhimurium LT2
cugaagauguucaggua

SEQ ID NO: 1864036 - RNA, 17 nt, Salmonella typhimurium LT2
cucuuucgguagccaca

SEQ ID NO: 1864037 - RNA, 15 nt, Salmonella typhimurium LT2
cucuuuccagcgaca

SEQ ID NO: 1864038 - RNA, 20 nt, Salmonella typhimurium LT2
cucuuucgguagccacagau

SEQ ID NO: 1864039 - RNA, 14 nt, Salmonella typhimurium LT2
cucuuugaacagcc

SEQ ID NO: 1864040 - RNA, 17 nt, Salmonella typhimurium LT2
cucuuucacuuucaggu

SEQ ID NO: 1864041 - RNA, 21 nt, Salmonella typhimurium LT2
cucuuucaccagcgccagaau

SEQ ID NO: 1864042 - RNA, 11 nt, Salmonella typhimurium LT2
cucuuuuucau

SEQ ID NO: 1864043 - RNA, 20 nt, Salmonella typhimurium LT2
cucuuuuucauagaaccacu

SEQ ID NO: 1864044 - RNA, 20 nt, Salmonella typhimurium LT2
cucuuugacgaccgcggccu

SEQ ID NO: 1864045 - RNA, 13 nt, Salmonella typhimurium LT2
cugaaaaugcccg

SEQ ID NO: 1864046 - RNA, 17 nt, Salmonella typhimurium LT2
cugaaacggaucaaaaa

SEQ ID NO: 1864047 - RNA, 19 nt, Salmonella typhimurium LT2
cugaaaccgccguuuuaac

SEQ ID NO: 1864048 - RNA, 18 nt, Salmonella typhimurium LT2
cugaaaggcgucagccgc

SEQ ID NO: 1864049 - RNA, 13 nt, Salmonella typhimurium LT2
cugaaagcaagua

SEQ ID NO: 1864050 - RNA, 12 nt, Salmonella typhimurium LT2
cugaaaaauccc

SEQ ID NO: 1864051 - RNA, 22 nt, Salmonella typhimurium LT2
cugaaaaauuuuccuggaauua

SEQ ID NO: 1864052 - RNA, 14 nt, Salmonella typhimurium LT2
cugagaaccccaga

SEQ ID NO: 1864053 - RNA, 17 nt, Salmonella typhimurium LT2
cugagaaaucaacguga

SEQ ID NO: 1864054 - RNA, 19 nt, Salmonella typhimurium LT2
cugagcaaacucaaugacu

SEQ ID NO: 1864055 - RNA, 16 nt, Salmonella typhimurium LT2
cugagcaaucaguuca

SEQ ID NO: 1864056 - RNA, 12 nt, Salmonella typhimurium LT2
cugagcauacac

SEQ ID NO: 1864057 - RNA, 22 nt, Salmonella typhimurium LT2
cugagcauacacauucaggcug

SEQ ID NO: 1864058 - RNA, 15 nt, Salmonella typhimurium LT2
cugagcagccagccc

SEQ ID NO: 1864059 - RNA, 18 nt, Salmonella typhimurium LT2
cugagcagccagcccagc

SEQ ID NO: 1864060 - RNA, 13 nt, Salmonella typhimurium LT2
cugacuaucuuua

SEQ ID NO: 1864061 - RNA, 23 nt, Salmonella typhimurium LT2
cugacggccugucuccgcagcag

SEQ ID NO: 1864062 - RNA, 16 nt, Salmonella typhimurium LT2
cugacguugcgggccu

SEQ ID NO: 1864063 - RNA, 13 nt, Salmonella typhimurium LT2
cugacggagcaaa

SEQ ID NO: 1864064 - RNA, 15 nt, Salmonella typhimurium LT2
cugacuauccacagc

SEQ ID NO: 1864065 - RNA, 18 nt, Salmonella typhimurium LT2
cugacuauccacagcgaa

SEQ ID NO: 1864066 - RNA, 18 nt, Salmonella typhimurium LT2
cugaccuuuuucauccuc

SEQ ID NO: 1864067 - RNA, 13 nt, Salmonella typhimurium LT2
cugacgcgcagcg

SEQ ID NO: 1864068 - RNA, 13 nt, Salmonella typhimurium LT2
cugacgcgccugg

SEQ ID NO: 1864069 - RNA, 14 nt, Salmonella typhimurium LT2
cugaccaaggcaaa

SEQ ID NO: 1864070 - RNA, 23 nt, Salmonella typhimurium LT2
cugaccagacagucgccgcuucg

SEQ ID NO: 1864071 - RNA, 16 nt, Salmonella typhimurium LT2
cugaccaucaacaaug

SEQ ID NO: 1864072 - RNA, 21 nt, Salmonella typhimurium LT2
cugaccguugaucuccgcgca

SEQ ID NO: 1864073 - RNA, 22 nt, Salmonella typhimurium LT2
cugaccugcugguuauuaucca

SEQ ID NO: 1864074 - RNA, 18 nt, Salmonella typhimurium LT2
cugacaaaucggcuccgg

SEQ ID NO: 1864075 - RNA, 17 nt, Salmonella typhimurium LT2
cugacaaauuauaaacu

SEQ ID NO: 1864076 - RNA, 14 nt, Salmonella typhimurium LT2
cugaagcguaaaaa

SEQ ID NO: 1864077 - RNA, 14 nt, Salmonella typhimurium LT2
cugaagcggcgcaa

SEQ ID NO: 1864078 - RNA, 20 nt, Salmonella typhimurium LT2
cugaagcggcgcaauuuucc

SEQ ID NO: 1864079 - RNA, 17 nt, Salmonella typhimurium LT2
cugaaggacaagcugcg

SEQ ID NO: 1864080 - RNA, 15 nt, Salmonella typhimurium LT2
cugaaggacaagcug

SEQ ID NO: 1864081 - RNA, 21 nt, Salmonella typhimurium LT2
cugaguucggcauggggucag

SEQ ID NO: 1864082 - RNA, 20 nt, Salmonella typhimurium LT2
cugauaccgcguuugcgcaa

SEQ ID NO: 1864083 - RNA, 22 nt, Salmonella typhimurium LT2
cugauaccgcguuugcgcaaca

SEQ ID NO: 1864084 - RNA, 20 nt, Salmonella typhimurium LT2
cugauacgcaccagcucuac

SEQ ID NO: 1864085 - RNA, 13 nt, Salmonella typhimurium LT2
cugauacugcucc

SEQ ID NO: 1864086 - RNA, 16 nt, Salmonella typhimurium LT2
cugauaagguaaagcc

SEQ ID NO: 1864087 - RNA, 19 nt, Salmonella typhimurium LT2
cugaguuucucccgccaga

SEQ ID NO: 1864088 - RNA, 16 nt, Salmonella typhimurium LT2
cugauaaucgagacug

SEQ ID NO: 1864089 - RNA, 21 nt, Salmonella typhimurium LT2
cugauauugcguaagcagcug

SEQ ID NO: 1864090 - RNA, 22 nt, Salmonella typhimurium LT2
cugauauugcauuugcguccau

SEQ ID NO: 1864091 - RNA, 17 nt, Salmonella typhimurium LT2
cugauccagcucuucuu

SEQ ID NO: 1864092 - RNA, 15 nt, Salmonella typhimurium LT2
cugaucagccgcgac

SEQ ID NO: 1864093 - RNA, 22 nt, Salmonella typhimurium LT2
cugaucgccacgccuaaacuga

SEQ ID NO: 1864094 - RNA, 14 nt, Salmonella typhimurium LT2
cugaucguggccac

SEQ ID NO: 1864095 - RNA, 17 nt, Salmonella typhimurium LT2
cugaucguuuuugucca

SEQ ID NO: 1864096 - RNA, 21 nt, Salmonella typhimurium LT2
cugaucguuuuuguccauaaa

SEQ ID NO: 1864097 - RNA, 18 nt, Salmonella typhimurium LT2
cugaucggcguuuagccc

SEQ ID NO: 1864098 - RNA, 20 nt, Salmonella typhimurium LT2
cugaucgacgaaaucccggc

SEQ ID NO: 1864099 - RNA, 19 nt, Salmonella typhimurium LT2
cugaucgauucucuucuuc

SEQ ID NO: 1864100 - RNA, 17 nt, Salmonella typhimurium LT2
cugauucuacucugcuc

SEQ ID NO: 1864101 - RNA, 21 nt, Salmonella typhimurium LT2
cugauucuuaucugugggucu

SEQ ID NO: 1864102 - RNA, 19 nt, Salmonella typhimurium LT2
cugauuuaaucgcuucaau

SEQ ID NO: 1864103 - RNA, 13 nt, Salmonella typhimurium LT2
cugcaaaagagga

SEQ ID NO: 1864104 - RNA, 20 nt, Salmonella typhimurium LT2
cugcaaaaagccuugcugaa

SEQ ID NO: 1864105 - RNA, 14 nt, Salmonella typhimurium LT2
cugcaaaaaaagaa

SEQ ID NO: 1864106 - RNA, 13 nt, Salmonella typhimurium LT2
cugaugccgucga

SEQ ID NO: 1864107 - RNA, 14 nt, Salmonella typhimurium LT2
cugaugccugaagg

SEQ ID NO: 1864108 - RNA, 22 nt, Salmonella typhimurium LT2
cugaugccauaaaaugcugggc

SEQ ID NO: 1864109 - RNA, 22 nt, Salmonella typhimurium LT2
cugaugcccagguuagcagcca

SEQ ID NO: 1864110 - RNA, 24 nt, Salmonella typhimurium LT2
cugaugcgcguuuagcgccagcag

SEQ ID NO: 1864111 - RNA, 18 nt, Salmonella typhimurium LT2
cugaugcgcuauaaaaau

SEQ ID NO: 1864112 - RNA, 22 nt, Salmonella typhimurium LT2
cugaugcguuguaccguuuucc

SEQ ID NO: 1864113 - RNA, 18 nt, Salmonella typhimurium LT2
cugaugauuuaaaaguac

SEQ ID NO: 1864114 - RNA, 17 nt, Salmonella typhimurium LT2
cugaugauuggccucca

SEQ ID NO: 1864115 - RNA, 21 nt, Salmonella typhimurium LT2
cugaugauggaacagacgccu

SEQ ID NO: 1864116 - RNA, 19 nt, Salmonella typhimurium LT2
cugcaaacgcggcgccagc

SEQ ID NO: 1864117 - RNA, 17 nt, Salmonella typhimurium LT2
cugcaacgccugcggau

SEQ ID NO: 1864118 - RNA, 16 nt, Salmonella typhimurium LT2
cugcaaaauauauaau

SEQ ID NO: 1864119 - RNA, 17 nt, Salmonella typhimurium LT2
cugcaauagcagaucgc

SEQ ID NO: 1864120 - RNA, 13 nt, Salmonella typhimurium LT2
cugcaagggaauc

SEQ ID NO: 1864121 - RNA, 17 nt, Salmonella typhimurium LT2
cugcaacuccugggcaa

SEQ ID NO: 1864122 - RNA, 16 nt, Salmonella typhimurium LT2
cugcuucagccacugg

SEQ ID NO: 1864123 - RNA, 17 nt, Salmonella typhimurium LT2
cugcuuucuaccagccu

SEQ ID NO: 1864124 - RNA, 16 nt, Salmonella typhimurium LT2
cugcuuauucuuuuca

SEQ ID NO: 1864125 - RNA, 22 nt, Salmonella typhimurium LT2
cugcuuaucgauaucugccugc

SEQ ID NO: 1864126 - RNA, 16 nt, Salmonella typhimurium LT2
cugcuuaaacagaauu

SEQ ID NO: 1864127 - RNA, 16 nt, Salmonella typhimurium LT2
cugcuggcaaaacgca

SEQ ID NO: 1864128 - RNA, 23 nt, Salmonella typhimurium LT2
cugcugcuugcuuuucaucacca

SEQ ID NO: 1864129 - RNA, 13 nt, Salmonella typhimurium LT2
cugcugcuugcuu

SEQ ID NO: 1864130 - RNA, 17 nt, Salmonella typhimurium LT2
cuggaaagcucuucaug

SEQ ID NO: 1864131 - RNA, 12 nt, Salmonella typhimurium LT2
cugcuuuuucua

SEQ ID NO: 1864132 - RNA, 13 nt, Salmonella typhimurium LT2
cugcuuuuucuag

SEQ ID NO: 1864133 - RNA, 16 nt, Salmonella typhimurium LT2
cuggacaugcuccgcc

SEQ ID NO: 1864134 - RNA, 17 nt, Salmonella typhimurium LT2
cuggacaaaccacagug

SEQ ID NO: 1864135 - RNA, 20 nt, Salmonella typhimurium LT2
cuggaauuugucgucaugcg

SEQ ID NO: 1864136 - RNA, 13 nt, Salmonella typhimurium LT2
cuggcaaaacgca

SEQ ID NO: 1864137 - RNA, 22 nt, Salmonella typhimurium LT2
cuggaucgugcggcgaagcauc

SEQ ID NO: 1864138 - RNA, 15 nt, Salmonella typhimurium LT2
cuggagaacgagaaa

SEQ ID NO: 1864139 - RNA, 19 nt, Salmonella typhimurium LT2
cuggcaauaaagcagggcg

SEQ ID NO: 1864140 - RNA, 16 nt, Salmonella typhimurium LT2
cuggcauuacgcuggc

SEQ ID NO: 1864141 - RNA, 17 nt, Salmonella typhimurium LT2
cuggcauuccccaucgc

SEQ ID NO: 1864142 - RNA, 19 nt, Salmonella typhimurium LT2
cuggccaaagcggguuaac

SEQ ID NO: 1864143 - RNA, 22 nt, Salmonella typhimurium LT2
cuggcaagaccgauagagacug

SEQ ID NO: 1864144 - RNA, 22 nt, Salmonella typhimurium LT2
cuggcaaagcgucauguaaugc

SEQ ID NO: 1864145 - RNA, 22 nt, Salmonella typhimurium LT2
cuggccaauuuuucacaugcaa

SEQ ID NO: 1864146 - RNA, 14 nt, Salmonella typhimurium LT2
cuggccacagcaaa

SEQ ID NO: 1864147 - RNA, 14 nt, Salmonella typhimurium LT2
cuggccaggcuuuc

SEQ ID NO: 1864148 - RNA, 21 nt, Salmonella typhimurium LT2
cuggccaguuucaaugcccag

SEQ ID NO: 1864149 - RNA, 19 nt, Salmonella typhimurium LT2
cugcucguuaaauccuccc

SEQ ID NO: 1864150 - RNA, 13 nt, Salmonella typhimurium LT2
aaacuauuuuuag

SEQ ID NO: 1864151 - RNA, 20 nt, Salmonella typhimurium LT2
cugcucguuaaauccuccca

SEQ ID NO: 1864152 - RNA, 16 nt, Salmonella typhimurium LT2
cugcucccucacgcgu

SEQ ID NO: 1864153 - RNA, 19 nt, Salmonella typhimurium LT2
cugcuccguccacgcgagc

SEQ ID NO: 1864154 - RNA, 24 nt, Salmonella typhimurium LT2
aaacucaaagcguuauuugcauuu

SEQ ID NO: 1864155 - RNA, 19 nt, Salmonella typhimurium LT2
cugcucuuugacaaacgcc

SEQ ID NO: 1864156 - RNA, 16 nt, Salmonella typhimurium LT2
cugcugcauccgcgcu

SEQ ID NO: 1864157 - RNA, 18 nt, Salmonella typhimurium LT2
cugcugccagccgccgcc

SEQ ID NO: 1864158 - RNA, 17 nt, Salmonella typhimurium LT2
cugcugcccuggaaccu

SEQ ID NO: 1864159 - RNA, 13 nt, Salmonella typhimurium LT2
cugcugcgcggcc

SEQ ID NO: 1864160 - RNA, 16 nt, Salmonella typhimurium LT2
cugcugcgcggccaga

SEQ ID NO: 1864161 - RNA, 15 nt, Salmonella typhimurium LT2
cugcggcucgccaau

SEQ ID NO: 1864162 - RNA, 18 nt, Salmonella typhimurium LT2
cugcggcuauauaaaauc

SEQ ID NO: 1864163 - RNA, 20 nt, Salmonella typhimurium LT2
cugcggcuauauaaaaucgg

SEQ ID NO: 1864164 - RNA, 20 nt, Salmonella typhimurium LT2
cugcggcgcuuugcgcucag

SEQ ID NO: 1864165 - RNA, 14 nt, Salmonella typhimurium LT2
cugcgggaaguagc

SEQ ID NO: 1864166 - RNA, 13 nt, Salmonella typhimurium LT2
cugcgcucgcccu

SEQ ID NO: 1864167 - RNA, 17 nt, Salmonella typhimurium LT2
cugcgcucacgcggcgc

SEQ ID NO: 1864168 - RNA, 21 nt, Salmonella typhimurium LT2
cugcgcuucgaugcguucaaa

SEQ ID NO: 1864169 - RNA, 14 nt, Salmonella typhimurium LT2
cugcgcugacggcg

SEQ ID NO: 1864170 - RNA, 21 nt, Salmonella typhimurium LT2
cugcuaucaggauucgacggc

SEQ ID NO: 1864171 - RNA, 22 nt, Salmonella typhimurium LT2
cugcguuugccgccuugucuca

SEQ ID NO: 1864172 - RNA, 14 nt, Salmonella typhimurium LT2
cugcucaaggcaau

SEQ ID NO: 1864173 - RNA, 20 nt, Salmonella typhimurium LT2
cugcguuaacgacccaucaa

SEQ ID NO: 1864174 - RNA, 20 nt, Salmonella typhimurium LT2
cugcguugcuauggcaacaa

SEQ ID NO: 1864175 - RNA, 15 nt, Salmonella typhimurium LT2
cugcguugccgccuu

SEQ ID NO: 1864176 - RNA, 12 nt, Salmonella typhimurium LT2
cugcguuaucgc

SEQ ID NO: 1864177 - RNA, 13 nt, Salmonella typhimurium LT2
cugcgucacagac

SEQ ID NO: 1864178 - RNA, 14 nt, Salmonella typhimurium LT2
cugcgucaaugacu

SEQ ID NO: 1864179 - RNA, 22 nt, Salmonella typhimurium LT2
cugcguaauguugauaucacuc

SEQ ID NO: 1864180 - RNA, 22 nt, Salmonella typhimurium LT2
cugcauuguuccugcuggcaaa

SEQ ID NO: 1864181 - RNA, 15 nt, Salmonella typhimurium LT2
cugcauugccugauu

SEQ ID NO: 1864182 - RNA, 20 nt, Salmonella typhimurium LT2
cugcaucguuugcaguuccg

SEQ ID NO: 1864183 - RNA, 19 nt, Salmonella typhimurium LT2
cugcaucguuugcaguucc

SEQ ID NO: 1864184 - RNA, 16 nt, Salmonella typhimurium LT2
cugcaucuuacugacc

SEQ ID NO: 1864185 - RNA, 21 nt, Salmonella typhimurium LT2
cugcauccgcuuucucggcga

SEQ ID NO: 1864186 - RNA, 15 nt, Salmonella typhimurium LT2
cugcaauuucuuuuc

SEQ ID NO: 1864187 - RNA, 19 nt, Salmonella typhimurium LT2
cugcacaaucgccagcccc

SEQ ID NO: 1864188 - RNA, 17 nt, Salmonella typhimurium LT2
cugcacaaucgccagcc

SEQ ID NO: 1864189 - RNA, 14 nt, Salmonella typhimurium LT2
cugcaggucacgau

SEQ ID NO: 1864190 - RNA, 17 nt, Salmonella typhimurium LT2
cugcccgccgccaccau

SEQ ID NO: 1864191 - RNA, 13 nt, Salmonella typhimurium LT2
cugcccgccgcca

SEQ ID NO: 1864192 - RNA, 11 nt, Salmonella typhimurium LT2
cugcccgccgc

SEQ ID NO: 1864193 - RNA, 17 nt, Salmonella typhimurium LT2
cugccgaugaucccggc

SEQ ID NO: 1864194 - RNA, 16 nt, Salmonella typhimurium LT2
cugccgauugccgcuc

SEQ ID NO: 1864195 - RNA, 14 nt, Salmonella typhimurium LT2
cugcccauuucagc

SEQ ID NO: 1864196 - RNA, 13 nt, Salmonella typhimurium LT2
cugcccaccuucg

SEQ ID NO: 1864197 - RNA, 15 nt, Salmonella typhimurium LT2
cugccaugccugaug

SEQ ID NO: 1864198 - RNA, 16 nt, Salmonella typhimurium LT2
cugccagcaccagcag

SEQ ID NO: 1864199 - RNA, 18 nt, Salmonella typhimurium LT2
cugccaguccgcccgccu

SEQ ID NO: 1864200 - RNA, 19 nt, Salmonella typhimurium LT2
cugccaguaguugaauaac

SEQ ID NO: 1864201 - RNA, 15 nt, Salmonella typhimurium LT2
cugccagccagcggg

SEQ ID NO: 1864202 - RNA, 18 nt, Salmonella typhimurium LT2
cugccagccagcgggcug

SEQ ID NO: 1864203 - RNA, 16 nt, Salmonella typhimurium LT2
cugcgcauccucuuuc

SEQ ID NO: 1864204 - RNA, 18 nt, Salmonella typhimurium LT2
cugcgcaucuggggcgcu

SEQ ID NO: 1864205 - RNA, 21 nt, Salmonella typhimurium LT2
cugcgcagcgcgcggaugacg

SEQ ID NO: 1864206 - RNA, 13 nt, Salmonella typhimurium LT2
cugcgcaccugca

SEQ ID NO: 1864207 - RNA, 22 nt, Salmonella typhimurium LT2
cugccuggcucauucuccggga

SEQ ID NO: 1864208 - RNA, 13 nt, Salmonella typhimurium LT2
cugccugcuucag

SEQ ID NO: 1864209 - RNA, 12 nt, Salmonella typhimurium LT2
cugccugcagac

SEQ ID NO: 1864210 - RNA, 22 nt, Salmonella typhimurium LT2
cugccuguuuacggcaggcccg

SEQ ID NO: 1864211 - RNA, 17 nt, Salmonella typhimurium LT2
cugcgaucaucauuccc

SEQ ID NO: 1864212 - RNA, 18 nt, Salmonella typhimurium LT2
cugccgggguaucauaaa

SEQ ID NO: 1864213 - RNA, 17 nt, Salmonella typhimurium LT2
cugccgcccaucgccac

SEQ ID NO: 1864214 - RNA, 16 nt, Salmonella typhimurium LT2
cugccgggacuuuaaa

SEQ ID NO: 1864215 - RNA, 15 nt, Salmonella typhimurium LT2
cugccgggagcagau

SEQ ID NO: 1864216 - RNA, 20 nt, Salmonella typhimurium LT2
cugccgccauuugcgcggcu

SEQ ID NO: 1864217 - RNA, 15 nt, Salmonella typhimurium LT2
cugccgcagccgcuc

SEQ ID NO: 1864218 - RNA, 19 nt, Salmonella typhimurium LT2
cugccggucggcgucugau

SEQ ID NO: 1864219 - RNA, 13 nt, Salmonella typhimurium LT2
cugccgguucggc

SEQ ID NO: 1864220 - RNA, 11 nt, Salmonella typhimurium LT2
cugccuaacug

SEQ ID NO: 1864221 - RNA, 15 nt, Salmonella typhimurium LT2
cugccucgcugaguu

SEQ ID NO: 1864222 - RNA, 16 nt, Salmonella typhimurium LT2
cugcgccucagccacg

SEQ ID NO: 1864223 - RNA, 15 nt, Salmonella typhimurium LT2
cugcgccugcauauc

SEQ ID NO: 1864224 - RNA, 15 nt, Salmonella typhimurium LT2
cugcgccugcucagc

SEQ ID NO: 1864225 - RNA, 13 nt, Salmonella typhimurium LT2
cugcgcgccugcu

SEQ ID NO: 1864226 - RNA, 22 nt, Salmonella typhimurium LT2
cugcgcgccgcccugcaucaug

SEQ ID NO: 1864227 - RNA, 12 nt, Salmonella typhimurium LT2
cugcgcgccgga

SEQ ID NO: 1864228 - RNA, 17 nt, Salmonella typhimurium LT2
cugcgccagcagcggcg

SEQ ID NO: 1864229 - RNA, 14 nt, Salmonella typhimurium LT2
cugcgccagccaga

SEQ ID NO: 1864230 - RNA, 19 nt, Salmonella typhimurium LT2
cugcgccagccagacggcg

SEQ ID NO: 1864231 - RNA, 13 nt, Salmonella typhimurium LT2
cugcgccagcacc

SEQ ID NO: 1864232 - RNA, 14 nt, Salmonella typhimurium LT2
cugcgccagcgccg

SEQ ID NO: 1864233 - RNA, 13 nt, Salmonella typhimurium LT2
cugcgccgcuugu

SEQ ID NO: 1864234 - RNA, 14 nt, Salmonella typhimurium LT2
cugcgcccgccugc

SEQ ID NO: 1864235 - RNA, 17 nt, Salmonella typhimurium LT2
cuaccuucacccccauc

SEQ ID NO: 1864236 - RNA, 13 nt, Salmonella typhimurium LT2
cuacgccaucauu

SEQ ID NO: 1864237 - RNA, 15 nt, Salmonella typhimurium LT2
cuacuaaauccuuga

SEQ ID NO: 1864238 - RNA, 23 nt, Salmonella typhimurium LT2
cuaacagucgcgccgugcccagc

SEQ ID NO: 1864239 - RNA, 16 nt, Salmonella typhimurium LT2
cuaaccaacugagcua

SEQ ID NO: 1864240 - RNA, 18 nt, Salmonella typhimurium LT2
cuacucugcucgccagua

SEQ ID NO: 1864241 - RNA, 12 nt, Salmonella typhimurium LT2
cuacugaaaagu

SEQ ID NO: 1864242 - RNA, 18 nt, Salmonella typhimurium LT2
cuacugccgccaucgcug

SEQ ID NO: 1864243 - RNA, 15 nt, Salmonella typhimurium LT2
cuacucccgucgccu

SEQ ID NO: 1864244 - RNA, 20 nt, Salmonella typhimurium LT2
cuacuccgcgagcagccaga

SEQ ID NO: 1864245 - RNA, 23 nt, Salmonella typhimurium LT2
cuagaugaugauuuaugaauagc

SEQ ID NO: 1864246 - RNA, 20 nt, Salmonella typhimurium LT2
cuagaugaugauuuaugaau

SEQ ID NO: 1864247 - RNA, 16 nt, Salmonella typhimurium LT2
cuagaugaaugacugu

SEQ ID NO: 1864248 - RNA, 14 nt, Salmonella typhimurium LT2
cuacuuccaccacc

SEQ ID NO: 1864249 - RNA, 15 nt, Salmonella typhimurium LT2
cuacuuccaccaccu

SEQ ID NO: 1864250 - RNA, 18 nt, Salmonella typhimurium LT2
cuacuuccaccaccuccu

SEQ ID NO: 1864251 - RNA, 15 nt, Salmonella typhimurium LT2
cuagcuucagguguu

SEQ ID NO: 1864252 - RNA, 21 nt, Salmonella typhimurium LT2
cuagcuucagguguuaguguc

SEQ ID NO: 1864253 - RNA, 21 nt, Salmonella typhimurium LT2
cuagcuucagguguuaguguu

SEQ ID NO: 1864254 - RNA, 19 nt, Salmonella typhimurium LT2
cuauaguucucgucugcug

SEQ ID NO: 1864255 - RNA, 16 nt, Salmonella typhimurium LT2
cuauagcuuuucauau

SEQ ID NO: 1864256 - RNA, 15 nt, Salmonella typhimurium LT2
cuauaggaaaauaau

SEQ ID NO: 1864257 - RNA, 15 nt, Salmonella typhimurium LT2
cuauaugcaggcaua

SEQ ID NO: 1864258 - RNA, 20 nt, Salmonella typhimurium LT2
cuauaugcaggcauaaaaaa

SEQ ID NO: 1864259 - RNA, 22 nt, Salmonella typhimurium LT2
cuauaugaaccuuguaacgggu

SEQ ID NO: 1864260 - RNA, 19 nt, Salmonella typhimurium LT2
cuaucacacugacaauaaa

SEQ ID NO: 1864261 - RNA, 17 nt, Salmonella typhimurium LT2
cuaucacaugugcgcua

SEQ ID NO: 1864262 - RNA, 11 nt, Salmonella typhimurium LT2
cuaucaauauu

SEQ ID NO: 1864263 - RNA, 23 nt, Salmonella typhimurium LT2
cuaucaauauucaugcuuucaau

SEQ ID NO: 1864264 - RNA, 17 nt, Salmonella typhimurium LT2
cuaucaagauaaaaaga

SEQ ID NO: 1864265 - RNA, 20 nt, Salmonella typhimurium LT2
cuauguaaagaaugaaaaaa

SEQ ID NO: 1864266 - RNA, 21 nt, Salmonella typhimurium LT2
cuauguacucugauccuaccc

SEQ ID NO: 1864267 - RNA, 18 nt, Salmonella typhimurium LT2
cuauguagcgcugaagcc

SEQ ID NO: 1864268 - RNA, 13 nt, Salmonella typhimurium LT2
cuaugcucccccc

SEQ ID NO: 1864269 - RNA, 14 nt, Salmonella typhimurium LT2
cuaugcuccccccc

SEQ ID NO: 1864270 - RNA, 19 nt, Salmonella typhimurium LT2
cuaugcucccccccuuccc

SEQ ID NO: 1864271 - RNA, 16 nt, Salmonella typhimurium LT2
cuauguuugcugagaa

SEQ ID NO: 1864272 - RNA, 18 nt, Salmonella typhimurium LT2
cuauguucaugcuggcuu

SEQ ID NO: 1864273 - RNA, 13 nt, Salmonella typhimurium LT2
cuaugcaaaacgu

SEQ ID NO: 1864274 - RNA, 15 nt, Salmonella typhimurium LT2
cuaucgcugcgcugc

SEQ ID NO: 1864275 - RNA, 23 nt, Salmonella typhimurium LT2
cuaucggaagaaaacgcaauaac

SEQ ID NO: 1864276 - RNA, 13 nt, Salmonella typhimurium LT2
cuaucauagccuc

SEQ ID NO: 1864277 - RNA, 16 nt, Salmonella typhimurium LT2
cuaucaggcaauacgc

SEQ ID NO: 1864278 - RNA, 13 nt, Salmonella typhimurium LT2
cuaucaccgccuc

SEQ ID NO: 1864279 - RNA, 20 nt, Salmonella typhimurium LT2
cuaucaccgccucgaccccu

SEQ ID NO: 1864280 - RNA, 22 nt, Salmonella typhimurium LT2
cuaucaccgcgaugaccaucaa

SEQ ID NO: 1864281 - RNA, 12 nt, Salmonella typhimurium LT2
cuauccagcagu

SEQ ID NO: 1864282 - RNA, 11 nt, Salmonella typhimurium LT2
cuauccacgca

SEQ ID NO: 1864283 - RNA, 18 nt, Salmonella typhimurium LT2
cuauccacgcagacgccg

SEQ ID NO: 1864284 - RNA, 19 nt, Salmonella typhimurium LT2
cuauccagggcacugucau

SEQ ID NO: 1864285 - RNA, 14 nt, Salmonella typhimurium LT2
cuauccagucagcg

SEQ ID NO: 1864286 - RNA, 20 nt, Salmonella typhimurium LT2
cuauccaugcgucgagcgcc

SEQ ID NO: 1864287 - RNA, 22 nt, Salmonella typhimurium LT2
cuauccgccgccagccauaaau

SEQ ID NO: 1864288 - RNA, 22 nt, Salmonella typhimurium LT2
cuauccggcaacaugacauuaa

SEQ ID NO: 1864289 - RNA, 15 nt, Salmonella typhimurium LT2
cuauccgccgccagc

SEQ ID NO: 1864290 - RNA, 22 nt, Salmonella typhimurium LT2
cuauccguccucuuucccuuuu

SEQ ID NO: 1864291 - RNA, 15 nt, Salmonella typhimurium LT2
cuaucccauuuuuug

SEQ ID NO: 1864292 - RNA, 21 nt, Salmonella typhimurium LT2
cuaucccauuuuuuguaucca

SEQ ID NO: 1864293 - RNA, 16 nt, Salmonella typhimurium LT2
cuaucgccaaacuggu

SEQ ID NO: 1864294 - RNA, 12 nt, Salmonella typhimurium LT2
cuaucgccgccc

SEQ ID NO: 1864295 - RNA, 17 nt, Salmonella typhimurium LT2
cuaucgaccagcaccug

SEQ ID NO: 1864296 - RNA, 19 nt, Salmonella typhimurium LT2
cucacauauucaauaauau

SEQ ID NO: 1864297 - RNA, 20 nt, Salmonella typhimurium LT2
cucaccgagacugcccggca

SEQ ID NO: 1864298 - RNA, 15 nt, Salmonella typhimurium LT2
cucaccccuucuuua

SEQ ID NO: 1864299 - RNA, 17 nt, Salmonella typhimurium LT2
cucaauaugccaggcau

SEQ ID NO: 1864300 - RNA, 18 nt, Salmonella typhimurium LT2
cucaaucauugucauuaa

SEQ ID NO: 1864301 - RNA, 19 nt, Salmonella typhimurium LT2
cucacagaaucaucaggcu

SEQ ID NO: 1864302 - RNA, 20 nt, Salmonella typhimurium LT2
cucaaguuauguuaucccca

SEQ ID NO: 1864303 - RNA, 19 nt, Salmonella typhimurium LT2
cucaauaauacgauguauc

SEQ ID NO: 1864304 - RNA, 19 nt, Salmonella typhimurium LT2
cucaauaucgccuaccgga

SEQ ID NO: 1864305 - RNA, 18 nt, Salmonella typhimurium LT2
cucacugccgacgcccuc

SEQ ID NO: 1864306 - RNA, 21 nt, Salmonella typhimurium LT2
cucaccgugguuaccgccaga

SEQ ID NO: 1864307 - RNA, 14 nt, Salmonella typhimurium LT2
cucaccugaugcga

SEQ ID NO: 1864308 - RNA, 16 nt, Salmonella typhimurium LT2
cucaccugcucgcccu

SEQ ID NO: 1864309 - RNA, 19 nt, Salmonella typhimurium LT2
cucacgauaacgcagcgcg

SEQ ID NO: 1864310 - RNA, 16 nt, Salmonella typhimurium LT2
cucacgauaaugaacc

SEQ ID NO: 1864311 - RNA, 24 nt, Salmonella typhimurium LT2
cucacgaauaagaaucagaugcuc

SEQ ID NO: 1864312 - RNA, 19 nt, Salmonella typhimurium LT2
cucaccguagcuccagacc

SEQ ID NO: 1864313 - RNA, 17 nt, Salmonella typhimurium LT2
cucaccgggcaggauac

SEQ ID NO: 1864314 - RNA, 22 nt, Salmonella typhimurium LT2
cucaccgcuaaucccagcgcgc

SEQ ID NO: 1864315 - RNA, 18 nt, Salmonella typhimurium LT2
cucaccgccggacaguuc

SEQ ID NO: 1864316 - RNA, 20 nt, Salmonella typhimurium LT2
cucaacagcgcggcaggccg

SEQ ID NO: 1864317 - RNA, 18 nt, Salmonella typhimurium LT2
cucaacacauaacgcccg

SEQ ID NO: 1864318 - RNA, 13 nt, Salmonella typhimurium LT2
cuauuaaucaccu

SEQ ID NO: 1864319 - RNA, 14 nt, Salmonella typhimurium LT2
cucaagcgccgccg

SEQ ID NO: 1864320 - RNA, 15 nt, Salmonella typhimurium LT2
cucaagcgccgccgc

SEQ ID NO: 1864321 - RNA, 16 nt, Salmonella typhimurium LT2
cucaagcggcaccaca

SEQ ID NO: 1864322 - RNA, 22 nt, Salmonella typhimurium LT2
cucaaggcaauagaccagcggc

SEQ ID NO: 1864323 - RNA, 20 nt, Salmonella typhimurium LT2
cucaacugcgggaaguagca

SEQ ID NO: 1864324 - RNA, 23 nt, Salmonella typhimurium LT2
cucaacgcgcccagauuggugau

SEQ ID NO: 1864325 - RNA, 18 nt, Salmonella typhimurium LT2
cucaacgcguucauccag

SEQ ID NO: 1864326 - RNA, 15 nt, Salmonella typhimurium LT2
cucaacgcccugcuc

SEQ ID NO: 1864327 - RNA, 13 nt, Salmonella typhimurium LT2
cucauccagcaac

SEQ ID NO: 1864328 - RNA, 17 nt, Salmonella typhimurium LT2
cucauccagcaaaauaa

SEQ ID NO: 1864329 - RNA, 22 nt, Salmonella typhimurium LT2
cucaucagccugaaagauuauu

SEQ ID NO: 1864330 - RNA, 21 nt, Salmonella typhimurium LT2
cucaucaauggauuuauggca

SEQ ID NO: 1864331 - RNA, 13 nt, Salmonella typhimurium LT2
cucaucacagcca

SEQ ID NO: 1864332 - RNA, 16 nt, Salmonella typhimurium LT2
cucauauuccagccac

SEQ ID NO: 1864333 - RNA, 18 nt, Salmonella typhimurium LT2
cucaucuuuuacaggccg

SEQ ID NO: 1864334 - RNA, 18 nt, Salmonella typhimurium LT2
cucaucugaugauuaauu

SEQ ID NO: 1864335 - RNA, 16 nt, Salmonella typhimurium LT2
cucaucggaaaaauag

SEQ ID NO: 1864336 - RNA, 15 nt, Salmonella typhimurium LT2
cucaucccccagccg

SEQ ID NO: 1864337 - RNA, 15 nt, Salmonella typhimurium LT2
cucauccgcugacac

SEQ ID NO: 1864338 - RNA, 13 nt, Salmonella typhimurium LT2
cucauacccuucc

SEQ ID NO: 1864339 - RNA, 15 nt, Salmonella typhimurium LT2
cucauacccuuccag

SEQ ID NO: 1864340 - RNA, 20 nt, Salmonella typhimurium LT2
cucauaccgccgcccagcac

SEQ ID NO: 1864341 - RNA, 16 nt, Salmonella typhimurium LT2
cucauagccgcuuucc

SEQ ID NO: 1864342 - RNA, 23 nt, Salmonella typhimurium LT2
cucauaccuggcuugauguaguc

SEQ ID NO: 1864343 - RNA, 19 nt, Salmonella typhimurium LT2
cucauaaauagccagcauc

SEQ ID NO: 1864344 - RNA, 17 nt, Salmonella typhimurium LT2
cucauaacccuccugcc

SEQ ID NO: 1864345 - RNA, 14 nt, Salmonella typhimurium LT2
cucagucagucccg

SEQ ID NO: 1864346 - RNA, 20 nt, Salmonella typhimurium LT2
cucaguccagccgccgcgcg

SEQ ID NO: 1864347 - RNA, 14 nt, Salmonella typhimurium LT2
cucaguuuccagcc

SEQ ID NO: 1864348 - RNA, 16 nt, Salmonella typhimurium LT2
cucaguugcguuccca

SEQ ID NO: 1864349 - RNA, 18 nt, Salmonella typhimurium LT2
cucaguugcguucccagu

SEQ ID NO: 1864350 - RNA, 16 nt, Salmonella typhimurium LT2
cucaguucauuauuuc

SEQ ID NO: 1864351 - RNA, 22 nt, Salmonella typhimurium LT2
cucagguuauacugugacgaca

SEQ ID NO: 1864352 - RNA, 18 nt, Salmonella typhimurium LT2
cucagguucgggccaccu

SEQ ID NO: 1864353 - RNA, 17 nt, Salmonella typhimurium LT2
cucagggugacagaaga

SEQ ID NO: 1864354 - RNA, 17 nt, Salmonella typhimurium LT2
cucagggucagaauaca

SEQ ID NO: 1864355 - RNA, 13 nt, Salmonella typhimurium LT2
cucagggcaaagu

SEQ ID NO: 1864356 - RNA, 18 nt, Salmonella typhimurium LT2
cucagggcgaaaaugauc

SEQ ID NO: 1864357 - RNA, 22 nt, Salmonella typhimurium LT2
cucaggcggggaguggugaucg

SEQ ID NO: 1864358 - RNA, 24 nt, Salmonella typhimurium LT2
cucagcaaaaucacgcacacgucu

SEQ ID NO: 1864359 - RNA, 13 nt, Salmonella typhimurium LT2
cuccgccccgccu

SEQ ID NO: 1864360 - RNA, 15 nt, Salmonella typhimurium LT2
cuccgcaauuuccug

SEQ ID NO: 1864361 - RNA, 13 nt, Salmonella typhimurium LT2
cuccgcagcuuca

SEQ ID NO: 1864362 - RNA, 18 nt, Salmonella typhimurium LT2
cuccgcagcuucaucauu

SEQ ID NO: 1864363 - RNA, 17 nt, Salmonella typhimurium LT2
cucccuuucuucucaac

SEQ ID NO: 1864364 - RNA, 21 nt, Salmonella typhimurium LT2
cucccuuugacaaccugccgu

SEQ ID NO: 1864365 - RNA, 16 nt, Salmonella typhimurium LT2
cuccgcccggugcuca

SEQ ID NO: 1864366 - RNA, 14 nt, Salmonella typhimurium LT2
cuccgccugcgguu

SEQ ID NO: 1864367 - RNA, 20 nt, Salmonella typhimurium LT2
cuccgccuggaacccaggca

SEQ ID NO: 1864368 - RNA, 14 nt, Salmonella typhimurium LT2
cuccgcgcauguaa

SEQ ID NO: 1864369 - RNA, 19 nt, Salmonella typhimurium LT2
cuccgcgcauguaaccaaa

SEQ ID NO: 1864370 - RNA, 14 nt, Salmonella typhimurium LT2
cuccgcgcuggcaa

SEQ ID NO: 1864371 - RNA, 13 nt, Salmonella typhimurium LT2
cuccgcgcuggca

SEQ ID NO: 1864372 - RNA, 15 nt, Salmonella typhimurium LT2
cuccgcgcuggcaau

SEQ ID NO: 1864373 - RNA, 15 nt, Salmonella typhimurium LT2
cuccggcaagccugu

SEQ ID NO: 1864374 - RNA, 16 nt, Salmonella typhimurium LT2
cucccgcagccacucc

SEQ ID NO: 1864375 - RNA, 21 nt, Salmonella typhimurium LT2
cucccgcgucacgaccggcga

SEQ ID NO: 1864376 - RNA, 18 nt, Salmonella typhimurium LT2
cucccuggcagugaucca

SEQ ID NO: 1864377 - RNA, 23 nt, Salmonella typhimurium LT2
cuccccuguuugcaucacgcgcu

SEQ ID NO: 1864378 - RNA, 23 nt, Salmonella typhimurium LT2
cucccaggccgccaccgccucgc

SEQ ID NO: 1864379 - RNA, 20 nt, Salmonella typhimurium LT2
cucccacucuuccagcaccg

SEQ ID NO: 1864380 - RNA, 18 nt, Salmonella typhimurium LT2
cucccacugccguagcgc

SEQ ID NO: 1864381 - RNA, 23 nt, Salmonella typhimurium LT2
cucccaacagacgaucuacggua

SEQ ID NO: 1864382 - RNA, 13 nt, Salmonella typhimurium LT2
cucccacauuuca

SEQ ID NO: 1864383 - RNA, 20 nt, Salmonella typhimurium LT2
cuccagcgccucggcgccca

SEQ ID NO: 1864384 - RNA, 14 nt, Salmonella typhimurium LT2
cuccagcgccugcu

SEQ ID NO: 1864385 - RNA, 19 nt, Salmonella typhimurium LT2
cuccagcguggcagugagc

SEQ ID NO: 1864386 - RNA, 16 nt, Salmonella typhimurium LT2
cuccagcuggcuggca

SEQ ID NO: 1864387 - RNA, 12 nt, Salmonella typhimurium LT2
cuccagcuggcu

SEQ ID NO: 1864388 - RNA, 16 nt, Salmonella typhimurium LT2
cuccaggccaagcgcc

SEQ ID NO: 1864389 - RNA, 21 nt, Salmonella typhimurium LT2
cucaugcuuaucgccaaacca

SEQ ID NO: 1864390 - RNA, 23 nt, Salmonella typhimurium LT2
cucauggcgaacucuuccagauc

SEQ ID NO: 1864391 - RNA, 21 nt, Salmonella typhimurium LT2
cucaugugcagcauccagcuc

SEQ ID NO: 1864392 - RNA, 16 nt, Salmonella typhimurium LT2
cucaugugcagcaucc

SEQ ID NO: 1864393 - RNA, 12 nt, Salmonella typhimurium LT2
cuccaguugaua

SEQ ID NO: 1864394 - RNA, 15 nt, Salmonella typhimurium LT2
cuccaguuucgccag

SEQ ID NO: 1864395 - RNA, 21 nt, Salmonella typhimurium LT2
cuccaguuucgccagcggcag

SEQ ID NO: 1864396 - RNA, 23 nt, Salmonella typhimurium LT2
cuccauaauuugaaucgccuggc

SEQ ID NO: 1864397 - RNA, 20 nt, Salmonella typhimurium LT2
cuccauacccuauuuacaga

SEQ ID NO: 1864398 - RNA, 19 nt, Salmonella typhimurium LT2
cuccaggcgaauccccauc

SEQ ID NO: 1864399 - RNA, 16 nt, Salmonella typhimurium LT2
cuccaggcgcugcugg

SEQ ID NO: 1864400 - RNA, 21 nt, Salmonella typhimurium LT2
cuccagggcaacggccagcgc

SEQ ID NO: 1864401 - RNA, 17 nt, Salmonella typhimurium LT2
cuccaguaauucccggc

SEQ ID NO: 1864402 - RNA, 18 nt, Salmonella typhimurium LT2
cuccugcgauagcugcug

SEQ ID NO: 1864403 - RNA, 20 nt, Salmonella typhimurium LT2
cuccugccagauuuucuuua

SEQ ID NO: 1864404 - RNA, 22 nt, Salmonella typhimurium LT2
cuccugaauagcuuucaccggu

SEQ ID NO: 1864405 - RNA, 22 nt, Salmonella typhimurium LT2
cuccugaaucgccgucagugag

SEQ ID NO: 1864406 - RNA, 18 nt, Salmonella typhimurium LT2
cuccugaagccagcgccc

SEQ ID NO: 1864407 - RNA, 21 nt, Salmonella typhimurium LT2
cuccugauaaccuauuuugca

SEQ ID NO: 1864408 - RNA, 21 nt, Salmonella typhimurium LT2
cuccugcaaucgcucuugcac

SEQ ID NO: 1864409 - RNA, 18 nt, Salmonella typhimurium LT2
cuccuggcuuaccugcuc

SEQ ID NO: 1864410 - RNA, 15 nt, Salmonella typhimurium LT2
cuccugugaagacau

SEQ ID NO: 1864411 - RNA, 11 nt, Salmonella typhimurium LT2
cuccugcuccu

SEQ ID NO: 1864412 - RNA, 14 nt, Salmonella typhimurium LT2
cuccggcagcgaau

SEQ ID NO: 1864413 - RNA, 11 nt, Salmonella typhimurium LT2
cuccucugcca

SEQ ID NO: 1864414 - RNA, 18 nt, Salmonella typhimurium LT2
cuccucucuuccuccuga

SEQ ID NO: 1864415 - RNA, 16 nt, Salmonella typhimurium LT2
cucgaaacgcugcgcu

SEQ ID NO: 1864416 - RNA, 16 nt, Salmonella typhimurium LT2
cuccuucuucgccguc

SEQ ID NO: 1864417 - RNA, 16 nt, Salmonella typhimurium LT2
cucgacguccagcgcg

SEQ ID NO: 1864418 - RNA, 19 nt, Salmonella typhimurium LT2
cucgacauagguucugcga

SEQ ID NO: 1864419 - RNA, 21 nt, Salmonella typhimurium LT2
cucgacguuuuccaucaccau

SEQ ID NO: 1864420 - RNA, 19 nt, Salmonella typhimurium LT2
cucgacuaaaggcagcgcg

SEQ ID NO: 1864421 - RNA, 20 nt, Salmonella typhimurium LT2
cucgaggaacuguucagcca

SEQ ID NO: 1864422 - RNA, 20 nt, Salmonella typhimurium LT2
cucgauaaucccggcgcgcg

SEQ ID NO: 1864423 - RNA, 23 nt, Salmonella typhimurium LT2
cucuccaguuugcguucacagca

SEQ ID NO: 1864424 - RNA, 18 nt, Salmonella typhimurium LT2
cucuccgcaauuaauuua

SEQ ID NO: 1864425 - RNA, 22 nt, Salmonella typhimurium LT2
cucuccgccgcgggcagcagca

SEQ ID NO: 1864426 - RNA, 12 nt, Salmonella typhimurium LT2
cucuccgccugc

SEQ ID NO: 1864427 - RNA, 21 nt, Salmonella typhimurium LT2
cucuccuacaccaccagcccg

SEQ ID NO: 1864428 - RNA, 18 nt, Salmonella typhimurium LT2
cucuauaccauaaaugaa

SEQ ID NO: 1864429 - RNA, 13 nt, Salmonella typhimurium LT2
cucuauaguaaau

SEQ ID NO: 1864430 - RNA, 21 nt, Salmonella typhimurium LT2
cucgucggcaagaauuucaau

SEQ ID NO: 1864431 - RNA, 13 nt, Salmonella typhimurium LT2
cucgucgcgcgcc

SEQ ID NO: 1864432 - RNA, 15 nt, Salmonella typhimurium LT2
cucuaucggcaaacc

SEQ ID NO: 1864433 - RNA, 21 nt, Salmonella typhimurium LT2
cucuauccggaggccuucuug

SEQ ID NO: 1864434 - RNA, 18 nt, Salmonella typhimurium LT2
cucuaugaaugccggaug

SEQ ID NO: 1864435 - RNA, 12 nt, Salmonella typhimurium LT2
cucucaacauaa

SEQ ID NO: 1864436 - RNA, 16 nt, Salmonella typhimurium LT2
cucuauuugcauagaa

SEQ ID NO: 1864437 - RNA, 15 nt, Salmonella typhimurium LT2
cucuauuaaaauaaa

SEQ ID NO: 1864438 - RNA, 21 nt, Salmonella typhimurium LT2
cucugcaaagaaauugggcuu

SEQ ID NO: 1864439 - RNA, 19 nt, Salmonella typhimurium LT2
cucugagaacuauuugccu

SEQ ID NO: 1864440 - RNA, 22 nt, Salmonella typhimurium LT2
cucugaggguguucaugcgacu

SEQ ID NO: 1864441 - RNA, 20 nt, Salmonella typhimurium LT2
cucugccgguuggccggccc

SEQ ID NO: 1864442 - RNA, 18 nt, Salmonella typhimurium LT2
cucugcccccgagccaga

SEQ ID NO: 1864443 - RNA, 22 nt, Salmonella typhimurium LT2
cucugcgcguaaacgcaacacc

SEQ ID NO: 1864444 - RNA, 21 nt, Salmonella typhimurium LT2
cucucuuucgguagccacaga

SEQ ID NO: 1864445 - RNA, 21 nt, Salmonella typhimurium LT2
cucugaaaaauuuuccuggaa

SEQ ID NO: 1864446 - RNA, 21 nt, Salmonella typhimurium LT2
cucucuggcgcauuccagacc

SEQ ID NO: 1864447 - RNA, 16 nt, Salmonella typhimurium LT2
cucucuuuaaucaccc

SEQ ID NO: 1864448 - RNA, 19 nt, Salmonella typhimurium LT2
cucucgccacgcuccauca

SEQ ID NO: 1864449 - RNA, 17 nt, Salmonella typhimurium LT2
cucucgcggucggcgca

SEQ ID NO: 1864450 - RNA, 21 nt, Salmonella typhimurium LT2
cucggcauacaccgccagcgu

SEQ ID NO: 1864451 - RNA, 16 nt, Salmonella typhimurium LT2
cucggcaccauuggcg

SEQ ID NO: 1864452 - RNA, 16 nt, Salmonella typhimurium LT2
cucggauagcuacgau

SEQ ID NO: 1864453 - RNA, 13 nt, Salmonella typhimurium LT2
cucggccuauaga

SEQ ID NO: 1864454 - RNA, 16 nt, Salmonella typhimurium LT2
cucgcuuacgcggcgc

SEQ ID NO: 1864455 - RNA, 22 nt, Salmonella typhimurium LT2
cucgcuuaaugaggccaccagu

SEQ ID NO: 1864456 - RNA, 17 nt, Salmonella typhimurium LT2
cucgcuuugccgccauc

SEQ ID NO: 1864457 - RNA, 17 nt, Salmonella typhimurium LT2
cucggacgaaaaaugaa

SEQ ID NO: 1864458 - RNA, 17 nt, Salmonella typhimurium LT2
cucgcucgcccaucacu

SEQ ID NO: 1864459 - RNA, 15 nt, Salmonella typhimurium LT2
cucgucgccagggcg

SEQ ID NO: 1864460 - RNA, 20 nt, Salmonella typhimurium LT2
cucggcgagcaguacgccug

SEQ ID NO: 1864461 - RNA, 20 nt, Salmonella typhimurium LT2
cguccuucacguuauucgga

SEQ ID NO: 1864462 - RNA, 15 nt, Salmonella typhimurium LT2
cguccugcccgccac

SEQ ID NO: 1864463 - RNA, 15 nt, Salmonella typhimurium LT2
cgucgaaugacgcgc

SEQ ID NO: 1864464 - RNA, 20 nt, Salmonella typhimurium LT2
cgucgacaaagccaacgccg

SEQ ID NO: 1864465 - RNA, 21 nt, Salmonella typhimurium LT2
cgucgacaaagccaacgccgc

SEQ ID NO: 1864466 - RNA, 14 nt, Salmonella typhimurium LT2
cgucgacccgcccc

SEQ ID NO: 1864467 - RNA, 14 nt, Salmonella typhimurium LT2
cgucgagacggugu

SEQ ID NO: 1864468 - RNA, 13 nt, Salmonella typhimurium LT2
cgucgagcgccgu

SEQ ID NO: 1864469 - RNA, 14 nt, Salmonella typhimurium LT2
cgucgagcagcagg

SEQ ID NO: 1864470 - RNA, 15 nt, Salmonella typhimurium LT2
cgucgaugugaaucc

SEQ ID NO: 1864471 - RNA, 22 nt, Salmonella typhimurium LT2
cgucgaugugaauccaggccag

SEQ ID NO: 1864472 - RNA, 16 nt, Salmonella typhimurium LT2
cguccauuacucucau

SEQ ID NO: 1864473 - RNA, 16 nt, Salmonella typhimurium LT2
cguccauaagcgcggc

SEQ ID NO: 1864474 - RNA, 14 nt, Salmonella typhimurium LT2
cguccauccgggua

SEQ ID NO: 1864475 - RNA, 23 nt, Salmonella typhimurium LT2
cguccaguccugccccugccagc

SEQ ID NO: 1864476 - RNA, 12 nt, Salmonella typhimurium LT2
cguccaggcucg

SEQ ID NO: 1864477 - RNA, 14 nt, Salmonella typhimurium LT2
cguccagggugaac

SEQ ID NO: 1864478 - RNA, 11 nt, Salmonella typhimurium LT2
cguccagcggc

SEQ ID NO: 1864479 - RNA, 19 nt, Salmonella typhimurium LT2
cguccagcgcgugaaccgu

SEQ ID NO: 1864480 - RNA, 16 nt, Salmonella typhimurium LT2
cguccagcccggcgga

SEQ ID NO: 1864481 - RNA, 18 nt, Salmonella typhimurium LT2
cgucauauagccgcgcag

SEQ ID NO: 1864482 - RNA, 19 nt, Salmonella typhimurium LT2
cguccgggccugauaagca

SEQ ID NO: 1864483 - RNA, 21 nt, Salmonella typhimurium LT2
cguccuaggacgaaaaaugaa

SEQ ID NO: 1864484 - RNA, 20 nt, Salmonella typhimurium LT2
cgucccaccacgcagccaug

SEQ ID NO: 1864485 - RNA, 23 nt, Salmonella typhimurium LT2
cgucccaccacgcagccauguaa

SEQ ID NO: 1864486 - RNA, 23 nt, Salmonella typhimurium LT2
cgucccacgcgccgccgaacaga

SEQ ID NO: 1864487 - RNA, 16 nt, Salmonella typhimurium LT2
cguccggaaaauccuc

SEQ ID NO: 1864488 - RNA, 18 nt, Salmonella typhimurium LT2
cguccccagccagagauc

SEQ ID NO: 1864489 - RNA, 17 nt, Salmonella typhimurium LT2
cguagugcuucucuuca

SEQ ID NO: 1864490 - RNA, 22 nt, Salmonella typhimurium LT2
cguaguuuauucuucuccucuu

SEQ ID NO: 1864491 - RNA, 18 nt, Salmonella typhimurium LT2
cguaugcagccaggccau

SEQ ID NO: 1864492 - RNA, 15 nt, Salmonella typhimurium LT2
cguauaauccagcuu

SEQ ID NO: 1864493 - RNA, 18 nt, Salmonella typhimurium LT2
cgucaaaacuuauuuuau

SEQ ID NO: 1864494 - RNA, 20 nt, Salmonella typhimurium LT2
cgucaaaauaagcaccggcg

SEQ ID NO: 1864495 - RNA, 15 nt, Salmonella typhimurium LT2
cgucaaacaguucag

SEQ ID NO: 1864496 - RNA, 12 nt, Salmonella typhimurium LT2
cgucaaaacagg

SEQ ID NO: 1864497 - RNA, 16 nt, Salmonella typhimurium LT2
cgucaaaacagauucc

SEQ ID NO: 1864498 - RNA, 17 nt, Salmonella typhimurium LT2
cgucaaacaguucagac

SEQ ID NO: 1864499 - RNA, 19 nt, Salmonella typhimurium LT2
cgucaaagaguuccugugc

SEQ ID NO: 1864500 - RNA, 12 nt, Salmonella typhimurium LT2
cguauucccccu

SEQ ID NO: 1864501 - RNA, 19 nt, Salmonella typhimurium LT2
cguauuccacggaauacga

SEQ ID NO: 1864502 - RNA, 13 nt, Salmonella typhimurium LT2
cguauuagauaag

SEQ ID NO: 1864503 - RNA, 20 nt, Salmonella typhimurium LT2
cguauggcauccuaacuggg

SEQ ID NO: 1864504 - RNA, 14 nt, Salmonella typhimurium LT2
cguaugguucaggu

SEQ ID NO: 1864505 - RNA, 19 nt, Salmonella typhimurium LT2
cguaugcugauaaagagca

SEQ ID NO: 1864506 - RNA, 17 nt, Salmonella typhimurium LT2
cguaauauacgccaccu

SEQ ID NO: 1864507 - RNA, 19 nt, Salmonella typhimurium LT2
cguaauaugggcacaaccc

SEQ ID NO: 1864508 - RNA, 13 nt, Salmonella typhimurium LT2
cguagcgcaucuc

SEQ ID NO: 1864509 - RNA, 19 nt, Salmonella typhimurium LT2
cguagcgccauccggcaau

SEQ ID NO: 1864510 - RNA, 18 nt, Salmonella typhimurium LT2
cguagcgagaaggcuuuu

SEQ ID NO: 1864511 - RNA, 19 nt, Salmonella typhimurium LT2
cguagcgaauaaucccggc

SEQ ID NO: 1864512 - RNA, 21 nt, Salmonella typhimurium LT2
cguaaucuuuucauauuauuu

SEQ ID NO: 1864513 - RNA, 19 nt, Salmonella typhimurium LT2
cguagcggucacccggcac

SEQ ID NO: 1864514 - RNA, 20 nt, Salmonella typhimurium LT2
cguaguagguauccagcaga

SEQ ID NO: 1864515 - RNA, 14 nt, Salmonella typhimurium LT2
cgucaaugcccggc

SEQ ID NO: 1864516 - RNA, 21 nt, Salmonella typhimurium LT2
cgucacaauaucgagaugacc

SEQ ID NO: 1864517 - RNA, 14 nt, Salmonella typhimurium LT2
cgucacagaccccg

SEQ ID NO: 1864518 - RNA, 22 nt, Salmonella typhimurium LT2
cgucacaggcuucgacaaacag

SEQ ID NO: 1864519 - RNA, 20 nt, Salmonella typhimurium LT2
cgucaccaccgcaggcagcg

SEQ ID NO: 1864520 - RNA, 15 nt, Salmonella typhimurium LT2
cgucaccacgcgcac

SEQ ID NO: 1864521 - RNA, 13 nt, Salmonella typhimurium LT2
cgucaauaacagg

SEQ ID NO: 1864522 - RNA, 19 nt, Salmonella typhimurium LT2
cgucaauaaagccgcccau

SEQ ID NO: 1864523 - RNA, 15 nt, Salmonella typhimurium LT2
cgucagcgcgcgcuu

SEQ ID NO: 1864524 - RNA, 21 nt, Salmonella typhimurium LT2
cgucagugagcccuccuccag

SEQ ID NO: 1864525 - RNA, 15 nt, Salmonella typhimurium LT2
cgucauaacgcgcau

SEQ ID NO: 1864526 - RNA, 24 nt, Salmonella typhimurium LT2
cgucagcacuucccacuguaaauu

SEQ ID NO: 1864527 - RNA, 20 nt, Salmonella typhimurium LT2
cgucagccacuucuuccagc

SEQ ID NO: 1864528 - RNA, 13 nt, Salmonella typhimurium LT2
cgucagcauggua

SEQ ID NO: 1864529 - RNA, 21 nt, Salmonella typhimurium LT2
cgucacgccgacgacaggcag

SEQ ID NO: 1864530 - RNA, 12 nt, Salmonella typhimurium LT2
cgucacgcggcu

SEQ ID NO: 1864531 - RNA, 15 nt, Salmonella typhimurium LT2
cgucacgguuuaucc

SEQ ID NO: 1864532 - RNA, 19 nt, Salmonella typhimurium LT2
cgucacgguuuauccccgc

SEQ ID NO: 1864533 - RNA, 21 nt, Salmonella typhimurium LT2
cgucacgguuuauccccgcug

SEQ ID NO: 1864534 - RNA, 20 nt, Salmonella typhimurium LT2
cggugcuguagcugcccgga

SEQ ID NO: 1864535 - RNA, 19 nt, Salmonella typhimurium LT2
cggugucaaagcgccagau

SEQ ID NO: 1864536 - RNA, 16 nt, Salmonella typhimurium LT2
cggugcucaauaaaag

SEQ ID NO: 1864537 - RNA, 14 nt, Salmonella typhimurium LT2
cggugcucuuuugu

SEQ ID NO: 1864538 - RNA, 17 nt, Salmonella typhimurium LT2
cggugcggcaagcgcgc

SEQ ID NO: 1864539 - RNA, 22 nt, Salmonella typhimurium LT2
cggugcgagaaaaagcaauaau

SEQ ID NO: 1864540 - RNA, 19 nt, Salmonella typhimurium LT2
cggugccauuccagccggu

SEQ ID NO: 1864541 - RNA, 23 nt, Salmonella typhimurium LT2
cggugaugaucaauaacgccggu

SEQ ID NO: 1864542 - RNA, 15 nt, Salmonella typhimurium LT2
cggugaggggggauu

SEQ ID NO: 1864543 - RNA, 17 nt, Salmonella typhimurium LT2
cguaacuguugccccgc

SEQ ID NO: 1864544 - RNA, 19 nt, Salmonella typhimurium LT2
cguaacuggauuccuggcu

SEQ ID NO: 1864545 - RNA, 14 nt, Salmonella typhimurium LT2
cguaagaucccagg

SEQ ID NO: 1864546 - RNA, 19 nt, Salmonella typhimurium LT2
cguaagaucgcgaggcaac

SEQ ID NO: 1864547 - RNA, 16 nt, Salmonella typhimurium LT2
cguaacuuauccacgc

SEQ ID NO: 1864548 - RNA, 17 nt, Salmonella typhimurium LT2
cguaagccacugcccag

SEQ ID NO: 1864549 - RNA, 22 nt, Salmonella typhimurium LT2
cguaacgccgucggcagccaga

SEQ ID NO: 1864550 - RNA, 20 nt, Salmonella typhimurium LT2
cguaacgugcuccagcgccu

SEQ ID NO: 1864551 - RNA, 21 nt, Salmonella typhimurium LT2
cguaacugcgguaaauaaugc

SEQ ID NO: 1864552 - RNA, 15 nt, Salmonella typhimurium LT2
cguaacucggcagcg

SEQ ID NO: 1864553 - RNA, 18 nt, Salmonella typhimurium LT2
cguaacagacgcaucuuu

SEQ ID NO: 1864554 - RNA, 14 nt, Salmonella typhimurium LT2
cguaaccggccagc

SEQ ID NO: 1864555 - RNA, 21 nt, Salmonella typhimurium LT2
cguaaauaccaccugccaaag

SEQ ID NO: 1864556 - RNA, 14 nt, Salmonella typhimurium LT2
cguaaauacccagg

SEQ ID NO: 1864557 - RNA, 17 nt, Salmonella typhimurium LT2
cguaaauaccuuccggc

SEQ ID NO: 1864558 - RNA, 17 nt, Salmonella typhimurium LT2
cguaaaucugaaauaaa

SEQ ID NO: 1864559 - RNA, 17 nt, Salmonella typhimurium LT2
cguaaaaaaacaucaua

SEQ ID NO: 1864560 - RNA, 13 nt, Salmonella typhimurium LT2
cgguuuugcgcug

SEQ ID NO: 1864561 - RNA, 20 nt, Salmonella typhimurium LT2
cgguuugggcgcgaaacugc

SEQ ID NO: 1864562 - RNA, 21 nt, Salmonella typhimurium LT2
cgguuuuauccccuucaggaa

SEQ ID NO: 1864563 - RNA, 22 nt, Salmonella typhimurium LT2
cgguuuuauccccuucaggaau

SEQ ID NO: 1864564 - RNA, 17 nt, Salmonella typhimurium LT2
cgguuuuauccccuuca

SEQ ID NO: 1864565 - RNA, 15 nt, Salmonella typhimurium LT2
cgguuuuaacaaccc

SEQ ID NO: 1864566 - RNA, 18 nt, Salmonella typhimurium LT2
cguaaacacguuaucuga

SEQ ID NO: 1864567 - RNA, 16 nt, Salmonella typhimurium LT2
cguaaacggcagccgc

SEQ ID NO: 1864568 - RNA, 19 nt, Salmonella typhimurium LT2
cguaaaagcgauaaagaca

SEQ ID NO: 1864569 - RNA, 14 nt, Salmonella typhimurium LT2
cguaaaagacgaag

SEQ ID NO: 1864570 - RNA, 21 nt, Salmonella typhimurium LT2
cgguuucuacuuccaccaccu

SEQ ID NO: 1864571 - RNA, 14 nt, Salmonella typhimurium LT2
cgguuuccauggca

SEQ ID NO: 1864572 - RNA, 15 nt, Salmonella typhimurium LT2
cgguuucaguucgua

SEQ ID NO: 1864573 - RNA, 16 nt, Salmonella typhimurium LT2
cgguuuagccgccaga

SEQ ID NO: 1864574 - RNA, 19 nt, Salmonella typhimurium LT2
cgguuuauaccgaaacagu

SEQ ID NO: 1864575 - RNA, 18 nt, Salmonella typhimurium LT2
cgguugccuuucgccagc

SEQ ID NO: 1864576 - RNA, 19 nt, Salmonella typhimurium LT2
cgguuggaucucaccacug

SEQ ID NO: 1864577 - RNA, 22 nt, Salmonella typhimurium LT2
cgguugucaaauuugcugccau

SEQ ID NO: 1864578 - RNA, 17 nt, Salmonella typhimurium LT2
cgguuggccuacaagau

SEQ ID NO: 1864579 - RNA, 13 nt, Salmonella typhimurium LT2
cgguucauccugc

SEQ ID NO: 1864580 - RNA, 14 nt, Salmonella typhimurium LT2
cgguucauccugcg

SEQ ID NO: 1864581 - RNA, 11 nt, Salmonella typhimurium LT2
cgguuaacaua

SEQ ID NO: 1864582 - RNA, 14 nt, Salmonella typhimurium LT2
cgguucgccgcgcg

SEQ ID NO: 1864583 - RNA, 22 nt, Salmonella typhimurium LT2
cgguucgccgcagccuaguucu

SEQ ID NO: 1864584 - RNA, 13 nt, Salmonella typhimurium LT2
cgucuucaucuuc

SEQ ID NO: 1864585 - RNA, 18 nt, Salmonella typhimurium LT2
cgucuucaucguucauug

SEQ ID NO: 1864586 - RNA, 13 nt, Salmonella typhimurium LT2
cgucuuuuuccag

SEQ ID NO: 1864587 - RNA, 22 nt, Salmonella typhimurium LT2
cgugaacacacccuucucaggg

SEQ ID NO: 1864588 - RNA, 16 nt, Salmonella typhimurium LT2
cgugaaccagcauccc

SEQ ID NO: 1864589 - RNA, 19 nt, Salmonella typhimurium LT2
cgugaaccagcaucccacg

SEQ ID NO: 1864590 - RNA, 21 nt, Salmonella typhimurium LT2
cgugaaccgaaauccaccagc

SEQ ID NO: 1864591 - RNA, 22 nt, Salmonella typhimurium LT2
cgugaaccgaaauccaccagcg

SEQ ID NO: 1864592 - RNA, 23 nt, Salmonella typhimurium LT2
cgugacgccuuccuccaguaauu

SEQ ID NO: 1864593 - RNA, 20 nt, Salmonella typhimurium LT2
cgugaccgauaaaaaagccu

SEQ ID NO: 1864594 - RNA, 18 nt, Salmonella typhimurium LT2
cgucucuuucauggaaau

SEQ ID NO: 1864595 - RNA, 22 nt, Salmonella typhimurium LT2
cgucugaguauacagacagcag

SEQ ID NO: 1864596 - RNA, 14 nt, Salmonella typhimurium LT2
cgucuguuguucuu

SEQ ID NO: 1864597 - RNA, 15 nt, Salmonella typhimurium LT2
cgucuuauccggccu

SEQ ID NO: 1864598 - RNA, 16 nt, Salmonella typhimurium LT2
cgucuuauccggccuc

SEQ ID NO: 1864599 - RNA, 17 nt, Salmonella typhimurium LT2
cgucuuauccggccugc

SEQ ID NO: 1864600 - RNA, 15 nt, Salmonella typhimurium LT2
cgucgcgacguccgc

SEQ ID NO: 1864601 - RNA, 15 nt, Salmonella typhimurium LT2
cgucgcgaucacaga

SEQ ID NO: 1864602 - RNA, 17 nt, Salmonella typhimurium LT2
cgucgcgcauggcaggg

SEQ ID NO: 1864603 - RNA, 18 nt, Salmonella typhimurium LT2
cgucucugagaucaaaca

SEQ ID NO: 1864604 - RNA, 18 nt, Salmonella typhimurium LT2
cgucgccuguccggccug

SEQ ID NO: 1864605 - RNA, 21 nt, Salmonella typhimurium LT2
cgucgccuguuucugcgccgc

SEQ ID NO: 1864606 - RNA, 22 nt, Salmonella typhimurium LT2
cgucgccuguuucugcgccgcu

SEQ ID NO: 1864607 - RNA, 15 nt, Salmonella typhimurium LT2
cgucgcgaagcugug

SEQ ID NO: 1864608 - RNA, 16 nt, Salmonella typhimurium LT2
cgucgccguuaagauc

SEQ ID NO: 1864609 - RNA, 15 nt, Salmonella typhimurium LT2
cgugcgccguccugc

SEQ ID NO: 1864610 - RNA, 23 nt, Salmonella typhimurium LT2
cgugcgcggcacacuuucaucag

SEQ ID NO: 1864611 - RNA, 17 nt, Salmonella typhimurium LT2
cgugcggcggacgccgg

SEQ ID NO: 1864612 - RNA, 17 nt, Salmonella typhimurium LT2
cgugcggcggccucuuc

SEQ ID NO: 1864613 - RNA, 20 nt, Salmonella typhimurium LT2
cgugcgguauaucacgccau

SEQ ID NO: 1864614 - RNA, 22 nt, Salmonella typhimurium LT2
cgugcaugggauacgccagcag

SEQ ID NO: 1864615 - RNA, 16 nt, Salmonella typhimurium LT2
cgugcauuaaaauaau

SEQ ID NO: 1864616 - RNA, 13 nt, Salmonella typhimurium LT2
cgugcacgcugcg

SEQ ID NO: 1864617 - RNA, 19 nt, Salmonella typhimurium LT2
cgugauaaagcugacgcgc

SEQ ID NO: 1864618 - RNA, 22 nt, Salmonella typhimurium LT2
cgugauaggagagcagaagcac

SEQ ID NO: 1864619 - RNA, 20 nt, Salmonella typhimurium LT2
cgugauaaagguauagugga

SEQ ID NO: 1864620 - RNA, 20 nt, Salmonella typhimurium LT2
cgugagugguagaaacuggc

SEQ ID NO: 1864621 - RNA, 14 nt, Salmonella typhimurium LT2
cgugaucgaggcgc

SEQ ID NO: 1864622 - RNA, 18 nt, Salmonella typhimurium LT2
cgugcaacgucaugaccg

SEQ ID NO: 1864623 - RNA, 19 nt, Salmonella typhimurium LT2
cgugcaagggaaggcgccc

SEQ ID NO: 1864624 - RNA, 22 nt, Salmonella typhimurium LT2
cguggcguuuucauuagccgcc

SEQ ID NO: 1864625 - RNA, 13 nt, Salmonella typhimurium LT2
cgugggaagcagc

SEQ ID NO: 1864626 - RNA, 15 nt, Salmonella typhimurium LT2
cgugggaagcagcag

SEQ ID NO: 1864627 - RNA, 15 nt, Salmonella typhimurium LT2
cguggcguaucggca

SEQ ID NO: 1864628 - RNA, 18 nt, Salmonella typhimurium LT2
cguggcgcugggccgacg

SEQ ID NO: 1864629 - RNA, 13 nt, Salmonella typhimurium LT2
cgugguaaaaagc

SEQ ID NO: 1864630 - RNA, 22 nt, Salmonella typhimurium LT2
cgugguaaagaagccgccgcca

SEQ ID NO: 1864631 - RNA, 13 nt, Salmonella typhimurium LT2
cguggggguucaa

SEQ ID NO: 1864632 - RNA, 16 nt, Salmonella typhimurium LT2
cguggggguucaaguc

SEQ ID NO: 1864633 - RNA, 22 nt, Salmonella typhimurium LT2
cguggggguucaaguccccccc

SEQ ID NO: 1864634 - RNA, 19 nt, Salmonella typhimurium LT2
cgugggcuacggcucccuc

SEQ ID NO: 1864635 - RNA, 17 nt, Salmonella typhimurium LT2
cguggaacugcagcgcg

SEQ ID NO: 1864636 - RNA, 14 nt, Salmonella typhimurium LT2
cguggaagcggaac

SEQ ID NO: 1864637 - RNA, 12 nt, Salmonella typhimurium LT2
cguggaaaagag

SEQ ID NO: 1864638 - RNA, 20 nt, Salmonella typhimurium LT2
cguggaaaaauuccgcagag

SEQ ID NO: 1864639 - RNA, 20 nt, Salmonella typhimurium LT2
cguggaucucgucgccggug

SEQ ID NO: 1864640 - RNA, 17 nt, Salmonella typhimurium LT2
cgugguuuccggcagcu

SEQ ID NO: 1864641 - RNA, 20 nt, Salmonella typhimurium LT2
cguguauuccagucgcucca

SEQ ID NO: 1864642 - RNA, 15 nt, Salmonella typhimurium LT2
cguguagguaagaua

SEQ ID NO: 1864643 - RNA, 21 nt, Salmonella typhimurium LT2
cguggugauucaaauccugga

SEQ ID NO: 1864644 - RNA, 14 nt, Salmonella typhimurium LT2
cgugguaucgaaaa

SEQ ID NO: 1864645 - RNA, 22 nt, Salmonella typhimurium LT2
cgugucgcguaacgccuccacc

SEQ ID NO: 1864646 - RNA, 14 nt, Salmonella typhimurium LT2
cguguccuugccag

SEQ ID NO: 1864647 - RNA, 19 nt, Salmonella typhimurium LT2
cguuaaaacggaacggcuc

SEQ ID NO: 1864648 - RNA, 22 nt, Salmonella typhimurium LT2
cguuaaaacggaucagccugag

SEQ ID NO: 1864649 - RNA, 13 nt, Salmonella typhimurium LT2
cguguuguccggc

SEQ ID NO: 1864650 - RNA, 20 nt, Salmonella typhimurium LT2
cguucggcaaaacgccgcag

SEQ ID NO: 1864651 - RNA, 11 nt, Salmonella typhimurium LT2
cguucuuccug

SEQ ID NO: 1864652 - RNA, 14 nt, Salmonella typhimurium LT2
cguugacgggcgac

SEQ ID NO: 1864653 - RNA, 14 nt, Salmonella typhimurium LT2
cguuccaggcgcuc

SEQ ID NO: 1864654 - RNA, 22 nt, Salmonella typhimurium LT2
cguuccauuccagaaucuggcc

SEQ ID NO: 1864655 - RNA, 15 nt, Salmonella typhimurium LT2
cguuaacgccgccau

SEQ ID NO: 1864656 - RNA, 22 nt, Salmonella typhimurium LT2
cguuaacccaaauccgcauuuc

SEQ ID NO: 1864657 - RNA, 14 nt, Salmonella typhimurium LT2
cguuaacccggcau

SEQ ID NO: 1864658 - RNA, 15 nt, Salmonella typhimurium LT2
cguuaaaucaacggc

SEQ ID NO: 1864659 - RNA, 16 nt, Salmonella typhimurium LT2
cguucauugcuuucuu

SEQ ID NO: 1864660 - RNA, 18 nt, Salmonella typhimurium LT2
cguugcgaaucagguaca

SEQ ID NO: 1864661 - RNA, 15 nt, Salmonella typhimurium LT2
cguugccugaaaagg

SEQ ID NO: 1864662 - RNA, 12 nt, Salmonella typhimurium LT2
cguugccgccaa

SEQ ID NO: 1864663 - RNA, 20 nt, Salmonella typhimurium LT2
cguuggaauaaaucacaacg

SEQ ID NO: 1864664 - RNA, 12 nt, Salmonella typhimurium LT2
cguugcuuuaua

SEQ ID NO: 1864665 - RNA, 13 nt, Salmonella typhimurium LT2
cguuggccgccag

SEQ ID NO: 1864666 - RNA, 18 nt, Salmonella typhimurium LT2
cguugcuggacauauucc

SEQ ID NO: 1864667 - RNA, 19 nt, Salmonella typhimurium LT2
cguugcguguuguacagca

SEQ ID NO: 1864668 - RNA, 14 nt, Salmonella typhimurium LT2
cguuuacgccgcca

SEQ ID NO: 1864669 - RNA, 15 nt, Salmonella typhimurium LT2
cguuuaaugucacca

SEQ ID NO: 1864670 - RNA, 15 nt, Salmonella typhimurium LT2
cguuuacgccgccau

SEQ ID NO: 1864671 - RNA, 13 nt, Salmonella typhimurium LT2
cguuuaccgccgc

SEQ ID NO: 1864672 - RNA, 13 nt, Salmonella typhimurium LT2
cguuuauuauuug

SEQ ID NO: 1864673 - RNA, 20 nt, Salmonella typhimurium LT2
cguuucaacaaacucagcca

SEQ ID NO: 1864674 - RNA, 23 nt, Salmonella typhimurium LT2
cguuuauauaaaaauagcuggcu

SEQ ID NO: 1864675 - RNA, 19 nt, Salmonella typhimurium LT2
cguuggcuugaucaacgcc

SEQ ID NO: 1864676 - RNA, 16 nt, Salmonella typhimurium LT2
cguuggcuuuuguagg

SEQ ID NO: 1864677 - RNA, 20 nt, Salmonella typhimurium LT2
cguuggcguaaaucaggcca

SEQ ID NO: 1864678 - RNA, 17 nt, Salmonella typhimurium LT2
cguuggccgccggacag

SEQ ID NO: 1864679 - RNA, 16 nt, Salmonella typhimurium LT2
cguuuaagcaugguga

SEQ ID NO: 1864680 - RNA, 17 nt, Salmonella typhimurium LT2
cguuucuguaaaucaac

SEQ ID NO: 1864681 - RNA, 14 nt, Salmonella typhimurium LT2
cguuugcagccaga

SEQ ID NO: 1864682 - RNA, 15 nt, Salmonella typhimurium LT2
cguuugcagcggaag

SEQ ID NO: 1864683 - RNA, 15 nt, Salmonella typhimurium LT2
cguuucuuucaucag

SEQ ID NO: 1864684 - RNA, 22 nt, Salmonella typhimurium LT2
cguuugcagaaaauuaugaaua

SEQ ID NO: 1864685 - RNA, 18 nt, Salmonella typhimurium LT2
cguuugcugagcagccag

SEQ ID NO: 1864686 - RNA, 15 nt, Salmonella typhimurium LT2
cguuugcgccgccau

SEQ ID NO: 1864687 - RNA, 18 nt, Salmonella typhimurium LT2
cuaaacucaacugggcga

SEQ ID NO: 1864688 - RNA, 20 nt, Salmonella typhimurium LT2
cuaaacuaaugccuggcagu

SEQ ID NO: 1864689 - RNA, 23 nt, Salmonella typhimurium LT2
cuaaagagggugaaccaaagcaa

SEQ ID NO: 1864690 - RNA, 18 nt, Salmonella typhimurium LT2
cuaaacucaucuuuauuc

SEQ ID NO: 1864691 - RNA, 13 nt, Salmonella typhimurium LT2
cuaaacucaucuu

SEQ ID NO: 1864692 - RNA, 15 nt, Salmonella typhimurium LT2
cuaaacucaucuuua

SEQ ID NO: 1864693 - RNA, 20 nt, Salmonella typhimurium LT2
cuaaaguuuauuuaggauuu

SEQ ID NO: 1864694 - RNA, 17 nt, Salmonella typhimurium LT2
cuaaauaaauaccaaag

SEQ ID NO: 1864695 - RNA, 19 nt, Salmonella typhimurium LT2
cuaaauaaauaccaaagaa

SEQ ID NO: 1864696 - RNA, 23 nt, Salmonella typhimurium LT2
cuaaaucagugauggauuucaca

SEQ ID NO: 1864697 - RNA, 11 nt, Salmonella typhimurium LT2
cuaaagcucau

SEQ ID NO: 1864698 - RNA, 19 nt, Salmonella typhimurium LT2
cuaaagcucaucaauaaua

SEQ ID NO: 1864699 - RNA, 23 nt, Salmonella typhimurium LT2
cuaaagcgcugaguggcgggcgu

SEQ ID NO: 1864700 - RNA, 18 nt, Salmonella typhimurium LT2
cuaaaugcauagccccag

SEQ ID NO: 1864701 - RNA, 17 nt, Salmonella typhimurium LT2
cuaaaugggcaggagau

SEQ ID NO: 1864702 - RNA, 17 nt, Salmonella typhimurium LT2
cuaaaugcauagcccca

SEQ ID NO: 1864703 - RNA, 14 nt, Salmonella typhimurium LT2
cuaaauuaaaaaua

SEQ ID NO: 1864704 - RNA, 22 nt, Salmonella typhimurium LT2
cuaaaugacgcgcgagaacugc

SEQ ID NO: 1864705 - RNA, 23 nt, Salmonella typhimurium LT2
cuaaaugacgcgcgagaacugcu

SEQ ID NO: 1864706 - RNA, 15 nt, Salmonella typhimurium LT2
cuaaaucauaccagc

SEQ ID NO: 1864707 - RNA, 13 nt, Salmonella typhimurium LT2
cggcugccugccg

SEQ ID NO: 1864708 - RNA, 24 nt, Salmonella typhimurium LT2
cggcugcgguacgccuugagcaaa

SEQ ID NO: 1864709 - RNA, 16 nt, Salmonella typhimurium LT2
cggcugcgccugcggg

SEQ ID NO: 1864710 - RNA, 21 nt, Salmonella typhimurium LT2
cggcuggacaugcuccgcccc

SEQ ID NO: 1864711 - RNA, 18 nt, Salmonella typhimurium LT2
cggcugaguucaggcacg

SEQ ID NO: 1864712 - RNA, 13 nt, Salmonella typhimurium LT2
cggcugcaaagca

SEQ ID NO: 1864713 - RNA, 22 nt, Salmonella typhimurium LT2
cggcugauggcguuccacccag

SEQ ID NO: 1864714 - RNA, 14 nt, Salmonella typhimurium LT2
cggcugaaccaccc

SEQ ID NO: 1864715 - RNA, 13 nt, Salmonella typhimurium LT2
cggcugaagcccc

SEQ ID NO: 1864716 - RNA, 22 nt, Salmonella typhimurium LT2
cggcucgccuuugcgcccguac

SEQ ID NO: 1864717 - RNA, 15 nt, Salmonella typhimurium LT2
cggcucgcguugcgu

SEQ ID NO: 1864718 - RNA, 17 nt, Salmonella typhimurium LT2
cggcucgaacuguucug

SEQ ID NO: 1864719 - RNA, 20 nt, Salmonella typhimurium LT2
cggcucgguuuauccccgcu

SEQ ID NO: 1864720 - RNA, 12 nt, Salmonella typhimurium LT2
cggcuucaucac

SEQ ID NO: 1864721 - RNA, 22 nt, Salmonella typhimurium LT2
cggcuuacaacauuguuacguu

SEQ ID NO: 1864722 - RNA, 16 nt, Salmonella typhimurium LT2
cggcuguguucauccc

SEQ ID NO: 1864723 - RNA, 13 nt, Salmonella typhimurium LT2
cggcugucaucaa

SEQ ID NO: 1864724 - RNA, 20 nt, Salmonella typhimurium LT2
cggcuucuuccggccccggg

SEQ ID NO: 1864725 - RNA, 18 nt, Salmonella typhimurium LT2
cggcuugccaagcaggaa

SEQ ID NO: 1864726 - RNA, 22 nt, Salmonella typhimurium LT2
cgggaaaacggccagugaaaua

SEQ ID NO: 1864727 - RNA, 12 nt, Salmonella typhimurium LT2
cgggaaaagcau

SEQ ID NO: 1864728 - RNA, 20 nt, Salmonella typhimurium LT2
cgggaaaagguuccggcgau

SEQ ID NO: 1864729 - RNA, 21 nt, Salmonella typhimurium LT2
cgggaaaaucagugaacaccc

SEQ ID NO: 1864730 - RNA, 19 nt, Salmonella typhimurium LT2
cgggaaacucgccgccaug

SEQ ID NO: 1864731 - RNA, 23 nt, Salmonella typhimurium LT2
cggcuugucauccuguucaucca

SEQ ID NO: 1864732 - RNA, 14 nt, Salmonella typhimurium LT2
cggcuugccuucau

SEQ ID NO: 1864733 - RNA, 21 nt, Salmonella typhimurium LT2
cggcuuucuguuccgaaauaa

SEQ ID NO: 1864734 - RNA, 21 nt, Salmonella typhimurium LT2
cggcuuucgggaucgccauca

SEQ ID NO: 1864735 - RNA, 21 nt, Salmonella typhimurium LT2
cggcgucacguucgucgccgg

SEQ ID NO: 1864736 - RNA, 18 nt, Salmonella typhimurium LT2
cggcguauuuaaaacgca

SEQ ID NO: 1864737 - RNA, 21 nt, Salmonella typhimurium LT2
cggcguauuuaaaacgcacga

SEQ ID NO: 1864738 - RNA, 21 nt, Salmonella typhimurium LT2
cggcguagccgccgagcgccg

SEQ ID NO: 1864739 - RNA, 17 nt, Salmonella typhimurium LT2
cggcgucccggcaaccg

SEQ ID NO: 1864740 - RNA, 14 nt, Salmonella typhimurium LT2
cggcguccgccagc

SEQ ID NO: 1864741 - RNA, 21 nt, Salmonella typhimurium LT2
cggcguguagccaaucagccc

SEQ ID NO: 1864742 - RNA, 16 nt, Salmonella typhimurium LT2
cggcguggaaccgccg

SEQ ID NO: 1864743 - RNA, 14 nt, Salmonella typhimurium LT2
cggcgucugaugaa

SEQ ID NO: 1864744 - RNA, 14 nt, Salmonella typhimurium LT2
cggcgugaaucccc

SEQ ID NO: 1864745 - RNA, 18 nt, Salmonella typhimurium LT2
cggcuacgcucacgcgca

SEQ ID NO: 1864746 - RNA, 22 nt, Salmonella typhimurium LT2
cggcuacggaguucaccgccgg

SEQ ID NO: 1864747 - RNA, 14 nt, Salmonella typhimurium LT2
cggcuacgggcggu

SEQ ID NO: 1864748 - RNA, 15 nt, Salmonella typhimurium LT2
cggcuacuccggcgc

SEQ ID NO: 1864749 - RNA, 16 nt, Salmonella typhimurium LT2
cggcuagcgcaguuug

SEQ ID NO: 1864750 - RNA, 22 nt, Salmonella typhimurium LT2
cggcuaacaacguuacgccagc

SEQ ID NO: 1864751 - RNA, 18 nt, Salmonella typhimurium LT2
cggcguuuuuuccugcug

SEQ ID NO: 1864752 - RNA, 17 nt, Salmonella typhimurium LT2
cggcuaaucaccaccuc

SEQ ID NO: 1864753 - RNA, 17 nt, Salmonella typhimurium LT2
cggcguuucacuucuga

SEQ ID NO: 1864754 - RNA, 14 nt, Salmonella typhimurium LT2
cggcguuucguaau

SEQ ID NO: 1864755 - RNA, 18 nt, Salmonella typhimurium LT2
cggcguuguuaugcguca

SEQ ID NO: 1864756 - RNA, 12 nt, Salmonella typhimurium LT2
cggcguucugcg

SEQ ID NO: 1864757 - RNA, 12 nt, Salmonella typhimurium LT2
cggcucccauuu

SEQ ID NO: 1864758 - RNA, 16 nt, Salmonella typhimurium LT2
cggcuccagcgccagc

SEQ ID NO: 1864759 - RNA, 17 nt, Salmonella typhimurium LT2
cggcuccagauugcuca

SEQ ID NO: 1864760 - RNA, 17 nt, Salmonella typhimurium LT2
cggcucauccagcaaca

SEQ ID NO: 1864761 - RNA, 22 nt, Salmonella typhimurium LT2
cggcucaccagcugacgcagca

SEQ ID NO: 1864762 - RNA, 24 nt, Salmonella typhimurium LT2
cggcucaccagcugacgcagcagc

SEQ ID NO: 1864763 - RNA, 16 nt, Salmonella typhimurium LT2
cggcucauccagcaac

SEQ ID NO: 1864764 - RNA, 20 nt, Salmonella typhimurium LT2
cggcuauguagcgcugaagc

SEQ ID NO: 1864765 - RNA, 21 nt, Salmonella typhimurium LT2
cggcuauguagcgcugaagcc

SEQ ID NO: 1864766 - RNA, 23 nt, Salmonella typhimurium LT2
cggcuauguagcgcugaagcccg

SEQ ID NO: 1864767 - RNA, 20 nt, Salmonella typhimurium LT2
cgggccauuccccauacagc

SEQ ID NO: 1864768 - RNA, 21 nt, Salmonella typhimurium LT2
cgggccgccaucuccggcagc

SEQ ID NO: 1864769 - RNA, 18 nt, Salmonella typhimurium LT2
cgggccgaaaucccggag

SEQ ID NO: 1864770 - RNA, 15 nt, Salmonella typhimurium LT2
cgggccugagcgcgc

SEQ ID NO: 1864771 - RNA, 13 nt, Salmonella typhimurium LT2
cgggccugccagg

SEQ ID NO: 1864772 - RNA, 12 nt, Salmonella typhimurium LT2
cgggccugugcc

SEQ ID NO: 1864773 - RNA, 20 nt, Salmonella typhimurium LT2
cgggccugauaagcacaggc

SEQ ID NO: 1864774 - RNA, 19 nt, Salmonella typhimurium LT2
cgggccguccggcaaaccc

SEQ ID NO: 1864775 - RNA, 13 nt, Salmonella typhimurium LT2
cgggccgcggcgc

SEQ ID NO: 1864776 - RNA, 13 nt, Salmonella typhimurium LT2
cgggccgcgcugc

SEQ ID NO: 1864777 - RNA, 22 nt, Salmonella typhimurium LT2
cgggcgguauuauccgccgcaa

SEQ ID NO: 1864778 - RNA, 22 nt, Salmonella typhimurium LT2
cgggcggguguucccugcccgu

SEQ ID NO: 1864779 - RNA, 22 nt, Salmonella typhimurium LT2
cgggcuaaaccacucguucccg

SEQ ID NO: 1864780 - RNA, 16 nt, Salmonella typhimurium LT2
cgggcgaccgucgggc

SEQ ID NO: 1864781 - RNA, 15 nt, Salmonella typhimurium LT2
cgggcgaagccugac

SEQ ID NO: 1864782 - RNA, 18 nt, Salmonella typhimurium LT2
cgggcgaacuucaccagc

SEQ ID NO: 1864783 - RNA, 23 nt, Salmonella typhimurium LT2
cgggcgcaaucaucaccacccgc

SEQ ID NO: 1864784 - RNA, 16 nt, Salmonella typhimurium LT2
cgggcgcgcgcgcaga

SEQ ID NO: 1864785 - RNA, 15 nt, Salmonella typhimurium LT2
cgggaugguuaaauu

SEQ ID NO: 1864786 - RNA, 17 nt, Salmonella typhimurium LT2
cgggaugggaacacagc

SEQ ID NO: 1864787 - RNA, 15 nt, Salmonella typhimurium LT2
cgggaucgaaccgcc

SEQ ID NO: 1864788 - RNA, 19 nt, Salmonella typhimurium LT2
cgggaucguaacaggucac

SEQ ID NO: 1864789 - RNA, 19 nt, Salmonella typhimurium LT2
cgggauacggcgagaccau

SEQ ID NO: 1864790 - RNA, 16 nt, Salmonella typhimurium LT2
cgggauagccuuccac

SEQ ID NO: 1864791 - RNA, 14 nt, Salmonella typhimurium LT2
cgggauauccucuu

SEQ ID NO: 1864792 - RNA, 23 nt, Salmonella typhimurium LT2
cgggaucagcggcugcaaagcau

SEQ ID NO: 1864793 - RNA, 18 nt, Salmonella typhimurium LT2
cgggauccccugcuccug

SEQ ID NO: 1864794 - RNA, 15 nt, Salmonella typhimurium LT2
cgggaaguccuucuc

SEQ ID NO: 1864795 - RNA, 14 nt, Salmonella typhimurium LT2
cgggaaugcgucgg

SEQ ID NO: 1864796 - RNA, 23 nt, Salmonella typhimurium LT2
cgggcacuccggcucgcacauau

SEQ ID NO: 1864797 - RNA, 20 nt, Salmonella typhimurium LT2
cgggcaaugccacugcccuc

SEQ ID NO: 1864798 - RNA, 20 nt, Salmonella typhimurium LT2
cgggcaaacagcacuacagc

SEQ ID NO: 1864799 - RNA, 18 nt, Salmonella typhimurium LT2
cgggaugucaucggucau

SEQ ID NO: 1864800 - RNA, 14 nt, Salmonella typhimurium LT2
cgggcaacacacgc

SEQ ID NO: 1864801 - RNA, 17 nt, Salmonella typhimurium LT2
cgggcaaccuucaaguu

SEQ ID NO: 1864802 - RNA, 18 nt, Salmonella typhimurium LT2
cgggcauacucuccucca

SEQ ID NO: 1864803 - RNA, 23 nt, Salmonella typhimurium LT2
cgggcaggcuuccacgcacgccg

SEQ ID NO: 1864804 - RNA, 17 nt, Salmonella typhimurium LT2
cgggccacucuccagca

SEQ ID NO: 1864805 - RNA, 19 nt, Salmonella typhimurium LT2
cgggcaguccggcggcagc

SEQ ID NO: 1864806 - RNA, 23 nt, Salmonella typhimurium LT2
cgggcagacauuugcgcacggcg

SEQ ID NO: 1864807 - RNA, 22 nt, Salmonella typhimurium LT2
cgggcagacaugaccgcacagc

SEQ ID NO: 1864808 - RNA, 22 nt, Salmonella typhimurium LT2
cggucgcuucccagugaaucca

SEQ ID NO: 1864809 - RNA, 21 nt, Salmonella typhimurium LT2
cggucgggauauaugcaaaac

SEQ ID NO: 1864810 - RNA, 19 nt, Salmonella typhimurium LT2
cggucuggaugcguucaaa

SEQ ID NO: 1864811 - RNA, 19 nt, Salmonella typhimurium LT2
cggucuggauuuggcugcc

SEQ ID NO: 1864812 - RNA, 13 nt, Salmonella typhimurium LT2
cggucugacggcc

SEQ ID NO: 1864813 - RNA, 15 nt, Salmonella typhimurium LT2
cggucuuucaacaua

SEQ ID NO: 1864814 - RNA, 13 nt, Salmonella typhimurium LT2
cggucuucaacac

SEQ ID NO: 1864815 - RNA, 19 nt, Salmonella typhimurium LT2
cggugaaugcgcggcugcg

SEQ ID NO: 1864816 - RNA, 17 nt, Salmonella typhimurium LT2
cggugacggaaaccagc

SEQ ID NO: 1864817 - RNA, 19 nt, Salmonella typhimurium LT2
cggugacggaaaccagcau

SEQ ID NO: 1864818 - RNA, 22 nt, Salmonella typhimurium LT2
cggugacgauacggcccagacc

SEQ ID NO: 1864819 - RNA, 17 nt, Salmonella typhimurium LT2
cggucgagcguaauucc

SEQ ID NO: 1864820 - RNA, 22 nt, Salmonella typhimurium LT2
cggucgagcuuuugcugcgcca

SEQ ID NO: 1864821 - RNA, 21 nt, Salmonella typhimurium LT2
cgguccguuuucgcccccagc

SEQ ID NO: 1864822 - RNA, 15 nt, Salmonella typhimurium LT2
cggucgacaccagcg

SEQ ID NO: 1864823 - RNA, 21 nt, Salmonella typhimurium LT2
cggucgcguuauaaccgccaa

SEQ ID NO: 1864824 - RNA, 18 nt, Salmonella typhimurium LT2
cggucauuaauccccggc

SEQ ID NO: 1864825 - RNA, 15 nt, Salmonella typhimurium LT2
cggucccuggcuggu

SEQ ID NO: 1864826 - RNA, 14 nt, Salmonella typhimurium LT2
cggucaguuugccc

SEQ ID NO: 1864827 - RNA, 22 nt, Salmonella typhimurium LT2
cggucaguguuuccauacauuu

SEQ ID NO: 1864828 - RNA, 23 nt, Salmonella typhimurium LT2
cggucagggcuuacucccuggug

SEQ ID NO: 1864829 - RNA, 19 nt, Salmonella typhimurium LT2
cggucagggugaaucccgc

SEQ ID NO: 1864830 - RNA, 22 nt, Salmonella typhimurium LT2
cggucagggugaaucccgccau

SEQ ID NO: 1864831 - RNA, 17 nt, Salmonella typhimurium LT2
cgguaagcacaacgcau

SEQ ID NO: 1864832 - RNA, 23 nt, Salmonella typhimurium LT2
cgguaagaaugcgcgucaggcca

SEQ ID NO: 1864833 - RNA, 13 nt, Salmonella typhimurium LT2
cgguaagccgaaa

SEQ ID NO: 1864834 - RNA, 22 nt, Salmonella typhimurium LT2
cgguaagcccauggcaggcagc

SEQ ID NO: 1864835 - RNA, 20 nt, Salmonella typhimurium LT2
cgguaagcuguuccggcuuc

SEQ ID NO: 1864836 - RNA, 16 nt, Salmonella typhimurium LT2
cgguaaggccaaucaa

SEQ ID NO: 1864837 - RNA, 16 nt, Salmonella typhimurium LT2
cgguaagucaaccagc

SEQ ID NO: 1864838 - RNA, 16 nt, Salmonella typhimurium LT2
cgguaaccauccauuc

SEQ ID NO: 1864839 - RNA, 15 nt, Salmonella typhimurium LT2
cgguaacguaacugg

SEQ ID NO: 1864840 - RNA, 21 nt, Salmonella typhimurium LT2
cgguaacguaacuggauuccu

SEQ ID NO: 1864841 - RNA, 13 nt, Salmonella typhimurium LT2
cgguaccaccagc

SEQ ID NO: 1864842 - RNA, 23 nt, Salmonella typhimurium LT2
cgguaauauauuucacuucauca

SEQ ID NO: 1864843 - RNA, 19 nt, Salmonella typhimurium LT2
cgguaaucacgucauuaaa

SEQ ID NO: 1864844 - RNA, 16 nt, Salmonella typhimurium LT2
cgguacacgcagucca

SEQ ID NO: 1864845 - RNA, 17 nt, Salmonella typhimurium LT2
cgguagcacuuuaaaca

SEQ ID NO: 1864846 - RNA, 14 nt, Salmonella typhimurium LT2
cgguacucuuuuuc

SEQ ID NO: 1864847 - RNA, 16 nt, Salmonella typhimurium LT2
cgguacgcaucaccag

SEQ ID NO: 1864848 - RNA, 20 nt, Salmonella typhimurium LT2
cgguaccgcuugggccaccu

SEQ ID NO: 1864849 - RNA, 14 nt, Salmonella typhimurium LT2
cgguacuccccuuu

SEQ ID NO: 1864850 - RNA, 15 nt, Salmonella typhimurium LT2
cgguacuccccuuuu

SEQ ID NO: 1864851 - RNA, 19 nt, Salmonella typhimurium LT2
cgguacggcgcugcucuuc

SEQ ID NO: 1864852 - RNA, 17 nt, Salmonella typhimurium LT2
cgguacgcaucaccagg

SEQ ID NO: 1864853 - RNA, 20 nt, Salmonella typhimurium LT2
cgguauaaauuuccgcagcc

SEQ ID NO: 1864854 - RNA, 15 nt, Salmonella typhimurium LT2
cgguauauuucucaa

SEQ ID NO: 1864855 - RNA, 15 nt, Salmonella typhimurium LT2
cgguauuauccgccg

SEQ ID NO: 1864856 - RNA, 15 nt, Salmonella typhimurium LT2
cgguaugccuuccag

SEQ ID NO: 1864857 - RNA, 19 nt, Salmonella typhimurium LT2
cgguaugaaggaccaacaa

SEQ ID NO: 1864858 - RNA, 17 nt, Salmonella typhimurium LT2
cgguauccuccugccag

SEQ ID NO: 1864859 - RNA, 15 nt, Salmonella typhimurium LT2
cggucaauacaucac

SEQ ID NO: 1864860 - RNA, 15 nt, Salmonella typhimurium LT2
cggucaaucaucaga

SEQ ID NO: 1864861 - RNA, 16 nt, Salmonella typhimurium LT2
cggucaacguuucccc

SEQ ID NO: 1864862 - RNA, 18 nt, Salmonella typhimurium LT2
aaacuaaguaaggaggaa

SEQ ID NO: 1864863 - RNA, 15 nt, Salmonella typhimurium LT2
cggucagcggcgcgc

SEQ ID NO: 1864864 - RNA, 18 nt, Salmonella typhimurium LT2
cggucaccugaccacgac

SEQ ID NO: 1864865 - RNA, 15 nt, Salmonella typhimurium LT2
cggggugucggagca

SEQ ID NO: 1864866 - RNA, 16 nt, Salmonella typhimurium LT2
cggggguuguucagcg

SEQ ID NO: 1864867 - RNA, 21 nt, Salmonella typhimurium LT2
cgggguuagcguuucaaccgc

SEQ ID NO: 1864868 - RNA, 18 nt, Salmonella typhimurium LT2
cgggguucgggcagcgcu

SEQ ID NO: 1864869 - RNA, 14 nt, Salmonella typhimurium LT2
cgggguuugcagau

SEQ ID NO: 1864870 - RNA, 18 nt, Salmonella typhimurium LT2
cgggguuugcagaugugc

SEQ ID NO: 1864871 - RNA, 17 nt, Salmonella typhimurium LT2
cggguaacagcauugag

SEQ ID NO: 1864872 - RNA, 14 nt, Salmonella typhimurium LT2
cggguaaacgcagc

SEQ ID NO: 1864873 - RNA, 21 nt, Salmonella typhimurium LT2
cggguaauguuuacuccauuc

SEQ ID NO: 1864874 - RNA, 16 nt, Salmonella typhimurium LT2
cgggggcgaucagcag

SEQ ID NO: 1864875 - RNA, 16 nt, Salmonella typhimurium LT2
cgggggcgacagcccc

SEQ ID NO: 1864876 - RNA, 17 nt, Salmonella typhimurium LT2
cggggguguugcaauaa

SEQ ID NO: 1864877 - RNA, 22 nt, Salmonella typhimurium LT2
cggggcucccacucuuccagca

SEQ ID NO: 1864878 - RNA, 13 nt, Salmonella typhimurium LT2
cggggcgcaaaau

SEQ ID NO: 1864879 - RNA, 12 nt, Salmonella typhimurium LT2
cgggcuucauac

SEQ ID NO: 1864880 - RNA, 21 nt, Salmonella typhimurium LT2
cgggcuuaacccaacgccugu

SEQ ID NO: 1864881 - RNA, 16 nt, Salmonella typhimurium LT2
cggggccagcgccagu

SEQ ID NO: 1864882 - RNA, 19 nt, Salmonella typhimurium LT2
cggggaucguucugcugau

SEQ ID NO: 1864883 - RNA, 18 nt, Salmonella typhimurium LT2
cggggauaaucagcagcg

SEQ ID NO: 1864884 - RNA, 14 nt, Salmonella typhimurium LT2
cggggaagggugag

SEQ ID NO: 1864885 - RNA, 14 nt, Salmonella typhimurium LT2
cgggugcgcagcaa

SEQ ID NO: 1864886 - RNA, 19 nt, Salmonella typhimurium LT2
cggguguucaccgcuacau

SEQ ID NO: 1864887 - RNA, 22 nt, Salmonella typhimurium LT2
cggguucagcgacaggcugucg

SEQ ID NO: 1864888 - RNA, 19 nt, Salmonella typhimurium LT2
cggguucgcgcgccgcuuc

SEQ ID NO: 1864889 - RNA, 14 nt, Salmonella typhimurium LT2
cgguaaaccucuuu

SEQ ID NO: 1864890 - RNA, 17 nt, Salmonella typhimurium LT2
cgguaaaccaggccagc

SEQ ID NO: 1864891 - RNA, 18 nt, Salmonella typhimurium LT2
cgguaaaccaggccagcg

SEQ ID NO: 1864892 - RNA, 15 nt, Salmonella typhimurium LT2
cgguaaaccaggcca

SEQ ID NO: 1864893 - RNA, 13 nt, Salmonella typhimurium LT2
cgguaaaaacagc

SEQ ID NO: 1864894 - RNA, 16 nt, Salmonella typhimurium LT2
cgguaaaaacagccau

SEQ ID NO: 1864895 - RNA, 14 nt, Salmonella typhimurium LT2
cggguuuuuacuuu

SEQ ID NO: 1864896 - RNA, 19 nt, Salmonella typhimurium LT2
cgguaaaggucgccgcauc

SEQ ID NO: 1864897 - RNA, 22 nt, Salmonella typhimurium LT2
cgguaaaugcuuaucugaugaa

SEQ ID NO: 1864898 - RNA, 17 nt, Salmonella typhimurium LT2
cgguaaagcagugcagu

SEQ ID NO: 1864899 - RNA, 13 nt, Salmonella typhimurium LT2
cgguaaacgucga

SEQ ID NO: 1864900 - RNA, 20 nt, Salmonella typhimurium LT2
cgguaacagcuugaucauca

SEQ ID NO: 1864901 - RNA, 12 nt, Salmonella typhimurium LT2
cggguugcugau

SEQ ID NO: 1864902 - RNA, 17 nt, Salmonella typhimurium LT2
cggguugccccggcuua

SEQ ID NO: 1864903 - RNA, 22 nt, Salmonella typhimurium LT2
cgggucggacgagcgcgucagc

SEQ ID NO: 1864904 - RNA, 17 nt, Salmonella typhimurium LT2
cgggugaucuuuauaaa

SEQ ID NO: 1864905 - RNA, 21 nt, Salmonella typhimurium LT2
cgggugacgcuaacgcgcacc

SEQ ID NO: 1864906 - RNA, 22 nt, Salmonella typhimurium LT2
cggguaggcugcuugagccagu

SEQ ID NO: 1864907 - RNA, 19 nt, Salmonella typhimurium LT2
cgggucagcgucugcccca

SEQ ID NO: 1864908 - RNA, 18 nt, Salmonella typhimurium LT2
cggguccagucgcgccgc

SEQ ID NO: 1864909 - RNA, 16 nt, Salmonella typhimurium LT2
cuucugacucgcugau

SEQ ID NO: 1864910 - RNA, 12 nt, Salmonella typhimurium LT2
cuucugaaaacc

SEQ ID NO: 1864911 - RNA, 20 nt, Salmonella typhimurium LT2
cuucugcgccuuuggcagga

SEQ ID NO: 1864912 - RNA, 19 nt, Salmonella typhimurium LT2
cuucugcugacauuccuuu

SEQ ID NO: 1864913 - RNA, 21 nt, Salmonella typhimurium LT2
cuucucacggauccagaacug

SEQ ID NO: 1864914 - RNA, 17 nt, Salmonella typhimurium LT2
cuucgucaaugcugcuu

SEQ ID NO: 1864915 - RNA, 22 nt, Salmonella typhimurium LT2
cuucgucacgcgcaaagcugcg

SEQ ID NO: 1864916 - RNA, 16 nt, Salmonella typhimurium LT2
cuucgucgucuucauc

SEQ ID NO: 1864917 - RNA, 18 nt, Salmonella typhimurium LT2
cuucguuauaaggccugc

SEQ ID NO: 1864918 - RNA, 16 nt, Salmonella typhimurium LT2
cuucguucaguuccag

SEQ ID NO: 1864919 - RNA, 15 nt, Salmonella typhimurium LT2
cuucguuaagcgguu

SEQ ID NO: 1864920 - RNA, 23 nt, Salmonella typhimurium LT2
cuucguuuccugucucuauuaac

SEQ ID NO: 1864921 - RNA, 23 nt, Salmonella typhimurium LT2
cuucguuuuauuugaugccuggc

SEQ ID NO: 1864922 - RNA, 15 nt, Salmonella typhimurium LT2
cuucuaccugcacau

SEQ ID NO: 1864923 - RNA, 13 nt, Salmonella typhimurium LT2
cuucuaauuuuuc

SEQ ID NO: 1864924 - RNA, 12 nt, Salmonella typhimurium LT2
cuucuauccacu

SEQ ID NO: 1864925 - RNA, 18 nt, Salmonella typhimurium LT2
cuucuucuaccaccuuau

SEQ ID NO: 1864926 - RNA, 19 nt, Salmonella typhimurium LT2
cuucuucaguuccgccaga

SEQ ID NO: 1864927 - RNA, 17 nt, Salmonella typhimurium LT2
cuucuucaguuccgcca

SEQ ID NO: 1864928 - RNA, 24 nt, Salmonella typhimurium LT2
cuucuucgcgcauuucugcugcaa

SEQ ID NO: 1864929 - RNA, 17 nt, Salmonella typhimurium LT2
cuucuucgcucucgcca

SEQ ID NO: 1864930 - RNA, 22 nt, Salmonella typhimurium LT2
cuucuucgucgucuucauccca

SEQ ID NO: 1864931 - RNA, 17 nt, Salmonella typhimurium LT2
cuucuucaagccaggcu

SEQ ID NO: 1864932 - RNA, 13 nt, Salmonella typhimurium LT2
cuucuggcucaga

SEQ ID NO: 1864933 - RNA, 18 nt, Salmonella typhimurium LT2
cuucugugauacuguagg

SEQ ID NO: 1864934 - RNA, 21 nt, Salmonella typhimurium LT2
cuucuuuaucuucugcugcuc

SEQ ID NO: 1864935 - RNA, 13 nt, Salmonella typhimurium LT2
cuucuuucaucau

SEQ ID NO: 1864936 - RNA, 18 nt, Salmonella typhimurium LT2
cuucuuugcgcgucucuc

SEQ ID NO: 1864937 - RNA, 13 nt, Salmonella typhimurium LT2
cuucuuuuacugc

SEQ ID NO: 1864938 - RNA, 22 nt, Salmonella typhimurium LT2
cuugaagccuuucuguucuuug

SEQ ID NO: 1864939 - RNA, 17 nt, Salmonella typhimurium LT2
cuugauccuguaacgca

SEQ ID NO: 1864940 - RNA, 20 nt, Salmonella typhimurium LT2
cuugauagcgaucagcgcca

SEQ ID NO: 1864941 - RNA, 22 nt, Salmonella typhimurium LT2
cuugaguuuuccgccauuggcg

SEQ ID NO: 1864942 - RNA, 18 nt, Salmonella typhimurium LT2
cuugacucugaagcggga

SEQ ID NO: 1864943 - RNA, 17 nt, Salmonella typhimurium LT2
cuugagcaaaacacagc

SEQ ID NO: 1864944 - RNA, 15 nt, Salmonella typhimurium LT2
cuugaccgccugauc

SEQ ID NO: 1864945 - RNA, 15 nt, Salmonella typhimurium LT2
cuugaucucucccug

SEQ ID NO: 1864946 - RNA, 17 nt, Salmonella typhimurium LT2
cuugauguagucgcuca

SEQ ID NO: 1864947 - RNA, 18 nt, Salmonella typhimurium LT2
cuugcaacccauacagcc

SEQ ID NO: 1864948 - RNA, 13 nt, Salmonella typhimurium LT2
cuugccagcgaga

SEQ ID NO: 1864949 - RNA, 22 nt, Salmonella typhimurium LT2
cuugcagccagaacucaucuuc

SEQ ID NO: 1864950 - RNA, 15 nt, Salmonella typhimurium LT2
cuugccguuuuucuc

SEQ ID NO: 1864951 - RNA, 18 nt, Salmonella typhimurium LT2
cuugccguuuuucucauc

SEQ ID NO: 1864952 - RNA, 19 nt, Salmonella typhimurium LT2
cuugccugcuuuuucauca

SEQ ID NO: 1864953 - RNA, 15 nt, Salmonella typhimurium LT2
cuugcgacauguugu

SEQ ID NO: 1864954 - RNA, 21 nt, Salmonella typhimurium LT2
cuugcccuguuucgcaggccg

SEQ ID NO: 1864955 - RNA, 21 nt, Salmonella typhimurium LT2
cuugcccagcauauuaacagu

SEQ ID NO: 1864956 - RNA, 12 nt, Salmonella typhimurium LT2
aaacuuuuaaau

SEQ ID NO: 1864957 - RNA, 14 nt, Salmonella typhimurium LT2
cuugcucucaggca

SEQ ID NO: 1864958 - RNA, 20 nt, Salmonella typhimurium LT2
cuugcuggccuguucaagug

SEQ ID NO: 1864959 - RNA, 17 nt, Salmonella typhimurium LT2
cuugcuuuucaucacca

SEQ ID NO: 1864960 - RNA, 11 nt, Salmonella typhimurium LT2
cuugcuuuauu

SEQ ID NO: 1864961 - RNA, 17 nt, Salmonella typhimurium LT2
cuugcggggagaaugcg

SEQ ID NO: 1864962 - RNA, 15 nt, Salmonella typhimurium LT2
cuugcggcugccagu

SEQ ID NO: 1864963 - RNA, 16 nt, Salmonella typhimurium LT2
cuugcggugagaaacg

SEQ ID NO: 1864964 - RNA, 13 nt, Salmonella typhimurium LT2
cuugcgcauggcc

SEQ ID NO: 1864965 - RNA, 21 nt, Salmonella typhimurium LT2
cuugcgccgccauccggcaag

SEQ ID NO: 1864966 - RNA, 19 nt, Salmonella typhimurium LT2
cuguuucaccguagcauca

SEQ ID NO: 1864967 - RNA, 17 nt, Salmonella typhimurium LT2
cuguuucaacacaucca

SEQ ID NO: 1864968 - RNA, 19 nt, Salmonella typhimurium LT2
cuguuuacccacuucuucc

SEQ ID NO: 1864969 - RNA, 21 nt, Salmonella typhimurium LT2
cuguuccugcgggaacagaua

SEQ ID NO: 1864970 - RNA, 20 nt, Salmonella typhimurium LT2
cuguucggggaauucaaaga

SEQ ID NO: 1864971 - RNA, 19 nt, Salmonella typhimurium LT2
cuguuuaagcgccuccaca

SEQ ID NO: 1864972 - RNA, 21 nt, Salmonella typhimurium LT2
cuguuuaagcgccuccacaaa

SEQ ID NO: 1864973 - RNA, 17 nt, Salmonella typhimurium LT2
cuguuuaagcgccucca

SEQ ID NO: 1864974 - RNA, 19 nt, Salmonella typhimurium LT2
cuguuccgaaauaaaucga

SEQ ID NO: 1864975 - RNA, 15 nt, Salmonella typhimurium LT2
cuguuaugaaacccg

SEQ ID NO: 1864976 - RNA, 15 nt, Salmonella typhimurium LT2
cuguuaugccuuuuu

SEQ ID NO: 1864977 - RNA, 17 nt, Salmonella typhimurium LT2
cuguuacgcugguuugu

SEQ ID NO: 1864978 - RNA, 23 nt, Salmonella typhimurium LT2
cuggcccggcaguugcugucgcu

SEQ ID NO: 1864979 - RNA, 16 nt, Salmonella typhimurium LT2
cuuaacgauaacguca

SEQ ID NO: 1864980 - RNA, 14 nt, Salmonella typhimurium LT2
cuuaacccauggcu

SEQ ID NO: 1864981 - RNA, 21 nt, Salmonella typhimurium LT2
cuuaaccgggaucgggacaug

SEQ ID NO: 1864982 - RNA, 19 nt, Salmonella typhimurium LT2
cuuaacgcguagccaaaag

SEQ ID NO: 1864983 - RNA, 14 nt, Salmonella typhimurium LT2
cuuaacgauuuuau

SEQ ID NO: 1864984 - RNA, 14 nt, Salmonella typhimurium LT2
aaacuggauaagcg

SEQ ID NO: 1864985 - RNA, 15 nt, Salmonella typhimurium LT2
aaacugcugccgcag

SEQ ID NO: 1864986 - RNA, 18 nt, Salmonella typhimurium LT2
cuuaaauugcgcgcggcc

SEQ ID NO: 1864987 - RNA, 15 nt, Salmonella typhimurium LT2
cuuaacagaauugcg

SEQ ID NO: 1864988 - RNA, 19 nt, Salmonella typhimurium LT2
cuuaaauaugaaagagaaa

SEQ ID NO: 1864989 - RNA, 21 nt, Salmonella typhimurium LT2
cuuaaauggcgcuguaaggca

SEQ ID NO: 1864990 - RNA, 17 nt, Salmonella typhimurium LT2
cuuaaauaaaaaugaua

SEQ ID NO: 1864991 - RNA, 21 nt, Salmonella typhimurium LT2
cuguuuuucguuccuucagcu

SEQ ID NO: 1864992 - RNA, 13 nt, Salmonella typhimurium LT2
cuuaaaaaauccu

SEQ ID NO: 1864993 - RNA, 14 nt, Salmonella typhimurium LT2
cuuaaaaaauccug

SEQ ID NO: 1864994 - RNA, 17 nt, Salmonella typhimurium LT2
cuuaccgcgucuuauca

SEQ ID NO: 1864995 - RNA, 18 nt, Salmonella typhimurium LT2
cuuaccaggucuuaccua

SEQ ID NO: 1864996 - RNA, 16 nt, Salmonella typhimurium LT2
cuuaccaaaagcauug

SEQ ID NO: 1864997 - RNA, 17 nt, Salmonella typhimurium LT2
cuuacagggcaaugccu

SEQ ID NO: 1864998 - RNA, 22 nt, Salmonella typhimurium LT2
cuuaaugcauggcagauaaacc

SEQ ID NO: 1864999 - RNA, 19 nt, Salmonella typhimurium LT2
cuuacgaugagcguggcgu

SEQ ID NO: 1865000 - RNA, 20 nt, Salmonella typhimurium LT2
cuuacgaagauugucgauca

SEQ ID NO: 1865001 - RNA, 23 nt, Salmonella typhimurium LT2
cuuacgaacugcggcuuuuucac

SEQ ID NO: 1865002 - RNA, 13 nt, Salmonella typhimurium LT2
cuuaccuucaucc

SEQ ID NO: 1865003 - RNA, 18 nt, Salmonella typhimurium LT2
cuuaccgggcuuacagcg

SEQ ID NO: 1865004 - RNA, 14 nt, Salmonella typhimurium LT2
cuuagguuuguagc

SEQ ID NO: 1865005 - RNA, 15 nt, Salmonella typhimurium LT2
cuuagcuaucugccc

SEQ ID NO: 1865006 - RNA, 20 nt, Salmonella typhimurium LT2
cuuauccggccuacaagccg

SEQ ID NO: 1865007 - RNA, 22 nt, Salmonella typhimurium LT2
cuuauccggccuacaagccgcc

SEQ ID NO: 1865008 - RNA, 19 nt, Salmonella typhimurium LT2
cuuauccgaccuacaagau

SEQ ID NO: 1865009 - RNA, 12 nt, Salmonella typhimurium LT2
cuuaugcccggc

SEQ ID NO: 1865010 - RNA, 20 nt, Salmonella typhimurium LT2
cuuauccggccugcaggcaa

SEQ ID NO: 1865011 - RNA, 23 nt, Salmonella typhimurium LT2
cuuauccggcuuauccggccugc

SEQ ID NO: 1865012 - RNA, 22 nt, Salmonella typhimurium LT2
cuuaucgggcccguugccuggc

SEQ ID NO: 1865013 - RNA, 15 nt, Salmonella typhimurium LT2
cuuaucgccaaagau

SEQ ID NO: 1865014 - RNA, 16 nt, Salmonella typhimurium LT2
cuuaucgccaaagaua

SEQ ID NO: 1865015 - RNA, 13 nt, Salmonella typhimurium LT2
cuuauuuguauug

SEQ ID NO: 1865016 - RNA, 17 nt, Salmonella typhimurium LT2
cuuauuuggguaauaaa

SEQ ID NO: 1865017 - RNA, 20 nt, Salmonella typhimurium LT2
cuuauuuggguaauaaagaa

SEQ ID NO: 1865018 - RNA, 15 nt, Salmonella typhimurium LT2
cuuauuucuccugcg

SEQ ID NO: 1865019 - RNA, 15 nt, Salmonella typhimurium LT2
cuuauuguuuuuuaa

SEQ ID NO: 1865020 - RNA, 17 nt, Salmonella typhimurium LT2
cuuauuguuuuuuaaga

SEQ ID NO: 1865021 - RNA, 18 nt, Salmonella typhimurium LT2
cuuauuguuuuuuaagac

SEQ ID NO: 1865022 - RNA, 18 nt, Salmonella typhimurium LT2
cuuauguaagcucccggg

SEQ ID NO: 1865023 - RNA, 14 nt, Salmonella typhimurium LT2
cuuccaguugcguc

SEQ ID NO: 1865024 - RNA, 20 nt, Salmonella typhimurium LT2
cuuccccuguaacugcaccu

SEQ ID NO: 1865025 - RNA, 15 nt, Salmonella typhimurium LT2
cuucccgacgcuggc

SEQ ID NO: 1865026 - RNA, 16 nt, Salmonella typhimurium LT2
cuuccaguuuugccag

SEQ ID NO: 1865027 - RNA, 19 nt, Salmonella typhimurium LT2
cuuccccuuucaccagaau

SEQ ID NO: 1865028 - RNA, 19 nt, Salmonella typhimurium LT2
cuuccgcuuuaagcgcugc

SEQ ID NO: 1865029 - RNA, 16 nt, Salmonella typhimurium LT2
cuuccgcuucgguuuu

SEQ ID NO: 1865030 - RNA, 20 nt, Salmonella typhimurium LT2
cuuccggcaucacaucgccg

SEQ ID NO: 1865031 - RNA, 16 nt, Salmonella typhimurium LT2
cuuccggcgagagaau

SEQ ID NO: 1865032 - RNA, 15 nt, Salmonella typhimurium LT2
cuuccggcgccucca

SEQ ID NO: 1865033 - RNA, 18 nt, Salmonella typhimurium LT2
cuuccagcgcguccagcc

SEQ ID NO: 1865034 - RNA, 15 nt, Salmonella typhimurium LT2
cuuccagcggcaggc

SEQ ID NO: 1865035 - RNA, 15 nt, Salmonella typhimurium LT2
cuuccagcgucucca

SEQ ID NO: 1865036 - RNA, 12 nt, Salmonella typhimurium LT2
cuuccagcucca

SEQ ID NO: 1865037 - RNA, 22 nt, Salmonella typhimurium LT2
cuuccagcgcgccgucaucgcu

SEQ ID NO: 1865038 - RNA, 17 nt, Salmonella typhimurium LT2
cuuccacugcaucucuu

SEQ ID NO: 1865039 - RNA, 20 nt, Salmonella typhimurium LT2
cuuccacugcaucucuucca

SEQ ID NO: 1865040 - RNA, 23 nt, Salmonella typhimurium LT2
cuuccaccauucgcgcauacucu

SEQ ID NO: 1865041 - RNA, 15 nt, Salmonella typhimurium LT2
cuucggcuccagcgc

SEQ ID NO: 1865042 - RNA, 18 nt, Salmonella typhimurium LT2
cuucgguaaaaacagcca

SEQ ID NO: 1865043 - RNA, 21 nt, Salmonella typhimurium LT2
cuucgccuucgcccauaucca

SEQ ID NO: 1865044 - RNA, 17 nt, Salmonella typhimurium LT2
cuucgauaauaaaauau

SEQ ID NO: 1865045 - RNA, 19 nt, Salmonella typhimurium LT2
cuucgauaauaaaauauua

SEQ ID NO: 1865046 - RNA, 19 nt, Salmonella typhimurium LT2
cuuccuguacgccugcuuc

SEQ ID NO: 1865047 - RNA, 17 nt, Salmonella typhimurium LT2
cuuccuggggaacagaa

SEQ ID NO: 1865048 - RNA, 19 nt, Salmonella typhimurium LT2
cuuccuggggaacagaagc

SEQ ID NO: 1865049 - RNA, 15 nt, Salmonella typhimurium LT2
cuuccugcugcgcuu

SEQ ID NO: 1865050 - RNA, 14 nt, Salmonella typhimurium LT2
cuuccugccagcac

SEQ ID NO: 1865051 - RNA, 17 nt, Salmonella typhimurium LT2
cuuccgguaucccaaac

SEQ ID NO: 1865052 - RNA, 15 nt, Salmonella typhimurium LT2
cuuccgggccggaga

SEQ ID NO: 1865053 - RNA, 18 nt, Salmonella typhimurium LT2
cuuccguccccagcccau

SEQ ID NO: 1865054 - RNA, 14 nt, Salmonella typhimurium LT2
cuuccguccccagc

SEQ ID NO: 1865055 - RNA, 15 nt, Salmonella typhimurium LT2
cuuccuccaccacca

SEQ ID NO: 1865056 - RNA, 19 nt, Salmonella typhimurium LT2
cuuccucaccguagcucca

SEQ ID NO: 1865057 - RNA, 18 nt, Salmonella typhimurium LT2
cuuccucauuauugccca

SEQ ID NO: 1865058 - RNA, 18 nt, Salmonella typhimurium LT2
cuucagaggccuuuugca

SEQ ID NO: 1865059 - RNA, 14 nt, Salmonella typhimurium LT2
cuucagcaaacggc

SEQ ID NO: 1865060 - RNA, 15 nt, Salmonella typhimurium LT2
cuucagcaacccuuu

SEQ ID NO: 1865061 - RNA, 19 nt, Salmonella typhimurium LT2
cuucagcaucaucucccag

SEQ ID NO: 1865062 - RNA, 16 nt, Salmonella typhimurium LT2
cuucagcaucaucucc

SEQ ID NO: 1865063 - RNA, 14 nt, Salmonella typhimurium LT2
cuucagcagcgaga

SEQ ID NO: 1865064 - RNA, 18 nt, Salmonella typhimurium LT2
cuucaguucagccgccag

SEQ ID NO: 1865065 - RNA, 12 nt, Salmonella typhimurium LT2
cuucaguaacca

SEQ ID NO: 1865066 - RNA, 14 nt, Salmonella typhimurium LT2
cuucaucagccagc

SEQ ID NO: 1865067 - RNA, 17 nt, Salmonella typhimurium LT2
cuucaucaguaacugac

SEQ ID NO: 1865068 - RNA, 14 nt, Salmonella typhimurium LT2
cuucauccacgccg

SEQ ID NO: 1865069 - RNA, 15 nt, Salmonella typhimurium LT2
cuucaucccacucaa

SEQ ID NO: 1865070 - RNA, 14 nt, Salmonella typhimurium LT2
cuucaucccagcua

SEQ ID NO: 1865071 - RNA, 14 nt, Salmonella typhimurium LT2
cuucauucaugcuu

SEQ ID NO: 1865072 - RNA, 24 nt, Salmonella typhimurium LT2
cuucauuuauggguuccaguugca

SEQ ID NO: 1865073 - RNA, 20 nt, Salmonella typhimurium LT2
cuuauuuuauuuuuauauuc

SEQ ID NO: 1865074 - RNA, 15 nt, Salmonella typhimurium LT2
cuucaacggucucag

SEQ ID NO: 1865075 - RNA, 17 nt, Salmonella typhimurium LT2
cuucaagcguuuccaga

SEQ ID NO: 1865076 - RNA, 14 nt, Salmonella typhimurium LT2
cuucaaucgccaaa

SEQ ID NO: 1865077 - RNA, 18 nt, Salmonella typhimurium LT2
cuucaccgagaaauuuag

SEQ ID NO: 1865078 - RNA, 18 nt, Salmonella typhimurium LT2
cuucacguugacgcaaac

SEQ ID NO: 1865079 - RNA, 15 nt, Salmonella typhimurium LT2
cuucacuaaaaacag

SEQ ID NO: 1865080 - RNA, 23 nt, Salmonella typhimurium LT2
cuucacguugacgcaaacugcca

SEQ ID NO: 1865081 - RNA, 19 nt, Salmonella typhimurium LT2
cuucacccagacugugaug

SEQ ID NO: 1865082 - RNA, 21 nt, Salmonella typhimurium LT2
cuuguuuaauggcagaauaaa

SEQ ID NO: 1865083 - RNA, 18 nt, Salmonella typhimurium LT2
aaagaacguguuuuucca

SEQ ID NO: 1865084 - RNA, 23 nt, Salmonella typhimurium LT2
aaagaacguguuuuuccagcaac

SEQ ID NO: 1865085 - RNA, 14 nt, Salmonella typhimurium LT2
cuuguugcggauga

SEQ ID NO: 1865086 - RNA, 23 nt, Salmonella typhimurium LT2
cuuguugaacacuaaccagcgcg

SEQ ID NO: 1865087 - RNA, 21 nt, Salmonella typhimurium LT2
cuugucggaacucacuugucu

SEQ ID NO: 1865088 - RNA, 15 nt, Salmonella typhimurium LT2
cuugugcuuccagcu

SEQ ID NO: 1865089 - RNA, 15 nt, Salmonella typhimurium LT2
cuugugcgcccaucu

SEQ ID NO: 1865090 - RNA, 15 nt, Salmonella typhimurium LT2
cuugugaugagcuca

SEQ ID NO: 1865091 - RNA, 14 nt, Salmonella typhimurium LT2
cuugugagggcaaa

SEQ ID NO: 1865092 - RNA, 22 nt, Salmonella typhimurium LT2
cuugucugggcauuaccccagc

SEQ ID NO: 1865093 - RNA, 23 nt, Salmonella typhimurium LT2
cuuguguggagguuucuucauca

SEQ ID NO: 1865094 - RNA, 22 nt, Salmonella typhimurium LT2
cuuguguggagguuucuucauc

SEQ ID NO: 1865095 - RNA, 14 nt, Salmonella typhimurium LT2
cuuguucgcagguc

SEQ ID NO: 1865096 - RNA, 20 nt, Salmonella typhimurium LT2
cuuguuauccaucagccagg

SEQ ID NO: 1865097 - RNA, 19 nt, Salmonella typhimurium LT2
cuuggcgaucaccagcacc

SEQ ID NO: 1865098 - RNA, 23 nt, Salmonella typhimurium LT2
cuuguaagggaggugcucuccca

SEQ ID NO: 1865099 - RNA, 17 nt, Salmonella typhimurium LT2
cuuguagaaaagaaggg

SEQ ID NO: 1865100 - RNA, 16 nt, Salmonella typhimurium LT2
cuuguauagacaagua

SEQ ID NO: 1865101 - RNA, 19 nt, Salmonella typhimurium LT2
cuuguaggcccgauaagca

SEQ ID NO: 1865102 - RNA, 17 nt, Salmonella typhimurium LT2
cuuuuaagguuaauucu

SEQ ID NO: 1865103 - RNA, 19 nt, Salmonella typhimurium LT2
cuuuuaaggcggcaaagau

SEQ ID NO: 1865104 - RNA, 21 nt, Salmonella typhimurium LT2
cuuuuaaggcggcaaagauaa

SEQ ID NO: 1865105 - RNA, 14 nt, Salmonella typhimurium LT2
cuuuuaauuuucug

SEQ ID NO: 1865106 - RNA, 19 nt, Salmonella typhimurium LT2
cuuuggcuuuaugaauauc

SEQ ID NO: 1865107 - RNA, 16 nt, Salmonella typhimurium LT2
cuuuggcgacuuuuuu

SEQ ID NO: 1865108 - RNA, 20 nt, Salmonella typhimurium LT2
cuuuggcaccguuagugauu

SEQ ID NO: 1865109 - RNA, 18 nt, Salmonella typhimurium LT2
cuuuggcaaacggcgcca

SEQ ID NO: 1865110 - RNA, 23 nt, Salmonella typhimurium LT2
cuuuggagauuucggcauuuuua

SEQ ID NO: 1865111 - RNA, 15 nt, Salmonella typhimurium LT2
cuuugagcagcgcca

SEQ ID NO: 1865112 - RNA, 12 nt, Salmonella typhimurium LT2
cuuugagaaagc

SEQ ID NO: 1865113 - RNA, 15 nt, Salmonella typhimurium LT2
cuuugaggaucaauu

SEQ ID NO: 1865114 - RNA, 23 nt, Salmonella typhimurium LT2
cuuugccgcaaacgccgaagcca

SEQ ID NO: 1865115 - RNA, 12 nt, Salmonella typhimurium LT2
cuuugcccagaa

SEQ ID NO: 1865116 - RNA, 20 nt, Salmonella typhimurium LT2
cuuugcccgagcgcuggcau

SEQ ID NO: 1865117 - RNA, 13 nt, Salmonella typhimurium LT2
cuuugccuuucuu

SEQ ID NO: 1865118 - RNA, 20 nt, Salmonella typhimurium LT2
cuuugcgccauuucaauaau

SEQ ID NO: 1865119 - RNA, 19 nt, Salmonella typhimurium LT2
cuuugcgauagcccggcau

SEQ ID NO: 1865120 - RNA, 17 nt, Salmonella typhimurium LT2
cuuugcgaaaaagugau

SEQ ID NO: 1865121 - RNA, 21 nt, Salmonella typhimurium LT2
cuuuccugaucaaucaacucu

SEQ ID NO: 1865122 - RNA, 17 nt, Salmonella typhimurium LT2
cuuuccugaucaaucaa

SEQ ID NO: 1865123 - RNA, 18 nt, Salmonella typhimurium LT2
cuuuccuuuuucaggcac

SEQ ID NO: 1865124 - RNA, 19 nt, Salmonella typhimurium LT2
cuuuccguuagcccuuuca

SEQ ID NO: 1865125 - RNA, 14 nt, Salmonella typhimurium LT2
cuuucgccagccgc

SEQ ID NO: 1865126 - RNA, 21 nt, Salmonella typhimurium LT2
cuuucgccagccgcagcucau

SEQ ID NO: 1865127 - RNA, 21 nt, Salmonella typhimurium LT2
cuuucgcaacauccgaaagcu

SEQ ID NO: 1865128 - RNA, 15 nt, Salmonella typhimurium LT2
cuuucgacgucacca

SEQ ID NO: 1865129 - RNA, 14 nt, Salmonella typhimurium LT2
cuuugaaaaucaca

SEQ ID NO: 1865130 - RNA, 22 nt, Salmonella typhimurium LT2
cuuucuguuaauaaucgaacug

SEQ ID NO: 1865131 - RNA, 12 nt, Salmonella typhimurium LT2
cuuucgucggua

SEQ ID NO: 1865132 - RNA, 21 nt, Salmonella typhimurium LT2
cuuucugggcaacucacacua

SEQ ID NO: 1865133 - RNA, 18 nt, Salmonella typhimurium LT2
cuuucgguagccacagau

SEQ ID NO: 1865134 - RNA, 21 nt, Salmonella typhimurium LT2
cuuucgguucgccgcagccua

SEQ ID NO: 1865135 - RNA, 18 nt, Salmonella typhimurium LT2
cuuucgucacuaacucca

SEQ ID NO: 1865136 - RNA, 23 nt, Salmonella typhimurium LT2
cuuucgucacuaacuccagcauc

SEQ ID NO: 1865137 - RNA, 16 nt, Salmonella typhimurium LT2
aaagaauuacugaaua

SEQ ID NO: 1865138 - RNA, 16 nt, Salmonella typhimurium LT2
cuuuaauuaaauuuuc

SEQ ID NO: 1865139 - RNA, 13 nt, Salmonella typhimurium LT2
cuuuaaccucuuu

SEQ ID NO: 1865140 - RNA, 13 nt, Salmonella typhimurium LT2
cuuuaacgcuggc

SEQ ID NO: 1865141 - RNA, 16 nt, Salmonella typhimurium LT2
cuuuaaccucuuuuuc

SEQ ID NO: 1865142 - RNA, 18 nt, Salmonella typhimurium LT2
cuuuaaccgccugcucaa

SEQ ID NO: 1865143 - RNA, 16 nt, Salmonella typhimurium LT2
cuuuacugaaucucag

SEQ ID NO: 1865144 - RNA, 18 nt, Salmonella typhimurium LT2
cuuuacguacccgcgccg

SEQ ID NO: 1865145 - RNA, 15 nt, Salmonella typhimurium LT2
cuuuacaccccacua

SEQ ID NO: 1865146 - RNA, 21 nt, Salmonella typhimurium LT2
cuuuaugucaguaauauauua

SEQ ID NO: 1865147 - RNA, 22 nt, Salmonella typhimurium LT2
cuuuaucuucugcugcucccuc

SEQ ID NO: 1865148 - RNA, 20 nt, Salmonella typhimurium LT2
cuuuaucuucugcugcuccc

SEQ ID NO: 1865149 - RNA, 23 nt, Salmonella typhimurium LT2
cuuuauaaaaagcacaucaggaa

SEQ ID NO: 1865150 - RNA, 19 nt, Salmonella typhimurium LT2
cuuuccagcuccagccgcu

SEQ ID NO: 1865151 - RNA, 20 nt, Salmonella typhimurium LT2
cuuuccaggccagcgacacg

SEQ ID NO: 1865152 - RNA, 15 nt, Salmonella typhimurium LT2
cuuuccagcuccagc

SEQ ID NO: 1865153 - RNA, 14 nt, Salmonella typhimurium LT2
cuuuccagcuccag

SEQ ID NO: 1865154 - RNA, 13 nt, Salmonella typhimurium LT2
cuuuccagcagcc

SEQ ID NO: 1865155 - RNA, 13 nt, Salmonella typhimurium LT2
cuuuccagaccaa

SEQ ID NO: 1865156 - RNA, 23 nt, Salmonella typhimurium LT2
cuuuccacaaucccggcaacugc

SEQ ID NO: 1865157 - RNA, 23 nt, Salmonella typhimurium LT2
gaaaauuaaucccaacccgacca

SEQ ID NO: 1865158 - RNA, 18 nt, Salmonella typhimurium LT2
gaaaaucacaucgccgga

SEQ ID NO: 1865159 - RNA, 22 nt, Salmonella typhimurium LT2
gaaaauuguccacggggcggca

SEQ ID NO: 1865160 - RNA, 20 nt, Salmonella typhimurium LT2
gaaaauuugcgggaacauau

SEQ ID NO: 1865161 - RNA, 21 nt, Salmonella typhimurium LT2
gaaaauuguccacggggcggc

SEQ ID NO: 1865162 - RNA, 23 nt, Salmonella typhimurium LT2
gaaaauaaacgcuugacucugaa

SEQ ID NO: 1865163 - RNA, 18 nt, Salmonella typhimurium LT2
gaaaaguuucgcucacac

SEQ ID NO: 1865164 - RNA, 11 nt, Salmonella typhimurium LT2
gaaaauauauu

SEQ ID NO: 1865165 - RNA, 17 nt, Salmonella typhimurium LT2
gaaaauaugaugcuauc

SEQ ID NO: 1865166 - RNA, 21 nt, Salmonella typhimurium LT2
gaaaagguuccggcgaucacc

SEQ ID NO: 1865167 - RNA, 22 nt, Salmonella typhimurium LT2
gaaaagguuccggcgaucacca

SEQ ID NO: 1865168 - RNA, 23 nt, Salmonella typhimurium LT2
gaaaaggccuggcugagaaaaau

SEQ ID NO: 1865169 - RNA, 20 nt, Salmonella typhimurium LT2
gaaaagcuguagcauaaaug

SEQ ID NO: 1865170 - RNA, 21 nt, Salmonella typhimurium LT2
gaaaaggccuggcugagaaaa

SEQ ID NO: 1865171 - RNA, 22 nt, Salmonella typhimurium LT2
gaaaaggccuggcugagaaaaa

SEQ ID NO: 1865172 - RNA, 20 nt, Salmonella typhimurium LT2
gaaaagcgggggcgacagcc

SEQ ID NO: 1865173 - RNA, 19 nt, Salmonella typhimurium LT2
gaaaagccggaauauugag

SEQ ID NO: 1865174 - RNA, 19 nt, Salmonella typhimurium LT2
gaaaaauuccgcagagcug

SEQ ID NO: 1865175 - RNA, 20 nt, Salmonella typhimurium LT2
gaaaaauaucgaugcuuauu

SEQ ID NO: 1865176 - RNA, 14 nt, Salmonella typhimurium LT2
gaaacauauauauc

SEQ ID NO: 1865177 - RNA, 12 nt, Salmonella typhimurium LT2
gaaacaccagaa

SEQ ID NO: 1865178 - RNA, 15 nt, Salmonella typhimurium LT2
gaaacaagcggcggc

SEQ ID NO: 1865179 - RNA, 14 nt, Salmonella typhimurium LT2
gaaacaagaagcac

SEQ ID NO: 1865180 - RNA, 23 nt, Salmonella typhimurium LT2
gaaacaacacaaaucgggcgggc

SEQ ID NO: 1865181 - RNA, 22 nt, Salmonella typhimurium LT2
gaaacaacacgaucgaugcccu

SEQ ID NO: 1865182 - RNA, 16 nt, Salmonella typhimurium LT2
gaaacccgccaccgcc

SEQ ID NO: 1865183 - RNA, 21 nt, Salmonella typhimurium LT2
gaaacccgccaccgccagcca

SEQ ID NO: 1865184 - RNA, 14 nt, Salmonella typhimurium LT2
gaaacccaaauaac

SEQ ID NO: 1865185 - RNA, 16 nt, Salmonella typhimurium LT2
gaaacccaaauaacca

SEQ ID NO: 1865186 - RNA, 22 nt, Salmonella typhimurium LT2
gaaaccccaaaucagcaaaaac

SEQ ID NO: 1865187 - RNA, 21 nt, Salmonella typhimurium LT2
gaaaccggcgcgccuuccagc

SEQ ID NO: 1865188 - RNA, 15 nt, Salmonella typhimurium LT2
gaaaccgcccugcag

SEQ ID NO: 1865189 - RNA, 16 nt, Salmonella typhimurium LT2
gaaaccgcccugcagg

SEQ ID NO: 1865190 - RNA, 20 nt, Salmonella typhimurium LT2
cuuuuucauagaaccacuua

SEQ ID NO: 1865191 - RNA, 17 nt, Salmonella typhimurium LT2
cuuuuucauauuuuccu

SEQ ID NO: 1865192 - RNA, 20 nt, Salmonella typhimurium LT2
cuuuuucaucaucuguugca

SEQ ID NO: 1865193 - RNA, 15 nt, Salmonella typhimurium LT2
cuuuuucccacugcg

SEQ ID NO: 1865194 - RNA, 23 nt, Salmonella typhimurium LT2
cuuuuuccagcagcuccagagcg

SEQ ID NO: 1865195 - RNA, 16 nt, Salmonella typhimurium LT2
cuuuuugaucuaaaaa

SEQ ID NO: 1865196 - RNA, 23 nt, Salmonella typhimurium LT2
cuuuuugaucuaaaaauuacauc

SEQ ID NO: 1865197 - RNA, 19 nt, Salmonella typhimurium LT2
cuuuuugcgccacuuuucc

SEQ ID NO: 1865198 - RNA, 20 nt, Salmonella typhimurium LT2
cuuuuugcgacacgcugcau

SEQ ID NO: 1865199 - RNA, 18 nt, Salmonella typhimurium LT2
cuuuuuugccuuucagau

SEQ ID NO: 1865200 - RNA, 19 nt, Salmonella typhimurium LT2
gaaaaaauacugauaaaaa

SEQ ID NO: 1865201 - RNA, 17 nt, Salmonella typhimurium LT2
cuuuuuuuaugccuggg

SEQ ID NO: 1865202 - RNA, 15 nt, Salmonella typhimurium LT2
gaaaaacaucggcaa

SEQ ID NO: 1865203 - RNA, 18 nt, Salmonella typhimurium LT2
gaaaaagaaaccuccgca

SEQ ID NO: 1865204 - RNA, 17 nt, Salmonella typhimurium LT2
gaaaaagaagaaaaaau

SEQ ID NO: 1865205 - RNA, 18 nt, Salmonella typhimurium LT2
gaaaaagaccaauacuga

SEQ ID NO: 1865206 - RNA, 16 nt, Salmonella typhimurium LT2
cuuuugggccgcgcag

SEQ ID NO: 1865207 - RNA, 15 nt, Salmonella typhimurium LT2
cuuuugguuuuucaa

SEQ ID NO: 1865208 - RNA, 15 nt, Salmonella typhimurium LT2
cuuuuuaaaaugacc

SEQ ID NO: 1865209 - RNA, 21 nt, Salmonella typhimurium LT2
cuuuuuaauucacaacugaag

SEQ ID NO: 1865210 - RNA, 17 nt, Salmonella typhimurium LT2
cuuuuuauuuacugccg

SEQ ID NO: 1865211 - RNA, 15 nt, Salmonella typhimurium LT2
cuuuuuauuuuauaa

SEQ ID NO: 1865212 - RNA, 15 nt, Salmonella typhimurium LT2
cuuuuuauuuuucug

SEQ ID NO: 1865213 - RNA, 22 nt, Salmonella typhimurium LT2
cuuuuucaacagcacccaggca

SEQ ID NO: 1865214 - RNA, 18 nt, Salmonella typhimurium LT2
cuuuuuaggcuauaaaaa

SEQ ID NO: 1865215 - RNA, 21 nt, Salmonella typhimurium LT2
cuuuugauacucugcuuuuuc

SEQ ID NO: 1865216 - RNA, 15 nt, Salmonella typhimurium LT2
cuuuuauccccacua

SEQ ID NO: 1865217 - RNA, 19 nt, Salmonella typhimurium LT2
cuuuuaguuacgcacgcca

SEQ ID NO: 1865218 - RNA, 15 nt, Salmonella typhimurium LT2
gaaaucgucgccaac

SEQ ID NO: 1865219 - RNA, 19 nt, Salmonella typhimurium LT2
gaaaucucgcuaaucauca

SEQ ID NO: 1865220 - RNA, 17 nt, Salmonella typhimurium LT2
gaaauggguaucuucau

SEQ ID NO: 1865221 - RNA, 19 nt, Salmonella typhimurium LT2
gaaauggcugacaucuuca

SEQ ID NO: 1865222 - RNA, 18 nt, Salmonella typhimurium LT2
gaaaugguuccaggcgcg

SEQ ID NO: 1865223 - RNA, 19 nt, Salmonella typhimurium LT2
gaaaugguuccaggcgcgc

SEQ ID NO: 1865224 - RNA, 22 nt, Salmonella typhimurium LT2
gaaauuuaggucaaaaaagcga

SEQ ID NO: 1865225 - RNA, 19 nt, Salmonella typhimurium LT2
aaagagcguaucgccggcg

SEQ ID NO: 1865226 - RNA, 16 nt, Salmonella typhimurium LT2
aaagaggaauguccag

SEQ ID NO: 1865227 - RNA, 12 nt, Salmonella typhimurium LT2
aaagaggaaagc

SEQ ID NO: 1865228 - RNA, 13 nt, Salmonella typhimurium LT2
gaaauuagagcca

SEQ ID NO: 1865229 - RNA, 17 nt, Salmonella typhimurium LT2
gaaauuagagccaauau

SEQ ID NO: 1865230 - RNA, 14 nt, Salmonella typhimurium LT2
gaacaacgccaggu

SEQ ID NO: 1865231 - RNA, 14 nt, Salmonella typhimurium LT2
gaacagacggcggc

SEQ ID NO: 1865232 - RNA, 21 nt, Salmonella typhimurium LT2
gaacagaacagugaguuaaga

SEQ ID NO: 1865233 - RNA, 21 nt, Salmonella typhimurium LT2
gaacagaaaaaaugcaccgcc

SEQ ID NO: 1865234 - RNA, 17 nt, Salmonella typhimurium LT2
gaacaguccaggaaaga

SEQ ID NO: 1865235 - RNA, 18 nt, Salmonella typhimurium LT2
gaacaggcgugggggagu

SEQ ID NO: 1865236 - RNA, 15 nt, Salmonella typhimurium LT2
gaacagggcgggcga

SEQ ID NO: 1865237 - RNA, 21 nt, Salmonella typhimurium LT2
gaacagggcgggcgauagaga

SEQ ID NO: 1865238 - RNA, 13 nt, Salmonella typhimurium LT2
gaacagcgacggc

SEQ ID NO: 1865239 - RNA, 20 nt, Salmonella typhimurium LT2
gaacagcgacggcuucacug

SEQ ID NO: 1865240 - RNA, 15 nt, Salmonella typhimurium LT2
gaaagccucuuccgc

SEQ ID NO: 1865241 - RNA, 18 nt, Salmonella typhimurium LT2
gaaagccucuuccgccug

SEQ ID NO: 1865242 - RNA, 18 nt, Salmonella typhimurium LT2
gaaagccccggcucaagc

SEQ ID NO: 1865243 - RNA, 16 nt, Salmonella typhimurium LT2
gaaagcgaaaauaaag

SEQ ID NO: 1865244 - RNA, 17 nt, Salmonella typhimurium LT2
gaaagcgaaaauaaagg

SEQ ID NO: 1865245 - RNA, 23 nt, Salmonella typhimurium LT2
gaaagaucagcagaacaaaggcu

SEQ ID NO: 1865246 - RNA, 13 nt, Salmonella typhimurium LT2
gaaagauaaaaua

SEQ ID NO: 1865247 - RNA, 17 nt, Salmonella typhimurium LT2
gaaagaguacgccgaua

SEQ ID NO: 1865248 - RNA, 16 nt, Salmonella typhimurium LT2
gaaagaaggcuugguu

SEQ ID NO: 1865249 - RNA, 20 nt, Salmonella typhimurium LT2
gaaacggcucgguuuauccc

SEQ ID NO: 1865250 - RNA, 22 nt, Salmonella typhimurium LT2
gaaacgguccugguccggaaua

SEQ ID NO: 1865251 - RNA, 16 nt, Salmonella typhimurium LT2
gaaacggaucaaaaag

SEQ ID NO: 1865252 - RNA, 19 nt, Salmonella typhimurium LT2
gaaacgcauacgcagcacu

SEQ ID NO: 1865253 - RNA, 18 nt, Salmonella typhimurium LT2
gaaacgcacccgcgcagg

SEQ ID NO: 1865254 - RNA, 19 nt, Salmonella typhimurium LT2
gaaacgacguccacaccuu

SEQ ID NO: 1865255 - RNA, 17 nt, Salmonella typhimurium LT2
gaaacgcggcguagccg

SEQ ID NO: 1865256 - RNA, 21 nt, Salmonella typhimurium LT2
gaaacgcgccacgcgccagcc

SEQ ID NO: 1865257 - RNA, 20 nt, Salmonella typhimurium LT2
gaaacgcuuucuggggugaa

SEQ ID NO: 1865258 - RNA, 14 nt, Salmonella typhimurium LT2
gaaacgccaggcac

SEQ ID NO: 1865259 - RNA, 17 nt, Salmonella typhimurium LT2
gaaaucauauaaaacag

SEQ ID NO: 1865260 - RNA, 23 nt, Salmonella typhimurium LT2
gaaauccgcgaauaccuucccgc

SEQ ID NO: 1865261 - RNA, 14 nt, Salmonella typhimurium LT2
gaaaucccggaggc

SEQ ID NO: 1865262 - RNA, 14 nt, Salmonella typhimurium LT2
gaaauaaaagcaau

SEQ ID NO: 1865263 - RNA, 21 nt, Salmonella typhimurium LT2
gaaagugggcgcuuuguuacu

SEQ ID NO: 1865264 - RNA, 13 nt, Salmonella typhimurium LT2
gaaaguggugggu

SEQ ID NO: 1865265 - RNA, 21 nt, Salmonella typhimurium LT2
gaaagucuucccgcaaacugg

SEQ ID NO: 1865266 - RNA, 16 nt, Salmonella typhimurium LT2
gaagaccguuuaaacg

SEQ ID NO: 1865267 - RNA, 16 nt, Salmonella typhimurium LT2
gaagagauuaacgacc

SEQ ID NO: 1865268 - RNA, 16 nt, Salmonella typhimurium LT2
gaagaucguuauccag

SEQ ID NO: 1865269 - RNA, 14 nt, Salmonella typhimurium LT2
gaagaucagcagag

SEQ ID NO: 1865270 - RNA, 16 nt, Salmonella typhimurium LT2
gaagaucagcagagcg

SEQ ID NO: 1865271 - RNA, 17 nt, Salmonella typhimurium LT2
gaagaauucgcaaugug

SEQ ID NO: 1865272 - RNA, 13 nt, Salmonella typhimurium LT2
gaacaugcauguu

SEQ ID NO: 1865273 - RNA, 20 nt, Salmonella typhimurium LT2
gaacaucuaccgcauacuga

SEQ ID NO: 1865274 - RNA, 22 nt, Salmonella typhimurium LT2
gaagcucaugugcagcauccag

SEQ ID NO: 1865275 - RNA, 16 nt, Salmonella typhimurium LT2
gaagcucagccaggcg

SEQ ID NO: 1865276 - RNA, 13 nt, Salmonella typhimurium LT2
gaagcgaccggcg

SEQ ID NO: 1865277 - RNA, 14 nt, Salmonella typhimurium LT2
gaagccuuucuguu

SEQ ID NO: 1865278 - RNA, 18 nt, Salmonella typhimurium LT2
gaagcguuucucuugugc

SEQ ID NO: 1865279 - RNA, 17 nt, Salmonella typhimurium LT2
gaagcgacgacacggcg

SEQ ID NO: 1865280 - RNA, 20 nt, Salmonella typhimurium LT2
gaagccacaaucugauaauc

SEQ ID NO: 1865281 - RNA, 18 nt, Salmonella typhimurium LT2
gaagcauccguuucccuc

SEQ ID NO: 1865282 - RNA, 19 nt, Salmonella typhimurium LT2
gaagcagguguuauuuuug

SEQ ID NO: 1865283 - RNA, 22 nt, Salmonella typhimurium LT2
gaagauuucuuaauuccucaga

SEQ ID NO: 1865284 - RNA, 17 nt, Salmonella typhimurium LT2
gaagauuuuuauucccg

SEQ ID NO: 1865285 - RNA, 18 nt, Salmonella typhimurium LT2
gaagauuucuuaauuccu

SEQ ID NO: 1865286 - RNA, 17 nt, Salmonella typhimurium LT2
gaagcagcuuauccggc

SEQ ID NO: 1865287 - RNA, 16 nt, Salmonella typhimurium LT2
gaagcagcuugcugcu

SEQ ID NO: 1865288 - RNA, 16 nt, Salmonella typhimurium LT2
gaagauuaucgucuau

SEQ ID NO: 1865289 - RNA, 17 nt, Salmonella typhimurium LT2
gaagauuaucgucuauc

SEQ ID NO: 1865290 - RNA, 16 nt, Salmonella typhimurium LT2
gaagaugguaauauua

SEQ ID NO: 1865291 - RNA, 13 nt, Salmonella typhimurium LT2
gaagcuuaccacc

SEQ ID NO: 1865292 - RNA, 20 nt, Salmonella typhimurium LT2
gaaggcucaaauuuggcuca

SEQ ID NO: 1865293 - RNA, 15 nt, Salmonella typhimurium LT2
gaaggcuucggucag

SEQ ID NO: 1865294 - RNA, 19 nt, Salmonella typhimurium LT2
gaaggcuuuggccucagca

SEQ ID NO: 1865295 - RNA, 14 nt, Salmonella typhimurium LT2
gaaggcuuuuccau

SEQ ID NO: 1865296 - RNA, 17 nt, Salmonella typhimurium LT2
gaagggcagaucgagga

SEQ ID NO: 1865297 - RNA, 16 nt, Salmonella typhimurium LT2
gaagcugcgcagcacu

SEQ ID NO: 1865298 - RNA, 17 nt, Salmonella typhimurium LT2
gaagcugccgucccagc

SEQ ID NO: 1865299 - RNA, 15 nt, Salmonella typhimurium LT2
gaagugccaguaacu

SEQ ID NO: 1865300 - RNA, 15 nt, Salmonella typhimurium LT2
gaagugccuguacuu

SEQ ID NO: 1865301 - RNA, 18 nt, Salmonella typhimurium LT2
gaaguauccuggaacaaa

SEQ ID NO: 1865302 - RNA, 18 nt, Salmonella typhimurium LT2
gaauacaaacccaggcaa

SEQ ID NO: 1865303 - RNA, 22 nt, Salmonella typhimurium LT2
gaauacgcuccagcuggcuggc

SEQ ID NO: 1865304 - RNA, 19 nt, Salmonella typhimurium LT2
gaauacggaaggauagccg

SEQ ID NO: 1865305 - RNA, 16 nt, Salmonella typhimurium LT2
gaauaacaaaaugaga

SEQ ID NO: 1865306 - RNA, 11 nt, Salmonella typhimurium LT2
gaauaaauccu

SEQ ID NO: 1865307 - RNA, 16 nt, Salmonella typhimurium LT2
gaauaauguaaaaaaa

SEQ ID NO: 1865308 - RNA, 13 nt, Salmonella typhimurium LT2
gaauaaccucccg

SEQ ID NO: 1865309 - RNA, 16 nt, Salmonella typhimurium LT2
gaauaaccacugaugg

SEQ ID NO: 1865310 - RNA, 15 nt, Salmonella typhimurium LT2
gaaguggugggugau

SEQ ID NO: 1865311 - RNA, 20 nt, Salmonella typhimurium LT2
gaagugguggcgaacaggcu

SEQ ID NO: 1865312 - RNA, 18 nt, Salmonella typhimurium LT2
gaaguuaccgcgccaggc

SEQ ID NO: 1865313 - RNA, 13 nt, Salmonella typhimurium LT2
aaagauaaucuga

SEQ ID NO: 1865314 - RNA, 14 nt, Salmonella typhimurium LT2
aaagauaaucugaa

SEQ ID NO: 1865315 - RNA, 16 nt, Salmonella typhimurium LT2
gaauaaagacaaugcu

SEQ ID NO: 1865316 - RNA, 17 nt, Salmonella typhimurium LT2
gaaguucuucuggcgca

SEQ ID NO: 1865317 - RNA, 14 nt, Salmonella typhimurium LT2
gaaugcuauaugca

SEQ ID NO: 1865318 - RNA, 20 nt, Salmonella typhimurium LT2
gaaugcugacgcguuuuuuc

SEQ ID NO: 1865319 - RNA, 17 nt, Salmonella typhimurium LT2
gaaugcuauaugcaggc

SEQ ID NO: 1865320 - RNA, 17 nt, Salmonella typhimurium LT2
gaaugcuggggcggcgc

SEQ ID NO: 1865321 - RNA, 23 nt, Salmonella typhimurium LT2
gaaugauugccggauggcggcgu

SEQ ID NO: 1865322 - RNA, 23 nt, Salmonella typhimurium LT2
gaaucugcggcugcgugauuuug

SEQ ID NO: 1865323 - RNA, 20 nt, Salmonella typhimurium LT2
gaaucucgugaucgccaaag

SEQ ID NO: 1865324 - RNA, 14 nt, Salmonella typhimurium LT2
gaauccgucagguu

SEQ ID NO: 1865325 - RNA, 19 nt, Salmonella typhimurium LT2
gaauccguugaucguccau

SEQ ID NO: 1865326 - RNA, 14 nt, Salmonella typhimurium LT2
gaaucgcuuccugg

SEQ ID NO: 1865327 - RNA, 17 nt, Salmonella typhimurium LT2
gaaucgcugcgccagca

SEQ ID NO: 1865328 - RNA, 15 nt, Salmonella typhimurium LT2
gaaucguucgccagu

SEQ ID NO: 1865329 - RNA, 20 nt, Salmonella typhimurium LT2
gaaucccgucguagccacca

SEQ ID NO: 1865330 - RNA, 21 nt, Salmonella typhimurium LT2
gaaucccccugccacaaccgc

SEQ ID NO: 1865331 - RNA, 14 nt, Salmonella typhimurium LT2
gaaucagaugcuca

SEQ ID NO: 1865332 - RNA, 22 nt, Salmonella typhimurium LT2
gaauaucacuaucaguuuuggc

SEQ ID NO: 1865333 - RNA, 15 nt, Salmonella typhimurium LT2
gaauaucuuuauccu

SEQ ID NO: 1865334 - RNA, 23 nt, Salmonella typhimurium LT2
gaauaugagauugugcuuuagcu

SEQ ID NO: 1865335 - RNA, 15 nt, Salmonella typhimurium LT2
gaaucaccgacagca

SEQ ID NO: 1865336 - RNA, 16 nt, Salmonella typhimurium LT2
gaauauucauuuccag

SEQ ID NO: 1865337 - RNA, 12 nt, Salmonella typhimurium LT2
gaauauggaaag

SEQ ID NO: 1865338 - RNA, 16 nt, Salmonella typhimurium LT2
aaagaugauuucuugu

SEQ ID NO: 1865339 - RNA, 19 nt, Salmonella typhimurium LT2
gaauaguuacggacaugcg

SEQ ID NO: 1865340 - RNA, 17 nt, Salmonella typhimurium LT2
gacaaaggcaagauccg

SEQ ID NO: 1865341 - RNA, 17 nt, Salmonella typhimurium LT2
gacaacaaaaagauauu

SEQ ID NO: 1865342 - RNA, 15 nt, Salmonella typhimurium LT2
gacacacuugauacu

SEQ ID NO: 1865343 - RNA, 23 nt, Salmonella typhimurium LT2
gacaaucgucacuucaauuugcc

SEQ ID NO: 1865344 - RNA, 20 nt, Salmonella typhimurium LT2
gacaauccgcgaaugguuca

SEQ ID NO: 1865345 - RNA, 15 nt, Salmonella typhimurium LT2
gacaacuauugcugc

SEQ ID NO: 1865346 - RNA, 15 nt, Salmonella typhimurium LT2
gaauggucggcugcu

SEQ ID NO: 1865347 - RNA, 22 nt, Salmonella typhimurium LT2
gaauucaaagaacagggggcgc

SEQ ID NO: 1865348 - RNA, 23 nt, Salmonella typhimurium LT2
gaaugcuucgccacgaccuacac

SEQ ID NO: 1865349 - RNA, 12 nt, Salmonella typhimurium LT2
gaauggagaagc

SEQ ID NO: 1865350 - RNA, 23 nt, Salmonella typhimurium LT2
gaauggggauaaugacauccaga

SEQ ID NO: 1865351 - RNA, 14 nt, Salmonella typhimurium LT2
gaauggcugcuuuu

SEQ ID NO: 1865352 - RNA, 20 nt, Salmonella typhimurium LT2
gaauuuuauuaagcaggccg

SEQ ID NO: 1865353 - RNA, 18 nt, Salmonella typhimurium LT2
gaauuugaacucuuucag

SEQ ID NO: 1865354 - RNA, 18 nt, Salmonella typhimurium LT2
gaccagugaacgucugca

SEQ ID NO: 1865355 - RNA, 18 nt, Salmonella typhimurium LT2
gaccagucggacagcgac

SEQ ID NO: 1865356 - RNA, 14 nt, Salmonella typhimurium LT2
gaccaguuaagcaa

SEQ ID NO: 1865357 - RNA, 15 nt, Salmonella typhimurium LT2
gaccaguaagagaac

SEQ ID NO: 1865358 - RNA, 19 nt, Salmonella typhimurium LT2
gaccaguaagagaacaaua

SEQ ID NO: 1865359 - RNA, 22 nt, Salmonella typhimurium LT2
gacccgcaaaccacgucugcgc

SEQ ID NO: 1865360 - RNA, 16 nt, Salmonella typhimurium LT2
gacccucccugcgcuu

SEQ ID NO: 1865361 - RNA, 21 nt, Salmonella typhimurium LT2
gacccgcuuccaguuuugcca

SEQ ID NO: 1865362 - RNA, 13 nt, Salmonella typhimurium LT2
gaccaggaucaga

SEQ ID NO: 1865363 - RNA, 15 nt, Salmonella typhimurium LT2
gaccaggaucagacc

SEQ ID NO: 1865364 - RNA, 20 nt, Salmonella typhimurium LT2
gaccaggauuuaauggucuc

SEQ ID NO: 1865365 - RNA, 23 nt, Salmonella typhimurium LT2
gaccagcaccaucuuuuccggca

SEQ ID NO: 1865366 - RNA, 18 nt, Salmonella typhimurium LT2
gaccagcaauaaaccacu

SEQ ID NO: 1865367 - RNA, 12 nt, Salmonella typhimurium LT2
gaccagcaucag

SEQ ID NO: 1865368 - RNA, 13 nt, Salmonella typhimurium LT2
gaccagcaucagc

SEQ ID NO: 1865369 - RNA, 18 nt, Salmonella typhimurium LT2
gaccagcaucagaauaau

SEQ ID NO: 1865370 - RNA, 20 nt, Salmonella typhimurium LT2
gaccaaaugguugguauugc

SEQ ID NO: 1865371 - RNA, 14 nt, Salmonella typhimurium LT2
gacauugcgcggcg

SEQ ID NO: 1865372 - RNA, 23 nt, Salmonella typhimurium LT2
gaccagaaccucacggagaaaag

SEQ ID NO: 1865373 - RNA, 15 nt, Salmonella typhimurium LT2
gaccagaccgauuug

SEQ ID NO: 1865374 - RNA, 21 nt, Salmonella typhimurium LT2
gaccagaccgauuuggucagu

SEQ ID NO: 1865375 - RNA, 15 nt, Salmonella typhimurium LT2
gacacuauuuuucag

SEQ ID NO: 1865376 - RNA, 14 nt, Salmonella typhimurium LT2
gacacuuuauucuc

SEQ ID NO: 1865377 - RNA, 20 nt, Salmonella typhimurium LT2
gacacuuuccgacguuuuuc

SEQ ID NO: 1865378 - RNA, 14 nt, Salmonella typhimurium LT2
gacagaaaaaauag

SEQ ID NO: 1865379 - RNA, 16 nt, Salmonella typhimurium LT2
gacagaauaugcauau

SEQ ID NO: 1865380 - RNA, 23 nt, Salmonella typhimurium LT2
gacagauuuuguacuuuugccag

SEQ ID NO: 1865381 - RNA, 17 nt, Salmonella typhimurium LT2
gacagaauaaugcccac

SEQ ID NO: 1865382 - RNA, 14 nt, Salmonella typhimurium LT2
gacagaacugauuu

SEQ ID NO: 1865383 - RNA, 13 nt, Salmonella typhimurium LT2
gacagaacaggau

SEQ ID NO: 1865384 - RNA, 13 nt, Salmonella typhimurium LT2
gacagaacccggc

SEQ ID NO: 1865385 - RNA, 23 nt, Salmonella typhimurium LT2
gacagcgacacuccgcgcaugua

SEQ ID NO: 1865386 - RNA, 17 nt, Salmonella typhimurium LT2
gacagccuauuaaucac

SEQ ID NO: 1865387 - RNA, 17 nt, Salmonella typhimurium LT2
gacagcaacaucuauca

SEQ ID NO: 1865388 - RNA, 18 nt, Salmonella typhimurium LT2
gacagcaaguugcgccac

SEQ ID NO: 1865389 - RNA, 17 nt, Salmonella typhimurium LT2
gacagcaauaucagcca

SEQ ID NO: 1865390 - RNA, 12 nt, Salmonella typhimurium LT2
gacagcaaugag

SEQ ID NO: 1865391 - RNA, 15 nt, Salmonella typhimurium LT2
gacacaguauucacc

SEQ ID NO: 1865392 - RNA, 17 nt, Salmonella typhimurium LT2
gacacauaaagcccaga

SEQ ID NO: 1865393 - RNA, 21 nt, Salmonella typhimurium LT2
gacacagcguacaauggcagg

SEQ ID NO: 1865394 - RNA, 13 nt, Salmonella typhimurium LT2
gacacaggccuga

SEQ ID NO: 1865395 - RNA, 16 nt, Salmonella typhimurium LT2
gacacaucaucgcugg

SEQ ID NO: 1865396 - RNA, 21 nt, Salmonella typhimurium LT2
gacacauugaugcuggggauu

SEQ ID NO: 1865397 - RNA, 14 nt, Salmonella typhimurium LT2
gacacgccaguuca

SEQ ID NO: 1865398 - RNA, 21 nt, Salmonella typhimurium LT2
gacacgcgcgcugcgccugga

SEQ ID NO: 1865399 - RNA, 15 nt, Salmonella typhimurium LT2
gacacgcugcauaua

SEQ ID NO: 1865400 - RNA, 23 nt, Salmonella typhimurium LT2
gacacgcugcauauaacuuucaa

SEQ ID NO: 1865401 - RNA, 17 nt, Salmonella typhimurium LT2
gacacucauccagacca

SEQ ID NO: 1865402 - RNA, 15 nt, Salmonella typhimurium LT2
gacacuaucuccuuc

SEQ ID NO: 1865403 - RNA, 20 nt, Salmonella typhimurium LT2
gacaggagcgccguggaaaa

SEQ ID NO: 1865404 - RNA, 20 nt, Salmonella typhimurium LT2
gacagcuuauacugauaucu

SEQ ID NO: 1865405 - RNA, 21 nt, Salmonella typhimurium LT2
gacagcggcgcagacacugcc

SEQ ID NO: 1865406 - RNA, 16 nt, Salmonella typhimurium LT2
gacagcguaaugcgcc

SEQ ID NO: 1865407 - RNA, 17 nt, Salmonella typhimurium LT2
gacagcguaaugcgcca

SEQ ID NO: 1865408 - RNA, 21 nt, Salmonella typhimurium LT2
gacagcguaguuuauucuucu

SEQ ID NO: 1865409 - RNA, 22 nt, Salmonella typhimurium LT2
gacagcgcgcaaaaaccggagc

SEQ ID NO: 1865410 - RNA, 15 nt, Salmonella typhimurium LT2
gacagcgcuggcugu

SEQ ID NO: 1865411 - RNA, 15 nt, Salmonella typhimurium LT2
gacaucucaggcaag

SEQ ID NO: 1865412 - RNA, 23 nt, Salmonella typhimurium LT2
gacaucgucacaauaugguuauc

SEQ ID NO: 1865413 - RNA, 14 nt, Salmonella typhimurium LT2
gacaugaccgcaca

SEQ ID NO: 1865414 - RNA, 14 nt, Salmonella typhimurium LT2
gacauagccgccac

SEQ ID NO: 1865415 - RNA, 20 nt, Salmonella typhimurium LT2
gacauagugcaagaugccgu

SEQ ID NO: 1865416 - RNA, 14 nt, Salmonella typhimurium LT2
gacguaaaucugaa

SEQ ID NO: 1865417 - RNA, 18 nt, Salmonella typhimurium LT2
gacguaaacgucggccuu

SEQ ID NO: 1865418 - RNA, 13 nt, Salmonella typhimurium LT2
gacgguuuucacu

SEQ ID NO: 1865419 - RNA, 23 nt, Salmonella typhimurium LT2
gacgguuuauccccgcuggcgcg

SEQ ID NO: 1865420 - RNA, 15 nt, Salmonella typhimurium LT2
gacgggugauuucac

SEQ ID NO: 1865421 - RNA, 11 nt, Salmonella typhimurium LT2
gacguccagac

SEQ ID NO: 1865422 - RNA, 15 nt, Salmonella typhimurium LT2
gacguccguuagcug

SEQ ID NO: 1865423 - RNA, 13 nt, Salmonella typhimurium LT2
gacgugauaauaa

SEQ ID NO: 1865424 - RNA, 18 nt, Salmonella typhimurium LT2
gacgucuucguacugugg

SEQ ID NO: 1865425 - RNA, 15 nt, Salmonella typhimurium LT2
gacgucgucaccacg

SEQ ID NO: 1865426 - RNA, 21 nt, Salmonella typhimurium LT2
gacgucgguaaucacgucauu

SEQ ID NO: 1865427 - RNA, 16 nt, Salmonella typhimurium LT2
gacggauucuuccucu

SEQ ID NO: 1865428 - RNA, 22 nt, Salmonella typhimurium LT2
gacggauuggcgcucaacagcc

SEQ ID NO: 1865429 - RNA, 22 nt, Salmonella typhimurium LT2
gacggcaauagaacgucgcgcg

SEQ ID NO: 1865430 - RNA, 24 nt, Salmonella typhimurium LT2
gacggcaacggcgacaagaauaug

SEQ ID NO: 1865431 - RNA, 22 nt, Salmonella typhimurium LT2
gacggcuucuucacgcagcgcc

SEQ ID NO: 1865432 - RNA, 21 nt, Salmonella typhimurium LT2
gacgggauuaaaugacgcccu

SEQ ID NO: 1865433 - RNA, 18 nt, Salmonella typhimurium LT2
gacgccuuagccugaauu

SEQ ID NO: 1865434 - RNA, 15 nt, Salmonella typhimurium LT2
gacgcagacaauaaa

SEQ ID NO: 1865435 - RNA, 23 nt, Salmonella typhimurium LT2
gacgcagacgauaccagggcgau

SEQ ID NO: 1865436 - RNA, 23 nt, Salmonella typhimurium LT2
gacgcagacgucaacaccuccag

SEQ ID NO: 1865437 - RNA, 22 nt, Salmonella typhimurium LT2
gacgcggaacuggugaaacagg

SEQ ID NO: 1865438 - RNA, 17 nt, Salmonella typhimurium LT2
gacgcgccacuuccagc

SEQ ID NO: 1865439 - RNA, 21 nt, Salmonella typhimurium LT2
gacgcgcgagaacugcugcau

SEQ ID NO: 1865440 - RNA, 21 nt, Salmonella typhimurium LT2
gacgcgcgcgaaaagaaacug

SEQ ID NO: 1865441 - RNA, 13 nt, Salmonella typhimurium LT2
gacgcgcagcacc

SEQ ID NO: 1865442 - RNA, 21 nt, Salmonella typhimurium LT2
gacgcgcaaaacucugagcau

SEQ ID NO: 1865443 - RNA, 19 nt, Salmonella typhimurium LT2
gacgcguguugccggacca

SEQ ID NO: 1865444 - RNA, 14 nt, Salmonella typhimurium LT2
gacgcguuaauauc

SEQ ID NO: 1865445 - RNA, 22 nt, Salmonella typhimurium LT2
gacgcuaaccucuauaguaaau

SEQ ID NO: 1865446 - RNA, 20 nt, Salmonella typhimurium LT2
gacgcucgacguccagcgcg

SEQ ID NO: 1865447 - RNA, 16 nt, Salmonella typhimurium LT2
gacgcuggaaccaggu

SEQ ID NO: 1865448 - RNA, 12 nt, Salmonella typhimurium LT2
gacgcugccaca

SEQ ID NO: 1865449 - RNA, 15 nt, Salmonella typhimurium LT2
gacgcucuuccucaa

SEQ ID NO: 1865450 - RNA, 14 nt, Salmonella typhimurium LT2
gacgagcgaaaaac

SEQ ID NO: 1865451 - RNA, 15 nt, Salmonella typhimurium LT2
gacgagcgacgaggc

SEQ ID NO: 1865452 - RNA, 19 nt, Salmonella typhimurium LT2
gacgagcggugcaaaaaua

SEQ ID NO: 1865453 - RNA, 23 nt, Salmonella typhimurium LT2
gacgaccguaauagcaauacuuu

SEQ ID NO: 1865454 - RNA, 14 nt, Salmonella typhimurium LT2
gaccuuaauuucuu

SEQ ID NO: 1865455 - RNA, 17 nt, Salmonella typhimurium LT2
gaccuuaucucgcugac

SEQ ID NO: 1865456 - RNA, 17 nt, Salmonella typhimurium LT2
gaccuguuccaugacgu

SEQ ID NO: 1865457 - RNA, 22 nt, Salmonella typhimurium LT2
gaccuguucuguaggcugugca

SEQ ID NO: 1865458 - RNA, 17 nt, Salmonella typhimurium LT2
gaccuucaucucuuugc

SEQ ID NO: 1865459 - RNA, 16 nt, Salmonella typhimurium LT2
gaccgucgcgcccucc

SEQ ID NO: 1865460 - RNA, 20 nt, Salmonella typhimurium LT2
gaccguaguagguauccagc

SEQ ID NO: 1865461 - RNA, 22 nt, Salmonella typhimurium LT2
gaccgguuuuucgccgaccauc

SEQ ID NO: 1865462 - RNA, 17 nt, Salmonella typhimurium LT2
gaccguaauaucgcggg

SEQ ID NO: 1865463 - RNA, 21 nt, Salmonella typhimurium LT2
gaccgugccggauggcggagu

SEQ ID NO: 1865464 - RNA, 12 nt, Salmonella typhimurium LT2
gaccucaagaau

SEQ ID NO: 1865465 - RNA, 12 nt, Salmonella typhimurium LT2
gaccucaaaaua

SEQ ID NO: 1865466 - RNA, 15 nt, Salmonella typhimurium LT2
gaccuaauaaccagc

SEQ ID NO: 1865467 - RNA, 14 nt, Salmonella typhimurium LT2
gaccuacaggccga

SEQ ID NO: 1865468 - RNA, 21 nt, Salmonella typhimurium LT2
gaccucauccaucagcgcggg

SEQ ID NO: 1865469 - RNA, 21 nt, Salmonella typhimurium LT2
gaccgggggcuggccacugga

SEQ ID NO: 1865470 - RNA, 22 nt, Salmonella typhimurium LT2
gaccggcugauugaccuggucg

SEQ ID NO: 1865471 - RNA, 15 nt, Salmonella typhimurium LT2
gaccgcacagcagac

SEQ ID NO: 1865472 - RNA, 14 nt, Salmonella typhimurium LT2
gaccgauaaauacc

SEQ ID NO: 1865473 - RNA, 13 nt, Salmonella typhimurium LT2
gaccgagucuaca

SEQ ID NO: 1865474 - RNA, 14 nt, Salmonella typhimurium LT2
gaccgauaauaaug

SEQ ID NO: 1865475 - RNA, 22 nt, Salmonella typhimurium LT2
gaccgaucucaugcaacuggca

SEQ ID NO: 1865476 - RNA, 21 nt, Salmonella typhimurium LT2
gacuggcgaccgccaccaucc

SEQ ID NO: 1865477 - RNA, 14 nt, Salmonella typhimurium LT2
gacuggcccugccg

SEQ ID NO: 1865478 - RNA, 16 nt, Salmonella typhimurium LT2
gacugcggggagcgaa

SEQ ID NO: 1865479 - RNA, 17 nt, Salmonella typhimurium LT2
gacugcgugagcgugga

SEQ ID NO: 1865480 - RNA, 14 nt, Salmonella typhimurium LT2
gacugcuucgcugg

SEQ ID NO: 1865481 - RNA, 13 nt, Salmonella typhimurium LT2
gacugcuuuuucu

SEQ ID NO: 1865482 - RNA, 20 nt, Salmonella typhimurium LT2
gacugguggcaagauaagcc

SEQ ID NO: 1865483 - RNA, 16 nt, Salmonella typhimurium LT2
gacugugauggcgguc

SEQ ID NO: 1865484 - RNA, 15 nt, Salmonella typhimurium LT2
gacuguucacaucca

SEQ ID NO: 1865485 - RNA, 14 nt, Salmonella typhimurium LT2
gacuguggaagaga

SEQ ID NO: 1865486 - RNA, 16 nt, Salmonella typhimurium LT2
gacugucgaaaccagc

SEQ ID NO: 1865487 - RNA, 19 nt, Salmonella typhimurium LT2
gacugucgaaaccagcaua

SEQ ID NO: 1865488 - RNA, 14 nt, Salmonella typhimurium LT2
gacugucgagaugc

SEQ ID NO: 1865489 - RNA, 13 nt, Salmonella typhimurium LT2
gacuguaaaucug

SEQ ID NO: 1865490 - RNA, 20 nt, Salmonella typhimurium LT2
gacuguagauaccuacuuua

SEQ ID NO: 1865491 - RNA, 14 nt, Salmonella typhimurium LT2
gacugaccagaccg

SEQ ID NO: 1865492 - RNA, 14 nt, Salmonella typhimurium LT2
gacugauauccauc

SEQ ID NO: 1865493 - RNA, 12 nt, Salmonella typhimurium LT2
gacugccaccac

SEQ ID NO: 1865494 - RNA, 15 nt, Salmonella typhimurium LT2
gacugcccaacagca

SEQ ID NO: 1865495 - RNA, 19 nt, Salmonella typhimurium LT2
gacugccguauaauccagc

SEQ ID NO: 1865496 - RNA, 20 nt, Salmonella typhimurium LT2
gacugccguauaauccagcu

SEQ ID NO: 1865497 - RNA, 15 nt, Salmonella typhimurium LT2
gacugcgcauuaaca

SEQ ID NO: 1865498 - RNA, 23 nt, Salmonella typhimurium LT2
gacuccccacaaucccgccagac

SEQ ID NO: 1865499 - RNA, 22 nt, Salmonella typhimurium LT2
gacucccaggcgcgcagcugcc

SEQ ID NO: 1865500 - RNA, 18 nt, Salmonella typhimurium LT2
gacguugaaaaaacgggc

SEQ ID NO: 1865501 - RNA, 19 nt, Salmonella typhimurium LT2
gacguugccgcccaccugc

SEQ ID NO: 1865502 - RNA, 12 nt, Salmonella typhimurium LT2
gacguugaaaaa

SEQ ID NO: 1865503 - RNA, 19 nt, Salmonella typhimurium LT2
gacgugcggcagggcgguc

SEQ ID NO: 1865504 - RNA, 18 nt, Salmonella typhimurium LT2
gacugaaaaucaaaaaca

SEQ ID NO: 1865505 - RNA, 15 nt, Salmonella typhimurium LT2
gacucucuuuaauca

SEQ ID NO: 1865506 - RNA, 23 nt, Salmonella typhimurium LT2
gacucugaagcgggaaagcguaa

SEQ ID NO: 1865507 - RNA, 19 nt, Salmonella typhimurium LT2
gacucugaagcgggaaagc

SEQ ID NO: 1865508 - RNA, 18 nt, Salmonella typhimurium LT2
gacucgcuacgcucgccc

SEQ ID NO: 1865509 - RNA, 21 nt, Salmonella typhimurium LT2
gacucgcgccuucgccggguu

SEQ ID NO: 1865510 - RNA, 18 nt, Salmonella typhimurium LT2
gacuugucggcaaucuca

SEQ ID NO: 1865511 - RNA, 16 nt, Salmonella typhimurium LT2
gacuuugaccagcauc

SEQ ID NO: 1865512 - RNA, 13 nt, Salmonella typhimurium LT2
gacuuuggauaaa

SEQ ID NO: 1865513 - RNA, 17 nt, Salmonella typhimurium LT2
gacuuuacaccccacua

SEQ ID NO: 1865514 - RNA, 16 nt, Salmonella typhimurium LT2
gacuguucagcugaca

SEQ ID NO: 1865515 - RNA, 17 nt, Salmonella typhimurium LT2
gacuguucacauccagc

SEQ ID NO: 1865516 - RNA, 13 nt, Salmonella typhimurium LT2
gacuuaaaagaau

SEQ ID NO: 1865517 - RNA, 19 nt, Salmonella typhimurium LT2
gacuuacgcagcauuagcc

SEQ ID NO: 1865518 - RNA, 18 nt, Salmonella typhimurium LT2
gacuuaggaauacccagc

SEQ ID NO: 1865519 - RNA, 14 nt, Salmonella typhimurium LT2
gacuuauucaauca

SEQ ID NO: 1865520 - RNA, 14 nt, Salmonella typhimurium LT2
gacuucgccucagc

SEQ ID NO: 1865521 - RNA, 17 nt, Salmonella typhimurium LT2
gacuucgucaaagaucu

SEQ ID NO: 1865522 - RNA, 23 nt, Salmonella typhimurium LT2
gacuucauuuuccacaauaccgu

SEQ ID NO: 1865523 - RNA, 14 nt, Salmonella typhimurium LT2
gacuucauuuucca

SEQ ID NO: 1865524 - RNA, 17 nt, Salmonella typhimurium LT2
gacuucacuuucaagcc

SEQ ID NO: 1865525 - RNA, 20 nt, Salmonella typhimurium LT2
gagaaaauaccgcacaucac

SEQ ID NO: 1865526 - RNA, 22 nt, Salmonella typhimurium LT2
gagaaaaauacgccagauaacg

SEQ ID NO: 1865527 - RNA, 13 nt, Salmonella typhimurium LT2
gacuuuuccuucc

SEQ ID NO: 1865528 - RNA, 22 nt, Salmonella typhimurium LT2
gacuuuuugaaaucacgccaca

SEQ ID NO: 1865529 - RNA, 18 nt, Salmonella typhimurium LT2
gacuuuuuccccgcgcug

SEQ ID NO: 1865530 - RNA, 17 nt, Salmonella typhimurium LT2
gagaaaaaaauccagua

SEQ ID NO: 1865531 - RNA, 20 nt, Salmonella typhimurium LT2
gacuuuuuugccuuucagau

SEQ ID NO: 1865532 - RNA, 17 nt, Salmonella typhimurium LT2
gagaaagugguggguga

SEQ ID NO: 1865533 - RNA, 12 nt, Salmonella typhimurium LT2
gagaaaguggug

SEQ ID NO: 1865534 - RNA, 18 nt, Salmonella typhimurium LT2
aaagcaacaugaaaggga

SEQ ID NO: 1865535 - RNA, 23 nt, Salmonella typhimurium LT2
aaagcaaccagaaugcccaggcc

SEQ ID NO: 1865536 - RNA, 22 nt, Salmonella typhimurium LT2
aaagcaauguaagaauaacaau

SEQ ID NO: 1865537 - RNA, 16 nt, Salmonella typhimurium LT2
gagaauuuccaguuca

SEQ ID NO: 1865538 - RNA, 21 nt, Salmonella typhimurium LT2
gagaauugacgauaucaucuu

SEQ ID NO: 1865539 - RNA, 21 nt, Salmonella typhimurium LT2
gagaagcccggccacagcgcc

SEQ ID NO: 1865540 - RNA, 15 nt, Salmonella typhimurium LT2
gagaacuauuugccu

SEQ ID NO: 1865541 - RNA, 17 nt, Salmonella typhimurium LT2
gagaauggaugugaaug

SEQ ID NO: 1865542 - RNA, 16 nt, Salmonella typhimurium LT2
gagaauggccagcaca

SEQ ID NO: 1865543 - RNA, 15 nt, Salmonella typhimurium LT2
gagaaucgaucagcu

SEQ ID NO: 1865544 - RNA, 15 nt, Salmonella typhimurium LT2
gagaaucgccaggau

SEQ ID NO: 1865545 - RNA, 19 nt, Salmonella typhimurium LT2
gagaaucaccuggcagccg

SEQ ID NO: 1865546 - RNA, 18 nt, Salmonella typhimurium LT2
gagaaucaccuggcagcc

SEQ ID NO: 1865547 - RNA, 15 nt, Salmonella typhimurium LT2
gagagauccugagaa

SEQ ID NO: 1865548 - RNA, 23 nt, Salmonella typhimurium LT2
gagagcgauaaacucagcgccag

SEQ ID NO: 1865549 - RNA, 20 nt, Salmonella typhimurium LT2
gagagcgcuucuaacaaaac

SEQ ID NO: 1865550 - RNA, 18 nt, Salmonella typhimurium LT2
gagagcaucaucugccau

SEQ ID NO: 1865551 - RNA, 18 nt, Salmonella typhimurium LT2
gagagaaaaaaauccagu

SEQ ID NO: 1865552 - RNA, 12 nt, Salmonella typhimurium LT2
gagagaaaaaaa

SEQ ID NO: 1865553 - RNA, 13 nt, Salmonella typhimurium LT2
gagacucaaagaa

SEQ ID NO: 1865554 - RNA, 15 nt, Salmonella typhimurium LT2
gagaucagcaguugc

SEQ ID NO: 1865555 - RNA, 17 nt, Salmonella typhimurium LT2
gagauauuuugucaggc

SEQ ID NO: 1865556 - RNA, 14 nt, Salmonella typhimurium LT2
gagauaauuuauga

SEQ ID NO: 1865557 - RNA, 19 nt, Salmonella typhimurium LT2
gagauaaccaucgcgcagc

SEQ ID NO: 1865558 - RNA, 16 nt, Salmonella typhimurium LT2
gagauaauccagccac

SEQ ID NO: 1865559 - RNA, 19 nt, Salmonella typhimurium LT2
gagagcguauccagcaccu

SEQ ID NO: 1865560 - RNA, 18 nt, Salmonella typhimurium LT2
gagagcguauccagcacc

SEQ ID NO: 1865561 - RNA, 13 nt, Salmonella typhimurium LT2
gagcaaugggaag

SEQ ID NO: 1865562 - RNA, 18 nt, Salmonella typhimurium LT2
gagcaaugggaaggaaaa

SEQ ID NO: 1865563 - RNA, 18 nt, Salmonella typhimurium LT2
gagaugaucguuuccagc

SEQ ID NO: 1865564 - RNA, 14 nt, Salmonella typhimurium LT2
gagaugcaggccaa

SEQ ID NO: 1865565 - RNA, 17 nt, Salmonella typhimurium LT2
gagaugcauaaaaaaac

SEQ ID NO: 1865566 - RNA, 23 nt, Salmonella typhimurium LT2
gagcagaaaaagucauuuucaug

SEQ ID NO: 1865567 - RNA, 17 nt, Salmonella typhimurium LT2
gagcacuucugacauuc

SEQ ID NO: 1865568 - RNA, 16 nt, Salmonella typhimurium LT2
gagcacugcccaggac

SEQ ID NO: 1865569 - RNA, 16 nt, Salmonella typhimurium LT2
aaagcagauagagcau

SEQ ID NO: 1865570 - RNA, 18 nt, Salmonella typhimurium LT2
gagcagguuacucuucca

SEQ ID NO: 1865571 - RNA, 22 nt, Salmonella typhimurium LT2
gagcaggcuuacgauauuuuuc

SEQ ID NO: 1865572 - RNA, 21 nt, Salmonella typhimurium LT2
gagcccugugcgguauugaua

SEQ ID NO: 1865573 - RNA, 13 nt, Salmonella typhimurium LT2
gagcccaguagcc

SEQ ID NO: 1865574 - RNA, 21 nt, Salmonella typhimurium LT2
gagccaucggcaaacgccgcc

SEQ ID NO: 1865575 - RNA, 19 nt, Salmonella typhimurium LT2
gagccauuaaugcaggcag

SEQ ID NO: 1865576 - RNA, 23 nt, Salmonella typhimurium LT2
gagcauaucaacggucaggcugu

SEQ ID NO: 1865577 - RNA, 13 nt, Salmonella typhimurium LT2
aaagcagcugcug

SEQ ID NO: 1865578 - RNA, 20 nt, Salmonella typhimurium LT2
gagcaucaucugccauuucu

SEQ ID NO: 1865579 - RNA, 18 nt, Salmonella typhimurium LT2
gauacaaggcaaucugau

SEQ ID NO: 1865580 - RNA, 23 nt, Salmonella typhimurium LT2
aaagcagugaauccccagaauuu

SEQ ID NO: 1865581 - RNA, 12 nt, Salmonella typhimurium LT2
aaagcagugcag

SEQ ID NO: 1865582 - RNA, 14 nt, Salmonella typhimurium LT2
aaagcaucugccgg

SEQ ID NO: 1865583 - RNA, 14 nt, Salmonella typhimurium LT2
gauaccgaagacgg

SEQ ID NO: 1865584 - RNA, 18 nt, Salmonella typhimurium LT2
gauaccccgccaaaccgg

SEQ ID NO: 1865585 - RNA, 13 nt, Salmonella typhimurium LT2
gauacccugaauc

SEQ ID NO: 1865586 - RNA, 19 nt, Salmonella typhimurium LT2
gauacccagcgucccggcg

SEQ ID NO: 1865587 - RNA, 15 nt, Salmonella typhimurium LT2
gauacccaccagcgu

SEQ ID NO: 1865588 - RNA, 22 nt, Salmonella typhimurium LT2
gauaccagggcgaugcccccag

SEQ ID NO: 1865589 - RNA, 12 nt, Salmonella typhimurium LT2
gauaccaguaau

SEQ ID NO: 1865590 - RNA, 15 nt, Salmonella typhimurium LT2
gauaccaguacaaca

SEQ ID NO: 1865591 - RNA, 18 nt, Salmonella typhimurium LT2
gauaccagccaacaguau

SEQ ID NO: 1865592 - RNA, 22 nt, Salmonella typhimurium LT2
gauaccagccuucggacugcug

SEQ ID NO: 1865593 - RNA, 15 nt, Salmonella typhimurium LT2
gauacagccaaauca

SEQ ID NO: 1865594 - RNA, 15 nt, Salmonella typhimurium LT2
gauacagaaaaccgg

SEQ ID NO: 1865595 - RNA, 18 nt, Salmonella typhimurium LT2
gauacauggcuauuccac

SEQ ID NO: 1865596 - RNA, 21 nt, Salmonella typhimurium LT2
gauaccaaaaucggcuucucc

SEQ ID NO: 1865597 - RNA, 22 nt, Salmonella typhimurium LT2
gauacauauuucgaucggccag

SEQ ID NO: 1865598 - RNA, 14 nt, Salmonella typhimurium LT2
gauaccaaauuacg

SEQ ID NO: 1865599 - RNA, 18 nt, Salmonella typhimurium LT2
gauaccaauucccagacc

SEQ ID NO: 1865600 - RNA, 16 nt, Salmonella typhimurium LT2
gauaaggcgugagcca

SEQ ID NO: 1865601 - RNA, 23 nt, Salmonella typhimurium LT2
gauaaggcggagccgccauccgg

SEQ ID NO: 1865602 - RNA, 19 nt, Salmonella typhimurium LT2
gauaaggcguaacacguua

SEQ ID NO: 1865603 - RNA, 22 nt, Salmonella typhimurium LT2
gauaaggucgcuauccagcagu

SEQ ID NO: 1865604 - RNA, 18 nt, Salmonella typhimurium LT2
gauaagucaugagcuauu

SEQ ID NO: 1865605 - RNA, 19 nt, Salmonella typhimurium LT2
gauaauauccccuaaauaa

SEQ ID NO: 1865606 - RNA, 11 nt, Salmonella typhimurium LT2
gauaauaauga

SEQ ID NO: 1865607 - RNA, 12 nt, Salmonella typhimurium LT2
gauaauaaaaua

SEQ ID NO: 1865608 - RNA, 13 nt, Salmonella typhimurium LT2
gauaauaaaauau

SEQ ID NO: 1865609 - RNA, 15 nt, Salmonella typhimurium LT2
gauaaugacauccag

SEQ ID NO: 1865610 - RNA, 19 nt, Salmonella typhimurium LT2
gauaaugcuuucgccagcc

SEQ ID NO: 1865611 - RNA, 13 nt, Salmonella typhimurium LT2
gauaaucaccagc

SEQ ID NO: 1865612 - RNA, 19 nt, Salmonella typhimurium LT2
gauaauauuaucagcaaua

SEQ ID NO: 1865613 - RNA, 17 nt, Salmonella typhimurium LT2
gauaaucauacagcgca

SEQ ID NO: 1865614 - RNA, 17 nt, Salmonella typhimurium LT2
gauaauccagacaaaca

SEQ ID NO: 1865615 - RNA, 14 nt, Salmonella typhimurium LT2
gauaauccagccac

SEQ ID NO: 1865616 - RNA, 17 nt, Salmonella typhimurium LT2
gauacguuugaaaugaa

SEQ ID NO: 1865617 - RNA, 17 nt, Salmonella typhimurium LT2
gauacgucuuacgccau

SEQ ID NO: 1865618 - RNA, 14 nt, Salmonella typhimurium LT2
gauacguuccagca

SEQ ID NO: 1865619 - RNA, 21 nt, Salmonella typhimurium LT2
gauaccggcgcagcaucugcg

SEQ ID NO: 1865620 - RNA, 18 nt, Salmonella typhimurium LT2
gauaccgucuuccuucca

SEQ ID NO: 1865621 - RNA, 21 nt, Salmonella typhimurium LT2
gauacggcguuggcugcucuu

SEQ ID NO: 1865622 - RNA, 18 nt, Salmonella typhimurium LT2
gauacucagccccaggcc

SEQ ID NO: 1865623 - RNA, 14 nt, Salmonella typhimurium LT2
gauagcaucuuccu

SEQ ID NO: 1865624 - RNA, 15 nt, Salmonella typhimurium LT2
gauagccguaaauaa

SEQ ID NO: 1865625 - RNA, 17 nt, Salmonella typhimurium LT2
gauagccguaaauaauc

SEQ ID NO: 1865626 - RNA, 16 nt, Salmonella typhimurium LT2
gauauauucagcaaau

SEQ ID NO: 1865627 - RNA, 19 nt, Salmonella typhimurium LT2
gauaucaacgucuugccau

SEQ ID NO: 1865628 - RNA, 22 nt, Salmonella typhimurium LT2
gauauaaaacgggccacugcug

SEQ ID NO: 1865629 - RNA, 15 nt, Salmonella typhimurium LT2
gauagcguuuuccag

SEQ ID NO: 1865630 - RNA, 20 nt, Salmonella typhimurium LT2
gauaguuuaaauccagcgcg

SEQ ID NO: 1865631 - RNA, 19 nt, Salmonella typhimurium LT2
gauagcgcuuuccaguccc

SEQ ID NO: 1865632 - RNA, 13 nt, Salmonella typhimurium LT2
gauagcggcggcg

SEQ ID NO: 1865633 - RNA, 21 nt, Salmonella typhimurium LT2
gauagcgaccugcggacuguu

SEQ ID NO: 1865634 - RNA, 17 nt, Salmonella typhimurium LT2
gauauuuucaccuccac

SEQ ID NO: 1865635 - RNA, 15 nt, Salmonella typhimurium LT2
gauauucugcacgca

SEQ ID NO: 1865636 - RNA, 18 nt, Salmonella typhimurium LT2
gauauugccuuauucaca

SEQ ID NO: 1865637 - RNA, 18 nt, Salmonella typhimurium LT2
gauauucccguuccagcu

SEQ ID NO: 1865638 - RNA, 15 nt, Salmonella typhimurium LT2
gauauuccauacggu

SEQ ID NO: 1865639 - RNA, 13 nt, Salmonella typhimurium LT2
gauaucgcuggcc

SEQ ID NO: 1865640 - RNA, 19 nt, Salmonella typhimurium LT2
gauaucaggacuuuuuccc

SEQ ID NO: 1865641 - RNA, 19 nt, Salmonella typhimurium LT2
gauauccagcaaugcacug

SEQ ID NO: 1865642 - RNA, 22 nt, Salmonella typhimurium LT2
gauauccgcgcucaacacauaa

SEQ ID NO: 1865643 - RNA, 18 nt, Salmonella typhimurium LT2
gauaucgcuaaccaggcc

SEQ ID NO: 1865644 - RNA, 17 nt, Salmonella typhimurium LT2
gauaucgccugguguga

SEQ ID NO: 1865645 - RNA, 14 nt, Salmonella typhimurium LT2
gagucuacaucaag

SEQ ID NO: 1865646 - RNA, 20 nt, Salmonella typhimurium LT2
gagucuuauccgacugacca

SEQ ID NO: 1865647 - RNA, 19 nt, Salmonella typhimurium LT2
gagucugaaaacucacgcc

SEQ ID NO: 1865648 - RNA, 23 nt, Salmonella typhimurium LT2
gagucguuauccagaucuucaga

SEQ ID NO: 1865649 - RNA, 13 nt, Salmonella typhimurium LT2
gagucuaaaaaua

SEQ ID NO: 1865650 - RNA, 13 nt, Salmonella typhimurium LT2
gagucgucaaauu

SEQ ID NO: 1865651 - RNA, 13 nt, Salmonella typhimurium LT2
gaguccagcggca

SEQ ID NO: 1865652 - RNA, 18 nt, Salmonella typhimurium LT2
gagguucccgccgccauc

SEQ ID NO: 1865653 - RNA, 13 nt, Salmonella typhimurium LT2
gagguguuuccag

SEQ ID NO: 1865654 - RNA, 20 nt, Salmonella typhimurium LT2
gaguauagcggcguuuauau

SEQ ID NO: 1865655 - RNA, 18 nt, Salmonella typhimurium LT2
gaguaucggcgauuaagu

SEQ ID NO: 1865656 - RNA, 16 nt, Salmonella typhimurium LT2
gaguaguuaaaaaagg

SEQ ID NO: 1865657 - RNA, 17 nt, Salmonella typhimurium LT2
gaguauacagacagcag

SEQ ID NO: 1865658 - RNA, 23 nt, Salmonella typhimurium LT2
gaguugcuuaaaggcggcaaggg

SEQ ID NO: 1865659 - RNA, 15 nt, Salmonella typhimurium LT2
gagugcguucuucca

SEQ ID NO: 1865660 - RNA, 19 nt, Salmonella typhimurium LT2
gagugcguucuuccacuuc

SEQ ID NO: 1865661 - RNA, 16 nt, Salmonella typhimurium LT2
gaguucauagcgcaca

SEQ ID NO: 1865662 - RNA, 22 nt, Salmonella typhimurium LT2
gauaaaguuagcguuauggaag

SEQ ID NO: 1865663 - RNA, 16 nt, Salmonella typhimurium LT2
gauaaaaagacagaua

SEQ ID NO: 1865664 - RNA, 18 nt, Salmonella typhimurium LT2
gauaaaaacacccgcacc

SEQ ID NO: 1865665 - RNA, 20 nt, Salmonella typhimurium LT2
gagggcgcgccguugaaauc

SEQ ID NO: 1865666 - RNA, 16 nt, Salmonella typhimurium LT2
gaggucauuauucagg

SEQ ID NO: 1865667 - RNA, 13 nt, Salmonella typhimurium LT2
gagguggaauaca

SEQ ID NO: 1865668 - RNA, 23 nt, Salmonella typhimurium LT2
gaggauuuucgcgucggacaggg

SEQ ID NO: 1865669 - RNA, 23 nt, Salmonella typhimurium LT2
gaggcaggggcucuaaaaaggaa

SEQ ID NO: 1865670 - RNA, 21 nt, Salmonella typhimurium LT2
gaggcaggggcucuaaaaagg

SEQ ID NO: 1865671 - RNA, 21 nt, Salmonella typhimurium LT2
gaggcacgguauuaacggcga

SEQ ID NO: 1865672 - RNA, 21 nt, Salmonella typhimurium LT2
gaggcguagccgaaacccaac

SEQ ID NO: 1865673 - RNA, 14 nt, Salmonella typhimurium LT2
gaggcugccgauga

SEQ ID NO: 1865674 - RNA, 15 nt, Salmonella typhimurium LT2
gaggcuugcagcauu

SEQ ID NO: 1865675 - RNA, 21 nt, Salmonella typhimurium LT2
gaggaugaaaaguauggcggu

SEQ ID NO: 1865676 - RNA, 17 nt, Salmonella typhimurium LT2
gaggaauuguccacccu

SEQ ID NO: 1865677 - RNA, 20 nt, Salmonella typhimurium LT2
gaggaagcugcgcagcacuu

SEQ ID NO: 1865678 - RNA, 14 nt, Salmonella typhimurium LT2
gagcuggcggcgga

SEQ ID NO: 1865679 - RNA, 13 nt, Salmonella typhimurium LT2
gagcgacaaaucu

SEQ ID NO: 1865680 - RNA, 22 nt, Salmonella typhimurium LT2
gagcgacaaaucugccgggagc

SEQ ID NO: 1865681 - RNA, 18 nt, Salmonella typhimurium LT2
gagcuguagcgaagggua

SEQ ID NO: 1865682 - RNA, 14 nt, Salmonella typhimurium LT2
ggccggccgcggcg

SEQ ID NO: 1865683 - RNA, 16 nt, Salmonella typhimurium LT2
ggccggaugaggcgca

SEQ ID NO: 1865684 - RNA, 21 nt, Salmonella typhimurium LT2
ggccgcgcugaugugcggccu

SEQ ID NO: 1865685 - RNA, 20 nt, Salmonella typhimurium LT2
ggccgcgaugguuacuccuc

SEQ ID NO: 1865686 - RNA, 16 nt, Salmonella typhimurium LT2
aaaguuuauuugaaua

SEQ ID NO: 1865687 - RNA, 12 nt, Salmonella typhimurium LT2
ggccgcucgccu

SEQ ID NO: 1865688 - RNA, 14 nt, Salmonella typhimurium LT2
ggccgcucgccugc

SEQ ID NO: 1865689 - RNA, 19 nt, Salmonella typhimurium LT2
ggccgauauugcggccuuc

SEQ ID NO: 1865690 - RNA, 22 nt, Salmonella typhimurium LT2
aaagugccagggcggaagcaga

SEQ ID NO: 1865691 - RNA, 18 nt, Salmonella typhimurium LT2
aaagugcgcacucagaaa

SEQ ID NO: 1865692 - RNA, 20 nt, Salmonella typhimurium LT2
ggccauuugcggaauaugag

SEQ ID NO: 1865693 - RNA, 13 nt, Salmonella typhimurium LT2
ggccgcagcgcca

SEQ ID NO: 1865694 - RNA, 23 nt, Salmonella typhimurium LT2
aaagugggcgcuuuguuacucuu

SEQ ID NO: 1865695 - RNA, 15 nt, Salmonella typhimurium LT2
aaaguggugggugau

SEQ ID NO: 1865696 - RNA, 16 nt, Salmonella typhimurium LT2
aaagugguuuuaagcu

SEQ ID NO: 1865697 - RNA, 16 nt, Salmonella typhimurium LT2
ggccgccgcacaggcg

SEQ ID NO: 1865698 - RNA, 16 nt, Salmonella typhimurium LT2
ggccgccaucuccggc

SEQ ID NO: 1865699 - RNA, 12 nt, Salmonella typhimurium LT2
ggccgccagaga

SEQ ID NO: 1865700 - RNA, 22 nt, Salmonella typhimurium LT2
ggccgccagcgugacccagaca

SEQ ID NO: 1865701 - RNA, 18 nt, Salmonella typhimurium LT2
ggccgccacgaccugcag

SEQ ID NO: 1865702 - RNA, 18 nt, Salmonella typhimurium LT2
aaaguuaacgauaguggu

SEQ ID NO: 1865703 - RNA, 17 nt, Salmonella typhimurium LT2
ggccgucaaaccggcgg

SEQ ID NO: 1865704 - RNA, 21 nt, Salmonella typhimurium LT2
ggccgucccacgcgccgccga

SEQ ID NO: 1865705 - RNA, 23 nt, Salmonella typhimurium LT2
ggccgugauccugguccggcagg

SEQ ID NO: 1865706 - RNA, 16 nt, Salmonella typhimurium LT2
aaaguuugaccagcaa

SEQ ID NO: 1865707 - RNA, 19 nt, Salmonella typhimurium LT2
aaaguuugaccagcaauaa

SEQ ID NO: 1865708 - RNA, 23 nt, Salmonella typhimurium LT2
ggccguucauucgccccagcaua

SEQ ID NO: 1865709 - RNA, 20 nt, Salmonella typhimurium LT2
ggccguggaucucgucgccg

SEQ ID NO: 1865710 - RNA, 15 nt, Salmonella typhimurium LT2
ggccguuuucaugca

SEQ ID NO: 1865711 - RNA, 14 nt, Salmonella typhimurium LT2
ggccuacaagccgc

SEQ ID NO: 1865712 - RNA, 17 nt, Salmonella typhimurium LT2
ggccuacaagccgccuc

SEQ ID NO: 1865713 - RNA, 22 nt, Salmonella typhimurium LT2
ggccuagaugaaugacugucca

SEQ ID NO: 1865714 - RNA, 16 nt, Salmonella typhimurium LT2
ggccuacauucauuaa

SEQ ID NO: 1865715 - RNA, 17 nt, Salmonella typhimurium LT2
ggccuacagacuguacc

SEQ ID NO: 1865716 - RNA, 12 nt, Salmonella typhimurium LT2
ggccuccugacg

SEQ ID NO: 1865717 - RNA, 13 nt, Salmonella typhimurium LT2
ggccuccuggcuu

SEQ ID NO: 1865718 - RNA, 22 nt, Salmonella typhimurium LT2
ggccugaaugcagaccucugcu

SEQ ID NO: 1865719 - RNA, 20 nt, Salmonella typhimurium LT2
ggccugaauaaugaccucca

SEQ ID NO: 1865720 - RNA, 21 nt, Salmonella typhimurium LT2
ggccucuuuuuagcagcaaua

SEQ ID NO: 1865721 - RNA, 18 nt, Salmonella typhimurium LT2
ggccuggcugagaaaaau

SEQ ID NO: 1865722 - RNA, 12 nt, Salmonella typhimurium LT2
aaauaaaaacca

SEQ ID NO: 1865723 - RNA, 13 nt, Salmonella typhimurium LT2
aaauaaaaaccau

SEQ ID NO: 1865724 - RNA, 15 nt, Salmonella typhimurium LT2
aaauaaaaaccauuu

SEQ ID NO: 1865725 - RNA, 15 nt, Salmonella typhimurium LT2
aaauaaaaaaggcag

SEQ ID NO: 1865726 - RNA, 18 nt, Salmonella typhimurium LT2
aaauaaaauuguuauuua

SEQ ID NO: 1865727 - RNA, 21 nt, Salmonella typhimurium LT2
aaauaaacgcuugacucugaa

SEQ ID NO: 1865728 - RNA, 16 nt, Salmonella typhimurium LT2
ggccuggagaucagca

SEQ ID NO: 1865729 - RNA, 12 nt, Salmonella typhimurium LT2
ggccuggagauc

SEQ ID NO: 1865730 - RNA, 23 nt, Salmonella typhimurium LT2
ggccugcagaauuucuacacagc

SEQ ID NO: 1865731 - RNA, 19 nt, Salmonella typhimurium LT2
ggccuuauccagacgcuga

SEQ ID NO: 1865732 - RNA, 22 nt, Salmonella typhimurium LT2
ggccuuauuuauagcaaauaug

SEQ ID NO: 1865733 - RNA, 17 nt, Salmonella typhimurium LT2
aaauaaagguucauauu

SEQ ID NO: 1865734 - RNA, 18 nt, Salmonella typhimurium LT2
aaauaaaugccgcaauaa

SEQ ID NO: 1865735 - RNA, 16 nt, Salmonella typhimurium LT2
aaauaaauccaugaga

SEQ ID NO: 1865736 - RNA, 15 nt, Salmonella typhimurium LT2
ggcgaauaaaauuca

SEQ ID NO: 1865737 - RNA, 14 nt, Salmonella typhimurium LT2
ggcgaaucgccugu

SEQ ID NO: 1865738 - RNA, 16 nt, Salmonella typhimurium LT2
ggcgaauagucgccgc

SEQ ID NO: 1865739 - RNA, 22 nt, Salmonella typhimurium LT2
ggccuucuuguuuucuacucuu

SEQ ID NO: 1865740 - RNA, 14 nt, Salmonella typhimurium LT2
aaauacugauuaau

SEQ ID NO: 1865741 - RNA, 15 nt, Salmonella typhimurium LT2
ggcgcggggaacaca

SEQ ID NO: 1865742 - RNA, 20 nt, Salmonella typhimurium LT2
ggcgcgguauuucgccgccg

SEQ ID NO: 1865743 - RNA, 20 nt, Salmonella typhimurium LT2
ggcgcuaaggcaucucuggc

SEQ ID NO: 1865744 - RNA, 13 nt, Salmonella typhimurium LT2
ggcgcuaaugcuu

SEQ ID NO: 1865745 - RNA, 15 nt, Salmonella typhimurium LT2
ggcgcuaucgccucc

SEQ ID NO: 1865746 - RNA, 17 nt, Salmonella typhimurium LT2
ggcgcuaucgccuccag

SEQ ID NO: 1865747 - RNA, 17 nt, Salmonella typhimurium LT2
ggcgccgccagccagga

SEQ ID NO: 1865748 - RNA, 17 nt, Salmonella typhimurium LT2
ggcgccgaagcaggcgg

SEQ ID NO: 1865749 - RNA, 16 nt, Salmonella typhimurium LT2
ggcgcgauauccacca

SEQ ID NO: 1865750 - RNA, 21 nt, Salmonella typhimurium LT2
ggcgccgugaguuucagcauc

SEQ ID NO: 1865751 - RNA, 16 nt, Salmonella typhimurium LT2
ggcgcagcaaacggca

SEQ ID NO: 1865752 - RNA, 22 nt, Salmonella typhimurium LT2
ggcgcagcgaaacugcgcgccg

SEQ ID NO: 1865753 - RNA, 15 nt, Salmonella typhimurium LT2
aaauacccucaguuc

SEQ ID NO: 1865754 - RNA, 15 nt, Salmonella typhimurium LT2
ggcgcauaucgcccu

SEQ ID NO: 1865755 - RNA, 18 nt, Salmonella typhimurium LT2
ggcgcaguuuacgcagcg

SEQ ID NO: 1865756 - RNA, 18 nt, Salmonella typhimurium LT2
ggcgcaucugaaaaaccu

SEQ ID NO: 1865757 - RNA, 12 nt, Salmonella typhimurium LT2
ggcgccauuucg

SEQ ID NO: 1865758 - RNA, 19 nt, Salmonella typhimurium LT2
ggcgccauuccugccgccg

SEQ ID NO: 1865759 - RNA, 15 nt, Salmonella typhimurium LT2
ggcgcccauccgccc

SEQ ID NO: 1865760 - RNA, 16 nt, Salmonella typhimurium LT2
ggcgacaaacagcgcc

SEQ ID NO: 1865761 - RNA, 23 nt, Salmonella typhimurium LT2
aaauacagagucgcuuaucugcu

SEQ ID NO: 1865762 - RNA, 18 nt, Salmonella typhimurium LT2
ggcgaucaucgcaggcgg

SEQ ID NO: 1865763 - RNA, 21 nt, Salmonella typhimurium LT2
ggcgauaaaccaacagccgcc

SEQ ID NO: 1865764 - RNA, 23 nt, Salmonella typhimurium LT2
ggcgauaaaccaacagccgccug

SEQ ID NO: 1865765 - RNA, 17 nt, Salmonella typhimurium LT2
ggcgauaaaccagcccc

SEQ ID NO: 1865766 - RNA, 20 nt, Salmonella typhimurium LT2
ggcgaguuuggugcccgcgu

SEQ ID NO: 1865767 - RNA, 17 nt, Salmonella typhimurium LT2
ggcgcacacccugcaga

SEQ ID NO: 1865768 - RNA, 13 nt, Salmonella typhimurium LT2
ggcgcacagcgcc

SEQ ID NO: 1865769 - RNA, 16 nt, Salmonella typhimurium LT2
ggcgcacacgcccagg

SEQ ID NO: 1865770 - RNA, 13 nt, Salmonella typhimurium LT2
ggcgcacaggccu

SEQ ID NO: 1865771 - RNA, 15 nt, Salmonella typhimurium LT2
ggcgcaauaacgaua

SEQ ID NO: 1865772 - RNA, 19 nt, Salmonella typhimurium LT2
ggcgcaaucuuugccgcaa

SEQ ID NO: 1865773 - RNA, 13 nt, Salmonella typhimurium LT2
ggcgauggcgcau

SEQ ID NO: 1865774 - RNA, 22 nt, Salmonella typhimurium LT2
ggcgugguggauauccagcaua

SEQ ID NO: 1865775 - RNA, 23 nt, Salmonella typhimurium LT2
ggcguuacuccgcgauagagcgc

SEQ ID NO: 1865776 - RNA, 23 nt, Salmonella typhimurium LT2
ggcguuacuggcgaccggcagcc

SEQ ID NO: 1865777 - RNA, 17 nt, Salmonella typhimurium LT2
ggcguuaucuugacaug

SEQ ID NO: 1865778 - RNA, 16 nt, Salmonella typhimurium LT2
ggcgucgccugugccg

SEQ ID NO: 1865779 - RNA, 11 nt, Salmonella typhimurium LT2
ggcgucgccgc

SEQ ID NO: 1865780 - RNA, 19 nt, Salmonella typhimurium LT2
ggcguuuauauaaaaauag

SEQ ID NO: 1865781 - RNA, 16 nt, Salmonella typhimurium LT2
ggcguuuugccgggcg

SEQ ID NO: 1865782 - RNA, 17 nt, Salmonella typhimurium LT2
ggcuaagccaaaaauaa

SEQ ID NO: 1865783 - RNA, 23 nt, Salmonella typhimurium LT2
ggcuaauaugccaggcuuccugc

SEQ ID NO: 1865784 - RNA, 18 nt, Salmonella typhimurium LT2
ggcuaacguuaaggaaac

SEQ ID NO: 1865785 - RNA, 23 nt, Salmonella typhimurium LT2
ggcuacggaguucaccgccggcg

SEQ ID NO: 1865786 - RNA, 22 nt, Salmonella typhimurium LT2
ggcucaaacggccugcgcugga

SEQ ID NO: 1865787 - RNA, 15 nt, Salmonella typhimurium LT2
ggcuauaggccauca

SEQ ID NO: 1865788 - RNA, 22 nt, Salmonella typhimurium LT2
ggcuaucaccucugcgggcucc

SEQ ID NO: 1865789 - RNA, 18 nt, Salmonella typhimurium LT2
ggcuagcccgcugcgccg

SEQ ID NO: 1865790 - RNA, 15 nt, Salmonella typhimurium LT2
ggcucaauaugccag

SEQ ID NO: 1865791 - RNA, 18 nt, Salmonella typhimurium LT2
ggcucagcauagcgcuga

SEQ ID NO: 1865792 - RNA, 17 nt, Salmonella typhimurium LT2
ggcgcuuuguuacucuu

SEQ ID NO: 1865793 - RNA, 22 nt, Salmonella typhimurium LT2
ggcgcuggggugcgccgcagcg

SEQ ID NO: 1865794 - RNA, 14 nt, Salmonella typhimurium LT2
ggcggcgugcgccc

SEQ ID NO: 1865795 - RNA, 14 nt, Salmonella typhimurium LT2
ggcggcucagggca

SEQ ID NO: 1865796 - RNA, 19 nt, Salmonella typhimurium LT2
ggcggcguuuauacgugug

SEQ ID NO: 1865797 - RNA, 14 nt, Salmonella typhimurium LT2
ggcggcguaaacac

SEQ ID NO: 1865798 - RNA, 20 nt, Salmonella typhimurium LT2
ggcggcgacuggcuaaacaa

SEQ ID NO: 1865799 - RNA, 18 nt, Salmonella typhimurium LT2
ggcggugauuuaaggcug

SEQ ID NO: 1865800 - RNA, 19 nt, Salmonella typhimurium LT2
ggcggucuggauuuggcug

SEQ ID NO: 1865801 - RNA, 21 nt, Salmonella typhimurium LT2
ggcguaaaugugcgccagccu

SEQ ID NO: 1865802 - RNA, 13 nt, Salmonella typhimurium LT2
ggcguaaaacugg

SEQ ID NO: 1865803 - RNA, 18 nt, Salmonella typhimurium LT2
ggcgguuugacggcugca

SEQ ID NO: 1865804 - RNA, 12 nt, Salmonella typhimurium LT2
ggcguaccagaa

SEQ ID NO: 1865805 - RNA, 15 nt, Salmonella typhimurium LT2
ggcguaauccagcuu

SEQ ID NO: 1865806 - RNA, 20 nt, Salmonella typhimurium LT2
ggcgucacccgccggcagua

SEQ ID NO: 1865807 - RNA, 20 nt, Salmonella typhimurium LT2
ggcguacuaaauaggcggca

SEQ ID NO: 1865808 - RNA, 21 nt, Salmonella typhimurium LT2
ggcguacuaaauaggcggcau

SEQ ID NO: 1865809 - RNA, 19 nt, Salmonella typhimurium LT2
ggcgucacguucgucgccg

SEQ ID NO: 1865810 - RNA, 22 nt, Salmonella typhimurium LT2
ggcgucagcaugguguguuccc

SEQ ID NO: 1865811 - RNA, 13 nt, Salmonella typhimurium LT2
ggcgucaggccgg

SEQ ID NO: 1865812 - RNA, 14 nt, Salmonella typhimurium LT2
ggccaucaugcagg

SEQ ID NO: 1865813 - RNA, 16 nt, Salmonella typhimurium LT2
ggccaguagcgggggc

SEQ ID NO: 1865814 - RNA, 16 nt, Salmonella typhimurium LT2
ggccaggcauugauaa

SEQ ID NO: 1865815 - RNA, 15 nt, Salmonella typhimurium LT2
ggccacucuccagca

SEQ ID NO: 1865816 - RNA, 17 nt, Salmonella typhimurium LT2
ggccagcaguuccacca

SEQ ID NO: 1865817 - RNA, 21 nt, Salmonella typhimurium LT2
ggccagccgacgcucuuccuc

SEQ ID NO: 1865818 - RNA, 16 nt, Salmonella typhimurium LT2
ggccagcgcgcguggg

SEQ ID NO: 1865819 - RNA, 14 nt, Salmonella typhimurium LT2
ggccagcgcgcggc

SEQ ID NO: 1865820 - RNA, 14 nt, Salmonella typhimurium LT2
ggccagcgccggcg

SEQ ID NO: 1865821 - RNA, 19 nt, Salmonella typhimurium LT2
ggcaugacuuuaccgguuu

SEQ ID NO: 1865822 - RNA, 21 nt, Salmonella typhimurium LT2
ggcauguccggcgacuccaga

SEQ ID NO: 1865823 - RNA, 15 nt, Salmonella typhimurium LT2
ggccaaacagcggcu

SEQ ID NO: 1865824 - RNA, 23 nt, Salmonella typhimurium LT2
ggcauuaaaaaaaagagcggcuu

SEQ ID NO: 1865825 - RNA, 21 nt, Salmonella typhimurium LT2
ggccaaaaaagccgcucgcca

SEQ ID NO: 1865826 - RNA, 18 nt, Salmonella typhimurium LT2
ggcauuuucuuaccuggu

SEQ ID NO: 1865827 - RNA, 16 nt, Salmonella typhimurium LT2
ggccaagcagcgccac

SEQ ID NO: 1865828 - RNA, 16 nt, Salmonella typhimurium LT2
ggccaacuuauccgac

SEQ ID NO: 1865829 - RNA, 14 nt, Salmonella typhimurium LT2
ggccaccagcgcca

SEQ ID NO: 1865830 - RNA, 14 nt, Salmonella typhimurium LT2
ggccaccagcacaa

SEQ ID NO: 1865831 - RNA, 12 nt, Salmonella typhimurium LT2
ggcaguucccua

SEQ ID NO: 1865832 - RNA, 16 nt, Salmonella typhimurium LT2
ggcaguuacacuauug

SEQ ID NO: 1865833 - RNA, 22 nt, Salmonella typhimurium LT2
ggcaguucagucgggaucgcca

SEQ ID NO: 1865834 - RNA, 23 nt, Salmonella typhimurium LT2
ggcagucgcuacaaccagcgcgg

SEQ ID NO: 1865835 - RNA, 21 nt, Salmonella typhimurium LT2
ggcagucgcuacaaccagcgc

SEQ ID NO: 1865836 - RNA, 19 nt, Salmonella typhimurium LT2
ggcagugccgguugccuga

SEQ ID NO: 1865837 - RNA, 21 nt, Salmonella typhimurium LT2
ggcagcgucguccagcccggc

SEQ ID NO: 1865838 - RNA, 18 nt, Salmonella typhimurium LT2
ggcauccggcccgugcca

SEQ ID NO: 1865839 - RNA, 18 nt, Salmonella typhimurium LT2
ggcauccgugaccugcug

SEQ ID NO: 1865840 - RNA, 13 nt, Salmonella typhimurium LT2
ggcaucucgccaa

SEQ ID NO: 1865841 - RNA, 18 nt, Salmonella typhimurium LT2
ggcaucucuucguucagg

SEQ ID NO: 1865842 - RNA, 15 nt, Salmonella typhimurium LT2
ggcauagacauccag

SEQ ID NO: 1865843 - RNA, 13 nt, Salmonella typhimurium LT2
ggcauagcaacga

SEQ ID NO: 1865844 - RNA, 16 nt, Salmonella typhimurium LT2
ggcauaagccagcccu

SEQ ID NO: 1865845 - RNA, 18 nt, Salmonella typhimurium LT2
ggcauaaacgccucaucc

SEQ ID NO: 1865846 - RNA, 19 nt, Salmonella typhimurium LT2
ggcauaaaaaagaggaaug

SEQ ID NO: 1865847 - RNA, 23 nt, Salmonella typhimurium LT2
ggcacgcuccugcuccugcggcg

SEQ ID NO: 1865848 - RNA, 13 nt, Salmonella typhimurium LT2
ggcacgcucuccu

SEQ ID NO: 1865849 - RNA, 19 nt, Salmonella typhimurium LT2
ggcacgcucuccuacacca

SEQ ID NO: 1865850 - RNA, 18 nt, Salmonella typhimurium LT2
ggcacggucaaucaucag

SEQ ID NO: 1865851 - RNA, 15 nt, Salmonella typhimurium LT2
ggcaccgaucauccc

SEQ ID NO: 1865852 - RNA, 19 nt, Salmonella typhimurium LT2
ggcagcaauacgcccgccc

SEQ ID NO: 1865853 - RNA, 21 nt, Salmonella typhimurium LT2
ggcacuguauaugcuacacgc

SEQ ID NO: 1865854 - RNA, 22 nt, Salmonella typhimurium LT2
ggcacucaccucuuccgccagg

SEQ ID NO: 1865855 - RNA, 19 nt, Salmonella typhimurium LT2
ggcagcgccugacggcgcu

SEQ ID NO: 1865856 - RNA, 19 nt, Salmonella typhimurium LT2
ggcagcgcgaacaggcugg

SEQ ID NO: 1865857 - RNA, 22 nt, Salmonella typhimurium LT2
aaaguacuucacaaucagcgca

SEQ ID NO: 1865858 - RNA, 18 nt, Salmonella typhimurium LT2
aaaguacuucacaaucag

SEQ ID NO: 1865859 - RNA, 19 nt, Salmonella typhimurium LT2
ggcagcagcagcagcagac

SEQ ID NO: 1865860 - RNA, 14 nt, Salmonella typhimurium LT2
ggcagcagcuucau

SEQ ID NO: 1865861 - RNA, 13 nt, Salmonella typhimurium LT2
ggcagcagcgcgc

SEQ ID NO: 1865862 - RNA, 17 nt, Salmonella typhimurium LT2
ggcacaauagcgcuaaa

SEQ ID NO: 1865863 - RNA, 14 nt, Salmonella typhimurium LT2
ggcacacagcacua

SEQ ID NO: 1865864 - RNA, 23 nt, Salmonella typhimurium LT2
ggcacacaggccgccgggucagc

SEQ ID NO: 1865865 - RNA, 16 nt, Salmonella typhimurium LT2
ggcacaguagacaacc

SEQ ID NO: 1865866 - RNA, 13 nt, Salmonella typhimurium LT2
ggcaaucaaaucc

SEQ ID NO: 1865867 - RNA, 17 nt, Salmonella typhimurium LT2
ggcaaugacgguaagca

SEQ ID NO: 1865868 - RNA, 12 nt, Salmonella typhimurium LT2
ggcaaugccacc

SEQ ID NO: 1865869 - RNA, 12 nt, Salmonella typhimurium LT2
ggcaaugccccc

SEQ ID NO: 1865870 - RNA, 22 nt, Salmonella typhimurium LT2
ggcaaucauaccgucagauucu

SEQ ID NO: 1865871 - RNA, 17 nt, Salmonella typhimurium LT2
ggcaauauuaaaugacg

SEQ ID NO: 1865872 - RNA, 14 nt, Salmonella typhimurium LT2
ggcaauaaaguuua

SEQ ID NO: 1865873 - RNA, 23 nt, Salmonella typhimurium LT2
ggcaauagaccagcggcccgcgc

SEQ ID NO: 1865874 - RNA, 15 nt, Salmonella typhimurium LT2
ggcaaaccccugcuc

SEQ ID NO: 1865875 - RNA, 19 nt, Salmonella typhimurium LT2
ggcaaaauggguucuggcg

SEQ ID NO: 1865876 - RNA, 20 nt, Salmonella typhimurium LT2
ggcaaacacaaaaugcccuu

SEQ ID NO: 1865877 - RNA, 21 nt, Salmonella typhimurium LT2
ggcaaacacaaaaugcccuuc

SEQ ID NO: 1865878 - RNA, 15 nt, Salmonella typhimurium LT2
ggauuguuuuuuagc

SEQ ID NO: 1865879 - RNA, 11 nt, Salmonella typhimurium LT2
ggauugucuua

SEQ ID NO: 1865880 - RNA, 17 nt, Salmonella typhimurium LT2
ggauuuaaaccgccccg

SEQ ID NO: 1865881 - RNA, 22 nt, Salmonella typhimurium LT2
ggauugaaccuaaaaaccagaa

SEQ ID NO: 1865882 - RNA, 20 nt, Salmonella typhimurium LT2
ggaucgccgcaaucagcauu

SEQ ID NO: 1865883 - RNA, 17 nt, Salmonella typhimurium LT2
ggaucgccaucgacagc

SEQ ID NO: 1865884 - RNA, 13 nt, Salmonella typhimurium LT2
ggaucgccaugcu

SEQ ID NO: 1865885 - RNA, 12 nt, Salmonella typhimurium LT2
ggcaaagcaggu

SEQ ID NO: 1865886 - RNA, 15 nt, Salmonella typhimurium LT2
ggcaaagcaggugag

SEQ ID NO: 1865887 - RNA, 22 nt, Salmonella typhimurium LT2
ggcaaagcucaacgcaggcugg

SEQ ID NO: 1865888 - RNA, 22 nt, Salmonella typhimurium LT2
ggcaaauagcguguguuuuccu

SEQ ID NO: 1865889 - RNA, 23 nt, Salmonella typhimurium LT2
ggcaacaaaacuaccgcgccagc

SEQ ID NO: 1865890 - RNA, 16 nt, Salmonella typhimurium LT2
ggcaacggcgacaaga

SEQ ID NO: 1865891 - RNA, 19 nt, Salmonella typhimurium LT2
ggcaacgucgacccgcccc

SEQ ID NO: 1865892 - RNA, 14 nt, Salmonella typhimurium LT2
ggcaacgaaaauca

SEQ ID NO: 1865893 - RNA, 14 nt, Salmonella typhimurium LT2
aaaggggagggcaa

SEQ ID NO: 1865894 - RNA, 16 nt, Salmonella typhimurium LT2
aaagggagcagacugu

SEQ ID NO: 1865895 - RNA, 12 nt, Salmonella typhimurium LT2
ggaccagcacaa

SEQ ID NO: 1865896 - RNA, 15 nt, Salmonella typhimurium LT2
ggaccagcacaaaaa

SEQ ID NO: 1865897 - RNA, 18 nt, Salmonella typhimurium LT2
ggaccacaagcugugcca

SEQ ID NO: 1865898 - RNA, 16 nt, Salmonella typhimurium LT2
ggacauacgccgccga

SEQ ID NO: 1865899 - RNA, 19 nt, Salmonella typhimurium LT2
ggacaguucgccaacgcgu

SEQ ID NO: 1865900 - RNA, 15 nt, Salmonella typhimurium LT2
ggaaucgucacagac

SEQ ID NO: 1865901 - RNA, 12 nt, Salmonella typhimurium LT2
ggaaucgcuggg

SEQ ID NO: 1865902 - RNA, 14 nt, Salmonella typhimurium LT2
ggaaucgcgaucca

SEQ ID NO: 1865903 - RNA, 16 nt, Salmonella typhimurium LT2
ggaauccagcgcgccc

SEQ ID NO: 1865904 - RNA, 14 nt, Salmonella typhimurium LT2
ggaauccccgccgc

SEQ ID NO: 1865905 - RNA, 21 nt, Salmonella typhimurium LT2
ggacguggguuucaauauagc

SEQ ID NO: 1865906 - RNA, 22 nt, Salmonella typhimurium LT2
ggacgucgacgccuuucuucac

SEQ ID NO: 1865907 - RNA, 19 nt, Salmonella typhimurium LT2
ggacgggauacggcgagac

SEQ ID NO: 1865908 - RNA, 13 nt, Salmonella typhimurium LT2
ggacggcgcagcg

SEQ ID NO: 1865909 - RNA, 13 nt, Salmonella typhimurium LT2
ggacggcaucagg

SEQ ID NO: 1865910 - RNA, 21 nt, Salmonella typhimurium LT2
aaagguuuguuuaauuuuguu

SEQ ID NO: 1865911 - RNA, 16 nt, Salmonella typhimurium LT2
aaaguaaauaagaaaa

SEQ ID NO: 1865912 - RNA, 13 nt, Salmonella typhimurium LT2
aaaguaaaacaag

SEQ ID NO: 1865913 - RNA, 22 nt, Salmonella typhimurium LT2
ggaggaacagcgccgucacccg

SEQ ID NO: 1865914 - RNA, 15 nt, Salmonella typhimurium LT2
ggagggggagugcug

SEQ ID NO: 1865915 - RNA, 22 nt, Salmonella typhimurium LT2
ggagcgaagaauucgcaaugug

SEQ ID NO: 1865916 - RNA, 13 nt, Salmonella typhimurium LT2
ggagcgcggcggc

SEQ ID NO: 1865917 - RNA, 13 nt, Salmonella typhimurium LT2
ggagaucagcaug

SEQ ID NO: 1865918 - RNA, 15 nt, Salmonella typhimurium LT2
ggagaucgcuuucca

SEQ ID NO: 1865919 - RNA, 18 nt, Salmonella typhimurium LT2
ggagaucgcuuuccagcg

SEQ ID NO: 1865920 - RNA, 20 nt, Salmonella typhimurium LT2
ggaucccgaauaucgcgagc

SEQ ID NO: 1865921 - RNA, 23 nt, Salmonella typhimurium LT2
ggauauccugcucgccugugccc

SEQ ID NO: 1865922 - RNA, 23 nt, Salmonella typhimurium LT2
ggaggucauuauucaggccuccu

SEQ ID NO: 1865923 - RNA, 18 nt, Salmonella typhimurium LT2
ggagguauacauccacug

SEQ ID NO: 1865924 - RNA, 20 nt, Salmonella typhimurium LT2
ggagguauacauccacuggu

SEQ ID NO: 1865925 - RNA, 23 nt, Salmonella typhimurium LT2
ggaguaugcgacgguaaaaauau

SEQ ID NO: 1865926 - RNA, 19 nt, Salmonella typhimurium LT2
ggaguccagcaacugcgcg

SEQ ID NO: 1865927 - RNA, 21 nt, Salmonella typhimurium LT2
ggagucgccgguuguccacug

SEQ ID NO: 1865928 - RNA, 13 nt, Salmonella typhimurium LT2
ggaguccagcaac

SEQ ID NO: 1865929 - RNA, 19 nt, Salmonella typhimurium LT2
ggagugaguccccaggagc

SEQ ID NO: 1865930 - RNA, 17 nt, Salmonella typhimurium LT2
ggagucuaaaaauaauu

SEQ ID NO: 1865931 - RNA, 16 nt, Salmonella typhimurium LT2
ggaguggcgaaauugg

SEQ ID NO: 1865932 - RNA, 12 nt, Salmonella typhimurium LT2
ggauagcaaucu

SEQ ID NO: 1865933 - RNA, 19 nt, Salmonella typhimurium LT2
ggauagugccugccgucgc

SEQ ID NO: 1865934 - RNA, 22 nt, Salmonella typhimurium LT2
ggaaaauaaugccucauuaaaa

SEQ ID NO: 1865935 - RNA, 15 nt, Salmonella typhimurium LT2
ggaaaagcuguagca

SEQ ID NO: 1865936 - RNA, 18 nt, Salmonella typhimurium LT2
ggaaaccuguucccggca

SEQ ID NO: 1865937 - RNA, 14 nt, Salmonella typhimurium LT2
ggaaacgccaggca

SEQ ID NO: 1865938 - RNA, 20 nt, Salmonella typhimurium LT2
ggaaaccagauaccccgcca

SEQ ID NO: 1865939 - RNA, 19 nt, Salmonella typhimurium LT2
ggaaaccaguucgcgcgug

SEQ ID NO: 1865940 - RNA, 17 nt, Salmonella typhimurium LT2
ggaaacuaugcaaaacg

SEQ ID NO: 1865941 - RNA, 17 nt, Salmonella typhimurium LT2
ggaaagugaaggccaga

SEQ ID NO: 1865942 - RNA, 14 nt, Salmonella typhimurium LT2
ggaaauaaagguuc

SEQ ID NO: 1865943 - RNA, 22 nt, Salmonella typhimurium LT2
ggaaauaaagguuucgauacag

SEQ ID NO: 1865944 - RNA, 20 nt, Salmonella typhimurium LT2
ggaaaucaaaccaccccagg

SEQ ID NO: 1865945 - RNA, 22 nt, Salmonella typhimurium LT2
ggaaucacgcauaucccacugc

SEQ ID NO: 1865946 - RNA, 21 nt, Salmonella typhimurium LT2
ggaauauugaugccguuuuca

SEQ ID NO: 1865947 - RNA, 14 nt, Salmonella typhimurium LT2
ggaauaucaauuca

SEQ ID NO: 1865948 - RNA, 18 nt, Salmonella typhimurium LT2
ggaaggauagccguauga

SEQ ID NO: 1865949 - RNA, 14 nt, Salmonella typhimurium LT2
ggaagacuggcgca

SEQ ID NO: 1865950 - RNA, 19 nt, Salmonella typhimurium LT2
ggaagacuggcgcagcaaa

SEQ ID NO: 1865951 - RNA, 21 nt, Salmonella typhimurium LT2
ggaagaaaucccacauuugau

SEQ ID NO: 1865952 - RNA, 18 nt, Salmonella typhimurium LT2
ggaacuguucagccagca

SEQ ID NO: 1865953 - RNA, 10 nt, Salmonella typhimurium LT2
ggaacgcugu

SEQ ID NO: 1865954 - RNA, 14 nt, Salmonella typhimurium LT2
ggaacccaggcacc

SEQ ID NO: 1865955 - RNA, 18 nt, Salmonella typhimurium LT2
ggaaccgguagccaggcg

SEQ ID NO: 1865956 - RNA, 18 nt, Salmonella typhimurium LT2
gcuuuguaaaacauucaa

SEQ ID NO: 1865957 - RNA, 12 nt, Salmonella typhimurium LT2
gcuuuuaaaaua

SEQ ID NO: 1865958 - RNA, 20 nt, Salmonella typhimurium LT2
gcuuuuacaggccgcucuau

SEQ ID NO: 1865959 - RNA, 23 nt, Salmonella typhimurium LT2
gcuuuuacagggcggcaggauga

SEQ ID NO: 1865960 - RNA, 17 nt, Salmonella typhimurium LT2
gcuuugaaucucuuccc

SEQ ID NO: 1865961 - RNA, 19 nt, Salmonella typhimurium LT2
gcuuugaaucucuucccag

SEQ ID NO: 1865962 - RNA, 19 nt, Salmonella typhimurium LT2
gcuuugauauagggcuuga

SEQ ID NO: 1865963 - RNA, 23 nt, Salmonella typhimurium LT2
gcuuugauuacugagaugacgcc

SEQ ID NO: 1865964 - RNA, 19 nt, Salmonella typhimurium LT2
gcuuugcaauguucaauau

SEQ ID NO: 1865965 - RNA, 15 nt, Salmonella typhimurium LT2
gcuuugcaacagggc

SEQ ID NO: 1865966 - RNA, 17 nt, Salmonella typhimurium LT2
gcuuugcguaaaaaaac

SEQ ID NO: 1865967 - RNA, 22 nt, Salmonella typhimurium LT2
gcuuugccgucgcgaacgugcu

SEQ ID NO: 1865968 - RNA, 20 nt, Salmonella typhimurium LT2
gcuuucugaauuucacgcuu

SEQ ID NO: 1865969 - RNA, 15 nt, Salmonella typhimurium LT2
gcuuucucuuccgcu

SEQ ID NO: 1865970 - RNA, 23 nt, Salmonella typhimurium LT2
gcuuucuuucuccagcguacugc

SEQ ID NO: 1865971 - RNA, 23 nt, Salmonella typhimurium LT2
gcuuucuuuuagcgcuucuccca

SEQ ID NO: 1865972 - RNA, 14 nt, Salmonella typhimurium LT2
gcuuucuucguuag

SEQ ID NO: 1865973 - RNA, 15 nt, Salmonella typhimurium LT2
gcuuucugccaggca

SEQ ID NO: 1865974 - RNA, 14 nt, Salmonella typhimurium LT2
gcuuucggaucaau

SEQ ID NO: 1865975 - RNA, 19 nt, Salmonella typhimurium LT2
gcuuuuuucucugcuuucg

SEQ ID NO: 1865976 - RNA, 13 nt, Salmonella typhimurium LT2
ggaaaaauaagag

SEQ ID NO: 1865977 - RNA, 22 nt, Salmonella typhimurium LT2
ggaaaacggccagugaaauaaa

SEQ ID NO: 1865978 - RNA, 16 nt, Salmonella typhimurium LT2
ggaaaaccccaucccg

SEQ ID NO: 1865979 - RNA, 17 nt, Salmonella typhimurium LT2
ggaaaacagcgccggca

SEQ ID NO: 1865980 - RNA, 22 nt, Salmonella typhimurium LT2
gcuuuuucauucugcuuaccag

SEQ ID NO: 1865981 - RNA, 16 nt, Salmonella typhimurium LT2
gcuuuuuacaaaguga

SEQ ID NO: 1865982 - RNA, 20 nt, Salmonella typhimurium LT2
gcuuuugguuuuucaaccac

SEQ ID NO: 1865983 - RNA, 15 nt, Salmonella typhimurium LT2
gcuuuugguuccuuc

SEQ ID NO: 1865984 - RNA, 17 nt, Salmonella typhimurium LT2
gcuuuugguuccuucag

SEQ ID NO: 1865985 - RNA, 19 nt, Salmonella typhimurium LT2
gcuuuugaauaaucccgca

SEQ ID NO: 1865986 - RNA, 22 nt, Salmonella typhimurium LT2
gcuuuucaugacgcucuccucc

SEQ ID NO: 1865987 - RNA, 12 nt, Salmonella typhimurium LT2
gcuuuucaggcu

SEQ ID NO: 1865988 - RNA, 19 nt, Salmonella typhimurium LT2
gcuuuuccaccccagcauu

SEQ ID NO: 1865989 - RNA, 19 nt, Salmonella typhimurium LT2
gcuaaaccacaugaccagc

SEQ ID NO: 1865990 - RNA, 12 nt, Salmonella typhimurium LT2
gcuaaaauaccc

SEQ ID NO: 1865991 - RNA, 14 nt, Salmonella typhimurium LT2
gcuaaacaucgucu

SEQ ID NO: 1865992 - RNA, 17 nt, Salmonella typhimurium LT2
gcuaaacaauuugccca

SEQ ID NO: 1865993 - RNA, 20 nt, Salmonella typhimurium LT2
gcuaaacaauuugcccagcg

SEQ ID NO: 1865994 - RNA, 15 nt, Salmonella typhimurium LT2
gcuaaaacagauaac

SEQ ID NO: 1865995 - RNA, 21 nt, Salmonella typhimurium LT2
gcuaaaacacccgcaaacuaa

SEQ ID NO: 1865996 - RNA, 14 nt, Salmonella typhimurium LT2
gcuaaccagcgagc

SEQ ID NO: 1865997 - RNA, 13 nt, Salmonella typhimurium LT2
gcuaaagucagca

SEQ ID NO: 1865998 - RNA, 19 nt, Salmonella typhimurium LT2
gcuaaaucacgcaggucau

SEQ ID NO: 1865999 - RNA, 16 nt, Salmonella typhimurium LT2
gcuaaauuaaaaauaa

SEQ ID NO: 1866000 - RNA, 17 nt, Salmonella typhimurium LT2
gcuaaccuguucagccg

SEQ ID NO: 1866001 - RNA, 16 nt, Salmonella typhimurium LT2
gcuaacgcgccccagg

SEQ ID NO: 1866002 - RNA, 17 nt, Salmonella typhimurium LT2
gcuaacgcgccccaggu

SEQ ID NO: 1866003 - RNA, 23 nt, Salmonella typhimurium LT2
gcuaagcguuacggaaaaaauac

SEQ ID NO: 1866004 - RNA, 22 nt, Salmonella typhimurium LT2
gcuaagcguuacggaaaaaaua

SEQ ID NO: 1866005 - RNA, 18 nt, Salmonella typhimurium LT2
gcuaaucccgcucgccag

SEQ ID NO: 1866006 - RNA, 18 nt, Salmonella typhimurium LT2
gcuaauccccccuuuuuu

SEQ ID NO: 1866007 - RNA, 18 nt, Salmonella typhimurium LT2
gcuaaugauuaucuuuuu

SEQ ID NO: 1866008 - RNA, 16 nt, Salmonella typhimurium LT2
gcuaaugaagacgaag

SEQ ID NO: 1866009 - RNA, 14 nt, Salmonella typhimurium LT2
gcuacgcagcggcg

SEQ ID NO: 1866010 - RNA, 14 nt, Salmonella typhimurium LT2
gcuacgccugccug

SEQ ID NO: 1866011 - RNA, 17 nt, Salmonella typhimurium LT2
gcuacgauaaagcuggg

SEQ ID NO: 1866012 - RNA, 22 nt, Salmonella typhimurium LT2
gcuacgauaaagcugggucagg

SEQ ID NO: 1866013 - RNA, 21 nt, Salmonella typhimurium LT2
gcuaccgucgacgucuuucuu

SEQ ID NO: 1866014 - RNA, 19 nt, Salmonella typhimurium LT2
gcuacguuuaucuggcuua

SEQ ID NO: 1866015 - RNA, 19 nt, Salmonella typhimurium LT2
gcuacguaaccggccagcc

SEQ ID NO: 1866016 - RNA, 18 nt, Salmonella typhimurium LT2
gcuacgguacugcccacc

SEQ ID NO: 1866017 - RNA, 14 nt, Salmonella typhimurium LT2
gcuacggcucccuc

SEQ ID NO: 1866018 - RNA, 14 nt, Salmonella typhimurium LT2
gcuacgcgucgcca

SEQ ID NO: 1866019 - RNA, 17 nt, Salmonella typhimurium LT2
gcuacgcuuaucaggcc

SEQ ID NO: 1866020 - RNA, 17 nt, Salmonella typhimurium LT2
gcuaauuuucagggugg

SEQ ID NO: 1866021 - RNA, 12 nt, Salmonella typhimurium LT2
gcuacccagaca

SEQ ID NO: 1866022 - RNA, 23 nt, Salmonella typhimurium LT2
gcuaccagcgcggcgccaguacu

SEQ ID NO: 1866023 - RNA, 17 nt, Salmonella typhimurium LT2
gcuaccaggcaaagcuc

SEQ ID NO: 1866024 - RNA, 14 nt, Salmonella typhimurium LT2
gcuaccagcgcggc

SEQ ID NO: 1866025 - RNA, 21 nt, Salmonella typhimurium LT2
gcuaccagcgcggcgccagua

SEQ ID NO: 1866026 - RNA, 19 nt, Salmonella typhimurium LT2
gcuacacgcgaauagccag

SEQ ID NO: 1866027 - RNA, 18 nt, Salmonella typhimurium LT2
gcuacaggugccacgcuu

SEQ ID NO: 1866028 - RNA, 22 nt, Salmonella typhimurium LT2
gcuacaguguuaacgcgugcuc

SEQ ID NO: 1866029 - RNA, 18 nt, Salmonella typhimurium LT2
gcguuguacggauggggu

SEQ ID NO: 1866030 - RNA, 12 nt, Salmonella typhimurium LT2
gcguuggcugcu

SEQ ID NO: 1866031 - RNA, 12 nt, Salmonella typhimurium LT2
gcguugcagcca

SEQ ID NO: 1866032 - RNA, 24 nt, Salmonella typhimurium LT2
gcguugaccagccuaccugccgcc

SEQ ID NO: 1866033 - RNA, 16 nt, Salmonella typhimurium LT2
gcguucugcugugccg

SEQ ID NO: 1866034 - RNA, 20 nt, Salmonella typhimurium LT2
gcguucuggaguuuaaacac

SEQ ID NO: 1866035 - RNA, 18 nt, Salmonella typhimurium LT2
gcguuuuuucaucggcag

SEQ ID NO: 1866036 - RNA, 22 nt, Salmonella typhimurium LT2
gcguuugucuucuuaguaacau

SEQ ID NO: 1866037 - RNA, 13 nt, Salmonella typhimurium LT2
gcguuuguaaugc

SEQ ID NO: 1866038 - RNA, 13 nt, Salmonella typhimurium LT2
gcguuuuccagcg

SEQ ID NO: 1866039 - RNA, 13 nt, Salmonella typhimurium LT2
gcguuuuccagcu

SEQ ID NO: 1866040 - RNA, 22 nt, Salmonella typhimurium LT2
gcguuuccccuuuaggcggcgc

SEQ ID NO: 1866041 - RNA, 22 nt, Salmonella typhimurium LT2
gcguuucgcgcgcgccugccgc

SEQ ID NO: 1866042 - RNA, 13 nt, Salmonella typhimurium LT2
gcguuucguaaug

SEQ ID NO: 1866043 - RNA, 14 nt, Salmonella typhimurium LT2
gcguuuaagccccu

SEQ ID NO: 1866044 - RNA, 15 nt, Salmonella typhimurium LT2
gcguggcguuccagu

SEQ ID NO: 1866045 - RNA, 14 nt, Salmonella typhimurium LT2
gcguggguucacag

SEQ ID NO: 1866046 - RNA, 13 nt, Salmonella typhimurium LT2
gcguguggugagg

SEQ ID NO: 1866047 - RNA, 23 nt, Salmonella typhimurium LT2
gcguuaagccguguaaauccaga

SEQ ID NO: 1866048 - RNA, 15 nt, Salmonella typhimurium LT2
gcguucaaaaucaaa

SEQ ID NO: 1866049 - RNA, 17 nt, Salmonella typhimurium LT2
gcguucauccagcgcgc

SEQ ID NO: 1866050 - RNA, 20 nt, Salmonella typhimurium LT2
gcguuacuggcgaccggcag

SEQ ID NO: 1866051 - RNA, 17 nt, Salmonella typhimurium LT2
gcguuacgggaacagaa

SEQ ID NO: 1866052 - RNA, 23 nt, Salmonella typhimurium LT2
gcguuaugcgcuugcgcaauuuc

SEQ ID NO: 1866053 - RNA, 20 nt, Salmonella typhimurium LT2
gcguucgcgcaguucaucca

SEQ ID NO: 1866054 - RNA, 15 nt, Salmonella typhimurium LT2
gcguucgcccugcgc

SEQ ID NO: 1866055 - RNA, 17 nt, Salmonella typhimurium LT2
gcguucggguuuuccug

SEQ ID NO: 1866056 - RNA, 13 nt, Salmonella typhimurium LT2
gcguucggccugc

SEQ ID NO: 1866057 - RNA, 17 nt, Salmonella typhimurium LT2
gcucacuaccgccgcga

SEQ ID NO: 1866058 - RNA, 21 nt, Salmonella typhimurium LT2
gcucacuaccgcgaugugcug

SEQ ID NO: 1866059 - RNA, 21 nt, Salmonella typhimurium LT2
gcucagauaacauaugaguua

SEQ ID NO: 1866060 - RNA, 19 nt, Salmonella typhimurium LT2
gcucaggccaaucacccca

SEQ ID NO: 1866061 - RNA, 13 nt, Salmonella typhimurium LT2
gcucagcgcggca

SEQ ID NO: 1866062 - RNA, 20 nt, Salmonella typhimurium LT2
gcucaauaccuuaguaaaac

SEQ ID NO: 1866063 - RNA, 13 nt, Salmonella typhimurium LT2
gcucaauaauauc

SEQ ID NO: 1866064 - RNA, 14 nt, Salmonella typhimurium LT2
gcucaauccaggug

SEQ ID NO: 1866065 - RNA, 17 nt, Salmonella typhimurium LT2
gcucaauaugccaggca

SEQ ID NO: 1866066 - RNA, 23 nt, Salmonella typhimurium LT2
gcucacccaguuuuuuucugcca

SEQ ID NO: 1866067 - RNA, 15 nt, Salmonella typhimurium LT2
gcucacccggcugga

SEQ ID NO: 1866068 - RNA, 15 nt, Salmonella typhimurium LT2
gcucacggcacgccc

SEQ ID NO: 1866069 - RNA, 16 nt, Salmonella typhimurium LT2
gcucacgguuucuacu

SEQ ID NO: 1866070 - RNA, 20 nt, Salmonella typhimurium LT2
gcucacgguuucuacuucca

SEQ ID NO: 1866071 - RNA, 22 nt, Salmonella typhimurium LT2
gcucaccgagacugcccggcau

SEQ ID NO: 1866072 - RNA, 20 nt, Salmonella typhimurium LT2
gcucaccgagacugcccggc

SEQ ID NO: 1866073 - RNA, 16 nt, Salmonella typhimurium LT2
gcucaccuccgccacc

SEQ ID NO: 1866074 - RNA, 22 nt, Salmonella typhimurium LT2
gcuccagaaucucgaaacaaua

SEQ ID NO: 1866075 - RNA, 13 nt, Salmonella typhimurium LT2
gcuccacuggccc

SEQ ID NO: 1866076 - RNA, 17 nt, Salmonella typhimurium LT2
gcuccacuggcccccug

SEQ ID NO: 1866077 - RNA, 16 nt, Salmonella typhimurium LT2
gcuccagcuggcuggc

SEQ ID NO: 1866078 - RNA, 18 nt, Salmonella typhimurium LT2
gcuccagcuucaucauca

SEQ ID NO: 1866079 - RNA, 22 nt, Salmonella typhimurium LT2
gcuccagcuucaucaucagcag

SEQ ID NO: 1866080 - RNA, 23 nt, Salmonella typhimurium LT2
gcuccagcuucaucaucagcagc

SEQ ID NO: 1866081 - RNA, 23 nt, Salmonella typhimurium LT2
gcuccagagcgccguggaaaaau

SEQ ID NO: 1866082 - RNA, 11 nt, Salmonella typhimurium LT2
gcuccagcugg

SEQ ID NO: 1866083 - RNA, 12 nt, Salmonella typhimurium LT2
gcuccccgccgc

SEQ ID NO: 1866084 - RNA, 23 nt, Salmonella typhimurium LT2
gcuccaguggucguuagccagau

SEQ ID NO: 1866085 - RNA, 23 nt, Salmonella typhimurium LT2
gcuccagggcugcuggccuucca

SEQ ID NO: 1866086 - RNA, 18 nt, Salmonella typhimurium LT2
gcucauuaacgacaacuu

SEQ ID NO: 1866087 - RNA, 20 nt, Salmonella typhimurium LT2
gcucaugugcagcauccagc

SEQ ID NO: 1866088 - RNA, 16 nt, Salmonella typhimurium LT2
gcucaugcgcggcggg

SEQ ID NO: 1866089 - RNA, 23 nt, Salmonella typhimurium LT2
gcuccaccagcgcaucaaugucg

SEQ ID NO: 1866090 - RNA, 15 nt, Salmonella typhimurium LT2
gcucauuucagcgag

SEQ ID NO: 1866091 - RNA, 23 nt, Salmonella typhimurium LT2
gcucaugugcagcauccagcuca

SEQ ID NO: 1866092 - RNA, 19 nt, Salmonella typhimurium LT2
gcucaggcguugacuuacg

SEQ ID NO: 1866093 - RNA, 13 nt, Salmonella typhimurium LT2
gcucagggucaga

SEQ ID NO: 1866094 - RNA, 20 nt, Salmonella typhimurium LT2
gcucagguuguccagcagca

SEQ ID NO: 1866095 - RNA, 21 nt, Salmonella typhimurium LT2
gcucagguuguccagcagcag

SEQ ID NO: 1866096 - RNA, 14 nt, Salmonella typhimurium LT2
gcucaguauggcca

SEQ ID NO: 1866097 - RNA, 18 nt, Salmonella typhimurium LT2
gcucaguugcguucccag

SEQ ID NO: 1866098 - RNA, 22 nt, Salmonella typhimurium LT2
gcucaguugcguucccaguucc

SEQ ID NO: 1866099 - RNA, 16 nt, Salmonella typhimurium LT2
gcuaugcgcuccagga

SEQ ID NO: 1866100 - RNA, 18 nt, Salmonella typhimurium LT2
gcuaugcucccccccuuc

SEQ ID NO: 1866101 - RNA, 20 nt, Salmonella typhimurium LT2
gcuaugcugaucaucuggcc

SEQ ID NO: 1866102 - RNA, 22 nt, Salmonella typhimurium LT2
gcuaugccggaggauauuuauu

SEQ ID NO: 1866103 - RNA, 17 nt, Salmonella typhimurium LT2
gcuauggcaacaaagcc

SEQ ID NO: 1866104 - RNA, 14 nt, Salmonella typhimurium LT2
gcuauggcaacaaa

SEQ ID NO: 1866105 - RNA, 16 nt, Salmonella typhimurium LT2
gcuauggcaacaaagc

SEQ ID NO: 1866106 - RNA, 22 nt, Salmonella typhimurium LT2
gcuaucuucaauacgaaaacca

SEQ ID NO: 1866107 - RNA, 13 nt, Salmonella typhimurium LT2
gcuaucuuugcug

SEQ ID NO: 1866108 - RNA, 14 nt, Salmonella typhimurium LT2
gcuauuaccaguaa

SEQ ID NO: 1866109 - RNA, 12 nt, Salmonella typhimurium LT2
gcuauuagccaa

SEQ ID NO: 1866110 - RNA, 19 nt, Salmonella typhimurium LT2
gcuauucgguagucgcuga

SEQ ID NO: 1866111 - RNA, 19 nt, Salmonella typhimurium LT2
gcuauucuucgaucgccug

SEQ ID NO: 1866112 - RNA, 13 nt, Salmonella typhimurium LT2
gcuauuguugaug

SEQ ID NO: 1866113 - RNA, 21 nt, Salmonella typhimurium LT2
gcuauuugcgcaucauuuuua

SEQ ID NO: 1866114 - RNA, 18 nt, Salmonella typhimurium LT2
gcuauuuugaucccacug

SEQ ID NO: 1866115 - RNA, 12 nt, Salmonella typhimurium LT2
gcucaaauauga

SEQ ID NO: 1866116 - RNA, 16 nt, Salmonella typhimurium LT2
gcucaaccgcgcggcg

SEQ ID NO: 1866117 - RNA, 21 nt, Salmonella typhimurium LT2
gcucaaccgcgcggcguucug

SEQ ID NO: 1866118 - RNA, 16 nt, Salmonella typhimurium LT2
gcucaacaaacuuaau

SEQ ID NO: 1866119 - RNA, 19 nt, Salmonella typhimurium LT2
gcucaacauugcucauacc

SEQ ID NO: 1866120 - RNA, 17 nt, Salmonella typhimurium LT2
gcucaacgcaggcugga

SEQ ID NO: 1866121 - RNA, 15 nt, Salmonella typhimurium LT2
gcucaagcgaaaaaa

SEQ ID NO: 1866122 - RNA, 16 nt, Salmonella typhimurium LT2
gcucaagcgccgcgau

SEQ ID NO: 1866123 - RNA, 18 nt, Salmonella typhimurium LT2
gcucaagcuguagcguuu

SEQ ID NO: 1866124 - RNA, 18 nt, Salmonella typhimurium LT2
gcuauaaauaaggccuga

SEQ ID NO: 1866125 - RNA, 21 nt, Salmonella typhimurium LT2
gcuauaaauaaggccugagcu

SEQ ID NO: 1866126 - RNA, 19 nt, Salmonella typhimurium LT2
gcuauaacguuuaauguca

SEQ ID NO: 1866127 - RNA, 15 nt, Salmonella typhimurium LT2
gcuauaagcggcguc

SEQ ID NO: 1866128 - RNA, 15 nt, Salmonella typhimurium LT2
gcuauauuuauaaaa

SEQ ID NO: 1866129 - RNA, 18 nt, Salmonella typhimurium LT2
gcuauauuuugugcaacc

SEQ ID NO: 1866130 - RNA, 22 nt, Salmonella typhimurium LT2
gcuauaugauagaaguuaugca

SEQ ID NO: 1866131 - RNA, 14 nt, Salmonella typhimurium LT2
gcuauacgcggcgu

SEQ ID NO: 1866132 - RNA, 22 nt, Salmonella typhimurium LT2
gcuauaguggauggcccacugu

SEQ ID NO: 1866133 - RNA, 22 nt, Salmonella typhimurium LT2
gcuauagccgcguuugaguagc

SEQ ID NO: 1866134 - RNA, 21 nt, Salmonella typhimurium LT2
gcuaucgcgccggacagcagc

SEQ ID NO: 1866135 - RNA, 20 nt, Salmonella typhimurium LT2
gcuauccaucgccgcgccgu

SEQ ID NO: 1866136 - RNA, 17 nt, Salmonella typhimurium LT2
gcuaucgagaaugguuu

SEQ ID NO: 1866137 - RNA, 18 nt, Salmonella typhimurium LT2
gcuaucgaccaccgggcg

SEQ ID NO: 1866138 - RNA, 22 nt, Salmonella typhimurium LT2
gcuauauuuuuuaucagacugg

SEQ ID NO: 1866139 - RNA, 23 nt, Salmonella typhimurium LT2
gcuaucaacgccuccaggcuacc

SEQ ID NO: 1866140 - RNA, 14 nt, Salmonella typhimurium LT2
gcuauccgccgcca

SEQ ID NO: 1866141 - RNA, 19 nt, Salmonella typhimurium LT2
gcuauccagcaguaaauaa

SEQ ID NO: 1866142 - RNA, 14 nt, Salmonella typhimurium LT2
gcuauccaucgccg

SEQ ID NO: 1866143 - RNA, 18 nt, Salmonella typhimurium LT2
gcuauccacgcagacgcc

SEQ ID NO: 1866144 - RNA, 16 nt, Salmonella typhimurium LT2
gcuagcccgcugcgcc

SEQ ID NO: 1866145 - RNA, 15 nt, Salmonella typhimurium LT2
gcucgcuuugccgcc

SEQ ID NO: 1866146 - RNA, 17 nt, Salmonella typhimurium LT2
gcucggcagcagcgcgc

SEQ ID NO: 1866147 - RNA, 16 nt, Salmonella typhimurium LT2
gcucccgcgccuaugu

SEQ ID NO: 1866148 - RNA, 20 nt, Salmonella typhimurium LT2
gcucccggaaccgaccgcga

SEQ ID NO: 1866149 - RNA, 11 nt, Salmonella typhimurium LT2
gcucgcggcgg

SEQ ID NO: 1866150 - RNA, 13 nt, Salmonella typhimurium LT2
gcucgcggcggac

SEQ ID NO: 1866151 - RNA, 21 nt, Salmonella typhimurium LT2
gcucguagcguuuaaagacca

SEQ ID NO: 1866152 - RNA, 19 nt, Salmonella typhimurium LT2
gcucugccgguuggccggc

SEQ ID NO: 1866153 - RNA, 14 nt, Salmonella typhimurium LT2
gcucugcaauuucu

SEQ ID NO: 1866154 - RNA, 19 nt, Salmonella typhimurium LT2
gcucugcaauuucugcugg

SEQ ID NO: 1866155 - RNA, 16 nt, Salmonella typhimurium LT2
gcucuccgccgcgggc

SEQ ID NO: 1866156 - RNA, 15 nt, Salmonella typhimurium LT2
gcucucuuccagguu

SEQ ID NO: 1866157 - RNA, 17 nt, Salmonella typhimurium LT2
gcucuucuucgcucucg

SEQ ID NO: 1866158 - RNA, 21 nt, Salmonella typhimurium LT2
gcucuucgccguuaucggccu

SEQ ID NO: 1866159 - RNA, 15 nt, Salmonella typhimurium LT2
gcucuguggggggaa

SEQ ID NO: 1866160 - RNA, 14 nt, Salmonella typhimurium LT2
gcucuggcgugaaa

SEQ ID NO: 1866161 - RNA, 12 nt, Salmonella typhimurium LT2
gcugacugccgu

SEQ ID NO: 1866162 - RNA, 18 nt, Salmonella typhimurium LT2
gcugacguuuuccucguu

SEQ ID NO: 1866163 - RNA, 17 nt, Salmonella typhimurium LT2
gcugacguuacgcggug

SEQ ID NO: 1866164 - RNA, 21 nt, Salmonella typhimurium LT2
gcugacguucgacccgcaaug

SEQ ID NO: 1866165 - RNA, 12 nt, Salmonella typhimurium LT2
gcugagaaaaag

SEQ ID NO: 1866166 - RNA, 21 nt, Salmonella typhimurium LT2
gcugagcgugaucgucuccug

SEQ ID NO: 1866167 - RNA, 17 nt, Salmonella typhimurium LT2
gcugagcuaaucaccca

SEQ ID NO: 1866168 - RNA, 16 nt, Salmonella typhimurium LT2
gcugagcuaaucaccc

SEQ ID NO: 1866169 - RNA, 13 nt, Salmonella typhimurium LT2
gcugaggccugca

SEQ ID NO: 1866170 - RNA, 12 nt, Salmonella typhimurium LT2
gcugauaaucaa

SEQ ID NO: 1866171 - RNA, 22 nt, Salmonella typhimurium LT2
gcugauaacuaauggcauuucc

SEQ ID NO: 1866172 - RNA, 19 nt, Salmonella typhimurium LT2
gcugaguuuagccagcagc

SEQ ID NO: 1866173 - RNA, 22 nt, Salmonella typhimurium LT2
gcugaguuucucccgccagaug

SEQ ID NO: 1866174 - RNA, 14 nt, Salmonella typhimurium LT2
gcugauaacaauau

SEQ ID NO: 1866175 - RNA, 22 nt, Salmonella typhimurium LT2
gcucuuuaccguauugccagau

SEQ ID NO: 1866176 - RNA, 13 nt, Salmonella typhimurium LT2
gcucuuucaacug

SEQ ID NO: 1866177 - RNA, 17 nt, Salmonella typhimurium LT2
gcucuuucaacuuccgc

SEQ ID NO: 1866178 - RNA, 23 nt, Salmonella typhimurium LT2
gcucuuuugucacaagaaggccu

SEQ ID NO: 1866179 - RNA, 21 nt, Salmonella typhimurium LT2
gcugaaaaccgcaucaagccc

SEQ ID NO: 1866180 - RNA, 15 nt, Salmonella typhimurium LT2
gcugacggcgcgauc

SEQ ID NO: 1866181 - RNA, 20 nt, Salmonella typhimurium LT2
gcugaccgcuuucccggcau

SEQ ID NO: 1866182 - RNA, 21 nt, Salmonella typhimurium LT2
gcugaugccagauggcaagau

SEQ ID NO: 1866183 - RNA, 13 nt, Salmonella typhimurium LT2
gcugaugacgcgc

SEQ ID NO: 1866184 - RNA, 18 nt, Salmonella typhimurium LT2
gcugauaccgucuuccuu

SEQ ID NO: 1866185 - RNA, 16 nt, Salmonella typhimurium LT2
gcugauacgccuggau

SEQ ID NO: 1866186 - RNA, 13 nt, Salmonella typhimurium LT2
gcugaugcagaua

SEQ ID NO: 1866187 - RNA, 20 nt, Salmonella typhimurium LT2
gcugcacaaucgccagcccc

SEQ ID NO: 1866188 - RNA, 14 nt, Salmonella typhimurium LT2
gcugcaggugcguu

SEQ ID NO: 1866189 - RNA, 16 nt, Salmonella typhimurium LT2
gcugccaugcggcggc

SEQ ID NO: 1866190 - RNA, 15 nt, Salmonella typhimurium LT2
gcugcauccgcgcuu

SEQ ID NO: 1866191 - RNA, 20 nt, Salmonella typhimurium LT2
gcugcaguuuauuuuugcga

SEQ ID NO: 1866192 - RNA, 16 nt, Salmonella typhimurium LT2
gcugcaucuuacugac

SEQ ID NO: 1866193 - RNA, 19 nt, Salmonella typhimurium LT2
gcugucgguuaacaccagu

SEQ ID NO: 1866194 - RNA, 18 nt, Salmonella typhimurium LT2
gcugucggcguuguuaug

SEQ ID NO: 1866195 - RNA, 14 nt, Salmonella typhimurium LT2
gcugucuggauaac

SEQ ID NO: 1866196 - RNA, 19 nt, Salmonella typhimurium LT2
gcugugauacuggcggcga

SEQ ID NO: 1866197 - RNA, 20 nt, Salmonella typhimurium LT2
gcugucgacaauaaauugcg

SEQ ID NO: 1866198 - RNA, 12 nt, Salmonella typhimurium LT2
gcugucgccaga

SEQ ID NO: 1866199 - RNA, 17 nt, Salmonella typhimurium LT2
gcugucgccaucaccag

SEQ ID NO: 1866200 - RNA, 14 nt, Salmonella typhimurium LT2
gcugucgccccuuu

SEQ ID NO: 1866201 - RNA, 18 nt, Salmonella typhimurium LT2
gcugucgauaauauccag

SEQ ID NO: 1866202 - RNA, 18 nt, Salmonella typhimurium LT2
gcuguaauugaggauugc

SEQ ID NO: 1866203 - RNA, 23 nt, Salmonella typhimurium LT2
gcuguaaccuacgccaagcaccu

SEQ ID NO: 1866204 - RNA, 17 nt, Salmonella typhimurium LT2
gcugguugccuuccuga

SEQ ID NO: 1866205 - RNA, 14 nt, Salmonella typhimurium LT2
gcuggcuuucgccu

SEQ ID NO: 1866206 - RNA, 18 nt, Salmonella typhimurium LT2
gcuggcuuucgccuggug

SEQ ID NO: 1866207 - RNA, 16 nt, Salmonella typhimurium LT2
gcuggcugccgccauu

SEQ ID NO: 1866208 - RNA, 14 nt, Salmonella typhimurium LT2
gcuggcucuugcug

SEQ ID NO: 1866209 - RNA, 19 nt, Salmonella typhimurium LT2
gcuggcucuugcuguagcu

SEQ ID NO: 1866210 - RNA, 22 nt, Salmonella typhimurium LT2
gcuggcgguaacaggcaccagc

SEQ ID NO: 1866211 - RNA, 19 nt, Salmonella typhimurium LT2
gcuggcgguuuuugugggu

SEQ ID NO: 1866212 - RNA, 21 nt, Salmonella typhimurium LT2
gcuggcguacaguuucgccgu

SEQ ID NO: 1866213 - RNA, 13 nt, Salmonella typhimurium LT2
gcuggcguccagc

SEQ ID NO: 1866214 - RNA, 22 nt, Salmonella typhimurium LT2
gcuggcgugacguguggcgcug

SEQ ID NO: 1866215 - RNA, 16 nt, Salmonella typhimurium LT2
gcuggguucauccagc

SEQ ID NO: 1866216 - RNA, 21 nt, Salmonella typhimurium LT2
aaagcugugccacauuuaugu

SEQ ID NO: 1866217 - RNA, 22 nt, Salmonella typhimurium LT2
aaagcuggccuucagguuuuua

SEQ ID NO: 1866218 - RNA, 15 nt, Salmonella typhimurium LT2
gcuggggcuggcggc

SEQ ID NO: 1866219 - RNA, 16 nt, Salmonella typhimurium LT2
gcugcgucgcuuccug

SEQ ID NO: 1866220 - RNA, 15 nt, Salmonella typhimurium LT2
gcugcgggaaaagca

SEQ ID NO: 1866221 - RNA, 16 nt, Salmonella typhimurium LT2
gcugcgggaaaagcau

SEQ ID NO: 1866222 - RNA, 12 nt, Salmonella typhimurium LT2
gcugcgggccgc

SEQ ID NO: 1866223 - RNA, 22 nt, Salmonella typhimurium LT2
gcugcguaacgcuuaaccccuc

SEQ ID NO: 1866224 - RNA, 16 nt, Salmonella typhimurium LT2
gcugcggcguccccca

SEQ ID NO: 1866225 - RNA, 14 nt, Salmonella typhimurium LT2
gcugcgggaggcgg

SEQ ID NO: 1866226 - RNA, 18 nt, Salmonella typhimurium LT2
gcugcgggaggcggucug

SEQ ID NO: 1866227 - RNA, 21 nt, Salmonella typhimurium LT2
gcugcggccuccgcagcuuca

SEQ ID NO: 1866228 - RNA, 11 nt, Salmonella typhimurium LT2
gcugcggauga

SEQ ID NO: 1866229 - RNA, 23 nt, Salmonella typhimurium LT2
gcugcugaccuuaauccagccgu

SEQ ID NO: 1866230 - RNA, 19 nt, Salmonella typhimurium LT2
gcugcugacguaaauucug

SEQ ID NO: 1866231 - RNA, 16 nt, Salmonella typhimurium LT2
gcugcucuugcggcug

SEQ ID NO: 1866232 - RNA, 18 nt, Salmonella typhimurium LT2
gcugcucuugcggcugca

SEQ ID NO: 1866233 - RNA, 19 nt, Salmonella typhimurium LT2
gcugcuuucuaccagccug

SEQ ID NO: 1866234 - RNA, 23 nt, Salmonella typhimurium LT2
gcuggacaugcuccgccccgccu

SEQ ID NO: 1866235 - RNA, 13 nt, Salmonella typhimurium LT2
gcuggcaggccau

SEQ ID NO: 1866236 - RNA, 15 nt, Salmonella typhimurium LT2
gcuggaggcggacga

SEQ ID NO: 1866237 - RNA, 19 nt, Salmonella typhimurium LT2
gcuggcauuaucguccguc

SEQ ID NO: 1866238 - RNA, 14 nt, Salmonella typhimurium LT2
gcuggcagggggag

SEQ ID NO: 1866239 - RNA, 15 nt, Salmonella typhimurium LT2
gcuggcgacggcggu

SEQ ID NO: 1866240 - RNA, 23 nt, Salmonella typhimurium LT2
gcuggcgauauccgugccgccgc

SEQ ID NO: 1866241 - RNA, 22 nt, Salmonella typhimurium LT2
gcuggcgaugauaaucguccca

SEQ ID NO: 1866242 - RNA, 16 nt, Salmonella typhimurium LT2
gcuggccuccagcacu

SEQ ID NO: 1866243 - RNA, 18 nt, Salmonella typhimurium LT2
gcuggcgcugacgacacu

SEQ ID NO: 1866244 - RNA, 21 nt, Salmonella typhimurium LT2
gcuggcgcgucacaacagccg

SEQ ID NO: 1866245 - RNA, 19 nt, Salmonella typhimurium LT2
gcuggcgcggggaacacuc

SEQ ID NO: 1866246 - RNA, 15 nt, Salmonella typhimurium LT2
gcuggcgcagccgcu

SEQ ID NO: 1866247 - RNA, 18 nt, Salmonella typhimurium LT2
gcuggcgcacgcgucauc

SEQ ID NO: 1866248 - RNA, 18 nt, Salmonella typhimurium LT2
gcuggcgcggggaacaca

SEQ ID NO: 1866249 - RNA, 17 nt, Salmonella typhimurium LT2
gcgucccggcagugcau

SEQ ID NO: 1866250 - RNA, 16 nt, Salmonella typhimurium LT2
gcgucccgucccacca

SEQ ID NO: 1866251 - RNA, 14 nt, Salmonella typhimurium LT2
gcgucccucuccag

SEQ ID NO: 1866252 - RNA, 22 nt, Salmonella typhimurium LT2
gcguccaguacuuucuuuugau

SEQ ID NO: 1866253 - RNA, 15 nt, Salmonella typhimurium LT2
gcguccagaggaucu

SEQ ID NO: 1866254 - RNA, 23 nt, Salmonella typhimurium LT2
gcguccacuuucucggcuuucca

SEQ ID NO: 1866255 - RNA, 13 nt, Salmonella typhimurium LT2
gcgucauguaaug

SEQ ID NO: 1866256 - RNA, 16 nt, Salmonella typhimurium LT2
gcgucgccauaaagcu

SEQ ID NO: 1866257 - RNA, 19 nt, Salmonella typhimurium LT2
gcgucgccccaaucgccag

SEQ ID NO: 1866258 - RNA, 17 nt, Salmonella typhimurium LT2
gcguccggggccagcgc

SEQ ID NO: 1866259 - RNA, 18 nt, Salmonella typhimurium LT2
gcguccggggccagcgcc

SEQ ID NO: 1866260 - RNA, 21 nt, Salmonella typhimurium LT2
gcguccggggccagcgccagu

SEQ ID NO: 1866261 - RNA, 18 nt, Salmonella typhimurium LT2
gcguccuccagcgugcag

SEQ ID NO: 1866262 - RNA, 19 nt, Salmonella typhimurium LT2
gcguaggucgcgaacagcu

SEQ ID NO: 1866263 - RNA, 21 nt, Salmonella typhimurium LT2
gcguaggccacaaaggccuca

SEQ ID NO: 1866264 - RNA, 15 nt, Salmonella typhimurium LT2
gcguagcgcgcggau

SEQ ID NO: 1866265 - RNA, 19 nt, Salmonella typhimurium LT2
gcguagccaaaagcgccac

SEQ ID NO: 1866266 - RNA, 13 nt, Salmonella typhimurium LT2
gcgucaaaacagg

SEQ ID NO: 1866267 - RNA, 15 nt, Salmonella typhimurium LT2
gcgucaaagcacaug

SEQ ID NO: 1866268 - RNA, 16 nt, Salmonella typhimurium LT2
gcguauaacgccgccc

SEQ ID NO: 1866269 - RNA, 11 nt, Salmonella typhimurium LT2
gcguauccagu

SEQ ID NO: 1866270 - RNA, 15 nt, Salmonella typhimurium LT2
gcgucaacguccagu

SEQ ID NO: 1866271 - RNA, 16 nt, Salmonella typhimurium LT2
gcgucaacggcgcggc

SEQ ID NO: 1866272 - RNA, 13 nt, Salmonella typhimurium LT2
gcgucacaacagc

SEQ ID NO: 1866273 - RNA, 17 nt, Salmonella typhimurium LT2
gcgucacaaaaacaccc

SEQ ID NO: 1866274 - RNA, 13 nt, Salmonella typhimurium LT2
gcgucaauauuaa

SEQ ID NO: 1866275 - RNA, 20 nt, Salmonella typhimurium LT2
gcgucacucuuacggcgccc

SEQ ID NO: 1866276 - RNA, 23 nt, Salmonella typhimurium LT2
gcgucaucggcgcgcuggcguga

SEQ ID NO: 1866277 - RNA, 19 nt, Salmonella typhimurium LT2
gcgucauaguuuuccagcc

SEQ ID NO: 1866278 - RNA, 12 nt, Salmonella typhimurium LT2
gcgucaggcgau

SEQ ID NO: 1866279 - RNA, 16 nt, Salmonella typhimurium LT2
gcgucagcccaagcug

SEQ ID NO: 1866280 - RNA, 20 nt, Salmonella typhimurium LT2
gcgucagcguguaaucgccg

SEQ ID NO: 1866281 - RNA, 15 nt, Salmonella typhimurium LT2
gcgucagcgugcggu

SEQ ID NO: 1866282 - RNA, 15 nt, Salmonella typhimurium LT2
gcgugcuggcggccg

SEQ ID NO: 1866283 - RNA, 15 nt, Salmonella typhimurium LT2
gcgugcucgcggcgg

SEQ ID NO: 1866284 - RNA, 15 nt, Salmonella typhimurium LT2
gcgugcgcuuccacu

SEQ ID NO: 1866285 - RNA, 16 nt, Salmonella typhimurium LT2
gcgugcgucauccggc

SEQ ID NO: 1866286 - RNA, 17 nt, Salmonella typhimurium LT2
gcgugaccaccgccuug

SEQ ID NO: 1866287 - RNA, 17 nt, Salmonella typhimurium LT2
gcgugagccacuaucca

SEQ ID NO: 1866288 - RNA, 20 nt, Salmonella typhimurium LT2
gcgugacguucaucauuuuc

SEQ ID NO: 1866289 - RNA, 20 nt, Salmonella typhimurium LT2
gcgugcaagggaaggcgccc

SEQ ID NO: 1866290 - RNA, 20 nt, Salmonella typhimurium LT2
gcgugauggaacaucuccca

SEQ ID NO: 1866291 - RNA, 17 nt, Salmonella typhimurium LT2
gcgugauaauuccccca

SEQ ID NO: 1866292 - RNA, 18 nt, Salmonella typhimurium LT2
gcgucugagcaucccggu

SEQ ID NO: 1866293 - RNA, 19 nt, Salmonella typhimurium LT2
gcgucugacagcgcgcguc

SEQ ID NO: 1866294 - RNA, 11 nt, Salmonella typhimurium LT2
gcgucucuccc

SEQ ID NO: 1866295 - RNA, 18 nt, Salmonella typhimurium LT2
gcgucugccccaaacgcu

SEQ ID NO: 1866296 - RNA, 18 nt, Salmonella typhimurium LT2
gcgucucgcacucgccgc

SEQ ID NO: 1866297 - RNA, 22 nt, Salmonella typhimurium LT2
gcgucucacuuuucgggugaga

SEQ ID NO: 1866298 - RNA, 17 nt, Salmonella typhimurium LT2
gcgucuuauccggccuc

SEQ ID NO: 1866299 - RNA, 15 nt, Salmonella typhimurium LT2
gcgucuuaucuggcc

SEQ ID NO: 1866300 - RNA, 17 nt, Salmonella typhimurium LT2
gcgucgcguaccagcgc

SEQ ID NO: 1866301 - RNA, 18 nt, Salmonella typhimurium LT2
gcgucgcuaaucagcaac

SEQ ID NO: 1866302 - RNA, 22 nt, Salmonella typhimurium LT2
gcgucgccuguccggccuguaa

SEQ ID NO: 1866303 - RNA, 17 nt, Salmonella typhimurium LT2
gcgucggcaccauuccc

SEQ ID NO: 1866304 - RNA, 12 nt, Salmonella typhimurium LT2
gcgucgcugguc

SEQ ID NO: 1866305 - RNA, 14 nt, Salmonella typhimurium LT2
gcgucgcuuccugu

SEQ ID NO: 1866306 - RNA, 16 nt, Salmonella typhimurium LT2
gcgucgcuucguucug

SEQ ID NO: 1866307 - RNA, 23 nt, Salmonella typhimurium LT2
gcgucgggggcgacaaacagcgc

SEQ ID NO: 1866308 - RNA, 21 nt, Salmonella typhimurium LT2
gcgggauuggucgcgccgcgc

SEQ ID NO: 1866309 - RNA, 13 nt, Salmonella typhimurium LT2
gcgggccgucagg

SEQ ID NO: 1866310 - RNA, 11 nt, Salmonella typhimurium LT2
gcgggccgcgg

SEQ ID NO: 1866311 - RNA, 21 nt, Salmonella typhimurium LT2
gcgggaugcuguaccgcccgc

SEQ ID NO: 1866312 - RNA, 20 nt, Salmonella typhimurium LT2
gcgggauaacgcaacaacag

SEQ ID NO: 1866313 - RNA, 16 nt, Salmonella typhimurium LT2
gcggcuguguccgcca

SEQ ID NO: 1866314 - RNA, 15 nt, Salmonella typhimurium LT2
gcggcuucagcgaca

SEQ ID NO: 1866315 - RNA, 17 nt, Salmonella typhimurium LT2
gcggcuucagcgacauc

SEQ ID NO: 1866316 - RNA, 18 nt, Salmonella typhimurium LT2
gcggguucccccacucuu

SEQ ID NO: 1866317 - RNA, 15 nt, Salmonella typhimurium LT2
gcggguucccccacu

SEQ ID NO: 1866318 - RNA, 20 nt, Salmonella typhimurium LT2
gcgggugugccucggcgacg

SEQ ID NO: 1866319 - RNA, 14 nt, Salmonella typhimurium LT2
gcggucagcggcgc

SEQ ID NO: 1866320 - RNA, 15 nt, Salmonella typhimurium LT2
gcgguagucacggag

SEQ ID NO: 1866321 - RNA, 12 nt, Salmonella typhimurium LT2
gcggucaggaau

SEQ ID NO: 1866322 - RNA, 13 nt, Salmonella typhimurium LT2
gcggucaggccag

SEQ ID NO: 1866323 - RNA, 23 nt, Salmonella typhimurium LT2
gcgguccaaagauaaacgacagc

SEQ ID NO: 1866324 - RNA, 18 nt, Salmonella typhimurium LT2
gcgguacgccuugagcaa

SEQ ID NO: 1866325 - RNA, 14 nt, Salmonella typhimurium LT2
gcgguagccagcgc

SEQ ID NO: 1866326 - RNA, 20 nt, Salmonella typhimurium LT2
gcgguagauucuaucuguuu

SEQ ID NO: 1866327 - RNA, 12 nt, Salmonella typhimurium LT2
gcgggguaaaau

SEQ ID NO: 1866328 - RNA, 23 nt, Salmonella typhimurium LT2
gcggucgauuuugccuucaauuc

SEQ ID NO: 1866329 - RNA, 18 nt, Salmonella typhimurium LT2
gcggucuuaucaaauuug

SEQ ID NO: 1866330 - RNA, 16 nt, Salmonella typhimurium LT2
gcggucgcugauaauc

SEQ ID NO: 1866331 - RNA, 14 nt, Salmonella typhimurium LT2
gcggucgccgcaug

SEQ ID NO: 1866332 - RNA, 19 nt, Salmonella typhimurium LT2
gcggucgccugccgcaugu

SEQ ID NO: 1866333 - RNA, 22 nt, Salmonella typhimurium LT2
gcggugcaugaauaucaaacca

SEQ ID NO: 1866334 - RNA, 20 nt, Salmonella typhimurium LT2
gcggugaucccaggccggca

SEQ ID NO: 1866335 - RNA, 21 nt, Salmonella typhimurium LT2
gcggugaggggggauugacuc

SEQ ID NO: 1866336 - RNA, 13 nt, Salmonella typhimurium LT2
gcgguggaagaga

SEQ ID NO: 1866337 - RNA, 17 nt, Salmonella typhimurium LT2
gcggugcucuuuuguca

SEQ ID NO: 1866338 - RNA, 15 nt, Salmonella typhimurium LT2
gcgguggcgcacagu

SEQ ID NO: 1866339 - RNA, 15 nt, Salmonella typhimurium LT2
gcgguugcagcaaaa

SEQ ID NO: 1866340 - RNA, 20 nt, Salmonella typhimurium LT2
gcgguuggccuacaagaucg

SEQ ID NO: 1866341 - RNA, 12 nt, Salmonella typhimurium LT2
gcguaaaaaaac

SEQ ID NO: 1866342 - RNA, 20 nt, Salmonella typhimurium LT2
gcguaaaccccuucaccacu

SEQ ID NO: 1866343 - RNA, 18 nt, Salmonella typhimurium LT2
gcguaacgccacauauaa

SEQ ID NO: 1866344 - RNA, 18 nt, Salmonella typhimurium LT2
gcguaacgccuccaccgu

SEQ ID NO: 1866345 - RNA, 22 nt, Salmonella typhimurium LT2
gcguaacagcgcuaucaggaag

SEQ ID NO: 1866346 - RNA, 22 nt, Salmonella typhimurium LT2
gcguaaggugaaauacccgccg

SEQ ID NO: 1866347 - RNA, 16 nt, Salmonella typhimurium LT2
gcguaaugagcgucgc

SEQ ID NO: 1866348 - RNA, 15 nt, Salmonella typhimurium LT2
gcguaauucagcauu

SEQ ID NO: 1866349 - RNA, 13 nt, Salmonella typhimurium LT2
gcguaauggccac

SEQ ID NO: 1866350 - RNA, 17 nt, Salmonella typhimurium LT2
gcguaaugcgccaggca

SEQ ID NO: 1866351 - RNA, 15 nt, Salmonella typhimurium LT2
gcguaccacgccgca

SEQ ID NO: 1866352 - RNA, 16 nt, Salmonella typhimurium LT2
gcguaccacuaauuua

SEQ ID NO: 1866353 - RNA, 18 nt, Salmonella typhimurium LT2
gcguaccgcuaucgccaa

SEQ ID NO: 1866354 - RNA, 18 nt, Salmonella typhimurium LT2
gcggcgaagcaucuuucc

SEQ ID NO: 1866355 - RNA, 22 nt, Salmonella typhimurium LT2
gcggcgaauauagcuaaugcaa

SEQ ID NO: 1866356 - RNA, 17 nt, Salmonella typhimurium LT2
gcggcgcaaaucgccau

SEQ ID NO: 1866357 - RNA, 21 nt, Salmonella typhimurium LT2
gcggcgaucagacgcugguug

SEQ ID NO: 1866358 - RNA, 18 nt, Salmonella typhimurium LT2
gcggcgagucgcgcccac

SEQ ID NO: 1866359 - RNA, 15 nt, Salmonella typhimurium LT2
gcggccugcggcgag

SEQ ID NO: 1866360 - RNA, 14 nt, Salmonella typhimurium LT2
gcggcagccaugcu

SEQ ID NO: 1866361 - RNA, 20 nt, Salmonella typhimurium LT2
gcggcagggcggucugguac

SEQ ID NO: 1866362 - RNA, 19 nt, Salmonella typhimurium LT2
gcggcaggugagggcgucg

SEQ ID NO: 1866363 - RNA, 20 nt, Salmonella typhimurium LT2
gcggcauacuuucgcgcggc

SEQ ID NO: 1866364 - RNA, 20 nt, Salmonella typhimurium LT2
gcggcaguaagccagcgggc

SEQ ID NO: 1866365 - RNA, 20 nt, Salmonella typhimurium LT2
gcggccaguuguucuuucac

SEQ ID NO: 1866366 - RNA, 24 nt, Salmonella typhimurium LT2
gcggcagaauuaacucaucacagc

SEQ ID NO: 1866367 - RNA, 19 nt, Salmonella typhimurium LT2
gcggcagaaauuaaaucau

SEQ ID NO: 1866368 - RNA, 22 nt, Salmonella typhimurium LT2
gcggcagcacgagcauccagau

SEQ ID NO: 1866369 - RNA, 21 nt, Salmonella typhimurium LT2
gcggcacacaacacggcggcu

SEQ ID NO: 1866370 - RNA, 15 nt, Salmonella typhimurium LT2
gcggcaagcgcgcca

SEQ ID NO: 1866371 - RNA, 19 nt, Salmonella typhimurium LT2
gcggauuccaguagcgcgc

SEQ ID NO: 1866372 - RNA, 20 nt, Salmonella typhimurium LT2
gcggauuccaguagcgcgcc

SEQ ID NO: 1866373 - RNA, 22 nt, Salmonella typhimurium LT2
gcggaucaaacuccgcgcuggc

SEQ ID NO: 1866374 - RNA, 23 nt, Salmonella typhimurium LT2
gcggaucaaacuccgcgcuggca

SEQ ID NO: 1866375 - RNA, 18 nt, Salmonella typhimurium LT2
gcggauacagcggcgcgc

SEQ ID NO: 1866376 - RNA, 16 nt, Salmonella typhimurium LT2
gcggagaucuccagau

SEQ ID NO: 1866377 - RNA, 16 nt, Salmonella typhimurium LT2
gcggagaucgcucccg

SEQ ID NO: 1866378 - RNA, 19 nt, Salmonella typhimurium LT2
gcggagguuucuuuuucua

SEQ ID NO: 1866379 - RNA, 15 nt, Salmonella typhimurium LT2
gcggacacccgcagc

SEQ ID NO: 1866380 - RNA, 12 nt, Salmonella typhimurium LT2
gcggacagcggc

SEQ ID NO: 1866381 - RNA, 17 nt, Salmonella typhimurium LT2
gcggagaagacgccgcc

SEQ ID NO: 1866382 - RNA, 19 nt, Salmonella typhimurium LT2
gcggagaagacgccgccgc

SEQ ID NO: 1866383 - RNA, 18 nt, Salmonella typhimurium LT2
gcgcuuucagcgcaugga

SEQ ID NO: 1866384 - RNA, 15 nt, Salmonella typhimurium LT2
gcgcuuucuucuuca

SEQ ID NO: 1866385 - RNA, 20 nt, Salmonella typhimurium LT2
gcgcuuuggguuaaugccag

SEQ ID NO: 1866386 - RNA, 18 nt, Salmonella typhimurium LT2
gcgcuuugccgcugcugc

SEQ ID NO: 1866387 - RNA, 16 nt, Salmonella typhimurium LT2
gcgcuuuagggcuucc

SEQ ID NO: 1866388 - RNA, 20 nt, Salmonella typhimurium LT2
gcggaaugaccugagcgugc

SEQ ID NO: 1866389 - RNA, 19 nt, Salmonella typhimurium LT2
gcggaauggcgggcgcagg

SEQ ID NO: 1866390 - RNA, 17 nt, Salmonella typhimurium LT2
gcgcuuuugccgcgccc

SEQ ID NO: 1866391 - RNA, 18 nt, Salmonella typhimurium LT2
gcggaaucgcuuccuggg

SEQ ID NO: 1866392 - RNA, 20 nt, Salmonella typhimurium LT2
gcggaaucgucacagacccc

SEQ ID NO: 1866393 - RNA, 16 nt, Salmonella typhimurium LT2
gcggaauuucaggaag

SEQ ID NO: 1866394 - RNA, 22 nt, Salmonella typhimurium LT2
gcgcuugccuuuacuguugccu

SEQ ID NO: 1866395 - RNA, 15 nt, Salmonella typhimurium LT2
gcgcuugauccaguu

SEQ ID NO: 1866396 - RNA, 19 nt, Salmonella typhimurium LT2
gcgcuucgugaaaaccuaa

SEQ ID NO: 1866397 - RNA, 15 nt, Salmonella typhimurium LT2
gcgcuucgccugccg

SEQ ID NO: 1866398 - RNA, 16 nt, Salmonella typhimurium LT2
gcgcuucgccugccgg

SEQ ID NO: 1866399 - RNA, 19 nt, Salmonella typhimurium LT2
gcgcuucgcuugcccggcc

SEQ ID NO: 1866400 - RNA, 18 nt, Salmonella typhimurium LT2
gcgcuucguuuccugucu

SEQ ID NO: 1866401 - RNA, 14 nt, Salmonella typhimurium LT2
gcgcugaagcccgc

SEQ ID NO: 1866402 - RNA, 16 nt, Salmonella typhimurium LT2
gcgcuccggcacuggc

SEQ ID NO: 1866403 - RNA, 22 nt, Salmonella typhimurium LT2
gcgcucuuuuucuugucuccac

SEQ ID NO: 1866404 - RNA, 12 nt, Salmonella typhimurium LT2
gcgcgcuccaga

SEQ ID NO: 1866405 - RNA, 24 nt, Salmonella typhimurium LT2
gcgcggaaggcgccucgcgcggcg

SEQ ID NO: 1866406 - RNA, 21 nt, Salmonella typhimurium LT2
gcgcggaaagugccguacggc

SEQ ID NO: 1866407 - RNA, 14 nt, Salmonella typhimurium LT2
gcgcggaucgccau

SEQ ID NO: 1866408 - RNA, 17 nt, Salmonella typhimurium LT2
gcgcggauauggcggcg

SEQ ID NO: 1866409 - RNA, 19 nt, Salmonella typhimurium LT2
gcgcggauauggcggcggc

SEQ ID NO: 1866410 - RNA, 19 nt, Salmonella typhimurium LT2
gcgcggcccauucaacggg

SEQ ID NO: 1866411 - RNA, 23 nt, Salmonella typhimurium LT2
gcgcgccgaaaauauacaccuga

SEQ ID NO: 1866412 - RNA, 16 nt, Salmonella typhimurium LT2
gcgcgcccugcgggcc

SEQ ID NO: 1866413 - RNA, 20 nt, Salmonella typhimurium LT2
gcgcgccggugaucccacca

SEQ ID NO: 1866414 - RNA, 19 nt, Salmonella typhimurium LT2
gcgcgccgggcuucauacc

SEQ ID NO: 1866415 - RNA, 13 nt, Salmonella typhimurium LT2
gcgcgccaugaga

SEQ ID NO: 1866416 - RNA, 12 nt, Salmonella typhimurium LT2
gcgcgcccagca

SEQ ID NO: 1866417 - RNA, 15 nt, Salmonella typhimurium LT2
gcgcgcccgacgcgc

SEQ ID NO: 1866418 - RNA, 17 nt, Salmonella typhimurium LT2
gcgcgcgaaaagaaacu

SEQ ID NO: 1866419 - RNA, 17 nt, Salmonella typhimurium LT2
gcgcgcacacaauagca

SEQ ID NO: 1866420 - RNA, 21 nt, Salmonella typhimurium LT2
gcgcgaucgccccgaccagga

SEQ ID NO: 1866421 - RNA, 19 nt, Salmonella typhimurium LT2
gcgcgcagaccacgaauca

SEQ ID NO: 1866422 - RNA, 15 nt, Salmonella typhimurium LT2
gcgcgccaguuuggu

SEQ ID NO: 1866423 - RNA, 14 nt, Salmonella typhimurium LT2
gcgauccugaaaug

SEQ ID NO: 1866424 - RNA, 21 nt, Salmonella typhimurium LT2
gcgaucgccgucguucagcca

SEQ ID NO: 1866425 - RNA, 19 nt, Salmonella typhimurium LT2
gcgcgaaucgacaauccgc

SEQ ID NO: 1866426 - RNA, 19 nt, Salmonella typhimurium LT2
gcgcgaacggcaucuacug

SEQ ID NO: 1866427 - RNA, 21 nt, Salmonella typhimurium LT2
gcgauccagccccagcgccag

SEQ ID NO: 1866428 - RNA, 21 nt, Salmonella typhimurium LT2
gcgauccaggucuuccgccgg

SEQ ID NO: 1866429 - RNA, 17 nt, Salmonella typhimurium LT2
gcgauccaggucuuccg

SEQ ID NO: 1866430 - RNA, 21 nt, Salmonella typhimurium LT2
gcgcguaaauccuccaucaug

SEQ ID NO: 1866431 - RNA, 20 nt, Salmonella typhimurium LT2
gcgcguagcggucacccggc

SEQ ID NO: 1866432 - RNA, 15 nt, Salmonella typhimurium LT2
gcgcgucagcgccuc

SEQ ID NO: 1866433 - RNA, 16 nt, Salmonella typhimurium LT2
gcgcgucaacggcgcg

SEQ ID NO: 1866434 - RNA, 17 nt, Salmonella typhimurium LT2
gcgcguccucacacuga

SEQ ID NO: 1866435 - RNA, 14 nt, Salmonella typhimurium LT2
gcgcguccagcggc

SEQ ID NO: 1866436 - RNA, 20 nt, Salmonella typhimurium LT2
gcgcgguauuucgccgccgc

SEQ ID NO: 1866437 - RNA, 18 nt, Salmonella typhimurium LT2
gcgcggucgcuucgccuu

SEQ ID NO: 1866438 - RNA, 21 nt, Salmonella typhimurium LT2
gcgcgguggcuuuuuccugcc

SEQ ID NO: 1866439 - RNA, 15 nt, Salmonella typhimurium LT2
gcgcgggaaacacua

SEQ ID NO: 1866440 - RNA, 19 nt, Salmonella typhimurium LT2
gcgcggcugccggacugcu

SEQ ID NO: 1866441 - RNA, 16 nt, Salmonella typhimurium LT2
gcgcggcgucgccgcc

SEQ ID NO: 1866442 - RNA, 14 nt, Salmonella typhimurium LT2
gcgcggggaacacu

SEQ ID NO: 1866443 - RNA, 14 nt, Salmonella typhimurium LT2
gcgcggggaacaca

SEQ ID NO: 1866444 - RNA, 15 nt, Salmonella typhimurium LT2
gcgcggggaacacaa

SEQ ID NO: 1866445 - RNA, 16 nt, Salmonella typhimurium LT2
gcgcggggaacacaau

SEQ ID NO: 1866446 - RNA, 20 nt, Salmonella typhimurium LT2
gcgcgggcgguacagcaucc

SEQ ID NO: 1866447 - RNA, 19 nt, Salmonella typhimurium LT2
gcgcguccuuauaaugcuu

SEQ ID NO: 1866448 - RNA, 13 nt, Salmonella typhimurium LT2
gcgcgucgccuga

SEQ ID NO: 1866449 - RNA, 14 nt, Salmonella typhimurium LT2
gcgcuaccagcgcg

SEQ ID NO: 1866450 - RNA, 14 nt, Salmonella typhimurium LT2
gcgcuaagccagcc

SEQ ID NO: 1866451 - RNA, 17 nt, Salmonella typhimurium LT2
gcgcuaauguggauagu

SEQ ID NO: 1866452 - RNA, 22 nt, Salmonella typhimurium LT2
gcgcuaagcguuacggaaaaaa

SEQ ID NO: 1866453 - RNA, 17 nt, Salmonella typhimurium LT2
gcgcuaaaugcauagcc

SEQ ID NO: 1866454 - RNA, 17 nt, Salmonella typhimurium LT2
gcgcguuccccaacagc

SEQ ID NO: 1866455 - RNA, 19 nt, Salmonella typhimurium LT2
gcgcguuuagcgccagcag

SEQ ID NO: 1866456 - RNA, 20 nt, Salmonella typhimurium LT2
gcgcguuuagcgccagcagc

SEQ ID NO: 1866457 - RNA, 20 nt, Salmonella typhimurium LT2
gcgcguugaugaaucugguc

SEQ ID NO: 1866458 - RNA, 15 nt, Salmonella typhimurium LT2
gcgcucacgcggcgc

SEQ ID NO: 1866459 - RNA, 16 nt, Salmonella typhimurium LT2
gcgcucaggaucgccg

SEQ ID NO: 1866460 - RNA, 16 nt, Salmonella typhimurium LT2
gcgcucauaaccgcga

SEQ ID NO: 1866461 - RNA, 22 nt, Salmonella typhimurium LT2
gcgcucaguucauuauuucaug

SEQ ID NO: 1866462 - RNA, 12 nt, Salmonella typhimurium LT2
gcgcuccaggau

SEQ ID NO: 1866463 - RNA, 19 nt, Salmonella typhimurium LT2
gcgcuccagcuucaucauc

SEQ ID NO: 1866464 - RNA, 18 nt, Salmonella typhimurium LT2
gcgcuaugcgcuccagga

SEQ ID NO: 1866465 - RNA, 17 nt, Salmonella typhimurium LT2
gcgcuauucccaggcaa

SEQ ID NO: 1866466 - RNA, 13 nt, Salmonella typhimurium LT2
gcgcucaagcgaa

SEQ ID NO: 1866467 - RNA, 18 nt, Salmonella typhimurium LT2
gcgcucaccuccgccacc

SEQ ID NO: 1866468 - RNA, 21 nt, Salmonella typhimurium LT2
gcgcuagcuucagguguuagu

SEQ ID NO: 1866469 - RNA, 16 nt, Salmonella typhimurium LT2
gcgcuaucgguaucau

SEQ ID NO: 1866470 - RNA, 23 nt, Salmonella typhimurium LT2
gcgcuacggcguuucacuucuga

SEQ ID NO: 1866471 - RNA, 19 nt, Salmonella typhimurium LT2
gcaagaaccgcuuuuccug

SEQ ID NO: 1866472 - RNA, 18 nt, Salmonella typhimurium LT2
gcaagacccgaaccugcg

SEQ ID NO: 1866473 - RNA, 18 nt, Salmonella typhimurium LT2
gcaagacccgacaguaaa

SEQ ID NO: 1866474 - RNA, 15 nt, Salmonella typhimurium LT2
gcaacuggcaauagc

SEQ ID NO: 1866475 - RNA, 14 nt, Salmonella typhimurium LT2
gcaacuguuuuacc

SEQ ID NO: 1866476 - RNA, 17 nt, Salmonella typhimurium LT2
gcaacucacgccauucc

SEQ ID NO: 1866477 - RNA, 22 nt, Salmonella typhimurium LT2
gcaacuccaguucccgacaggc

SEQ ID NO: 1866478 - RNA, 21 nt, Salmonella typhimurium LT2
gcaacguuucuuucaucagau

SEQ ID NO: 1866479 - RNA, 18 nt, Salmonella typhimurium LT2
gcaacguuuguaacagca

SEQ ID NO: 1866480 - RNA, 22 nt, Salmonella typhimurium LT2
aaagcgcgagggauuaucuuua

SEQ ID NO: 1866481 - RNA, 22 nt, Salmonella typhimurium LT2
gcaacugagcgaauccccgggc

SEQ ID NO: 1866482 - RNA, 14 nt, Salmonella typhimurium LT2
gcaacgcgcaucaa

SEQ ID NO: 1866483 - RNA, 20 nt, Salmonella typhimurium LT2
gcaacgcuucugagaauuug

SEQ ID NO: 1866484 - RNA, 18 nt, Salmonella typhimurium LT2
gcaacggaaggaaauaac

SEQ ID NO: 1866485 - RNA, 23 nt, Salmonella typhimurium LT2
gcaacgccguacuccagcccauc

SEQ ID NO: 1866486 - RNA, 15 nt, Salmonella typhimurium LT2
gcaacgccggugccu

SEQ ID NO: 1866487 - RNA, 20 nt, Salmonella typhimurium LT2
gcaacggugagaccauugca

SEQ ID NO: 1866488 - RNA, 16 nt, Salmonella typhimurium LT2
gcaacgggcaaugcca

SEQ ID NO: 1866489 - RNA, 12 nt, Salmonella typhimurium LT2
gcaacgucagua

SEQ ID NO: 1866490 - RNA, 17 nt, Salmonella typhimurium LT2
gcaacgucgacccgccc

SEQ ID NO: 1866491 - RNA, 21 nt, Salmonella typhimurium LT2
gcaacgugaacugcgccugca

SEQ ID NO: 1866492 - RNA, 22 nt, Salmonella typhimurium LT2
gcaacgugcaggcgccgccauc

SEQ ID NO: 1866493 - RNA, 18 nt, Salmonella typhimurium LT2
gcaacguguaggccuggu

SEQ ID NO: 1866494 - RNA, 19 nt, Salmonella typhimurium LT2
gcaacgaucccuaauaaaa

SEQ ID NO: 1866495 - RNA, 22 nt, Salmonella typhimurium LT2
gcaacgauucguaaauugacug

SEQ ID NO: 1866496 - RNA, 17 nt, Salmonella typhimurium LT2
gcaacgacgucuuucuu

SEQ ID NO: 1866497 - RNA, 14 nt, Salmonella typhimurium LT2
gcaaccuuacguuu

SEQ ID NO: 1866498 - RNA, 21 nt, Salmonella typhimurium LT2
gcaaccuuaaacaucgcccuc

SEQ ID NO: 1866499 - RNA, 14 nt, Salmonella typhimurium LT2
gcaaccugagcgcg

SEQ ID NO: 1866500 - RNA, 18 nt, Salmonella typhimurium LT2
gcaaccgcucuccgcaau

SEQ ID NO: 1866501 - RNA, 18 nt, Salmonella typhimurium LT2
gcaaccgcuuugucagag

SEQ ID NO: 1866502 - RNA, 14 nt, Salmonella typhimurium LT2
gcaaccggcguggu

SEQ ID NO: 1866503 - RNA, 15 nt, Salmonella typhimurium LT2
gcaauagaguaauga

SEQ ID NO: 1866504 - RNA, 17 nt, Salmonella typhimurium LT2
gcaauacagccagcaca

SEQ ID NO: 1866505 - RNA, 19 nt, Salmonella typhimurium LT2
gcaauaauguuuacgccau

SEQ ID NO: 1866506 - RNA, 13 nt, Salmonella typhimurium LT2
gcaauaacaggca

SEQ ID NO: 1866507 - RNA, 14 nt, Salmonella typhimurium LT2
gcaauaacaggcac

SEQ ID NO: 1866508 - RNA, 20 nt, Salmonella typhimurium LT2
gcaauauuacaaagcaguaa

SEQ ID NO: 1866509 - RNA, 19 nt, Salmonella typhimurium LT2
gcaauaugucuuaaacagc

SEQ ID NO: 1866510 - RNA, 21 nt, Salmonella typhimurium LT2
gcaauaugaaaccgcccugca

SEQ ID NO: 1866511 - RNA, 16 nt, Salmonella typhimurium LT2
gcaauaucgaugccag

SEQ ID NO: 1866512 - RNA, 17 nt, Salmonella typhimurium LT2
gcaauagaguaaugaca

SEQ ID NO: 1866513 - RNA, 13 nt, Salmonella typhimurium LT2
gcaauagucucca

SEQ ID NO: 1866514 - RNA, 14 nt, Salmonella typhimurium LT2
gcaaguauacuuau

SEQ ID NO: 1866515 - RNA, 18 nt, Salmonella typhimurium LT2
gcaauaaagcagggcggc

SEQ ID NO: 1866516 - RNA, 14 nt, Salmonella typhimurium LT2
gcaauaaaaggaau

SEQ ID NO: 1866517 - RNA, 24 nt, Salmonella typhimurium LT2
gcaauaaacuaaguaaggaggaau

SEQ ID NO: 1866518 - RNA, 15 nt, Salmonella typhimurium LT2
gcaauaaaauauccu

SEQ ID NO: 1866519 - RNA, 19 nt, Salmonella typhimurium LT2
gcaauaaaauauccuccac

SEQ ID NO: 1866520 - RNA, 15 nt, Salmonella typhimurium LT2
gcaaggcaucaggcu

SEQ ID NO: 1866521 - RNA, 19 nt, Salmonella typhimurium LT2
gcaaggaaaaccaguaacg

SEQ ID NO: 1866522 - RNA, 12 nt, Salmonella typhimurium LT2
gcaaggcgcggu

SEQ ID NO: 1866523 - RNA, 16 nt, Salmonella typhimurium LT2
gcaagggaagagauua

SEQ ID NO: 1866524 - RNA, 19 nt, Salmonella typhimurium LT2
gcaagggaaucucuucacg

SEQ ID NO: 1866525 - RNA, 12 nt, Salmonella typhimurium LT2
gcaagggcaagg

SEQ ID NO: 1866526 - RNA, 18 nt, Salmonella typhimurium LT2
gcaagggcaagggcaagg

SEQ ID NO: 1866527 - RNA, 15 nt, Salmonella typhimurium LT2
gcaagggcaaucuga

SEQ ID NO: 1866528 - RNA, 20 nt, Salmonella typhimurium LT2
gcaagcauaaaaaacaucau

SEQ ID NO: 1866529 - RNA, 17 nt, Salmonella typhimurium LT2
gcaagcgcuaagcaaca

SEQ ID NO: 1866530 - RNA, 14 nt, Salmonella typhimurium LT2
gcaaucacacuaca

SEQ ID NO: 1866531 - RNA, 16 nt, Salmonella typhimurium LT2
gcaaucacauacagca

SEQ ID NO: 1866532 - RNA, 20 nt, Salmonella typhimurium LT2
gcaauauuuucaaccggguu

SEQ ID NO: 1866533 - RNA, 19 nt, Salmonella typhimurium LT2
gcaaucacccacgucagua

SEQ ID NO: 1866534 - RNA, 22 nt, Salmonella typhimurium LT2
gcaaucacccacgucaguaaga

SEQ ID NO: 1866535 - RNA, 20 nt, Salmonella typhimurium LT2
gcaaucaguacgcgcgcggc

SEQ ID NO: 1866536 - RNA, 21 nt, Salmonella typhimurium LT2
gcaaucaguacgcgcgcggcg

SEQ ID NO: 1866537 - RNA, 18 nt, Salmonella typhimurium LT2
gcaaugaagcaagugcug

SEQ ID NO: 1866538 - RNA, 12 nt, Salmonella typhimurium LT2
gcaaugccacca

SEQ ID NO: 1866539 - RNA, 12 nt, Salmonella typhimurium LT2
gcaaugauuuuu

SEQ ID NO: 1866540 - RNA, 15 nt, Salmonella typhimurium LT2
gcaaucggcuuugac

SEQ ID NO: 1866541 - RNA, 16 nt, Salmonella typhimurium LT2
gcaaucgggccugcuc

SEQ ID NO: 1866542 - RNA, 19 nt, Salmonella typhimurium LT2
gcaaucgggccugcuccgu

SEQ ID NO: 1866543 - RNA, 14 nt, Salmonella typhimurium LT2
gcaaucgagaucag

SEQ ID NO: 1866544 - RNA, 21 nt, Salmonella typhimurium LT2
gcaaucgacguugaucgccau

SEQ ID NO: 1866545 - RNA, 18 nt, Salmonella typhimurium LT2
gcaaucucuggccaggca

SEQ ID NO: 1866546 - RNA, 18 nt, Salmonella typhimurium LT2
gcaaucucuuccgcccag

SEQ ID NO: 1866547 - RNA, 17 nt, Salmonella typhimurium LT2
gcaaucuuuagcaccuu

SEQ ID NO: 1866548 - RNA, 18 nt, Salmonella typhimurium LT2
gcaaugcccgguuuuuua

SEQ ID NO: 1866549 - RNA, 20 nt, Salmonella typhimurium LT2
gcaaugcgcuuuuuuugccc

SEQ ID NO: 1866550 - RNA, 14 nt, Salmonella typhimurium LT2
gcaaugcgcuccag

SEQ ID NO: 1866551 - RNA, 21 nt, Salmonella typhimurium LT2
gcaaugcgcuuuuuuugcccu

SEQ ID NO: 1866552 - RNA, 23 nt, Salmonella typhimurium LT2
gcaaugcugacgacauucagcac

SEQ ID NO: 1866553 - RNA, 14 nt, Salmonella typhimurium LT2
gcaaugggaaggaa

SEQ ID NO: 1866554 - RNA, 11 nt, Salmonella typhimurium LT2
gcaauuaauau

SEQ ID NO: 1866555 - RNA, 22 nt, Salmonella typhimurium LT2
gcaauuaauauauuuauauaua

SEQ ID NO: 1866556 - RNA, 19 nt, Salmonella typhimurium LT2
gcaauuacggacagaaaaa

SEQ ID NO: 1866557 - RNA, 20 nt, Salmonella typhimurium LT2
gcaauuacggacagaaaaaa

SEQ ID NO: 1866558 - RNA, 22 nt, Salmonella typhimurium LT2
gcaauuuaucgugccggauggc

SEQ ID NO: 1866559 - RNA, 17 nt, Salmonella typhimurium LT2
gcaauuccgccaucuca

SEQ ID NO: 1866560 - RNA, 15 nt, Salmonella typhimurium LT2
gcaauuccugacugc

SEQ ID NO: 1866561 - RNA, 23 nt, Salmonella typhimurium LT2
gcaauucgagauuuuucugcgcc

SEQ ID NO: 1866562 - RNA, 22 nt, Salmonella typhimurium LT2
gcaauucgaggagcgcggcggc

SEQ ID NO: 1866563 - RNA, 23 nt, Salmonella typhimurium LT2
gcaauuugguuagggaucaucuu

SEQ ID NO: 1866564 - RNA, 18 nt, Salmonella typhimurium LT2
gcaauuucauucaccacc

SEQ ID NO: 1866565 - RNA, 18 nt, Salmonella typhimurium LT2
gcacaaaaagagcaauau

SEQ ID NO: 1866566 - RNA, 18 nt, Salmonella typhimurium LT2
gcaauuuuguuaaauccc

SEQ ID NO: 1866567 - RNA, 15 nt, Salmonella typhimurium LT2
gcacagguacaggcc

SEQ ID NO: 1866568 - RNA, 20 nt, Salmonella typhimurium LT2
gcacagguacaggccgccgc

SEQ ID NO: 1866569 - RNA, 14 nt, Salmonella typhimurium LT2
gcacauaacgugcc

SEQ ID NO: 1866570 - RNA, 18 nt, Salmonella typhimurium LT2
gcacaguuuuccccccuc

SEQ ID NO: 1866571 - RNA, 16 nt, Salmonella typhimurium LT2
gcacaguauuaccgcu

SEQ ID NO: 1866572 - RNA, 18 nt, Salmonella typhimurium LT2
gcacaguacgcccggcgg

SEQ ID NO: 1866573 - RNA, 17 nt, Salmonella typhimurium LT2
gcacagcggauggcuga

SEQ ID NO: 1866574 - RNA, 15 nt, Salmonella typhimurium LT2
gcacagcacauagaa

SEQ ID NO: 1866575 - RNA, 15 nt, Salmonella typhimurium LT2
gcacagccccagcac

SEQ ID NO: 1866576 - RNA, 15 nt, Salmonella typhimurium LT2
gcacagcccauacca

SEQ ID NO: 1866577 - RNA, 15 nt, Salmonella typhimurium LT2
gcacagccaguaaga

SEQ ID NO: 1866578 - RNA, 19 nt, Salmonella typhimurium LT2
gcacagccaguaagaacga

SEQ ID NO: 1866579 - RNA, 21 nt, Salmonella typhimurium LT2
gcaccaaaguuaaucagcgcu

SEQ ID NO: 1866580 - RNA, 17 nt, Salmonella typhimurium LT2
gcaccaaauccuccagc

SEQ ID NO: 1866581 - RNA, 20 nt, Salmonella typhimurium LT2
gcacaugcagcgcaaacuca

SEQ ID NO: 1866582 - RNA, 18 nt, Salmonella typhimurium LT2
gcacaucgccauuaaaag

SEQ ID NO: 1866583 - RNA, 17 nt, Salmonella typhimurium LT2
gcacaucgccauuaaaa

SEQ ID NO: 1866584 - RNA, 14 nt, Salmonella typhimurium LT2
gcacaucaggaaau

SEQ ID NO: 1866585 - RNA, 21 nt, Salmonella typhimurium LT2
gcacaucaugaugaucuucag

SEQ ID NO: 1866586 - RNA, 13 nt, Salmonella typhimurium LT2
gcacaauuccggc

SEQ ID NO: 1866587 - RNA, 17 nt, Salmonella typhimurium LT2
gcacaauaccaauaaga

SEQ ID NO: 1866588 - RNA, 21 nt, Salmonella typhimurium LT2
gcacaacgcauuggcaaugaa

SEQ ID NO: 1866589 - RNA, 13 nt, Salmonella typhimurium LT2
gcacagaagcgcc

SEQ ID NO: 1866590 - RNA, 15 nt, Salmonella typhimurium LT2
gcacagaaucaccuu

SEQ ID NO: 1866591 - RNA, 15 nt, Salmonella typhimurium LT2
gcacacuuucaucag

SEQ ID NO: 1866592 - RNA, 18 nt, Salmonella typhimurium LT2
gcacacgucuacccaggu

SEQ ID NO: 1866593 - RNA, 14 nt, Salmonella typhimurium LT2
gcacacgucugagc

SEQ ID NO: 1866594 - RNA, 13 nt, Salmonella typhimurium LT2
gcacaccauuuca

SEQ ID NO: 1866595 - RNA, 19 nt, Salmonella typhimurium LT2
gcacaccgccguaaaggga

SEQ ID NO: 1866596 - RNA, 20 nt, Salmonella typhimurium LT2
gcaccgccaaacgcggucag

SEQ ID NO: 1866597 - RNA, 15 nt, Salmonella typhimurium LT2
gcaccgccaaacgcg

SEQ ID NO: 1866598 - RNA, 16 nt, Salmonella typhimurium LT2
gcaccgccagcgccgc

SEQ ID NO: 1866599 - RNA, 13 nt, Salmonella typhimurium LT2
gcaccgccagcgc

SEQ ID NO: 1866600 - RNA, 20 nt, Salmonella typhimurium LT2
gcaccgcuucaauaagaaac

SEQ ID NO: 1866601 - RNA, 17 nt, Salmonella typhimurium LT2
gcacccugucaaagcau

SEQ ID NO: 1866602 - RNA, 16 nt, Salmonella typhimurium LT2
gcaccgaugacaauaa

SEQ ID NO: 1866603 - RNA, 17 nt, Salmonella typhimurium LT2
gcaccgaugacaauaau

SEQ ID NO: 1866604 - RNA, 18 nt, Salmonella typhimurium LT2
gcaccuggagcgccuccc

SEQ ID NO: 1866605 - RNA, 18 nt, Salmonella typhimurium LT2
gcaccucaauaugaaauu

SEQ ID NO: 1866606 - RNA, 23 nt, Salmonella typhimurium LT2
gcaccguuauucgaugcggccag

SEQ ID NO: 1866607 - RNA, 13 nt, Salmonella typhimurium LT2
gcaccacucccca

SEQ ID NO: 1866608 - RNA, 13 nt, Salmonella typhimurium LT2
gcaccagcaacac

SEQ ID NO: 1866609 - RNA, 15 nt, Salmonella typhimurium LT2
gcaccagcaaugaua

SEQ ID NO: 1866610 - RNA, 17 nt, Salmonella typhimurium LT2
gcaccagcaggugguac

SEQ ID NO: 1866611 - RNA, 14 nt, Salmonella typhimurium LT2
gcaccagccccagc

SEQ ID NO: 1866612 - RNA, 13 nt, Salmonella typhimurium LT2
gcaccagccagga

SEQ ID NO: 1866613 - RNA, 20 nt, Salmonella typhimurium LT2
gcaccaggaagacuauccag

SEQ ID NO: 1866614 - RNA, 23 nt, Salmonella typhimurium LT2
gcaccaggauacguucaucuucc

SEQ ID NO: 1866615 - RNA, 17 nt, Salmonella typhimurium LT2
gcaccacgcaaaccgcu

SEQ ID NO: 1866616 - RNA, 15 nt, Salmonella typhimurium LT2
gcaccaguuccccau

SEQ ID NO: 1866617 - RNA, 23 nt, Salmonella typhimurium LT2
gcaccaguucacuccuaagagaa

SEQ ID NO: 1866618 - RNA, 17 nt, Salmonella typhimurium LT2
gcaccauggcuauccac

SEQ ID NO: 1866619 - RNA, 22 nt, Salmonella typhimurium LT2
gcaccaucuuuuccggcagggu

SEQ ID NO: 1866620 - RNA, 17 nt, Salmonella typhimurium LT2
gcaccauucccacgcau

SEQ ID NO: 1866621 - RNA, 16 nt, Salmonella typhimurium LT2
gcacccggagagaaac

SEQ ID NO: 1866622 - RNA, 17 nt, Salmonella typhimurium LT2
gcacccaucuuuaccaa

SEQ ID NO: 1866623 - RNA, 18 nt, Salmonella typhimurium LT2
gcacgcccuucgucagga

SEQ ID NO: 1866624 - RNA, 14 nt, Salmonella typhimurium LT2
gcacgcccaucggc

SEQ ID NO: 1866625 - RNA, 12 nt, Salmonella typhimurium LT2
gcacgccagggu

SEQ ID NO: 1866626 - RNA, 14 nt, Salmonella typhimurium LT2
gcacgccaggguaa

SEQ ID NO: 1866627 - RNA, 15 nt, Salmonella typhimurium LT2
gcacgccaucgccug

SEQ ID NO: 1866628 - RNA, 16 nt, Salmonella typhimurium LT2
gcacgccacauugacc

SEQ ID NO: 1866629 - RNA, 20 nt, Salmonella typhimurium LT2
gcaccuguuucugcuggccu

SEQ ID NO: 1866630 - RNA, 17 nt, Salmonella typhimurium LT2
gcaccuggguauuccac

SEQ ID NO: 1866631 - RNA, 15 nt, Salmonella typhimurium LT2
gcaccuucaacagcu

SEQ ID NO: 1866632 - RNA, 20 nt, Salmonella typhimurium LT2
gcaccuucaacagcucgcca

SEQ ID NO: 1866633 - RNA, 15 nt, Salmonella typhimurium LT2
gcacgacacaaaagc

SEQ ID NO: 1866634 - RNA, 18 nt, Salmonella typhimurium LT2
gcacgaacauaccggagc

SEQ ID NO: 1866635 - RNA, 16 nt, Salmonella typhimurium LT2
gcacgacggugcuaua

SEQ ID NO: 1866636 - RNA, 14 nt, Salmonella typhimurium LT2
gcacgccuuccugg

SEQ ID NO: 1866637 - RNA, 16 nt, Salmonella typhimurium LT2
gcacgccugcauaaag

SEQ ID NO: 1866638 - RNA, 18 nt, Salmonella typhimurium LT2
gcacgcuuuggcaggccu

SEQ ID NO: 1866639 - RNA, 18 nt, Salmonella typhimurium LT2
gcacgcuggcaucaauau

SEQ ID NO: 1866640 - RNA, 16 nt, Salmonella typhimurium LT2
gcacggaugcaucaug

SEQ ID NO: 1866641 - RNA, 16 nt, Salmonella typhimurium LT2
gcacucgcgacauggc

SEQ ID NO: 1866642 - RNA, 15 nt, Salmonella typhimurium LT2
gcacucugcgccagg

SEQ ID NO: 1866643 - RNA, 22 nt, Salmonella typhimurium LT2
gcacuccccggcuugcggggag

SEQ ID NO: 1866644 - RNA, 18 nt, Salmonella typhimurium LT2
gcacucgaagauacggau

SEQ ID NO: 1866645 - RNA, 13 nt, Salmonella typhimurium LT2
gcacucgccgcca

SEQ ID NO: 1866646 - RNA, 15 nt, Salmonella typhimurium LT2
gcacucagaaaauua

SEQ ID NO: 1866647 - RNA, 14 nt, Salmonella typhimurium LT2
gcacucaccucuuc

SEQ ID NO: 1866648 - RNA, 16 nt, Salmonella typhimurium LT2
gcacucaaccugugua

SEQ ID NO: 1866649 - RNA, 20 nt, Salmonella typhimurium LT2
gcacgucauuacgguauuua

SEQ ID NO: 1866650 - RNA, 19 nt, Salmonella typhimurium LT2
gcacuacggauggcccugc

SEQ ID NO: 1866651 - RNA, 18 nt, Salmonella typhimurium LT2
gcacuacggcaaacacaa

SEQ ID NO: 1866652 - RNA, 24 nt, Salmonella typhimurium LT2
gcacuacgguccaguugcccucuu

SEQ ID NO: 1866653 - RNA, 15 nt, Salmonella typhimurium LT2
gcacguugucccagg

SEQ ID NO: 1866654 - RNA, 15 nt, Salmonella typhimurium LT2
gcacguuuuccaggu

SEQ ID NO: 1866655 - RNA, 16 nt, Salmonella typhimurium LT2
gcacuaacgauagagg

SEQ ID NO: 1866656 - RNA, 22 nt, Salmonella typhimurium LT2
gcacuaacgauagaggguugau

SEQ ID NO: 1866657 - RNA, 16 nt, Salmonella typhimurium LT2
gcacuuucauugccgu

SEQ ID NO: 1866658 - RNA, 18 nt, Salmonella typhimurium LT2
gcacuuuccagccccuuc

SEQ ID NO: 1866659 - RNA, 23 nt, Salmonella typhimurium LT2
gcacuuuccagccccuucgcugu

SEQ ID NO: 1866660 - RNA, 12 nt, Salmonella typhimurium LT2
gcacuuucauug

SEQ ID NO: 1866661 - RNA, 19 nt, Salmonella typhimurium LT2
gcacuuccugaaucaccag

SEQ ID NO: 1866662 - RNA, 22 nt, Salmonella typhimurium LT2
gcacuucgccgggauaaaacac

SEQ ID NO: 1866663 - RNA, 22 nt, Salmonella typhimurium LT2
gcacuugucggggaagggugag

SEQ ID NO: 1866664 - RNA, 15 nt, Salmonella typhimurium LT2
gcacugcgccuugcc

SEQ ID NO: 1866665 - RNA, 18 nt, Salmonella typhimurium LT2
gcacuguaacgcacuggu

SEQ ID NO: 1866666 - RNA, 16 nt, Salmonella typhimurium LT2
gcacugguagaaaaac

SEQ ID NO: 1866667 - RNA, 19 nt, Salmonella typhimurium LT2
gcacugggcgaagguggcg

SEQ ID NO: 1866668 - RNA, 21 nt, Salmonella typhimurium LT2
gcacuuacucuacauucuguu

SEQ ID NO: 1866669 - RNA, 13 nt, Salmonella typhimurium LT2
gcagauaccagcc

SEQ ID NO: 1866670 - RNA, 14 nt, Salmonella typhimurium LT2
gcagauagagcaua

SEQ ID NO: 1866671 - RNA, 23 nt, Salmonella typhimurium LT2
gcagauaguucguuugcgcgagg

SEQ ID NO: 1866672 - RNA, 21 nt, Salmonella typhimurium LT2
gcagauagccugccagcacca

SEQ ID NO: 1866673 - RNA, 14 nt, Salmonella typhimurium LT2
gcagauaucuucca

SEQ ID NO: 1866674 - RNA, 19 nt, Salmonella typhimurium LT2
gcagagucgcagcggcggu

SEQ ID NO: 1866675 - RNA, 16 nt, Salmonella typhimurium LT2
gcagagucgcagcggc

SEQ ID NO: 1866676 - RNA, 14 nt, Salmonella typhimurium LT2
gcagaguuuaucuc

SEQ ID NO: 1866677 - RNA, 13 nt, Salmonella typhimurium LT2
gcagagcccagcg

SEQ ID NO: 1866678 - RNA, 20 nt, Salmonella typhimurium LT2
gcagagcgcgcucugccuuu

SEQ ID NO: 1866679 - RNA, 15 nt, Salmonella typhimurium LT2
gcagaggucgccgcu

SEQ ID NO: 1866680 - RNA, 15 nt, Salmonella typhimurium LT2
gcagaguccagcggc

SEQ ID NO: 1866681 - RNA, 14 nt, Salmonella typhimurium LT2
gcagagcugacggg

SEQ ID NO: 1866682 - RNA, 20 nt, Salmonella typhimurium LT2
gcagaugcugcugcgcggcc

SEQ ID NO: 1866683 - RNA, 18 nt, Salmonella typhimurium LT2
gcagaucugucgccauga

SEQ ID NO: 1866684 - RNA, 21 nt, Salmonella typhimurium LT2
gcagaugguauaaaucacgcu

SEQ ID NO: 1866685 - RNA, 23 nt, Salmonella typhimurium LT2
gcagauccuuaacgucaaagcua

SEQ ID NO: 1866686 - RNA, 20 nt, Salmonella typhimurium LT2
gcagauccgcgauaucaauc

SEQ ID NO: 1866687 - RNA, 16 nt, Salmonella typhimurium LT2
gcagauccaucgccug

SEQ ID NO: 1866688 - RNA, 22 nt, Salmonella typhimurium LT2
gcagaucgucggcguucaacac

SEQ ID NO: 1866689 - RNA, 17 nt, Salmonella typhimurium LT2
gcagaucugucgccaug

SEQ ID NO: 1866690 - RNA, 17 nt, Salmonella typhimurium LT2
gcagacauauuuucucu

SEQ ID NO: 1866691 - RNA, 20 nt, Salmonella typhimurium LT2
gcagacagacaaccagcagg

SEQ ID NO: 1866692 - RNA, 14 nt, Salmonella typhimurium LT2
gcagacgccugccg

SEQ ID NO: 1866693 - RNA, 16 nt, Salmonella typhimurium LT2
gcagacggagaugauc

SEQ ID NO: 1866694 - RNA, 18 nt, Salmonella typhimurium LT2
gcagacugacgaaacacu

SEQ ID NO: 1866695 - RNA, 20 nt, Salmonella typhimurium LT2
gcagacguuuaucggccagc

SEQ ID NO: 1866696 - RNA, 22 nt, Salmonella typhimurium LT2
gcagacucaacugcgggaagua

SEQ ID NO: 1866697 - RNA, 11 nt, Salmonella typhimurium LT2
gcagacucagu

SEQ ID NO: 1866698 - RNA, 18 nt, Salmonella typhimurium LT2
gcagacucaguucgcgac

SEQ ID NO: 1866699 - RNA, 14 nt, Salmonella typhimurium LT2
gcagacgucaacac

SEQ ID NO: 1866700 - RNA, 14 nt, Salmonella typhimurium LT2
gcagacuguaaauc

SEQ ID NO: 1866701 - RNA, 15 nt, Salmonella typhimurium LT2
gcagacuguaaaucu

SEQ ID NO: 1866702 - RNA, 15 nt, Salmonella typhimurium LT2
gcagacuuucugaca

SEQ ID NO: 1866703 - RNA, 19 nt, Salmonella typhimurium LT2
gcagaaucaggcacaaccc

SEQ ID NO: 1866704 - RNA, 14 nt, Salmonella typhimurium LT2
gcagacacugccac

SEQ ID NO: 1866705 - RNA, 15 nt, Salmonella typhimurium LT2
gcagaaccgccgcga

SEQ ID NO: 1866706 - RNA, 21 nt, Salmonella typhimurium LT2
gcagaaggccagugguaaaaa

SEQ ID NO: 1866707 - RNA, 18 nt, Salmonella typhimurium LT2
gcagaacaaacagaccgc

SEQ ID NO: 1866708 - RNA, 14 nt, Salmonella typhimurium LT2
gcagaacagcgacg

SEQ ID NO: 1866709 - RNA, 20 nt, Salmonella typhimurium LT2
gcagaaauaaaauacuucca

SEQ ID NO: 1866710 - RNA, 17 nt, Salmonella typhimurium LT2
gcagaaacuggcggcgc

SEQ ID NO: 1866711 - RNA, 13 nt, Salmonella typhimurium LT2
gcagcaucgccau

SEQ ID NO: 1866712 - RNA, 18 nt, Salmonella typhimurium LT2
gcagcauaucgccguuca

SEQ ID NO: 1866713 - RNA, 21 nt, Salmonella typhimurium LT2
gcagcagggauauacaaauau

SEQ ID NO: 1866714 - RNA, 14 nt, Salmonella typhimurium LT2
gcagcaggcgggcu

SEQ ID NO: 1866715 - RNA, 17 nt, Salmonella typhimurium LT2
gcagcagcuucgccaga

SEQ ID NO: 1866716 - RNA, 12 nt, Salmonella typhimurium LT2
gcagcagcuuca

SEQ ID NO: 1866717 - RNA, 19 nt, Salmonella typhimurium LT2
gcagcaggacguugccgcc

SEQ ID NO: 1866718 - RNA, 22 nt, Salmonella typhimurium LT2
gcagcagcgcuuucuucuucac

SEQ ID NO: 1866719 - RNA, 22 nt, Salmonella typhimurium LT2
gcagccagggaacuccagcagg

SEQ ID NO: 1866720 - RNA, 13 nt, Salmonella typhimurium LT2
gcagccaggccau

SEQ ID NO: 1866721 - RNA, 19 nt, Salmonella typhimurium LT2
gcagccaggccauuuuuuc

SEQ ID NO: 1866722 - RNA, 23 nt, Salmonella typhimurium LT2
gcagccagaaaaagggaaaagcc

SEQ ID NO: 1866723 - RNA, 19 nt, Salmonella typhimurium LT2
gcagccacagccuguguca

SEQ ID NO: 1866724 - RNA, 12 nt, Salmonella typhimurium LT2
gcagccacagaa

SEQ ID NO: 1866725 - RNA, 22 nt, Salmonella typhimurium LT2
gcagcauugggucaugcggaug

SEQ ID NO: 1866726 - RNA, 18 nt, Salmonella typhimurium LT2
gcagcagaaucaggcaca

SEQ ID NO: 1866727 - RNA, 15 nt, Salmonella typhimurium LT2
gcagcacuuucgcuu

SEQ ID NO: 1866728 - RNA, 17 nt, Salmonella typhimurium LT2
gcagcagauuaacagcu

SEQ ID NO: 1866729 - RNA, 20 nt, Salmonella typhimurium LT2
gcagcaccucaauaugaaau

SEQ ID NO: 1866730 - RNA, 17 nt, Salmonella typhimurium LT2
gcagcaccgguuuuucc

SEQ ID NO: 1866731 - RNA, 17 nt, Salmonella typhimurium LT2
gcagcacgagcauccag

SEQ ID NO: 1866732 - RNA, 17 nt, Salmonella typhimurium LT2
gcagcacaugcaauuug

SEQ ID NO: 1866733 - RNA, 23 nt, Salmonella typhimurium LT2
gcagcaauaauuacagccgcguu

SEQ ID NO: 1866734 - RNA, 20 nt, Salmonella typhimurium LT2
gcagcaaugugcgccaggau

SEQ ID NO: 1866735 - RNA, 19 nt, Salmonella typhimurium LT2
gcagcacacgcuucugguu

SEQ ID NO: 1866736 - RNA, 16 nt, Salmonella typhimurium LT2
gcagcaagcggcuguc

SEQ ID NO: 1866737 - RNA, 14 nt, Salmonella typhimurium LT2
gcagcaagaacaga

SEQ ID NO: 1866738 - RNA, 20 nt, Salmonella typhimurium LT2
gcagcaacugauucaaaagg

SEQ ID NO: 1866739 - RNA, 16 nt, Salmonella typhimurium LT2
gcagcaaauacagaug

SEQ ID NO: 1866740 - RNA, 16 nt, Salmonella typhimurium LT2
gcagcgagcaccgauc

SEQ ID NO: 1866741 - RNA, 15 nt, Salmonella typhimurium LT2
gcagcgaagaucagg

SEQ ID NO: 1866742 - RNA, 17 nt, Salmonella typhimurium LT2
gcagcgaagaucaggag

SEQ ID NO: 1866743 - RNA, 16 nt, Salmonella typhimurium LT2
gcagccguuucuucug

SEQ ID NO: 1866744 - RNA, 23 nt, Salmonella typhimurium LT2
gcagccuaguucugcgccaguga

SEQ ID NO: 1866745 - RNA, 16 nt, Salmonella typhimurium LT2
gcagccgguauccagc

SEQ ID NO: 1866746 - RNA, 13 nt, Salmonella typhimurium LT2
gcagccugccgca

SEQ ID NO: 1866747 - RNA, 15 nt, Salmonella typhimurium LT2
gcagcgaaacgcgcu

SEQ ID NO: 1866748 - RNA, 16 nt, Salmonella typhimurium LT2
gcagcgaaacgcgcua

SEQ ID NO: 1866749 - RNA, 15 nt, Salmonella typhimurium LT2
gcagccgggccagac

SEQ ID NO: 1866750 - RNA, 12 nt, Salmonella typhimurium LT2
gcagccgccacc

SEQ ID NO: 1866751 - RNA, 18 nt, Salmonella typhimurium LT2
gcagcccgcccacaggcu

SEQ ID NO: 1866752 - RNA, 21 nt, Salmonella typhimurium LT2
gcagccccggcauccaguucc

SEQ ID NO: 1866753 - RNA, 14 nt, Salmonella typhimurium LT2
gcagccccagcgcc

SEQ ID NO: 1866754 - RNA, 16 nt, Salmonella typhimurium LT2
gcagcgcccgcugucc

SEQ ID NO: 1866755 - RNA, 13 nt, Salmonella typhimurium LT2
gcagcgccgccug

SEQ ID NO: 1866756 - RNA, 21 nt, Salmonella typhimurium LT2
gcagcgccauugagcauucua

SEQ ID NO: 1866757 - RNA, 13 nt, Salmonella typhimurium LT2
gcagcgccaucca

SEQ ID NO: 1866758 - RNA, 20 nt, Salmonella typhimurium LT2
gcagcgcgcgacccagcgca

SEQ ID NO: 1866759 - RNA, 18 nt, Salmonella typhimurium LT2
gcagcgcgcgacccagcg

SEQ ID NO: 1866760 - RNA, 11 nt, Salmonella typhimurium LT2
gcagcggcggu

SEQ ID NO: 1866761 - RNA, 14 nt, Salmonella typhimurium LT2
gcagcggcucgcgu

SEQ ID NO: 1866762 - RNA, 21 nt, Salmonella typhimurium LT2
gcagcgggaccauacuggcga

SEQ ID NO: 1866763 - RNA, 15 nt, Salmonella typhimurium LT2
gcagcgucggcuuca

SEQ ID NO: 1866764 - RNA, 18 nt, Salmonella typhimurium LT2
gcagcgucugcccuccug

SEQ ID NO: 1866765 - RNA, 15 nt, Salmonella typhimurium LT2
gcaggcaacaugacc

SEQ ID NO: 1866766 - RNA, 19 nt, Salmonella typhimurium LT2
gcaggauucgaaccugcga

SEQ ID NO: 1866767 - RNA, 18 nt, Salmonella typhimurium LT2
gcaggcauaaaaaagagg

SEQ ID NO: 1866768 - RNA, 19 nt, Salmonella typhimurium LT2
gcaggcgucauagccgcgc

SEQ ID NO: 1866769 - RNA, 20 nt, Salmonella typhimurium LT2
gcaggcgucauagccgcgcg

SEQ ID NO: 1866770 - RNA, 16 nt, Salmonella typhimurium LT2
gcaggcggugcgcagc

SEQ ID NO: 1866771 - RNA, 19 nt, Salmonella typhimurium LT2
gcaggcgggugcgcagccc

SEQ ID NO: 1866772 - RNA, 17 nt, Salmonella typhimurium LT2
gcaggccaaacagcggc

SEQ ID NO: 1866773 - RNA, 18 nt, Salmonella typhimurium LT2
gcaggccaaauagggcgc

SEQ ID NO: 1866774 - RNA, 13 nt, Salmonella typhimurium LT2
gcaggcauggcca

SEQ ID NO: 1866775 - RNA, 17 nt, Salmonella typhimurium LT2
gcaggcauuaaaaaaac

SEQ ID NO: 1866776 - RNA, 20 nt, Salmonella typhimurium LT2
gcagggacuccugcgccgga

SEQ ID NO: 1866777 - RNA, 22 nt, Salmonella typhimurium LT2
gcaggcuuccacgcacgccggc

SEQ ID NO: 1866778 - RNA, 18 nt, Salmonella typhimurium LT2
gcagguagucauauucac

SEQ ID NO: 1866779 - RNA, 19 nt, Salmonella typhimurium LT2
gcaggugauggcggcuugg

SEQ ID NO: 1866780 - RNA, 16 nt, Salmonella typhimurium LT2
gcaggugguacaucaa

SEQ ID NO: 1866781 - RNA, 13 nt, Salmonella typhimurium LT2
gcaugagccagcc

SEQ ID NO: 1866782 - RNA, 16 nt, Salmonella typhimurium LT2
gcaugagccagcccuc

SEQ ID NO: 1866783 - RNA, 14 nt, Salmonella typhimurium LT2
gcaugagccagccc

SEQ ID NO: 1866784 - RNA, 19 nt, Salmonella typhimurium LT2
gcaugaggguuguuuucug

SEQ ID NO: 1866785 - RNA, 21 nt, Salmonella typhimurium LT2
gcaugaucauacugccgccgu

SEQ ID NO: 1866786 - RNA, 20 nt, Salmonella typhimurium LT2
gcaugcccgccagcgggccg

SEQ ID NO: 1866787 - RNA, 13 nt, Salmonella typhimurium LT2
gcaugccgcaggc

SEQ ID NO: 1866788 - RNA, 15 nt, Salmonella typhimurium LT2
gcaugcguaaauuga

SEQ ID NO: 1866789 - RNA, 22 nt, Salmonella typhimurium LT2
gcauggggagaccccacacuac

SEQ ID NO: 1866790 - RNA, 17 nt, Salmonella typhimurium LT2
gcauggguaaagcccau

SEQ ID NO: 1866791 - RNA, 18 nt, Salmonella typhimurium LT2
gcaugaauaaccucccgc

SEQ ID NO: 1866792 - RNA, 20 nt, Salmonella typhimurium LT2
gcaugaauaaccucccgccg

SEQ ID NO: 1866793 - RNA, 23 nt, Salmonella typhimurium LT2
gcaugacgggggcgaucagcagg

SEQ ID NO: 1866794 - RNA, 16 nt, Salmonella typhimurium LT2
gcaugagcaaaaugcu

SEQ ID NO: 1866795 - RNA, 17 nt, Salmonella typhimurium LT2
gcauucucgccgugacu

SEQ ID NO: 1866796 - RNA, 21 nt, Salmonella typhimurium LT2
gcauucucuguugccgcccgu

SEQ ID NO: 1866797 - RNA, 15 nt, Salmonella typhimurium LT2
gcauucugcaacugu

SEQ ID NO: 1866798 - RNA, 23 nt, Salmonella typhimurium LT2
gcauucagacauuuauuuggcaa

SEQ ID NO: 1866799 - RNA, 20 nt, Salmonella typhimurium LT2
gcauuauauuggcuggccug

SEQ ID NO: 1866800 - RNA, 22 nt, Salmonella typhimurium LT2
gcauuauguaauaacugacgau

SEQ ID NO: 1866801 - RNA, 15 nt, Salmonella typhimurium LT2
gcauuauucggcuuu

SEQ ID NO: 1866802 - RNA, 19 nt, Salmonella typhimurium LT2
gcauuagcaugggcuaaag

SEQ ID NO: 1866803 - RNA, 19 nt, Salmonella typhimurium LT2
gcauuaaccugauccagga

SEQ ID NO: 1866804 - RNA, 14 nt, Salmonella typhimurium LT2
gcauuaaaaugaug

SEQ ID NO: 1866805 - RNA, 15 nt, Salmonella typhimurium LT2
gcauuaaaaaaaaga

SEQ ID NO: 1866806 - RNA, 19 nt, Salmonella typhimurium LT2
gcauuguuaauccagagcg

SEQ ID NO: 1866807 - RNA, 19 nt, Salmonella typhimurium LT2
gccaaaacccaccagcagg

SEQ ID NO: 1866808 - RNA, 11 nt, Salmonella typhimurium LT2
gccaaaaaugg

SEQ ID NO: 1866809 - RNA, 14 nt, Salmonella typhimurium LT2
gcauuuuuucuuca

SEQ ID NO: 1866810 - RNA, 18 nt, Salmonella typhimurium LT2
gccaaaaaaucagcaauc

SEQ ID NO: 1866811 - RNA, 17 nt, Salmonella typhimurium LT2
gcauugggauggauaaa

SEQ ID NO: 1866812 - RNA, 22 nt, Salmonella typhimurium LT2
gcauugguggggcuaagugagc

SEQ ID NO: 1866813 - RNA, 18 nt, Salmonella typhimurium LT2
gcauugugaggaaccucu

SEQ ID NO: 1866814 - RNA, 19 nt, Salmonella typhimurium LT2
gcauuggcguuaccggcag

SEQ ID NO: 1866815 - RNA, 13 nt, Salmonella typhimurium LT2
gcauugacgugcu

SEQ ID NO: 1866816 - RNA, 13 nt, Salmonella typhimurium LT2
gcaucggcaucaa

SEQ ID NO: 1866817 - RNA, 15 nt, Salmonella typhimurium LT2
gcaucgcuccccaac

SEQ ID NO: 1866818 - RNA, 23 nt, Salmonella typhimurium LT2
gcaucgcguuauugaccaucgcc

SEQ ID NO: 1866819 - RNA, 13 nt, Salmonella typhimurium LT2
gcaucgcggucag

SEQ ID NO: 1866820 - RNA, 20 nt, Salmonella typhimurium LT2
gcaucggguugacuacuccc

SEQ ID NO: 1866821 - RNA, 17 nt, Salmonella typhimurium LT2
gcauccggcuucuggcu

SEQ ID NO: 1866822 - RNA, 13 nt, Salmonella typhimurium LT2
gcauccggcgguc

SEQ ID NO: 1866823 - RNA, 22 nt, Salmonella typhimurium LT2
gcaucaggaaauccuggauacg

SEQ ID NO: 1866824 - RNA, 17 nt, Salmonella typhimurium LT2
gcauccggccagcgaca

SEQ ID NO: 1866825 - RNA, 14 nt, Salmonella typhimurium LT2
gcauccggcaucaa

SEQ ID NO: 1866826 - RNA, 20 nt, Salmonella typhimurium LT2
gcauccgcuuucucggcgag

SEQ ID NO: 1866827 - RNA, 22 nt, Salmonella typhimurium LT2
gcaucccgcuccguaggccgga

SEQ ID NO: 1866828 - RNA, 20 nt, Salmonella typhimurium LT2
gcauaccgugugcagugaca

SEQ ID NO: 1866829 - RNA, 16 nt, Salmonella typhimurium LT2
gcauaccuccucucuu

SEQ ID NO: 1866830 - RNA, 18 nt, Salmonella typhimurium LT2
gcauaccaaguuuggcaa

SEQ ID NO: 1866831 - RNA, 12 nt, Salmonella typhimurium LT2
gcauaccgagcc

SEQ ID NO: 1866832 - RNA, 19 nt, Salmonella typhimurium LT2
gcauaccgagcccuaucac

SEQ ID NO: 1866833 - RNA, 21 nt, Salmonella typhimurium LT2
gcauacucauuaccggcugcc

SEQ ID NO: 1866834 - RNA, 22 nt, Salmonella typhimurium LT2
gcauacacgccgggcacgcuga

SEQ ID NO: 1866835 - RNA, 17 nt, Salmonella typhimurium LT2
gcauacaccgccagcgu

SEQ ID NO: 1866836 - RNA, 23 nt, Salmonella typhimurium LT2
gcauacauucuguuuucgagccu

SEQ ID NO: 1866837 - RNA, 23 nt, Salmonella typhimurium LT2
gcauacagcgauaaccgccgccg

SEQ ID NO: 1866838 - RNA, 21 nt, Salmonella typhimurium LT2
gcaguagccacgguaacagcu

SEQ ID NO: 1866839 - RNA, 16 nt, Salmonella typhimurium LT2
gcaguacgccaaaaaa

SEQ ID NO: 1866840 - RNA, 21 nt, Salmonella typhimurium LT2
gcaguacgcgcaaccgcauca

SEQ ID NO: 1866841 - RNA, 12 nt, Salmonella typhimurium LT2
gcaguagccaug

SEQ ID NO: 1866842 - RNA, 22 nt, Salmonella typhimurium LT2
gcaguagugugguauucagccc

SEQ ID NO: 1866843 - RNA, 14 nt, Salmonella typhimurium LT2
gcauauccagcgcc

SEQ ID NO: 1866844 - RNA, 19 nt, Salmonella typhimurium LT2
gcauauccagcgccugcgc

SEQ ID NO: 1866845 - RNA, 18 nt, Salmonella typhimurium LT2
gcauauaagagacgccaa

SEQ ID NO: 1866846 - RNA, 14 nt, Salmonella typhimurium LT2
gcauacuuccucac

SEQ ID NO: 1866847 - RNA, 15 nt, Salmonella typhimurium LT2
gcaucacggcagcac

SEQ ID NO: 1866848 - RNA, 19 nt, Salmonella typhimurium LT2
gcaucacgcgcuggcgcgc

SEQ ID NO: 1866849 - RNA, 18 nt, Salmonella typhimurium LT2
gcaucacaucaaagcccc

SEQ ID NO: 1866850 - RNA, 18 nt, Salmonella typhimurium LT2
gcaucaaugcccagcgca

SEQ ID NO: 1866851 - RNA, 19 nt, Salmonella typhimurium LT2
gcaucaauggcgucaaaca

SEQ ID NO: 1866852 - RNA, 17 nt, Salmonella typhimurium LT2
gcaucaauaaaaucacc

SEQ ID NO: 1866853 - RNA, 16 nt, Salmonella typhimurium LT2
gccaaaagaggcagca

SEQ ID NO: 1866854 - RNA, 22 nt, Salmonella typhimurium LT2
gccaaaacccaccagcagggca

SEQ ID NO: 1866855 - RNA, 22 nt, Salmonella typhimurium LT2
gccaaaacccuucgcaacaggu

SEQ ID NO: 1866856 - RNA, 17 nt, Salmonella typhimurium LT2
gccaaaagaggcagcaa

SEQ ID NO: 1866857 - RNA, 19 nt, Salmonella typhimurium LT2
gccaaaauggacagggucg

SEQ ID NO: 1866858 - RNA, 21 nt, Salmonella typhimurium LT2
gccaaacacccagccccccua

SEQ ID NO: 1866859 - RNA, 21 nt, Salmonella typhimurium LT2
gccaaauuuucaaccacggau

SEQ ID NO: 1866860 - RNA, 19 nt, Salmonella typhimurium LT2
gccaacauagccacaggcu

SEQ ID NO: 1866861 - RNA, 21 nt, Salmonella typhimurium LT2
gccaacaggucgaugauuuuc

SEQ ID NO: 1866862 - RNA, 21 nt, Salmonella typhimurium LT2
gccaacagccgcccacaaccg

SEQ ID NO: 1866863 - RNA, 16 nt, Salmonella typhimurium LT2
gccaacagaagauccu

SEQ ID NO: 1866864 - RNA, 18 nt, Salmonella typhimurium LT2
gccaaccagauuuuucac

SEQ ID NO: 1866865 - RNA, 20 nt, Salmonella typhimurium LT2
gccaaccaccgcggagaucg

SEQ ID NO: 1866866 - RNA, 21 nt, Salmonella typhimurium LT2
gccaacgauacagcacggcag

SEQ ID NO: 1866867 - RNA, 16 nt, Salmonella typhimurium LT2
gccaacgauacagcac

SEQ ID NO: 1866868 - RNA, 13 nt, Salmonella typhimurium LT2
gccaacgccgccc

SEQ ID NO: 1866869 - RNA, 18 nt, Salmonella typhimurium LT2
gccaagcagcgccacgcc

SEQ ID NO: 1866870 - RNA, 23 nt, Salmonella typhimurium LT2
gccaagaucgccaagcugugauu

SEQ ID NO: 1866871 - RNA, 19 nt, Salmonella typhimurium LT2
gccaagaccgccuaacagc

SEQ ID NO: 1866872 - RNA, 18 nt, Salmonella typhimurium LT2
gccaaugcguuguuccug

SEQ ID NO: 1866873 - RNA, 13 nt, Salmonella typhimurium LT2
gccaauuccugcc

SEQ ID NO: 1866874 - RNA, 21 nt, Salmonella typhimurium LT2
gccaauguacguaaaaccagc

SEQ ID NO: 1866875 - RNA, 19 nt, Salmonella typhimurium LT2
gccaauguacguaaaacca

SEQ ID NO: 1866876 - RNA, 12 nt, Salmonella typhimurium LT2
gccaauguugcg

SEQ ID NO: 1866877 - RNA, 21 nt, Salmonella typhimurium LT2
gccacaaccgcccccaacuga

SEQ ID NO: 1866878 - RNA, 18 nt, Salmonella typhimurium LT2
gccaauaaccaccuguuc

SEQ ID NO: 1866879 - RNA, 21 nt, Salmonella typhimurium LT2
gccaaguaauaaagagaacga

SEQ ID NO: 1866880 - RNA, 17 nt, Salmonella typhimurium LT2
gccaaguaauaaagaga

SEQ ID NO: 1866881 - RNA, 24 nt, Salmonella typhimurium LT2
gccaauacgggagagcguauccag

SEQ ID NO: 1866882 - RNA, 14 nt, Salmonella typhimurium LT2
gccaauaugcgcaa

SEQ ID NO: 1866883 - RNA, 16 nt, Salmonella typhimurium LT2
gccaagcugcagaauc

SEQ ID NO: 1866884 - RNA, 19 nt, Salmonella typhimurium LT2
gccaagcgcggcagcagcu

SEQ ID NO: 1866885 - RNA, 15 nt, Salmonella typhimurium LT2
gccaaguaacacggc

SEQ ID NO: 1866886 - RNA, 24 nt, Salmonella typhimurium LT2
gccacggcuuuuacgccauuggca

SEQ ID NO: 1866887 - RNA, 16 nt, Salmonella typhimurium LT2
gccacgguacggcuuu

SEQ ID NO: 1866888 - RNA, 21 nt, Salmonella typhimurium LT2
gccacggcguguugaaguccu

SEQ ID NO: 1866889 - RNA, 17 nt, Salmonella typhimurium LT2
gccacgguuggcccagc

SEQ ID NO: 1866890 - RNA, 20 nt, Salmonella typhimurium LT2
gccacgucacgcaacaggcc

SEQ ID NO: 1866891 - RNA, 15 nt, Salmonella typhimurium LT2
gccacgguuggccca

SEQ ID NO: 1866892 - RNA, 19 nt, Salmonella typhimurium LT2
gccacgguguggcccagcg

SEQ ID NO: 1866893 - RNA, 15 nt, Salmonella typhimurium LT2
gccaccuuucugcuc

SEQ ID NO: 1866894 - RNA, 20 nt, Salmonella typhimurium LT2
gccacgagaaauccacauua

SEQ ID NO: 1866895 - RNA, 15 nt, Salmonella typhimurium LT2
gccacugcuggccca

SEQ ID NO: 1866896 - RNA, 11 nt, Salmonella typhimurium LT2
gccacuggccu

SEQ ID NO: 1866897 - RNA, 12 nt, Salmonella typhimurium LT2
gccacucuccag

SEQ ID NO: 1866898 - RNA, 15 nt, Salmonella typhimurium LT2
gccacugcccagaga

SEQ ID NO: 1866899 - RNA, 13 nt, Salmonella typhimurium LT2
gccacuccgccag

SEQ ID NO: 1866900 - RNA, 14 nt, Salmonella typhimurium LT2
gccacuccgccagu

SEQ ID NO: 1866901 - RNA, 13 nt, Salmonella typhimurium LT2
gccacuagcucag

SEQ ID NO: 1866902 - RNA, 21 nt, Salmonella typhimurium LT2
gccacuaccagcguaccgaua

SEQ ID NO: 1866903 - RNA, 13 nt, Salmonella typhimurium LT2
gccacagaaugcc

SEQ ID NO: 1866904 - RNA, 12 nt, Salmonella typhimurium LT2
gccacagcaaau

SEQ ID NO: 1866905 - RNA, 21 nt, Salmonella typhimurium LT2
gccacagauuaugcagcucuu

SEQ ID NO: 1866906 - RNA, 13 nt, Salmonella typhimurium LT2
gccacagccaggc

SEQ ID NO: 1866907 - RNA, 17 nt, Salmonella typhimurium LT2
gccaccaugcugguugg

SEQ ID NO: 1866908 - RNA, 17 nt, Salmonella typhimurium LT2
gccacccacuucgccgg

SEQ ID NO: 1866909 - RNA, 13 nt, Salmonella typhimurium LT2
gccacccggcuuu

SEQ ID NO: 1866910 - RNA, 15 nt, Salmonella typhimurium LT2
gccacccgccugcgc

SEQ ID NO: 1866911 - RNA, 20 nt, Salmonella typhimurium LT2
gccaccuguuucgccaggcc

SEQ ID NO: 1866912 - RNA, 22 nt, Salmonella typhimurium LT2
gccaccgguuuuuuccugcaca

SEQ ID NO: 1866913 - RNA, 17 nt, Salmonella typhimurium LT2
gccaccgggcaacccgg

SEQ ID NO: 1866914 - RNA, 20 nt, Salmonella typhimurium LT2
gccaccgggcaacacacgcu

SEQ ID NO: 1866915 - RNA, 16 nt, Salmonella typhimurium LT2
gccaccgccagccaug

SEQ ID NO: 1866916 - RNA, 15 nt, Salmonella typhimurium LT2
gccacccuccgggcc

SEQ ID NO: 1866917 - RNA, 23 nt, Salmonella typhimurium LT2
gcccgacaggguuugccagcacc

SEQ ID NO: 1866918 - RNA, 15 nt, Salmonella typhimurium LT2
gccccugggcgaaaa

SEQ ID NO: 1866919 - RNA, 17 nt, Salmonella typhimurium LT2
gccccuggcgcgccagc

SEQ ID NO: 1866920 - RNA, 18 nt, Salmonella typhimurium LT2
gccccuggcgcgccagcu

SEQ ID NO: 1866921 - RNA, 18 nt, Salmonella typhimurium LT2
gccccugagcaaucaguu

SEQ ID NO: 1866922 - RNA, 21 nt, Salmonella typhimurium LT2
gcccgcaaacagagcgccggc

SEQ ID NO: 1866923 - RNA, 14 nt, Salmonella typhimurium LT2
gcccgcacucgcgc

SEQ ID NO: 1866924 - RNA, 17 nt, Salmonella typhimurium LT2
gcccgcacucgcgcuuc

SEQ ID NO: 1866925 - RNA, 17 nt, Salmonella typhimurium LT2
gccccgacaaaacgggc

SEQ ID NO: 1866926 - RNA, 19 nt, Salmonella typhimurium LT2
gcccccgauucaaucuggu

SEQ ID NO: 1866927 - RNA, 22 nt, Salmonella typhimurium LT2
gccccgacuuaccaccgugccc

SEQ ID NO: 1866928 - RNA, 17 nt, Salmonella typhimurium LT2
gcccccaugccgccugc

SEQ ID NO: 1866929 - RNA, 14 nt, Salmonella typhimurium LT2
gccccgcgcgccug

SEQ ID NO: 1866930 - RNA, 16 nt, Salmonella typhimurium LT2
gccccgcgcgccugca

SEQ ID NO: 1866931 - RNA, 16 nt, Salmonella typhimurium LT2
gccccgcaccuguugc

SEQ ID NO: 1866932 - RNA, 14 nt, Salmonella typhimurium LT2
gccccagcgccagc

SEQ ID NO: 1866933 - RNA, 20 nt, Salmonella typhimurium LT2
gccccagcgguaccaccagc

SEQ ID NO: 1866934 - RNA, 17 nt, Salmonella typhimurium LT2
gccccagcgccagccgc

SEQ ID NO: 1866935 - RNA, 17 nt, Salmonella typhimurium LT2
gccccagcgccagcugc

SEQ ID NO: 1866936 - RNA, 17 nt, Salmonella typhimurium LT2
gccccagcccugugccg

SEQ ID NO: 1866937 - RNA, 19 nt, Salmonella typhimurium LT2
gccccagcaccaacgccgc

SEQ ID NO: 1866938 - RNA, 13 nt, Salmonella typhimurium LT2
gccccagcaccag

SEQ ID NO: 1866939 - RNA, 16 nt, Salmonella typhimurium LT2
gccccagcaccagagc

SEQ ID NO: 1866940 - RNA, 20 nt, Salmonella typhimurium LT2
gccccagcaugagccagccc

SEQ ID NO: 1866941 - RNA, 22 nt, Salmonella typhimurium LT2
gcccagauagcgcaucagacug

SEQ ID NO: 1866942 - RNA, 10 nt, Salmonella typhimurium LT2
gcccagcagc

SEQ ID NO: 1866943 - RNA, 14 nt, Salmonella typhimurium LT2
gcccagcagcagaa

SEQ ID NO: 1866944 - RNA, 13 nt, Salmonella typhimurium LT2
gcccagccugccc

SEQ ID NO: 1866945 - RNA, 23 nt, Salmonella typhimurium LT2
gcccagcgcgauacgcagaaccg

SEQ ID NO: 1866946 - RNA, 21 nt, Salmonella typhimurium LT2
gcccaugauggugaacagaau

SEQ ID NO: 1866947 - RNA, 17 nt, Salmonella typhimurium LT2
gcccauggcaggcagca

SEQ ID NO: 1866948 - RNA, 20 nt, Salmonella typhimurium LT2
gcccauggcaggcagcacaa

SEQ ID NO: 1866949 - RNA, 15 nt, Salmonella typhimurium LT2
gcccaugccgcccag

SEQ ID NO: 1866950 - RNA, 13 nt, Salmonella typhimurium LT2
gccccaauaccac

SEQ ID NO: 1866951 - RNA, 14 nt, Salmonella typhimurium LT2
gccccaccgccaga

SEQ ID NO: 1866952 - RNA, 12 nt, Salmonella typhimurium LT2
gccccaccgcca

SEQ ID NO: 1866953 - RNA, 19 nt, Salmonella typhimurium LT2
gccccagaaaaugcucagu

SEQ ID NO: 1866954 - RNA, 18 nt, Salmonella typhimurium LT2
gccccagauacgcacggu

SEQ ID NO: 1866955 - RNA, 22 nt, Salmonella typhimurium LT2
gccaguccuccggcugaagccc

SEQ ID NO: 1866956 - RNA, 16 nt, Salmonella typhimurium LT2
gccagucgccaggcaa

SEQ ID NO: 1866957 - RNA, 17 nt, Salmonella typhimurium LT2
gccagucgccaggcaag

SEQ ID NO: 1866958 - RNA, 15 nt, Salmonella typhimurium LT2
gccagucaccagcag

SEQ ID NO: 1866959 - RNA, 20 nt, Salmonella typhimurium LT2
gccaguauuggccucggggc

SEQ ID NO: 1866960 - RNA, 18 nt, Salmonella typhimurium LT2
gccaguacagcacgccgg

SEQ ID NO: 1866961 - RNA, 17 nt, Salmonella typhimurium LT2
gccaguaccgccgccgg

SEQ ID NO: 1866962 - RNA, 15 nt, Salmonella typhimurium LT2
gccaguaccgccgcc

SEQ ID NO: 1866963 - RNA, 14 nt, Salmonella typhimurium LT2
gccaguagcugcuc

SEQ ID NO: 1866964 - RNA, 18 nt, Salmonella typhimurium LT2
gccaguaucgcgccgcca

SEQ ID NO: 1866965 - RNA, 15 nt, Salmonella typhimurium LT2
gccaguagcucgccg

SEQ ID NO: 1866966 - RNA, 23 nt, Salmonella typhimurium LT2
gccaguauagcguuuuuuauucg

SEQ ID NO: 1866967 - RNA, 18 nt, Salmonella typhimurium LT2
gccaguuagcgaccgcgc

SEQ ID NO: 1866968 - RNA, 19 nt, Salmonella typhimurium LT2
gccaguucauuccgcccug

SEQ ID NO: 1866969 - RNA, 17 nt, Salmonella typhimurium LT2
gccaguucacgccgccg

SEQ ID NO: 1866970 - RNA, 18 nt, Salmonella typhimurium LT2
gccaguugcgcaggguau

SEQ ID NO: 1866971 - RNA, 20 nt, Salmonella typhimurium LT2
gccagugggcgucaaaaucc

SEQ ID NO: 1866972 - RNA, 14 nt, Salmonella typhimurium LT2
gccagugacaaauu

SEQ ID NO: 1866973 - RNA, 15 nt, Salmonella typhimurium LT2
gccaggcuuccugcg

SEQ ID NO: 1866974 - RNA, 14 nt, Salmonella typhimurium LT2
gccacuucuuccag

SEQ ID NO: 1866975 - RNA, 20 nt, Salmonella typhimurium LT2
gccagggaacuccagcaggg

SEQ ID NO: 1866976 - RNA, 18 nt, Salmonella typhimurium LT2
gccacuucacuggcggca

SEQ ID NO: 1866977 - RNA, 21 nt, Salmonella typhimurium LT2
gccacuuccagcgcgccguca

SEQ ID NO: 1866978 - RNA, 19 nt, Salmonella typhimurium LT2
gccaggggaugauuuucag

SEQ ID NO: 1866979 - RNA, 21 nt, Salmonella typhimurium LT2
gccaggggaugauuuucaggc

SEQ ID NO: 1866980 - RNA, 17 nt, Salmonella typhimurium LT2
gccaggggaugauuuuc

SEQ ID NO: 1866981 - RNA, 22 nt, Salmonella typhimurium LT2
gccagggccaaucagaaucaga

SEQ ID NO: 1866982 - RNA, 13 nt, Salmonella typhimurium LT2
gccagguccagau

SEQ ID NO: 1866983 - RNA, 18 nt, Salmonella typhimurium LT2
gccaggucucauagcgcc

SEQ ID NO: 1866984 - RNA, 18 nt, Salmonella typhimurium LT2
gccaggugacuuugcccu

SEQ ID NO: 1866985 - RNA, 20 nt, Salmonella typhimurium LT2
gccaggucucauagcgcccc

SEQ ID NO: 1866986 - RNA, 16 nt, Salmonella typhimurium LT2
gccaggugccgagguu

SEQ ID NO: 1866987 - RNA, 23 nt, Salmonella typhimurium LT2
gccagguuauuucgcgcaguuag

SEQ ID NO: 1866988 - RNA, 15 nt, Salmonella typhimurium LT2
gccagguuauccagu

SEQ ID NO: 1866989 - RNA, 20 nt, Salmonella typhimurium LT2
gccagguugcgcccggcgca

SEQ ID NO: 1866990 - RNA, 17 nt, Salmonella typhimurium LT2
gccauccauugcgccac

SEQ ID NO: 1866991 - RNA, 21 nt, Salmonella typhimurium LT2
gccauccauugcgccacggau

SEQ ID NO: 1866992 - RNA, 13 nt, Salmonella typhimurium LT2
gccauccagcacc

SEQ ID NO: 1866993 - RNA, 14 nt, Salmonella typhimurium LT2
gccauccagcacca

SEQ ID NO: 1866994 - RNA, 16 nt, Salmonella typhimurium LT2
gccauccggcaauuaa

SEQ ID NO: 1866995 - RNA, 20 nt, Salmonella typhimurium LT2
gccauccggcaucacaggcu

SEQ ID NO: 1866996 - RNA, 16 nt, Salmonella typhimurium LT2
gccauccggcaacaaa

SEQ ID NO: 1866997 - RNA, 15 nt, Salmonella typhimurium LT2
gccauccggcaaaaa

SEQ ID NO: 1866998 - RNA, 21 nt, Salmonella typhimurium LT2
gccauccggcaaaaagcuuac

SEQ ID NO: 1866999 - RNA, 13 nt, Salmonella typhimurium LT2
gccaucgccgcca

SEQ ID NO: 1867000 - RNA, 21 nt, Salmonella typhimurium LT2
gccaucaauccauuucgccag

SEQ ID NO: 1867001 - RNA, 14 nt, Salmonella typhimurium LT2
gccauacacgcggc

SEQ ID NO: 1867002 - RNA, 21 nt, Salmonella typhimurium LT2
gccauaacaucacggguuuua

SEQ ID NO: 1867003 - RNA, 17 nt, Salmonella typhimurium LT2
gccauaagcgaacaggc

SEQ ID NO: 1867004 - RNA, 17 nt, Salmonella typhimurium LT2
gccauaauggauuaggu

SEQ ID NO: 1867005 - RNA, 19 nt, Salmonella typhimurium LT2
gccauaccggcgcgcgcca

SEQ ID NO: 1867006 - RNA, 17 nt, Salmonella typhimurium LT2
gccauagcguuuaaaaa

SEQ ID NO: 1867007 - RNA, 21 nt, Salmonella typhimurium LT2
gccaguuucucgucauaguga

SEQ ID NO: 1867008 - RNA, 20 nt, Salmonella typhimurium LT2
gccaguuguccgcuggucag

SEQ ID NO: 1867009 - RNA, 12 nt, Salmonella typhimurium LT2
gccaguuuacgc

SEQ ID NO: 1867010 - RNA, 17 nt, Salmonella typhimurium LT2
gcccaacugccagcgga

SEQ ID NO: 1867011 - RNA, 18 nt, Salmonella typhimurium LT2
gcccaacuguuaucauag

SEQ ID NO: 1867012 - RNA, 14 nt, Salmonella typhimurium LT2
gccauuccagccgg

SEQ ID NO: 1867013 - RNA, 13 nt, Salmonella typhimurium LT2
gccauuccaagaa

SEQ ID NO: 1867014 - RNA, 18 nt, Salmonella typhimurium LT2
gccauuccgcuucuucca

SEQ ID NO: 1867015 - RNA, 14 nt, Salmonella typhimurium LT2
gccauuucugcuca

SEQ ID NO: 1867016 - RNA, 17 nt, Salmonella typhimurium LT2
gccauuuccugauuuuu

SEQ ID NO: 1867017 - RNA, 13 nt, Salmonella typhimurium LT2
gccauugaagucc

SEQ ID NO: 1867018 - RNA, 19 nt, Salmonella typhimurium LT2
gccauucgcccagucauca

SEQ ID NO: 1867019 - RNA, 18 nt, Salmonella typhimurium LT2
gccaugaucgccgccauc

SEQ ID NO: 1867020 - RNA, 15 nt, Salmonella typhimurium LT2
gccaugaucgccgcc

SEQ ID NO: 1867021 - RNA, 18 nt, Salmonella typhimurium LT2
gccaugacgccaagcugc

SEQ ID NO: 1867022 - RNA, 18 nt, Salmonella typhimurium LT2
gccaugaacgacccgcgc

SEQ ID NO: 1867023 - RNA, 23 nt, Salmonella typhimurium LT2
gccaucgucaccggaucgcugag

SEQ ID NO: 1867024 - RNA, 11 nt, Salmonella typhimurium LT2
gccaucggcau

SEQ ID NO: 1867025 - RNA, 23 nt, Salmonella typhimurium LT2
gccaucggaaacuauccuggccu

SEQ ID NO: 1867026 - RNA, 21 nt, Salmonella typhimurium LT2
gccaucggacauauuuuacca

SEQ ID NO: 1867027 - RNA, 15 nt, Salmonella typhimurium LT2
gccauggccgcagcc

SEQ ID NO: 1867028 - RNA, 17 nt, Salmonella typhimurium LT2
gccaugcuuuccgggcc

SEQ ID NO: 1867029 - RNA, 12 nt, Salmonella typhimurium LT2
gcccgucagggg

SEQ ID NO: 1867030 - RNA, 17 nt, Salmonella typhimurium LT2
gcccguagcgacgccau

SEQ ID NO: 1867031 - RNA, 19 nt, Salmonella typhimurium LT2
gcccguaccgcggcgcugc

SEQ ID NO: 1867032 - RNA, 13 nt, Salmonella typhimurium LT2
gcccgguucaccg

SEQ ID NO: 1867033 - RNA, 23 nt, Salmonella typhimurium LT2
gcccggugauggugcagccccgg

SEQ ID NO: 1867034 - RNA, 19 nt, Salmonella typhimurium LT2
gcccgguggcgcuggcgcu

SEQ ID NO: 1867035 - RNA, 15 nt, Salmonella typhimurium LT2
gcccgguggcgccgc

SEQ ID NO: 1867036 - RNA, 23 nt, Salmonella typhimurium LT2
gcccgccaccagcacagcccagu

SEQ ID NO: 1867037 - RNA, 14 nt, Salmonella typhimurium LT2
gcccgccagcacca

SEQ ID NO: 1867038 - RNA, 13 nt, Salmonella typhimurium LT2
gcccgccagcaua

SEQ ID NO: 1867039 - RNA, 20 nt, Salmonella typhimurium LT2
gcccgguaagcgcagcgcca

SEQ ID NO: 1867040 - RNA, 15 nt, Salmonella typhimurium LT2
gcccgguaaacgcuu

SEQ ID NO: 1867041 - RNA, 19 nt, Salmonella typhimurium LT2
gcccgggucguugacguga

SEQ ID NO: 1867042 - RNA, 14 nt, Salmonella typhimurium LT2
gcccuaucgcugcg

SEQ ID NO: 1867043 - RNA, 19 nt, Salmonella typhimurium LT2
gcccucaucggcaaacauc

SEQ ID NO: 1867044 - RNA, 14 nt, Salmonella typhimurium LT2
gcccguuguccgcc

SEQ ID NO: 1867045 - RNA, 16 nt, Salmonella typhimurium LT2
gcccguugccuggcga

SEQ ID NO: 1867046 - RNA, 15 nt, Salmonella typhimurium LT2
gcccguuuuuuccag

SEQ ID NO: 1867047 - RNA, 22 nt, Salmonella typhimurium LT2
gcccuucgucaggaggccugaa

SEQ ID NO: 1867048 - RNA, 22 nt, Salmonella typhimurium LT2
gcccuucgcccaucgccgccuc

SEQ ID NO: 1867049 - RNA, 11 nt, Salmonella typhimurium LT2
gcccuuuuguu

SEQ ID NO: 1867050 - RNA, 12 nt, Salmonella typhimurium LT2
gcccuuugcccu

SEQ ID NO: 1867051 - RNA, 13 nt, Salmonella typhimurium LT2
gcccuuucuucaa

SEQ ID NO: 1867052 - RNA, 11 nt, Salmonella typhimurium LT2
gcccuuucuua

SEQ ID NO: 1867053 - RNA, 12 nt, Salmonella typhimurium LT2
gcccugccacca

SEQ ID NO: 1867054 - RNA, 14 nt, Salmonella typhimurium LT2
gcccugccaccagc

SEQ ID NO: 1867055 - RNA, 15 nt, Salmonella typhimurium LT2
gcccugaucccacag

SEQ ID NO: 1867056 - RNA, 16 nt, Salmonella typhimurium LT2
gcccugauggcgcgcc

SEQ ID NO: 1867057 - RNA, 23 nt, Salmonella typhimurium LT2
gcccugaugauuuaaaaguacaa

SEQ ID NO: 1867058 - RNA, 17 nt, Salmonella typhimurium LT2
gcccucuuuaucaaaca

SEQ ID NO: 1867059 - RNA, 23 nt, Salmonella typhimurium LT2
gcccugaagggcggcuggauaaa

SEQ ID NO: 1867060 - RNA, 13 nt, Salmonella typhimurium LT2
gcccucuauccac

SEQ ID NO: 1867061 - RNA, 21 nt, Salmonella typhimurium LT2
gccgacaucacgcaaaugcag

SEQ ID NO: 1867062 - RNA, 16 nt, Salmonella typhimurium LT2
gccgacgauuugcgcu

SEQ ID NO: 1867063 - RNA, 15 nt, Salmonella typhimurium LT2
gccgacgacaggcag

SEQ ID NO: 1867064 - RNA, 21 nt, Salmonella typhimurium LT2
gccgacaggcagguugccgau

SEQ ID NO: 1867065 - RNA, 19 nt, Salmonella typhimurium LT2
gccgacauagcugaacaau

SEQ ID NO: 1867066 - RNA, 23 nt, Salmonella typhimurium LT2
gccgaauaagcgacagcgccauc

SEQ ID NO: 1867067 - RNA, 22 nt, Salmonella typhimurium LT2
aaagcuacguuugaacagcagc

SEQ ID NO: 1867068 - RNA, 20 nt, Salmonella typhimurium LT2
aaagcguucggccugcugca

SEQ ID NO: 1867069 - RNA, 14 nt, Salmonella typhimurium LT2
gccgaagugcgcgc

SEQ ID NO: 1867070 - RNA, 20 nt, Salmonella typhimurium LT2
gccgaaguucauaaauguac

SEQ ID NO: 1867071 - RNA, 17 nt, Salmonella typhimurium LT2
gccgaaguucgcgccgc

SEQ ID NO: 1867072 - RNA, 22 nt, Salmonella typhimurium LT2
aaagcggcgaauauagcuaaug

SEQ ID NO: 1867073 - RNA, 14 nt, Salmonella typhimurium LT2
aaagcggcuguagc

SEQ ID NO: 1867074 - RNA, 14 nt, Salmonella typhimurium LT2
gccgaagccaacgc

SEQ ID NO: 1867075 - RNA, 14 nt, Salmonella typhimurium LT2
gccgaagacucccc

SEQ ID NO: 1867076 - RNA, 15 nt, Salmonella typhimurium LT2
gccgaagacuccccu

SEQ ID NO: 1867077 - RNA, 15 nt, Salmonella typhimurium LT2
gccgauucccgccug

SEQ ID NO: 1867078 - RNA, 19 nt, Salmonella typhimurium LT2
gccgaggguggcaccgcgc

SEQ ID NO: 1867079 - RNA, 16 nt, Salmonella typhimurium LT2
gccgacgcucuuccuc

SEQ ID NO: 1867080 - RNA, 16 nt, Salmonella typhimurium LT2
gccgccaucgccagua

SEQ ID NO: 1867081 - RNA, 13 nt, Salmonella typhimurium LT2
gccgccauccggc

SEQ ID NO: 1867082 - RNA, 23 nt, Salmonella typhimurium LT2
gccgccauucgcuuccgccggga

SEQ ID NO: 1867083 - RNA, 12 nt, Salmonella typhimurium LT2
gccgccauggcg

SEQ ID NO: 1867084 - RNA, 18 nt, Salmonella typhimurium LT2
gccgccaucgucgccacc

SEQ ID NO: 1867085 - RNA, 22 nt, Salmonella typhimurium LT2
gccgccauccggcaauuccgca

SEQ ID NO: 1867086 - RNA, 12 nt, Salmonella typhimurium LT2
gccgccagcgac

SEQ ID NO: 1867087 - RNA, 21 nt, Salmonella typhimurium LT2
gccgccagcgucucagcaggc

SEQ ID NO: 1867088 - RNA, 21 nt, Salmonella typhimurium LT2
gccgccagcucgucggccagc

SEQ ID NO: 1867089 - RNA, 17 nt, Salmonella typhimurium LT2
gccgccaccacaaagcg

SEQ ID NO: 1867090 - RNA, 14 nt, Salmonella typhimurium LT2
gccgccaccgccuc

SEQ ID NO: 1867091 - RNA, 13 nt, Salmonella typhimurium LT2
gccgccaaagcgg

SEQ ID NO: 1867092 - RNA, 20 nt, Salmonella typhimurium LT2
gccgccaaacugcgcgccgc

SEQ ID NO: 1867093 - RNA, 23 nt, Salmonella typhimurium LT2
gccgccaaacugcgcgccgcccu

SEQ ID NO: 1867094 - RNA, 19 nt, Salmonella typhimurium LT2
gccgccaaacugcgcgccg

SEQ ID NO: 1867095 - RNA, 20 nt, Salmonella typhimurium LT2
gccgcagugaagaauggcgc

SEQ ID NO: 1867096 - RNA, 16 nt, Salmonella typhimurium LT2
gccgcaggacagcgac

SEQ ID NO: 1867097 - RNA, 18 nt, Salmonella typhimurium LT2
gccgcaauuccugacugc

SEQ ID NO: 1867098 - RNA, 18 nt, Salmonella typhimurium LT2
gccgcaaugaccacaaau

SEQ ID NO: 1867099 - RNA, 21 nt, Salmonella typhimurium LT2
gccgcaaugaccacaaauucu

SEQ ID NO: 1867100 - RNA, 12 nt, Salmonella typhimurium LT2
gccgccgagcgc

SEQ ID NO: 1867101 - RNA, 14 nt, Salmonella typhimurium LT2
gccgccgagcgccg

SEQ ID NO: 1867102 - RNA, 19 nt, Salmonella typhimurium LT2
gccgccgaggaucaguaac

SEQ ID NO: 1867103 - RNA, 17 nt, Salmonella typhimurium LT2
aaagcuauucacaccuu

SEQ ID NO: 1867104 - RNA, 14 nt, Salmonella typhimurium LT2
gccgccgacaggau

SEQ ID NO: 1867105 - RNA, 18 nt, Salmonella typhimurium LT2
gccgcccccaugccgccu

SEQ ID NO: 1867106 - RNA, 21 nt, Salmonella typhimurium LT2
gccgcccaggccugauaagcg

SEQ ID NO: 1867107 - RNA, 18 nt, Salmonella typhimurium LT2
gccgcccaucgccacagc

SEQ ID NO: 1867108 - RNA, 18 nt, Salmonella typhimurium LT2
gccgcccaaccagcccag

SEQ ID NO: 1867109 - RNA, 14 nt, Salmonella typhimurium LT2
gccgcccaccugca

SEQ ID NO: 1867110 - RNA, 18 nt, Salmonella typhimurium LT2
gccgcgccuaccagcgcu

SEQ ID NO: 1867111 - RNA, 20 nt, Salmonella typhimurium LT2
gccgcgagaacuuccgccac

SEQ ID NO: 1867112 - RNA, 19 nt, Salmonella typhimurium LT2
gccgcgagaaucgccagga

SEQ ID NO: 1867113 - RNA, 21 nt, Salmonella typhimurium LT2
gccgcgagaaauaccaaauau

SEQ ID NO: 1867114 - RNA, 19 nt, Salmonella typhimurium LT2
gccgcgccagacgcccuuc

SEQ ID NO: 1867115 - RNA, 14 nt, Salmonella typhimurium LT2
gccgccucgcgcac

SEQ ID NO: 1867116 - RNA, 13 nt, Salmonella typhimurium LT2
gccgccucccccu

SEQ ID NO: 1867117 - RNA, 14 nt, Salmonella typhimurium LT2
gccgccucccccuc

SEQ ID NO: 1867118 - RNA, 12 nt, Salmonella typhimurium LT2
gccgccugcacg

SEQ ID NO: 1867119 - RNA, 13 nt, Salmonella typhimurium LT2
gcgacagcgccau

SEQ ID NO: 1867120 - RNA, 13 nt, Salmonella typhimurium LT2
gcgacagcgcgcc

SEQ ID NO: 1867121 - RNA, 21 nt, Salmonella typhimurium LT2
gcgacagucgcagagcccagc

SEQ ID NO: 1867122 - RNA, 20 nt, Salmonella typhimurium LT2
gcgaauuuuauuaagcaggc

SEQ ID NO: 1867123 - RNA, 20 nt, Salmonella typhimurium LT2
gcgacaaugaagcauaaaaa

SEQ ID NO: 1867124 - RNA, 20 nt, Salmonella typhimurium LT2
gcgacacgcgcgcugcgccu

SEQ ID NO: 1867125 - RNA, 14 nt, Salmonella typhimurium LT2
gcgaauaccuuccc

SEQ ID NO: 1867126 - RNA, 21 nt, Salmonella typhimurium LT2
gcgaauacccagcuuucucac

SEQ ID NO: 1867127 - RNA, 18 nt, Salmonella typhimurium LT2
gcgaaacagggcaaggau

SEQ ID NO: 1867128 - RNA, 18 nt, Salmonella typhimurium LT2
gcgaaucacauccgccag

SEQ ID NO: 1867129 - RNA, 15 nt, Salmonella typhimurium LT2
gcgaauagcgcgcua

SEQ ID NO: 1867130 - RNA, 15 nt, Salmonella typhimurium LT2
gcgaauauacgcacc

SEQ ID NO: 1867131 - RNA, 18 nt, Salmonella typhimurium LT2
gcgaauuucaaucgccag

SEQ ID NO: 1867132 - RNA, 22 nt, Salmonella typhimurium LT2
gcgaauuuuauuaagcaggccg

SEQ ID NO: 1867133 - RNA, 16 nt, Salmonella typhimurium LT2
gcgaauuuccugccag

SEQ ID NO: 1867134 - RNA, 20 nt, Salmonella typhimurium LT2
gcgaauuuccugccagaccu

SEQ ID NO: 1867135 - RNA, 14 nt, Salmonella typhimurium LT2
gcgaaugcgcgcca

SEQ ID NO: 1867136 - RNA, 17 nt, Salmonella typhimurium LT2
gcgaauccuaaacucaa

SEQ ID NO: 1867137 - RNA, 23 nt, Salmonella typhimurium LT2
gcgaauccgugcgcagaauauac

SEQ ID NO: 1867138 - RNA, 20 nt, Salmonella typhimurium LT2
gcgaccaguucaccggcggc

SEQ ID NO: 1867139 - RNA, 15 nt, Salmonella typhimurium LT2
gcgaccagcgcacca

SEQ ID NO: 1867140 - RNA, 14 nt, Salmonella typhimurium LT2
gcgaccacgccacc

SEQ ID NO: 1867141 - RNA, 13 nt, Salmonella typhimurium LT2
gcgaccacgccag

SEQ ID NO: 1867142 - RNA, 14 nt, Salmonella typhimurium LT2
gcgaccacgccagc

SEQ ID NO: 1867143 - RNA, 19 nt, Salmonella typhimurium LT2
gcgacgacuucacccgcgg

SEQ ID NO: 1867144 - RNA, 20 nt, Salmonella typhimurium LT2
gcgaccgcgccggucgccag

SEQ ID NO: 1867145 - RNA, 21 nt, Salmonella typhimurium LT2
gcgaccgcgccggucgccagc

SEQ ID NO: 1867146 - RNA, 21 nt, Salmonella typhimurium LT2
gcgaccgcaucaaugcccagc

SEQ ID NO: 1867147 - RNA, 16 nt, Salmonella typhimurium LT2
gcgacugaaaaucaaa

SEQ ID NO: 1867148 - RNA, 19 nt, Salmonella typhimurium LT2
gcgacguuaacgccgccau

SEQ ID NO: 1867149 - RNA, 16 nt, Salmonella typhimurium LT2
gcgacuucgcuuccug

SEQ ID NO: 1867150 - RNA, 18 nt, Salmonella typhimurium LT2
gcgacuggaacaggccaa

SEQ ID NO: 1867151 - RNA, 18 nt, Salmonella typhimurium LT2
gcgacuggaacgucauca

SEQ ID NO: 1867152 - RNA, 14 nt, Salmonella typhimurium LT2
gcgagcagaaaaag

SEQ ID NO: 1867153 - RNA, 20 nt, Salmonella typhimurium LT2
gcgagcaaaacccggugcgg

SEQ ID NO: 1867154 - RNA, 18 nt, Salmonella typhimurium LT2
gcgacuuuuuucacccag

SEQ ID NO: 1867155 - RNA, 20 nt, Salmonella typhimurium LT2
gcgacuuuccgccaccagau

SEQ ID NO: 1867156 - RNA, 22 nt, Salmonella typhimurium LT2
gcgacgccagauuaucggccag

SEQ ID NO: 1867157 - RNA, 16 nt, Salmonella typhimurium LT2
gcgacgauagucagcg

SEQ ID NO: 1867158 - RNA, 15 nt, Salmonella typhimurium LT2
gcgacggaccggcag

SEQ ID NO: 1867159 - RNA, 16 nt, Salmonella typhimurium LT2
gcgacgguaaaaauau

SEQ ID NO: 1867160 - RNA, 18 nt, Salmonella typhimurium LT2
gcgacguauuacgcaggc

SEQ ID NO: 1867161 - RNA, 20 nt, Salmonella typhimurium LT2
gcgacguaaugaucagcgcu

SEQ ID NO: 1867162 - RNA, 19 nt, Salmonella typhimurium LT2
gcgagcgauagagaguucc

SEQ ID NO: 1867163 - RNA, 19 nt, Salmonella typhimurium LT2
gcgagccuucaacaaaguu

SEQ ID NO: 1867164 - RNA, 21 nt, Salmonella typhimurium LT2
gcgaggcagcggcgaucaucu

SEQ ID NO: 1867165 - RNA, 18 nt, Salmonella typhimurium LT2
gcgagcguuccguauuuu

SEQ ID NO: 1867166 - RNA, 18 nt, Salmonella typhimurium LT2
gcgaguaaccuuucaccu

SEQ ID NO: 1867167 - RNA, 19 nt, Salmonella typhimurium LT2
gcgauacgcagaaccgccg

SEQ ID NO: 1867168 - RNA, 22 nt, Salmonella typhimurium LT2
gcgauacgcgcguucguugaug

SEQ ID NO: 1867169 - RNA, 18 nt, Salmonella typhimurium LT2
gcgauacucugcccgccg

SEQ ID NO: 1867170 - RNA, 14 nt, Salmonella typhimurium LT2
gcgauacuggcagu

SEQ ID NO: 1867171 - RNA, 21 nt, Salmonella typhimurium LT2
gcgauagagaccgcuuuagcc

SEQ ID NO: 1867172 - RNA, 20 nt, Salmonella typhimurium LT2
gcgauaaggucgcuauccag

SEQ ID NO: 1867173 - RNA, 21 nt, Salmonella typhimurium LT2
gcgauaagauccgggcuggca

SEQ ID NO: 1867174 - RNA, 19 nt, Salmonella typhimurium LT2
gcgauaaucaacucuccuu

SEQ ID NO: 1867175 - RNA, 21 nt, Salmonella typhimurium LT2
gccucaauugccgucagcucc

SEQ ID NO: 1867176 - RNA, 18 nt, Salmonella typhimurium LT2
gccucuuuuuagcagcaa

SEQ ID NO: 1867177 - RNA, 16 nt, Salmonella typhimurium LT2
gccugacagcaaugag

SEQ ID NO: 1867178 - RNA, 12 nt, Salmonella typhimurium LT2
gccugaaugcuc

SEQ ID NO: 1867179 - RNA, 18 nt, Salmonella typhimurium LT2
gccugaaugcacugcuga

SEQ ID NO: 1867180 - RNA, 16 nt, Salmonella typhimurium LT2
gccugaauaaugaccu

SEQ ID NO: 1867181 - RNA, 14 nt, Salmonella typhimurium LT2
gccugaaccggugg

SEQ ID NO: 1867182 - RNA, 22 nt, Salmonella typhimurium LT2
gccugaacgaagagaugccgga

SEQ ID NO: 1867183 - RNA, 17 nt, Salmonella typhimurium LT2
gccuaccugccgccaua

SEQ ID NO: 1867184 - RNA, 19 nt, Salmonella typhimurium LT2
gccuaccggaauacacaau

SEQ ID NO: 1867185 - RNA, 18 nt, Salmonella typhimurium LT2
gccugacgaauagcgcgc

SEQ ID NO: 1867186 - RNA, 15 nt, Salmonella typhimurium LT2
gccugacgccaccac

SEQ ID NO: 1867187 - RNA, 16 nt, Salmonella typhimurium LT2
gccugaccauugcugu

SEQ ID NO: 1867188 - RNA, 15 nt, Salmonella typhimurium LT2
gccugacugaagacg

SEQ ID NO: 1867189 - RNA, 16 nt, Salmonella typhimurium LT2
gccugauaaaacgcag

SEQ ID NO: 1867190 - RNA, 16 nt, Salmonella typhimurium LT2
gccugauaagcacagg

SEQ ID NO: 1867191 - RNA, 12 nt, Salmonella typhimurium LT2
gccugagcuuuc

SEQ ID NO: 1867192 - RNA, 20 nt, Salmonella typhimurium LT2
gccugcaaaccucucccccg

SEQ ID NO: 1867193 - RNA, 12 nt, Salmonella typhimurium LT2
gccugaugcugc

SEQ ID NO: 1867194 - RNA, 15 nt, Salmonella typhimurium LT2
gccugauggcgcagc

SEQ ID NO: 1867195 - RNA, 14 nt, Salmonella typhimurium LT2
gccugauucauucc

SEQ ID NO: 1867196 - RNA, 21 nt, Salmonella typhimurium LT2
gccugauggcgcugcgccauc

SEQ ID NO: 1867197 - RNA, 19 nt, Salmonella typhimurium LT2
gccugaucgauucucuucu

SEQ ID NO: 1867198 - RNA, 12 nt, Salmonella typhimurium LT2
gccugaucuuuc

SEQ ID NO: 1867199 - RNA, 13 nt, Salmonella typhimurium LT2
gccugaucgccac

SEQ ID NO: 1867200 - RNA, 22 nt, Salmonella typhimurium LT2
gccugauaagcauagcgccauc

SEQ ID NO: 1867201 - RNA, 19 nt, Salmonella typhimurium LT2
gccugauaagcuuucuguu

SEQ ID NO: 1867202 - RNA, 14 nt, Salmonella typhimurium LT2
gccugcaggcaacg

SEQ ID NO: 1867203 - RNA, 20 nt, Salmonella typhimurium LT2
gccugcacggcgucauccac

SEQ ID NO: 1867204 - RNA, 20 nt, Salmonella typhimurium LT2
gccugcacaaaaagagcaau

SEQ ID NO: 1867205 - RNA, 21 nt, Salmonella typhimurium LT2
gccugcauacguuucaccagc

SEQ ID NO: 1867206 - RNA, 13 nt, Salmonella typhimurium LT2
gccugccauagca

SEQ ID NO: 1867207 - RNA, 20 nt, Salmonella typhimurium LT2
gccugccagcaacccaccug

SEQ ID NO: 1867208 - RNA, 18 nt, Salmonella typhimurium LT2
gccugcgaaugcaggccg

SEQ ID NO: 1867209 - RNA, 17 nt, Salmonella typhimurium LT2
gccugcgaaugcaggcc

SEQ ID NO: 1867210 - RNA, 21 nt, Salmonella typhimurium LT2
gccugcgccaguucauccagc

SEQ ID NO: 1867211 - RNA, 13 nt, Salmonella typhimurium LT2
gccugcuccacca

SEQ ID NO: 1867212 - RNA, 15 nt, Salmonella typhimurium LT2
gccugcuccaccagc

SEQ ID NO: 1867213 - RNA, 14 nt, Salmonella typhimurium LT2
gccugcuccgggcg

SEQ ID NO: 1867214 - RNA, 22 nt, Salmonella typhimurium LT2
gccugcuccguaucgugcugcu

SEQ ID NO: 1867215 - RNA, 16 nt, Salmonella typhimurium LT2
gccugcgucaucccca

SEQ ID NO: 1867216 - RNA, 14 nt, Salmonella typhimurium LT2
gccugcgugcgccg

SEQ ID NO: 1867217 - RNA, 22 nt, Salmonella typhimurium LT2
gccuucccgauaaccgcguuca

SEQ ID NO: 1867218 - RNA, 12 nt, Salmonella typhimurium LT2
gccuuccagcaa

SEQ ID NO: 1867219 - RNA, 18 nt, Salmonella typhimurium LT2
gccuuccagugcggcgag

SEQ ID NO: 1867220 - RNA, 20 nt, Salmonella typhimurium LT2
gccuucgaagaauuccaccu

SEQ ID NO: 1867221 - RNA, 23 nt, Salmonella typhimurium LT2
gccuucgaagaauuccaccuuac

SEQ ID NO: 1867222 - RNA, 21 nt, Salmonella typhimurium LT2
gccuuccucgucggcaagaau

SEQ ID NO: 1867223 - RNA, 17 nt, Salmonella typhimurium LT2
gccuuccugcaggcgag

SEQ ID NO: 1867224 - RNA, 14 nt, Salmonella typhimurium LT2
gccuuccugccagc

SEQ ID NO: 1867225 - RNA, 13 nt, Salmonella typhimurium LT2
gccuucuggccaa

SEQ ID NO: 1867226 - RNA, 21 nt, Salmonella typhimurium LT2
gccuuguagcgcugcccaauc

SEQ ID NO: 1867227 - RNA, 14 nt, Salmonella typhimurium LT2
gccuuuaugcaguu

SEQ ID NO: 1867228 - RNA, 15 nt, Salmonella typhimurium LT2
gccuuuaagcugauu

SEQ ID NO: 1867229 - RNA, 15 nt, Salmonella typhimurium LT2
gcgaaaauaggcuuu

SEQ ID NO: 1867230 - RNA, 12 nt, Salmonella typhimurium LT2
gcgaaaauaaac

SEQ ID NO: 1867231 - RNA, 13 nt, Salmonella typhimurium LT2
gcgaaaaagugau

SEQ ID NO: 1867232 - RNA, 23 nt, Salmonella typhimurium LT2
gcgaaaacguugacuuaaaaagc

SEQ ID NO: 1867233 - RNA, 15 nt, Salmonella typhimurium LT2
gcgaaaacagcuggc

SEQ ID NO: 1867234 - RNA, 13 nt, Salmonella typhimurium LT2
gccuucauaauga

SEQ ID NO: 1867235 - RNA, 17 nt, Salmonella typhimurium LT2
gccuuauccagacgcug

SEQ ID NO: 1867236 - RNA, 14 nt, Salmonella typhimurium LT2
gccuuauccggccu

SEQ ID NO: 1867237 - RNA, 13 nt, Salmonella typhimurium LT2
gccuuauccggcc

SEQ ID NO: 1867238 - RNA, 13 nt, Salmonella typhimurium LT2
gccuuccagaaau

SEQ ID NO: 1867239 - RNA, 14 nt, Salmonella typhimurium LT2
gccuucauuaauuu

SEQ ID NO: 1867240 - RNA, 21 nt, Salmonella typhimurium LT2
gccugugcuuucgccaccagc

SEQ ID NO: 1867241 - RNA, 17 nt, Salmonella typhimurium LT2
gccugugccagcucguu

SEQ ID NO: 1867242 - RNA, 16 nt, Salmonella typhimurium LT2
gccuuacggugcgugg

SEQ ID NO: 1867243 - RNA, 23 nt, Salmonella typhimurium LT2
gccuuacggugcguggcgcuggg

SEQ ID NO: 1867244 - RNA, 21 nt, Salmonella typhimurium LT2
gccuguaccgcuucccgcguc

SEQ ID NO: 1867245 - RNA, 22 nt, Salmonella typhimurium LT2
gccugucuauuguuuagacaga

SEQ ID NO: 1867246 - RNA, 15 nt, Salmonella typhimurium LT2
gccugucuccgcagc

SEQ ID NO: 1867247 - RNA, 16 nt, Salmonella typhimurium LT2
gccuguacuugcgccg

SEQ ID NO: 1867248 - RNA, 21 nt, Salmonella typhimurium LT2
gccugugacguuaacgcagca

SEQ ID NO: 1867249 - RNA, 21 nt, Salmonella typhimurium LT2
gccugguggcgacgcguggca

SEQ ID NO: 1867250 - RNA, 21 nt, Salmonella typhimurium LT2
gccuggugcgggucaaaagcg

SEQ ID NO: 1867251 - RNA, 22 nt, Salmonella typhimurium LT2
gccuggugcgggucaaaagcgu

SEQ ID NO: 1867252 - RNA, 22 nt, Salmonella typhimurium LT2
gccugguuuaagaugccggggc

SEQ ID NO: 1867253 - RNA, 19 nt, Salmonella typhimurium LT2
gccuguaaaacaacccccg

SEQ ID NO: 1867254 - RNA, 17 nt, Salmonella typhimurium LT2
gccuguaaacagaugcu

SEQ ID NO: 1867255 - RNA, 22 nt, Salmonella typhimurium LT2
gccuggcagaaguccccagccg

SEQ ID NO: 1867256 - RNA, 15 nt, Salmonella typhimurium LT2
gccuggcauuuuacu

SEQ ID NO: 1867257 - RNA, 14 nt, Salmonella typhimurium LT2
gccggcuucuuccg

SEQ ID NO: 1867258 - RNA, 23 nt, Salmonella typhimurium LT2
gccggcuucuuccggccccggga

SEQ ID NO: 1867259 - RNA, 15 nt, Salmonella typhimurium LT2
gccgggaucagcggc

SEQ ID NO: 1867260 - RNA, 14 nt, Salmonella typhimurium LT2
gccggccgcaguuu

SEQ ID NO: 1867261 - RNA, 22 nt, Salmonella typhimurium LT2
gccggaaucgcgauccagcccc

SEQ ID NO: 1867262 - RNA, 13 nt, Salmonella typhimurium LT2
gccggacagcagc

SEQ ID NO: 1867263 - RNA, 15 nt, Salmonella typhimurium LT2
gccggacguugaaaa

SEQ ID NO: 1867264 - RNA, 22 nt, Salmonella typhimurium LT2
gccggauaaggcggagccgcca

SEQ ID NO: 1867265 - RNA, 16 nt, Salmonella typhimurium LT2
gccggauaagguguuu

SEQ ID NO: 1867266 - RNA, 18 nt, Salmonella typhimurium LT2
gccggauaauaguuagcc

SEQ ID NO: 1867267 - RNA, 17 nt, Salmonella typhimurium LT2
gccggaucgggcuucca

SEQ ID NO: 1867268 - RNA, 21 nt, Salmonella typhimurium LT2
gccggauaguaucuuauccgg

SEQ ID NO: 1867269 - RNA, 13 nt, Salmonella typhimurium LT2
gccggacuccagc

SEQ ID NO: 1867270 - RNA, 13 nt, Salmonella typhimurium LT2
gccggagaccggc

SEQ ID NO: 1867271 - RNA, 15 nt, Salmonella typhimurium LT2
gccggauaagacgcu

SEQ ID NO: 1867272 - RNA, 13 nt, Salmonella typhimurium LT2
gccggcaaagcca

SEQ ID NO: 1867273 - RNA, 15 nt, Salmonella typhimurium LT2
gccggauggcgucug

SEQ ID NO: 1867274 - RNA, 13 nt, Salmonella typhimurium LT2
gccggauggcgcu

SEQ ID NO: 1867275 - RNA, 14 nt, Salmonella typhimurium LT2
gccggauggcggcg

SEQ ID NO: 1867276 - RNA, 16 nt, Salmonella typhimurium LT2
gccggcaggcagcgcc

SEQ ID NO: 1867277 - RNA, 15 nt, Salmonella typhimurium LT2
gccggcaucauucug

SEQ ID NO: 1867278 - RNA, 18 nt, Salmonella typhimurium LT2
gccgucucuuucauggaa

SEQ ID NO: 1867279 - RNA, 21 nt, Salmonella typhimurium LT2
gccguggcggugacuuccuga

SEQ ID NO: 1867280 - RNA, 19 nt, Salmonella typhimurium LT2
gccgugggauugcagcaga

SEQ ID NO: 1867281 - RNA, 19 nt, Salmonella typhimurium LT2
gccuaccagcgcuauccag

SEQ ID NO: 1867282 - RNA, 21 nt, Salmonella typhimurium LT2
gccuaaguggauagaguuaaa

SEQ ID NO: 1867283 - RNA, 15 nt, Salmonella typhimurium LT2
gccuaccagucgacu

SEQ ID NO: 1867284 - RNA, 13 nt, Salmonella typhimurium LT2
gccuaccgccaua

SEQ ID NO: 1867285 - RNA, 15 nt, Salmonella typhimurium LT2
gccuaccgauaaauc

SEQ ID NO: 1867286 - RNA, 14 nt, Salmonella typhimurium LT2
gccuaaauuuaacu

SEQ ID NO: 1867287 - RNA, 13 nt, Salmonella typhimurium LT2
gccguuuugucua

SEQ ID NO: 1867288 - RNA, 22 nt, Salmonella typhimurium LT2
gccguaaggcgugccgccgcga

SEQ ID NO: 1867289 - RNA, 19 nt, Salmonella typhimurium LT2
gccguaccguugccgccga

SEQ ID NO: 1867290 - RNA, 18 nt, Salmonella typhimurium LT2
gccguagcccgcuuuacc

SEQ ID NO: 1867291 - RNA, 16 nt, Salmonella typhimurium LT2
gccguacuccagccca

SEQ ID NO: 1867292 - RNA, 16 nt, Salmonella typhimurium LT2
gccgguguuaaccaga

SEQ ID NO: 1867293 - RNA, 19 nt, Salmonella typhimurium LT2
gccgguucucccaccgcgc

SEQ ID NO: 1867294 - RNA, 20 nt, Salmonella typhimurium LT2
gccguaacgaacgcggauca

SEQ ID NO: 1867295 - RNA, 22 nt, Salmonella typhimurium LT2
gccgguuuuagcguauccggca

SEQ ID NO: 1867296 - RNA, 19 nt, Salmonella typhimurium LT2
gccgucaucgcucaucagc

SEQ ID NO: 1867297 - RNA, 23 nt, Salmonella typhimurium LT2
gccgucaucagcaagacucgcgc

SEQ ID NO: 1867298 - RNA, 20 nt, Salmonella typhimurium LT2
gccgucagcuccugcgggcu

SEQ ID NO: 1867299 - RNA, 19 nt, Salmonella typhimurium LT2
gccgucgucaccgccgcgc

SEQ ID NO: 1867300 - RNA, 17 nt, Salmonella typhimurium LT2
gccggugccauuccagc

SEQ ID NO: 1867301 - RNA, 21 nt, Salmonella typhimurium LT2
gccggugccgcaaucgguuuc

SEQ ID NO: 1867302 - RNA, 13 nt, Salmonella typhimurium LT2
gccgguauccagc

SEQ ID NO: 1867303 - RNA, 17 nt, Salmonella typhimurium LT2
gccgguauccagcgcgu

SEQ ID NO: 1867304 - RNA, 14 nt, Salmonella typhimurium LT2
gccggguuuaaugc

SEQ ID NO: 1867305 - RNA, 17 nt, Salmonella typhimurium LT2
gccggguuugccgugcg

SEQ ID NO: 1867306 - RNA, 21 nt, Salmonella typhimurium LT2
gccgguacgcagcaggcagac

SEQ ID NO: 1867307 - RNA, 17 nt, Salmonella typhimurium LT2
gccgguacgcagcaggc

SEQ ID NO: 1867308 - RNA, 22 nt, Salmonella typhimurium LT2
gccggggcucccacucuuccag

SEQ ID NO: 1867309 - RNA, 14 nt, Salmonella typhimurium LT2
gccgggcuucacgg

SEQ ID NO: 1867310 - RNA, 16 nt, Salmonella typhimurium LT2
gccgggcuucauaccg

SEQ ID NO: 1867311 - RNA, 19 nt, Salmonella typhimurium LT2
gccggguauugugccccgc

SEQ ID NO: 1867312 - RNA, 21 nt, Salmonella typhimurium LT2
gccgggcuauccggcuguucg

SEQ ID NO: 1867313 - RNA, 15 nt, Salmonella typhimurium LT2
gccgggcugaccgcu

SEQ ID NO: 1867314 - RNA, 23 nt, Salmonella typhimurium LT2
gccgggcggcuguguccgccaug

SEQ ID NO: 1867315 - RNA, 21 nt, Salmonella typhimurium LT2
gguucgaacgacagaauaugc

SEQ ID NO: 1867316 - RNA, 17 nt, Salmonella typhimurium LT2
gguucgccucccucacc

SEQ ID NO: 1867317 - RNA, 17 nt, Salmonella typhimurium LT2
gguuacuauuuuucacc

SEQ ID NO: 1867318 - RNA, 17 nt, Salmonella typhimurium LT2
gguuacgcgacgugcug

SEQ ID NO: 1867319 - RNA, 22 nt, Salmonella typhimurium LT2
gguuagcagccacacacuguuu

SEQ ID NO: 1867320 - RNA, 22 nt, Salmonella typhimurium LT2
gguuacuggcuaguauauuaaa

SEQ ID NO: 1867321 - RNA, 23 nt, Salmonella typhimurium LT2
gguuaccaaacccuuuggcaaaa

SEQ ID NO: 1867322 - RNA, 22 nt, Salmonella typhimurium LT2
gguuacaugcugaagcagugug

SEQ ID NO: 1867323 - RNA, 20 nt, Salmonella typhimurium LT2
gguuaaugaaaucgucgcca

SEQ ID NO: 1867324 - RNA, 16 nt, Salmonella typhimurium LT2
gguuaauacugaucag

SEQ ID NO: 1867325 - RNA, 14 nt, Salmonella typhimurium LT2
gguuauccagcagc

SEQ ID NO: 1867326 - RNA, 21 nt, Salmonella typhimurium LT2
gguucaccaccacccagugcc

SEQ ID NO: 1867327 - RNA, 22 nt, Salmonella typhimurium LT2
gguucaccagcgcgccgccgcc

SEQ ID NO: 1867328 - RNA, 22 nt, Salmonella typhimurium LT2
gguucagcaacgugaacugcgc

SEQ ID NO: 1867329 - RNA, 16 nt, Salmonella typhimurium LT2
gguucaaggcaggaau

SEQ ID NO: 1867330 - RNA, 15 nt, Salmonella typhimurium LT2
ggugugccugcgcuu

SEQ ID NO: 1867331 - RNA, 17 nt, Salmonella typhimurium LT2
gguuaagauacauauca

SEQ ID NO: 1867332 - RNA, 15 nt, Salmonella typhimurium LT2
gguguccccugcagg

SEQ ID NO: 1867333 - RNA, 18 nt, Salmonella typhimurium LT2
ggugucaucuucuuccgg

SEQ ID NO: 1867334 - RNA, 14 nt, Salmonella typhimurium LT2
ggugucagauccuu

SEQ ID NO: 1867335 - RNA, 16 nt, Salmonella typhimurium LT2
ggugggugaugacggg

SEQ ID NO: 1867336 - RNA, 15 nt, Salmonella typhimurium LT2
gguggucuggagccu

SEQ ID NO: 1867337 - RNA, 13 nt, Salmonella typhimurium LT2
gguuggccagcau

SEQ ID NO: 1867338 - RNA, 14 nt, Salmonella typhimurium LT2
gguugugccaguaa

SEQ ID NO: 1867339 - RNA, 20 nt, Salmonella typhimurium LT2
gguuuacgauacguuugaaa

SEQ ID NO: 1867340 - RNA, 15 nt, Salmonella typhimurium LT2
gguuuacugccagua

SEQ ID NO: 1867341 - RNA, 14 nt, Salmonella typhimurium LT2
gguugccgcaaaug

SEQ ID NO: 1867342 - RNA, 17 nt, Salmonella typhimurium LT2
gguugcgaauaaacaca

SEQ ID NO: 1867343 - RNA, 22 nt, Salmonella typhimurium LT2
gguugccugauggcgcugcgcu

SEQ ID NO: 1867344 - RNA, 15 nt, Salmonella typhimurium LT2
gguugcccgcaggcu

SEQ ID NO: 1867345 - RNA, 23 nt, Salmonella typhimurium LT2
gguugcccgguggcgcugcgcuu

SEQ ID NO: 1867346 - RNA, 22 nt, Salmonella typhimurium LT2
gguugauaccggaggagugcgc

SEQ ID NO: 1867347 - RNA, 20 nt, Salmonella typhimurium LT2
gguugaaggucugacaacua

SEQ ID NO: 1867348 - RNA, 18 nt, Salmonella typhimurium LT2
gguucucugccaucaucc

SEQ ID NO: 1867349 - RNA, 13 nt, Salmonella typhimurium LT2
guaaaaaaauaaa

SEQ ID NO: 1867350 - RNA, 15 nt, Salmonella typhimurium LT2
gguuuuuuuacucug

SEQ ID NO: 1867351 - RNA, 14 nt, Salmonella typhimurium LT2
guaaaaaaaaccgu

SEQ ID NO: 1867352 - RNA, 23 nt, Salmonella typhimurium LT2
guaaaaaaaaccguaucacugua

SEQ ID NO: 1867353 - RNA, 22 nt, Salmonella typhimurium LT2
gguuuuucgccgaccauccaga

SEQ ID NO: 1867354 - RNA, 12 nt, Salmonella typhimurium LT2
gguuuuuuaaug

SEQ ID NO: 1867355 - RNA, 17 nt, Salmonella typhimurium LT2
guaaaacgauauugccu

SEQ ID NO: 1867356 - RNA, 14 nt, Salmonella typhimurium LT2
guaaaaagaaagcu

SEQ ID NO: 1867357 - RNA, 14 nt, Salmonella typhimurium LT2
gguuugcagcagag

SEQ ID NO: 1867358 - RNA, 19 nt, Salmonella typhimurium LT2
gguuucccugccucaacau

SEQ ID NO: 1867359 - RNA, 13 nt, Salmonella typhimurium LT2
gguuucccaguca

SEQ ID NO: 1867360 - RNA, 16 nt, Salmonella typhimurium LT2
ggugaugcgcaacguu

SEQ ID NO: 1867361 - RNA, 16 nt, Salmonella typhimurium LT2
ggugaugcgccagcca

SEQ ID NO: 1867362 - RNA, 15 nt, Salmonella typhimurium LT2
ggugcaaaacguuug

SEQ ID NO: 1867363 - RNA, 18 nt, Salmonella typhimurium LT2
ggugcaugcggagauggc

SEQ ID NO: 1867364 - RNA, 17 nt, Salmonella typhimurium LT2
ggugcccgcaaaaccuu

SEQ ID NO: 1867365 - RNA, 23 nt, Salmonella typhimurium LT2
ggugccauaucguucaguuucaa

SEQ ID NO: 1867366 - RNA, 17 nt, Salmonella typhimurium LT2
ggugccauuccagccgg

SEQ ID NO: 1867367 - RNA, 16 nt, Salmonella typhimurium LT2
ggugcacgaacugcug

SEQ ID NO: 1867368 - RNA, 17 nt, Salmonella typhimurium LT2
ggugcacgaacugcugc

SEQ ID NO: 1867369 - RNA, 23 nt, Salmonella typhimurium LT2
ggugacgagggaaggggauuuuc

SEQ ID NO: 1867370 - RNA, 14 nt, Salmonella typhimurium LT2
ggugacagaagaga

SEQ ID NO: 1867371 - RNA, 15 nt, Salmonella typhimurium LT2
ggugaauaaauccuu

SEQ ID NO: 1867372 - RNA, 13 nt, Salmonella typhimurium LT2
ggcucaucaaaca

SEQ ID NO: 1867373 - RNA, 22 nt, Salmonella typhimurium LT2
ggcucaucaaacagcggcacuu

SEQ ID NO: 1867374 - RNA, 23 nt, Salmonella typhimurium LT2
ggcuccgagacucaaagaaaaca

SEQ ID NO: 1867375 - RNA, 17 nt, Salmonella typhimurium LT2
gguggcgccgcgccacc

SEQ ID NO: 1867376 - RNA, 16 nt, Salmonella typhimurium LT2
gguggcgaagcucagc

SEQ ID NO: 1867377 - RNA, 23 nt, Salmonella typhimurium LT2
ggugggcgguauccuccugccag

SEQ ID NO: 1867378 - RNA, 21 nt, Salmonella typhimurium LT2
ggugcgccccagcaugagcca

SEQ ID NO: 1867379 - RNA, 23 nt, Salmonella typhimurium LT2
ggugcgcagccccagcgccagcc

SEQ ID NO: 1867380 - RNA, 14 nt, Salmonella typhimurium LT2
ggugcucaauaaaa

SEQ ID NO: 1867381 - RNA, 15 nt, Salmonella typhimurium LT2
ggugcucaaucagaa

SEQ ID NO: 1867382 - RNA, 17 nt, Salmonella typhimurium LT2
ggugcguccgguagaga

SEQ ID NO: 1867383 - RNA, 14 nt, Salmonella typhimurium LT2
ggugccgccgcaga

SEQ ID NO: 1867384 - RNA, 22 nt, Salmonella typhimurium LT2
guacggauagccauuucugccu

SEQ ID NO: 1867385 - RNA, 18 nt, Salmonella typhimurium LT2
guacggcgagaccaccgu

SEQ ID NO: 1867386 - RNA, 20 nt, Salmonella typhimurium LT2
guacgcgucugaaugacgcc

SEQ ID NO: 1867387 - RNA, 22 nt, Salmonella typhimurium LT2
guacgcgcgucguauaugccaa

SEQ ID NO: 1867388 - RNA, 22 nt, Salmonella typhimurium LT2
guacgccucgcgcaccauaaua

SEQ ID NO: 1867389 - RNA, 14 nt, Salmonella typhimurium LT2
guacgcaggaggga

SEQ ID NO: 1867390 - RNA, 17 nt, Salmonella typhimurium LT2
guacgcaggcggcuggc

SEQ ID NO: 1867391 - RNA, 20 nt, Salmonella typhimurium LT2
guaccgacgccauuccccag

SEQ ID NO: 1867392 - RNA, 23 nt, Salmonella typhimurium LT2
guaccgauuguuuggugcugaaa

SEQ ID NO: 1867393 - RNA, 22 nt, Salmonella typhimurium LT2
guaccgcuacgcaggccauuuc

SEQ ID NO: 1867394 - RNA, 17 nt, Salmonella typhimurium LT2
guaccgcuacgcaggcc

SEQ ID NO: 1867395 - RNA, 19 nt, Salmonella typhimurium LT2
guaccgcuaucgccaaacu

SEQ ID NO: 1867396 - RNA, 23 nt, Salmonella typhimurium LT2
guaccggcaggacaaucauaaua

SEQ ID NO: 1867397 - RNA, 16 nt, Salmonella typhimurium LT2
guaccgccgccgggcc

SEQ ID NO: 1867398 - RNA, 17 nt, Salmonella typhimurium LT2
guaccugaagccauccu

SEQ ID NO: 1867399 - RNA, 16 nt, Salmonella typhimurium LT2
guaccguugccgccga

SEQ ID NO: 1867400 - RNA, 15 nt, Salmonella typhimurium LT2
guaccucgcauacuu

SEQ ID NO: 1867401 - RNA, 22 nt, Salmonella typhimurium LT2
guaccucgcauacuuccucacc

SEQ ID NO: 1867402 - RNA, 17 nt, Salmonella typhimurium LT2
guaccgucuggcgaggc

SEQ ID NO: 1867403 - RNA, 20 nt, Salmonella typhimurium LT2
guaccagaacucguugccag

SEQ ID NO: 1867404 - RNA, 18 nt, Salmonella typhimurium LT2
guaccacgccgcacacag

SEQ ID NO: 1867405 - RNA, 15 nt, Salmonella typhimurium LT2
guaccacgccgcaca

SEQ ID NO: 1867406 - RNA, 22 nt, Salmonella typhimurium LT2
guaccauaccggugcgccccag

SEQ ID NO: 1867407 - RNA, 16 nt, Salmonella typhimurium LT2
guaccagcgcccgagc

SEQ ID NO: 1867408 - RNA, 17 nt, Salmonella typhimurium LT2
guaccauaccggugcgc

SEQ ID NO: 1867409 - RNA, 12 nt, Salmonella typhimurium LT2
guaccaaacagc

SEQ ID NO: 1867410 - RNA, 12 nt, Salmonella typhimurium LT2
guaccaacugcu

SEQ ID NO: 1867411 - RNA, 14 nt, Salmonella typhimurium LT2
guaccaauacccag

SEQ ID NO: 1867412 - RNA, 16 nt, Salmonella typhimurium LT2
guaccaauacccagcg

SEQ ID NO: 1867413 - RNA, 17 nt, Salmonella typhimurium LT2
guacagcaauaaaagga

SEQ ID NO: 1867414 - RNA, 20 nt, Salmonella typhimurium LT2
guacacuucagccagacgcu

SEQ ID NO: 1867415 - RNA, 16 nt, Salmonella typhimurium LT2
guacaggccgccgccu

SEQ ID NO: 1867416 - RNA, 16 nt, Salmonella typhimurium LT2
guacaucgcgcugacc

SEQ ID NO: 1867417 - RNA, 16 nt, Salmonella typhimurium LT2
guacauaacagcagca

SEQ ID NO: 1867418 - RNA, 13 nt, Salmonella typhimurium LT2
guacaucuuccau

SEQ ID NO: 1867419 - RNA, 14 nt, Salmonella typhimurium LT2
guacauaacaucuc

SEQ ID NO: 1867420 - RNA, 20 nt, Salmonella typhimurium LT2
guaaucggccuguuggccuu

SEQ ID NO: 1867421 - RNA, 23 nt, Salmonella typhimurium LT2
guaaucaaacauacgccuuuacc

SEQ ID NO: 1867422 - RNA, 22 nt, Salmonella typhimurium LT2
guaauccacauccaaccgcuga

SEQ ID NO: 1867423 - RNA, 20 nt, Salmonella typhimurium LT2
guaauggcgggaaaagguuc

SEQ ID NO: 1867424 - RNA, 15 nt, Salmonella typhimurium LT2
guaaugcuugcugcu

SEQ ID NO: 1867425 - RNA, 16 nt, Salmonella typhimurium LT2
guaaugguguccacaa

SEQ ID NO: 1867426 - RNA, 13 nt, Salmonella typhimurium LT2
guaauggccuaca

SEQ ID NO: 1867427 - RNA, 15 nt, Salmonella typhimurium LT2
guaaugcgccaggca

SEQ ID NO: 1867428 - RNA, 16 nt, Salmonella typhimurium LT2
guaaugcucaacucug

SEQ ID NO: 1867429 - RNA, 20 nt, Salmonella typhimurium LT2
guaaugaucagaacucacau

SEQ ID NO: 1867430 - RNA, 19 nt, Salmonella typhimurium LT2
guacaagggccgccgccau

SEQ ID NO: 1867431 - RNA, 16 nt, Salmonella typhimurium LT2
guacaauggcaggcau

SEQ ID NO: 1867432 - RNA, 16 nt, Salmonella typhimurium LT2
guacaauuuccugcca

SEQ ID NO: 1867433 - RNA, 22 nt, Salmonella typhimurium LT2
guacaaugcaaagaaaaacagg

SEQ ID NO: 1867434 - RNA, 17 nt, Salmonella typhimurium LT2
guacaaucgcguuuucc

SEQ ID NO: 1867435 - RNA, 20 nt, Salmonella typhimurium LT2
guacaaacaaauaaauccau

SEQ ID NO: 1867436 - RNA, 23 nt, Salmonella typhimurium LT2
guacaaauguaguaccaggcaga

SEQ ID NO: 1867437 - RNA, 11 nt, Salmonella typhimurium LT2
guaauuuucac

SEQ ID NO: 1867438 - RNA, 14 nt, Salmonella typhimurium LT2
guaauuuugauaua

SEQ ID NO: 1867439 - RNA, 19 nt, Salmonella typhimurium LT2
guaauuugaacauauccgc

SEQ ID NO: 1867440 - RNA, 13 nt, Salmonella typhimurium LT2
guacaaaaaaugu

SEQ ID NO: 1867441 - RNA, 14 nt, Salmonella typhimurium LT2
guaauuuuucuccc

SEQ ID NO: 1867442 - RNA, 17 nt, Salmonella typhimurium LT2
guaauuuuucucccagc

SEQ ID NO: 1867443 - RNA, 19 nt, Salmonella typhimurium LT2
guaauuuuuugauauuacg

SEQ ID NO: 1867444 - RNA, 18 nt, Salmonella typhimurium LT2
guaaugucuggugcagca

SEQ ID NO: 1867445 - RNA, 18 nt, Salmonella typhimurium LT2
guaauucucccaaauuuu

SEQ ID NO: 1867446 - RNA, 19 nt, Salmonella typhimurium LT2
guaacgacgaauauccaga

SEQ ID NO: 1867447 - RNA, 15 nt, Salmonella typhimurium LT2
guaacgcauaagcgc

SEQ ID NO: 1867448 - RNA, 14 nt, Salmonella typhimurium LT2
guaacgccuccacc

SEQ ID NO: 1867449 - RNA, 19 nt, Salmonella typhimurium LT2
guaacgccgucggcagcca

SEQ ID NO: 1867450 - RNA, 14 nt, Salmonella typhimurium LT2
guaacuaaaauacu

SEQ ID NO: 1867451 - RNA, 19 nt, Salmonella typhimurium LT2
guaagaucccagggcggcg

SEQ ID NO: 1867452 - RNA, 18 nt, Salmonella typhimurium LT2
guaagauuugcgccgccg

SEQ ID NO: 1867453 - RNA, 13 nt, Salmonella typhimurium LT2
guaagacaaaaau

SEQ ID NO: 1867454 - RNA, 15 nt, Salmonella typhimurium LT2
guaagagagccuuau

SEQ ID NO: 1867455 - RNA, 14 nt, Salmonella typhimurium LT2
guaacuaucuguuc

SEQ ID NO: 1867456 - RNA, 17 nt, Salmonella typhimurium LT2
guaacuggcuccacggg

SEQ ID NO: 1867457 - RNA, 22 nt, Salmonella typhimurium LT2
guaaguuugcguacucagcaga

SEQ ID NO: 1867458 - RNA, 18 nt, Salmonella typhimurium LT2
guaaguuacuaaaaguaa

SEQ ID NO: 1867459 - RNA, 19 nt, Salmonella typhimurium LT2
guaagucgccgcagcucca

SEQ ID NO: 1867460 - RNA, 21 nt, Salmonella typhimurium LT2
guaaguaugccgcauaaaauu

SEQ ID NO: 1867461 - RNA, 14 nt, Salmonella typhimurium LT2
guaagcuauuucug

SEQ ID NO: 1867462 - RNA, 13 nt, Salmonella typhimurium LT2
guaagcucccggg

SEQ ID NO: 1867463 - RNA, 13 nt, Salmonella typhimurium LT2
guaagccagcggg

SEQ ID NO: 1867464 - RNA, 21 nt, Salmonella typhimurium LT2
guaagccgcgcugguuggugu

SEQ ID NO: 1867465 - RNA, 22 nt, Salmonella typhimurium LT2
guaagccuggcauaacauuggu

SEQ ID NO: 1867466 - RNA, 20 nt, Salmonella typhimurium LT2
guaaggcauuaauauccagu

SEQ ID NO: 1867467 - RNA, 18 nt, Salmonella typhimurium LT2
guaauacggagcaaaaaa

SEQ ID NO: 1867468 - RNA, 17 nt, Salmonella typhimurium LT2
guaauaaccguggcggc

SEQ ID NO: 1867469 - RNA, 17 nt, Salmonella typhimurium LT2
guaaguuuccugcgcag

SEQ ID NO: 1867470 - RNA, 14 nt, Salmonella typhimurium LT2
guaauaaaaaacaa

SEQ ID NO: 1867471 - RNA, 12 nt, Salmonella typhimurium LT2
guaauaaagaag

SEQ ID NO: 1867472 - RNA, 13 nt, Salmonella typhimurium LT2
guaauaaagaagg

SEQ ID NO: 1867473 - RNA, 23 nt, Salmonella typhimurium LT2
guaauagaguuuauguaccaguu

SEQ ID NO: 1867474 - RNA, 18 nt, Salmonella typhimurium LT2
guaauagcgucuaaauuu

SEQ ID NO: 1867475 - RNA, 12 nt, Salmonella typhimurium LT2
guaauauuaaaa

SEQ ID NO: 1867476 - RNA, 15 nt, Salmonella typhimurium LT2
guaauaugggcacaa

SEQ ID NO: 1867477 - RNA, 18 nt, Salmonella typhimurium LT2
guaauauaaucuaccauu

SEQ ID NO: 1867478 - RNA, 17 nt, Salmonella typhimurium LT2
guaacauacaaaaagua

SEQ ID NO: 1867479 - RNA, 20 nt, Salmonella typhimurium LT2
guaacauccuggguuugcug

SEQ ID NO: 1867480 - RNA, 23 nt, Salmonella typhimurium LT2
guaacaucgaacuguuuacccac

SEQ ID NO: 1867481 - RNA, 11 nt, Salmonella typhimurium LT2
guaacaguccg

SEQ ID NO: 1867482 - RNA, 22 nt, Salmonella typhimurium LT2
guaaccaaagcaccauucuuca

SEQ ID NO: 1867483 - RNA, 14 nt, Salmonella typhimurium LT2
guaacauauuuuua

SEQ ID NO: 1867484 - RNA, 21 nt, Salmonella typhimurium LT2
guaaauuuguuuaaucauaaa

SEQ ID NO: 1867485 - RNA, 18 nt, Salmonella typhimurium LT2
guaacaacuguuuuucac

SEQ ID NO: 1867486 - RNA, 15 nt, Salmonella typhimurium LT2
guaacaccuuacgca

SEQ ID NO: 1867487 - RNA, 16 nt, Salmonella typhimurium LT2
guaacaggcaccagcg

SEQ ID NO: 1867488 - RNA, 14 nt, Salmonella typhimurium LT2
guaaauaaaaacca

SEQ ID NO: 1867489 - RNA, 19 nt, Salmonella typhimurium LT2
guaaauaaaaaccauuuau

SEQ ID NO: 1867490 - RNA, 14 nt, Salmonella typhimurium LT2
guaaauacugaacu

SEQ ID NO: 1867491 - RNA, 20 nt, Salmonella typhimurium LT2
guaaauaaaugccgcaauaa

SEQ ID NO: 1867492 - RNA, 17 nt, Salmonella typhimurium LT2
guaaauagagaaaucaa

SEQ ID NO: 1867493 - RNA, 13 nt, Salmonella typhimurium LT2
guaaauagcccgg

SEQ ID NO: 1867494 - RNA, 13 nt, Salmonella typhimurium LT2
guaaauauaacgc

SEQ ID NO: 1867495 - RNA, 21 nt, Salmonella typhimurium LT2
guaaaucgcgagccuucaaca

SEQ ID NO: 1867496 - RNA, 18 nt, Salmonella typhimurium LT2
guaaauauugauuaaucg

SEQ ID NO: 1867497 - RNA, 22 nt, Salmonella typhimurium LT2
guaaauauugaguucaauaagc

SEQ ID NO: 1867498 - RNA, 22 nt, Salmonella typhimurium LT2
guaaaucaacuuuuuuaccauu

SEQ ID NO: 1867499 - RNA, 18 nt, Salmonella typhimurium LT2
guaaaugcgcgcggcugc

SEQ ID NO: 1867500 - RNA, 20 nt, Salmonella typhimurium LT2
guaaaugcgcgcggcugccg

SEQ ID NO: 1867501 - RNA, 14 nt, Salmonella typhimurium LT2
guaaauaagaaaau

SEQ ID NO: 1867502 - RNA, 12 nt, Salmonella typhimurium LT2
guaaaucugaaa

SEQ ID NO: 1867503 - RNA, 14 nt, Salmonella typhimurium LT2
guaaauugacugga

SEQ ID NO: 1867504 - RNA, 19 nt, Salmonella typhimurium LT2
guaaagauuuuuauuaaaa

SEQ ID NO: 1867505 - RNA, 16 nt, Salmonella typhimurium LT2
guaaaggggagcccag

SEQ ID NO: 1867506 - RNA, 22 nt, Salmonella typhimurium LT2
guaaagcguguaaccaccuggg

SEQ ID NO: 1867507 - RNA, 21 nt, Salmonella typhimurium LT2
guaaacuggauaagcgcagcg

SEQ ID NO: 1867508 - RNA, 14 nt, Salmonella typhimurium LT2
guaaacuccauuaa

SEQ ID NO: 1867509 - RNA, 17 nt, Salmonella typhimurium LT2
guaaaccggucucuuaa

SEQ ID NO: 1867510 - RNA, 16 nt, Salmonella typhimurium LT2
guaaacgccugcacca

SEQ ID NO: 1867511 - RNA, 22 nt, Salmonella typhimurium LT2
guaaacgcaacaccaucccgcu

SEQ ID NO: 1867512 - RNA, 23 nt, Salmonella typhimurium LT2
guaaaccucaaggcucagcagag

SEQ ID NO: 1867513 - RNA, 21 nt, Salmonella typhimurium LT2
guaaacgcauuaguauuucac

SEQ ID NO: 1867514 - RNA, 16 nt, Salmonella typhimurium LT2
guaaacgugccacagu

SEQ ID NO: 1867515 - RNA, 18 nt, Salmonella typhimurium LT2
guaaacgcgaccagcgca

SEQ ID NO: 1867516 - RNA, 21 nt, Salmonella typhimurium LT2
guaaacgcgaccagcgcacca

SEQ ID NO: 1867517 - RNA, 19 nt, Salmonella typhimurium LT2
guaaacgcuccggcaggca

SEQ ID NO: 1867518 - RNA, 21 nt, Salmonella typhimurium LT2
guaaacccgauucugccaguu

SEQ ID NO: 1867519 - RNA, 16 nt, Salmonella typhimurium LT2
guaaaccggucaggca

SEQ ID NO: 1867520 - RNA, 13 nt, Salmonella typhimurium LT2
guaaacagaugcu

SEQ ID NO: 1867521 - RNA, 12 nt, Salmonella typhimurium LT2
guaaaacgcugg

SEQ ID NO: 1867522 - RNA, 22 nt, Salmonella typhimurium LT2
guacucggcuacgaaccgagcg

SEQ ID NO: 1867523 - RNA, 18 nt, Salmonella typhimurium LT2
guacucugauccuacccg

SEQ ID NO: 1867524 - RNA, 19 nt, Salmonella typhimurium LT2
guacggcuuucuuucucca

SEQ ID NO: 1867525 - RNA, 20 nt, Salmonella typhimurium LT2
guacuccccuuuuuucuguu

SEQ ID NO: 1867526 - RNA, 15 nt, Salmonella typhimurium LT2
guacuccagcccauc

SEQ ID NO: 1867527 - RNA, 15 nt, Salmonella typhimurium LT2
guacucauccauuuc

SEQ ID NO: 1867528 - RNA, 13 nt, Salmonella typhimurium LT2
guacuuuucaucc

SEQ ID NO: 1867529 - RNA, 20 nt, Salmonella typhimurium LT2
guagaaauucugcaggccaa

SEQ ID NO: 1867530 - RNA, 19 nt, Salmonella typhimurium LT2
guagaaugaauuucuucau

SEQ ID NO: 1867531 - RNA, 11 nt, Salmonella typhimurium LT2
guacuuucaaa

SEQ ID NO: 1867532 - RNA, 14 nt, Salmonella typhimurium LT2
guacuuacccagag

SEQ ID NO: 1867533 - RNA, 16 nt, Salmonella typhimurium LT2
guacuucuccugccag

SEQ ID NO: 1867534 - RNA, 13 nt, Salmonella typhimurium LT2
guagacucaggcg

SEQ ID NO: 1867535 - RNA, 16 nt, Salmonella typhimurium LT2
guagacucaggcgcau

SEQ ID NO: 1867536 - RNA, 18 nt, Salmonella typhimurium LT2
guagacgcgcuagcuuca

SEQ ID NO: 1867537 - RNA, 14 nt, Salmonella typhimurium LT2
guagagcuccacgc

SEQ ID NO: 1867538 - RNA, 20 nt, Salmonella typhimurium LT2
guagagcuccacgccauagc

SEQ ID NO: 1867539 - RNA, 17 nt, Salmonella typhimurium LT2
guagagaucgacaaacc

SEQ ID NO: 1867540 - RNA, 15 nt, Salmonella typhimurium LT2
guagauauaccauac

SEQ ID NO: 1867541 - RNA, 12 nt, Salmonella typhimurium LT2
guagaugaacuc

SEQ ID NO: 1867542 - RNA, 20 nt, Salmonella typhimurium LT2
guagauggcgcuaaaaccgu

SEQ ID NO: 1867543 - RNA, 20 nt, Salmonella typhimurium LT2
guagcagcgaugacagcagg

SEQ ID NO: 1867544 - RNA, 18 nt, Salmonella typhimurium LT2
guagcagcgaugacagca

SEQ ID NO: 1867545 - RNA, 14 nt, Salmonella typhimurium LT2
guagcaggagaucu

SEQ ID NO: 1867546 - RNA, 20 nt, Salmonella typhimurium LT2
guagccaaaauuuacgggga

SEQ ID NO: 1867547 - RNA, 18 nt, Salmonella typhimurium LT2
guagcaguguaucgaaga

SEQ ID NO: 1867548 - RNA, 12 nt, Salmonella typhimurium LT2
guagcaucauca

SEQ ID NO: 1867549 - RNA, 17 nt, Salmonella typhimurium LT2
guagccacgcccgccgc

SEQ ID NO: 1867550 - RNA, 15 nt, Salmonella typhimurium LT2
guagccaacacauca

SEQ ID NO: 1867551 - RNA, 15 nt, Salmonella typhimurium LT2
guagccagcgcagcg

SEQ ID NO: 1867552 - RNA, 14 nt, Salmonella typhimurium LT2
guaguguauccaga

SEQ ID NO: 1867553 - RNA, 18 nt, Salmonella typhimurium LT2
guagucaaauuccagcaa

SEQ ID NO: 1867554 - RNA, 14 nt, Salmonella typhimurium LT2
guaguaucauccau

SEQ ID NO: 1867555 - RNA, 16 nt, Salmonella typhimurium LT2
guagguauccagcaga

SEQ ID NO: 1867556 - RNA, 20 nt, Salmonella typhimurium LT2
guaggucgcgaacagcuuuu

SEQ ID NO: 1867557 - RNA, 15 nt, Salmonella typhimurium LT2
guaggguacagcgcg

SEQ ID NO: 1867558 - RNA, 18 nt, Salmonella typhimurium LT2
guagggcugccaucaggc

SEQ ID NO: 1867559 - RNA, 13 nt, Salmonella typhimurium LT2
guaggcuucaacc

SEQ ID NO: 1867560 - RNA, 18 nt, Salmonella typhimurium LT2
guaggcuggaucaggcgc

SEQ ID NO: 1867561 - RNA, 21 nt, Salmonella typhimurium LT2
guaggcccgguaagcgcagcg

SEQ ID NO: 1867562 - RNA, 13 nt, Salmonella typhimurium LT2
guaggccaggcau

SEQ ID NO: 1867563 - RNA, 12 nt, Salmonella typhimurium LT2
guagcgcgcuuc

SEQ ID NO: 1867564 - RNA, 14 nt, Salmonella typhimurium LT2
guagcgcggcagcg

SEQ ID NO: 1867565 - RNA, 21 nt, Salmonella typhimurium LT2
guagcgcuuuuuccagcgcau

SEQ ID NO: 1867566 - RNA, 15 nt, Salmonella typhimurium LT2
guagcgcugaagccc

SEQ ID NO: 1867567 - RNA, 17 nt, Salmonella typhimurium LT2
guagcgccaucaggcau

SEQ ID NO: 1867568 - RNA, 19 nt, Salmonella typhimurium LT2
guagcgcauuauucggcuu

SEQ ID NO: 1867569 - RNA, 18 nt, Salmonella typhimurium LT2
guagcggcaacagcacca

SEQ ID NO: 1867570 - RNA, 21 nt, Salmonella typhimurium LT2
guagccugcgaagaugagcca

SEQ ID NO: 1867571 - RNA, 23 nt, Salmonella typhimurium LT2
guagcuggagauacuuucuucua

SEQ ID NO: 1867572 - RNA, 16 nt, Salmonella typhimurium LT2
guagcucauaacucgc

SEQ ID NO: 1867573 - RNA, 14 nt, Salmonella typhimurium LT2
guagcuccagaccu

SEQ ID NO: 1867574 - RNA, 23 nt, Salmonella typhimurium LT2
guagcguuucgcgcgcgccugcc

SEQ ID NO: 1867575 - RNA, 18 nt, Salmonella typhimurium LT2
guagcgucaccggcggcg

SEQ ID NO: 1867576 - RNA, 20 nt, Salmonella typhimurium LT2
guagcuauaaucacaggggu

SEQ ID NO: 1867577 - RNA, 13 nt, Salmonella typhimurium LT2
guauaauaauauc

SEQ ID NO: 1867578 - RNA, 18 nt, Salmonella typhimurium LT2
guauaaucccgcggcgga

SEQ ID NO: 1867579 - RNA, 19 nt, Salmonella typhimurium LT2
guauaaaucccggugggga

SEQ ID NO: 1867580 - RNA, 14 nt, Salmonella typhimurium LT2
guauaacuggucau

SEQ ID NO: 1867581 - RNA, 16 nt, Salmonella typhimurium LT2
guauaaaauggcaaag

SEQ ID NO: 1867582 - RNA, 19 nt, Salmonella typhimurium LT2
guauaaaauggcaaagucg

SEQ ID NO: 1867583 - RNA, 17 nt, Salmonella typhimurium LT2
guauaaacucagcaaua

SEQ ID NO: 1867584 - RNA, 16 nt, Salmonella typhimurium LT2
guaguuggugggugau

SEQ ID NO: 1867585 - RNA, 14 nt, Salmonella typhimurium LT2
guauagaaauagcc

SEQ ID NO: 1867586 - RNA, 14 nt, Salmonella typhimurium LT2
guauaccgcuuuuc

SEQ ID NO: 1867587 - RNA, 21 nt, Salmonella typhimurium LT2
guauagcggcguuuauauaaa

SEQ ID NO: 1867588 - RNA, 13 nt, Salmonella typhimurium LT2
guauagccaggca

SEQ ID NO: 1867589 - RNA, 21 nt, Salmonella typhimurium LT2
guauaugggcaauuauauucg

SEQ ID NO: 1867590 - RNA, 22 nt, Salmonella typhimurium LT2
guaucugucacuuaaguaaaga

SEQ ID NO: 1867591 - RNA, 17 nt, Salmonella typhimurium LT2
guaucucgucgccaggg

SEQ ID NO: 1867592 - RNA, 17 nt, Salmonella typhimurium LT2
guaucgauacagacgcc

SEQ ID NO: 1867593 - RNA, 15 nt, Salmonella typhimurium LT2
guaucgacgcagaca

SEQ ID NO: 1867594 - RNA, 13 nt, Salmonella typhimurium LT2
guaucgcucugcu

SEQ ID NO: 1867595 - RNA, 22 nt, Salmonella typhimurium LT2
guaucgcccaccgacagauagc

SEQ ID NO: 1867596 - RNA, 12 nt, Salmonella typhimurium LT2
guauccgccaua

SEQ ID NO: 1867597 - RNA, 19 nt, Salmonella typhimurium LT2
guauccggccugcagggaa

SEQ ID NO: 1867598 - RNA, 19 nt, Salmonella typhimurium LT2
guauccccagucuuccugc

SEQ ID NO: 1867599 - RNA, 12 nt, Salmonella typhimurium LT2
guaucccgccag

SEQ ID NO: 1867600 - RNA, 18 nt, Salmonella typhimurium LT2
guauccccagucuuccug

SEQ ID NO: 1867601 - RNA, 16 nt, Salmonella typhimurium LT2
guaucccgccagcggc

SEQ ID NO: 1867602 - RNA, 17 nt, Salmonella typhimurium LT2
guauccaccaccuggug

SEQ ID NO: 1867603 - RNA, 14 nt, Salmonella typhimurium LT2
guauccauugccag

SEQ ID NO: 1867604 - RNA, 17 nt, Salmonella typhimurium LT2
guaucccaccuaaccca

SEQ ID NO: 1867605 - RNA, 21 nt, Salmonella typhimurium LT2
guauccauucucaucagaccg

SEQ ID NO: 1867606 - RNA, 18 nt, Salmonella typhimurium LT2
guaucaaacccuuccaga

SEQ ID NO: 1867607 - RNA, 21 nt, Salmonella typhimurium LT2
guaucaacacgguuuaccugu

SEQ ID NO: 1867608 - RNA, 14 nt, Salmonella typhimurium LT2
guaucaacccgguu

SEQ ID NO: 1867609 - RNA, 21 nt, Salmonella typhimurium LT2
guaucaacccgguuuaccagu

SEQ ID NO: 1867610 - RNA, 11 nt, Salmonella typhimurium LT2
guaucaacggg

SEQ ID NO: 1867611 - RNA, 16 nt, Salmonella typhimurium LT2
guaucacuguaaaagg

SEQ ID NO: 1867612 - RNA, 21 nt, Salmonella typhimurium LT2
guaucaucgcuuaacggccca

SEQ ID NO: 1867613 - RNA, 11 nt, Salmonella typhimurium LT2
guaucaucgcu

SEQ ID NO: 1867614 - RNA, 22 nt, Salmonella typhimurium LT2
guaugcccccuccagccagcgc

SEQ ID NO: 1867615 - RNA, 16 nt, Salmonella typhimurium LT2
guaugcgcaaaucaaa

SEQ ID NO: 1867616 - RNA, 15 nt, Salmonella typhimurium LT2
guaugcagccaggcc

SEQ ID NO: 1867617 - RNA, 16 nt, Salmonella typhimurium LT2
guaugcggucaaaagc

SEQ ID NO: 1867618 - RNA, 21 nt, Salmonella typhimurium LT2
guaugcggggguguugcaaua

SEQ ID NO: 1867619 - RNA, 15 nt, Salmonella typhimurium LT2
guauggcgccaauau

SEQ ID NO: 1867620 - RNA, 16 nt, Salmonella typhimurium LT2
guauuaacauauauag

SEQ ID NO: 1867621 - RNA, 17 nt, Salmonella typhimurium LT2
guauuaacgcuuugcca

SEQ ID NO: 1867622 - RNA, 13 nt, Salmonella typhimurium LT2
guaugccuuccag

SEQ ID NO: 1867623 - RNA, 16 nt, Salmonella typhimurium LT2
guauuacuauacccgc

SEQ ID NO: 1867624 - RNA, 21 nt, Salmonella typhimurium LT2
guauuacacuacuucuucagu

SEQ ID NO: 1867625 - RNA, 17 nt, Salmonella typhimurium LT2
guauuaagccuuuuuaa

SEQ ID NO: 1867626 - RNA, 13 nt, Salmonella typhimurium LT2
guauucuaacuga

SEQ ID NO: 1867627 - RNA, 21 nt, Salmonella typhimurium LT2
guauucugcgccagccagcuc

SEQ ID NO: 1867628 - RNA, 16 nt, Salmonella typhimurium LT2
guauucggaauaaugu

SEQ ID NO: 1867629 - RNA, 18 nt, Salmonella typhimurium LT2
guauucagcccgcuggcu

SEQ ID NO: 1867630 - RNA, 16 nt, Salmonella typhimurium LT2
guauuaucaaugguua

SEQ ID NO: 1867631 - RNA, 20 nt, Salmonella typhimurium LT2
guauuccagucgcuccacca

SEQ ID NO: 1867632 - RNA, 20 nt, Salmonella typhimurium LT2
guauucccguuuuucaucca

SEQ ID NO: 1867633 - RNA, 15 nt, Salmonella typhimurium LT2
guauucauaccuuua

SEQ ID NO: 1867634 - RNA, 12 nt, Salmonella typhimurium LT2
guauugugcuua

SEQ ID NO: 1867635 - RNA, 14 nt, Salmonella typhimurium LT2
guauugguauuuug

SEQ ID NO: 1867636 - RNA, 17 nt, Salmonella typhimurium LT2
guauuucugaaaaaccg

SEQ ID NO: 1867637 - RNA, 23 nt, Salmonella typhimurium LT2
guauuucgacuuucuucggauua

SEQ ID NO: 1867638 - RNA, 19 nt, Salmonella typhimurium LT2
guauuucccuucccagccc

SEQ ID NO: 1867639 - RNA, 17 nt, Salmonella typhimurium LT2
guauuuccauuuuucag

SEQ ID NO: 1867640 - RNA, 16 nt, Salmonella typhimurium LT2
gucaaacuuuuauaaa

SEQ ID NO: 1867641 - RNA, 18 nt, Salmonella typhimurium LT2
gucaaacuuuuauaaaua

SEQ ID NO: 1867642 - RNA, 19 nt, Salmonella typhimurium LT2
gucaaacaguucagacacc

SEQ ID NO: 1867643 - RNA, 14 nt, Salmonella typhimurium LT2
gucaaacccuuccg

SEQ ID NO: 1867644 - RNA, 22 nt, Salmonella typhimurium LT2
gucaacauagcuauauuuagcc

SEQ ID NO: 1867645 - RNA, 14 nt, Salmonella typhimurium LT2
gucaaaacuuauuu

SEQ ID NO: 1867646 - RNA, 22 nt, Salmonella typhimurium LT2
gucaaaacuuauuuuauuuuua

SEQ ID NO: 1867647 - RNA, 12 nt, Salmonella typhimurium LT2
gucaaaagcugc

SEQ ID NO: 1867648 - RNA, 23 nt, Salmonella typhimurium LT2
gucaaaauuaaucgccagcagcg

SEQ ID NO: 1867649 - RNA, 21 nt, Salmonella typhimurium LT2
guauuuuuuuacacaauucug

SEQ ID NO: 1867650 - RNA, 15 nt, Salmonella typhimurium LT2
gucgaugauuuucaa

SEQ ID NO: 1867651 - RNA, 15 nt, Salmonella typhimurium LT2
gucgagguuauaaac

SEQ ID NO: 1867652 - RNA, 15 nt, Salmonella typhimurium LT2
gucgcagcggcugcg

SEQ ID NO: 1867653 - RNA, 19 nt, Salmonella typhimurium LT2
gucgacguugccaggcgac

SEQ ID NO: 1867654 - RNA, 21 nt, Salmonella typhimurium LT2
gucgacguuuuucagccgcgc

SEQ ID NO: 1867655 - RNA, 15 nt, Salmonella typhimurium LT2
gucgacaccagcgau

SEQ ID NO: 1867656 - RNA, 18 nt, Salmonella typhimurium LT2
gucgacaaagccgcagcg

SEQ ID NO: 1867657 - RNA, 18 nt, Salmonella typhimurium LT2
gucgaacuuacggcgcgc

SEQ ID NO: 1867658 - RNA, 20 nt, Salmonella typhimurium LT2
gucgaacuuacggcgcgcca

SEQ ID NO: 1867659 - RNA, 19 nt, Salmonella typhimurium LT2
gucgagaaaccgcucgccg

SEQ ID NO: 1867660 - RNA, 21 nt, Salmonella typhimurium LT2
gucgagaaaccgcucgccgcc

SEQ ID NO: 1867661 - RNA, 20 nt, Salmonella typhimurium LT2
gucgaggacggccugacggu

SEQ ID NO: 1867662 - RNA, 23 nt, Salmonella typhimurium LT2
gucgaggaagcugcgcagcacuu

SEQ ID NO: 1867663 - RNA, 16 nt, Salmonella typhimurium LT2
gucgaggaucaucucc

SEQ ID NO: 1867664 - RNA, 14 nt, Salmonella typhimurium LT2
gucgaacgguaaca

SEQ ID NO: 1867665 - RNA, 17 nt, Salmonella typhimurium LT2
guccuguaacaacuguu

SEQ ID NO: 1867666 - RNA, 23 nt, Salmonella typhimurium LT2
guccuguaacaacuguuuuucac

SEQ ID NO: 1867667 - RNA, 15 nt, Salmonella typhimurium LT2
guccugggcugccag

SEQ ID NO: 1867668 - RNA, 19 nt, Salmonella typhimurium LT2
guccugggcugccagggca

SEQ ID NO: 1867669 - RNA, 16 nt, Salmonella typhimurium LT2
guccugggccgccacg

SEQ ID NO: 1867670 - RNA, 19 nt, Salmonella typhimurium LT2
guccucuuucccuuuuuaa

SEQ ID NO: 1867671 - RNA, 21 nt, Salmonella typhimurium LT2
guccgccuaccagcacaugau

SEQ ID NO: 1867672 - RNA, 15 nt, Salmonella typhimurium LT2
guccgguaucggcaa

SEQ ID NO: 1867673 - RNA, 15 nt, Salmonella typhimurium LT2
guccgcacgccugca

SEQ ID NO: 1867674 - RNA, 22 nt, Salmonella typhimurium LT2
guccgccaauuccugccagaga

SEQ ID NO: 1867675 - RNA, 16 nt, Salmonella typhimurium LT2
guccgcaaagaaccaa

SEQ ID NO: 1867676 - RNA, 21 nt, Salmonella typhimurium LT2
guccucggacgaaaaaugaau

SEQ ID NO: 1867677 - RNA, 14 nt, Salmonella typhimurium LT2
guccgguguccauc

SEQ ID NO: 1867678 - RNA, 16 nt, Salmonella typhimurium LT2
gucgcuauggugcggg

SEQ ID NO: 1867679 - RNA, 22 nt, Salmonella typhimurium LT2
gucgcucaauagcgauucauca

SEQ ID NO: 1867680 - RNA, 21 nt, Salmonella typhimurium LT2
gucgcuaaagccuaccaccuc

SEQ ID NO: 1867681 - RNA, 16 nt, Salmonella typhimurium LT2
gucgcguaguuuuuca

SEQ ID NO: 1867682 - RNA, 22 nt, Salmonella typhimurium LT2
gucgcgcucguaggccagcgcu

SEQ ID NO: 1867683 - RNA, 23 nt, Salmonella typhimurium LT2
gucgcgcccaacucccccaugga

SEQ ID NO: 1867684 - RNA, 23 nt, Salmonella typhimurium LT2
gucgccaggcaagguuaacguca

SEQ ID NO: 1867685 - RNA, 18 nt, Salmonella typhimurium LT2
gucgccacgcgacgccag

SEQ ID NO: 1867686 - RNA, 19 nt, Salmonella typhimurium LT2
gucgccaccaugcugguug

SEQ ID NO: 1867687 - RNA, 12 nt, Salmonella typhimurium LT2
gucgccaccugc

SEQ ID NO: 1867688 - RNA, 13 nt, Salmonella typhimurium LT2
gucgccaccugcg

SEQ ID NO: 1867689 - RNA, 21 nt, Salmonella typhimurium LT2
gucgccauauccaagccccuc

SEQ ID NO: 1867690 - RNA, 12 nt, Salmonella typhimurium LT2
gucgccaucagg

SEQ ID NO: 1867691 - RNA, 16 nt, Salmonella typhimurium LT2
gucguaggcucaaagu

SEQ ID NO: 1867692 - RNA, 20 nt, Salmonella typhimurium LT2
gucgguaucguugcggcgca

SEQ ID NO: 1867693 - RNA, 22 nt, Salmonella typhimurium LT2
gucgguaucguugcggcgcagg

SEQ ID NO: 1867694 - RNA, 13 nt, Salmonella typhimurium LT2
gucggucaggaaa

SEQ ID NO: 1867695 - RNA, 15 nt, Salmonella typhimurium LT2
gucggguucgcgcgc

SEQ ID NO: 1867696 - RNA, 21 nt, Salmonella typhimurium LT2
gucgguaaaaaugcaaugucu

SEQ ID NO: 1867697 - RNA, 20 nt, Salmonella typhimurium LT2
gucgguaaagcgcaccagcc

SEQ ID NO: 1867698 - RNA, 19 nt, Salmonella typhimurium LT2
gucggcgccaucaugcagc

SEQ ID NO: 1867699 - RNA, 16 nt, Salmonella typhimurium LT2
gucggcgaugugccug

SEQ ID NO: 1867700 - RNA, 19 nt, Salmonella typhimurium LT2
gucuacccgguguaaaaaa

SEQ ID NO: 1867701 - RNA, 15 nt, Salmonella typhimurium LT2
gucuaccagcucucc

SEQ ID NO: 1867702 - RNA, 18 nt, Salmonella typhimurium LT2
gucuaacuuaccaguuau

SEQ ID NO: 1867703 - RNA, 15 nt, Salmonella typhimurium LT2
gucgucauaaagccc

SEQ ID NO: 1867704 - RNA, 13 nt, Salmonella typhimurium LT2
gucguccccugga

SEQ ID NO: 1867705 - RNA, 14 nt, Salmonella typhimurium LT2
gucgucgaaaccgu

SEQ ID NO: 1867706 - RNA, 22 nt, Salmonella typhimurium LT2
gucgucggcauggucagcauaa

SEQ ID NO: 1867707 - RNA, 20 nt, Salmonella typhimurium LT2
gucacagguucgaaucccgu

SEQ ID NO: 1867708 - RNA, 23 nt, Salmonella typhimurium LT2
gucacauacuucuguaugcuccu

SEQ ID NO: 1867709 - RNA, 22 nt, Salmonella typhimurium LT2
gucacagaauacccuccgccau

SEQ ID NO: 1867710 - RNA, 16 nt, Salmonella typhimurium LT2
gucaauauuaaugcug

SEQ ID NO: 1867711 - RNA, 23 nt, Salmonella typhimurium LT2
gucaacgcacuguaacgcacugg

SEQ ID NO: 1867712 - RNA, 16 nt, Salmonella typhimurium LT2
gucaacgccaagcgcg

SEQ ID NO: 1867713 - RNA, 14 nt, Salmonella typhimurium LT2
gucaagguggugcu

SEQ ID NO: 1867714 - RNA, 16 nt, Salmonella typhimurium LT2
gucaauacaucacgca

SEQ ID NO: 1867715 - RNA, 20 nt, Salmonella typhimurium LT2
gucacugguacgugaaauaa

SEQ ID NO: 1867716 - RNA, 15 nt, Salmonella typhimurium LT2
gucacugucagcauc

SEQ ID NO: 1867717 - RNA, 16 nt, Salmonella typhimurium LT2
gucacugucagcauca

SEQ ID NO: 1867718 - RNA, 20 nt, Salmonella typhimurium LT2
gucaccagcagcauuucaaa

SEQ ID NO: 1867719 - RNA, 12 nt, Salmonella typhimurium LT2
gucacauccaga

SEQ ID NO: 1867720 - RNA, 14 nt, Salmonella typhimurium LT2
gucaguccaccugu

SEQ ID NO: 1867721 - RNA, 14 nt, Salmonella typhimurium LT2
gucagucacauacu

SEQ ID NO: 1867722 - RNA, 19 nt, Salmonella typhimurium LT2
gucagugagcccuccucca

SEQ ID NO: 1867723 - RNA, 15 nt, Salmonella typhimurium LT2
gucagugaacguuca

SEQ ID NO: 1867724 - RNA, 17 nt, Salmonella typhimurium LT2
gucaggaggccugaaua

SEQ ID NO: 1867725 - RNA, 13 nt, Salmonella typhimurium LT2
gucaggaaacugg

SEQ ID NO: 1867726 - RNA, 18 nt, Salmonella typhimurium LT2
gucaguaccucgcauacu

SEQ ID NO: 1867727 - RNA, 13 nt, Salmonella typhimurium LT2
gucagguuuuuug

SEQ ID NO: 1867728 - RNA, 23 nt, Salmonella typhimurium LT2
gucaguaagauuugcgccgccgu

SEQ ID NO: 1867729 - RNA, 22 nt, Salmonella typhimurium LT2
gucaggaugggcuucuucacua

SEQ ID NO: 1867730 - RNA, 16 nt, Salmonella typhimurium LT2
gucaggaugggcuucu

SEQ ID NO: 1867731 - RNA, 17 nt, Salmonella typhimurium LT2
gucagaccggcaaucaa

SEQ ID NO: 1867732 - RNA, 15 nt, Salmonella typhimurium LT2
gucagcaccaguaca

SEQ ID NO: 1867733 - RNA, 15 nt, Salmonella typhimurium LT2
gucagcgcggcuucc

SEQ ID NO: 1867734 - RNA, 14 nt, Salmonella typhimurium LT2
gucagcggcgcgcc

SEQ ID NO: 1867735 - RNA, 22 nt, Salmonella typhimurium LT2
gucagcggcugacacucaucca

SEQ ID NO: 1867736 - RNA, 22 nt, Salmonella typhimurium LT2
gucagcguuacuguagcugagc

SEQ ID NO: 1867737 - RNA, 17 nt, Salmonella typhimurium LT2
gucagcgucaucggcuc

SEQ ID NO: 1867738 - RNA, 17 nt, Salmonella typhimurium LT2
gucagcgucgcuaccag

SEQ ID NO: 1867739 - RNA, 15 nt, Salmonella typhimurium LT2
gucagcuccgguauc

SEQ ID NO: 1867740 - RNA, 17 nt, Salmonella typhimurium LT2
gucccucuccagggcaa

SEQ ID NO: 1867741 - RNA, 15 nt, Salmonella typhimurium LT2
gucccugauguaguu

SEQ ID NO: 1867742 - RNA, 18 nt, Salmonella typhimurium LT2
guccgaauaacucugcuc

SEQ ID NO: 1867743 - RNA, 20 nt, Salmonella typhimurium LT2
guccgaauaacucugcucuu

SEQ ID NO: 1867744 - RNA, 20 nt, Salmonella typhimurium LT2
gucccggcgucauacugcca

SEQ ID NO: 1867745 - RNA, 14 nt, Salmonella typhimurium LT2
guccccagccgcca

SEQ ID NO: 1867746 - RNA, 21 nt, Salmonella typhimurium LT2
guccccagcgauccagccgca

SEQ ID NO: 1867747 - RNA, 16 nt, Salmonella typhimurium LT2
guccaguucguucugc

SEQ ID NO: 1867748 - RNA, 16 nt, Salmonella typhimurium LT2
guccauugcgagaaaa

SEQ ID NO: 1867749 - RNA, 14 nt, Salmonella typhimurium LT2
guccauuuuccucc

SEQ ID NO: 1867750 - RNA, 13 nt, Salmonella typhimurium LT2
guccauaaaauga

SEQ ID NO: 1867751 - RNA, 16 nt, Salmonella typhimurium LT2
gucccacaugaacucg

SEQ ID NO: 1867752 - RNA, 13 nt, Salmonella typhimurium LT2
guccccaccaacg

SEQ ID NO: 1867753 - RNA, 15 nt, Salmonella typhimurium LT2
gucauaucauccagc

SEQ ID NO: 1867754 - RNA, 15 nt, Salmonella typhimurium LT2
gucauaaguguuuua

SEQ ID NO: 1867755 - RNA, 20 nt, Salmonella typhimurium LT2
gucauaaguguuuuaaguuu

SEQ ID NO: 1867756 - RNA, 13 nt, Salmonella typhimurium LT2
gucauaauauuca

SEQ ID NO: 1867757 - RNA, 15 nt, Salmonella typhimurium LT2
gucauaauauucaua

SEQ ID NO: 1867758 - RNA, 12 nt, Salmonella typhimurium LT2
gucauaaaacug

SEQ ID NO: 1867759 - RNA, 17 nt, Salmonella typhimurium LT2
gucauaccaugauucau

SEQ ID NO: 1867760 - RNA, 21 nt, Salmonella typhimurium LT2
gucauuggggacgcgcaaacg

SEQ ID NO: 1867761 - RNA, 14 nt, Salmonella typhimurium LT2
gucauugacagcaa

SEQ ID NO: 1867762 - RNA, 14 nt, Salmonella typhimurium LT2
gucaugcucgcuuu

SEQ ID NO: 1867763 - RNA, 15 nt, Salmonella typhimurium LT2
gucauuguaaaaccg

SEQ ID NO: 1867764 - RNA, 15 nt, Salmonella typhimurium LT2
guccacgacaauauc

SEQ ID NO: 1867765 - RNA, 19 nt, Salmonella typhimurium LT2
guccacgacaauauccucg

SEQ ID NO: 1867766 - RNA, 15 nt, Salmonella typhimurium LT2
guccacgacagaacc

SEQ ID NO: 1867767 - RNA, 17 nt, Salmonella typhimurium LT2
guccacgacagaacccg

SEQ ID NO: 1867768 - RNA, 13 nt, Salmonella typhimurium LT2
guccacuuucugu

SEQ ID NO: 1867769 - RNA, 22 nt, Salmonella typhimurium LT2
guccacggauauuuaccgccgc

SEQ ID NO: 1867770 - RNA, 22 nt, Salmonella typhimurium LT2
guccacuuaaauuuugauggac

SEQ ID NO: 1867771 - RNA, 18 nt, Salmonella typhimurium LT2
gugccugacagcaaugag

SEQ ID NO: 1867772 - RNA, 23 nt, Salmonella typhimurium LT2
gugccgugagcacguaggccaga

SEQ ID NO: 1867773 - RNA, 21 nt, Salmonella typhimurium LT2
gugccguuaaucgauaagcca

SEQ ID NO: 1867774 - RNA, 16 nt, Salmonella typhimurium LT2
gugccguguaaggcaa

SEQ ID NO: 1867775 - RNA, 12 nt, Salmonella typhimurium LT2
gugccgcuggug

SEQ ID NO: 1867776 - RNA, 23 nt, Salmonella typhimurium LT2
gugccggaaagacggcagcgcca

SEQ ID NO: 1867777 - RNA, 13 nt, Salmonella typhimurium LT2
gugccgccagauc

SEQ ID NO: 1867778 - RNA, 12 nt, Salmonella typhimurium LT2
gugccaccagcc

SEQ ID NO: 1867779 - RNA, 21 nt, Salmonella typhimurium LT2
gugccaauggcgauaaaaaua

SEQ ID NO: 1867780 - RNA, 12 nt, Salmonella typhimurium LT2
gugccagaaaca

SEQ ID NO: 1867781 - RNA, 13 nt, Salmonella typhimurium LT2
gugccagaaacau

SEQ ID NO: 1867782 - RNA, 11 nt, Salmonella typhimurium LT2
gugccauauuc

SEQ ID NO: 1867783 - RNA, 16 nt, Salmonella typhimurium LT2
gugccgauucccgccu

SEQ ID NO: 1867784 - RNA, 12 nt, Salmonella typhimurium LT2
gugcccaucggc

SEQ ID NO: 1867785 - RNA, 19 nt, Salmonella typhimurium LT2
gugcccauaaaaaucccaa

SEQ ID NO: 1867786 - RNA, 12 nt, Salmonella typhimurium LT2
gugcccagcgcg

SEQ ID NO: 1867787 - RNA, 18 nt, Salmonella typhimurium LT2
gugccccgcgcgccugca

SEQ ID NO: 1867788 - RNA, 17 nt, Salmonella typhimurium LT2
gugcaccguaucggcag

SEQ ID NO: 1867789 - RNA, 16 nt, Salmonella typhimurium LT2
gugcagcaagcggcug

SEQ ID NO: 1867790 - RNA, 17 nt, Salmonella typhimurium LT2
gugcagcaagcggcugu

SEQ ID NO: 1867791 - RNA, 16 nt, Salmonella typhimurium LT2
gugcacgaacugcugc

SEQ ID NO: 1867792 - RNA, 14 nt, Salmonella typhimurium LT2
gugcagccaugucu

SEQ ID NO: 1867793 - RNA, 18 nt, Salmonella typhimurium LT2
gugcaaacgauaaaagcu

SEQ ID NO: 1867794 - RNA, 21 nt, Salmonella typhimurium LT2
gugcaaacgauaaaagcucug

SEQ ID NO: 1867795 - RNA, 14 nt, Salmonella typhimurium LT2
gugcaacagagagc

SEQ ID NO: 1867796 - RNA, 18 nt, Salmonella typhimurium LT2
gugcaacaguugcgucuu

SEQ ID NO: 1867797 - RNA, 15 nt, Salmonella typhimurium LT2
gugcaaccgccugca

SEQ ID NO: 1867798 - RNA, 16 nt, Salmonella typhimurium LT2
aaauauagcuuuucau

SEQ ID NO: 1867799 - RNA, 22 nt, Salmonella typhimurium LT2
gugcaugggauacgccagcaga

SEQ ID NO: 1867800 - RNA, 16 nt, Salmonella typhimurium LT2
gugaugacuaaaucag

SEQ ID NO: 1867801 - RNA, 23 nt, Salmonella typhimurium LT2
gugaugauuacucuucauucaug

SEQ ID NO: 1867802 - RNA, 15 nt, Salmonella typhimurium LT2
gugaugacuaaauca

SEQ ID NO: 1867803 - RNA, 18 nt, Salmonella typhimurium LT2
gugaugagcucaaauaug

SEQ ID NO: 1867804 - RNA, 18 nt, Salmonella typhimurium LT2
gugaugcaucagaacaaa

SEQ ID NO: 1867805 - RNA, 16 nt, Salmonella typhimurium LT2
gugaugcggacgcuga

SEQ ID NO: 1867806 - RNA, 19 nt, Salmonella typhimurium LT2
gugaugcguugagcguguc

SEQ ID NO: 1867807 - RNA, 15 nt, Salmonella typhimurium LT2
gugauuacaaaaugu

SEQ ID NO: 1867808 - RNA, 13 nt, Salmonella typhimurium LT2
gugaugugccggu

SEQ ID NO: 1867809 - RNA, 14 nt, Salmonella typhimurium LT2
gugaugugguugug

SEQ ID NO: 1867810 - RNA, 12 nt, Salmonella typhimurium LT2
gugauuacaaaa

SEQ ID NO: 1867811 - RNA, 15 nt, Salmonella typhimurium LT2
gucuaucgcuucucc

SEQ ID NO: 1867812 - RNA, 12 nt, Salmonella typhimurium LT2
gugauauagcaa

SEQ ID NO: 1867813 - RNA, 14 nt, Salmonella typhimurium LT2
gugauagcgcgcca

SEQ ID NO: 1867814 - RNA, 17 nt, Salmonella typhimurium LT2
gugauacucugcgcugc

SEQ ID NO: 1867815 - RNA, 18 nt, Salmonella typhimurium LT2
gugcggguucauccgcga

SEQ ID NO: 1867816 - RNA, 22 nt, Salmonella typhimurium LT2
gugcgguauugauacaggcgcu

SEQ ID NO: 1867817 - RNA, 23 nt, Salmonella typhimurium LT2
gugcgcguagcgaugagaaauag

SEQ ID NO: 1867818 - RNA, 13 nt, Salmonella typhimurium LT2
gugcgccccaggu

SEQ ID NO: 1867819 - RNA, 15 nt, Salmonella typhimurium LT2
gugcgccguaaacaa

SEQ ID NO: 1867820 - RNA, 12 nt, Salmonella typhimurium LT2
gugcgccccagc

SEQ ID NO: 1867821 - RNA, 13 nt, Salmonella typhimurium LT2
gugcgagaaaaag

SEQ ID NO: 1867822 - RNA, 15 nt, Salmonella typhimurium LT2
gugcuuccagcucca

SEQ ID NO: 1867823 - RNA, 14 nt, Salmonella typhimurium LT2
gugcuuccagcucc

SEQ ID NO: 1867824 - RNA, 13 nt, Salmonella typhimurium LT2
gugcuuccagcuc

SEQ ID NO: 1867825 - RNA, 17 nt, Salmonella typhimurium LT2
guggaaucagucgggua

SEQ ID NO: 1867826 - RNA, 23 nt, Salmonella typhimurium LT2
guggacaaucaggcugcggauga

SEQ ID NO: 1867827 - RNA, 22 nt, Salmonella typhimurium LT2
guggaaugccccagguuauaga

SEQ ID NO: 1867828 - RNA, 14 nt, Salmonella typhimurium LT2
gugcuccguccugu

SEQ ID NO: 1867829 - RNA, 14 nt, Salmonella typhimurium LT2
gugcucgcggcgga

SEQ ID NO: 1867830 - RNA, 21 nt, Salmonella typhimurium LT2
gugcucucccagcugagcuaa

SEQ ID NO: 1867831 - RNA, 18 nt, Salmonella typhimurium LT2
gugcucauuugcggcguc

SEQ ID NO: 1867832 - RNA, 16 nt, Salmonella typhimurium LT2
gugcucagccccuggg

SEQ ID NO: 1867833 - RNA, 24 nt, Salmonella typhimurium LT2
gugcgugacccauaguuucauauc

SEQ ID NO: 1867834 - RNA, 23 nt, Salmonella typhimurium LT2
gugcguggcgccugcggcaggca

SEQ ID NO: 1867835 - RNA, 14 nt, Salmonella typhimurium LT2
gugcguucuuccac

SEQ ID NO: 1867836 - RNA, 16 nt, Salmonella typhimurium LT2
guguagguaagauauu

SEQ ID NO: 1867837 - RNA, 18 nt, Salmonella typhimurium LT2
guguccguaagcggcgga

SEQ ID NO: 1867838 - RNA, 11 nt, Salmonella typhimurium LT2
gugucaaagcg

SEQ ID NO: 1867839 - RNA, 19 nt, Salmonella typhimurium LT2
gugucaaauuguacuuuuu

SEQ ID NO: 1867840 - RNA, 15 nt, Salmonella typhimurium LT2
guguaauguuuucug

SEQ ID NO: 1867841 - RNA, 16 nt, Salmonella typhimurium LT2
guguaaaagccagcaa

SEQ ID NO: 1867842 - RNA, 12 nt, Salmonella typhimurium LT2
guguaaaugacg

SEQ ID NO: 1867843 - RNA, 19 nt, Salmonella typhimurium LT2
guguaauaaccguggcggc

SEQ ID NO: 1867844 - RNA, 21 nt, Salmonella typhimurium LT2
guguaauaaccguggcggcag

SEQ ID NO: 1867845 - RNA, 14 nt, Salmonella typhimurium LT2
guguaaaaauuuuu

SEQ ID NO: 1867846 - RNA, 14 nt, Salmonella typhimurium LT2
guguaaaagccagc

SEQ ID NO: 1867847 - RNA, 22 nt, Salmonella typhimurium LT2
gugguccgguaacggaugaaag

SEQ ID NO: 1867848 - RNA, 23 nt, Salmonella typhimurium LT2
guggucaguagcguucucuccag

SEQ ID NO: 1867849 - RNA, 21 nt, Salmonella typhimurium LT2
gugguaucucgucgccagggc

SEQ ID NO: 1867850 - RNA, 20 nt, Salmonella typhimurium LT2
gugguagugauucuuuucaa

SEQ ID NO: 1867851 - RNA, 14 nt, Salmonella typhimurium LT2
guggucgcggcuca

SEQ ID NO: 1867852 - RNA, 21 nt, Salmonella typhimurium LT2
guggucgcggcucaccagcug

SEQ ID NO: 1867853 - RNA, 16 nt, Salmonella typhimurium LT2
guggcuuuauugacua

SEQ ID NO: 1867854 - RNA, 17 nt, Salmonella typhimurium LT2
gugggcgugucgccggg

SEQ ID NO: 1867855 - RNA, 19 nt, Salmonella typhimurium LT2
gugggcuacggcucccucg

SEQ ID NO: 1867856 - RNA, 19 nt, Salmonella typhimurium LT2
guggcgcugcgcuuaccag

SEQ ID NO: 1867857 - RNA, 13 nt, Salmonella typhimurium LT2
guggcgcuccagc

SEQ ID NO: 1867858 - RNA, 12 nt, Salmonella typhimurium LT2
guggccguggug

SEQ ID NO: 1867859 - RNA, 23 nt, Salmonella typhimurium LT2
guggccgauauggccguuuucau

SEQ ID NO: 1867860 - RNA, 19 nt, Salmonella typhimurium LT2
guggccgauauugccuuca

SEQ ID NO: 1867861 - RNA, 14 nt, Salmonella typhimurium LT2
guuaucaggauaau

SEQ ID NO: 1867862 - RNA, 21 nt, Salmonella typhimurium LT2
guuaucaggauaauuucaccc

SEQ ID NO: 1867863 - RNA, 20 nt, Salmonella typhimurium LT2
guuaucaggcaugauuuucu

SEQ ID NO: 1867864 - RNA, 14 nt, Salmonella typhimurium LT2
guuaucccugcuga

SEQ ID NO: 1867865 - RNA, 19 nt, Salmonella typhimurium LT2
guuaucgauucugaauaau

SEQ ID NO: 1867866 - RNA, 15 nt, Salmonella typhimurium LT2
guuaucgccccaggc

SEQ ID NO: 1867867 - RNA, 12 nt, Salmonella typhimurium LT2
guuauguauuua

SEQ ID NO: 1867868 - RNA, 23 nt, Salmonella typhimurium LT2
guuauucuccaggcugaugugcu

SEQ ID NO: 1867869 - RNA, 17 nt, Salmonella typhimurium LT2
guuaguuucuauuaaau

SEQ ID NO: 1867870 - RNA, 12 nt, Salmonella typhimurium LT2
guuagccccuua

SEQ ID NO: 1867871 - RNA, 23 nt, Salmonella typhimurium LT2
guuagcgcauuuuuaucagaccu

SEQ ID NO: 1867872 - RNA, 15 nt, Salmonella typhimurium LT2
guuagcgcccauaau

SEQ ID NO: 1867873 - RNA, 21 nt, Salmonella typhimurium LT2
guuauaaauccccgccgccau

SEQ ID NO: 1867874 - RNA, 22 nt, Salmonella typhimurium LT2
guuauaaccgaugcagccugga

SEQ ID NO: 1867875 - RNA, 23 nt, Salmonella typhimurium LT2
guuauaaccagacgguuuauccc

SEQ ID NO: 1867876 - RNA, 22 nt, Salmonella typhimurium LT2
guuauaaggccugccguccuga

SEQ ID NO: 1867877 - RNA, 16 nt, Salmonella typhimurium LT2
guuacggaaaaaauac

SEQ ID NO: 1867878 - RNA, 21 nt, Salmonella typhimurium LT2
guuacgcggucuuuuaaaaga

SEQ ID NO: 1867879 - RNA, 15 nt, Salmonella typhimurium LT2
guuagcaaguccggg

SEQ ID NO: 1867880 - RNA, 13 nt, Salmonella typhimurium LT2
guuacuaaaagua

SEQ ID NO: 1867881 - RNA, 22 nt, Salmonella typhimurium LT2
guuagagcacaucacucauaau

SEQ ID NO: 1867882 - RNA, 13 nt, Salmonella typhimurium LT2
guuaccagcauca

SEQ ID NO: 1867883 - RNA, 19 nt, Salmonella typhimurium LT2
guuacaauauugcgcgcua

SEQ ID NO: 1867884 - RNA, 14 nt, Salmonella typhimurium LT2
guuacaugcugaag

SEQ ID NO: 1867885 - RNA, 21 nt, Salmonella typhimurium LT2
guuaauccagagcggauaaau

SEQ ID NO: 1867886 - RNA, 20 nt, Salmonella typhimurium LT2
guuaauacugaucaguuugc

SEQ ID NO: 1867887 - RNA, 13 nt, Salmonella typhimurium LT2
guuaaaucauaac

SEQ ID NO: 1867888 - RNA, 21 nt, Salmonella typhimurium LT2
guuaauaaucgaacugacggu

SEQ ID NO: 1867889 - RNA, 18 nt, Salmonella typhimurium LT2
guguuuucgauuucauuc

SEQ ID NO: 1867890 - RNA, 14 nt, Salmonella typhimurium LT2
guuaaagccgaugg

SEQ ID NO: 1867891 - RNA, 20 nt, Salmonella typhimurium LT2
guguuguacagcaauaaaag

SEQ ID NO: 1867892 - RNA, 23 nt, Salmonella typhimurium LT2
gugucgccggggcgcuggcguga

SEQ ID NO: 1867893 - RNA, 16 nt, Salmonella typhimurium LT2
guuccugagcagacau

SEQ ID NO: 1867894 - RNA, 16 nt, Salmonella typhimurium LT2
guucgauacuauaacg

SEQ ID NO: 1867895 - RNA, 18 nt, Salmonella typhimurium LT2
guucgcaacaugaauuaa

SEQ ID NO: 1867896 - RNA, 21 nt, Salmonella typhimurium LT2
guucgcgggucgguuucaguu

SEQ ID NO: 1867897 - RNA, 16 nt, Salmonella typhimurium LT2
guucgcuuauuccucc

SEQ ID NO: 1867898 - RNA, 13 nt, Salmonella typhimurium LT2
guucgcuucuucu

SEQ ID NO: 1867899 - RNA, 14 nt, Salmonella typhimurium LT2
guucguacuccugc

SEQ ID NO: 1867900 - RNA, 15 nt, Salmonella typhimurium LT2
guucguacuccugca

SEQ ID NO: 1867901 - RNA, 16 nt, Salmonella typhimurium LT2
guuccggcauaaauaa

SEQ ID NO: 1867902 - RNA, 14 nt, Salmonella typhimurium LT2
guuccguaagcgcc

SEQ ID NO: 1867903 - RNA, 21 nt, Salmonella typhimurium LT2
guuccguuaguguuggccuga

SEQ ID NO: 1867904 - RNA, 20 nt, Salmonella typhimurium LT2
guucccgagcggccaaaggg

SEQ ID NO: 1867905 - RNA, 17 nt, Salmonella typhimurium LT2
guucccgcgccagcguc

SEQ ID NO: 1867906 - RNA, 13 nt, Salmonella typhimurium LT2
guuccaggcgcgc

SEQ ID NO: 1867907 - RNA, 17 nt, Salmonella typhimurium LT2
guuccagccgccaggca

SEQ ID NO: 1867908 - RNA, 14 nt, Salmonella typhimurium LT2
guuccagcgccacg

SEQ ID NO: 1867909 - RNA, 15 nt, Salmonella typhimurium LT2
guuccagaaugguua

SEQ ID NO: 1867910 - RNA, 21 nt, Salmonella typhimurium LT2
guuccagcagcgcaucauggu

SEQ ID NO: 1867911 - RNA, 21 nt, Salmonella typhimurium LT2
guuccagcagcucaucaauaa

SEQ ID NO: 1867912 - RNA, 21 nt, Salmonella typhimurium LT2
guucauuucaggcaaaggaau

SEQ ID NO: 1867913 - RNA, 22 nt, Salmonella typhimurium LT2
guucauuuaggcguacgacagg

SEQ ID NO: 1867914 - RNA, 20 nt, Salmonella typhimurium LT2
guucauucccgccaauaacc

SEQ ID NO: 1867915 - RNA, 15 nt, Salmonella typhimurium LT2
guucauugcuuucuu

SEQ ID NO: 1867916 - RNA, 16 nt, Salmonella typhimurium LT2
guucauuaacaucugu

SEQ ID NO: 1867917 - RNA, 22 nt, Salmonella typhimurium LT2
guucauggguuagauauaguuu

SEQ ID NO: 1867918 - RNA, 16 nt, Salmonella typhimurium LT2
guucauaagucaucca

SEQ ID NO: 1867919 - RNA, 12 nt, Salmonella typhimurium LT2
guucaguuuuuc

SEQ ID NO: 1867920 - RNA, 16 nt, Salmonella typhimurium LT2
guucaguaugaucaug

SEQ ID NO: 1867921 - RNA, 13 nt, Salmonella typhimurium LT2
guucagguuuuuu

SEQ ID NO: 1867922 - RNA, 21 nt, Salmonella typhimurium LT2
guucaacgccgaacaggccau

SEQ ID NO: 1867923 - RNA, 14 nt, Salmonella typhimurium LT2
guucaagucucgcc

SEQ ID NO: 1867924 - RNA, 18 nt, Salmonella typhimurium LT2
guucaauauucaaugggu

SEQ ID NO: 1867925 - RNA, 23 nt, Salmonella typhimurium LT2
guucaauagagcgcagcaaaacg

SEQ ID NO: 1867926 - RNA, 18 nt, Salmonella typhimurium LT2
guucaauagagcgcagca

SEQ ID NO: 1867927 - RNA, 23 nt, Salmonella typhimurium LT2
guucagaccagaaccucacggag

SEQ ID NO: 1867928 - RNA, 17 nt, Salmonella typhimurium LT2
guucacuccuaagagaa

SEQ ID NO: 1867929 - RNA, 20 nt, Salmonella typhimurium LT2
guucaauucauagagcgcgu

SEQ ID NO: 1867930 - RNA, 17 nt, Salmonella typhimurium LT2
guucuguaggcugugca

SEQ ID NO: 1867931 - RNA, 19 nt, Salmonella typhimurium LT2
guucuuacggacguggggg

SEQ ID NO: 1867932 - RNA, 20 nt, Salmonella typhimurium LT2
guucugcgucgcgcauggca

SEQ ID NO: 1867933 - RNA, 19 nt, Salmonella typhimurium LT2
guucugcgccauuuccagc

SEQ ID NO: 1867934 - RNA, 22 nt, Salmonella typhimurium LT2
guucguucaacguaaagcuggc

SEQ ID NO: 1867935 - RNA, 14 nt, Salmonella typhimurium LT2
guugaaaaccugca

SEQ ID NO: 1867936 - RNA, 14 nt, Salmonella typhimurium LT2
guugaaagccccgg

SEQ ID NO: 1867937 - RNA, 19 nt, Salmonella typhimurium LT2
guucuuucgccagaaccgc

SEQ ID NO: 1867938 - RNA, 18 nt, Salmonella typhimurium LT2
guucuuugauuagcucau

SEQ ID NO: 1867939 - RNA, 14 nt, Salmonella typhimurium LT2
guucuuucugccau

SEQ ID NO: 1867940 - RNA, 17 nt, Salmonella typhimurium LT2
guucuucggcauaacgc

SEQ ID NO: 1867941 - RNA, 23 nt, Salmonella typhimurium LT2
guucuucgaccguuaccguacua

SEQ ID NO: 1867942 - RNA, 13 nt, Salmonella typhimurium LT2
guugcaacuccag

SEQ ID NO: 1867943 - RNA, 21 nt, Salmonella typhimurium LT2
guugaaguucucaucgcuauu

SEQ ID NO: 1867944 - RNA, 17 nt, Salmonella typhimurium LT2
guugagcaaugggaagg

SEQ ID NO: 1867945 - RNA, 22 nt, Salmonella typhimurium LT2
guugagcaaugggaaggaaaau

SEQ ID NO: 1867946 - RNA, 12 nt, Salmonella typhimurium LT2
guuuaaaccacu

SEQ ID NO: 1867947 - RNA, 13 nt, Salmonella typhimurium LT2
guuuaaagcgcuc

SEQ ID NO: 1867948 - RNA, 20 nt, Salmonella typhimurium LT2
guuuaaaucgcuaagcagaa

SEQ ID NO: 1867949 - RNA, 13 nt, Salmonella typhimurium LT2
guuuaaaaauuuu

SEQ ID NO: 1867950 - RNA, 22 nt, Salmonella typhimurium LT2
guuguucuuauuguuguauuug

SEQ ID NO: 1867951 - RNA, 22 nt, Salmonella typhimurium LT2
guuuagacagacagcguaaaua

SEQ ID NO: 1867952 - RNA, 22 nt, Salmonella typhimurium LT2
guuuacgagccauuaaugcagg

SEQ ID NO: 1867953 - RNA, 13 nt, Salmonella typhimurium LT2
guuuagacagaca

SEQ ID NO: 1867954 - RNA, 18 nt, Salmonella typhimurium LT2
guuuacccaggaagagua

SEQ ID NO: 1867955 - RNA, 19 nt, Salmonella typhimurium LT2
guuuacccagcgaaugcug

SEQ ID NO: 1867956 - RNA, 19 nt, Salmonella typhimurium LT2
guuuaccaaacacgaggcu

SEQ ID NO: 1867957 - RNA, 17 nt, Salmonella typhimurium LT2
guuuauuucgucagcac

SEQ ID NO: 1867958 - RNA, 17 nt, Salmonella typhimurium LT2
guugcccucuuuaucaa

SEQ ID NO: 1867959 - RNA, 21 nt, Salmonella typhimurium LT2
guugccaggguucaaccugau

SEQ ID NO: 1867960 - RNA, 16 nt, Salmonella typhimurium LT2
guugccagcggccagg

SEQ ID NO: 1867961 - RNA, 21 nt, Salmonella typhimurium LT2
guugccaauagcaaugaagca

SEQ ID NO: 1867962 - RNA, 19 nt, Salmonella typhimurium LT2
guugccaaaaaaucagcaa

SEQ ID NO: 1867963 - RNA, 15 nt, Salmonella typhimurium LT2
guugccacugccacg

SEQ ID NO: 1867964 - RNA, 18 nt, Salmonella typhimurium LT2
guugccacugccacgagc

SEQ ID NO: 1867965 - RNA, 12 nt, Salmonella typhimurium LT2
guugccgcccgu

SEQ ID NO: 1867966 - RNA, 13 nt, Salmonella typhimurium LT2
guuggagguggaa

SEQ ID NO: 1867967 - RNA, 16 nt, Salmonella typhimurium LT2
guuggaguaauguuca

SEQ ID NO: 1867968 - RNA, 14 nt, Salmonella typhimurium LT2
guuggaucucacca

SEQ ID NO: 1867969 - RNA, 16 nt, Salmonella typhimurium LT2
guuggaucucaccacu

SEQ ID NO: 1867970 - RNA, 21 nt, Salmonella typhimurium LT2
guuggcauucgaauccuccug

SEQ ID NO: 1867971 - RNA, 23 nt, Salmonella typhimurium LT2
guugggauaaugucgacgcgcuc

SEQ ID NO: 1867972 - RNA, 18 nt, Salmonella typhimurium LT2
guuggggauaaccagaaa

SEQ ID NO: 1867973 - RNA, 20 nt, Salmonella typhimurium LT2
guugggguugcccggcgcca

SEQ ID NO: 1867974 - RNA, 22 nt, Salmonella typhimurium LT2
guuguacggaugggguaucgcc

SEQ ID NO: 1867975 - RNA, 23 nt, Salmonella typhimurium LT2
guuguaguuucagcccaaaagcg

SEQ ID NO: 1867976 - RNA, 18 nt, Salmonella typhimurium LT2
uaaaaagccagcguaaau

SEQ ID NO: 1867977 - RNA, 15 nt, Salmonella typhimurium LT2
uaaaaagagaaaaaa

SEQ ID NO: 1867978 - RNA, 22 nt, Salmonella typhimurium LT2
uaaaaauaacgcgauaaucccc

SEQ ID NO: 1867979 - RNA, 23 nt, Salmonella typhimurium LT2
uaaaaacgcgcucgccagcgcag

SEQ ID NO: 1867980 - RNA, 16 nt, Salmonella typhimurium LT2
uaaaaacccugccgaa

SEQ ID NO: 1867981 - RNA, 14 nt, Salmonella typhimurium LT2
uaaaaacagccaua

SEQ ID NO: 1867982 - RNA, 14 nt, Salmonella typhimurium LT2
uaaaaaccauuuau

SEQ ID NO: 1867983 - RNA, 10 nt, Salmonella typhimurium LT2
uaaaaaccag

SEQ ID NO: 1867984 - RNA, 16 nt, Salmonella typhimurium LT2
uaaaaaaauaaaaaag

SEQ ID NO: 1867985 - RNA, 13 nt, Salmonella typhimurium LT2
uaaaaaaacauca

SEQ ID NO: 1867986 - RNA, 23 nt, Salmonella typhimurium LT2
uaaaaaaggcagaagaaucugcc

SEQ ID NO: 1867987 - RNA, 22 nt, Salmonella typhimurium LT2
guuuuuuaaccguucuuccugg

SEQ ID NO: 1867988 - RNA, 13 nt, Salmonella typhimurium LT2
guuuuuucugucg

SEQ ID NO: 1867989 - RNA, 14 nt, Salmonella typhimurium LT2
guuuuuuucaucuu

SEQ ID NO: 1867990 - RNA, 16 nt, Salmonella typhimurium LT2
guuuuucgaaaauuuc

SEQ ID NO: 1867991 - RNA, 14 nt, Salmonella typhimurium LT2
guuuuucucaucaa

SEQ ID NO: 1867992 - RNA, 14 nt, Salmonella typhimurium LT2
guuuuuacuuucca

SEQ ID NO: 1867993 - RNA, 22 nt, Salmonella typhimurium LT2
guuuuuggaaacuaugcaaaac

SEQ ID NO: 1867994 - RNA, 18 nt, Salmonella typhimurium LT2
guuuuugcgccauugccg

SEQ ID NO: 1867995 - RNA, 17 nt, Salmonella typhimurium LT2
guuuuugucucuucaug

SEQ ID NO: 1867996 - RNA, 14 nt, Salmonella typhimurium LT2
guuuguaaaauaca

SEQ ID NO: 1867997 - RNA, 14 nt, Salmonella typhimurium LT2
guuuuaaaaauaac

SEQ ID NO: 1867998 - RNA, 13 nt, Salmonella typhimurium LT2
guuuuaauuccug

SEQ ID NO: 1867999 - RNA, 17 nt, Salmonella typhimurium LT2
guuuuacaccagcuuuu

SEQ ID NO: 1868000 - RNA, 17 nt, Salmonella typhimurium LT2
guuuuaacgucaucacc

SEQ ID NO: 1868001 - RNA, 16 nt, Salmonella typhimurium LT2
guuuuaagcuucuuau

SEQ ID NO: 1868002 - RNA, 15 nt, Salmonella typhimurium LT2
aaaucaggaaaaagg

SEQ ID NO: 1868003 - RNA, 20 nt, Salmonella typhimurium LT2
aaaucaggccaagcaacauu

SEQ ID NO: 1868004 - RNA, 14 nt, Salmonella typhimurium LT2
guuucuucuguccc

SEQ ID NO: 1868005 - RNA, 19 nt, Salmonella typhimurium LT2
guuugccccauuguucuuu

SEQ ID NO: 1868006 - RNA, 22 nt, Salmonella typhimurium LT2
guuugaucuuuuucagcaccuu

SEQ ID NO: 1868007 - RNA, 16 nt, Salmonella typhimurium LT2
aaauccagcagaauaa

SEQ ID NO: 1868008 - RNA, 22 nt, Salmonella typhimurium LT2
aaauccagggaaaccauguuga

SEQ ID NO: 1868009 - RNA, 13 nt, Salmonella typhimurium LT2
guuuucauuagcc

SEQ ID NO: 1868010 - RNA, 17 nt, Salmonella typhimurium LT2
aaaucagugauggauuu

SEQ ID NO: 1868011 - RNA, 14 nt, Salmonella typhimurium LT2
uaaaaauauccgcc

SEQ ID NO: 1868012 - RNA, 18 nt, Salmonella typhimurium LT2
uaaaaauaucugaauaac

SEQ ID NO: 1868013 - RNA, 19 nt, Salmonella typhimurium LT2
uaaaaauaucugaauaacc

SEQ ID NO: 1868014 - RNA, 22 nt, Salmonella typhimurium LT2
uaaaaaugauaagcacuauuau

SEQ ID NO: 1868015 - RNA, 17 nt, Salmonella typhimurium LT2
uaaaaauuguuccugua

SEQ ID NO: 1868016 - RNA, 22 nt, Salmonella typhimurium LT2
uaaaacaaaaaaacggccucaa

SEQ ID NO: 1868017 - RNA, 20 nt, Salmonella typhimurium LT2
uaaaacaccacaaagucgcc

SEQ ID NO: 1868018 - RNA, 15 nt, Salmonella typhimurium LT2
uaaaaccgaucgccu

SEQ ID NO: 1868019 - RNA, 14 nt, Salmonella typhimurium LT2
uaaaacauaaagau

SEQ ID NO: 1868020 - RNA, 17 nt, Salmonella typhimurium LT2
uaaaacagccugucgcc

SEQ ID NO: 1868021 - RNA, 16 nt, Salmonella typhimurium LT2
uaaaagcaauguaaga

SEQ ID NO: 1868022 - RNA, 19 nt, Salmonella typhimurium LT2
uaaaagcaauguaagaaua

SEQ ID NO: 1868023 - RNA, 17 nt, Salmonella typhimurium LT2
uaaaagcccuuaucgcc

SEQ ID NO: 1868024 - RNA, 20 nt, Salmonella typhimurium LT2
uaaaacuucgauaauaaaau

SEQ ID NO: 1868025 - RNA, 23 nt, Salmonella typhimurium LT2
uaaaagaagaaaccgcagaaaaa

SEQ ID NO: 1868026 - RNA, 22 nt, Salmonella typhimurium LT2
uaaaagagaaaaagaagaaaaa

SEQ ID NO: 1868027 - RNA, 17 nt, Salmonella typhimurium LT2
uaaaacuggcuaucgcc

SEQ ID NO: 1868028 - RNA, 18 nt, Salmonella typhimurium LT2
uaaaacgguaugaaacau

SEQ ID NO: 1868029 - RNA, 16 nt, Salmonella typhimurium LT2
uaaaacgccugugcua

SEQ ID NO: 1868030 - RNA, 22 nt, Salmonella typhimurium LT2
uaaaacgauauugccuuauuca

SEQ ID NO: 1868031 - RNA, 14 nt, Salmonella typhimurium LT2
uaaaaguacaaugc

SEQ ID NO: 1868032 - RNA, 22 nt, Salmonella typhimurium LT2
uaaaaguacaaugcaaagaaaa

SEQ ID NO: 1868033 - RNA, 15 nt, Salmonella typhimurium LT2
uaaaauaaauuaauu

SEQ ID NO: 1868034 - RNA, 21 nt, Salmonella typhimurium LT2
uaaaauacgcucaauauacuu

SEQ ID NO: 1868035 - RNA, 20 nt, Salmonella typhimurium LT2
uaaaaucggggucuuccagc

SEQ ID NO: 1868036 - RNA, 16 nt, Salmonella typhimurium LT2
uaaaauccggcugccu

SEQ ID NO: 1868037 - RNA, 14 nt, Salmonella typhimurium LT2
uaaaaucaacgcuc

SEQ ID NO: 1868038 - RNA, 15 nt, Salmonella typhimurium LT2
uaaagcgcaaaauag

SEQ ID NO: 1868039 - RNA, 19 nt, Salmonella typhimurium LT2
uaaagcgcucguuauaauu

SEQ ID NO: 1868040 - RNA, 15 nt, Salmonella typhimurium LT2
uaaagccuucaugcu

SEQ ID NO: 1868041 - RNA, 20 nt, Salmonella typhimurium LT2
uaaagcgaauuguuugaaaa

SEQ ID NO: 1868042 - RNA, 20 nt, Salmonella typhimurium LT2
uaaaggggagcccaguagcc

SEQ ID NO: 1868043 - RNA, 21 nt, Salmonella typhimurium LT2
uaaaggcguuuagauagcugu

SEQ ID NO: 1868044 - RNA, 19 nt, Salmonella typhimurium LT2
uaaagcagugcaguauugc

SEQ ID NO: 1868045 - RNA, 15 nt, Salmonella typhimurium LT2
uaaagagcaggccaa

SEQ ID NO: 1868046 - RNA, 12 nt, Salmonella typhimurium LT2
uaaauaaacagc

SEQ ID NO: 1868047 - RNA, 14 nt, Salmonella typhimurium LT2
uaaauaaaauuguu

SEQ ID NO: 1868048 - RNA, 22 nt, Salmonella typhimurium LT2
uaaauacccaggccaucagaau

SEQ ID NO: 1868049 - RNA, 13 nt, Salmonella typhimurium LT2
uaaauaauuuugu

SEQ ID NO: 1868050 - RNA, 16 nt, Salmonella typhimurium LT2
uaaauaggcgccgccg

SEQ ID NO: 1868051 - RNA, 14 nt, Salmonella typhimurium LT2
uaaauaggcggcau

SEQ ID NO: 1868052 - RNA, 19 nt, Salmonella typhimurium LT2
uaaauaggcgccgccgaca

SEQ ID NO: 1868053 - RNA, 18 nt, Salmonella typhimurium LT2
uaaauagacuguugaaag

SEQ ID NO: 1868054 - RNA, 15 nt, Salmonella typhimurium LT2
uaaacaggcaggccc

SEQ ID NO: 1868055 - RNA, 16 nt, Salmonella typhimurium LT2
uaaacagguaaaacaa

SEQ ID NO: 1868056 - RNA, 20 nt, Salmonella typhimurium LT2
uaaacaauuugcccagcgcu

SEQ ID NO: 1868057 - RNA, 12 nt, Salmonella typhimurium LT2
uaaacauauggc

SEQ ID NO: 1868058 - RNA, 23 nt, Salmonella typhimurium LT2
uaaacaguuccgcaaagcccauc

SEQ ID NO: 1868059 - RNA, 16 nt, Salmonella typhimurium LT2
uaaacaucagccauuc

SEQ ID NO: 1868060 - RNA, 20 nt, Salmonella typhimurium LT2
uaaaauuuugcauaaauaau

SEQ ID NO: 1868061 - RNA, 19 nt, Salmonella typhimurium LT2
uaaacaauggaaccaucaa

SEQ ID NO: 1868062 - RNA, 17 nt, Salmonella typhimurium LT2
uaaaauucauuauaaaa

SEQ ID NO: 1868063 - RNA, 20 nt, Salmonella typhimurium LT2
uaaaauucauuauaaaacau

SEQ ID NO: 1868064 - RNA, 20 nt, Salmonella typhimurium LT2
uaaaauuguaauaauuuaaa

SEQ ID NO: 1868065 - RNA, 15 nt, Salmonella typhimurium LT2
uaaacgcaacaccau

SEQ ID NO: 1868066 - RNA, 17 nt, Salmonella typhimurium LT2
uaaacgacagcgccauc

SEQ ID NO: 1868067 - RNA, 12 nt, Salmonella typhimurium LT2
uaaaccucuuug

SEQ ID NO: 1868068 - RNA, 19 nt, Salmonella typhimurium LT2
uaaacccgauucugccagu

SEQ ID NO: 1868069 - RNA, 17 nt, Salmonella typhimurium LT2
uaaaccgaaaggguaua

SEQ ID NO: 1868070 - RNA, 16 nt, Salmonella typhimurium LT2
uaaaccauuucuccug

SEQ ID NO: 1868071 - RNA, 16 nt, Salmonella typhimurium LT2
uaaacaugcuggauga

SEQ ID NO: 1868072 - RNA, 14 nt, Salmonella typhimurium LT2
uaaacgucaugcug

SEQ ID NO: 1868073 - RNA, 15 nt, Salmonella typhimurium LT2
uaaccuuucaccuua

SEQ ID NO: 1868074 - RNA, 17 nt, Salmonella typhimurium LT2
uaacgacaaaaauacca

SEQ ID NO: 1868075 - RNA, 19 nt, Salmonella typhimurium LT2
uaacgacaaaaauaccacu

SEQ ID NO: 1868076 - RNA, 13 nt, Salmonella typhimurium LT2
uaacgacauuuuu

SEQ ID NO: 1868077 - RNA, 17 nt, Salmonella typhimurium LT2
uaaccucuauaguaaau

SEQ ID NO: 1868078 - RNA, 22 nt, Salmonella typhimurium LT2
uaaccggacgauuuaagcuuaa

SEQ ID NO: 1868079 - RNA, 17 nt, Salmonella typhimurium LT2
uaaccaauuaaauuauu

SEQ ID NO: 1868080 - RNA, 16 nt, Salmonella typhimurium LT2
uaaccaaagcaccauu

SEQ ID NO: 1868081 - RNA, 19 nt, Salmonella typhimurium LT2
uaaccaauaaugcaggcua

SEQ ID NO: 1868082 - RNA, 17 nt, Salmonella typhimurium LT2
uaaccgcgaucgaugug

SEQ ID NO: 1868083 - RNA, 23 nt, Salmonella typhimurium LT2
uaaccgcuaaacagcaaaucggg

SEQ ID NO: 1868084 - RNA, 16 nt, Salmonella typhimurium LT2
uaaccgccuccgacaa

SEQ ID NO: 1868085 - RNA, 14 nt, Salmonella typhimurium LT2
uaacauacaaaaag

SEQ ID NO: 1868086 - RNA, 16 nt, Salmonella typhimurium LT2
uaacauguuuuguauu

SEQ ID NO: 1868087 - RNA, 18 nt, Salmonella typhimurium LT2
uaacaggcaccagcguau

SEQ ID NO: 1868088 - RNA, 13 nt, Salmonella typhimurium LT2
uaacagccagcga

SEQ ID NO: 1868089 - RNA, 16 nt, Salmonella typhimurium LT2
uaacagcgcgaccagc

SEQ ID NO: 1868090 - RNA, 16 nt, Salmonella typhimurium LT2
uaacaggaagcggcug

SEQ ID NO: 1868091 - RNA, 17 nt, Salmonella typhimurium LT2
uaacaguggguugacgu

SEQ ID NO: 1868092 - RNA, 19 nt, Salmonella typhimurium LT2
uaacaguuggcuugccagc

SEQ ID NO: 1868093 - RNA, 20 nt, Salmonella typhimurium LT2
uaacaauccuaccguaacgu

SEQ ID NO: 1868094 - RNA, 19 nt, Salmonella typhimurium LT2
uaacagauaguuaauaaug

SEQ ID NO: 1868095 - RNA, 20 nt, Salmonella typhimurium LT2
uaaauuuaacucguccuguu

SEQ ID NO: 1868096 - RNA, 12 nt, Salmonella typhimurium LT2
uaaauugcggca

SEQ ID NO: 1868097 - RNA, 18 nt, Salmonella typhimurium LT2
uaaauugcggcaugaucu

SEQ ID NO: 1868098 - RNA, 23 nt, Salmonella typhimurium LT2
uaaauuguuugguuuugaaaauc

SEQ ID NO: 1868099 - RNA, 22 nt, Salmonella typhimurium LT2
uaaauuucaacccgaucgccau

SEQ ID NO: 1868100 - RNA, 23 nt, Salmonella typhimurium LT2
uaaauuuccucuugucaggcaaa

SEQ ID NO: 1868101 - RNA, 18 nt, Salmonella typhimurium LT2
uaaauuuccgcagccaga

SEQ ID NO: 1868102 - RNA, 17 nt, Salmonella typhimurium LT2
uaaauuuccgcagccag

SEQ ID NO: 1868103 - RNA, 15 nt, Salmonella typhimurium LT2
uaacaaaugaagcaa

SEQ ID NO: 1868104 - RNA, 23 nt, Salmonella typhimurium LT2
uaaaugguacuuuucauccacag

SEQ ID NO: 1868105 - RNA, 15 nt, Salmonella typhimurium LT2
uaaaucaauacaggc

SEQ ID NO: 1868106 - RNA, 15 nt, Salmonella typhimurium LT2
uaaaucaauuuuaau

SEQ ID NO: 1868107 - RNA, 13 nt, Salmonella typhimurium LT2
uaaaucaaccugc

SEQ ID NO: 1868108 - RNA, 21 nt, Salmonella typhimurium LT2
uaaaucaacuuuuuuaccauu

SEQ ID NO: 1868109 - RNA, 21 nt, Salmonella typhimurium LT2
uaaaucugaaauaaaagcaau

SEQ ID NO: 1868110 - RNA, 18 nt, Salmonella typhimurium LT2
uaggccugguaagcguag

SEQ ID NO: 1868111 - RNA, 14 nt, Salmonella typhimurium LT2
uaggcgacaggcgu

SEQ ID NO: 1868112 - RNA, 22 nt, Salmonella typhimurium LT2
uaggcagagaaaugcgccugca

SEQ ID NO: 1868113 - RNA, 15 nt, Salmonella typhimurium LT2
uaggcacuuuccaga

SEQ ID NO: 1868114 - RNA, 21 nt, Salmonella typhimurium LT2
uaggccagccgacgcucuucc

SEQ ID NO: 1868115 - RNA, 22 nt, Salmonella typhimurium LT2
uaggccagcguuaccucuuucg

SEQ ID NO: 1868116 - RNA, 22 nt, Salmonella typhimurium LT2
uaggcguaaagauuagaauagc

SEQ ID NO: 1868117 - RNA, 18 nt, Salmonella typhimurium LT2
uaggcuauaaaaaucauc

SEQ ID NO: 1868118 - RNA, 17 nt, Salmonella typhimurium LT2
uaggcuuuugguucaaa

SEQ ID NO: 1868119 - RNA, 14 nt, Salmonella typhimurium LT2
uaguaucauauuuu

SEQ ID NO: 1868120 - RNA, 12 nt, Salmonella typhimurium LT2
uaggucagcgau

SEQ ID NO: 1868121 - RNA, 14 nt, Salmonella typhimurium LT2
uagguauccagcag

SEQ ID NO: 1868122 - RNA, 13 nt, Salmonella typhimurium LT2
uaggggaaaacau

SEQ ID NO: 1868123 - RNA, 14 nt, Salmonella typhimurium LT2
uaggggcaucggag

SEQ ID NO: 1868124 - RNA, 18 nt, Salmonella typhimurium LT2
uaguuaaaggugguguua

SEQ ID NO: 1868125 - RNA, 21 nt, Salmonella typhimurium LT2
uaguuaacgccguuaccagca

SEQ ID NO: 1868126 - RNA, 11 nt, Salmonella typhimurium LT2
uaguuaaaaaa

SEQ ID NO: 1868127 - RNA, 15 nt, Salmonella typhimurium LT2
uagugugcugauugu

SEQ ID NO: 1868128 - RNA, 12 nt, Salmonella typhimurium LT2
uaguuguuuuau

SEQ ID NO: 1868129 - RNA, 13 nt, Salmonella typhimurium LT2
uagucaaauugaa

SEQ ID NO: 1868130 - RNA, 16 nt, Salmonella typhimurium LT2
uagucaaacccuuccg

SEQ ID NO: 1868131 - RNA, 16 nt, Salmonella typhimurium LT2
uagucauugacagcaa

SEQ ID NO: 1868132 - RNA, 17 nt, Salmonella typhimurium LT2
uagucauugacagcaag

SEQ ID NO: 1868133 - RNA, 13 nt, Salmonella typhimurium LT2
uaguccagcagcc

SEQ ID NO: 1868134 - RNA, 18 nt, Salmonella typhimurium LT2
uaguccgggugcaaaccc

SEQ ID NO: 1868135 - RNA, 15 nt, Salmonella typhimurium LT2
uagugcgauaugugg

SEQ ID NO: 1868136 - RNA, 22 nt, Salmonella typhimurium LT2
uaguguccacuuaaauuuugau

SEQ ID NO: 1868137 - RNA, 15 nt, Salmonella typhimurium LT2
uagugucuaauuuaa

SEQ ID NO: 1868138 - RNA, 18 nt, Salmonella typhimurium LT2
uauaaaaauagcuggcug

SEQ ID NO: 1868139 - RNA, 15 nt, Salmonella typhimurium LT2
uauaaaacauaaaga

SEQ ID NO: 1868140 - RNA, 21 nt, Salmonella typhimurium LT2
uauaaaacuucgauaauaaaa

SEQ ID NO: 1868141 - RNA, 14 nt, Salmonella typhimurium LT2
uauaaacucagcaa

SEQ ID NO: 1868142 - RNA, 15 nt, Salmonella typhimurium LT2
uauaaaacuacaaca

SEQ ID NO: 1868143 - RNA, 11 nt, Salmonella typhimurium LT2
uauaaaccuga

SEQ ID NO: 1868144 - RNA, 20 nt, Salmonella typhimurium LT2
uauaaaaaaugguuuuauuu

SEQ ID NO: 1868145 - RNA, 23 nt, Salmonella typhimurium LT2
uaguuuccgccgcgguauucaua

SEQ ID NO: 1868146 - RNA, 18 nt, Salmonella typhimurium LT2
uaguuucuauuaaaucag

SEQ ID NO: 1868147 - RNA, 19 nt, Salmonella typhimurium LT2
uaguuucuauuaaaucaga

SEQ ID NO: 1868148 - RNA, 16 nt, Salmonella typhimurium LT2
uaguuucuauuaaauc

SEQ ID NO: 1868149 - RNA, 20 nt, Salmonella typhimurium LT2
uaguuuuaaccuucuacccc

SEQ ID NO: 1868150 - RNA, 14 nt, Salmonella typhimurium LT2
uaguuugcauaacc

SEQ ID NO: 1868151 - RNA, 15 nt, Salmonella typhimurium LT2
uauccaccgccagac

SEQ ID NO: 1868152 - RNA, 17 nt, Salmonella typhimurium LT2
uauccaauaauaagaau

SEQ ID NO: 1868153 - RNA, 17 nt, Salmonella typhimurium LT2
uauccaguuuuuuacuu

SEQ ID NO: 1868154 - RNA, 16 nt, Salmonella typhimurium LT2
uauccauaaacuggcg

SEQ ID NO: 1868155 - RNA, 18 nt, Salmonella typhimurium LT2
uaucauuuugauucaguu

SEQ ID NO: 1868156 - RNA, 19 nt, Salmonella typhimurium LT2
uaucauuuuuguuaauucu

SEQ ID NO: 1868157 - RNA, 23 nt, Salmonella typhimurium LT2
uaucaggcugagcgacgguuuua

SEQ ID NO: 1868158 - RNA, 23 nt, Salmonella typhimurium LT2
uaucaggguuauuuccgcuggcc

SEQ ID NO: 1868159 - RNA, 18 nt, Salmonella typhimurium LT2
uaucaggccgacaaauga

SEQ ID NO: 1868160 - RNA, 17 nt, Salmonella typhimurium LT2
uaucaguuaugacagac

SEQ ID NO: 1868161 - RNA, 14 nt, Salmonella typhimurium LT2
uaucauaaaaggcu

SEQ ID NO: 1868162 - RNA, 20 nt, Salmonella typhimurium LT2
uaucaucuugcuuaagccag

SEQ ID NO: 1868163 - RNA, 17 nt, Salmonella typhimurium LT2
uaucaaucaccucuucc

SEQ ID NO: 1868164 - RNA, 24 nt, Salmonella typhimurium LT2
uaucaaugcgacagcggcaaggca

SEQ ID NO: 1868165 - RNA, 19 nt, Salmonella typhimurium LT2
uaucaaaccaguuuuucau

SEQ ID NO: 1868166 - RNA, 17 nt, Salmonella typhimurium LT2
uaucaaacugaaaauca

SEQ ID NO: 1868167 - RNA, 14 nt, Salmonella typhimurium LT2
uaucaaauacgcua

SEQ ID NO: 1868168 - RNA, 13 nt, Salmonella typhimurium LT2
uauauuuuucccu

SEQ ID NO: 1868169 - RNA, 16 nt, Salmonella typhimurium LT2
uauauucuuuguuuaa

SEQ ID NO: 1868170 - RNA, 20 nt, Salmonella typhimurium LT2
uauauucuuuguuuaaaaau

SEQ ID NO: 1868171 - RNA, 15 nt, Salmonella typhimurium LT2
uauauucaugauagu

SEQ ID NO: 1868172 - RNA, 13 nt, Salmonella typhimurium LT2
uauauucagaauu

SEQ ID NO: 1868173 - RNA, 13 nt, Salmonella typhimurium LT2
uauaucaggcaaa

SEQ ID NO: 1868174 - RNA, 19 nt, Salmonella typhimurium LT2
uauaguccugaugaaaaac

SEQ ID NO: 1868175 - RNA, 15 nt, Salmonella typhimurium LT2
uauagugaagauggu

SEQ ID NO: 1868176 - RNA, 22 nt, Salmonella typhimurium LT2
uauauacucccccuaacucuag

SEQ ID NO: 1868177 - RNA, 21 nt, Salmonella typhimurium LT2
uauagacgccggucaugccau

SEQ ID NO: 1868178 - RNA, 12 nt, Salmonella typhimurium LT2
uauagaucaggc

SEQ ID NO: 1868179 - RNA, 13 nt, Salmonella typhimurium LT2
uauagccaggcag

SEQ ID NO: 1868180 - RNA, 22 nt, Salmonella typhimurium LT2
uauagcucagcgcggcagccgg

SEQ ID NO: 1868181 - RNA, 14 nt, Salmonella typhimurium LT2
uauacuggaagcua

SEQ ID NO: 1868182 - RNA, 13 nt, Salmonella typhimurium LT2
uauacugugacga

SEQ ID NO: 1868183 - RNA, 12 nt, Salmonella typhimurium LT2
uauacucaaaaa

SEQ ID NO: 1868184 - RNA, 21 nt, Salmonella typhimurium LT2
uauaccauaaaugaaaccuca

SEQ ID NO: 1868185 - RNA, 18 nt, Salmonella typhimurium LT2
uauacccgcguuuucuca

SEQ ID NO: 1868186 - RNA, 20 nt, Salmonella typhimurium LT2
uauacaucugauuaccgguu

SEQ ID NO: 1868187 - RNA, 15 nt, Salmonella typhimurium LT2
uauacaucgcuuucc

SEQ ID NO: 1868188 - RNA, 17 nt, Salmonella typhimurium LT2
uauacaucgcuuuccag

SEQ ID NO: 1868189 - RNA, 16 nt, Salmonella typhimurium LT2
uauacauacauacaua

SEQ ID NO: 1868190 - RNA, 23 nt, Salmonella typhimurium LT2
uauaacuaaacucaucuuuauuc

SEQ ID NO: 1868191 - RNA, 20 nt, Salmonella typhimurium LT2
uauaacuaaacucaucuuua

SEQ ID NO: 1868192 - RNA, 23 nt, Salmonella typhimurium LT2
uauaacgugacugucauuucuca

SEQ ID NO: 1868193 - RNA, 17 nt, Salmonella typhimurium LT2
uauacaguaaaacgcca

SEQ ID NO: 1868194 - RNA, 21 nt, Salmonella typhimurium LT2
uauacaguaaaacgccaagaa

SEQ ID NO: 1868195 - RNA, 12 nt, Salmonella typhimurium LT2
uauacagcaccu

SEQ ID NO: 1868196 - RNA, 15 nt, Salmonella typhimurium LT2
uauacagcaccugcu

SEQ ID NO: 1868197 - RNA, 21 nt, Salmonella typhimurium LT2
uagcggcguuuauauaaaaau

SEQ ID NO: 1868198 - RNA, 18 nt, Salmonella typhimurium LT2
uagcgggcaaugccacca

SEQ ID NO: 1868199 - RNA, 15 nt, Salmonella typhimurium LT2
uagcggcucaggaag

SEQ ID NO: 1868200 - RNA, 21 nt, Salmonella typhimurium LT2
uagcggcagccaugcuauuca

SEQ ID NO: 1868201 - RNA, 23 nt, Salmonella typhimurium LT2
uagcgggcaaugccaccagcgcc

SEQ ID NO: 1868202 - RNA, 16 nt, Salmonella typhimurium LT2
uagcggguucuuucuu

SEQ ID NO: 1868203 - RNA, 21 nt, Salmonella typhimurium LT2
uagcgccuucaggcaucagau

SEQ ID NO: 1868204 - RNA, 15 nt, Salmonella typhimurium LT2
uagcgcgcuuccugc

SEQ ID NO: 1868205 - RNA, 22 nt, Salmonella typhimurium LT2
uagcgccuccccuaaucgagga

SEQ ID NO: 1868206 - RNA, 17 nt, Salmonella typhimurium LT2
uagcgcuuuccaguccc

SEQ ID NO: 1868207 - RNA, 21 nt, Salmonella typhimurium LT2
uagcgcugagcguagauauac

SEQ ID NO: 1868208 - RNA, 17 nt, Salmonella typhimurium LT2
uagcgcuuaucccaguc

SEQ ID NO: 1868209 - RNA, 17 nt, Salmonella typhimurium LT2
uagcgcaaaagcgcgcc

SEQ ID NO: 1868210 - RNA, 14 nt, Salmonella typhimurium LT2
uagcgccaucagac

SEQ ID NO: 1868211 - RNA, 19 nt, Salmonella typhimurium LT2
uagcgcaguaauuucuugc

SEQ ID NO: 1868212 - RNA, 19 nt, Salmonella typhimurium LT2
uagcgcaggggggaaauga

SEQ ID NO: 1868213 - RNA, 23 nt, Salmonella typhimurium LT2
uagccuuccaccgucuugcugcg

SEQ ID NO: 1868214 - RNA, 22 nt, Salmonella typhimurium LT2
uagccuuccuggggaacagaag

SEQ ID NO: 1868215 - RNA, 20 nt, Salmonella typhimurium LT2
uagcgaaacugccuaaauug

SEQ ID NO: 1868216 - RNA, 23 nt, Salmonella typhimurium LT2
uagcgaaucacauccgccagcgc

SEQ ID NO: 1868217 - RNA, 16 nt, Salmonella typhimurium LT2
uagcgaccgcgguaac

SEQ ID NO: 1868218 - RNA, 14 nt, Salmonella typhimurium LT2
uagcgaccuuuuuu

SEQ ID NO: 1868219 - RNA, 22 nt, Salmonella typhimurium LT2
uagcccagucgcacaaagcguu

SEQ ID NO: 1868220 - RNA, 12 nt, Salmonella typhimurium LT2
uagccagcauca

SEQ ID NO: 1868221 - RNA, 15 nt, Salmonella typhimurium LT2
uagccagccaaacag

SEQ ID NO: 1868222 - RNA, 20 nt, Salmonella typhimurium LT2
uagccaccggcagcgucguc

SEQ ID NO: 1868223 - RNA, 20 nt, Salmonella typhimurium LT2
uagccaguaccgaaaucauc

SEQ ID NO: 1868224 - RNA, 20 nt, Salmonella typhimurium LT2
uagccggugccgcaaucggu

SEQ ID NO: 1868225 - RNA, 21 nt, Salmonella typhimurium LT2
uagccgguaugaacgggaacc

SEQ ID NO: 1868226 - RNA, 21 nt, Salmonella typhimurium LT2
uagccuaaugacggacgcaga

SEQ ID NO: 1868227 - RNA, 14 nt, Salmonella typhimurium LT2
uagccguucuccag

SEQ ID NO: 1868228 - RNA, 15 nt, Salmonella typhimurium LT2
uagccguucaugcac

SEQ ID NO: 1868229 - RNA, 21 nt, Salmonella typhimurium LT2
uagccguccauguucggcaug

SEQ ID NO: 1868230 - RNA, 22 nt, Salmonella typhimurium LT2
uagccucggucgagcuuuugcu

SEQ ID NO: 1868231 - RNA, 19 nt, Salmonella typhimurium LT2
uagccgcgcucaagcuggg

SEQ ID NO: 1868232 - RNA, 22 nt, Salmonella typhimurium LT2
uagccgccagcuaauuuuacuu

SEQ ID NO: 1868233 - RNA, 20 nt, Salmonella typhimurium LT2
uagccgccagauccuggcug

SEQ ID NO: 1868234 - RNA, 21 nt, Salmonella typhimurium LT2
uagcccuuucauuucugccug

SEQ ID NO: 1868235 - RNA, 16 nt, Salmonella typhimurium LT2
uagcguguguuuuccu

SEQ ID NO: 1868236 - RNA, 18 nt, Salmonella typhimurium LT2
uagcguucauucccgcca

SEQ ID NO: 1868237 - RNA, 22 nt, Salmonella typhimurium LT2
uagcguucaucaauauacuccc

SEQ ID NO: 1868238 - RNA, 18 nt, Salmonella typhimurium LT2
uagcgucucaucaaaaag

SEQ ID NO: 1868239 - RNA, 14 nt, Salmonella typhimurium LT2
uagcgucuaaauuu

SEQ ID NO: 1868240 - RNA, 16 nt, Salmonella typhimurium LT2
uagcguuucgaacucu

SEQ ID NO: 1868241 - RNA, 15 nt, Salmonella typhimurium LT2
uagcuaaauuaaaaa

SEQ ID NO: 1868242 - RNA, 13 nt, Salmonella typhimurium LT2
uagcuaauggcuu

SEQ ID NO: 1868243 - RNA, 19 nt, Salmonella typhimurium LT2
uagcuauguaguaaauagg

SEQ ID NO: 1868244 - RNA, 18 nt, Salmonella typhimurium LT2
uagcuaucgaucccaaua

SEQ ID NO: 1868245 - RNA, 15 nt, Salmonella typhimurium LT2
uagcuuaaaaaaucc

SEQ ID NO: 1868246 - RNA, 23 nt, Salmonella typhimurium LT2
uagcugucccagcgucaacugcg

SEQ ID NO: 1868247 - RNA, 16 nt, Salmonella typhimurium LT2
uagcugcggcucgcca

SEQ ID NO: 1868248 - RNA, 21 nt, Salmonella typhimurium LT2
uagcugcggcuauauaaaauc

SEQ ID NO: 1868249 - RNA, 12 nt, Salmonella typhimurium LT2
uagcugaacgcu

SEQ ID NO: 1868250 - RNA, 14 nt, Salmonella typhimurium LT2
uagcucgccgcuga

SEQ ID NO: 1868251 - RNA, 17 nt, Salmonella typhimurium LT2
uagcuuuuccgcuggaa

SEQ ID NO: 1868252 - RNA, 16 nt, Salmonella typhimurium LT2
uaggaaaggcagagaa

SEQ ID NO: 1868253 - RNA, 17 nt, Salmonella typhimurium LT2
uaggaucaaccaccuuc

SEQ ID NO: 1868254 - RNA, 19 nt, Salmonella typhimurium LT2
uaggaguaaauaauuuugu

SEQ ID NO: 1868255 - RNA, 17 nt, Salmonella typhimurium LT2
uaggagagcagaagcac

SEQ ID NO: 1868256 - RNA, 20 nt, Salmonella typhimurium LT2
uagccaaagcgguaauuaau

SEQ ID NO: 1868257 - RNA, 15 nt, Salmonella typhimurium LT2
uagccaacacaucag

SEQ ID NO: 1868258 - RNA, 23 nt, Salmonella typhimurium LT2
uagcauuuccgcaucguuaucau

SEQ ID NO: 1868259 - RNA, 17 nt, Salmonella typhimurium LT2
uagcaucaggacauggu

SEQ ID NO: 1868260 - RNA, 19 nt, Salmonella typhimurium LT2
uagcagcauaaacaucagc

SEQ ID NO: 1868261 - RNA, 15 nt, Salmonella typhimurium LT2
uagcacuuuaaacac

SEQ ID NO: 1868262 - RNA, 21 nt, Salmonella typhimurium LT2
uagcauaaaugcgaugaacau

SEQ ID NO: 1868263 - RNA, 16 nt, Salmonella typhimurium LT2
uagcauaagcacagau

SEQ ID NO: 1868264 - RNA, 23 nt, Salmonella typhimurium LT2
uagcaaaggcuaccggacaaaca

SEQ ID NO: 1868265 - RNA, 20 nt, Salmonella typhimurium LT2
uagcaacacagacuuugcac

SEQ ID NO: 1868266 - RNA, 12 nt, Salmonella typhimurium LT2
uagcaaaucauc

SEQ ID NO: 1868267 - RNA, 16 nt, Salmonella typhimurium LT2
uagcaaaucaucgcca

SEQ ID NO: 1868268 - RNA, 22 nt, Salmonella typhimurium LT2
uagcaaaucaucgccaugacca

SEQ ID NO: 1868269 - RNA, 14 nt, Salmonella typhimurium LT2
uagcaaacuacuuu

SEQ ID NO: 1868270 - RNA, 13 nt, Salmonella typhimurium LT2
uagcaaugaagca

SEQ ID NO: 1868271 - RNA, 15 nt, Salmonella typhimurium LT2
uagcaaugaagcaag

SEQ ID NO: 1868272 - RNA, 12 nt, Salmonella typhimurium LT2
uagcaccagacc

SEQ ID NO: 1868273 - RNA, 15 nt, Salmonella typhimurium LT2
uagcacccaggaugg

SEQ ID NO: 1868274 - RNA, 17 nt, Salmonella typhimurium LT2
uagauauaguuuuucaa

SEQ ID NO: 1868275 - RNA, 17 nt, Salmonella typhimurium LT2
uagauaugaaagaagga

SEQ ID NO: 1868276 - RNA, 15 nt, Salmonella typhimurium LT2
uagaugaaugacugu

SEQ ID NO: 1868277 - RNA, 19 nt, Salmonella typhimurium LT2
uagaugaaugacuguccac

SEQ ID NO: 1868278 - RNA, 19 nt, Salmonella typhimurium LT2
uagauucuaacauaaugaa

SEQ ID NO: 1868279 - RNA, 17 nt, Salmonella typhimurium LT2
uagauucaaccagugca

SEQ ID NO: 1868280 - RNA, 18 nt, Salmonella typhimurium LT2
uagagcaaucuggcagua

SEQ ID NO: 1868281 - RNA, 19 nt, Salmonella typhimurium LT2
uagagcaaucuggcaguau

SEQ ID NO: 1868282 - RNA, 16 nt, Salmonella typhimurium LT2
uagagagaaucggguc

SEQ ID NO: 1868283 - RNA, 15 nt, Salmonella typhimurium LT2
uagagugcuucuuca

SEQ ID NO: 1868284 - RNA, 16 nt, Salmonella typhimurium LT2
uagauaccuacuuuau

SEQ ID NO: 1868285 - RNA, 16 nt, Salmonella typhimurium LT2
uaccaccugccaaagc

SEQ ID NO: 1868286 - RNA, 18 nt, Salmonella typhimurium LT2
uaccacgccgcacacagc

SEQ ID NO: 1868287 - RNA, 19 nt, Salmonella typhimurium LT2
uaccgccguuucguugcca

SEQ ID NO: 1868288 - RNA, 23 nt, Salmonella typhimurium LT2
uaccggcaggugauggcggcuug

SEQ ID NO: 1868289 - RNA, 15 nt, Salmonella typhimurium LT2
uaccgcuaaaauacc

SEQ ID NO: 1868290 - RNA, 14 nt, Salmonella typhimurium LT2
uaccacuaauuuaa

SEQ ID NO: 1868291 - RNA, 13 nt, Salmonella typhimurium LT2
uaccuauuuuaaa

SEQ ID NO: 1868292 - RNA, 22 nt, Salmonella typhimurium LT2
uaccuauuuuaaauucccagcg

SEQ ID NO: 1868293 - RNA, 17 nt, Salmonella typhimurium LT2
uaccuaccagcgcgcca

SEQ ID NO: 1868294 - RNA, 14 nt, Salmonella typhimurium LT2
uaccuguuuaucug

SEQ ID NO: 1868295 - RNA, 18 nt, Salmonella typhimurium LT2
uaccugcgcaaucaugac

SEQ ID NO: 1868296 - RNA, 23 nt, Salmonella typhimurium LT2
uaccuggaauagcgugggcagac

SEQ ID NO: 1868297 - RNA, 17 nt, Salmonella typhimurium LT2
uaccuggcuugauguag

SEQ ID NO: 1868298 - RNA, 19 nt, Salmonella typhimurium LT2
uaccugguauuauugucuu

SEQ ID NO: 1868299 - RNA, 17 nt, Salmonella typhimurium LT2
uaccugagccucuaaau

SEQ ID NO: 1868300 - RNA, 14 nt, Salmonella typhimurium LT2
uaccugauaaaacu

SEQ ID NO: 1868301 - RNA, 22 nt, Salmonella typhimurium LT2
uaccugcacuuuaagcggcagc

SEQ ID NO: 1868302 - RNA, 21 nt, Salmonella typhimurium LT2
uaccugcaaaaacgccagacc

SEQ ID NO: 1868303 - RNA, 20 nt, Salmonella typhimurium LT2
uaccuccucucuuccuccug

SEQ ID NO: 1868304 - RNA, 23 nt, Salmonella typhimurium LT2
uaccuucuucacuaaaaacaggc

SEQ ID NO: 1868305 - RNA, 14 nt, Salmonella typhimurium LT2
uaccuuguucuucc

SEQ ID NO: 1868306 - RNA, 16 nt, Salmonella typhimurium LT2
uaccuuguucuuccau

SEQ ID NO: 1868307 - RNA, 15 nt, Salmonella typhimurium LT2
uaccuucacaaaaag

SEQ ID NO: 1868308 - RNA, 20 nt, Salmonella typhimurium LT2
uacgaacugcggcuuuuuca

SEQ ID NO: 1868309 - RNA, 21 nt, Salmonella typhimurium LT2
uacgaacugcggcuuuuucac

SEQ ID NO: 1868310 - RNA, 23 nt, Salmonella typhimurium LT2
uaccuuuuccggcggcaguccca

SEQ ID NO: 1868311 - RNA, 15 nt, Salmonella typhimurium LT2
uaccuuuaucuugac

SEQ ID NO: 1868312 - RNA, 15 nt, Salmonella typhimurium LT2
uacucagggcgaaaa

SEQ ID NO: 1868313 - RNA, 22 nt, Salmonella typhimurium LT2
uacucagggcgaaaaugaucac

SEQ ID NO: 1868314 - RNA, 23 nt, Salmonella typhimurium LT2
uacucauccauuuccguuuucag

SEQ ID NO: 1868315 - RNA, 14 nt, Salmonella typhimurium LT2
uacuccacaguuca

SEQ ID NO: 1868316 - RNA, 11 nt, Salmonella typhimurium LT2
uacuauuuccu

SEQ ID NO: 1868317 - RNA, 14 nt, Salmonella typhimurium LT2
uacucaacaucauu

SEQ ID NO: 1868318 - RNA, 18 nt, Salmonella typhimurium LT2
uacuauaacgcgcugcug

SEQ ID NO: 1868319 - RNA, 19 nt, Salmonella typhimurium LT2
uacucacgacuuucaccag

SEQ ID NO: 1868320 - RNA, 20 nt, Salmonella typhimurium LT2
uacucagcacauucagagcg

SEQ ID NO: 1868321 - RNA, 12 nt, Salmonella typhimurium LT2
uacguuuauucu

SEQ ID NO: 1868322 - RNA, 13 nt, Salmonella typhimurium LT2
uacguuccagcag

SEQ ID NO: 1868323 - RNA, 23 nt, Salmonella typhimurium LT2
uacguucccggggauuugcugcg

SEQ ID NO: 1868324 - RNA, 13 nt, Salmonella typhimurium LT2
uacguucaaauug

SEQ ID NO: 1868325 - RNA, 22 nt, Salmonella typhimurium LT2
uacguucaacgggaaaaaauua

SEQ ID NO: 1868326 - RNA, 16 nt, Salmonella typhimurium LT2
uacuaucuucaaaacc

SEQ ID NO: 1868327 - RNA, 14 nt, Salmonella typhimurium LT2
uacuauaggaucug

SEQ ID NO: 1868328 - RNA, 20 nt, Salmonella typhimurium LT2
uacuauacccgcguuuucuc

SEQ ID NO: 1868329 - RNA, 13 nt, Salmonella typhimurium LT2
uacuaaaaguaaa

SEQ ID NO: 1868330 - RNA, 16 nt, Salmonella typhimurium LT2
uacuaaaaguaaauaa

SEQ ID NO: 1868331 - RNA, 15 nt, Salmonella typhimurium LT2
uacggaaaaaauacu

SEQ ID NO: 1868332 - RNA, 21 nt, Salmonella typhimurium LT2
uacgcuucggcuccagcgccu

SEQ ID NO: 1868333 - RNA, 14 nt, Salmonella typhimurium LT2
uacgcugcaaaaag

SEQ ID NO: 1868334 - RNA, 12 nt, Salmonella typhimurium LT2
uacgauguauca

SEQ ID NO: 1868335 - RNA, 16 nt, Salmonella typhimurium LT2
uacgaucgccaccgca

SEQ ID NO: 1868336 - RNA, 19 nt, Salmonella typhimurium LT2
uacgaacgcgaaggccagc

SEQ ID NO: 1868337 - RNA, 18 nt, Salmonella typhimurium LT2
uacgaaguuuaauucauu

SEQ ID NO: 1868338 - RNA, 21 nt, Salmonella typhimurium LT2
uacggauaccguccaccagca

SEQ ID NO: 1868339 - RNA, 20 nt, Salmonella typhimurium LT2
uacggacgccagauaaucac

SEQ ID NO: 1868340 - RNA, 20 nt, Salmonella typhimurium LT2
uacgggcuuuugcgccgaaa

SEQ ID NO: 1868341 - RNA, 11 nt, Salmonella typhimurium LT2
uacggcaggcc

SEQ ID NO: 1868342 - RNA, 14 nt, Salmonella typhimurium LT2
uacgguacugccca

SEQ ID NO: 1868343 - RNA, 21 nt, Salmonella typhimurium LT2
uacgguccguuuucgccccca

SEQ ID NO: 1868344 - RNA, 19 nt, Salmonella typhimurium LT2
uacggucgacaccagcgau

SEQ ID NO: 1868345 - RNA, 14 nt, Salmonella typhimurium LT2
uagaacccaaagcc

SEQ ID NO: 1868346 - RNA, 16 nt, Salmonella typhimurium LT2
uagaacggaaguugca

SEQ ID NO: 1868347 - RNA, 19 nt, Salmonella typhimurium LT2
uagaagcucaugugcagca

SEQ ID NO: 1868348 - RNA, 17 nt, Salmonella typhimurium LT2
uagaacuaucugaaagu

SEQ ID NO: 1868349 - RNA, 15 nt, Salmonella typhimurium LT2
uagaacuuccaacua

SEQ ID NO: 1868350 - RNA, 16 nt, Salmonella typhimurium LT2
uagaacuuccaacuaa

SEQ ID NO: 1868351 - RNA, 21 nt, Salmonella typhimurium LT2
uagaccacgccaucaacagcg

SEQ ID NO: 1868352 - RNA, 16 nt, Salmonella typhimurium LT2
uagaccagcggcccgc

SEQ ID NO: 1868353 - RNA, 21 nt, Salmonella typhimurium LT2
uagacaauugcugcguaaccg

SEQ ID NO: 1868354 - RNA, 20 nt, Salmonella typhimurium LT2
uagacaucaaaauuaccuuu

SEQ ID NO: 1868355 - RNA, 13 nt, Salmonella typhimurium LT2
uagacacaaaugc

SEQ ID NO: 1868356 - RNA, 17 nt, Salmonella typhimurium LT2
uagacgccggucaugcc

SEQ ID NO: 1868357 - RNA, 22 nt, Salmonella typhimurium LT2
uagacgacaucuuuuccugaag

SEQ ID NO: 1868358 - RNA, 12 nt, Salmonella typhimurium LT2
uagacgagcgaa

SEQ ID NO: 1868359 - RNA, 13 nt, Salmonella typhimurium LT2
uagacgagcgaaa

SEQ ID NO: 1868360 - RNA, 21 nt, Salmonella typhimurium LT2
uagacuggcgccgucacguuc

SEQ ID NO: 1868361 - RNA, 19 nt, Salmonella typhimurium LT2
uagacuacaugccaacuuu

SEQ ID NO: 1868362 - RNA, 20 nt, Salmonella typhimurium LT2
uagacgcgcuagcuucaggu

SEQ ID NO: 1868363 - RNA, 23 nt, Salmonella typhimurium LT2
uagacgucgcguacaauugcuuc

SEQ ID NO: 1868364 - RNA, 16 nt, Salmonella typhimurium LT2
uagagaccgcuuuagc

SEQ ID NO: 1868365 - RNA, 16 nt, Salmonella typhimurium LT2
uagagaccauagacuc

SEQ ID NO: 1868366 - RNA, 21 nt, Salmonella typhimurium LT2
uagacuuuggcgcagucacag

SEQ ID NO: 1868367 - RNA, 13 nt, Salmonella typhimurium LT2
uagagaaaucaac

SEQ ID NO: 1868368 - RNA, 22 nt, Salmonella typhimurium LT2
uagaaagucuuuuguuuuucuc

SEQ ID NO: 1868369 - RNA, 23 nt, Salmonella typhimurium LT2
uagaaagucuuuuguuuuucucu

SEQ ID NO: 1868370 - RNA, 14 nt, Salmonella typhimurium LT2
uacuuuguacugua

SEQ ID NO: 1868371 - RNA, 17 nt, Salmonella typhimurium LT2
uacuuuggccuaacagu

SEQ ID NO: 1868372 - RNA, 14 nt, Salmonella typhimurium LT2
uacuuuuagaacua

SEQ ID NO: 1868373 - RNA, 19 nt, Salmonella typhimurium LT2
uacuucguagacucaggcg

SEQ ID NO: 1868374 - RNA, 18 nt, Salmonella typhimurium LT2
uacuugcugcuaugaaaa

SEQ ID NO: 1868375 - RNA, 19 nt, Salmonella typhimurium LT2
uacuuauagcuggcuuuau

SEQ ID NO: 1868376 - RNA, 16 nt, Salmonella typhimurium LT2
uacuuucccccagauu

SEQ ID NO: 1868377 - RNA, 14 nt, Salmonella typhimurium LT2
uacuuucuacaaau

SEQ ID NO: 1868378 - RNA, 12 nt, Salmonella typhimurium LT2
uacuuucuccau

SEQ ID NO: 1868379 - RNA, 21 nt, Salmonella typhimurium LT2
uacuggugcccgcaaaaccuu

SEQ ID NO: 1868380 - RNA, 18 nt, Salmonella typhimurium LT2
uacuuaauucugcugccu

SEQ ID NO: 1868381 - RNA, 18 nt, Salmonella typhimurium LT2
uaauugcuuuuuuccaca

SEQ ID NO: 1868382 - RNA, 16 nt, Salmonella typhimurium LT2
uaauugcugaagauaa

SEQ ID NO: 1868383 - RNA, 21 nt, Salmonella typhimurium LT2
uaauugcuuugcaauguucaa

SEQ ID NO: 1868384 - RNA, 23 nt, Salmonella typhimurium LT2
uaauuuccagugccaguuaagca

SEQ ID NO: 1868385 - RNA, 17 nt, Salmonella typhimurium LT2
uaauuuauauugugccu

SEQ ID NO: 1868386 - RNA, 18 nt, Salmonella typhimurium LT2
uaauuuaauaauaaauuu

SEQ ID NO: 1868387 - RNA, 14 nt, Salmonella typhimurium LT2
uaauuaguuuuacc

SEQ ID NO: 1868388 - RNA, 19 nt, Salmonella typhimurium LT2
uaauuaucuaccagccgau

SEQ ID NO: 1868389 - RNA, 14 nt, Salmonella typhimurium LT2
uaauucacaacuga

SEQ ID NO: 1868390 - RNA, 22 nt, Salmonella typhimurium LT2
uaauucauggccaucaacuucu

SEQ ID NO: 1868391 - RNA, 14 nt, Salmonella typhimurium LT2
uaauucaugcugua

SEQ ID NO: 1868392 - RNA, 18 nt, Salmonella typhimurium LT2
uaauggcgcgaaaacagc

SEQ ID NO: 1868393 - RNA, 19 nt, Salmonella typhimurium LT2
uaauggccuguaccgcuuc

SEQ ID NO: 1868394 - RNA, 14 nt, Salmonella typhimurium LT2
uaaugccaaaaugg

SEQ ID NO: 1868395 - RNA, 16 nt, Salmonella typhimurium LT2
uaaugccacgagaaau

SEQ ID NO: 1868396 - RNA, 14 nt, Salmonella typhimurium LT2
uaaugcuugcugcu

SEQ ID NO: 1868397 - RNA, 21 nt, Salmonella typhimurium LT2
uaauggauucucgcgccgggg

SEQ ID NO: 1868398 - RNA, 18 nt, Salmonella typhimurium LT2
uaauggcauaacgcugua

SEQ ID NO: 1868399 - RNA, 18 nt, Salmonella typhimurium LT2
uaauggccaccagcacaa

SEQ ID NO: 1868400 - RNA, 16 nt, Salmonella typhimurium LT2
uaaugcuuuccagcca

SEQ ID NO: 1868401 - RNA, 17 nt, Salmonella typhimurium LT2
uaaugcuuuaaaugccu

SEQ ID NO: 1868402 - RNA, 16 nt, Salmonella typhimurium LT2
uaaugacaaaaauuaa

SEQ ID NO: 1868403 - RNA, 16 nt, Salmonella typhimurium LT2
uaaugacauagugcaa

SEQ ID NO: 1868404 - RNA, 15 nt, Salmonella typhimurium LT2
uaaugacauccagag

SEQ ID NO: 1868405 - RNA, 15 nt, Salmonella typhimurium LT2
uaaugaauaaucucg

SEQ ID NO: 1868406 - RNA, 14 nt, Salmonella typhimurium LT2
uaaucuuuucauau

SEQ ID NO: 1868407 - RNA, 22 nt, Salmonella typhimurium LT2
uaaucugaaagacaugcaaugc

SEQ ID NO: 1868408 - RNA, 23 nt, Salmonella typhimurium LT2
uaaucucgguacgccaaaucugu

SEQ ID NO: 1868409 - RNA, 16 nt, Salmonella typhimurium LT2
uaaucguguaaucuuu

SEQ ID NO: 1868410 - RNA, 23 nt, Salmonella typhimurium LT2
uaaucggcggcgcgaccauaaug

SEQ ID NO: 1868411 - RNA, 20 nt, Salmonella typhimurium LT2
uaauccuuguccauguaaac

SEQ ID NO: 1868412 - RNA, 22 nt, Salmonella typhimurium LT2
uaauccuuguccauguaaacuc

SEQ ID NO: 1868413 - RNA, 15 nt, Salmonella typhimurium LT2
uaaucgcgagaaaau

SEQ ID NO: 1868414 - RNA, 18 nt, Salmonella typhimurium LT2
uaaucgcgagaaaauaga

SEQ ID NO: 1868415 - RNA, 18 nt, Salmonella typhimurium LT2
uaauccgugaauguccug

SEQ ID NO: 1868416 - RNA, 18 nt, Salmonella typhimurium LT2
uaauccgcugcaacuccc

SEQ ID NO: 1868417 - RNA, 19 nt, Salmonella typhimurium LT2
uaacgaggccaccaucacu

SEQ ID NO: 1868418 - RNA, 18 nt, Salmonella typhimurium LT2
uaccaauacccagcgcca

SEQ ID NO: 1868419 - RNA, 21 nt, Salmonella typhimurium LT2
uaccaauaagaacuuuaucac

SEQ ID NO: 1868420 - RNA, 16 nt, Salmonella typhimurium LT2
uaccaagucucaagag

SEQ ID NO: 1868421 - RNA, 17 nt, Salmonella typhimurium LT2
uaccaaagucaucaauu

SEQ ID NO: 1868422 - RNA, 22 nt, Salmonella typhimurium LT2
uacauuuuguauucgcagggcu

SEQ ID NO: 1868423 - RNA, 21 nt, Salmonella typhimurium LT2
uacauaucuguuuggcaaggg

SEQ ID NO: 1868424 - RNA, 17 nt, Salmonella typhimurium LT2
uacauaucauuauguca

SEQ ID NO: 1868425 - RNA, 22 nt, Salmonella typhimurium LT2
uacauaguucuggcuuugcgcc

SEQ ID NO: 1868426 - RNA, 17 nt, Salmonella typhimurium LT2
uacaggcuguccaacca

SEQ ID NO: 1868427 - RNA, 18 nt, Salmonella typhimurium LT2
uacaggcuuaacacccgg

SEQ ID NO: 1868428 - RNA, 21 nt, Salmonella typhimurium LT2
uacagccaaaucagcaggaca

SEQ ID NO: 1868429 - RNA, 17 nt, Salmonella typhimurium LT2
uacagccaaaucagcag

SEQ ID NO: 1868430 - RNA, 20 nt, Salmonella typhimurium LT2
uacagcccgccagcaccagg

SEQ ID NO: 1868431 - RNA, 14 nt, Salmonella typhimurium LT2
uacagccgaagcca

SEQ ID NO: 1868432 - RNA, 22 nt, Salmonella typhimurium LT2
uacagcgccuuuucaaaagaga

SEQ ID NO: 1868433 - RNA, 19 nt, Salmonella typhimurium LT2
uacagccuuuugagcagca

SEQ ID NO: 1868434 - RNA, 13 nt, Salmonella typhimurium LT2
uacagaugcugua

SEQ ID NO: 1868435 - RNA, 24 nt, Salmonella typhimurium LT2
uacagaugcugucuuagugaaaua

SEQ ID NO: 1868436 - RNA, 20 nt, Salmonella typhimurium LT2
uacagcaacgggacggcggc

SEQ ID NO: 1868437 - RNA, 14 nt, Salmonella typhimurium LT2
uacagcaccugcuc

SEQ ID NO: 1868438 - RNA, 23 nt, Salmonella typhimurium LT2
uacaggcaaucggccagguauug

SEQ ID NO: 1868439 - RNA, 16 nt, Salmonella typhimurium LT2
uacaggacauuugggg

SEQ ID NO: 1868440 - RNA, 15 nt, Salmonella typhimurium LT2
uacaggcguguggca

SEQ ID NO: 1868441 - RNA, 17 nt, Salmonella typhimurium LT2
uacaggcguguggcaua

SEQ ID NO: 1868442 - RNA, 17 nt, Salmonella typhimurium LT2
uacaggcaucuuccagc

SEQ ID NO: 1868443 - RNA, 13 nt, Salmonella typhimurium LT2
uacaggcaucuuc

SEQ ID NO: 1868444 - RNA, 17 nt, Salmonella typhimurium LT2
uacaggccgauauauug

SEQ ID NO: 1868445 - RNA, 21 nt, Salmonella typhimurium LT2
uacaggccgccgggucagaaa

SEQ ID NO: 1868446 - RNA, 17 nt, Salmonella typhimurium LT2
uacaggccggacaggcg

SEQ ID NO: 1868447 - RNA, 13 nt, Salmonella typhimurium LT2
uacaguuuaucug

SEQ ID NO: 1868448 - RNA, 15 nt, Salmonella typhimurium LT2
uacaguuuaucugcg

SEQ ID NO: 1868449 - RNA, 18 nt, Salmonella typhimurium LT2
uacaggggauuguuaacg

SEQ ID NO: 1868450 - RNA, 12 nt, Salmonella typhimurium LT2
uacacaucaucu

SEQ ID NO: 1868451 - RNA, 16 nt, Salmonella typhimurium LT2
uacacauuuuaaacca

SEQ ID NO: 1868452 - RNA, 19 nt, Salmonella typhimurium LT2
uacacauuuuaaaccaauc

SEQ ID NO: 1868453 - RNA, 15 nt, Salmonella typhimurium LT2
uacacacucggugca

SEQ ID NO: 1868454 - RNA, 12 nt, Salmonella typhimurium LT2
uacacaccagca

SEQ ID NO: 1868455 - RNA, 22 nt, Salmonella typhimurium LT2
uacaauauugcgcgcuauguuc

SEQ ID NO: 1868456 - RNA, 17 nt, Salmonella typhimurium LT2
uacaaugcaaagaaaaa

SEQ ID NO: 1868457 - RNA, 21 nt, Salmonella typhimurium LT2
uacaaccguggcguuuucauu

SEQ ID NO: 1868458 - RNA, 22 nt, Salmonella typhimurium LT2
uacaaccguggcguuuucauua

SEQ ID NO: 1868459 - RNA, 16 nt, Salmonella typhimurium LT2
uacacuucauccuuua

SEQ ID NO: 1868460 - RNA, 21 nt, Salmonella typhimurium LT2
uacagaauccggcgcucauca

SEQ ID NO: 1868461 - RNA, 15 nt, Salmonella typhimurium LT2
uacagacagcagaug

SEQ ID NO: 1868462 - RNA, 23 nt, Salmonella typhimurium LT2
uacacgcaucgggucgcgugccg

SEQ ID NO: 1868463 - RNA, 20 nt, Salmonella typhimurium LT2
uacacgauuaaccucacgca

SEQ ID NO: 1868464 - RNA, 12 nt, Salmonella typhimurium LT2
uacaccuuugcc

SEQ ID NO: 1868465 - RNA, 17 nt, Salmonella typhimurium LT2
uacacugauaccccagc

SEQ ID NO: 1868466 - RNA, 16 nt, Salmonella typhimurium LT2
uacacuacuucuucag

SEQ ID NO: 1868467 - RNA, 18 nt, Salmonella typhimurium LT2
uacaccccuucuggagaa

SEQ ID NO: 1868468 - RNA, 13 nt, Salmonella typhimurium LT2
uacaccccacuau

SEQ ID NO: 1868469 - RNA, 16 nt, Salmonella typhimurium LT2
uacacauucaggcugg

SEQ ID NO: 1868470 - RNA, 21 nt, Salmonella typhimurium LT2
uauuucugucagcguuuuuca

SEQ ID NO: 1868471 - RNA, 19 nt, Salmonella typhimurium LT2
uauuucuguauaauuauuu

SEQ ID NO: 1868472 - RNA, 14 nt, Salmonella typhimurium LT2
uauuucugaaaaac

SEQ ID NO: 1868473 - RNA, 15 nt, Salmonella typhimurium LT2
uauuucugaaaaacc

SEQ ID NO: 1868474 - RNA, 19 nt, Salmonella typhimurium LT2
uauuuccaauguaaauuaa

SEQ ID NO: 1868475 - RNA, 17 nt, Salmonella typhimurium LT2
uauuuccaccuucucuu

SEQ ID NO: 1868476 - RNA, 17 nt, Salmonella typhimurium LT2
uauuuccauuuuucaga

SEQ ID NO: 1868477 - RNA, 22 nt, Salmonella typhimurium LT2
uauuucgacaagaagauuucuu

SEQ ID NO: 1868478 - RNA, 15 nt, Salmonella typhimurium LT2
uauuuuaaauuccca

SEQ ID NO: 1868479 - RNA, 17 nt, Salmonella typhimurium LT2
uauuuuauaaaacuaca

SEQ ID NO: 1868480 - RNA, 20 nt, Salmonella typhimurium LT2
uauuuuauaaaacuacaaca

SEQ ID NO: 1868481 - RNA, 21 nt, Salmonella typhimurium LT2
uauuuuguaggccuaaaaaua

SEQ ID NO: 1868482 - RNA, 12 nt, Salmonella typhimurium LT2
uauuuuccagaa

SEQ ID NO: 1868483 - RNA, 15 nt, Salmonella typhimurium LT2
uauuuucuaucuuuu

SEQ ID NO: 1868484 - RNA, 18 nt, Salmonella typhimurium LT2
ucaaagaaaacaucagcc

SEQ ID NO: 1868485 - RNA, 13 nt, Salmonella typhimurium LT2
ucaaagaaaacau

SEQ ID NO: 1868486 - RNA, 20 nt, Salmonella typhimurium LT2
ucaaacuuuuauaaauauag

SEQ ID NO: 1868487 - RNA, 14 nt, Salmonella typhimurium LT2
ucaaacgccugcau

SEQ ID NO: 1868488 - RNA, 17 nt, Salmonella typhimurium LT2
ucaaacgccugcaucaa

SEQ ID NO: 1868489 - RNA, 20 nt, Salmonella typhimurium LT2
ucaaacccuuccagacagcu

SEQ ID NO: 1868490 - RNA, 14 nt, Salmonella typhimurium LT2
ucaaacccuuccgc

SEQ ID NO: 1868491 - RNA, 16 nt, Salmonella typhimurium LT2
ucaaaauauaacuucu

SEQ ID NO: 1868492 - RNA, 11 nt, Salmonella typhimurium LT2
ucaaaaucaaa

SEQ ID NO: 1868493 - RNA, 18 nt, Salmonella typhimurium LT2
ucaaaauaacgcuucacc

SEQ ID NO: 1868494 - RNA, 22 nt, Salmonella typhimurium LT2
ucaaaggcgcugaacgcauaca

SEQ ID NO: 1868495 - RNA, 17 nt, Salmonella typhimurium LT2
ucaaauaccuuuucauu

SEQ ID NO: 1868496 - RNA, 17 nt, Salmonella typhimurium LT2
ucaaauccaacucaguu

SEQ ID NO: 1868497 - RNA, 23 nt, Salmonella typhimurium LT2
ucaaauccaacucaguuuccagc

SEQ ID NO: 1868498 - RNA, 14 nt, Salmonella typhimurium LT2
ucaaauccaccgcc

SEQ ID NO: 1868499 - RNA, 15 nt, Salmonella typhimurium LT2
ucaaauccaccgcca

SEQ ID NO: 1868500 - RNA, 18 nt, Salmonella typhimurium LT2
ucaaauccaccgccagca

SEQ ID NO: 1868501 - RNA, 23 nt, Salmonella typhimurium LT2
ucaaauaagacauggaguuccag

SEQ ID NO: 1868502 - RNA, 22 nt, Salmonella typhimurium LT2
ucaaauaagacauggaguucca

SEQ ID NO: 1868503 - RNA, 16 nt, Salmonella typhimurium LT2
uauuuuuauuuuagcu

SEQ ID NO: 1868504 - RNA, 12 nt, Salmonella typhimurium LT2
uauuuuuucgca

SEQ ID NO: 1868505 - RNA, 14 nt, Salmonella typhimurium LT2
ucaaaaaaaaccag

SEQ ID NO: 1868506 - RNA, 13 nt, Salmonella typhimurium LT2
uauuuuuucuuua

SEQ ID NO: 1868507 - RNA, 22 nt, Salmonella typhimurium LT2
ucaaaaaagcgacgcugucaau

SEQ ID NO: 1868508 - RNA, 11 nt, Salmonella typhimurium LT2
ucaaaaaagag

SEQ ID NO: 1868509 - RNA, 14 nt, Salmonella typhimurium LT2
ucaaaaaagagaag

SEQ ID NO: 1868510 - RNA, 13 nt, Salmonella typhimurium LT2
ucaaaaaagagaa

SEQ ID NO: 1868511 - RNA, 14 nt, Salmonella typhimurium LT2
ucaaaacgacauaa

SEQ ID NO: 1868512 - RNA, 16 nt, Salmonella typhimurium LT2
ucaaaaauaaaaaaac

SEQ ID NO: 1868513 - RNA, 19 nt, Salmonella typhimurium LT2
ucaaaaagcgcgcggcugc

SEQ ID NO: 1868514 - RNA, 21 nt, Salmonella typhimurium LT2
uauuuauuaguguuauauaau

SEQ ID NO: 1868515 - RNA, 22 nt, Salmonella typhimurium LT2
uauuucacgccgaugguugcca

SEQ ID NO: 1868516 - RNA, 22 nt, Salmonella typhimurium LT2
uauuucaucuauuauuuuucua

SEQ ID NO: 1868517 - RNA, 13 nt, Salmonella typhimurium LT2
uauuucagacuua

SEQ ID NO: 1868518 - RNA, 13 nt, Salmonella typhimurium LT2
uauuuacagguga

SEQ ID NO: 1868519 - RNA, 20 nt, Salmonella typhimurium LT2
uauuuagccguucaugcacu

SEQ ID NO: 1868520 - RNA, 14 nt, Salmonella typhimurium LT2
uauuuauauauaga

SEQ ID NO: 1868521 - RNA, 17 nt, Salmonella typhimurium LT2
uauugccugaagaacau

SEQ ID NO: 1868522 - RNA, 15 nt, Salmonella typhimurium LT2
uauugccuuauucac

SEQ ID NO: 1868523 - RNA, 16 nt, Salmonella typhimurium LT2
uauugccuuauucaca

SEQ ID NO: 1868524 - RNA, 17 nt, Salmonella typhimurium LT2
uauugcggaucagcaaa

SEQ ID NO: 1868525 - RNA, 15 nt, Salmonella typhimurium LT2
uauuguaccugccgc

SEQ ID NO: 1868526 - RNA, 14 nt, Salmonella typhimurium LT2
uauugugagaaaag

SEQ ID NO: 1868527 - RNA, 13 nt, Salmonella typhimurium LT2
uauugucaugcua

SEQ ID NO: 1868528 - RNA, 18 nt, Salmonella typhimurium LT2
uauugugcgcaagaaaag

SEQ ID NO: 1868529 - RNA, 12 nt, Salmonella typhimurium LT2
uauugagauaau

SEQ ID NO: 1868530 - RNA, 20 nt, Salmonella typhimurium LT2
uauugccacaauaucaucgu

SEQ ID NO: 1868531 - RNA, 15 nt, Salmonella typhimurium LT2
uauugagaauaaacu

SEQ ID NO: 1868532 - RNA, 15 nt, Salmonella typhimurium LT2
uauugaccaucucuu

SEQ ID NO: 1868533 - RNA, 23 nt, Salmonella typhimurium LT2
uauugacaacaaauccaaucuga

SEQ ID NO: 1868534 - RNA, 17 nt, Salmonella typhimurium LT2
uauugacgcuuucuucc

SEQ ID NO: 1868535 - RNA, 17 nt, Salmonella typhimurium LT2
aaaucgaacacauuucc

SEQ ID NO: 1868536 - RNA, 15 nt, Salmonella typhimurium LT2
uauccgccagccagc

SEQ ID NO: 1868537 - RNA, 15 nt, Salmonella typhimurium LT2
uauccgccagccagu

SEQ ID NO: 1868538 - RNA, 16 nt, Salmonella typhimurium LT2
uauccgacgcaacuca

SEQ ID NO: 1868539 - RNA, 19 nt, Salmonella typhimurium LT2
uauccauuucaucaggcag

SEQ ID NO: 1868540 - RNA, 15 nt, Salmonella typhimurium LT2
uaucccuuucaaaaa

SEQ ID NO: 1868541 - RNA, 23 nt, Salmonella typhimurium LT2
uauccaucagccaggguuuaauc

SEQ ID NO: 1868542 - RNA, 21 nt, Salmonella typhimurium LT2
uauuagcgguacucuuuuucc

SEQ ID NO: 1868543 - RNA, 17 nt, Salmonella typhimurium LT2
uauuaucggcaccaucu

SEQ ID NO: 1868544 - RNA, 17 nt, Salmonella typhimurium LT2
uauucgcgcccucauuc

SEQ ID NO: 1868545 - RNA, 16 nt, Salmonella typhimurium LT2
uauucugaaagaaaag

SEQ ID NO: 1868546 - RNA, 15 nt, Salmonella typhimurium LT2
uauucgacacaggcg

SEQ ID NO: 1868547 - RNA, 19 nt, Salmonella typhimurium LT2
uauuccagggcauuuuuuc

SEQ ID NO: 1868548 - RNA, 20 nt, Salmonella typhimurium LT2
uauuccagucgcuccaccac

SEQ ID NO: 1868549 - RNA, 17 nt, Salmonella typhimurium LT2
uauuccaucaaaagcuu

SEQ ID NO: 1868550 - RNA, 17 nt, Salmonella typhimurium LT2
uauucaucaucuugucc

SEQ ID NO: 1868551 - RNA, 20 nt, Salmonella typhimurium LT2
uauucauauuuauacaucau

SEQ ID NO: 1868552 - RNA, 12 nt, Salmonella typhimurium LT2
uauucaggugga

SEQ ID NO: 1868553 - RNA, 13 nt, Salmonella typhimurium LT2
uauucauauuaua

SEQ ID NO: 1868554 - RNA, 13 nt, Salmonella typhimurium LT2
uauucauaacgcc

SEQ ID NO: 1868555 - RNA, 21 nt, Salmonella typhimurium LT2
uauucacacgcucacccaguu

SEQ ID NO: 1868556 - RNA, 19 nt, Salmonella typhimurium LT2
uauucaagcuguuggaugc

SEQ ID NO: 1868557 - RNA, 13 nt, Salmonella typhimurium LT2
uauuauugucuuu

SEQ ID NO: 1868558 - RNA, 21 nt, Salmonella typhimurium LT2
uauucaagaacgguuuauccc

SEQ ID NO: 1868559 - RNA, 15 nt, Salmonella typhimurium LT2
ucaagauaaaaagac

SEQ ID NO: 1868560 - RNA, 18 nt, Salmonella typhimurium LT2
ucaagauaaaaagacaga

SEQ ID NO: 1868561 - RNA, 21 nt, Salmonella typhimurium LT2
ucaagaaucaauauaucaggc

SEQ ID NO: 1868562 - RNA, 22 nt, Salmonella typhimurium LT2
ucaacuggcggcucagggcaaa

SEQ ID NO: 1868563 - RNA, 17 nt, Salmonella typhimurium LT2
ucaacucucuauaauca

SEQ ID NO: 1868564 - RNA, 21 nt, Salmonella typhimurium LT2
ucaacugcgggaaguagcaaa

SEQ ID NO: 1868565 - RNA, 20 nt, Salmonella typhimurium LT2
ucaacugcucuaccaacuga

SEQ ID NO: 1868566 - RNA, 21 nt, Salmonella typhimurium LT2
ucaacugcucuaccaacugag

SEQ ID NO: 1868567 - RNA, 14 nt, Salmonella typhimurium LT2
ucaacgugaccauu

SEQ ID NO: 1868568 - RNA, 15 nt, Salmonella typhimurium LT2
ucaaaucgcggcgcu

SEQ ID NO: 1868569 - RNA, 23 nt, Salmonella typhimurium LT2
ucaaaucgcaggcauucauccgu

SEQ ID NO: 1868570 - RNA, 17 nt, Salmonella typhimurium LT2
ucaagcaacuguagaau

SEQ ID NO: 1868571 - RNA, 21 nt, Salmonella typhimurium LT2
ucaagauuuugugaccgccuu

SEQ ID NO: 1868572 - RNA, 17 nt, Salmonella typhimurium LT2
ucaagagugaacacgua

SEQ ID NO: 1868573 - RNA, 16 nt, Salmonella typhimurium LT2
ucaagaucgcgcagca

SEQ ID NO: 1868574 - RNA, 21 nt, Salmonella typhimurium LT2
ucaagaucgcgcagcaggcca

SEQ ID NO: 1868575 - RNA, 14 nt, Salmonella typhimurium LT2
ucaagcaguuccag

SEQ ID NO: 1868576 - RNA, 22 nt, Salmonella typhimurium LT2
ucaagcccauguucaugaacca

SEQ ID NO: 1868577 - RNA, 19 nt, Salmonella typhimurium LT2
ucaagcccccgcaacauug

SEQ ID NO: 1868578 - RNA, 14 nt, Salmonella typhimurium LT2
ucaagcaacuguag

SEQ ID NO: 1868579 - RNA, 14 nt, Salmonella typhimurium LT2
ucaagcgaaaaaau

SEQ ID NO: 1868580 - RNA, 21 nt, Salmonella typhimurium LT2
ucaagccgggcggcugugucc

SEQ ID NO: 1868581 - RNA, 13 nt, Salmonella typhimurium LT2
ucaagccgcaacg

SEQ ID NO: 1868582 - RNA, 22 nt, Salmonella typhimurium LT2
ucaaggcaggaaucguccgaau

SEQ ID NO: 1868583 - RNA, 15 nt, Salmonella typhimurium LT2
ucaaggcgcagaacc

SEQ ID NO: 1868584 - RNA, 22 nt, Salmonella typhimurium LT2
ucaagcuuugcguaaaaaaaca

SEQ ID NO: 1868585 - RNA, 20 nt, Salmonella typhimurium LT2
ucaagcucaccaccaccaaa

SEQ ID NO: 1868586 - RNA, 22 nt, Salmonella typhimurium LT2
ucaagcguuuccagaguacauu

SEQ ID NO: 1868587 - RNA, 22 nt, Salmonella typhimurium LT2
ucaaguagaacuuccaacuaaa

SEQ ID NO: 1868588 - RNA, 19 nt, Salmonella typhimurium LT2
ucaaucaacuccauaauuu

SEQ ID NO: 1868589 - RNA, 18 nt, Salmonella typhimurium LT2
ucaauauugaacauuuuu

SEQ ID NO: 1868590 - RNA, 10 nt, Salmonella typhimurium LT2
ucaagucccc

SEQ ID NO: 1868591 - RNA, 22 nt, Salmonella typhimurium LT2
ucaaguccccccccucgcacca

SEQ ID NO: 1868592 - RNA, 16 nt, Salmonella typhimurium LT2
ucaauauucaaugggu

SEQ ID NO: 1868593 - RNA, 17 nt, Salmonella typhimurium LT2
ucaauauucaauggguu

SEQ ID NO: 1868594 - RNA, 17 nt, Salmonella typhimurium LT2
ucaauauuaaugcugcg

SEQ ID NO: 1868595 - RNA, 22 nt, Salmonella typhimurium LT2
ucaaguuauguuauccccacuu

SEQ ID NO: 1868596 - RNA, 23 nt, Salmonella typhimurium LT2
ucaauauguuguggcaauauuuu

SEQ ID NO: 1868597 - RNA, 13 nt, Salmonella typhimurium LT2
ucaaugcccggca

SEQ ID NO: 1868598 - RNA, 22 nt, Salmonella typhimurium LT2
ucaaugcccuuaaauccggccu

SEQ ID NO: 1868599 - RNA, 16 nt, Salmonella typhimurium LT2
ucaaugcccagcgcaa

SEQ ID NO: 1868600 - RNA, 17 nt, Salmonella typhimurium LT2
ucaaucggcgauagagu

SEQ ID NO: 1868601 - RNA, 15 nt, Salmonella typhimurium LT2
ucaaucgccaccaca

SEQ ID NO: 1868602 - RNA, 16 nt, Salmonella typhimurium LT2
ucaaucgccaccacau

SEQ ID NO: 1868603 - RNA, 15 nt, Salmonella typhimurium LT2
ucaaucgccaaaucc

SEQ ID NO: 1868604 - RNA, 22 nt, Salmonella typhimurium LT2
ucaaucuggccguuugcugcuc

SEQ ID NO: 1868605 - RNA, 13 nt, Salmonella typhimurium LT2
ucacaaccuccac

SEQ ID NO: 1868606 - RNA, 18 nt, Salmonella typhimurium LT2
ucacaaccuccacgccca

SEQ ID NO: 1868607 - RNA, 16 nt, Salmonella typhimurium LT2
ucacaacgucaucccg

SEQ ID NO: 1868608 - RNA, 21 nt, Salmonella typhimurium LT2
ucacaacguaaugaucaugcu

SEQ ID NO: 1868609 - RNA, 19 nt, Salmonella typhimurium LT2
ucacaaauaucacaaaccc

SEQ ID NO: 1868610 - RNA, 16 nt, Salmonella typhimurium LT2
ucacaaauuaaaaauc

SEQ ID NO: 1868611 - RNA, 18 nt, Salmonella typhimurium LT2
ucaauuuuaauuuaauaa

SEQ ID NO: 1868612 - RNA, 12 nt, Salmonella typhimurium LT2
ucaauuuccagu

SEQ ID NO: 1868613 - RNA, 11 nt, Salmonella typhimurium LT2
ucaauuuccag

SEQ ID NO: 1868614 - RNA, 17 nt, Salmonella typhimurium LT2
ucacaaucagccacggc

SEQ ID NO: 1868615 - RNA, 17 nt, Salmonella typhimurium LT2
ucacaaucgcgccugcc

SEQ ID NO: 1868616 - RNA, 15 nt, Salmonella typhimurium LT2
ucacaagcuguuucu

SEQ ID NO: 1868617 - RNA, 20 nt, Salmonella typhimurium LT2
ucacaagcuguuucuccguu

SEQ ID NO: 1868618 - RNA, 14 nt, Salmonella typhimurium LT2
ucacaagauucacu

SEQ ID NO: 1868619 - RNA, 19 nt, Salmonella typhimurium LT2
ucacacauaagcacaccau

SEQ ID NO: 1868620 - RNA, 23 nt, Salmonella typhimurium LT2
ucacacaagucaccguuuuucau

SEQ ID NO: 1868621 - RNA, 11 nt, Salmonella typhimurium LT2
ucacaauuacg

SEQ ID NO: 1868622 - RNA, 15 nt, Salmonella typhimurium LT2
ucacaccauauccaa

SEQ ID NO: 1868623 - RNA, 16 nt, Salmonella typhimurium LT2
ucacacgcucacccag

SEQ ID NO: 1868624 - RNA, 21 nt, Salmonella typhimurium LT2
ucaccagcccuuccaccaguu

SEQ ID NO: 1868625 - RNA, 15 nt, Salmonella typhimurium LT2
ucaccauucccagcg

SEQ ID NO: 1868626 - RNA, 16 nt, Salmonella typhimurium LT2
ucacccagacugugau

SEQ ID NO: 1868627 - RNA, 15 nt, Salmonella typhimurium LT2
ucacccacuuguagc

SEQ ID NO: 1868628 - RNA, 22 nt, Salmonella typhimurium LT2
ucacccaaaaugccauauacau

SEQ ID NO: 1868629 - RNA, 19 nt, Salmonella typhimurium LT2
ucaccagcagcacaaaaau

SEQ ID NO: 1868630 - RNA, 12 nt, Salmonella typhimurium LT2
ucaccagcaccg

SEQ ID NO: 1868631 - RNA, 19 nt, Salmonella typhimurium LT2
ucaccagcaccgccagcgc

SEQ ID NO: 1868632 - RNA, 15 nt, Salmonella typhimurium LT2
ucaccgacagcaccg

SEQ ID NO: 1868633 - RNA, 19 nt, Salmonella typhimurium LT2
ucaccgccagugcauagca

SEQ ID NO: 1868634 - RNA, 21 nt, Salmonella typhimurium LT2
ucaccguauuagcaaaucuuc

SEQ ID NO: 1868635 - RNA, 18 nt, Salmonella typhimurium LT2
ucaccguccgccaggccc

SEQ ID NO: 1868636 - RNA, 18 nt, Salmonella typhimurium LT2
ucaccguggcaaaaucca

SEQ ID NO: 1868637 - RNA, 19 nt, Salmonella typhimurium LT2
ucaccguuuaaaaacauca

SEQ ID NO: 1868638 - RNA, 21 nt, Salmonella typhimurium LT2
ucaccguagcaucaucaaacg

SEQ ID NO: 1868639 - RNA, 19 nt, Salmonella typhimurium LT2
ucaccggauacccagccac

SEQ ID NO: 1868640 - RNA, 21 nt, Salmonella typhimurium LT2
ucaccgcggcaaccagcccau

SEQ ID NO: 1868641 - RNA, 11 nt, Salmonella typhimurium LT2
ucacgaccagc

SEQ ID NO: 1868642 - RNA, 23 nt, Salmonella typhimurium LT2
ucacgaccggcgaacgcuggcug

SEQ ID NO: 1868643 - RNA, 19 nt, Salmonella typhimurium LT2
ucacgauaaugaaccuuac

SEQ ID NO: 1868644 - RNA, 18 nt, Salmonella typhimurium LT2
ucacgauacuguugcagu

SEQ ID NO: 1868645 - RNA, 18 nt, Salmonella typhimurium LT2
ucacgauaguuugccgga

SEQ ID NO: 1868646 - RNA, 19 nt, Salmonella typhimurium LT2
ucacgauccgcaaauuacu

SEQ ID NO: 1868647 - RNA, 14 nt, Salmonella typhimurium LT2
ucacgauaauguuu

SEQ ID NO: 1868648 - RNA, 16 nt, Salmonella typhimurium LT2
ucacgauaccagcgug

SEQ ID NO: 1868649 - RNA, 21 nt, Salmonella typhimurium LT2
ucaccuuuacuuaauucugcu

SEQ ID NO: 1868650 - RNA, 17 nt, Salmonella typhimurium LT2
ucacgaaauaacgcacu

SEQ ID NO: 1868651 - RNA, 21 nt, Salmonella typhimurium LT2
ucacgaacgaguacguaaugc

SEQ ID NO: 1868652 - RNA, 21 nt, Salmonella typhimurium LT2
ucaccucuucgcuguuaaccu

SEQ ID NO: 1868653 - RNA, 11 nt, Salmonella typhimurium LT2
ucaccuccacg

SEQ ID NO: 1868654 - RNA, 18 nt, Salmonella typhimurium LT2
ucaccuggaugcugccug

SEQ ID NO: 1868655 - RNA, 21 nt, Salmonella typhimurium LT2
ucaccugucgcuaacgcuaca

SEQ ID NO: 1868656 - RNA, 23 nt, Salmonella typhimurium LT2
ucaccugccguaccguugccgcc

SEQ ID NO: 1868657 - RNA, 15 nt, Salmonella typhimurium LT2
ucaccugcucgcccu

SEQ ID NO: 1868658 - RNA, 20 nt, Salmonella typhimurium LT2
ucacgcagcgugaagcugcc

SEQ ID NO: 1868659 - RNA, 17 nt, Salmonella typhimurium LT2
ucacgcaacaacaggcc

SEQ ID NO: 1868660 - RNA, 22 nt, Salmonella typhimurium LT2
ucacgguacgcaucaccaggca

SEQ ID NO: 1868661 - RNA, 23 nt, Salmonella typhimurium LT2
ucacgguauucguuaccagcauc

SEQ ID NO: 1868662 - RNA, 22 nt, Salmonella typhimurium LT2
ucacgcgccgccugcacggcgu

SEQ ID NO: 1868663 - RNA, 20 nt, Salmonella typhimurium LT2
ucacgcugaaaaccgcauca

SEQ ID NO: 1868664 - RNA, 15 nt, Salmonella typhimurium LT2
ucacgcucccggaac

SEQ ID NO: 1868665 - RNA, 12 nt, Salmonella typhimurium LT2
ucacuaauuuga

SEQ ID NO: 1868666 - RNA, 18 nt, Salmonella typhimurium LT2
ucacuaauccccauuuuu

SEQ ID NO: 1868667 - RNA, 16 nt, Salmonella typhimurium LT2
ucacgguucgcaauca

SEQ ID NO: 1868668 - RNA, 16 nt, Salmonella typhimurium LT2
ucacguacaaacgcuu

SEQ ID NO: 1868669 - RNA, 20 nt, Salmonella typhimurium LT2
ucacguacaaacgcuucuau

SEQ ID NO: 1868670 - RNA, 19 nt, Salmonella typhimurium LT2
ucacguaccauauucaacu

SEQ ID NO: 1868671 - RNA, 17 nt, Salmonella typhimurium LT2
ucacuccuaagagaaaa

SEQ ID NO: 1868672 - RNA, 22 nt, Salmonella typhimurium LT2
ucacuccaggcguuuaugagau

SEQ ID NO: 1868673 - RNA, 18 nt, Salmonella typhimurium LT2
ucacuccuuagauuaauc

SEQ ID NO: 1868674 - RNA, 19 nt, Salmonella typhimurium LT2
ucacuauucuuaucauuua

SEQ ID NO: 1868675 - RNA, 20 nt, Salmonella typhimurium LT2
ucacuacuaaauccuugagu

SEQ ID NO: 1868676 - RNA, 16 nt, Salmonella typhimurium LT2
ucauaaucgcgauacu

SEQ ID NO: 1868677 - RNA, 20 nt, Salmonella typhimurium LT2
ucauaauuucguuuuaccca

SEQ ID NO: 1868678 - RNA, 14 nt, Salmonella typhimurium LT2
ucauaccgccgccc

SEQ ID NO: 1868679 - RNA, 13 nt, Salmonella typhimurium LT2
ucauaccaugauu

SEQ ID NO: 1868680 - RNA, 17 nt, Salmonella typhimurium LT2
ucauacauagcaggcca

SEQ ID NO: 1868681 - RNA, 21 nt, Salmonella typhimurium LT2
ucauacagcccgcgcagaauc

SEQ ID NO: 1868682 - RNA, 22 nt, Salmonella typhimurium LT2
ucauacgcuuucugaauuuccu

SEQ ID NO: 1868683 - RNA, 22 nt, Salmonella typhimurium LT2
ucauacgaucgcgcacaugcug

SEQ ID NO: 1868684 - RNA, 14 nt, Salmonella typhimurium LT2
ucauacuauuuccu

SEQ ID NO: 1868685 - RNA, 18 nt, Salmonella typhimurium LT2
ucauacgcuuuacgcuua

SEQ ID NO: 1868686 - RNA, 13 nt, Salmonella typhimurium LT2
ucauauaaaacag

SEQ ID NO: 1868687 - RNA, 16 nt, Salmonella typhimurium LT2
ucauaguuuuccagcc

SEQ ID NO: 1868688 - RNA, 19 nt, Salmonella typhimurium LT2
ucauagcccagcgugccug

SEQ ID NO: 1868689 - RNA, 14 nt, Salmonella typhimurium LT2
ucauagacugcgcu

SEQ ID NO: 1868690 - RNA, 18 nt, Salmonella typhimurium LT2
ucauacugccaaccauca

SEQ ID NO: 1868691 - RNA, 14 nt, Salmonella typhimurium LT2
ucauacuggcgaug

SEQ ID NO: 1868692 - RNA, 23 nt, Salmonella typhimurium LT2
ucauacuggcgaugauacccuga

SEQ ID NO: 1868693 - RNA, 21 nt, Salmonella typhimurium LT2
ucaucaauggauuuauggcac

SEQ ID NO: 1868694 - RNA, 17 nt, Salmonella typhimurium LT2
ucaucaauaucuuuuug

SEQ ID NO: 1868695 - RNA, 17 nt, Salmonella typhimurium LT2
ucaucaaucaucucauu

SEQ ID NO: 1868696 - RNA, 16 nt, Salmonella typhimurium LT2
ucaucacaucccagca

SEQ ID NO: 1868697 - RNA, 20 nt, Salmonella typhimurium LT2
ucaucacaaaaucauugcgu

SEQ ID NO: 1868698 - RNA, 15 nt, Salmonella typhimurium LT2
ucaucaaacgauacc

SEQ ID NO: 1868699 - RNA, 11 nt, Salmonella typhimurium LT2
ucaucaacgcg

SEQ ID NO: 1868700 - RNA, 19 nt, Salmonella typhimurium LT2
ucauauggaagcuguuaau

SEQ ID NO: 1868701 - RNA, 21 nt, Salmonella typhimurium LT2
ucauaucccggcugacauaau

SEQ ID NO: 1868702 - RNA, 16 nt, Salmonella typhimurium LT2
ucauaucauccagccc

SEQ ID NO: 1868703 - RNA, 15 nt, Salmonella typhimurium LT2
ucauauugcgccgca

SEQ ID NO: 1868704 - RNA, 19 nt, Salmonella typhimurium LT2
ucauauuguagguuuuccu

SEQ ID NO: 1868705 - RNA, 23 nt, Salmonella typhimurium LT2
ucauauuguagguuuuccucucu

SEQ ID NO: 1868706 - RNA, 19 nt, Salmonella typhimurium LT2
ucauauuaaauuccggcuc

SEQ ID NO: 1868707 - RNA, 21 nt, Salmonella typhimurium LT2
ucauauuuucagaaaucauau

SEQ ID NO: 1868708 - RNA, 22 nt, Salmonella typhimurium LT2
ucauauuugcuggcuugcucag

SEQ ID NO: 1868709 - RNA, 16 nt, Salmonella typhimurium LT2
ucaucggccaccacau

SEQ ID NO: 1868710 - RNA, 18 nt, Salmonella typhimurium LT2
ucaucgccuuaacucuua

SEQ ID NO: 1868711 - RNA, 15 nt, Salmonella typhimurium LT2
ucaucgccuucaucc

SEQ ID NO: 1868712 - RNA, 16 nt, Salmonella typhimurium LT2
ucaucgcaaauucugu

SEQ ID NO: 1868713 - RNA, 20 nt, Salmonella typhimurium LT2
ucaucgcaggcggucagcac

SEQ ID NO: 1868714 - RNA, 20 nt, Salmonella typhimurium LT2
ucauccagucagcaauuaac

SEQ ID NO: 1868715 - RNA, 17 nt, Salmonella typhimurium LT2
ucaucccacgucgccuu

SEQ ID NO: 1868716 - RNA, 15 nt, Salmonella typhimurium LT2
ucauccccaacauca

SEQ ID NO: 1868717 - RNA, 16 nt, Salmonella typhimurium LT2
ucaucccagucaucgu

SEQ ID NO: 1868718 - RNA, 22 nt, Salmonella typhimurium LT2
ucaucccagucgucaucccagu

SEQ ID NO: 1868719 - RNA, 23 nt, Salmonella typhimurium LT2
ucaucccgguuucccgcgugaac

SEQ ID NO: 1868720 - RNA, 17 nt, Salmonella typhimurium LT2
ucaucccgcugugaucc

SEQ ID NO: 1868721 - RNA, 12 nt, Salmonella typhimurium LT2
ucauccgcuucg

SEQ ID NO: 1868722 - RNA, 11 nt, Salmonella typhimurium LT2
ucauccagcag

SEQ ID NO: 1868723 - RNA, 24 nt, Salmonella typhimurium LT2
ucauccagcgagccuuccaucgca

SEQ ID NO: 1868724 - RNA, 11 nt, Salmonella typhimurium LT2
ucauccagcaa

SEQ ID NO: 1868725 - RNA, 16 nt, Salmonella typhimurium LT2
ucauccagcaaaauaa

SEQ ID NO: 1868726 - RNA, 19 nt, Salmonella typhimurium LT2
ucaucauugcgccaagacc

SEQ ID NO: 1868727 - RNA, 14 nt, Salmonella typhimurium LT2
ucauccagaaaaug

SEQ ID NO: 1868728 - RNA, 22 nt, Salmonella typhimurium LT2
ucaucaugcugcugauccuguu

SEQ ID NO: 1868729 - RNA, 18 nt, Salmonella typhimurium LT2
ucaucaugacacuuuauu

SEQ ID NO: 1868730 - RNA, 22 nt, Salmonella typhimurium LT2
ucaucaucuuguccucaucauu

SEQ ID NO: 1868731 - RNA, 18 nt, Salmonella typhimurium LT2
ucaucaucggcacagcca

SEQ ID NO: 1868732 - RNA, 20 nt, Salmonella typhimurium LT2
ucaucauuauauagucaaug

SEQ ID NO: 1868733 - RNA, 17 nt, Salmonella typhimurium LT2
ucaucauuaccuuuucc

SEQ ID NO: 1868734 - RNA, 21 nt, Salmonella typhimurium LT2
ucaucaugaaaaacaguaccg

SEQ ID NO: 1868735 - RNA, 19 nt, Salmonella typhimurium LT2
ucaucagcacaaaauccca

SEQ ID NO: 1868736 - RNA, 15 nt, Salmonella typhimurium LT2
ucaucagcacaaaau

SEQ ID NO: 1868737 - RNA, 15 nt, Salmonella typhimurium LT2
ucaucagcaucuuug

SEQ ID NO: 1868738 - RNA, 16 nt, Salmonella typhimurium LT2
ucaucagccagcaucg

SEQ ID NO: 1868739 - RNA, 15 nt, Salmonella typhimurium LT2
ucaucaggcaauaaa

SEQ ID NO: 1868740 - RNA, 17 nt, Salmonella typhimurium LT2
ucaucagaccgagaccc

SEQ ID NO: 1868741 - RNA, 15 nt, Salmonella typhimurium LT2
ucaucaucagcagca

SEQ ID NO: 1868742 - RNA, 15 nt, Salmonella typhimurium LT2
ucaucaggccugcaa

SEQ ID NO: 1868743 - RNA, 22 nt, Salmonella typhimurium LT2
ucauaaauguacugcaauaacc

SEQ ID NO: 1868744 - RNA, 20 nt, Salmonella typhimurium LT2
ucauaauaagcgcucaggca

SEQ ID NO: 1868745 - RNA, 22 nt, Salmonella typhimurium LT2
ucauaaaggcuuuaaagcaggc

SEQ ID NO: 1868746 - RNA, 22 nt, Salmonella typhimurium LT2
ucauaaaacccguuaaauacca

SEQ ID NO: 1868747 - RNA, 22 nt, Salmonella typhimurium LT2
ucagucccgggcuaaucgcaaa

SEQ ID NO: 1868748 - RNA, 23 nt, Salmonella typhimurium LT2
ucaguccccagcguaccacgccg

SEQ ID NO: 1868749 - RNA, 19 nt, Salmonella typhimurium LT2
ucaguccgcaaagaaccaa

SEQ ID NO: 1868750 - RNA, 12 nt, Salmonella typhimurium LT2
ucaguucagaaa

SEQ ID NO: 1868751 - RNA, 16 nt, Salmonella typhimurium LT2
ucaguucggagaucag

SEQ ID NO: 1868752 - RNA, 15 nt, Salmonella typhimurium LT2
ucauaaaaaagaaua

SEQ ID NO: 1868753 - RNA, 16 nt, Salmonella typhimurium LT2
ucaggcaaaaaaaacc

SEQ ID NO: 1868754 - RNA, 19 nt, Salmonella typhimurium LT2
ucaggaugggcuucuucac

SEQ ID NO: 1868755 - RNA, 22 nt, Salmonella typhimurium LT2
ucaggcaauaaaaaaggcagag

SEQ ID NO: 1868756 - RNA, 20 nt, Salmonella typhimurium LT2
ucaggcaauaaacaucagcc

SEQ ID NO: 1868757 - RNA, 23 nt, Salmonella typhimurium LT2
ucaggcaauaaacaucagccauu

SEQ ID NO: 1868758 - RNA, 20 nt, Salmonella typhimurium LT2
ucaggcaauacgcugccgga

SEQ ID NO: 1868759 - RNA, 18 nt, Salmonella typhimurium LT2
ucagggguccccacggga

SEQ ID NO: 1868760 - RNA, 14 nt, Salmonella typhimurium LT2
ucaguaaccagggc

SEQ ID NO: 1868761 - RNA, 23 nt, Salmonella typhimurium LT2
ucaguaccucgcauacuuccuca

SEQ ID NO: 1868762 - RNA, 18 nt, Salmonella typhimurium LT2
ucaguacagccaaaaaua

SEQ ID NO: 1868763 - RNA, 15 nt, Salmonella typhimurium LT2
ucagguuuuuuucau

SEQ ID NO: 1868764 - RNA, 21 nt, Salmonella typhimurium LT2
ucagguuuuuugugaguucau

SEQ ID NO: 1868765 - RNA, 11 nt, Salmonella typhimurium LT2
ucagguuuuuu

SEQ ID NO: 1868766 - RNA, 13 nt, Salmonella typhimurium LT2
ucagguuacgcac

SEQ ID NO: 1868767 - RNA, 19 nt, Salmonella typhimurium LT2
ucaggguuuucuaccgcag

SEQ ID NO: 1868768 - RNA, 17 nt, Salmonella typhimurium LT2
ucagguaaguguaaguu

SEQ ID NO: 1868769 - RNA, 16 nt, Salmonella typhimurium LT2
ucaggguuuucaggaa

SEQ ID NO: 1868770 - RNA, 17 nt, Salmonella typhimurium LT2
ucaggugaguaaauaaa

SEQ ID NO: 1868771 - RNA, 21 nt, Salmonella typhimurium LT2
ucagguuacgcacuacaucau

SEQ ID NO: 1868772 - RNA, 15 nt, Salmonella typhimurium LT2
ucagguuaggcgcga

SEQ ID NO: 1868773 - RNA, 16 nt, Salmonella typhimurium LT2
ucagguuguccagcag

SEQ ID NO: 1868774 - RNA, 14 nt, Salmonella typhimurium LT2
ucagcuuaauuguu

SEQ ID NO: 1868775 - RNA, 23 nt, Salmonella typhimurium LT2
ucagcugauugggauaaacacag

SEQ ID NO: 1868776 - RNA, 22 nt, Salmonella typhimurium LT2
ucagcugcugcgcuuuccaggc

SEQ ID NO: 1868777 - RNA, 24 nt, Salmonella typhimurium LT2
ucagcguguuucaucucaucaaug

SEQ ID NO: 1868778 - RNA, 23 nt, Salmonella typhimurium LT2
ucagcgugggcagccguuucuuc

SEQ ID NO: 1868779 - RNA, 18 nt, Salmonella typhimurium LT2
ucagcgcgccgcgcagca

SEQ ID NO: 1868780 - RNA, 12 nt, Salmonella typhimurium LT2
ucagcgcgcgcu

SEQ ID NO: 1868781 - RNA, 19 nt, Salmonella typhimurium LT2
ucagcgcggcagccggaac

SEQ ID NO: 1868782 - RNA, 12 nt, Salmonella typhimurium LT2
ucagcgcgcucc

SEQ ID NO: 1868783 - RNA, 23 nt, Salmonella typhimurium LT2
ucaggaauaacaucguaaaucaa

SEQ ID NO: 1868784 - RNA, 17 nt, Salmonella typhimurium LT2
ucaggaaggagcaaaca

SEQ ID NO: 1868785 - RNA, 13 nt, Salmonella typhimurium LT2
ucaggaucaauuc

SEQ ID NO: 1868786 - RNA, 18 nt, Salmonella typhimurium LT2
ucaggaaaacgcuuucca

SEQ ID NO: 1868787 - RNA, 13 nt, Salmonella typhimurium LT2
ucaggaaacuggc

SEQ ID NO: 1868788 - RNA, 13 nt, Salmonella typhimurium LT2
ucaggaaaugaac

SEQ ID NO: 1868789 - RNA, 16 nt, Salmonella typhimurium LT2
ucaggaaaugaaccag

SEQ ID NO: 1868790 - RNA, 19 nt, Salmonella typhimurium LT2
ucacugacuauccacagcg

SEQ ID NO: 1868791 - RNA, 14 nt, Salmonella typhimurium LT2
ucacucugaaaaau

SEQ ID NO: 1868792 - RNA, 22 nt, Salmonella typhimurium LT2
ucagccacggaauaucuuuuuu

SEQ ID NO: 1868793 - RNA, 20 nt, Salmonella typhimurium LT2
ucagccagcugcuggcgaug

SEQ ID NO: 1868794 - RNA, 21 nt, Salmonella typhimurium LT2
ucagccauuaaccagauuacc

SEQ ID NO: 1868795 - RNA, 22 nt, Salmonella typhimurium LT2
ucagccugaaagauuauuuuau

SEQ ID NO: 1868796 - RNA, 17 nt, Salmonella typhimurium LT2
ucagccugagcgccagc

SEQ ID NO: 1868797 - RNA, 16 nt, Salmonella typhimurium LT2
ucagccugaaagauua

SEQ ID NO: 1868798 - RNA, 14 nt, Salmonella typhimurium LT2
ucagccuuuucaua

SEQ ID NO: 1868799 - RNA, 14 nt, Salmonella typhimurium LT2
ucauuguaaaaccg

SEQ ID NO: 1868800 - RNA, 13 nt, Salmonella typhimurium LT2
ucauuucaacaua

SEQ ID NO: 1868801 - RNA, 16 nt, Salmonella typhimurium LT2
ucauuggggacgcgca

SEQ ID NO: 1868802 - RNA, 18 nt, Salmonella typhimurium LT2
ucauugggagcaaagcuc

SEQ ID NO: 1868803 - RNA, 18 nt, Salmonella typhimurium LT2
ucauugguuaauucaaaa

SEQ ID NO: 1868804 - RNA, 21 nt, Salmonella typhimurium LT2
ucauuggaagagacacgcuga

SEQ ID NO: 1868805 - RNA, 15 nt, Salmonella typhimurium LT2
ucauucugucagcaa

SEQ ID NO: 1868806 - RNA, 13 nt, Salmonella typhimurium LT2
ucauuuguuccuc

SEQ ID NO: 1868807 - RNA, 22 nt, Salmonella typhimurium LT2
ucauuuuuuaauaucaauucca

SEQ ID NO: 1868808 - RNA, 17 nt, Salmonella typhimurium LT2
ucaugguagucaaauuc

SEQ ID NO: 1868809 - RNA, 17 nt, Salmonella typhimurium LT2
ucaugguguauaaauaa

SEQ ID NO: 1868810 - RNA, 13 nt, Salmonella typhimurium LT2
ucauguauuguua

SEQ ID NO: 1868811 - RNA, 22 nt, Salmonella typhimurium LT2
ucauguacccguuucuguaaau

SEQ ID NO: 1868812 - RNA, 13 nt, Salmonella typhimurium LT2
ucauuaauauaau

SEQ ID NO: 1868813 - RNA, 14 nt, Salmonella typhimurium LT2
ucauuauucaggcc

SEQ ID NO: 1868814 - RNA, 13 nt, Salmonella typhimurium LT2
ucauuaccuuuuc

SEQ ID NO: 1868815 - RNA, 21 nt, Salmonella typhimurium LT2
ucauuacgcgcaugcaaacgu

SEQ ID NO: 1868816 - RNA, 16 nt, Salmonella typhimurium LT2
ucauuacgcuuccugc

SEQ ID NO: 1868817 - RNA, 22 nt, Salmonella typhimurium LT2
ucauuaccuacgcgauaaaaaa

SEQ ID NO: 1868818 - RNA, 12 nt, Salmonella typhimurium LT2
ucauuacaggcg

SEQ ID NO: 1868819 - RNA, 20 nt, Salmonella typhimurium LT2
ucauucgggucaaugccguc

SEQ ID NO: 1868820 - RNA, 18 nt, Salmonella typhimurium LT2
ucauucgcgaauagugca

SEQ ID NO: 1868821 - RNA, 13 nt, Salmonella typhimurium LT2
ucauucgaccaca

SEQ ID NO: 1868822 - RNA, 21 nt, Salmonella typhimurium LT2
ucauucgagaugcauaaaaaa

SEQ ID NO: 1868823 - RNA, 16 nt, Salmonella typhimurium LT2
ucaugcuggucagcaa

SEQ ID NO: 1868824 - RNA, 22 nt, Salmonella typhimurium LT2
ucaugcuggcgaugaguaaaau

SEQ ID NO: 1868825 - RNA, 15 nt, Salmonella typhimurium LT2
ucaugcugcaccgca

SEQ ID NO: 1868826 - RNA, 15 nt, Salmonella typhimurium LT2
ucaugcgggagcuug

SEQ ID NO: 1868827 - RNA, 16 nt, Salmonella typhimurium LT2
ucaugcggucuucacu

SEQ ID NO: 1868828 - RNA, 16 nt, Salmonella typhimurium LT2
ucaugcggugcaugaa

SEQ ID NO: 1868829 - RNA, 18 nt, Salmonella typhimurium LT2
ucauggaagguauucauc

SEQ ID NO: 1868830 - RNA, 14 nt, Salmonella typhimurium LT2
ucaugcuuaucgcc

SEQ ID NO: 1868831 - RNA, 16 nt, Salmonella typhimurium LT2
ucaugcuuaucgccaa

SEQ ID NO: 1868832 - RNA, 21 nt, Salmonella typhimurium LT2
ucaugcuuaucgccaaaccag

SEQ ID NO: 1868833 - RNA, 22 nt, Salmonella typhimurium LT2
ucaugccugccagcauuaaccc

SEQ ID NO: 1868834 - RNA, 17 nt, Salmonella typhimurium LT2
ucaugcgccuucugcug

SEQ ID NO: 1868835 - RNA, 22 nt, Salmonella typhimurium LT2
ucaugccuucuuugccuuuuuc

SEQ ID NO: 1868836 - RNA, 16 nt, Salmonella typhimurium LT2
ucaugcaggccggaac

SEQ ID NO: 1868837 - RNA, 18 nt, Salmonella typhimurium LT2
ucaugccacgccaucaga

SEQ ID NO: 1868838 - RNA, 23 nt, Salmonella typhimurium LT2
ucaugcagcccgcacucgcgcuu

SEQ ID NO: 1868839 - RNA, 14 nt, Salmonella typhimurium LT2
ucaugaucuuuccu

SEQ ID NO: 1868840 - RNA, 22 nt, Salmonella typhimurium LT2
ucaugaugaucuucagcccguu

SEQ ID NO: 1868841 - RNA, 23 nt, Salmonella typhimurium LT2
ucaugaucuuuccuuuuucaggc

SEQ ID NO: 1868842 - RNA, 12 nt, Salmonella typhimurium LT2
ucaugaaacucg

SEQ ID NO: 1868843 - RNA, 21 nt, Salmonella typhimurium LT2
ucaugacuuuuuucaaccuca

SEQ ID NO: 1868844 - RNA, 15 nt, Salmonella typhimurium LT2
ucaugagcuauuuca

SEQ ID NO: 1868845 - RNA, 22 nt, Salmonella typhimurium LT2
ucaugaaucgcgcgcgccaguc

SEQ ID NO: 1868846 - RNA, 23 nt, Salmonella typhimurium LT2
ucaugaaucgcgcgcgccaguca

SEQ ID NO: 1868847 - RNA, 18 nt, Salmonella typhimurium LT2
ucaugaccgguuuuucgc

SEQ ID NO: 1868848 - RNA, 14 nt, Salmonella typhimurium LT2
ucaucuaucugcuu

SEQ ID NO: 1868849 - RNA, 15 nt, Salmonella typhimurium LT2
ucaucuaucugcuuc

SEQ ID NO: 1868850 - RNA, 13 nt, Salmonella typhimurium LT2
ucaucuacacgca

SEQ ID NO: 1868851 - RNA, 13 nt, Salmonella typhimurium LT2
ucaucugacugcg

SEQ ID NO: 1868852 - RNA, 22 nt, Salmonella typhimurium LT2
ucaucuauagccugcuggguac

SEQ ID NO: 1868853 - RNA, 18 nt, Salmonella typhimurium LT2
ucaucggucaguuugccc

SEQ ID NO: 1868854 - RNA, 14 nt, Salmonella typhimurium LT2
ucaucguaccaaua

SEQ ID NO: 1868855 - RNA, 17 nt, Salmonella typhimurium LT2
ucaucgguuacuccuua

SEQ ID NO: 1868856 - RNA, 18 nt, Salmonella typhimurium LT2
ucaucgguguucacaauu

SEQ ID NO: 1868857 - RNA, 20 nt, Salmonella typhimurium LT2
ucaucggucaguuugcccca

SEQ ID NO: 1868858 - RNA, 11 nt, Salmonella typhimurium LT2
ucaucugcuuc

SEQ ID NO: 1868859 - RNA, 17 nt, Salmonella typhimurium LT2
ucaucuucacuucacaa

SEQ ID NO: 1868860 - RNA, 18 nt, Salmonella typhimurium LT2
ucaucuucaccuuuccag

SEQ ID NO: 1868861 - RNA, 15 nt, Salmonella typhimurium LT2
ucaucuucacuucac

SEQ ID NO: 1868862 - RNA, 17 nt, Salmonella typhimurium LT2
ucaucuucaccuuucca

SEQ ID NO: 1868863 - RNA, 16 nt, Salmonella typhimurium LT2
ucaucuuuauccauaa

SEQ ID NO: 1868864 - RNA, 14 nt, Salmonella typhimurium LT2
ucaucuuuuaaaau

SEQ ID NO: 1868865 - RNA, 19 nt, Salmonella typhimurium LT2
uccaccucgcgacugcuga

SEQ ID NO: 1868866 - RNA, 18 nt, Salmonella typhimurium LT2
uccaccggguccagucgc

SEQ ID NO: 1868867 - RNA, 20 nt, Salmonella typhimurium LT2
uccaccuacgcucauaaaaa

SEQ ID NO: 1868868 - RNA, 16 nt, Salmonella typhimurium LT2
uccacugagcgcgcca

SEQ ID NO: 1868869 - RNA, 17 nt, Salmonella typhimurium LT2
uccagaauacgccgccg

SEQ ID NO: 1868870 - RNA, 16 nt, Salmonella typhimurium LT2
uccacuguccagaucu

SEQ ID NO: 1868871 - RNA, 22 nt, Salmonella typhimurium LT2
uccacuguccagaucuucccag

SEQ ID NO: 1868872 - RNA, 12 nt, Salmonella typhimurium LT2
uccacuggcccc

SEQ ID NO: 1868873 - RNA, 17 nt, Salmonella typhimurium LT2
uccacugcagugucaaa

SEQ ID NO: 1868874 - RNA, 19 nt, Salmonella typhimurium LT2
uccacugcaucucuuccag

SEQ ID NO: 1868875 - RNA, 16 nt, Salmonella typhimurium LT2
uccagacaauccgcgg

SEQ ID NO: 1868876 - RNA, 17 nt, Salmonella typhimurium LT2
uccagaaugcguaaaaa

SEQ ID NO: 1868877 - RNA, 14 nt, Salmonella typhimurium LT2
uccagaccaccagc

SEQ ID NO: 1868878 - RNA, 20 nt, Salmonella typhimurium LT2
uccagacgcugacaaaucgg

SEQ ID NO: 1868879 - RNA, 15 nt, Salmonella typhimurium LT2
uccagaggcguugcc

SEQ ID NO: 1868880 - RNA, 22 nt, Salmonella typhimurium LT2
uccagaggguaauuucuuccau

SEQ ID NO: 1868881 - RNA, 22 nt, Salmonella typhimurium LT2
uccagaggaucuggacgccaau

SEQ ID NO: 1868882 - RNA, 14 nt, Salmonella typhimurium LT2
uccagacucugcgc

SEQ ID NO: 1868883 - RNA, 15 nt, Salmonella typhimurium LT2
uccagacguugcucu

SEQ ID NO: 1868884 - RNA, 18 nt, Salmonella typhimurium LT2
uccagaucuucccaguua

SEQ ID NO: 1868885 - RNA, 23 nt, Salmonella typhimurium LT2
uccagaucuucccaguuauauuu

SEQ ID NO: 1868886 - RNA, 14 nt, Salmonella typhimurium LT2
uccagaugacacua

SEQ ID NO: 1868887 - RNA, 16 nt, Salmonella typhimurium LT2
uccagaugaagcgcau

SEQ ID NO: 1868888 - RNA, 16 nt, Salmonella typhimurium LT2
uccagauagggccagg

SEQ ID NO: 1868889 - RNA, 17 nt, Salmonella typhimurium LT2
uccagauccacugcauc

SEQ ID NO: 1868890 - RNA, 18 nt, Salmonella typhimurium LT2
uccagauccacugcaucc

SEQ ID NO: 1868891 - RNA, 20 nt, Salmonella typhimurium LT2
uccagaugcgccagauucau

SEQ ID NO: 1868892 - RNA, 18 nt, Salmonella typhimurium LT2
uccagaugucaguaacag

SEQ ID NO: 1868893 - RNA, 23 nt, Salmonella typhimurium LT2
uccagaugcgugaccgcguugcc

SEQ ID NO: 1868894 - RNA, 22 nt, Salmonella typhimurium LT2
uccagauuacuaugaggauuau

SEQ ID NO: 1868895 - RNA, 17 nt, Salmonella typhimurium LT2
uccagcaaaaaaugccg

SEQ ID NO: 1868896 - RNA, 15 nt, Salmonella typhimurium LT2
uccagauugcucagg

SEQ ID NO: 1868897 - RNA, 13 nt, Salmonella typhimurium LT2
uccaccagcccau

SEQ ID NO: 1868898 - RNA, 12 nt, Salmonella typhimurium LT2
uccaccagaacc

SEQ ID NO: 1868899 - RNA, 12 nt, Salmonella typhimurium LT2
uccaccgccaga

SEQ ID NO: 1868900 - RNA, 22 nt, Salmonella typhimurium LT2
uccacagguaaaauugccgcca

SEQ ID NO: 1868901 - RNA, 15 nt, Salmonella typhimurium LT2
uccacauacugcaau

SEQ ID NO: 1868902 - RNA, 14 nt, Salmonella typhimurium LT2
uccacauuccagac

SEQ ID NO: 1868903 - RNA, 16 nt, Salmonella typhimurium LT2
uccaccaaccaggcaa

SEQ ID NO: 1868904 - RNA, 14 nt, Salmonella typhimurium LT2
uccacauugcaaug

SEQ ID NO: 1868905 - RNA, 21 nt, Salmonella typhimurium LT2
uccacauuggcuuugccauuc

SEQ ID NO: 1868906 - RNA, 12 nt, Salmonella typhimurium LT2
uccaccaccauc

SEQ ID NO: 1868907 - RNA, 22 nt, Salmonella typhimurium LT2
uccaaauggcguacuaaauagg

SEQ ID NO: 1868908 - RNA, 16 nt, Salmonella typhimurium LT2
uccacagcgaauuccg

SEQ ID NO: 1868909 - RNA, 22 nt, Salmonella typhimurium LT2
uccaggaaguaaauuauuccuu

SEQ ID NO: 1868910 - RNA, 17 nt, Salmonella typhimurium LT2
uccagcuucaucaucag

SEQ ID NO: 1868911 - RNA, 22 nt, Salmonella typhimurium LT2
uccagcuuugacgucacuguca

SEQ ID NO: 1868912 - RNA, 18 nt, Salmonella typhimurium LT2
uccaggaaacgcugcgcc

SEQ ID NO: 1868913 - RNA, 23 nt, Salmonella typhimurium LT2
uccagcugguauaggccaggcua

SEQ ID NO: 1868914 - RNA, 12 nt, Salmonella typhimurium LT2
uccagcuggcug

SEQ ID NO: 1868915 - RNA, 22 nt, Salmonella typhimurium LT2
uccagcuggguuuugucgguaa

SEQ ID NO: 1868916 - RNA, 14 nt, Salmonella typhimurium LT2
uccagucagcguua

SEQ ID NO: 1868917 - RNA, 19 nt, Salmonella typhimurium LT2
uccagucaaaaugucagua

SEQ ID NO: 1868918 - RNA, 16 nt, Salmonella typhimurium LT2
uccagucagcaauuaa

SEQ ID NO: 1868919 - RNA, 18 nt, Salmonella typhimurium LT2
uccaguaauucccggcag

SEQ ID NO: 1868920 - RNA, 22 nt, Salmonella typhimurium LT2
uccaguaauucccggcaggcgu

SEQ ID NO: 1868921 - RNA, 19 nt, Salmonella typhimurium LT2
uccaguacuuucuuuugau

SEQ ID NO: 1868922 - RNA, 17 nt, Salmonella typhimurium LT2
uccaguaguuccuggag

SEQ ID NO: 1868923 - RNA, 18 nt, Salmonella typhimurium LT2
uccaguaguuccuggaga

SEQ ID NO: 1868924 - RNA, 22 nt, Salmonella typhimurium LT2
uccaguaguuccuggagaacga

SEQ ID NO: 1868925 - RNA, 20 nt, Salmonella typhimurium LT2
uccauacacugcauaaauau

SEQ ID NO: 1868926 - RNA, 23 nt, Salmonella typhimurium LT2
uccauaaacuggcgcacaggccu

SEQ ID NO: 1868927 - RNA, 17 nt, Salmonella typhimurium LT2
uccagccgguguuaacc

SEQ ID NO: 1868928 - RNA, 23 nt, Salmonella typhimurium LT2
uccagccgcccgcgauaaaaauc

SEQ ID NO: 1868929 - RNA, 13 nt, Salmonella typhimurium LT2
uccagccagggau

SEQ ID NO: 1868930 - RNA, 23 nt, Salmonella typhimurium LT2
uccagccagcguuucuggaagua

SEQ ID NO: 1868931 - RNA, 23 nt, Salmonella typhimurium LT2
uccagccccagcgccagcugcgu

SEQ ID NO: 1868932 - RNA, 13 nt, Salmonella typhimurium LT2
uccagccccuucg

SEQ ID NO: 1868933 - RNA, 14 nt, Salmonella typhimurium LT2
uccagcguuucucu

SEQ ID NO: 1868934 - RNA, 18 nt, Salmonella typhimurium LT2
uccagcguuacgcgcugc

SEQ ID NO: 1868935 - RNA, 14 nt, Salmonella typhimurium LT2
uccagcuccaucca

SEQ ID NO: 1868936 - RNA, 13 nt, Salmonella typhimurium LT2
uccagcuccagcc

SEQ ID NO: 1868937 - RNA, 16 nt, Salmonella typhimurium LT2
uccagccuugcugaga

SEQ ID NO: 1868938 - RNA, 15 nt, Salmonella typhimurium LT2
uccagcgaauaauga

SEQ ID NO: 1868939 - RNA, 16 nt, Salmonella typhimurium LT2
uccagcgagccuucca

SEQ ID NO: 1868940 - RNA, 17 nt, Salmonella typhimurium LT2
uccagcgagccuuccau

SEQ ID NO: 1868941 - RNA, 14 nt, Salmonella typhimurium LT2
uccagcgcaaaggg

SEQ ID NO: 1868942 - RNA, 13 nt, Salmonella typhimurium LT2
uccagcagcgcau

SEQ ID NO: 1868943 - RNA, 12 nt, Salmonella typhimurium LT2
uccagccagcgc

SEQ ID NO: 1868944 - RNA, 19 nt, Salmonella typhimurium LT2
uccagccagcgccagcguu

SEQ ID NO: 1868945 - RNA, 11 nt, Salmonella typhimurium LT2
uccagcagcca

SEQ ID NO: 1868946 - RNA, 20 nt, Salmonella typhimurium LT2
uccagcagccaugccagcgc

SEQ ID NO: 1868947 - RNA, 12 nt, Salmonella typhimurium LT2
uccagcacggca

SEQ ID NO: 1868948 - RNA, 19 nt, Salmonella typhimurium LT2
uccagcacgagugccagcc

SEQ ID NO: 1868949 - RNA, 20 nt, Salmonella typhimurium LT2
uccagcacgagugccagccc

SEQ ID NO: 1868950 - RNA, 15 nt, Salmonella typhimurium LT2
uccagcaccucaucc

SEQ ID NO: 1868951 - RNA, 16 nt, Salmonella typhimurium LT2
uccagcacauccucaa

SEQ ID NO: 1868952 - RNA, 22 nt, Salmonella typhimurium LT2
ugcaccgcaucaaacucgccca

SEQ ID NO: 1868953 - RNA, 19 nt, Salmonella typhimurium LT2
ugcaccuuuuuuuccagcg

SEQ ID NO: 1868954 - RNA, 17 nt, Salmonella typhimurium LT2
ugcacccggagagaaac

SEQ ID NO: 1868955 - RNA, 16 nt, Salmonella typhimurium LT2
ugauuugcggcagaaa

SEQ ID NO: 1868956 - RNA, 15 nt, Salmonella typhimurium LT2
ugauuuggaggccgg

SEQ ID NO: 1868957 - RNA, 16 nt, Salmonella typhimurium LT2
ugcacguaccugcucc

SEQ ID NO: 1868958 - RNA, 20 nt, Salmonella typhimurium LT2
ugcacgccaggguaauacug

SEQ ID NO: 1868959 - RNA, 21 nt, Salmonella typhimurium LT2
ugcacgccaggguaauacugg

SEQ ID NO: 1868960 - RNA, 22 nt, Salmonella typhimurium LT2
ugcacgcccauacacaccagca

SEQ ID NO: 1868961 - RNA, 14 nt, Salmonella typhimurium LT2
ugcacgccgggaau

SEQ ID NO: 1868962 - RNA, 21 nt, Salmonella typhimurium LT2
ugcacgcuuuaucuggucugc

SEQ ID NO: 1868963 - RNA, 14 nt, Salmonella typhimurium LT2
ugcaggccggauaa

SEQ ID NO: 1868964 - RNA, 18 nt, Salmonella typhimurium LT2
ugcaggcaggucuccagc

SEQ ID NO: 1868965 - RNA, 10 nt, Salmonella typhimurium LT2
ugcaggcaac

SEQ ID NO: 1868966 - RNA, 17 nt, Salmonella typhimurium LT2
ugcaggauucgaaccug

SEQ ID NO: 1868967 - RNA, 13 nt, Salmonella typhimurium LT2
ugcagcgccgccu

SEQ ID NO: 1868968 - RNA, 18 nt, Salmonella typhimurium LT2
ugcagcggaauucccaca

SEQ ID NO: 1868969 - RNA, 18 nt, Salmonella typhimurium LT2
ugcagcaggacgcgcacu

SEQ ID NO: 1868970 - RNA, 18 nt, Salmonella typhimurium LT2
ugcagcauugggauggau

SEQ ID NO: 1868971 - RNA, 12 nt, Salmonella typhimurium LT2
ugcagcagccag

SEQ ID NO: 1868972 - RNA, 19 nt, Salmonella typhimurium LT2
ugcagagaaguguacaaac

SEQ ID NO: 1868973 - RNA, 23 nt, Salmonella typhimurium LT2
ugcaucgccaguuugucaugcgu

SEQ ID NO: 1868974 - RNA, 20 nt, Salmonella typhimurium LT2
ugcaucuugaaugauuuugu

SEQ ID NO: 1868975 - RNA, 15 nt, Salmonella typhimurium LT2
ugcaucuugaaugau

SEQ ID NO: 1868976 - RNA, 14 nt, Salmonella typhimurium LT2
ugcaugaauaucaa

SEQ ID NO: 1868977 - RNA, 13 nt, Salmonella typhimurium LT2
ugcaugacgcagg

SEQ ID NO: 1868978 - RNA, 13 nt, Salmonella typhimurium LT2
ugcaugaaauccu

SEQ ID NO: 1868979 - RNA, 17 nt, Salmonella typhimurium LT2
ugcauggcagauaaacc

SEQ ID NO: 1868980 - RNA, 23 nt, Salmonella typhimurium LT2
ugcauggccggucuuaugcugcc

SEQ ID NO: 1868981 - RNA, 20 nt, Salmonella typhimurium LT2
ugcaugccucgaaaauauau

SEQ ID NO: 1868982 - RNA, 15 nt, Salmonella typhimurium LT2
ugcaugauuaauacg

SEQ ID NO: 1868983 - RNA, 17 nt, Salmonella typhimurium LT2
ugcauguaguaagccau

SEQ ID NO: 1868984 - RNA, 17 nt, Salmonella typhimurium LT2
ugcauuaaccugaucca

SEQ ID NO: 1868985 - RNA, 22 nt, Salmonella typhimurium LT2
ugcauauacguugcggcgcguu

SEQ ID NO: 1868986 - RNA, 13 nt, Salmonella typhimurium LT2
ugcauauuguauu

SEQ ID NO: 1868987 - RNA, 16 nt, Salmonella typhimurium LT2
ugcauauuguauuggu

SEQ ID NO: 1868988 - RNA, 19 nt, Salmonella typhimurium LT2
ugcaggcgggugcgcagcc

SEQ ID NO: 1868989 - RNA, 20 nt, Salmonella typhimurium LT2
ugcagggaauaagcacccau

SEQ ID NO: 1868990 - RNA, 20 nt, Salmonella typhimurium LT2
ugcaggggcaguaaauuaaa

SEQ ID NO: 1868991 - RNA, 16 nt, Salmonella typhimurium LT2
ugccaaguaauaaaga

SEQ ID NO: 1868992 - RNA, 18 nt, Salmonella typhimurium LT2
ugccaaguaauaaagaga

SEQ ID NO: 1868993 - RNA, 15 nt, Salmonella typhimurium LT2
ugccacaauuugcag

SEQ ID NO: 1868994 - RNA, 14 nt, Salmonella typhimurium LT2
ugccaaccaccgcg

SEQ ID NO: 1868995 - RNA, 14 nt, Salmonella typhimurium LT2
ugccagcaccagca

SEQ ID NO: 1868996 - RNA, 19 nt, Salmonella typhimurium LT2
ugccagauaguaaugcuca

SEQ ID NO: 1868997 - RNA, 12 nt, Salmonella typhimurium LT2
ugccacuggccu

SEQ ID NO: 1868998 - RNA, 13 nt, Salmonella typhimurium LT2
ugccacuggguuu

SEQ ID NO: 1868999 - RNA, 13 nt, Salmonella typhimurium LT2
ugccacugccacg

SEQ ID NO: 1869000 - RNA, 13 nt, Salmonella typhimurium LT2
ugccacuccgcca

SEQ ID NO: 1869001 - RNA, 21 nt, Salmonella typhimurium LT2
ugccacgccccuaaggcagcg

SEQ ID NO: 1869002 - RNA, 17 nt, Salmonella typhimurium LT2
ugccacacucucuccag

SEQ ID NO: 1869003 - RNA, 20 nt, Salmonella typhimurium LT2
ugccauuuccugauuuuuua

SEQ ID NO: 1869004 - RNA, 23 nt, Salmonella typhimurium LT2
ugccauuaucaccauucccagcg

SEQ ID NO: 1869005 - RNA, 17 nt, Salmonella typhimurium LT2
ugccauucgcccaguca

SEQ ID NO: 1869006 - RNA, 14 nt, Salmonella typhimurium LT2
ugccaugcggcggc

SEQ ID NO: 1869007 - RNA, 15 nt, Salmonella typhimurium LT2
ugccauguuaauacc

SEQ ID NO: 1869008 - RNA, 17 nt, Salmonella typhimurium LT2
ugccaucgcuucuacag

SEQ ID NO: 1869009 - RNA, 14 nt, Salmonella typhimurium LT2
ugccaucggccagc

SEQ ID NO: 1869010 - RNA, 13 nt, Salmonella typhimurium LT2
ugccauauucaac

SEQ ID NO: 1869011 - RNA, 18 nt, Salmonella typhimurium LT2
ugccauaucguucaguuu

SEQ ID NO: 1869012 - RNA, 20 nt, Salmonella typhimurium LT2
ugccauaucguucaguuuca

SEQ ID NO: 1869013 - RNA, 17 nt, Salmonella typhimurium LT2
ugccaguucauuccgcc

SEQ ID NO: 1869014 - RNA, 16 nt, Salmonella typhimurium LT2
ugccaguuucucaaag

SEQ ID NO: 1869015 - RNA, 15 nt, Salmonella typhimurium LT2
ugccauaaaaugcug

SEQ ID NO: 1869016 - RNA, 19 nt, Salmonella typhimurium LT2
ugccaguuucucaaagcug

SEQ ID NO: 1869017 - RNA, 18 nt, Salmonella typhimurium LT2
ugccaguugcaguugcgc

SEQ ID NO: 1869018 - RNA, 23 nt, Salmonella typhimurium LT2
ugccagucaauaagcuugcuuuc

SEQ ID NO: 1869019 - RNA, 19 nt, Salmonella typhimurium LT2
ugccaguaacguucuucga

SEQ ID NO: 1869020 - RNA, 17 nt, Salmonella typhimurium LT2
ugccaguaccgccgccg

SEQ ID NO: 1869021 - RNA, 16 nt, Salmonella typhimurium LT2
ugccaguacgccaggc

SEQ ID NO: 1869022 - RNA, 15 nt, Salmonella typhimurium LT2
ugccaguagcugcuc

SEQ ID NO: 1869023 - RNA, 15 nt, Salmonella typhimurium LT2
ugccagggccaauca

SEQ ID NO: 1869024 - RNA, 11 nt, Salmonella typhimurium LT2
ugccagguaac

SEQ ID NO: 1869025 - RNA, 19 nt, Salmonella typhimurium LT2
ugccagggcggaagcagau

SEQ ID NO: 1869026 - RNA, 17 nt, Salmonella typhimurium LT2
ugccagcucguuauuuc

SEQ ID NO: 1869027 - RNA, 14 nt, Salmonella typhimurium LT2
ugccaggcauuuuc

SEQ ID NO: 1869028 - RNA, 18 nt, Salmonella typhimurium LT2
ugccaggccgcaucgcgu

SEQ ID NO: 1869029 - RNA, 15 nt, Salmonella typhimurium LT2
ugccagccgccgccg

SEQ ID NO: 1869030 - RNA, 15 nt, Salmonella typhimurium LT2
ugccagcggccaggg

SEQ ID NO: 1869031 - RNA, 20 nt, Salmonella typhimurium LT2
ugccagcguaagucugguaa

SEQ ID NO: 1869032 - RNA, 15 nt, Salmonella typhimurium LT2
ugcccggccuccggu

SEQ ID NO: 1869033 - RNA, 21 nt, Salmonella typhimurium LT2
ugcccgcucgcuuacgcggcg

SEQ ID NO: 1869034 - RNA, 18 nt, Salmonella typhimurium LT2
ugcccgccguuaaaucau

SEQ ID NO: 1869035 - RNA, 16 nt, Salmonella typhimurium LT2
ugcccgguuuuuuaau

SEQ ID NO: 1869036 - RNA, 17 nt, Salmonella typhimurium LT2
ugcccgguggcgcuggc

SEQ ID NO: 1869037 - RNA, 19 nt, Salmonella typhimurium LT2
ugcccgucgcuacaggcaa

SEQ ID NO: 1869038 - RNA, 14 nt, Salmonella typhimurium LT2
ugccccucuuuuua

SEQ ID NO: 1869039 - RNA, 15 nt, Salmonella typhimurium LT2
ugcccgccgccagcc

SEQ ID NO: 1869040 - RNA, 22 nt, Salmonella typhimurium LT2
ugcccgccgccgcaugaaucaa

SEQ ID NO: 1869041 - RNA, 13 nt, Salmonella typhimurium LT2
ugcccgccagcgg

SEQ ID NO: 1869042 - RNA, 17 nt, Salmonella typhimurium LT2
ugcccgccagcgggccg

SEQ ID NO: 1869043 - RNA, 20 nt, Salmonella typhimurium LT2
ugcccgcaaucucuggccag

SEQ ID NO: 1869044 - RNA, 21 nt, Salmonella typhimurium LT2
ugcccgccacccuccgggccg

SEQ ID NO: 1869045 - RNA, 19 nt, Salmonella typhimurium LT2
ugcccaucgcgccaugauu

SEQ ID NO: 1869046 - RNA, 13 nt, Salmonella typhimurium LT2
ugcccaucggcac

SEQ ID NO: 1869047 - RNA, 14 nt, Salmonella typhimurium LT2
ugcccaugaagcga

SEQ ID NO: 1869048 - RNA, 18 nt, Salmonella typhimurium LT2
ugcccaguuuacccagcg

SEQ ID NO: 1869049 - RNA, 17 nt, Salmonella typhimurium LT2
ugcccaucgcgccauga

SEQ ID NO: 1869050 - RNA, 18 nt, Salmonella typhimurium LT2
ugcccauuuaacagauag

SEQ ID NO: 1869051 - RNA, 18 nt, Salmonella typhimurium LT2
ugcccauuucagcauuaa

SEQ ID NO: 1869052 - RNA, 21 nt, Salmonella typhimurium LT2
ugccccacgauacgucccugc

SEQ ID NO: 1869053 - RNA, 18 nt, Salmonella typhimurium LT2
ugccccagcgcugcugua

SEQ ID NO: 1869054 - RNA, 22 nt, Salmonella typhimurium LT2
ugccccccgacuucacgcugca

SEQ ID NO: 1869055 - RNA, 23 nt, Salmonella typhimurium LT2
ugcccccgccaaaauccggccca

SEQ ID NO: 1869056 - RNA, 18 nt, Salmonella typhimurium LT2
ugcccagcaucccgcugg

SEQ ID NO: 1869057 - RNA, 22 nt, Salmonella typhimurium LT2
ugcccagccgaaacguauggug

SEQ ID NO: 1869058 - RNA, 16 nt, Salmonella typhimurium LT2
ugccgccgucgcggcu

SEQ ID NO: 1869059 - RNA, 19 nt, Salmonella typhimurium LT2
ugccgccgggccaucuucc

SEQ ID NO: 1869060 - RNA, 17 nt, Salmonella typhimurium LT2
ugccgcgcccagcgccg

SEQ ID NO: 1869061 - RNA, 13 nt, Salmonella typhimurium LT2
ugccgcgccagcc

SEQ ID NO: 1869062 - RNA, 15 nt, Salmonella typhimurium LT2
ugccgccugccugca

SEQ ID NO: 1869063 - RNA, 19 nt, Salmonella typhimurium LT2
ugccggagaccuuuuucau

SEQ ID NO: 1869064 - RNA, 21 nt, Salmonella typhimurium LT2
ugccggaguuuuuccgggccg

SEQ ID NO: 1869065 - RNA, 16 nt, Salmonella typhimurium LT2
ugccggaacucagcua

SEQ ID NO: 1869066 - RNA, 22 nt, Salmonella typhimurium LT2
ugccgcuggugcuacgggcgcu

SEQ ID NO: 1869067 - RNA, 14 nt, Salmonella typhimurium LT2
ugccgcugcugccu

SEQ ID NO: 1869068 - RNA, 22 nt, Salmonella typhimurium LT2
ugccgugcgccgacaucgccac

SEQ ID NO: 1869069 - RNA, 14 nt, Salmonella typhimurium LT2
ugccguuaacugcu

SEQ ID NO: 1869070 - RNA, 17 nt, Salmonella typhimurium LT2
ugccguuaacugcugcu

SEQ ID NO: 1869071 - RNA, 17 nt, Salmonella typhimurium LT2
ugccguucauuugcaau

SEQ ID NO: 1869072 - RNA, 19 nt, Salmonella typhimurium LT2
ugccguuauacaucgcuuu

SEQ ID NO: 1869073 - RNA, 12 nt, Salmonella typhimurium LT2
ugccguuuucaa

SEQ ID NO: 1869074 - RNA, 17 nt, Salmonella typhimurium LT2
ugccguuuuccagccgu

SEQ ID NO: 1869075 - RNA, 18 nt, Salmonella typhimurium LT2
ugccguuuuucucaucaa

SEQ ID NO: 1869076 - RNA, 15 nt, Salmonella typhimurium LT2
ugccucauuaaaaaa

SEQ ID NO: 1869077 - RNA, 18 nt, Salmonella typhimurium LT2
ugccuaaaguggcgccuu

SEQ ID NO: 1869078 - RNA, 19 nt, Salmonella typhimurium LT2
ugccuaacuggaaaaagac

SEQ ID NO: 1869079 - RNA, 14 nt, Salmonella typhimurium LT2
ugccuacgcggcca

SEQ ID NO: 1869080 - RNA, 14 nt, Salmonella typhimurium LT2
ugccgucagcuccu

SEQ ID NO: 1869081 - RNA, 12 nt, Salmonella typhimurium LT2
ugccgugccggg

SEQ ID NO: 1869082 - RNA, 16 nt, Salmonella typhimurium LT2
ugccgucaucagcaag

SEQ ID NO: 1869083 - RNA, 14 nt, Salmonella typhimurium LT2
ugccguagcgcgcu

SEQ ID NO: 1869084 - RNA, 16 nt, Salmonella typhimurium LT2
ugccgucaacacgcag

SEQ ID NO: 1869085 - RNA, 14 nt, Salmonella typhimurium LT2
ugccgggagcagau

SEQ ID NO: 1869086 - RNA, 13 nt, Salmonella typhimurium LT2
ugccgggaaaacg

SEQ ID NO: 1869087 - RNA, 17 nt, Salmonella typhimurium LT2
ugccggcuuuccgcacc

SEQ ID NO: 1869088 - RNA, 13 nt, Salmonella typhimurium LT2
ugccgggccuggc

SEQ ID NO: 1869089 - RNA, 19 nt, Salmonella typhimurium LT2
ugccggauggcgcuaaugc

SEQ ID NO: 1869090 - RNA, 23 nt, Salmonella typhimurium LT2
ugccggauggcgguauaacugcc

SEQ ID NO: 1869091 - RNA, 14 nt, Salmonella typhimurium LT2
ugccggauuuuuca

SEQ ID NO: 1869092 - RNA, 15 nt, Salmonella typhimurium LT2
ugccgccagcaguug

SEQ ID NO: 1869093 - RNA, 21 nt, Salmonella typhimurium LT2
ugccgccagaaucaccucuuu

SEQ ID NO: 1869094 - RNA, 21 nt, Salmonella typhimurium LT2
ugccgccauaacgccggcgcu

SEQ ID NO: 1869095 - RNA, 20 nt, Salmonella typhimurium LT2
ugccgccauaggucagcgcu

SEQ ID NO: 1869096 - RNA, 14 nt, Salmonella typhimurium LT2
ugccgcccauccag

SEQ ID NO: 1869097 - RNA, 15 nt, Salmonella typhimurium LT2
ugccgcccaggccug

SEQ ID NO: 1869098 - RNA, 13 nt, Salmonella typhimurium LT2
ugccgcccaccug

SEQ ID NO: 1869099 - RNA, 19 nt, Salmonella typhimurium LT2
ugccgcccaccugcagcag

SEQ ID NO: 1869100 - RNA, 19 nt, Salmonella typhimurium LT2
ugccgccgcgaugcaucuu

SEQ ID NO: 1869101 - RNA, 16 nt, Salmonella typhimurium LT2
ugccgcccauccagag

SEQ ID NO: 1869102 - RNA, 18 nt, Salmonella typhimurium LT2
ugccgaucaccagcgcau

SEQ ID NO: 1869103 - RNA, 15 nt, Salmonella typhimurium LT2
ugccgaucaccagcg

SEQ ID NO: 1869104 - RNA, 16 nt, Salmonella typhimurium LT2
ugccgaugccgccgca

SEQ ID NO: 1869105 - RNA, 20 nt, Salmonella typhimurium LT2
ugccgcaaacgccugcuccg

SEQ ID NO: 1869106 - RNA, 23 nt, Salmonella typhimurium LT2
ugccgauuuaccucucaccagua

SEQ ID NO: 1869107 - RNA, 21 nt, Salmonella typhimurium LT2
ugccgaugacgcuccugaauc

SEQ ID NO: 1869108 - RNA, 19 nt, Salmonella typhimurium LT2
ugccgauugccgcucagcu

SEQ ID NO: 1869109 - RNA, 21 nt, Salmonella typhimurium LT2
ugccgcagccgcucaggguaa

SEQ ID NO: 1869110 - RNA, 15 nt, Salmonella typhimurium LT2
ugccgcaauaaacac

SEQ ID NO: 1869111 - RNA, 19 nt, Salmonella typhimurium LT2
ugcccucaacgcccugcuc

SEQ ID NO: 1869112 - RNA, 15 nt, Salmonella typhimurium LT2
ugcccuucgcgcgau

SEQ ID NO: 1869113 - RNA, 12 nt, Salmonella typhimurium LT2
ugcccuuuaucc

SEQ ID NO: 1869114 - RNA, 19 nt, Salmonella typhimurium LT2
ugcccuguuucgcaggccg

SEQ ID NO: 1869115 - RNA, 22 nt, Salmonella typhimurium LT2
ugcccugcuugucgaucaucag

SEQ ID NO: 1869116 - RNA, 17 nt, Salmonella typhimurium LT2
ugccgacagaacugauu

SEQ ID NO: 1869117 - RNA, 20 nt, Salmonella typhimurium LT2
ugccgacaaagagcucccca

SEQ ID NO: 1869118 - RNA, 14 nt, Salmonella typhimurium LT2
ugccgaacgcggcu

SEQ ID NO: 1869119 - RNA, 18 nt, Salmonella typhimurium LT2
ugcgcagaccgcguucca

SEQ ID NO: 1869120 - RNA, 21 nt, Salmonella typhimurium LT2
ugcgcagccccagcgccagcc

SEQ ID NO: 1869121 - RNA, 17 nt, Salmonella typhimurium LT2
ugcgcagcguuuccaga

SEQ ID NO: 1869122 - RNA, 16 nt, Salmonella typhimurium LT2
ugcgauuugacaucag

SEQ ID NO: 1869123 - RNA, 15 nt, Salmonella typhimurium LT2
ugcgcaacgagugcu

SEQ ID NO: 1869124 - RNA, 15 nt, Salmonella typhimurium LT2
ugcgcaaaucaaaag

SEQ ID NO: 1869125 - RNA, 20 nt, Salmonella typhimurium LT2
ugcgcaaaaagcccuuugcc

SEQ ID NO: 1869126 - RNA, 19 nt, Salmonella typhimurium LT2
ugcgauucaccgugccacc

SEQ ID NO: 1869127 - RNA, 22 nt, Salmonella typhimurium LT2
ugcgacuuugcgccggcagucc

SEQ ID NO: 1869128 - RNA, 22 nt, Salmonella typhimurium LT2
ugccugcuucagacaacgccgc

SEQ ID NO: 1869129 - RNA, 17 nt, Salmonella typhimurium LT2
ugccucccguuucagug

SEQ ID NO: 1869130 - RNA, 12 nt, Salmonella typhimurium LT2
ugccuggcaguu

SEQ ID NO: 1869131 - RNA, 15 nt, Salmonella typhimurium LT2
ugccuggagccagcc

SEQ ID NO: 1869132 - RNA, 22 nt, Salmonella typhimurium LT2
ugcgacagauacacgcccucuc

SEQ ID NO: 1869133 - RNA, 21 nt, Salmonella typhimurium LT2
ugcgacucggugccgcugcug

SEQ ID NO: 1869134 - RNA, 13 nt, Salmonella typhimurium LT2
ugcgacugcccaa

SEQ ID NO: 1869135 - RNA, 17 nt, Salmonella typhimurium LT2
ugcgacugcccaacagc

SEQ ID NO: 1869136 - RNA, 21 nt, Salmonella typhimurium LT2
ugcgcaucuggggcgcuuugc

SEQ ID NO: 1869137 - RNA, 21 nt, Salmonella typhimurium LT2
ugcgcccagcccggaaauaaa

SEQ ID NO: 1869138 - RNA, 19 nt, Salmonella typhimurium LT2
aaauggaucggcuugccuu

SEQ ID NO: 1869139 - RNA, 21 nt, Salmonella typhimurium LT2
ugcgccccagcaugagccagc

SEQ ID NO: 1869140 - RNA, 15 nt, Salmonella typhimurium LT2
ugcgcccaucaucau

SEQ ID NO: 1869141 - RNA, 21 nt, Salmonella typhimurium LT2
aaauggcaaguaaaauaaccc

SEQ ID NO: 1869142 - RNA, 12 nt, Salmonella typhimurium LT2
aaauggcgcugu

SEQ ID NO: 1869143 - RNA, 11 nt, Salmonella typhimurium LT2
aaauggccauc

SEQ ID NO: 1869144 - RNA, 14 nt, Salmonella typhimurium LT2
aaauggcaugagca

SEQ ID NO: 1869145 - RNA, 21 nt, Salmonella typhimurium LT2
aaauggcauugcccggcggca

SEQ ID NO: 1869146 - RNA, 12 nt, Salmonella typhimurium LT2
ugcgccugcuca

SEQ ID NO: 1869147 - RNA, 16 nt, Salmonella typhimurium LT2
ugcgccgugcuuguuc

SEQ ID NO: 1869148 - RNA, 21 nt, Salmonella typhimurium LT2
ugcgccgugaaauuuccuccg

SEQ ID NO: 1869149 - RNA, 16 nt, Salmonella typhimurium LT2
aaauggucggucacgc

SEQ ID NO: 1869150 - RNA, 15 nt, Salmonella typhimurium LT2
aaaugggucgcggca

SEQ ID NO: 1869151 - RNA, 19 nt, Salmonella typhimurium LT2
ugcgcgaccacgccagcca

SEQ ID NO: 1869152 - RNA, 21 nt, Salmonella typhimurium LT2
ugcgccuucugcugcgggaaa

SEQ ID NO: 1869153 - RNA, 18 nt, Salmonella typhimurium LT2
ugcgccugugguuuaaaa

SEQ ID NO: 1869154 - RNA, 13 nt, Salmonella typhimurium LT2
ugcgccuguuagg

SEQ ID NO: 1869155 - RNA, 12 nt, Salmonella typhimurium LT2
ugcgccuuccag

SEQ ID NO: 1869156 - RNA, 14 nt, Salmonella typhimurium LT2
ugcgucaaaauaag

SEQ ID NO: 1869157 - RNA, 22 nt, Salmonella typhimurium LT2
ugcguaccgcuaucgccaaacu

SEQ ID NO: 1869158 - RNA, 14 nt, Salmonella typhimurium LT2
ugcguacucagcag

SEQ ID NO: 1869159 - RNA, 19 nt, Salmonella typhimurium LT2
ugcguagacaaugcaggcc

SEQ ID NO: 1869160 - RNA, 17 nt, Salmonella typhimurium LT2
ugcggucaaaagcugca

SEQ ID NO: 1869161 - RNA, 19 nt, Salmonella typhimurium LT2
ugcguaaugagcgucgcca

SEQ ID NO: 1869162 - RNA, 21 nt, Salmonella typhimurium LT2
ugcguaaucuuuucauauuau

SEQ ID NO: 1869163 - RNA, 15 nt, Salmonella typhimurium LT2
ugcguaaucuuuuca

SEQ ID NO: 1869164 - RNA, 19 nt, Salmonella typhimurium LT2
ugcguacaaucgcguuuuc

SEQ ID NO: 1869165 - RNA, 21 nt, Salmonella typhimurium LT2
ugcgguaugcguugcaaauau

SEQ ID NO: 1869166 - RNA, 20 nt, Salmonella typhimurium LT2
ugcggccaugaucgccgcca

SEQ ID NO: 1869167 - RNA, 15 nt, Salmonella typhimurium LT2
ugcggaugcgccauc

SEQ ID NO: 1869168 - RNA, 18 nt, Salmonella typhimurium LT2
ugcggcaaaaauccuucu

SEQ ID NO: 1869169 - RNA, 20 nt, Salmonella typhimurium LT2
ugcggacgcagcucauaccc

SEQ ID NO: 1869170 - RNA, 23 nt, Salmonella typhimurium LT2
ugcgcugaaauagcgcugcggcu

SEQ ID NO: 1869171 - RNA, 22 nt, Salmonella typhimurium LT2
ugcgcuccagcuucaucaucag

SEQ ID NO: 1869172 - RNA, 17 nt, Salmonella typhimurium LT2
ugcgcucuaucaccgcc

SEQ ID NO: 1869173 - RNA, 12 nt, Salmonella typhimurium LT2
ugcgcuaagcgu

SEQ ID NO: 1869174 - RNA, 21 nt, Salmonella typhimurium LT2
ugcgcguuuagcgccagcagc

SEQ ID NO: 1869175 - RNA, 15 nt, Salmonella typhimurium LT2
ugcgcuauccgcgcu

SEQ ID NO: 1869176 - RNA, 20 nt, Salmonella typhimurium LT2
ugcgcuauccgcgcucgcca

SEQ ID NO: 1869177 - RNA, 23 nt, Salmonella typhimurium LT2
ugcgcuauguaagguucccugcg

SEQ ID NO: 1869178 - RNA, 21 nt, Salmonella typhimurium LT2
ugcgcgcgagugaucccaaca

SEQ ID NO: 1869179 - RNA, 23 nt, Salmonella typhimurium LT2
ugcgcgccauacuuacugcuguc

SEQ ID NO: 1869180 - RNA, 22 nt, Salmonella typhimurium LT2
ugcgcggcgacgcgaggcuuuu

SEQ ID NO: 1869181 - RNA, 17 nt, Salmonella typhimurium LT2
ugcgcguuuagcgccag

SEQ ID NO: 1869182 - RNA, 17 nt, Salmonella typhimurium LT2
ugcgcguuuuccaccag

SEQ ID NO: 1869183 - RNA, 21 nt, Salmonella typhimurium LT2
ugcgcgucccucuccagggca

SEQ ID NO: 1869184 - RNA, 14 nt, Salmonella typhimurium LT2
ugcgcgucccucuc

SEQ ID NO: 1869185 - RNA, 15 nt, Salmonella typhimurium LT2
ugcgcgucccucucc

SEQ ID NO: 1869186 - RNA, 16 nt, Salmonella typhimurium LT2
ugcgcgucucucccuc

SEQ ID NO: 1869187 - RNA, 17 nt, Salmonella typhimurium LT2
ugcgcgucaggccaggg

SEQ ID NO: 1869188 - RNA, 17 nt, Salmonella typhimurium LT2
ugcgcgguccacaggcc

SEQ ID NO: 1869189 - RNA, 22 nt, Salmonella typhimurium LT2
ugcgcguaaacgcaacaccauc

SEQ ID NO: 1869190 - RNA, 16 nt, Salmonella typhimurium LT2
ugagcgaaacuccagc

SEQ ID NO: 1869191 - RNA, 16 nt, Salmonella typhimurium LT2
ugagccucuaaauguu

SEQ ID NO: 1869192 - RNA, 19 nt, Salmonella typhimurium LT2
ugagccagaugucgccaga

SEQ ID NO: 1869193 - RNA, 14 nt, Salmonella typhimurium LT2
ugagcccuccucca

SEQ ID NO: 1869194 - RNA, 23 nt, Salmonella typhimurium LT2
ugagccacucacguucagcgcgg

SEQ ID NO: 1869195 - RNA, 20 nt, Salmonella typhimurium LT2
ugagcaucaaacuuuuaaau

SEQ ID NO: 1869196 - RNA, 18 nt, Salmonella typhimurium LT2
ugagcauacacauucagg

SEQ ID NO: 1869197 - RNA, 18 nt, Salmonella typhimurium LT2
ugagacaaaaaagcugcg

SEQ ID NO: 1869198 - RNA, 12 nt, Salmonella typhimurium LT2
ugagcagcgcga

SEQ ID NO: 1869199 - RNA, 13 nt, Salmonella typhimurium LT2
ugagcagcggcug

SEQ ID NO: 1869200 - RNA, 16 nt, Salmonella typhimurium LT2
ugagcagccagcccag

SEQ ID NO: 1869201 - RNA, 12 nt, Salmonella typhimurium LT2
ugagaaaaguaa

SEQ ID NO: 1869202 - RNA, 14 nt, Salmonella typhimurium LT2
ugagaaaaguaaaa

SEQ ID NO: 1869203 - RNA, 20 nt, Salmonella typhimurium LT2
ugagaaaaggaagaauaaau

SEQ ID NO: 1869204 - RNA, 19 nt, Salmonella typhimurium LT2
ugagaaaauuacgcccauc

SEQ ID NO: 1869205 - RNA, 13 nt, Salmonella typhimurium LT2
ugagaaaaauacg

SEQ ID NO: 1869206 - RNA, 19 nt, Salmonella typhimurium LT2
ugagaauuuccaguucaau

SEQ ID NO: 1869207 - RNA, 17 nt, Salmonella typhimurium LT2
ugagaauuuccaguuca

SEQ ID NO: 1869208 - RNA, 14 nt, Salmonella typhimurium LT2
ugagaauggcggga

SEQ ID NO: 1869209 - RNA, 20 nt, Salmonella typhimurium LT2
ugagaaggucaguccaccug

SEQ ID NO: 1869210 - RNA, 13 nt, Salmonella typhimurium LT2
ugacgaaacauua

SEQ ID NO: 1869211 - RNA, 13 nt, Salmonella typhimurium LT2
ugacgaaaaaaga

SEQ ID NO: 1869212 - RNA, 15 nt, Salmonella typhimurium LT2
ugaccuuaauccagc

SEQ ID NO: 1869213 - RNA, 18 nt, Salmonella typhimurium LT2
ugaccuucaccugaauau

SEQ ID NO: 1869214 - RNA, 16 nt, Salmonella typhimurium LT2
ugacugucauuucuca

SEQ ID NO: 1869215 - RNA, 13 nt, Salmonella typhimurium LT2
ugagcgcaaugcu

SEQ ID NO: 1869216 - RNA, 20 nt, Salmonella typhimurium LT2
ugagcgagucagacaccagc

SEQ ID NO: 1869217 - RNA, 20 nt, Salmonella typhimurium LT2
ugagcgccgcgccuaccagc

SEQ ID NO: 1869218 - RNA, 17 nt, Salmonella typhimurium LT2
ugagcgcgaacgcucca

SEQ ID NO: 1869219 - RNA, 22 nt, Salmonella typhimurium LT2
ugagcgccuggacccacaagcc

SEQ ID NO: 1869220 - RNA, 20 nt, Salmonella typhimurium LT2
ugaggaaaaaccgccucaau

SEQ ID NO: 1869221 - RNA, 17 nt, Salmonella typhimurium LT2
ugagguuaaucuucagg

SEQ ID NO: 1869222 - RNA, 16 nt, Salmonella typhimurium LT2
ugaggccgcucgccau

SEQ ID NO: 1869223 - RNA, 23 nt, Salmonella typhimurium LT2
ugaggccugcacaaaaagagcaa

SEQ ID NO: 1869224 - RNA, 13 nt, Salmonella typhimurium LT2
ugaggcaagaggg

SEQ ID NO: 1869225 - RNA, 14 nt, Salmonella typhimurium LT2
ugaguacggaacaa

SEQ ID NO: 1869226 - RNA, 20 nt, Salmonella typhimurium LT2
ugaguacggaacaaaacgga

SEQ ID NO: 1869227 - RNA, 23 nt, Salmonella typhimurium LT2
ugauacagccaaaucagcaggac

SEQ ID NO: 1869228 - RNA, 23 nt, Salmonella typhimurium LT2
ugauaaucaacggucuugccagc

SEQ ID NO: 1869229 - RNA, 15 nt, Salmonella typhimurium LT2
ugauaaucagcaaga

SEQ ID NO: 1869230 - RNA, 21 nt, Salmonella typhimurium LT2
ugauaauauuaucagcaauaa

SEQ ID NO: 1869231 - RNA, 16 nt, Salmonella typhimurium LT2
ugauaauggcauauaa

SEQ ID NO: 1869232 - RNA, 21 nt, Salmonella typhimurium LT2
ugaguauugacgaaaagauaa

SEQ ID NO: 1869233 - RNA, 16 nt, Salmonella typhimurium LT2
ugaguauuggcaagaa

SEQ ID NO: 1869234 - RNA, 19 nt, Salmonella typhimurium LT2
ugaguccauaccguuucaa

SEQ ID NO: 1869235 - RNA, 18 nt, Salmonella typhimurium LT2
ugaguuugucauccagac

SEQ ID NO: 1869236 - RNA, 17 nt, Salmonella typhimurium LT2
ugaguuugacugccaga

SEQ ID NO: 1869237 - RNA, 22 nt, Salmonella typhimurium LT2
ugaguuuuaacgaaggauuuau

SEQ ID NO: 1869238 - RNA, 13 nt, Salmonella typhimurium LT2
ugauaaagcgcuc

SEQ ID NO: 1869239 - RNA, 20 nt, Salmonella typhimurium LT2
ugauaaagcuuucaucuuua

SEQ ID NO: 1869240 - RNA, 12 nt, Salmonella typhimurium LT2
ugaucccaaugu

SEQ ID NO: 1869241 - RNA, 17 nt, Salmonella typhimurium LT2
ugaucccacagcggaug

SEQ ID NO: 1869242 - RNA, 22 nt, Salmonella typhimurium LT2
ugauccaccaccaguacauggc

SEQ ID NO: 1869243 - RNA, 15 nt, Salmonella typhimurium LT2
ugauccacacuggcg

SEQ ID NO: 1869244 - RNA, 23 nt, Salmonella typhimurium LT2
ugaucagaacucacauauucaau

SEQ ID NO: 1869245 - RNA, 18 nt, Salmonella typhimurium LT2
ugaucagcacgcggaaca

SEQ ID NO: 1869246 - RNA, 18 nt, Salmonella typhimurium LT2
ugaucuauccaauaauaa

SEQ ID NO: 1869247 - RNA, 20 nt, Salmonella typhimurium LT2
ugaucuauccaauaauaaga

SEQ ID NO: 1869248 - RNA, 18 nt, Salmonella typhimurium LT2
ugaucaaucaacucuuua

SEQ ID NO: 1869249 - RNA, 21 nt, Salmonella typhimurium LT2
ugauauuagaaagcugcacca

SEQ ID NO: 1869250 - RNA, 20 nt, Salmonella typhimurium LT2
ugauacauagucuauguuca

SEQ ID NO: 1869251 - RNA, 22 nt, Salmonella typhimurium LT2
ugauauugcguaagcagcugcu

SEQ ID NO: 1869252 - RNA, 16 nt, Salmonella typhimurium LT2
ugauauugugcauacu

SEQ ID NO: 1869253 - RNA, 17 nt, Salmonella typhimurium LT2
ugauauuuucaggcacc

SEQ ID NO: 1869254 - RNA, 21 nt, Salmonella typhimurium LT2
ugaugcuaacgcccucucucc

SEQ ID NO: 1869255 - RNA, 17 nt, Salmonella typhimurium LT2
ugauggcgaacagcccc

SEQ ID NO: 1869256 - RNA, 15 nt, Salmonella typhimurium LT2
ugauggccacaucgu

SEQ ID NO: 1869257 - RNA, 20 nt, Salmonella typhimurium LT2
ugauggcagaccguggccgu

SEQ ID NO: 1869258 - RNA, 20 nt, Salmonella typhimurium LT2
ugauggcgcuacgcuuauca

SEQ ID NO: 1869259 - RNA, 15 nt, Salmonella typhimurium LT2
ugauggcgcugccuu

SEQ ID NO: 1869260 - RNA, 13 nt, Salmonella typhimurium LT2
ugauggcgcugcg

SEQ ID NO: 1869261 - RNA, 16 nt, Salmonella typhimurium LT2
ugauggcgcugcgcca

SEQ ID NO: 1869262 - RNA, 21 nt, Salmonella typhimurium LT2
ugauggcuaauauccagccac

SEQ ID NO: 1869263 - RNA, 13 nt, Salmonella typhimurium LT2
ugaugccacaggc

SEQ ID NO: 1869264 - RNA, 20 nt, Salmonella typhimurium LT2
ugaugccguuuucauccauu

SEQ ID NO: 1869265 - RNA, 13 nt, Salmonella typhimurium LT2
ugaugccuggcag

SEQ ID NO: 1869266 - RNA, 14 nt, Salmonella typhimurium LT2
ugaugccuggcagu

SEQ ID NO: 1869267 - RNA, 13 nt, Salmonella typhimurium LT2
ugaucuuuauaaa

SEQ ID NO: 1869268 - RNA, 23 nt, Salmonella typhimurium LT2
ugaucguuuuuguccauaaaaug

SEQ ID NO: 1869269 - RNA, 19 nt, Salmonella typhimurium LT2
ugaucuuucaacguuuuau

SEQ ID NO: 1869270 - RNA, 13 nt, Salmonella typhimurium LT2
ugauuuccagaau

SEQ ID NO: 1869271 - RNA, 11 nt, Salmonella typhimurium LT2
ugauuuauuca

SEQ ID NO: 1869272 - RNA, 19 nt, Salmonella typhimurium LT2
ugauucguggcucaaggau

SEQ ID NO: 1869273 - RNA, 18 nt, Salmonella typhimurium LT2
ugauuacugagaugacgc

SEQ ID NO: 1869274 - RNA, 15 nt, Salmonella typhimurium LT2
ugauuacaaaaugug

SEQ ID NO: 1869275 - RNA, 17 nt, Salmonella typhimurium LT2
ugauuaaugcugcacca

SEQ ID NO: 1869276 - RNA, 16 nt, Salmonella typhimurium LT2
ugaugucgaggaaaaa

SEQ ID NO: 1869277 - RNA, 17 nt, Salmonella typhimurium LT2
ugaugucgaggaaaaac

SEQ ID NO: 1869278 - RNA, 21 nt, Salmonella typhimurium LT2
ugaugguuucggcaugccacu

SEQ ID NO: 1869279 - RNA, 18 nt, Salmonella typhimurium LT2
ugaugggcgcacagcgcc

SEQ ID NO: 1869280 - RNA, 13 nt, Salmonella typhimurium LT2
ugaauuucuucau

SEQ ID NO: 1869281 - RNA, 15 nt, Salmonella typhimurium LT2
ugacaaaaaucugaa

SEQ ID NO: 1869282 - RNA, 19 nt, Salmonella typhimurium LT2
ugacaaaaaucugaauucg

SEQ ID NO: 1869283 - RNA, 13 nt, Salmonella typhimurium LT2
ugacaaaaauuaa

SEQ ID NO: 1869284 - RNA, 14 nt, Salmonella typhimurium LT2
ugaauucguuaccu

SEQ ID NO: 1869285 - RNA, 18 nt, Salmonella typhimurium LT2
ugaauuaauggucagauc

SEQ ID NO: 1869286 - RNA, 11 nt, Salmonella typhimurium LT2
ugaauguuuug

SEQ ID NO: 1869287 - RNA, 13 nt, Salmonella typhimurium LT2
ugaauuaacuuau

SEQ ID NO: 1869288 - RNA, 17 nt, Salmonella typhimurium LT2
ugaauuaacuuauucgu

SEQ ID NO: 1869289 - RNA, 20 nt, Salmonella typhimurium LT2
ugaauggcggagaucuccag

SEQ ID NO: 1869290 - RNA, 21 nt, Salmonella typhimurium LT2
ugaaugcucucauauuccagc

SEQ ID NO: 1869291 - RNA, 18 nt, Salmonella typhimurium LT2
ugaaugccauccagcacc

SEQ ID NO: 1869292 - RNA, 18 nt, Salmonella typhimurium LT2
ugaaugagucggaccauc

SEQ ID NO: 1869293 - RNA, 11 nt, Salmonella typhimurium LT2
ugaaugacugu

SEQ ID NO: 1869294 - RNA, 23 nt, Salmonella typhimurium LT2
ugaaugagcaaugagauccacug

SEQ ID NO: 1869295 - RNA, 20 nt, Salmonella typhimurium LT2
ugaaugaguaaccagaccgu

SEQ ID NO: 1869296 - RNA, 16 nt, Salmonella typhimurium LT2
ugaauccaggccagau

SEQ ID NO: 1869297 - RNA, 22 nt, Salmonella typhimurium LT2
ugaaucaucgguaaaugcuuau

SEQ ID NO: 1869298 - RNA, 16 nt, Salmonella typhimurium LT2
ugaaucaagcuuugcg

SEQ ID NO: 1869299 - RNA, 14 nt, Salmonella typhimurium LT2
ugaauauugucggc

SEQ ID NO: 1869300 - RNA, 21 nt, Salmonella typhimurium LT2
ugaaucgccgucagugagccc

SEQ ID NO: 1869301 - RNA, 18 nt, Salmonella typhimurium LT2
ugaaucggcaccuggagc

SEQ ID NO: 1869302 - RNA, 21 nt, Salmonella typhimurium LT2
ugaaucucagauaauagcugc

SEQ ID NO: 1869303 - RNA, 21 nt, Salmonella typhimurium LT2
ugacaaucuccuccggcuuca

SEQ ID NO: 1869304 - RNA, 12 nt, Salmonella typhimurium LT2
ugacaaucugcu

SEQ ID NO: 1869305 - RNA, 16 nt, Salmonella typhimurium LT2
ugacacaauauaacaa

SEQ ID NO: 1869306 - RNA, 11 nt, Salmonella typhimurium LT2
ugacaaggcga

SEQ ID NO: 1869307 - RNA, 17 nt, Salmonella typhimurium LT2
ugacaaggcgaucucaa

SEQ ID NO: 1869308 - RNA, 21 nt, Salmonella typhimurium LT2
ugacaaagguugcgccaaagc

SEQ ID NO: 1869309 - RNA, 22 nt, Salmonella typhimurium LT2
ugacaaauuguuuaaaaacagg

SEQ ID NO: 1869310 - RNA, 22 nt, Salmonella typhimurium LT2
ugacaaaucggcuccggcaaaa

SEQ ID NO: 1869311 - RNA, 20 nt, Salmonella typhimurium LT2
ugacaaauuguuuaaaaaca

SEQ ID NO: 1869312 - RNA, 19 nt, Salmonella typhimurium LT2
ugacagccaaacugcugua

SEQ ID NO: 1869313 - RNA, 18 nt, Salmonella typhimurium LT2
ugacagcacauagccuaa

SEQ ID NO: 1869314 - RNA, 13 nt, Salmonella typhimurium LT2
ugacagcaacauc

SEQ ID NO: 1869315 - RNA, 15 nt, Salmonella typhimurium LT2
ugacagaguccacag

SEQ ID NO: 1869316 - RNA, 21 nt, Salmonella typhimurium LT2
ugacagagcucgucaaaaauc

SEQ ID NO: 1869317 - RNA, 16 nt, Salmonella typhimurium LT2
ugacacuuuauucucu

SEQ ID NO: 1869318 - RNA, 14 nt, Salmonella typhimurium LT2
ugacagacaggccu

SEQ ID NO: 1869319 - RNA, 18 nt, Salmonella typhimurium LT2
ugacacagaggaauauua

SEQ ID NO: 1869320 - RNA, 14 nt, Salmonella typhimurium LT2
ugacacugauauac

SEQ ID NO: 1869321 - RNA, 17 nt, Salmonella typhimurium LT2
ugacacuaucuccuucc

SEQ ID NO: 1869322 - RNA, 17 nt, Salmonella typhimurium LT2
ugacacgccaguucaug

SEQ ID NO: 1869323 - RNA, 19 nt, Salmonella typhimurium LT2
ugaccgcuucgccuucgcc

SEQ ID NO: 1869324 - RNA, 17 nt, Salmonella typhimurium LT2
ugaccauucgcacucca

SEQ ID NO: 1869325 - RNA, 12 nt, Salmonella typhimurium LT2
ugaccucgccua

SEQ ID NO: 1869326 - RNA, 14 nt, Salmonella typhimurium LT2
ugaccgcguugcca

SEQ ID NO: 1869327 - RNA, 16 nt, Salmonella typhimurium LT2
ugaccuuaauccagcc

SEQ ID NO: 1869328 - RNA, 18 nt, Salmonella typhimurium LT2
ugaccugcagcuccgcaa

SEQ ID NO: 1869329 - RNA, 21 nt, Salmonella typhimurium LT2
ugaccagcuucucaguaugaa

SEQ ID NO: 1869330 - RNA, 16 nt, Salmonella typhimurium LT2
ugaccaucgccagcca

SEQ ID NO: 1869331 - RNA, 15 nt, Salmonella typhimurium LT2
ugaccaucaaauaau

SEQ ID NO: 1869332 - RNA, 14 nt, Salmonella typhimurium LT2
ugaccagcaauaaa

SEQ ID NO: 1869333 - RNA, 17 nt, Salmonella typhimurium LT2
ugacagugaagugugaa

SEQ ID NO: 1869334 - RNA, 23 nt, Salmonella typhimurium LT2
ugaaaccgaauccuuuggauuca

SEQ ID NO: 1869335 - RNA, 22 nt, Salmonella typhimurium LT2
ugaaaccggcgcgccuuccagc

SEQ ID NO: 1869336 - RNA, 18 nt, Salmonella typhimurium LT2
ugaaacgaaaacugggca

SEQ ID NO: 1869337 - RNA, 20 nt, Salmonella typhimurium LT2
ucuucguguaacgcauacau

SEQ ID NO: 1869338 - RNA, 14 nt, Salmonella typhimurium LT2
ugaaaccccaaauc

SEQ ID NO: 1869339 - RNA, 20 nt, Salmonella typhimurium LT2
ugaaaccccaaaucagcaaa

SEQ ID NO: 1869340 - RNA, 14 nt, Salmonella typhimurium LT2
ucuucgucgucauc

SEQ ID NO: 1869341 - RNA, 13 nt, Salmonella typhimurium LT2
ucuucgucgucuu

SEQ ID NO: 1869342 - RNA, 15 nt, Salmonella typhimurium LT2
ucuucggcuucaccg

SEQ ID NO: 1869343 - RNA, 15 nt, Salmonella typhimurium LT2
ugaaauagcgcugcg

SEQ ID NO: 1869344 - RNA, 15 nt, Salmonella typhimurium LT2
ugaaagugauuucau

SEQ ID NO: 1869345 - RNA, 22 nt, Salmonella typhimurium LT2
ugaaaguaagcuauuucuguau

SEQ ID NO: 1869346 - RNA, 22 nt, Salmonella typhimurium LT2
ugaaagaccuaaaccacguccc

SEQ ID NO: 1869347 - RNA, 20 nt, Salmonella typhimurium LT2
ugaacauacguuuaaagcgc

SEQ ID NO: 1869348 - RNA, 13 nt, Salmonella typhimurium LT2
ugaacauuuuuuc

SEQ ID NO: 1869349 - RNA, 20 nt, Salmonella typhimurium LT2
ugaaccagcaucccacgaau

SEQ ID NO: 1869350 - RNA, 21 nt, Salmonella typhimurium LT2
ugaacaccacugaaaaauaau

SEQ ID NO: 1869351 - RNA, 15 nt, Salmonella typhimurium LT2
ugaacacaaaaaacg

SEQ ID NO: 1869352 - RNA, 19 nt, Salmonella typhimurium LT2
ugaacacacccuucucagg

SEQ ID NO: 1869353 - RNA, 17 nt, Salmonella typhimurium LT2
ugaacaauaugucgauu

SEQ ID NO: 1869354 - RNA, 15 nt, Salmonella typhimurium LT2
ugaauaccaaagccc

SEQ ID NO: 1869355 - RNA, 17 nt, Salmonella typhimurium LT2
ugaauaccaaaucucaa

SEQ ID NO: 1869356 - RNA, 12 nt, Salmonella typhimurium LT2
ugaauaccagcg

SEQ ID NO: 1869357 - RNA, 18 nt, Salmonella typhimurium LT2
ugaauaauuucuucuuua

SEQ ID NO: 1869358 - RNA, 19 nt, Salmonella typhimurium LT2
ugaauaauauguaaauuau

SEQ ID NO: 1869359 - RNA, 17 nt, Salmonella typhimurium LT2
ugaauaaugguaaauuu

SEQ ID NO: 1869360 - RNA, 14 nt, Salmonella typhimurium LT2
ugaauaaugaccuc

SEQ ID NO: 1869361 - RNA, 22 nt, Salmonella typhimurium LT2
ugaagugugcaaacgauaaaag

SEQ ID NO: 1869362 - RNA, 18 nt, Salmonella typhimurium LT2
ugaauaguugauaauauu

SEQ ID NO: 1869363 - RNA, 14 nt, Salmonella typhimurium LT2
ugaauauaauucau

SEQ ID NO: 1869364 - RNA, 13 nt, Salmonella typhimurium LT2
ugaauaucaagau

SEQ ID NO: 1869365 - RNA, 19 nt, Salmonella typhimurium LT2
ugaagaugguaauauuaaa

SEQ ID NO: 1869366 - RNA, 18 nt, Salmonella typhimurium LT2
ugaagauaaacagcagcg

SEQ ID NO: 1869367 - RNA, 14 nt, Salmonella typhimurium LT2
ugaagaucagcaga

SEQ ID NO: 1869368 - RNA, 17 nt, Salmonella typhimurium LT2
ugaagcgcguucguccc

SEQ ID NO: 1869369 - RNA, 20 nt, Salmonella typhimurium LT2
ugaagcccuuuaguaaaguu

SEQ ID NO: 1869370 - RNA, 22 nt, Salmonella typhimurium LT2
ugaaggcucaaauuuggcucaa

SEQ ID NO: 1869371 - RNA, 21 nt, Salmonella typhimurium LT2
ugaagggcggcuggauaaaag

SEQ ID NO: 1869372 - RNA, 18 nt, Salmonella typhimurium LT2
ugaaccuguuaucaggau

SEQ ID NO: 1869373 - RNA, 13 nt, Salmonella typhimurium LT2
ugaacgccaggcc

SEQ ID NO: 1869374 - RNA, 18 nt, Salmonella typhimurium LT2
ucgccugcgucgccccaa

SEQ ID NO: 1869375 - RNA, 20 nt, Salmonella typhimurium LT2
ucgccuguaccgggcagaca

SEQ ID NO: 1869376 - RNA, 13 nt, Salmonella typhimurium LT2
ucgccuucauccg

SEQ ID NO: 1869377 - RNA, 16 nt, Salmonella typhimurium LT2
ucgccuuacccggccu

SEQ ID NO: 1869378 - RNA, 22 nt, Salmonella typhimurium LT2
ucgccuuaacucuuaaaucaug

SEQ ID NO: 1869379 - RNA, 16 nt, Salmonella typhimurium LT2
ucgccuuucaccagcg

SEQ ID NO: 1869380 - RNA, 17 nt, Salmonella typhimurium LT2
ucgccuucuucaucuuc

SEQ ID NO: 1869381 - RNA, 15 nt, Salmonella typhimurium LT2
ucgccuuucaccagc

SEQ ID NO: 1869382 - RNA, 20 nt, Salmonella typhimurium LT2
ucgcgagaaaauagaggaaa

SEQ ID NO: 1869383 - RNA, 20 nt, Salmonella typhimurium LT2
ucgcgauaaucaacucuccu

SEQ ID NO: 1869384 - RNA, 17 nt, Salmonella typhimurium LT2
ucgcgaucacagacaga

SEQ ID NO: 1869385 - RNA, 21 nt, Salmonella typhimurium LT2
ucgcgacggaccggcagcguc

SEQ ID NO: 1869386 - RNA, 20 nt, Salmonella typhimurium LT2
ucgcgaauagugcagaaagg

SEQ ID NO: 1869387 - RNA, 13 nt, Salmonella typhimurium LT2
ucgcgaauuucaa

SEQ ID NO: 1869388 - RNA, 12 nt, Salmonella typhimurium LT2
ucgcgccgccaa

SEQ ID NO: 1869389 - RNA, 21 nt, Salmonella typhimurium LT2
ucgcgccagcgacaucccaga

SEQ ID NO: 1869390 - RNA, 17 nt, Salmonella typhimurium LT2
ucgcgcauggcagggcg

SEQ ID NO: 1869391 - RNA, 20 nt, Salmonella typhimurium LT2
ucgcgccaaaagaggcagca

SEQ ID NO: 1869392 - RNA, 13 nt, Salmonella typhimurium LT2
ucgcgcagccagc

SEQ ID NO: 1869393 - RNA, 13 nt, Salmonella typhimurium LT2
ucgcgauuuagcg

SEQ ID NO: 1869394 - RNA, 13 nt, Salmonella typhimurium LT2
ucgccgcggcgca

SEQ ID NO: 1869395 - RNA, 20 nt, Salmonella typhimurium LT2
ucgccgcggugauccuccug

SEQ ID NO: 1869396 - RNA, 18 nt, Salmonella typhimurium LT2
ucgccgcgcgaagaggau

SEQ ID NO: 1869397 - RNA, 23 nt, Salmonella typhimurium LT2
ucgccggcagacgauagcgggug

SEQ ID NO: 1869398 - RNA, 21 nt, Salmonella typhimurium LT2
ucgccggagccgccuggccug

SEQ ID NO: 1869399 - RNA, 20 nt, Salmonella typhimurium LT2
ucgccugaaugcacugcuga

SEQ ID NO: 1869400 - RNA, 16 nt, Salmonella typhimurium LT2
ucgccugaugaccgcc

SEQ ID NO: 1869401 - RNA, 14 nt, Salmonella typhimurium LT2
ucgccguccauuuc

SEQ ID NO: 1869402 - RNA, 18 nt, Salmonella typhimurium LT2
ucgccgucagugagcccu

SEQ ID NO: 1869403 - RNA, 17 nt, Salmonella typhimurium LT2
ucgccguguaagagcug

SEQ ID NO: 1869404 - RNA, 19 nt, Salmonella typhimurium LT2
ucgccgucguucagccagc

SEQ ID NO: 1869405 - RNA, 18 nt, Salmonella typhimurium LT2
ucgccgucguucagccag

SEQ ID NO: 1869406 - RNA, 17 nt, Salmonella typhimurium LT2
ucgccguugauuuucag

SEQ ID NO: 1869407 - RNA, 13 nt, Salmonella typhimurium LT2
ucgccguuaugca

SEQ ID NO: 1869408 - RNA, 22 nt, Salmonella typhimurium LT2
ucgcccaaauaguccagcagcc

SEQ ID NO: 1869409 - RNA, 23 nt, Salmonella typhimurium LT2
ucgcccaaauaguccagcagcca

SEQ ID NO: 1869410 - RNA, 19 nt, Salmonella typhimurium LT2
ucgcccaaaugcucugcaa

SEQ ID NO: 1869411 - RNA, 18 nt, Salmonella typhimurium LT2
ucgccauuccaagaauga

SEQ ID NO: 1869412 - RNA, 15 nt, Salmonella typhimurium LT2
ucgccaugaccacaa

SEQ ID NO: 1869413 - RNA, 15 nt, Salmonella typhimurium LT2
ucgcccacgcccaga

SEQ ID NO: 1869414 - RNA, 13 nt, Salmonella typhimurium LT2
ucgcccaugacau

SEQ ID NO: 1869415 - RNA, 19 nt, Salmonella typhimurium LT2
ucgcccaugacauucccau

SEQ ID NO: 1869416 - RNA, 21 nt, Salmonella typhimurium LT2
ucgccccgaauccacugucca

SEQ ID NO: 1869417 - RNA, 18 nt, Salmonella typhimurium LT2
ucgcccgcagcaaaaaau

SEQ ID NO: 1869418 - RNA, 18 nt, Salmonella typhimurium LT2
ucgccaaagcagcugcug

SEQ ID NO: 1869419 - RNA, 23 nt, Salmonella typhimurium LT2
uccauaccguuucaacugccccu

SEQ ID NO: 1869420 - RNA, 15 nt, Salmonella typhimurium LT2
ucgccacagcggaau

SEQ ID NO: 1869421 - RNA, 18 nt, Salmonella typhimurium LT2
ucgccaccagcaaaaguu

SEQ ID NO: 1869422 - RNA, 12 nt, Salmonella typhimurium LT2
ucgccaccagcg

SEQ ID NO: 1869423 - RNA, 17 nt, Salmonella typhimurium LT2
ucgccaccaugcugguu

SEQ ID NO: 1869424 - RNA, 23 nt, Salmonella typhimurium LT2
ucgccacccggcuuuuuuauugc

SEQ ID NO: 1869425 - RNA, 21 nt, Salmonella typhimurium LT2
ucgccaccgcauuuucagcuu

SEQ ID NO: 1869426 - RNA, 22 nt, Salmonella typhimurium LT2
ucgccaccguaacuaaaauacu

SEQ ID NO: 1869427 - RNA, 17 nt, Salmonella typhimurium LT2
ucgccagacccagcgcu

SEQ ID NO: 1869428 - RNA, 18 nt, Salmonella typhimurium LT2
ucgccagaccgaaaagcc

SEQ ID NO: 1869429 - RNA, 18 nt, Salmonella typhimurium LT2
ucgccauauccaagcccc

SEQ ID NO: 1869430 - RNA, 12 nt, Salmonella typhimurium LT2
ucgccauaucuu

SEQ ID NO: 1869431 - RNA, 15 nt, Salmonella typhimurium LT2
ucgccauccugacca

SEQ ID NO: 1869432 - RNA, 10 nt, Salmonella typhimurium LT2
ucgccaggcc

SEQ ID NO: 1869433 - RNA, 20 nt, Salmonella typhimurium LT2
ucgccagcggaucgcgucca

SEQ ID NO: 1869434 - RNA, 17 nt, Salmonella typhimurium LT2
ucgccagcgcagucagu

SEQ ID NO: 1869435 - RNA, 18 nt, Salmonella typhimurium LT2
ucgccagcggcagcgcgg

SEQ ID NO: 1869436 - RNA, 22 nt, Salmonella typhimurium LT2
ucgccagcauacgucugcgcug

SEQ ID NO: 1869437 - RNA, 14 nt, Salmonella typhimurium LT2
ucgccagccgcagc

SEQ ID NO: 1869438 - RNA, 14 nt, Salmonella typhimurium LT2
ucgccagccccagc

SEQ ID NO: 1869439 - RNA, 15 nt, Salmonella typhimurium LT2
ucgccagccauucgc

SEQ ID NO: 1869440 - RNA, 17 nt, Salmonella typhimurium LT2
ucgcucucuuucaccag

SEQ ID NO: 1869441 - RNA, 17 nt, Salmonella typhimurium LT2
ucgcugacgccagccag

SEQ ID NO: 1869442 - RNA, 18 nt, Salmonella typhimurium LT2
ucgcugacgccagccagc

SEQ ID NO: 1869443 - RNA, 16 nt, Salmonella typhimurium LT2
ucgcuggcguauuaug

SEQ ID NO: 1869444 - RNA, 16 nt, Salmonella typhimurium LT2
ucgcugcucccggcgu

SEQ ID NO: 1869445 - RNA, 18 nt, Salmonella typhimurium LT2
ucgcugcguuucgggaac

SEQ ID NO: 1869446 - RNA, 20 nt, Salmonella typhimurium LT2
ucgcugcgcucgcccuucgg

SEQ ID NO: 1869447 - RNA, 15 nt, Salmonella typhimurium LT2
ucgcugcgccagcag

SEQ ID NO: 1869448 - RNA, 21 nt, Salmonella typhimurium LT2
ucgcucgacauagguucugcg

SEQ ID NO: 1869449 - RNA, 13 nt, Salmonella typhimurium LT2
ucgcuccagggca

SEQ ID NO: 1869450 - RNA, 14 nt, Salmonella typhimurium LT2
ucgcucaccggccc

SEQ ID NO: 1869451 - RNA, 17 nt, Salmonella typhimurium LT2
ucgcucaauagcgauuc

SEQ ID NO: 1869452 - RNA, 14 nt, Salmonella typhimurium LT2
ucgcuaauuuuuaa

SEQ ID NO: 1869453 - RNA, 20 nt, Salmonella typhimurium LT2
ucgcuacaaccagcgcggcc

SEQ ID NO: 1869454 - RNA, 12 nt, Salmonella typhimurium LT2
ucgcuacaggca

SEQ ID NO: 1869455 - RNA, 14 nt, Salmonella typhimurium LT2
ucgcuacaggcaau

SEQ ID NO: 1869456 - RNA, 15 nt, Salmonella typhimurium LT2
ucgcuaauucucccu

SEQ ID NO: 1869457 - RNA, 20 nt, Salmonella typhimurium LT2
ucgcuaccuucuucccauau

SEQ ID NO: 1869458 - RNA, 16 nt, Salmonella typhimurium LT2
ucgcuaccuuuuuuca

SEQ ID NO: 1869459 - RNA, 17 nt, Salmonella typhimurium LT2
ucgcuaccuuuuuucag

SEQ ID NO: 1869460 - RNA, 18 nt, Salmonella typhimurium LT2
ucgcguuuuucgaaaauu

SEQ ID NO: 1869461 - RNA, 23 nt, Salmonella typhimurium LT2
ucgcuaagagugacgguuuucac

SEQ ID NO: 1869462 - RNA, 23 nt, Salmonella typhimurium LT2
ucgcuaucugacagccaaacugc

SEQ ID NO: 1869463 - RNA, 16 nt, Salmonella typhimurium LT2
ucgcucaacaaacuua

SEQ ID NO: 1869464 - RNA, 17 nt, Salmonella typhimurium LT2
ucgcucaacaaacuuaa

SEQ ID NO: 1869465 - RNA, 16 nt, Salmonella typhimurium LT2
ucgcuauauacccccu

SEQ ID NO: 1869466 - RNA, 13 nt, Salmonella typhimurium LT2
ucgcuaucaauac

SEQ ID NO: 1869467 - RNA, 16 nt, Salmonella typhimurium LT2
ucgcguaguuuuucau

SEQ ID NO: 1869468 - RNA, 20 nt, Salmonella typhimurium LT2
ucgcgucaauauuaaugcug

SEQ ID NO: 1869469 - RNA, 17 nt, Salmonella typhimurium LT2
ucgcggugaucccaggc

SEQ ID NO: 1869470 - RNA, 19 nt, Salmonella typhimurium LT2
ucgcgcugucugccggcgu

SEQ ID NO: 1869471 - RNA, 20 nt, Salmonella typhimurium LT2
ucgcggaagcgaccggcguc

SEQ ID NO: 1869472 - RNA, 14 nt, Salmonella typhimurium LT2
ucgcgcugcaggug

SEQ ID NO: 1869473 - RNA, 18 nt, Salmonella typhimurium LT2
ucgcggaauuucaggaag

SEQ ID NO: 1869474 - RNA, 20 nt, Salmonella typhimurium LT2
ucgcggcaguaagccagcgg

SEQ ID NO: 1869475 - RNA, 15 nt, Salmonella typhimurium LT2
ucgcggcaauggcuu

SEQ ID NO: 1869476 - RNA, 17 nt, Salmonella typhimurium LT2
ucgcgcucaagcgaaaa

SEQ ID NO: 1869477 - RNA, 22 nt, Salmonella typhimurium LT2
ucgcgcggcgguucauccugcg

SEQ ID NO: 1869478 - RNA, 17 nt, Salmonella typhimurium LT2
ucgcgcggcaauuucac

SEQ ID NO: 1869479 - RNA, 18 nt, Salmonella typhimurium LT2
ucgcgccuucgccggguu

SEQ ID NO: 1869480 - RNA, 19 nt, Salmonella typhimurium LT2
ucgcgccgugcccagcauc

SEQ ID NO: 1869481 - RNA, 17 nt, Salmonella typhimurium LT2
ucgcgccgugcccagca

SEQ ID NO: 1869482 - RNA, 18 nt, Salmonella typhimurium LT2
ucgcgccggaacagggcc

SEQ ID NO: 1869483 - RNA, 19 nt, Salmonella typhimurium LT2
ucgcuuuuauguuacccag

SEQ ID NO: 1869484 - RNA, 13 nt, Salmonella typhimurium LT2
ucgcuuucucuuc

SEQ ID NO: 1869485 - RNA, 21 nt, Salmonella typhimurium LT2
ucgcuuucaucguauaaauuu

SEQ ID NO: 1869486 - RNA, 17 nt, Salmonella typhimurium LT2
ucgcuugcccggccguu

SEQ ID NO: 1869487 - RNA, 16 nt, Salmonella typhimurium LT2
ucgcuuacgcggcgcg

SEQ ID NO: 1869488 - RNA, 12 nt, Salmonella typhimurium LT2
ucgcuguuaacc

SEQ ID NO: 1869489 - RNA, 20 nt, Salmonella typhimurium LT2
ucgcuuaacaacuccagcaa

SEQ ID NO: 1869490 - RNA, 22 nt, Salmonella typhimurium LT2
ucgcuuaacaacuccagcaaau

SEQ ID NO: 1869491 - RNA, 22 nt, Salmonella typhimurium LT2
ucgcuuaacggcccaggcaucg

SEQ ID NO: 1869492 - RNA, 18 nt, Salmonella typhimurium LT2
ucggaagacuggcgcagc

SEQ ID NO: 1869493 - RNA, 19 nt, Salmonella typhimurium LT2
ucggaacucacuugucuuc

SEQ ID NO: 1869494 - RNA, 16 nt, Salmonella typhimurium LT2
ucggagguucgaaucc

SEQ ID NO: 1869495 - RNA, 20 nt, Salmonella typhimurium LT2
ucggagguuuucucauccag

SEQ ID NO: 1869496 - RNA, 12 nt, Salmonella typhimurium LT2
ucggagauauac

SEQ ID NO: 1869497 - RNA, 15 nt, Salmonella typhimurium LT2
ucggagauauacauc

SEQ ID NO: 1869498 - RNA, 20 nt, Salmonella typhimurium LT2
ucggagauuucauccucuug

SEQ ID NO: 1869499 - RNA, 22 nt, Salmonella typhimurium LT2
ucggacguaugcuuacagagca

SEQ ID NO: 1869500 - RNA, 18 nt, Salmonella typhimurium LT2
ucggcaucuguagcggcg

SEQ ID NO: 1869501 - RNA, 20 nt, Salmonella typhimurium LT2
ucggcauggcgggagauuga

SEQ ID NO: 1869502 - RNA, 13 nt, Salmonella typhimurium LT2
ucggcauaucgcc

SEQ ID NO: 1869503 - RNA, 12 nt, Salmonella typhimurium LT2
ucggcagcgcga

SEQ ID NO: 1869504 - RNA, 15 nt, Salmonella typhimurium LT2
ucggcaccauuccca

SEQ ID NO: 1869505 - RNA, 17 nt, Salmonella typhimurium LT2
ucggcaccaucuaaauc

SEQ ID NO: 1869506 - RNA, 14 nt, Salmonella typhimurium LT2
ucggcaauaucccg

SEQ ID NO: 1869507 - RNA, 20 nt, Salmonella typhimurium LT2
ucggcaaaacgcgccacgaa

SEQ ID NO: 1869508 - RNA, 18 nt, Salmonella typhimurium LT2
ucggggagacgggcggag

SEQ ID NO: 1869509 - RNA, 19 nt, Salmonella typhimurium LT2
ucgggcccguugccuggcg

SEQ ID NO: 1869510 - RNA, 23 nt, Salmonella typhimurium LT2
ucgggcaggcuuccacgcacgcc

SEQ ID NO: 1869511 - RNA, 22 nt, Salmonella typhimurium LT2
ucgggugacgagggaaggggau

SEQ ID NO: 1869512 - RNA, 23 nt, Salmonella typhimurium LT2
ucgggugagacgcagccucucuu

SEQ ID NO: 1869513 - RNA, 17 nt, Salmonella typhimurium LT2
ucggguaaaaguuugcu

SEQ ID NO: 1869514 - RNA, 16 nt, Salmonella typhimurium LT2
ucggggucuuccagca

SEQ ID NO: 1869515 - RNA, 11 nt, Salmonella typhimurium LT2
ucgguaaccau

SEQ ID NO: 1869516 - RNA, 13 nt, Salmonella typhimurium LT2
ucggguuuuccug

SEQ ID NO: 1869517 - RNA, 21 nt, Salmonella typhimurium LT2
ucgguauaacuggucaucccc

SEQ ID NO: 1869518 - RNA, 15 nt, Salmonella typhimurium LT2
ucgguacuccccuuu

SEQ ID NO: 1869519 - RNA, 23 nt, Salmonella typhimurium LT2
ucgguacuucacaauaagaaauu

SEQ ID NO: 1869520 - RNA, 18 nt, Salmonella typhimurium LT2
ucgguagaaugaauguag

SEQ ID NO: 1869521 - RNA, 22 nt, Salmonella typhimurium LT2
ucgguagcuguaccagaucgcc

SEQ ID NO: 1869522 - RNA, 23 nt, Salmonella typhimurium LT2
ucgguguucacaauuguggucgu

SEQ ID NO: 1869523 - RNA, 22 nt, Salmonella typhimurium LT2
ucggugguuuuaacccccagca

SEQ ID NO: 1869524 - RNA, 22 nt, Salmonella typhimurium LT2
ucgguuugugucguaguggcau

SEQ ID NO: 1869525 - RNA, 19 nt, Salmonella typhimurium LT2
ucguaaagcgcauccagcu

SEQ ID NO: 1869526 - RNA, 20 nt, Salmonella typhimurium LT2
ucgguuugcagacgugcaau

SEQ ID NO: 1869527 - RNA, 18 nt, Salmonella typhimurium LT2
ucggugaaaaugaaaaau

SEQ ID NO: 1869528 - RNA, 16 nt, Salmonella typhimurium LT2
ucggucaacauuccgu

SEQ ID NO: 1869529 - RNA, 20 nt, Salmonella typhimurium LT2
ucggucauaaccggccgaug

SEQ ID NO: 1869530 - RNA, 18 nt, Salmonella typhimurium LT2
ucggucagauaaauaacg

SEQ ID NO: 1869531 - RNA, 24 nt, Salmonella typhimurium LT2
ucggugcuuccggcacugcgccuu

SEQ ID NO: 1869532 - RNA, 14 nt, Salmonella typhimurium LT2
ucggugauuuccag

SEQ ID NO: 1869533 - RNA, 19 nt, Salmonella typhimurium LT2
ucggugacggaaaccagca

SEQ ID NO: 1869534 - RNA, 23 nt, Salmonella typhimurium LT2
ucggcgaugugccuguaaauguu

SEQ ID NO: 1869535 - RNA, 17 nt, Salmonella typhimurium LT2
ucggcgacgucccggca

SEQ ID NO: 1869536 - RNA, 14 nt, Salmonella typhimurium LT2
ucggccauuuuuuu

SEQ ID NO: 1869537 - RNA, 16 nt, Salmonella typhimurium LT2
ucggccagcaguucca

SEQ ID NO: 1869538 - RNA, 18 nt, Salmonella typhimurium LT2
ucggccagauaguggcug

SEQ ID NO: 1869539 - RNA, 21 nt, Salmonella typhimurium LT2
ucggccacgcuaaagucagca

SEQ ID NO: 1869540 - RNA, 15 nt, Salmonella typhimurium LT2
ucggcucauccagca

SEQ ID NO: 1869541 - RNA, 21 nt, Salmonella typhimurium LT2
ucggcucagacaguagcggcg

SEQ ID NO: 1869542 - RNA, 17 nt, Salmonella typhimurium LT2
ucggcguugcccaucgc

SEQ ID NO: 1869543 - RNA, 16 nt, Salmonella typhimurium LT2
ucggcuucucccaaca

SEQ ID NO: 1869544 - RNA, 21 nt, Salmonella typhimurium LT2
ucgggaaucaucgaggccacc

SEQ ID NO: 1869545 - RNA, 14 nt, Salmonella typhimurium LT2
ucgggaacgcuguc

SEQ ID NO: 1869546 - RNA, 13 nt, Salmonella typhimurium LT2
ucggcgcgcuggc

SEQ ID NO: 1869547 - RNA, 12 nt, Salmonella typhimurium LT2
ucggcgcggaaa

SEQ ID NO: 1869548 - RNA, 15 nt, Salmonella typhimurium LT2
ucguccaguaaaauc

SEQ ID NO: 1869549 - RNA, 21 nt, Salmonella typhimurium LT2
ucgucauucauggcgcgcgcc

SEQ ID NO: 1869550 - RNA, 21 nt, Salmonella typhimurium LT2
ucgucaugcucgcuuuccauu

SEQ ID NO: 1869551 - RNA, 21 nt, Salmonella typhimurium LT2
ucgucagacggacaucagagg

SEQ ID NO: 1869552 - RNA, 19 nt, Salmonella typhimurium LT2
ucgucauaauuucguuuua

SEQ ID NO: 1869553 - RNA, 15 nt, Salmonella typhimurium LT2
ucgucauccauccac

SEQ ID NO: 1869554 - RNA, 12 nt, Salmonella typhimurium LT2
ucgucaguucca

SEQ ID NO: 1869555 - RNA, 21 nt, Salmonella typhimurium LT2
ucgucauagcguugauaugcu

SEQ ID NO: 1869556 - RNA, 15 nt, Salmonella typhimurium LT2
ucgucggcaagaauu

SEQ ID NO: 1869557 - RNA, 22 nt, Salmonella typhimurium LT2
ucgucggcaagaauuucaauca

SEQ ID NO: 1869558 - RNA, 19 nt, Salmonella typhimurium LT2
ucgucggcauggucagcau

SEQ ID NO: 1869559 - RNA, 11 nt, Salmonella typhimurium LT2
ucguaccuuca

SEQ ID NO: 1869560 - RNA, 21 nt, Salmonella typhimurium LT2
ucguacacgcgcccgccgcca

SEQ ID NO: 1869561 - RNA, 14 nt, Salmonella typhimurium LT2
ucguacuccugcau

SEQ ID NO: 1869562 - RNA, 15 nt, Salmonella typhimurium LT2
ucguagacucaggcg

SEQ ID NO: 1869563 - RNA, 12 nt, Salmonella typhimurium LT2
ucguaauuuaaa

SEQ ID NO: 1869564 - RNA, 19 nt, Salmonella typhimurium LT2
ucgucaaagaucucgguga

SEQ ID NO: 1869565 - RNA, 19 nt, Salmonella typhimurium LT2
ucgucaccugauagcgggu

SEQ ID NO: 1869566 - RNA, 22 nt, Salmonella typhimurium LT2
ucgucacaauaugguuauccag

SEQ ID NO: 1869567 - RNA, 19 nt, Salmonella typhimurium LT2
ucguauugacaacaaaucc

SEQ ID NO: 1869568 - RNA, 13 nt, Salmonella typhimurium LT2
ucguauccccagu

SEQ ID NO: 1869569 - RNA, 20 nt, Salmonella typhimurium LT2
ucguauccccagucuuccug

SEQ ID NO: 1869570 - RNA, 21 nt, Salmonella typhimurium LT2
ucguauccccagucuuccugc

SEQ ID NO: 1869571 - RNA, 16 nt, Salmonella typhimurium LT2
ucguaugcagccaggc

SEQ ID NO: 1869572 - RNA, 15 nt, Salmonella typhimurium LT2
ucguagccgcgcgcc

SEQ ID NO: 1869573 - RNA, 18 nt, Salmonella typhimurium LT2
ucguaguggaucagcaga

SEQ ID NO: 1869574 - RNA, 18 nt, Salmonella typhimurium LT2
ucgucuguuguucuuauu

SEQ ID NO: 1869575 - RNA, 16 nt, Salmonella typhimurium LT2
ucgucugccgggaaca

SEQ ID NO: 1869576 - RNA, 20 nt, Salmonella typhimurium LT2
ucgugacccguuucccggau

SEQ ID NO: 1869577 - RNA, 17 nt, Salmonella typhimurium LT2
ucgucuucaucccaguc

SEQ ID NO: 1869578 - RNA, 23 nt, Salmonella typhimurium LT2
ucgugaaaaccuaaauaaauacc

SEQ ID NO: 1869579 - RNA, 19 nt, Salmonella typhimurium LT2
ucgugccaugaccauucgc

SEQ ID NO: 1869580 - RNA, 18 nt, Salmonella typhimurium LT2
ucgugccgauaucaauaa

SEQ ID NO: 1869581 - RNA, 15 nt, Salmonella typhimurium LT2
ucgugcagcgccgcc

SEQ ID NO: 1869582 - RNA, 20 nt, Salmonella typhimurium LT2
ucgugcaggauucgaaccug

SEQ ID NO: 1869583 - RNA, 18 nt, Salmonella typhimurium LT2
ucgugcaaccgccugcac

SEQ ID NO: 1869584 - RNA, 20 nt, Salmonella typhimurium LT2
ucguguggcggaaugaccug

SEQ ID NO: 1869585 - RNA, 11 nt, Salmonella typhimurium LT2
ucguuaucauu

SEQ ID NO: 1869586 - RNA, 20 nt, Salmonella typhimurium LT2
ucguuagcaaauugcugaug

SEQ ID NO: 1869587 - RNA, 16 nt, Salmonella typhimurium LT2
ucguuagcaaauugcu

SEQ ID NO: 1869588 - RNA, 14 nt, Salmonella typhimurium LT2
ucguuaccgcuuca

SEQ ID NO: 1869589 - RNA, 16 nt, Salmonella typhimurium LT2
ucguuacccuccugca

SEQ ID NO: 1869590 - RNA, 21 nt, Salmonella typhimurium LT2
ucguuaaaacggaucagccug

SEQ ID NO: 1869591 - RNA, 15 nt, Salmonella typhimurium LT2
ucguucaaaagugcc

SEQ ID NO: 1869592 - RNA, 13 nt, Salmonella typhimurium LT2
ucguuauuuccga

SEQ ID NO: 1869593 - RNA, 14 nt, Salmonella typhimurium LT2
ucguucaguuucaa

SEQ ID NO: 1869594 - RNA, 16 nt, Salmonella typhimurium LT2
ucguucauugcuuucu

SEQ ID NO: 1869595 - RNA, 17 nt, Salmonella typhimurium LT2
ucguugacuucaaucac

SEQ ID NO: 1869596 - RNA, 15 nt, Salmonella typhimurium LT2
ucguugccagcggcc

SEQ ID NO: 1869597 - RNA, 15 nt, Salmonella typhimurium LT2
ucguuguaguaaucc

SEQ ID NO: 1869598 - RNA, 18 nt, Salmonella typhimurium LT2
ucguuucccucauauuug

SEQ ID NO: 1869599 - RNA, 14 nt, Salmonella typhimurium LT2
ucuccagcaacagc

SEQ ID NO: 1869600 - RNA, 22 nt, Salmonella typhimurium LT2
ucuccagggcaacggccagcgc

SEQ ID NO: 1869601 - RNA, 15 nt, Salmonella typhimurium LT2
ucucauugaucaguu

SEQ ID NO: 1869602 - RNA, 18 nt, Salmonella typhimurium LT2
ucucauuguguacaucca

SEQ ID NO: 1869603 - RNA, 22 nt, Salmonella typhimurium LT2
ucucauuguguacauccaggag

SEQ ID NO: 1869604 - RNA, 12 nt, Salmonella typhimurium LT2
ucucauuguauu

SEQ ID NO: 1869605 - RNA, 18 nt, Salmonella typhimurium LT2
ucucauuguauuucucaa

SEQ ID NO: 1869606 - RNA, 14 nt, Salmonella typhimurium LT2
ucuccaguuugcgu

SEQ ID NO: 1869607 - RNA, 17 nt, Salmonella typhimurium LT2
ucucccagaugaaaaau

SEQ ID NO: 1869608 - RNA, 18 nt, Salmonella typhimurium LT2
ucucccagccgggcagga

SEQ ID NO: 1869609 - RNA, 14 nt, Salmonella typhimurium LT2
ucucccaucaauaa

SEQ ID NO: 1869610 - RNA, 20 nt, Salmonella typhimurium LT2
ucucccagccgggcaggaaa

SEQ ID NO: 1869611 - RNA, 17 nt, Salmonella typhimurium LT2
ucucccagccgucaugc

SEQ ID NO: 1869612 - RNA, 13 nt, Salmonella typhimurium LT2
ucucccaacuguu

SEQ ID NO: 1869613 - RNA, 22 nt, Salmonella typhimurium LT2
ucuccaugucacuggcggcggu

SEQ ID NO: 1869614 - RNA, 17 nt, Salmonella typhimurium LT2
ucuccaugccagaagag

SEQ ID NO: 1869615 - RNA, 22 nt, Salmonella typhimurium LT2
ucuccaugccagaagagaagcu

SEQ ID NO: 1869616 - RNA, 15 nt, Salmonella typhimurium LT2
ucuccgcaauuaauu

SEQ ID NO: 1869617 - RNA, 13 nt, Salmonella typhimurium LT2
ucucccuggcagu

SEQ ID NO: 1869618 - RNA, 22 nt, Salmonella typhimurium LT2
ucucccuacugcuuagcucauc

SEQ ID NO: 1869619 - RNA, 21 nt, Salmonella typhimurium LT2
ucucgcuauauacccccugca

SEQ ID NO: 1869620 - RNA, 16 nt, Salmonella typhimurium LT2
ucucgcacucgccgcc

SEQ ID NO: 1869621 - RNA, 17 nt, Salmonella typhimurium LT2
ucucgccgguuggcaug

SEQ ID NO: 1869622 - RNA, 13 nt, Salmonella typhimurium LT2
ucucgcacaucau

SEQ ID NO: 1869623 - RNA, 17 nt, Salmonella typhimurium LT2
ucucgccaaaccacacc

SEQ ID NO: 1869624 - RNA, 16 nt, Salmonella typhimurium LT2
ucucgauuucacgaua

SEQ ID NO: 1869625 - RNA, 16 nt, Salmonella typhimurium LT2
ucucgaaacaauagcu

SEQ ID NO: 1869626 - RNA, 18 nt, Salmonella typhimurium LT2
ucucgauccguccaggau

SEQ ID NO: 1869627 - RNA, 19 nt, Salmonella typhimurium LT2
ucuccggcagcgaauguau

SEQ ID NO: 1869628 - RNA, 18 nt, Salmonella typhimurium LT2
ucuccgcuuuuuuaaucc

SEQ ID NO: 1869629 - RNA, 20 nt, Salmonella typhimurium LT2
ucuccggcgcugcgcucuuu

SEQ ID NO: 1869630 - RNA, 22 nt, Salmonella typhimurium LT2
ucuccuacaccaccagcccggc

SEQ ID NO: 1869631 - RNA, 15 nt, Salmonella typhimurium LT2
ucuccugcgccagcc

SEQ ID NO: 1869632 - RNA, 21 nt, Salmonella typhimurium LT2
ucuccugcgauagcugcugac

SEQ ID NO: 1869633 - RNA, 20 nt, Salmonella typhimurium LT2
ucuccuggaugcgcugaaau

SEQ ID NO: 1869634 - RNA, 13 nt, Salmonella typhimurium LT2
ucucuauuaaccg

SEQ ID NO: 1869635 - RNA, 12 nt, Salmonella typhimurium LT2
ucucgugaacag

SEQ ID NO: 1869636 - RNA, 20 nt, Salmonella typhimurium LT2
ucucuggcgcgggcuucacg

SEQ ID NO: 1869637 - RNA, 15 nt, Salmonella typhimurium LT2
ucucugccaucaucc

SEQ ID NO: 1869638 - RNA, 15 nt, Salmonella typhimurium LT2
ucucugagaucaaac

SEQ ID NO: 1869639 - RNA, 17 nt, Salmonella typhimurium LT2
ucucugaggguguucau

SEQ ID NO: 1869640 - RNA, 19 nt, Salmonella typhimurium LT2
ucucuucgucauacucucu

SEQ ID NO: 1869641 - RNA, 17 nt, Salmonella typhimurium LT2
aaauggagcgagcuggu

SEQ ID NO: 1869642 - RNA, 10 nt, Salmonella typhimurium LT2
aaaugcuuug

SEQ ID NO: 1869643 - RNA, 15 nt, Salmonella typhimurium LT2
ucucuucuuuaaggc

SEQ ID NO: 1869644 - RNA, 12 nt, Salmonella typhimurium LT2
ucucuugccugc

SEQ ID NO: 1869645 - RNA, 16 nt, Salmonella typhimurium LT2
ucugagcgcaaacauc

SEQ ID NO: 1869646 - RNA, 18 nt, Salmonella typhimurium LT2
ucugaccuacaaucgucu

SEQ ID NO: 1869647 - RNA, 11 nt, Salmonella typhimurium LT2
ucugaccaguu

SEQ ID NO: 1869648 - RNA, 13 nt, Salmonella typhimurium LT2
ucugacagccaaa

SEQ ID NO: 1869649 - RNA, 15 nt, Salmonella typhimurium LT2
ucugacacagaggaa

SEQ ID NO: 1869650 - RNA, 17 nt, Salmonella typhimurium LT2
ucugacaggucggcguu

SEQ ID NO: 1869651 - RNA, 22 nt, Salmonella typhimurium LT2
ucugaaaggcgucagccgccau

SEQ ID NO: 1869652 - RNA, 19 nt, Salmonella typhimurium LT2
ucugaaaaggggauaacaa

SEQ ID NO: 1869653 - RNA, 17 nt, Salmonella typhimurium LT2
ucugcacuuugccagag

SEQ ID NO: 1869654 - RNA, 15 nt, Salmonella typhimurium LT2
ucugcacgcacgacg

SEQ ID NO: 1869655 - RNA, 22 nt, Salmonella typhimurium LT2
ucugaguauacagacagcagau

SEQ ID NO: 1869656 - RNA, 19 nt, Salmonella typhimurium LT2
ucugauacugcuccggcgc

SEQ ID NO: 1869657 - RNA, 18 nt, Salmonella typhimurium LT2
ucuuauccggccugcaug

SEQ ID NO: 1869658 - RNA, 23 nt, Salmonella typhimurium LT2
ucuuacggcgcccaacaaacgcu

SEQ ID NO: 1869659 - RNA, 16 nt, Salmonella typhimurium LT2
ucuuacgagaggcuuu

SEQ ID NO: 1869660 - RNA, 18 nt, Salmonella typhimurium LT2
ucuuacggaaaaaugucg

SEQ ID NO: 1869661 - RNA, 14 nt, Salmonella typhimurium LT2
ucuuaguaacauaa

SEQ ID NO: 1869662 - RNA, 21 nt, Salmonella typhimurium LT2
ucuuaauuuuguugaaauuuc

SEQ ID NO: 1869663 - RNA, 21 nt, Salmonella typhimurium LT2
ucuuaccaggucuuaccuauu

SEQ ID NO: 1869664 - RNA, 18 nt, Salmonella typhimurium LT2
ucuuaccgcuaaaauacc

SEQ ID NO: 1869665 - RNA, 12 nt, Salmonella typhimurium LT2
ucuguuguucuu

SEQ ID NO: 1869666 - RNA, 22 nt, Salmonella typhimurium LT2
ucuguuaaaaaauuuauaacgu

SEQ ID NO: 1869667 - RNA, 22 nt, Salmonella typhimurium LT2
ucugugucguccgggccugaua

SEQ ID NO: 1869668 - RNA, 23 nt, Salmonella typhimurium LT2
ucuguuaucaggcauagagaggc

SEQ ID NO: 1869669 - RNA, 19 nt, Salmonella typhimurium LT2
ucuuccagcgucuccagac

SEQ ID NO: 1869670 - RNA, 14 nt, Salmonella typhimurium LT2
ucuuccagcugcuc

SEQ ID NO: 1869671 - RNA, 14 nt, Salmonella typhimurium LT2
ucuuccaucagcca

SEQ ID NO: 1869672 - RNA, 16 nt, Salmonella typhimurium LT2
ucuuccaugccuucau

SEQ ID NO: 1869673 - RNA, 12 nt, Salmonella typhimurium LT2
ucuucccauauu

SEQ ID NO: 1869674 - RNA, 17 nt, Salmonella typhimurium LT2
ucuuccagcgccaaaaa

SEQ ID NO: 1869675 - RNA, 23 nt, Salmonella typhimurium LT2
ucuucccaccggacgaaaaaucu

SEQ ID NO: 1869676 - RNA, 15 nt, Salmonella typhimurium LT2
ucuuccucugugccg

SEQ ID NO: 1869677 - RNA, 15 nt, Salmonella typhimurium LT2
ucuucacuaaaaaca

SEQ ID NO: 1869678 - RNA, 16 nt, Salmonella typhimurium LT2
ucuucacuaaaaacag

SEQ ID NO: 1869679 - RNA, 23 nt, Salmonella typhimurium LT2
ucuucacgacccggcguuuucag

SEQ ID NO: 1869680 - RNA, 23 nt, Salmonella typhimurium LT2
ucuucacgaucgaacgcuaaauc

SEQ ID NO: 1869681 - RNA, 19 nt, Salmonella typhimurium LT2
ucuucaccuuuccagucaa

SEQ ID NO: 1869682 - RNA, 20 nt, Salmonella typhimurium LT2
ucuuccaaccgugucugcug

SEQ ID NO: 1869683 - RNA, 23 nt, Salmonella typhimurium LT2
ucuuccaccacggcaaaaauaug

SEQ ID NO: 1869684 - RNA, 13 nt, Salmonella typhimurium LT2
ucuuccaccauuc

SEQ ID NO: 1869685 - RNA, 17 nt, Salmonella typhimurium LT2
ucuuccacuucagcagc

SEQ ID NO: 1869686 - RNA, 15 nt, Salmonella typhimurium LT2
ucuuccacuucagcc

SEQ ID NO: 1869687 - RNA, 23 nt, Salmonella typhimurium LT2
ucuuccagcacgauauccagcac

SEQ ID NO: 1869688 - RNA, 21 nt, Salmonella typhimurium LT2
ucuguaauucucccaaauuuu

SEQ ID NO: 1869689 - RNA, 15 nt, Salmonella typhimurium LT2
ucuguagcuucuguc

SEQ ID NO: 1869690 - RNA, 17 nt, Salmonella typhimurium LT2
ucuguaugacaacauaa

SEQ ID NO: 1869691 - RNA, 12 nt, Salmonella typhimurium LT2
ucugugaggaaa

SEQ ID NO: 1869692 - RNA, 22 nt, Salmonella typhimurium LT2
ucugucuuuacugaaucucaga

SEQ ID NO: 1869693 - RNA, 18 nt, Salmonella typhimurium LT2
ucugcuugagcaggcaga

SEQ ID NO: 1869694 - RNA, 13 nt, Salmonella typhimurium LT2
ucugcuuuuucac

SEQ ID NO: 1869695 - RNA, 18 nt, Salmonella typhimurium LT2
ucugcuuauucuuuucaa

SEQ ID NO: 1869696 - RNA, 13 nt, Salmonella typhimurium LT2
ucuggcucccgca

SEQ ID NO: 1869697 - RNA, 22 nt, Salmonella typhimurium LT2
ucuggcucaagaguaggccgga

SEQ ID NO: 1869698 - RNA, 13 nt, Salmonella typhimurium LT2
ucuggcucgccgu

SEQ ID NO: 1869699 - RNA, 16 nt, Salmonella typhimurium LT2
ucuggcguuacggaac

SEQ ID NO: 1869700 - RNA, 17 nt, Salmonella typhimurium LT2
ucuggauuacaaaaaua

SEQ ID NO: 1869701 - RNA, 13 nt, Salmonella typhimurium LT2
ucuggcaauaagg

SEQ ID NO: 1869702 - RNA, 12 nt, Salmonella typhimurium LT2
ucuggugcagca

SEQ ID NO: 1869703 - RNA, 12 nt, Salmonella typhimurium LT2
ucuaaaaaggaa

SEQ ID NO: 1869704 - RNA, 11 nt, Salmonella typhimurium LT2
ucuaaaaauaa

SEQ ID NO: 1869705 - RNA, 21 nt, Salmonella typhimurium LT2
ucuaaaaauaauugauaauaa

SEQ ID NO: 1869706 - RNA, 17 nt, Salmonella typhimurium LT2
ucguuugcaguuccgca

SEQ ID NO: 1869707 - RNA, 13 nt, Salmonella typhimurium LT2
ucguuuuccgcaa

SEQ ID NO: 1869708 - RNA, 17 nt, Salmonella typhimurium LT2
ucguuuuuguuuaaaaa

SEQ ID NO: 1869709 - RNA, 17 nt, Salmonella typhimurium LT2
ucuaaaucauaccagcg

SEQ ID NO: 1869710 - RNA, 23 nt, Salmonella typhimurium LT2
ucuaaagagacagaaucaggcca

SEQ ID NO: 1869711 - RNA, 16 nt, Salmonella typhimurium LT2
ucuaauaacacaauac

SEQ ID NO: 1869712 - RNA, 23 nt, Salmonella typhimurium LT2
aaaucuucuacuucaauuuucca

SEQ ID NO: 1869713 - RNA, 23 nt, Salmonella typhimurium LT2
ucuaacgcaacggaaggaaauaa

SEQ ID NO: 1869714 - RNA, 14 nt, Salmonella typhimurium LT2
ucuaagaauuuaau

SEQ ID NO: 1869715 - RNA, 16 nt, Salmonella typhimurium LT2
ucuaagaauuuaaucu

SEQ ID NO: 1869716 - RNA, 17 nt, Salmonella typhimurium LT2
ucuaccagccuggcuga

SEQ ID NO: 1869717 - RNA, 20 nt, Salmonella typhimurium LT2
ucuaccaacugagcuaacga

SEQ ID NO: 1869718 - RNA, 16 nt, Salmonella typhimurium LT2
ucuaccgcauacugaa

SEQ ID NO: 1869719 - RNA, 14 nt, Salmonella typhimurium LT2
ucuaccccgugauu

SEQ ID NO: 1869720 - RNA, 19 nt, Salmonella typhimurium LT2
ucuacgcugccauccucau

SEQ ID NO: 1869721 - RNA, 15 nt, Salmonella typhimurium LT2
ucuacgcgccagcag

SEQ ID NO: 1869722 - RNA, 15 nt, Salmonella typhimurium LT2
aaaugagauugauaa

SEQ ID NO: 1869723 - RNA, 15 nt, Salmonella typhimurium LT2
ucuacaucgccgcga

SEQ ID NO: 1869724 - RNA, 19 nt, Salmonella typhimurium LT2
ucuacaaguucagcaggcu

SEQ ID NO: 1869725 - RNA, 14 nt, Salmonella typhimurium LT2
ucuaauuaaaaaga

SEQ ID NO: 1869726 - RNA, 19 nt, Salmonella typhimurium LT2
ucucaauaucguugccgcc

SEQ ID NO: 1869727 - RNA, 13 nt, Salmonella typhimurium LT2
ucucaaugaacag

SEQ ID NO: 1869728 - RNA, 15 nt, Salmonella typhimurium LT2
ucucaagcgccgccg

SEQ ID NO: 1869729 - RNA, 18 nt, Salmonella typhimurium LT2
ucucaagcgccgccgcau

SEQ ID NO: 1869730 - RNA, 22 nt, Salmonella typhimurium LT2
ucucaagcgccgccgcauuuug

SEQ ID NO: 1869731 - RNA, 14 nt, Salmonella typhimurium LT2
ucucaagagugaac

SEQ ID NO: 1869732 - RNA, 14 nt, Salmonella typhimurium LT2
ucucaaagugcgcc

SEQ ID NO: 1869733 - RNA, 16 nt, Salmonella typhimurium LT2
ucucaaaaacaccauu

SEQ ID NO: 1869734 - RNA, 13 nt, Salmonella typhimurium LT2
ucuauuuuuucaa

SEQ ID NO: 1869735 - RNA, 13 nt, Salmonella typhimurium LT2
ucuauuaaaauaa

SEQ ID NO: 1869736 - RNA, 17 nt, Salmonella typhimurium LT2
ucuauuauuuuucuauu

SEQ ID NO: 1869737 - RNA, 16 nt, Salmonella typhimurium LT2
ucucaccgcccaggcc

SEQ ID NO: 1869738 - RNA, 11 nt, Salmonella typhimurium LT2
aaaugcgcaug

SEQ ID NO: 1869739 - RNA, 20 nt, Salmonella typhimurium LT2
aaaugcgcgcggcugccgga

SEQ ID NO: 1869740 - RNA, 13 nt, Salmonella typhimurium LT2
ucucaccguggca

SEQ ID NO: 1869741 - RNA, 19 nt, Salmonella typhimurium LT2
ucucacguacaaacgcuuc

SEQ ID NO: 1869742 - RNA, 22 nt, Salmonella typhimurium LT2
aaaugccugccguuuuuaacac

SEQ ID NO: 1869743 - RNA, 21 nt, Salmonella typhimurium LT2
aaaugcccgauggcguaagcu

SEQ ID NO: 1869744 - RNA, 16 nt, Salmonella typhimurium LT2
aaaugccgcccaucca

SEQ ID NO: 1869745 - RNA, 23 nt, Salmonella typhimurium LT2
aaaugccgcccauccagagcagu

SEQ ID NO: 1869746 - RNA, 14 nt, Salmonella typhimurium LT2
ucucagauaauagc

SEQ ID NO: 1869747 - RNA, 23 nt, Salmonella typhimurium LT2
ucucaggcaucgcugauaaaaac

SEQ ID NO: 1869748 - RNA, 20 nt, Salmonella typhimurium LT2
ucucaggcuugccaaagcgg

SEQ ID NO: 1869749 - RNA, 19 nt, Salmonella typhimurium LT2
ucucauccagcuugccguc

SEQ ID NO: 1869750 - RNA, 13 nt, Salmonella typhimurium LT2
aaaugauguccac

SEQ ID NO: 1869751 - RNA, 18 nt, Salmonella typhimurium LT2
aaaugauuuuuauaaaau

SEQ ID NO: 1869752 - RNA, 20 nt, Salmonella typhimurium LT2
aaaugauaagcacuauuaua

SEQ ID NO: 1869753 - RNA, 13 nt, Salmonella typhimurium LT2
aaaugaucacuuc

SEQ ID NO: 1869754 - RNA, 19 nt, Salmonella typhimurium LT2
ucuagaugaugauuuauga

SEQ ID NO: 1869755 - RNA, 16 nt, Salmonella typhimurium LT2
ucuaucggcaaaccau

SEQ ID NO: 1869756 - RNA, 17 nt, Salmonella typhimurium LT2
ucuaugaaugccggaug

SEQ ID NO: 1869757 - RNA, 14 nt, Salmonella typhimurium LT2
ucuaugcgcuaugu

SEQ ID NO: 1869758 - RNA, 20 nt, Salmonella typhimurium LT2
ucuauagcggucaaaauaua

SEQ ID NO: 1869759 - RNA, 15 nt, Salmonella typhimurium LT2
uuaacaacuccagca

SEQ ID NO: 1869760 - RNA, 17 nt, Salmonella typhimurium LT2
uuaaauugguuauauua

SEQ ID NO: 1869761 - RNA, 17 nt, Salmonella typhimurium LT2
uuaaauugcuauaccgc

SEQ ID NO: 1869762 - RNA, 20 nt, Salmonella typhimurium LT2
uuaaaugugcggcguacugc

SEQ ID NO: 1869763 - RNA, 13 nt, Salmonella typhimurium LT2
uuaaauaaaaaug

SEQ ID NO: 1869764 - RNA, 19 nt, Salmonella typhimurium LT2
uuaaaguacuucacaauca

SEQ ID NO: 1869765 - RNA, 13 nt, Salmonella typhimurium LT2
uuaaagccuucau

SEQ ID NO: 1869766 - RNA, 19 nt, Salmonella typhimurium LT2
uuaaauaccagcaccugaa

SEQ ID NO: 1869767 - RNA, 22 nt, Salmonella typhimurium LT2
uuaagccccucgcuaaugcccg

SEQ ID NO: 1869768 - RNA, 15 nt, Salmonella typhimurium LT2
uuaaggcaucaauac

SEQ ID NO: 1869769 - RNA, 20 nt, Salmonella typhimurium LT2
uuaaggccggcauuuuauuc

SEQ ID NO: 1869770 - RNA, 21 nt, Salmonella typhimurium LT2
uuaaggccggcauuuuauuca

SEQ ID NO: 1869771 - RNA, 17 nt, Salmonella typhimurium LT2
uuaaggcggcaaagaua

SEQ ID NO: 1869772 - RNA, 21 nt, Salmonella typhimurium LT2
uuaauauaugaaccaagauaa

SEQ ID NO: 1869773 - RNA, 11 nt, Salmonella typhimurium LT2
uuaauacacga

SEQ ID NO: 1869774 - RNA, 15 nt, Salmonella typhimurium LT2
uuaauauauuuauau

SEQ ID NO: 1869775 - RNA, 16 nt, Salmonella typhimurium LT2
uuaauauauuuauaua

SEQ ID NO: 1869776 - RNA, 15 nt, Salmonella typhimurium LT2
uuaaucagcgcuguc

SEQ ID NO: 1869777 - RNA, 16 nt, Salmonella typhimurium LT2
uuaacaucagaaaaaa

SEQ ID NO: 1869778 - RNA, 16 nt, Salmonella typhimurium LT2
uuaacaucaccuuuca

SEQ ID NO: 1869779 - RNA, 13 nt, Salmonella typhimurium LT2
uuaacauaugggc

SEQ ID NO: 1869780 - RNA, 20 nt, Salmonella typhimurium LT2
uuaacagcgccaucaggaaa

SEQ ID NO: 1869781 - RNA, 18 nt, Salmonella typhimurium LT2
uuaacagauaguuaauaa

SEQ ID NO: 1869782 - RNA, 19 nt, Salmonella typhimurium LT2
uuaacagauggcgcuucgu

SEQ ID NO: 1869783 - RNA, 20 nt, Salmonella typhimurium LT2
uuaacauguuuuguauuaau

SEQ ID NO: 1869784 - RNA, 15 nt, Salmonella typhimurium LT2
uuaacgacaaaaaua

SEQ ID NO: 1869785 - RNA, 22 nt, Salmonella typhimurium LT2
uuaacgcgaauccgccauagcc

SEQ ID NO: 1869786 - RNA, 18 nt, Salmonella typhimurium LT2
uuaacgcauguuccgcua

SEQ ID NO: 1869787 - RNA, 21 nt, Salmonella typhimurium LT2
uuaagaacgguuggaauaauu

SEQ ID NO: 1869788 - RNA, 14 nt, Salmonella typhimurium LT2
uuaagauccugacu

SEQ ID NO: 1869789 - RNA, 22 nt, Salmonella typhimurium LT2
uuaagaucgcaggccaaaaaaa

SEQ ID NO: 1869790 - RNA, 23 nt, Salmonella typhimurium LT2
uuaagaucgcaggccaaaaaaac

SEQ ID NO: 1869791 - RNA, 23 nt, Salmonella typhimurium LT2
uuaagcaacugauuaaucugccg

SEQ ID NO: 1869792 - RNA, 22 nt, Salmonella typhimurium LT2
uuaacuggcgacgacuucaccc

SEQ ID NO: 1869793 - RNA, 19 nt, Salmonella typhimurium LT2
uuaacuucuccuccaucag

SEQ ID NO: 1869794 - RNA, 13 nt, Salmonella typhimurium LT2
uuacguaguccgg

SEQ ID NO: 1869795 - RNA, 15 nt, Salmonella typhimurium LT2
uuacgucagcaauac

SEQ ID NO: 1869796 - RNA, 16 nt, Salmonella typhimurium LT2
uuacuaccaucaauac

SEQ ID NO: 1869797 - RNA, 17 nt, Salmonella typhimurium LT2
uuacuaccaucaauacu

SEQ ID NO: 1869798 - RNA, 23 nt, Salmonella typhimurium LT2
uuacgcuuaauggcgucaaucaa

SEQ ID NO: 1869799 - RNA, 21 nt, Salmonella typhimurium LT2
uuacgcucgucaaacaguuca

SEQ ID NO: 1869800 - RNA, 17 nt, Salmonella typhimurium LT2
uuacgggaacagaauua

SEQ ID NO: 1869801 - RNA, 19 nt, Salmonella typhimurium LT2
uuacggauguacucaucca

SEQ ID NO: 1869802 - RNA, 14 nt, Salmonella typhimurium LT2
uuacgcugccucuu

SEQ ID NO: 1869803 - RNA, 12 nt, Salmonella typhimurium LT2
uuacgccgccau

SEQ ID NO: 1869804 - RNA, 19 nt, Salmonella typhimurium LT2
uuacgcggucuuuuaaaag

SEQ ID NO: 1869805 - RNA, 18 nt, Salmonella typhimurium LT2
uuacgcagcaagaacaga

SEQ ID NO: 1869806 - RNA, 22 nt, Salmonella typhimurium LT2
uuacgcagcaagaacagagcaa

SEQ ID NO: 1869807 - RNA, 20 nt, Salmonella typhimurium LT2
uuacgcacgccagauaaauc

SEQ ID NO: 1869808 - RNA, 13 nt, Salmonella typhimurium LT2
uuacgcacuuuua

SEQ ID NO: 1869809 - RNA, 13 nt, Salmonella typhimurium LT2
uuacgccacguuc

SEQ ID NO: 1869810 - RNA, 14 nt, Salmonella typhimurium LT2
uuacucuuccacca

SEQ ID NO: 1869811 - RNA, 11 nt, Salmonella typhimurium LT2
uuacucuucca

SEQ ID NO: 1869812 - RNA, 14 nt, Salmonella typhimurium LT2
uuacuaucccauuu

SEQ ID NO: 1869813 - RNA, 18 nt, Salmonella typhimurium LT2
uuacuauagauauuaaac

SEQ ID NO: 1869814 - RNA, 14 nt, Salmonella typhimurium LT2
uuagacaucaaaau

SEQ ID NO: 1869815 - RNA, 14 nt, Salmonella typhimurium LT2
uuagcgaaacugcc

SEQ ID NO: 1869816 - RNA, 22 nt, Salmonella typhimurium LT2
uuagcgcgaaauaaucagguga

SEQ ID NO: 1869817 - RNA, 19 nt, Salmonella typhimurium LT2
uuagcgcauuuuuaucaga

SEQ ID NO: 1869818 - RNA, 15 nt, Salmonella typhimurium LT2
uuagcgcccauaaug

SEQ ID NO: 1869819 - RNA, 14 nt, Salmonella typhimurium LT2
uuagauuaaucacu

SEQ ID NO: 1869820 - RNA, 12 nt, Salmonella typhimurium LT2
uuaccucuuucg

SEQ ID NO: 1869821 - RNA, 13 nt, Salmonella typhimurium LT2
uuaccuaccaguu

SEQ ID NO: 1869822 - RNA, 22 nt, Salmonella typhimurium LT2
uuacgaaucgaauacagcgccu

SEQ ID NO: 1869823 - RNA, 18 nt, Salmonella typhimurium LT2
uuacgauacguuugaaau

SEQ ID NO: 1869824 - RNA, 15 nt, Salmonella typhimurium LT2
uuacgauauuuuucu

SEQ ID NO: 1869825 - RNA, 20 nt, Salmonella typhimurium LT2
uuacgagugcguucuuccac

SEQ ID NO: 1869826 - RNA, 16 nt, Salmonella typhimurium LT2
uuaccgcgcucaaaug

SEQ ID NO: 1869827 - RNA, 16 nt, Salmonella typhimurium LT2
uuaccgguucaacugg

SEQ ID NO: 1869828 - RNA, 14 nt, Salmonella typhimurium LT2
uuaccggcaauagu

SEQ ID NO: 1869829 - RNA, 21 nt, Salmonella typhimurium LT2
uuaccggcaauagucuccaug

SEQ ID NO: 1869830 - RNA, 22 nt, Salmonella typhimurium LT2
uuaccaucaggugaguaaauaa

SEQ ID NO: 1869831 - RNA, 23 nt, Salmonella typhimurium LT2
uuaccaucaggugaguaaauaaa

SEQ ID NO: 1869832 - RNA, 22 nt, Salmonella typhimurium LT2
uuaccagaccggcaucucaucu

SEQ ID NO: 1869833 - RNA, 19 nt, Salmonella typhimurium LT2
uuaccacuuugcgcuccug

SEQ ID NO: 1869834 - RNA, 19 nt, Salmonella typhimurium LT2
uuaccagcaauaacaggca

SEQ ID NO: 1869835 - RNA, 23 nt, Salmonella typhimurium LT2
uuacaucaaaugaacacaaaaaa

SEQ ID NO: 1869836 - RNA, 19 nt, Salmonella typhimurium LT2
uuaaugacuuuuuauauaa

SEQ ID NO: 1869837 - RNA, 15 nt, Salmonella typhimurium LT2
uuaauuuaauaauaa

SEQ ID NO: 1869838 - RNA, 17 nt, Salmonella typhimurium LT2
uuaauuuucuuuuauug

SEQ ID NO: 1869839 - RNA, 18 nt, Salmonella typhimurium LT2
uuaaugacuuuuuauaua

SEQ ID NO: 1869840 - RNA, 14 nt, Salmonella typhimurium LT2
uuaaucccaacccg

SEQ ID NO: 1869841 - RNA, 16 nt, Salmonella typhimurium LT2
uuacacaauaucaaua

SEQ ID NO: 1869842 - RNA, 15 nt, Salmonella typhimurium LT2
uuacacagacugcuu

SEQ ID NO: 1869843 - RNA, 22 nt, Salmonella typhimurium LT2
uguuugaugucgaggaaaaaca

SEQ ID NO: 1869844 - RNA, 23 nt, Salmonella typhimurium LT2
uguuucuuuuaaggcggcaaaga

SEQ ID NO: 1869845 - RNA, 15 nt, Salmonella typhimurium LT2
uguuucgucaauauu

SEQ ID NO: 1869846 - RNA, 23 nt, Salmonella typhimurium LT2
uguuuccauacauuuuuguaaua

SEQ ID NO: 1869847 - RNA, 21 nt, Salmonella typhimurium LT2
uguuuccauacauuuuuguaa

SEQ ID NO: 1869848 - RNA, 15 nt, Salmonella typhimurium LT2
uguuuccagugcagc

SEQ ID NO: 1869849 - RNA, 16 nt, Salmonella typhimurium LT2
uguuucaucucaucaa

SEQ ID NO: 1869850 - RNA, 13 nt, Salmonella typhimurium LT2
uguuucauuucgc

SEQ ID NO: 1869851 - RNA, 19 nt, Salmonella typhimurium LT2
uguuuauccccgcuggcgc

SEQ ID NO: 1869852 - RNA, 17 nt, Salmonella typhimurium LT2
uguuuucgagccuugcc

SEQ ID NO: 1869853 - RNA, 12 nt, Salmonella typhimurium LT2
uguuuuucucuu

SEQ ID NO: 1869854 - RNA, 16 nt, Salmonella typhimurium LT2
uguuuuuauuuuucuu

SEQ ID NO: 1869855 - RNA, 12 nt, Salmonella typhimurium LT2
uguuuuucagau

SEQ ID NO: 1869856 - RNA, 19 nt, Salmonella typhimurium LT2
uguuuucauauguuugaua

SEQ ID NO: 1869857 - RNA, 16 nt, Salmonella typhimurium LT2
uguuuuauuaccuccu

SEQ ID NO: 1869858 - RNA, 16 nt, Salmonella typhimurium LT2
uguuuuagcaugacaa

SEQ ID NO: 1869859 - RNA, 15 nt, Salmonella typhimurium LT2
uguuuuauacucaaa

SEQ ID NO: 1869860 - RNA, 20 nt, Salmonella typhimurium LT2
uguuuuauacucaaaaaauc

SEQ ID NO: 1869861 - RNA, 19 nt, Salmonella typhimurium LT2
uguuuuaccaaaucaauag

SEQ ID NO: 1869862 - RNA, 18 nt, Salmonella typhimurium LT2
uuaaacucugaaaacggu

SEQ ID NO: 1869863 - RNA, 21 nt, Salmonella typhimurium LT2
uuaaaaugcggggacuggaug

SEQ ID NO: 1869864 - RNA, 17 nt, Salmonella typhimurium LT2
uuaaaaagcugcauaau

SEQ ID NO: 1869865 - RNA, 13 nt, Salmonella typhimurium LT2
uuaaaaagcugca

SEQ ID NO: 1869866 - RNA, 14 nt, Salmonella typhimurium LT2
uuaaaaagcugcau

SEQ ID NO: 1869867 - RNA, 16 nt, Salmonella typhimurium LT2
uuaaaaagcagccaga

SEQ ID NO: 1869868 - RNA, 22 nt, Salmonella typhimurium LT2
uuaaaaacagguugcguaacgc

SEQ ID NO: 1869869 - RNA, 12 nt, Salmonella typhimurium LT2
uuaaaaacauca

SEQ ID NO: 1869870 - RNA, 20 nt, Salmonella typhimurium LT2
uuaaaaaaauaugcaauuaa

SEQ ID NO: 1869871 - RNA, 11 nt, Salmonella typhimurium LT2
uuaaaaaaacg

SEQ ID NO: 1869872 - RNA, 19 nt, Salmonella typhimurium LT2
uuaaaacggaucagccuga

SEQ ID NO: 1869873 - RNA, 21 nt, Salmonella typhimurium LT2
uguuauuaugugaucuauaua

SEQ ID NO: 1869874 - RNA, 13 nt, Salmonella typhimurium LT2
uguuaugaaugac

SEQ ID NO: 1869875 - RNA, 16 nt, Salmonella typhimurium LT2
uguuauccuaaaucug

SEQ ID NO: 1869876 - RNA, 15 nt, Salmonella typhimurium LT2
uguuaguuucuauua

SEQ ID NO: 1869877 - RNA, 20 nt, Salmonella typhimurium LT2
uguuauaaccagacgguuua

SEQ ID NO: 1869878 - RNA, 14 nt, Salmonella typhimurium LT2
uguuaguuucuauu

SEQ ID NO: 1869879 - RNA, 20 nt, Salmonella typhimurium LT2
uguuauagccuaaucucgcc

SEQ ID NO: 1869880 - RNA, 19 nt, Salmonella typhimurium LT2
uguuaguguccuuacggac

SEQ ID NO: 1869881 - RNA, 19 nt, Salmonella typhimurium LT2
uguuaguguucuuacggac

SEQ ID NO: 1869882 - RNA, 14 nt, Salmonella typhimurium LT2
uguucauaaagugc

SEQ ID NO: 1869883 - RNA, 18 nt, Salmonella typhimurium LT2
uguucauaaagugccagg

SEQ ID NO: 1869884 - RNA, 14 nt, Salmonella typhimurium LT2
uguucagccagcaa

SEQ ID NO: 1869885 - RNA, 13 nt, Salmonella typhimurium LT2
uguucacaauugu

SEQ ID NO: 1869886 - RNA, 17 nt, Salmonella typhimurium LT2
uguucaaaaacauccac

SEQ ID NO: 1869887 - RNA, 23 nt, Salmonella typhimurium LT2
uguucauaucgaagaccuggccg

SEQ ID NO: 1869888 - RNA, 21 nt, Salmonella typhimurium LT2
uguucaucaaagaaaaccacg

SEQ ID NO: 1869889 - RNA, 11 nt, Salmonella typhimurium LT2
uguucccugcc

SEQ ID NO: 1869890 - RNA, 14 nt, Salmonella typhimurium LT2
uguuccugagcaga

SEQ ID NO: 1869891 - RNA, 19 nt, Salmonella typhimurium LT2
uguuccugagucacagaau

SEQ ID NO: 1869892 - RNA, 17 nt, Salmonella typhimurium LT2
uguuccugcuggcaaaa

SEQ ID NO: 1869893 - RNA, 15 nt, Salmonella typhimurium LT2
uguucgccacccgcc

SEQ ID NO: 1869894 - RNA, 21 nt, Salmonella typhimurium LT2
uguucgcuucuucuaccaccu

SEQ ID NO: 1869895 - RNA, 19 nt, Salmonella typhimurium LT2
uguucguagcccauagcaa

SEQ ID NO: 1869896 - RNA, 13 nt, Salmonella typhimurium LT2
uguucuuccauug

SEQ ID NO: 1869897 - RNA, 13 nt, Salmonella typhimurium LT2
uguucuuacggac

SEQ ID NO: 1869898 - RNA, 13 nt, Salmonella typhimurium LT2
uguucuucuuuca

SEQ ID NO: 1869899 - RNA, 14 nt, Salmonella typhimurium LT2
uguugacugcgcuc

SEQ ID NO: 1869900 - RNA, 12 nt, Salmonella typhimurium LT2
uguugacugcgc

SEQ ID NO: 1869901 - RNA, 20 nt, Salmonella typhimurium LT2
uguugaaacaucauuucuac

SEQ ID NO: 1869902 - RNA, 14 nt, Salmonella typhimurium LT2
uguugaccaacaau

SEQ ID NO: 1869903 - RNA, 16 nt, Salmonella typhimurium LT2
uguugcgcaagcacug

SEQ ID NO: 1869904 - RNA, 21 nt, Salmonella typhimurium LT2
uguugcggaugaccgcaaacc

SEQ ID NO: 1869905 - RNA, 20 nt, Salmonella typhimurium LT2
uguugccggauagcucgcug

SEQ ID NO: 1869906 - RNA, 16 nt, Salmonella typhimurium LT2
uguugcuccagcauca

SEQ ID NO: 1869907 - RNA, 13 nt, Salmonella typhimurium LT2
uguugccaugauc

SEQ ID NO: 1869908 - RNA, 21 nt, Salmonella typhimurium LT2
uguugcaccuguuucugcugg

SEQ ID NO: 1869909 - RNA, 22 nt, Salmonella typhimurium LT2
uguugcacgcauggcacuggcg

SEQ ID NO: 1869910 - RNA, 23 nt, Salmonella typhimurium LT2
uguugauauggugcgcuuuuggc

SEQ ID NO: 1869911 - RNA, 23 nt, Salmonella typhimurium LT2
uguugaucucauuguauuucuca

SEQ ID NO: 1869912 - RNA, 21 nt, Salmonella typhimurium LT2
uguugugugccgcgcuggugg

SEQ ID NO: 1869913 - RNA, 22 nt, Salmonella typhimurium LT2
uguuguacagcaauaaaaggaa

SEQ ID NO: 1869914 - RNA, 22 nt, Salmonella typhimurium LT2
uguuguagaaugaauuucuuca

SEQ ID NO: 1869915 - RNA, 21 nt, Salmonella typhimurium LT2
uguuggcaccguucgcauuac

SEQ ID NO: 1869916 - RNA, 19 nt, Salmonella typhimurium LT2
uguugggguugcccggcgc

SEQ ID NO: 1869917 - RNA, 21 nt, Salmonella typhimurium LT2
uguuguucgucuuuugaauag

SEQ ID NO: 1869918 - RNA, 16 nt, Salmonella typhimurium LT2
uguuuaauacgcuguc

SEQ ID NO: 1869919 - RNA, 20 nt, Salmonella typhimurium LT2
uguuuaaucaacggguuaaa

SEQ ID NO: 1869920 - RNA, 18 nt, Salmonella typhimurium LT2
uguuuaauggcagaauaa

SEQ ID NO: 1869921 - RNA, 14 nt, Salmonella typhimurium LT2
uguuuaccuuuacg

SEQ ID NO: 1869922 - RNA, 14 nt, Salmonella typhimurium LT2
uguuuacgccgcca

SEQ ID NO: 1869923 - RNA, 16 nt, Salmonella typhimurium LT2
uguacuugcgccgcca

SEQ ID NO: 1869924 - RNA, 19 nt, Salmonella typhimurium LT2
uguacuuguugcuggcagg

SEQ ID NO: 1869925 - RNA, 21 nt, Salmonella typhimurium LT2
uguagaaauucugcaggccaa

SEQ ID NO: 1869926 - RNA, 21 nt, Salmonella typhimurium LT2
uguagaaaagaaggggcuggc

SEQ ID NO: 1869927 - RNA, 19 nt, Salmonella typhimurium LT2
uguacccucgcgccaguga

SEQ ID NO: 1869928 - RNA, 16 nt, Salmonella typhimurium LT2
uguaccagcaacgcca

SEQ ID NO: 1869929 - RNA, 16 nt, Salmonella typhimurium LT2
uguaccaacugcugcg

SEQ ID NO: 1869930 - RNA, 22 nt, Salmonella typhimurium LT2
uguaacgaguugcggcaacgug

SEQ ID NO: 1869931 - RNA, 13 nt, Salmonella typhimurium LT2
uguaaccaacaaa

SEQ ID NO: 1869932 - RNA, 22 nt, Salmonella typhimurium LT2
uguaacgggugaucuuuauaaa

SEQ ID NO: 1869933 - RNA, 21 nt, Salmonella typhimurium LT2
uguacaaacacgucuuugcug

SEQ ID NO: 1869934 - RNA, 20 nt, Salmonella typhimurium LT2
ugguuucaugcaucauugaa

SEQ ID NO: 1869935 - RNA, 23 nt, Salmonella typhimurium LT2
uggucuuaaugcugcgguugagc

SEQ ID NO: 1869936 - RNA, 18 nt, Salmonella typhimurium LT2
uggucuggauugcagaga

SEQ ID NO: 1869937 - RNA, 14 nt, Salmonella typhimurium LT2
uggucuucuuucag

SEQ ID NO: 1869938 - RNA, 22 nt, Salmonella typhimurium LT2
ugguuuaaacucugaaaacggu

SEQ ID NO: 1869939 - RNA, 21 nt, Salmonella typhimurium LT2
uggugaaacugaugugacauu

SEQ ID NO: 1869940 - RNA, 15 nt, Salmonella typhimurium LT2
uguaacacgccuggc

SEQ ID NO: 1869941 - RNA, 20 nt, Salmonella typhimurium LT2
uguaacagcaggacccgaga

SEQ ID NO: 1869942 - RNA, 11 nt, Salmonella typhimurium LT2
uguaaaaaaau

SEQ ID NO: 1869943 - RNA, 21 nt, Salmonella typhimurium LT2
uguaaaaaaauaaaaaaggca

SEQ ID NO: 1869944 - RNA, 18 nt, Salmonella typhimurium LT2
ugguuuuuaucuuuucuc

SEQ ID NO: 1869945 - RNA, 16 nt, Salmonella typhimurium LT2
uguaggccuaaaaaua

SEQ ID NO: 1869946 - RNA, 13 nt, Salmonella typhimurium LT2
uguagcgcuuugg

SEQ ID NO: 1869947 - RNA, 19 nt, Salmonella typhimurium LT2
uguagcgccgccugacugg

SEQ ID NO: 1869948 - RNA, 17 nt, Salmonella typhimurium LT2
uguagcgcugaagcccg

SEQ ID NO: 1869949 - RNA, 18 nt, Salmonella typhimurium LT2
uguagauacugauauacg

SEQ ID NO: 1869950 - RNA, 18 nt, Salmonella typhimurium LT2
uguagcucauaacucgcu

SEQ ID NO: 1869951 - RNA, 17 nt, Salmonella typhimurium LT2
uguaggguacagcgcga

SEQ ID NO: 1869952 - RNA, 18 nt, Salmonella typhimurium LT2
uguagguuccgacaauaa

SEQ ID NO: 1869953 - RNA, 12 nt, Salmonella typhimurium LT2
uguaguuaucgc

SEQ ID NO: 1869954 - RNA, 18 nt, Salmonella typhimurium LT2
uguaguuagcgcccauaa

SEQ ID NO: 1869955 - RNA, 15 nt, Salmonella typhimurium LT2
uguauaaacucagca

SEQ ID NO: 1869956 - RNA, 17 nt, Salmonella typhimurium LT2
uguauacauacauacau

SEQ ID NO: 1869957 - RNA, 16 nt, Salmonella typhimurium LT2
uguauagacaaguaua

SEQ ID NO: 1869958 - RNA, 14 nt, Salmonella typhimurium LT2
ugucacgcaggggg

SEQ ID NO: 1869959 - RNA, 22 nt, Salmonella typhimurium LT2
ugucaagguggugcucuaacca

SEQ ID NO: 1869960 - RNA, 15 nt, Salmonella typhimurium LT2
ugucaaauucaagcc

SEQ ID NO: 1869961 - RNA, 13 nt, Salmonella typhimurium LT2
ugucaaagcauug

SEQ ID NO: 1869962 - RNA, 22 nt, Salmonella typhimurium LT2
uguauuaaaggaucgauuaagg

SEQ ID NO: 1869963 - RNA, 15 nt, Salmonella typhimurium LT2
uguaugcucauaaga

SEQ ID NO: 1869964 - RNA, 19 nt, Salmonella typhimurium LT2
ugucagaagaagguaaaag

SEQ ID NO: 1869965 - RNA, 19 nt, Salmonella typhimurium LT2
ugucacuuaaguaaagauu

SEQ ID NO: 1869966 - RNA, 21 nt, Salmonella typhimurium LT2
ugucauagucggcgccaaagu

SEQ ID NO: 1869967 - RNA, 16 nt, Salmonella typhimurium LT2
ugucaguggacgauaa

SEQ ID NO: 1869968 - RNA, 17 nt, Salmonella typhimurium LT2
ugucaucgccauccugc

SEQ ID NO: 1869969 - RNA, 14 nt, Salmonella typhimurium LT2
ugucauccaccagg

SEQ ID NO: 1869970 - RNA, 18 nt, Salmonella typhimurium LT2
ugucauccuguucaucca

SEQ ID NO: 1869971 - RNA, 19 nt, Salmonella typhimurium LT2
ugucauccuguucauccac

SEQ ID NO: 1869972 - RNA, 16 nt, Salmonella typhimurium LT2
ugucauauuugugagc

SEQ ID NO: 1869973 - RNA, 20 nt, Salmonella typhimurium LT2
ugucaugcuaaaacagauaa

SEQ ID NO: 1869974 - RNA, 17 nt, Salmonella typhimurium LT2
ugucaugcuaaaacaga

SEQ ID NO: 1869975 - RNA, 19 nt, Salmonella typhimurium LT2
ugucguauaccguuucucc

SEQ ID NO: 1869976 - RNA, 17 nt, Salmonella typhimurium LT2
ugucgggccaggcuccg

SEQ ID NO: 1869977 - RNA, 19 nt, Salmonella typhimurium LT2
ugucgggccuacagaugaa

SEQ ID NO: 1869978 - RNA, 21 nt, Salmonella typhimurium LT2
ugucgcggauaugcagcagcc

SEQ ID NO: 1869979 - RNA, 14 nt, Salmonella typhimurium LT2
uguccacacugacg

SEQ ID NO: 1869980 - RNA, 19 nt, Salmonella typhimurium LT2
uguccaacguugugcuccg

SEQ ID NO: 1869981 - RNA, 22 nt, Salmonella typhimurium LT2
uguccaacguugugcuccgccg

SEQ ID NO: 1869982 - RNA, 15 nt, Salmonella typhimurium LT2
uguccagaucuuccc

SEQ ID NO: 1869983 - RNA, 20 nt, Salmonella typhimurium LT2
uguccaggucaucaccucca

SEQ ID NO: 1869984 - RNA, 12 nt, Salmonella typhimurium LT2
ugucgccaggcc

SEQ ID NO: 1869985 - RNA, 19 nt, Salmonella typhimurium LT2
ugucgccgguuagcgccgc

SEQ ID NO: 1869986 - RNA, 14 nt, Salmonella typhimurium LT2
ugucgccucgcuaa

SEQ ID NO: 1869987 - RNA, 19 nt, Salmonella typhimurium LT2
ugugcagugacagaggaau

SEQ ID NO: 1869988 - RNA, 11 nt, Salmonella typhimurium LT2
ugugauaaaug

SEQ ID NO: 1869989 - RNA, 20 nt, Salmonella typhimurium LT2
ugugcgccgcguucgcauau

SEQ ID NO: 1869990 - RNA, 17 nt, Salmonella typhimurium LT2
ugugcgcuuuggcugcc

SEQ ID NO: 1869991 - RNA, 13 nt, Salmonella typhimurium LT2
ugugccgucaucc

SEQ ID NO: 1869992 - RNA, 14 nt, Salmonella typhimurium LT2
ugucuuagugaaau

SEQ ID NO: 1869993 - RNA, 14 nt, Salmonella typhimurium LT2
ugucugggcauuac

SEQ ID NO: 1869994 - RNA, 13 nt, Salmonella typhimurium LT2
ugucuuaaauaug

SEQ ID NO: 1869995 - RNA, 14 nt, Salmonella typhimurium LT2
ugugaccccggccu

SEQ ID NO: 1869996 - RNA, 18 nt, Salmonella typhimurium LT2
ugugacagcaacaucuau

SEQ ID NO: 1869997 - RNA, 23 nt, Salmonella typhimurium LT2
ugugagccauaacaacuauuuuu

SEQ ID NO: 1869998 - RNA, 23 nt, Salmonella typhimurium LT2
uguuaccagcaacugaccaucuu

SEQ ID NO: 1869999 - RNA, 18 nt, Salmonella typhimurium LT2
uguuacgcugguuugugu

SEQ ID NO: 1870000 - RNA, 15 nt, Salmonella typhimurium LT2
uguuaauaagcagaa

SEQ ID NO: 1870001 - RNA, 20 nt, Salmonella typhimurium LT2
uguuaacgucgucauucaug

SEQ ID NO: 1870002 - RNA, 22 nt, Salmonella typhimurium LT2
uguuaacgcggguuuuuacuuu

SEQ ID NO: 1870003 - RNA, 21 nt, Salmonella typhimurium LT2
uguuaauuugcaucaggccaa

SEQ ID NO: 1870004 - RNA, 14 nt, Salmonella typhimurium LT2
uguguuugagcagc

SEQ ID NO: 1870005 - RNA, 15 nt, Salmonella typhimurium LT2
uguguuugagcagcc

SEQ ID NO: 1870006 - RNA, 24 nt, Salmonella typhimurium LT2
uguguugcucaaaaaagaguaaag

SEQ ID NO: 1870007 - RNA, 15 nt, Salmonella typhimurium LT2
ugugucguccgggcc

SEQ ID NO: 1870008 - RNA, 14 nt, Salmonella typhimurium LT2
ugugucgggccagg

SEQ ID NO: 1870009 - RNA, 18 nt, Salmonella typhimurium LT2
ugugucgggccaggcucc

SEQ ID NO: 1870010 - RNA, 20 nt, Salmonella typhimurium LT2
ugugugccgcccaggccuga

SEQ ID NO: 1870011 - RNA, 13 nt, Salmonella typhimurium LT2
ugugcuccaucag

SEQ ID NO: 1870012 - RNA, 22 nt, Salmonella typhimurium LT2
ugugcuuaucacguagccagag

SEQ ID NO: 1870013 - RNA, 16 nt, Salmonella typhimurium LT2
ugugcugauugucagc

SEQ ID NO: 1870014 - RNA, 18 nt, Salmonella typhimurium LT2
uguggcauaaauaaaccg

SEQ ID NO: 1870015 - RNA, 22 nt, Salmonella typhimurium LT2
uguguaccagcaacgccagcga

SEQ ID NO: 1870016 - RNA, 21 nt, Salmonella typhimurium LT2
uguguacauccaggaggcaaa

SEQ ID NO: 1870017 - RNA, 13 nt, Salmonella typhimurium LT2
ugugguuuaaaac

SEQ ID NO: 1870018 - RNA, 15 nt, Salmonella typhimurium LT2
ugugguuaucguaua

SEQ ID NO: 1870019 - RNA, 22 nt, Salmonella typhimurium LT2
uguguagaaauucugcaggcca

SEQ ID NO: 1870020 - RNA, 18 nt, Salmonella typhimurium LT2
uguggucgcggcucacca

SEQ ID NO: 1870021 - RNA, 19 nt, Salmonella typhimurium LT2
ugugguguuccauugcugc

SEQ ID NO: 1870022 - RNA, 22 nt, Salmonella typhimurium LT2
uguggggggaacggcagacagc

SEQ ID NO: 1870023 - RNA, 12 nt, Salmonella typhimurium LT2
ugugggccaaaa

SEQ ID NO: 1870024 - RNA, 22 nt, Salmonella typhimurium LT2
ugugggcgacuaucgccgcccc

SEQ ID NO: 1870025 - RNA, 20 nt, Salmonella typhimurium LT2
ugugggucugcggcggugcc

SEQ ID NO: 1870026 - RNA, 16 nt, Salmonella typhimurium LT2
uggggauuaagcgagc

SEQ ID NO: 1870027 - RNA, 18 nt, Salmonella typhimurium LT2
uggggauugggcagacuu

SEQ ID NO: 1870028 - RNA, 14 nt, Salmonella typhimurium LT2
uggggcgcuuugcu

SEQ ID NO: 1870029 - RNA, 14 nt, Salmonella typhimurium LT2
ugggucugcggcgg

SEQ ID NO: 1870030 - RNA, 17 nt, Salmonella typhimurium LT2
uggggcuaagugagcau

SEQ ID NO: 1870031 - RNA, 14 nt, Salmonella typhimurium LT2
uggggguucaaguc

SEQ ID NO: 1870032 - RNA, 17 nt, Salmonella typhimurium LT2
ugggcucaucaaacagc

SEQ ID NO: 1870033 - RNA, 21 nt, Salmonella typhimurium LT2
ugggcucaucaaacagcggca

SEQ ID NO: 1870034 - RNA, 17 nt, Salmonella typhimurium LT2
ugggcgcacagcgccau

SEQ ID NO: 1870035 - RNA, 17 nt, Salmonella typhimurium LT2
uggcuuuacccgggcca

SEQ ID NO: 1870036 - RNA, 23 nt, Salmonella typhimurium LT2
uggcuuuaugcacgccgggaaua

SEQ ID NO: 1870037 - RNA, 23 nt, Salmonella typhimurium LT2
ugggaugcguaauccggccuggc

SEQ ID NO: 1870038 - RNA, 14 nt, Salmonella typhimurium LT2
ugggaucagguaag

SEQ ID NO: 1870039 - RNA, 14 nt, Salmonella typhimurium LT2
ugggcaaucaucag

SEQ ID NO: 1870040 - RNA, 21 nt, Salmonella typhimurium LT2
uggcuuuccugaucaaucaac

SEQ ID NO: 1870041 - RNA, 15 nt, Salmonella typhimurium LT2
uggcuuugcaacagg

SEQ ID NO: 1870042 - RNA, 15 nt, Salmonella typhimurium LT2
uggucaccaugacgc

SEQ ID NO: 1870043 - RNA, 15 nt, Salmonella typhimurium LT2
uggucaaacaaauca

SEQ ID NO: 1870044 - RNA, 12 nt, Salmonella typhimurium LT2
uggucaucgcgg

SEQ ID NO: 1870045 - RNA, 16 nt, Salmonella typhimurium LT2
uggucauccccgucuc

SEQ ID NO: 1870046 - RNA, 12 nt, Salmonella typhimurium LT2
uggucagcagcc

SEQ ID NO: 1870047 - RNA, 22 nt, Salmonella typhimurium LT2
uggucagcgccgcgccgucggc

SEQ ID NO: 1870048 - RNA, 19 nt, Salmonella typhimurium LT2
uggucagcguaccagcggu

SEQ ID NO: 1870049 - RNA, 14 nt, Salmonella typhimurium LT2
uggucaucgaaggc

SEQ ID NO: 1870050 - RNA, 14 nt, Salmonella typhimurium LT2
uggucgaaaauauc

SEQ ID NO: 1870051 - RNA, 17 nt, Salmonella typhimurium LT2
uggucgaccguucgcac

SEQ ID NO: 1870052 - RNA, 15 nt, Salmonella typhimurium LT2
uggucgccagcgucu

SEQ ID NO: 1870053 - RNA, 15 nt, Salmonella typhimurium LT2
uggucgagauacugc

SEQ ID NO: 1870054 - RNA, 18 nt, Salmonella typhimurium LT2
ugguaccaaacagcagaa

SEQ ID NO: 1870055 - RNA, 13 nt, Salmonella typhimurium LT2
ugguaauuuaaag

SEQ ID NO: 1870056 - RNA, 18 nt, Salmonella typhimurium LT2
ugguaauuaaaggcagcg

SEQ ID NO: 1870057 - RNA, 21 nt, Salmonella typhimurium LT2
ugguaaagaagccgccgccau

SEQ ID NO: 1870058 - RNA, 19 nt, Salmonella typhimurium LT2
uggguuuauguaggguggc

SEQ ID NO: 1870059 - RNA, 14 nt, Salmonella typhimurium LT2
ugguauaaaucccg

SEQ ID NO: 1870060 - RNA, 16 nt, Salmonella typhimurium LT2
ugguaguaagucagcu

SEQ ID NO: 1870061 - RNA, 17 nt, Salmonella typhimurium LT2
ugguauaggccaggcua

SEQ ID NO: 1870062 - RNA, 14 nt, Salmonella typhimurium LT2
ugguauuucaggcc

SEQ ID NO: 1870063 - RNA, 14 nt, Salmonella typhimurium LT2
ugguacucaacauc

SEQ ID NO: 1870064 - RNA, 22 nt, Salmonella typhimurium LT2
ugguaccggauuuagcggcagc

SEQ ID NO: 1870065 - RNA, 16 nt, Salmonella typhimurium LT2
ugguacuuuucaucca

SEQ ID NO: 1870066 - RNA, 12 nt, Salmonella typhimurium LT2
ugguagaaaaac

SEQ ID NO: 1870067 - RNA, 22 nt, Salmonella typhimurium LT2
ugguagagaucgacaaaccacu

SEQ ID NO: 1870068 - RNA, 16 nt, Salmonella typhimurium LT2
ugguagacgcaccaga

SEQ ID NO: 1870069 - RNA, 16 nt, Salmonella typhimurium LT2
uggcgguauaguccgu

SEQ ID NO: 1870070 - RNA, 14 nt, Salmonella typhimurium LT2
uggcggaaaauagc

SEQ ID NO: 1870071 - RNA, 19 nt, Salmonella typhimurium LT2
uggcgcuuuacaugccgcu

SEQ ID NO: 1870072 - RNA, 22 nt, Salmonella typhimurium LT2
uggcgcuuugcuuauccggccu

SEQ ID NO: 1870073 - RNA, 14 nt, Salmonella typhimurium LT2
uggcggaaagaagc

SEQ ID NO: 1870074 - RNA, 13 nt, Salmonella typhimurium LT2
uggcggaacugcg

SEQ ID NO: 1870075 - RNA, 15 nt, Salmonella typhimurium LT2
uggcggcauaauaug

SEQ ID NO: 1870076 - RNA, 12 nt, Salmonella typhimurium LT2
uggcggcaaaaa

SEQ ID NO: 1870077 - RNA, 18 nt, Salmonella typhimurium LT2
uggcgccuuuuggcagca

SEQ ID NO: 1870078 - RNA, 18 nt, Salmonella typhimurium LT2
uggcgccugcggcaggca

SEQ ID NO: 1870079 - RNA, 19 nt, Salmonella typhimurium LT2
uggcgaucagcggcagcuc

SEQ ID NO: 1870080 - RNA, 18 nt, Salmonella typhimurium LT2
uggcgaggaacaucagcc

SEQ ID NO: 1870081 - RNA, 17 nt, Salmonella typhimurium LT2
uggcgauauccgugccg

SEQ ID NO: 1870082 - RNA, 19 nt, Salmonella typhimurium LT2
uggccgcgugcucgcggcg

SEQ ID NO: 1870083 - RNA, 19 nt, Salmonella typhimurium LT2
uggccgcuuugcgaacagc

SEQ ID NO: 1870084 - RNA, 20 nt, Salmonella typhimurium LT2
uggcgaacagccccaccgcc

SEQ ID NO: 1870085 - RNA, 20 nt, Salmonella typhimurium LT2
uggcgaauacuguuccaggc

SEQ ID NO: 1870086 - RNA, 19 nt, Salmonella typhimurium LT2
uggccuuuuuuauggcuuu

SEQ ID NO: 1870087 - RNA, 14 nt, Salmonella typhimurium LT2
uggccguggugaag

SEQ ID NO: 1870088 - RNA, 17 nt, Salmonella typhimurium LT2
uggccuagaugaaugac

SEQ ID NO: 1870089 - RNA, 19 nt, Salmonella typhimurium LT2
uggccuagaugaaugacug

SEQ ID NO: 1870090 - RNA, 13 nt, Salmonella typhimurium LT2
uggccucaucaug

SEQ ID NO: 1870091 - RNA, 19 nt, Salmonella typhimurium LT2
uggcagcggcaguaaauuu

SEQ ID NO: 1870092 - RNA, 23 nt, Salmonella typhimurium LT2
uggcagccucguccugcaauuug

SEQ ID NO: 1870093 - RNA, 22 nt, Salmonella typhimurium LT2
uggcauuuccggaccguuauca

SEQ ID NO: 1870094 - RNA, 17 nt, Salmonella typhimurium LT2
uggccacaucguuaccc

SEQ ID NO: 1870095 - RNA, 13 nt, Salmonella typhimurium LT2
uggccacaucguu

SEQ ID NO: 1870096 - RNA, 16 nt, Salmonella typhimurium LT2
uggccaaucagcgggu

SEQ ID NO: 1870097 - RNA, 19 nt, Salmonella typhimurium LT2
uggccaggaauaaagguca

SEQ ID NO: 1870098 - RNA, 14 nt, Salmonella typhimurium LT2
uggccaucuuccag

SEQ ID NO: 1870099 - RNA, 22 nt, Salmonella typhimurium LT2
uggccgaugucaauuacgcacc

SEQ ID NO: 1870100 - RNA, 14 nt, Salmonella typhimurium LT2
uggcaaaauccaac

SEQ ID NO: 1870101 - RNA, 20 nt, Salmonella typhimurium LT2
uggcaaacggauauuuuagg

SEQ ID NO: 1870102 - RNA, 19 nt, Salmonella typhimurium LT2
uggauuucacaaucaucgc

SEQ ID NO: 1870103 - RNA, 19 nt, Salmonella typhimurium LT2
uggauugcauccaacuuau

SEQ ID NO: 1870104 - RNA, 16 nt, Salmonella typhimurium LT2
ugcguucauggcgcga

SEQ ID NO: 1870105 - RNA, 20 nt, Salmonella typhimurium LT2
ugcguucaggcggcaaaaaa

SEQ ID NO: 1870106 - RNA, 20 nt, Salmonella typhimurium LT2
ugcguucacagcaccauguu

SEQ ID NO: 1870107 - RNA, 14 nt, Salmonella typhimurium LT2
ugcguuacaggaca

SEQ ID NO: 1870108 - RNA, 23 nt, Salmonella typhimurium LT2
ugcguuaacggcuucguuucaga

SEQ ID NO: 1870109 - RNA, 23 nt, Salmonella typhimurium LT2
ugcguuaaacgcugugaccagua

SEQ ID NO: 1870110 - RNA, 15 nt, Salmonella typhimurium LT2
uggcacgacuuuucc

SEQ ID NO: 1870111 - RNA, 19 nt, Salmonella typhimurium LT2
uggcacgacuuuuccuucc

SEQ ID NO: 1870112 - RNA, 22 nt, Salmonella typhimurium LT2
uggcaacauagcaucguuaccg

SEQ ID NO: 1870113 - RNA, 20 nt, Salmonella typhimurium LT2
uggcaaucaguacgcgcgcg

SEQ ID NO: 1870114 - RNA, 21 nt, Salmonella typhimurium LT2
uuauuuuagugaaaaaauauc

SEQ ID NO: 1870115 - RNA, 13 nt, Salmonella typhimurium LT2
uuauuuucauacu

SEQ ID NO: 1870116 - RNA, 20 nt, Salmonella typhimurium LT2
uucaaaugauuuuuauaaaa

SEQ ID NO: 1870117 - RNA, 19 nt, Salmonella typhimurium LT2
uucaaauguuguuugaaaa

SEQ ID NO: 1870118 - RNA, 14 nt, Salmonella typhimurium LT2
uucaacaaacucag

SEQ ID NO: 1870119 - RNA, 19 nt, Salmonella typhimurium LT2
uuauuccauucaucgauuu

SEQ ID NO: 1870120 - RNA, 19 nt, Salmonella typhimurium LT2
uuauuccauuuuaaccuua

SEQ ID NO: 1870121 - RNA, 21 nt, Salmonella typhimurium LT2
uuauuauguagcaacagacua

SEQ ID NO: 1870122 - RNA, 24 nt, Salmonella typhimurium LT2
uuauuuccaauguaaauuaauuca

SEQ ID NO: 1870123 - RNA, 15 nt, Salmonella typhimurium LT2
uuauugcguugcuuu

SEQ ID NO: 1870124 - RNA, 22 nt, Salmonella typhimurium LT2
uuauugcuguaggcacuuucca

SEQ ID NO: 1870125 - RNA, 21 nt, Salmonella typhimurium LT2
uuauugccaucggacauauuu

SEQ ID NO: 1870126 - RNA, 17 nt, Salmonella typhimurium LT2
uuauucgguuuaucccc

SEQ ID NO: 1870127 - RNA, 19 nt, Salmonella typhimurium LT2
uuauucggaaugaugugcu

SEQ ID NO: 1870128 - RNA, 17 nt, Salmonella typhimurium LT2
uuauucggcgagaaaac

SEQ ID NO: 1870129 - RNA, 22 nt, Salmonella typhimurium LT2
uuauucgcauguugacugcgcu

SEQ ID NO: 1870130 - RNA, 17 nt, Salmonella typhimurium LT2
uucaaucgccaguuuuu

SEQ ID NO: 1870131 - RNA, 14 nt, Salmonella typhimurium LT2
uucaaguccccccc

SEQ ID NO: 1870132 - RNA, 23 nt, Salmonella typhimurium LT2
uucaaggcucaauacgcauaaug

SEQ ID NO: 1870133 - RNA, 14 nt, Salmonella typhimurium LT2
uucaaugcccaggc

SEQ ID NO: 1870134 - RNA, 19 nt, Salmonella typhimurium LT2
uucaauuagcgccuccccu

SEQ ID NO: 1870135 - RNA, 24 nt, Salmonella typhimurium LT2
uucaccaaaucaucaaucgcuuuu

SEQ ID NO: 1870136 - RNA, 15 nt, Salmonella typhimurium LT2
uucacaaaaaguauu

SEQ ID NO: 1870137 - RNA, 15 nt, Salmonella typhimurium LT2
uucacuuauaaauaa

SEQ ID NO: 1870138 - RNA, 14 nt, Salmonella typhimurium LT2
uucacuuuuucucu

SEQ ID NO: 1870139 - RNA, 17 nt, Salmonella typhimurium LT2
uucacuuuaccaggcau

SEQ ID NO: 1870140 - RNA, 13 nt, Salmonella typhimurium LT2
uucacuuauaaau

SEQ ID NO: 1870141 - RNA, 22 nt, Salmonella typhimurium LT2
uucacgggucauuaagaaacug

SEQ ID NO: 1870142 - RNA, 17 nt, Salmonella typhimurium LT2
uucacgcugcauaaaac

SEQ ID NO: 1870143 - RNA, 23 nt, Salmonella typhimurium LT2
uucaccaccggaugauucaguaa

SEQ ID NO: 1870144 - RNA, 22 nt, Salmonella typhimurium LT2
uucaccagcgguuucaggccag

SEQ ID NO: 1870145 - RNA, 16 nt, Salmonella typhimurium LT2
uucaucaggccugcaa

SEQ ID NO: 1870146 - RNA, 21 nt, Salmonella typhimurium LT2
uucaucaggcaauaaacauca

SEQ ID NO: 1870147 - RNA, 11 nt, Salmonella typhimurium LT2
uucaucaccau

SEQ ID NO: 1870148 - RNA, 20 nt, Salmonella typhimurium LT2
uucaucaugacacuuuauuc

SEQ ID NO: 1870149 - RNA, 13 nt, Salmonella typhimurium LT2
uucaucauucauc

SEQ ID NO: 1870150 - RNA, 17 nt, Salmonella typhimurium LT2
uucaucaguaacugacg

SEQ ID NO: 1870151 - RNA, 14 nt, Salmonella typhimurium LT2
uucaucaguaacug

SEQ ID NO: 1870152 - RNA, 20 nt, Salmonella typhimurium LT2
uucaucgccgauuccugcug

SEQ ID NO: 1870153 - RNA, 16 nt, Salmonella typhimurium LT2
uucaucgacaaauacu

SEQ ID NO: 1870154 - RNA, 14 nt, Salmonella typhimurium LT2
uucaucauuuuccc

SEQ ID NO: 1870155 - RNA, 14 nt, Salmonella typhimurium LT2
uucauccagcagca

SEQ ID NO: 1870156 - RNA, 16 nt, Salmonella typhimurium LT2
uucaucaaagaaaacc

SEQ ID NO: 1870157 - RNA, 21 nt, Salmonella typhimurium LT2
uucauaccggauauggcaaaa

SEQ ID NO: 1870158 - RNA, 15 nt, Salmonella typhimurium LT2
uucauagaaccacuu

SEQ ID NO: 1870159 - RNA, 17 nt, Salmonella typhimurium LT2
uucauagagaagucuga

SEQ ID NO: 1870160 - RNA, 14 nt, Salmonella typhimurium LT2
uucauagaaccacu

SEQ ID NO: 1870161 - RNA, 13 nt, Salmonella typhimurium LT2
uucauacgcuuuc

SEQ ID NO: 1870162 - RNA, 14 nt, Salmonella typhimurium LT2
uucauagucgcuuu

SEQ ID NO: 1870163 - RNA, 21 nt, Salmonella typhimurium LT2
uucauagucgcuuuucauacu

SEQ ID NO: 1870164 - RNA, 21 nt, Salmonella typhimurium LT2
uucauauagucauaauacuca

SEQ ID NO: 1870165 - RNA, 16 nt, Salmonella typhimurium LT2
uucagccuuuucauau

SEQ ID NO: 1870166 - RNA, 13 nt, Salmonella typhimurium LT2
uucagcgacaggc

SEQ ID NO: 1870167 - RNA, 15 nt, Salmonella typhimurium LT2
uucagcaaauaaucg

SEQ ID NO: 1870168 - RNA, 15 nt, Salmonella typhimurium LT2
uucagcgacuucguc

SEQ ID NO: 1870169 - RNA, 18 nt, Salmonella typhimurium LT2
uucagcgcgauaaauacc

SEQ ID NO: 1870170 - RNA, 19 nt, Salmonella typhimurium LT2
uucagcgucaaauacagca

SEQ ID NO: 1870171 - RNA, 16 nt, Salmonella typhimurium LT2
uucaggucaucggccu

SEQ ID NO: 1870172 - RNA, 22 nt, Salmonella typhimurium LT2
uucaggucuggauuacaaaaau

SEQ ID NO: 1870173 - RNA, 16 nt, Salmonella typhimurium LT2
uucagucuggcaaacc

SEQ ID NO: 1870174 - RNA, 15 nt, Salmonella typhimurium LT2
uucagucaacagugu

SEQ ID NO: 1870175 - RNA, 16 nt, Salmonella typhimurium LT2
uucaguaagacaaaaa

SEQ ID NO: 1870176 - RNA, 17 nt, Salmonella typhimurium LT2
uucaguaagacaaaaau

SEQ ID NO: 1870177 - RNA, 19 nt, Salmonella typhimurium LT2
uucaguaagaguaccauuc

SEQ ID NO: 1870178 - RNA, 16 nt, Salmonella typhimurium LT2
uucaguaaaucaacuu

SEQ ID NO: 1870179 - RNA, 19 nt, Salmonella typhimurium LT2
uucauaacuugccgccugc

SEQ ID NO: 1870180 - RNA, 21 nt, Salmonella typhimurium LT2
uucauaauaagcgcucaggca

SEQ ID NO: 1870181 - RNA, 12 nt, Salmonella typhimurium LT2
uucauaaauacg

SEQ ID NO: 1870182 - RNA, 17 nt, Salmonella typhimurium LT2
uucauaaagugccaggg

SEQ ID NO: 1870183 - RNA, 16 nt, Salmonella typhimurium LT2
uucauaacaccaauac

SEQ ID NO: 1870184 - RNA, 12 nt, Salmonella typhimurium LT2
uucauaaaugua

SEQ ID NO: 1870185 - RNA, 16 nt, Salmonella typhimurium LT2
uucaguucggagauca

SEQ ID NO: 1870186 - RNA, 23 nt, Salmonella typhimurium LT2
uucaguggucaggcgaccaauau

SEQ ID NO: 1870187 - RNA, 18 nt, Salmonella typhimurium LT2
uucauaaaagaucauucc

SEQ ID NO: 1870188 - RNA, 13 nt, Salmonella typhimurium LT2
uucaguuucuucg

SEQ ID NO: 1870189 - RNA, 20 nt, Salmonella typhimurium LT2
uucaguuguccauuuuccuc

SEQ ID NO: 1870190 - RNA, 16 nt, Salmonella typhimurium LT2
uucaucgcugcucaac

SEQ ID NO: 1870191 - RNA, 15 nt, Salmonella typhimurium LT2
uucaucggcucgacu

SEQ ID NO: 1870192 - RNA, 19 nt, Salmonella typhimurium LT2
uucaucgguaauauuaagg

SEQ ID NO: 1870193 - RNA, 15 nt, Salmonella typhimurium LT2
uucaucucaucaaug

SEQ ID NO: 1870194 - RNA, 18 nt, Salmonella typhimurium LT2
uucaucuuuuaaaaucag

SEQ ID NO: 1870195 - RNA, 13 nt, Salmonella typhimurium LT2
uucaucuuccaca

SEQ ID NO: 1870196 - RNA, 16 nt, Salmonella typhimurium LT2
uucaugaucuuuccuu

SEQ ID NO: 1870197 - RNA, 16 nt, Salmonella typhimurium LT2
uucaugauacccagcg

SEQ ID NO: 1870198 - RNA, 18 nt, Salmonella typhimurium LT2
uucaugaucuuuccuuuu

SEQ ID NO: 1870199 - RNA, 14 nt, Salmonella typhimurium LT2
uucaugaaucauca

SEQ ID NO: 1870200 - RNA, 21 nt, Salmonella typhimurium LT2
uucaugguacucaacaucauu

SEQ ID NO: 1870201 - RNA, 14 nt, Salmonella typhimurium LT2
uucauuaaaccacu

SEQ ID NO: 1870202 - RNA, 16 nt, Salmonella typhimurium LT2
uucaugcacaaaaccc

SEQ ID NO: 1870203 - RNA, 18 nt, Salmonella typhimurium LT2
uucaugcacgaugguauc

SEQ ID NO: 1870204 - RNA, 22 nt, Salmonella typhimurium LT2
uucaugcacaaaacccgcagcc

SEQ ID NO: 1870205 - RNA, 17 nt, Salmonella typhimurium LT2
uucaugcagcccgcacu

SEQ ID NO: 1870206 - RNA, 16 nt, Salmonella typhimurium LT2
uucaugcuguauaaac

SEQ ID NO: 1870207 - RNA, 15 nt, Salmonella typhimurium LT2
uucaugcuucucaaa

SEQ ID NO: 1870208 - RNA, 22 nt, Salmonella typhimurium LT2
uucauuuguuccucgaaacgcu

SEQ ID NO: 1870209 - RNA, 16 nt, Salmonella typhimurium LT2
uuccaaaauccaggga

SEQ ID NO: 1870210 - RNA, 16 nt, Salmonella typhimurium LT2
uucauucgccaccagg

SEQ ID NO: 1870211 - RNA, 13 nt, Salmonella typhimurium LT2
uucauuauuucau

SEQ ID NO: 1870212 - RNA, 12 nt, Salmonella typhimurium LT2
uucauuauaaaa

SEQ ID NO: 1870213 - RNA, 17 nt, Salmonella typhimurium LT2
uucauuauaaaacauaa

SEQ ID NO: 1870214 - RNA, 22 nt, Salmonella typhimurium LT2
uucauuggcuaaugaagacgaa

SEQ ID NO: 1870215 - RNA, 15 nt, Salmonella typhimurium LT2
uucauuucaauguaa

SEQ ID NO: 1870216 - RNA, 15 nt, Salmonella typhimurium LT2
uucauuucaaugcgu

SEQ ID NO: 1870217 - RNA, 20 nt, Salmonella typhimurium LT2
uucauuucgcccaucgcuuu

SEQ ID NO: 1870218 - RNA, 12 nt, Salmonella typhimurium LT2
uucauuugcaau

SEQ ID NO: 1870219 - RNA, 22 nt, Salmonella typhimurium LT2
uuccugagcagacauauuuuca

SEQ ID NO: 1870220 - RNA, 14 nt, Salmonella typhimurium LT2
uuccgucaugguga

SEQ ID NO: 1870221 - RNA, 21 nt, Salmonella typhimurium LT2
uuccguaagcgccagcgguuu

SEQ ID NO: 1870222 - RNA, 12 nt, Salmonella typhimurium LT2
uucgacaucuuc

SEQ ID NO: 1870223 - RNA, 22 nt, Salmonella typhimurium LT2
uucgacaagaagauuucuuaau

SEQ ID NO: 1870224 - RNA, 14 nt, Salmonella typhimurium LT2
uucgaauccuccug

SEQ ID NO: 1870225 - RNA, 17 nt, Salmonella typhimurium LT2
uucgaauuacauaacca

SEQ ID NO: 1870226 - RNA, 12 nt, Salmonella typhimurium LT2
uucgaauucuga

SEQ ID NO: 1870227 - RNA, 23 nt, Salmonella typhimurium LT2
uuccuuccgaaucaauuccuaca

SEQ ID NO: 1870228 - RNA, 18 nt, Salmonella typhimurium LT2
uucgaacgccgacaucac

SEQ ID NO: 1870229 - RNA, 20 nt, Salmonella typhimurium LT2
uucgaacuacugauuccugc

SEQ ID NO: 1870230 - RNA, 15 nt, Salmonella typhimurium LT2
uuccgcacauaauca

SEQ ID NO: 1870231 - RNA, 16 nt, Salmonella typhimurium LT2
uucccuuccagcgacg

SEQ ID NO: 1870232 - RNA, 15 nt, Salmonella typhimurium LT2
uucccuuaucugcaa

SEQ ID NO: 1870233 - RNA, 16 nt, Salmonella typhimurium LT2
uucccuucugaaauga

SEQ ID NO: 1870234 - RNA, 11 nt, Salmonella typhimurium LT2
uucccuggccg

SEQ ID NO: 1870235 - RNA, 16 nt, Salmonella typhimurium LT2
uuccgggccgacagac

SEQ ID NO: 1870236 - RNA, 15 nt, Salmonella typhimurium LT2
uuccggguauucauc

SEQ ID NO: 1870237 - RNA, 18 nt, Salmonella typhimurium LT2
uuccggcggucagccagc

SEQ ID NO: 1870238 - RNA, 18 nt, Salmonella typhimurium LT2
uuccggcucgccacggcc

SEQ ID NO: 1870239 - RNA, 18 nt, Salmonella typhimurium LT2
uuccggcugccagccagc

SEQ ID NO: 1870240 - RNA, 19 nt, Salmonella typhimurium LT2
uuccggcggcagaugcucg

SEQ ID NO: 1870241 - RNA, 19 nt, Salmonella typhimurium LT2
uuccgccgcgguauucaua

SEQ ID NO: 1870242 - RNA, 19 nt, Salmonella typhimurium LT2
uuccgcgagagaaaaaaau

SEQ ID NO: 1870243 - RNA, 14 nt, Salmonella typhimurium LT2
uuccgccagauaca

SEQ ID NO: 1870244 - RNA, 21 nt, Salmonella typhimurium LT2
uuccgccagcgccagcagcag

SEQ ID NO: 1870245 - RNA, 19 nt, Salmonella typhimurium LT2
uuccgcccgcgcucccgcc

SEQ ID NO: 1870246 - RNA, 22 nt, Salmonella typhimurium LT2
uuccccuguaacugcaccuuuu

SEQ ID NO: 1870247 - RNA, 15 nt, Salmonella typhimurium LT2
uucccucauauuugu

SEQ ID NO: 1870248 - RNA, 21 nt, Salmonella typhimurium LT2
uucccuaccagacgcgccugc

SEQ ID NO: 1870249 - RNA, 20 nt, Salmonella typhimurium LT2
uucccccacuucugacagaa

SEQ ID NO: 1870250 - RNA, 17 nt, Salmonella typhimurium LT2
uucccccauccgcgccg

SEQ ID NO: 1870251 - RNA, 13 nt, Salmonella typhimurium LT2
uucgcgcaguuca

SEQ ID NO: 1870252 - RNA, 16 nt, Salmonella typhimurium LT2
uucgcggaauuucagg

SEQ ID NO: 1870253 - RNA, 21 nt, Salmonella typhimurium LT2
uucgcgaauagugcagaaagg

SEQ ID NO: 1870254 - RNA, 22 nt, Salmonella typhimurium LT2
uucgccauucccgcgacgucaa

SEQ ID NO: 1870255 - RNA, 13 nt, Salmonella typhimurium LT2
uucgcccacgccc

SEQ ID NO: 1870256 - RNA, 13 nt, Salmonella typhimurium LT2
uucgcccauaucc

SEQ ID NO: 1870257 - RNA, 16 nt, Salmonella typhimurium LT2
uucgcccaucgccgcc

SEQ ID NO: 1870258 - RNA, 18 nt, Salmonella typhimurium LT2
uucgcccggcgccagcuc

SEQ ID NO: 1870259 - RNA, 17 nt, Salmonella typhimurium LT2
uucgccacgcucacuuu

SEQ ID NO: 1870260 - RNA, 15 nt, Salmonella typhimurium LT2
uucgccagugacaaa

SEQ ID NO: 1870261 - RNA, 20 nt, Salmonella typhimurium LT2
uucgauuguugacugccagc

SEQ ID NO: 1870262 - RNA, 22 nt, Salmonella typhimurium LT2
uucgacggagauuaacagcgcg

SEQ ID NO: 1870263 - RNA, 23 nt, Salmonella typhimurium LT2
uucgauaaacucaaucaggcuau

SEQ ID NO: 1870264 - RNA, 14 nt, Salmonella typhimurium LT2
uucgauaaacucaa

SEQ ID NO: 1870265 - RNA, 14 nt, Salmonella typhimurium LT2
uucgaugaaaaaga

SEQ ID NO: 1870266 - RNA, 23 nt, Salmonella typhimurium LT2
uucgaugaugagaugcaggccaa

SEQ ID NO: 1870267 - RNA, 17 nt, Salmonella typhimurium LT2
uucgauaaccaccagcg

SEQ ID NO: 1870268 - RNA, 13 nt, Salmonella typhimurium LT2
uucgaucaugccu

SEQ ID NO: 1870269 - RNA, 17 nt, Salmonella typhimurium LT2
uucgggcacuccggcuc

SEQ ID NO: 1870270 - RNA, 13 nt, Salmonella typhimurium LT2
uucgggccgccgc

SEQ ID NO: 1870271 - RNA, 19 nt, Salmonella typhimurium LT2
uucgggcgcaugcugccau

SEQ ID NO: 1870272 - RNA, 15 nt, Salmonella typhimurium LT2
uucgucgagcagcag

SEQ ID NO: 1870273 - RNA, 13 nt, Salmonella typhimurium LT2
uucggucagaucc

SEQ ID NO: 1870274 - RNA, 14 nt, Salmonella typhimurium LT2
uucggguuuuccug

SEQ ID NO: 1870275 - RNA, 14 nt, Salmonella typhimurium LT2
uucguucucugaau

SEQ ID NO: 1870276 - RNA, 15 nt, Salmonella typhimurium LT2
uucguucucugaaua

SEQ ID NO: 1870277 - RNA, 12 nt, Salmonella typhimurium LT2
uucggcauguuc

SEQ ID NO: 1870278 - RNA, 13 nt, Salmonella typhimurium LT2
uucggcuucaauu

SEQ ID NO: 1870279 - RNA, 15 nt, Salmonella typhimurium LT2
uucggauucaauauu

SEQ ID NO: 1870280 - RNA, 18 nt, Salmonella typhimurium LT2
uucggauuauuggucagc

SEQ ID NO: 1870281 - RNA, 16 nt, Salmonella typhimurium LT2
uucggcaauccaucac

SEQ ID NO: 1870282 - RNA, 13 nt, Salmonella typhimurium LT2
uucgcuaaaucag

SEQ ID NO: 1870283 - RNA, 16 nt, Salmonella typhimurium LT2
uucggaucgauaaaag

SEQ ID NO: 1870284 - RNA, 22 nt, Salmonella typhimurium LT2
uucgcgucaaaacuuauuuuau

SEQ ID NO: 1870285 - RNA, 15 nt, Salmonella typhimurium LT2
uucgcggcaaacaca

SEQ ID NO: 1870286 - RNA, 14 nt, Salmonella typhimurium LT2
uucugucagcguuu

SEQ ID NO: 1870287 - RNA, 15 nt, Salmonella typhimurium LT2
uucugucgccaccac

SEQ ID NO: 1870288 - RNA, 16 nt, Salmonella typhimurium LT2
uucuguauuuucuauc

SEQ ID NO: 1870289 - RNA, 23 nt, Salmonella typhimurium LT2
uucuguccauguuuuauacucaa

SEQ ID NO: 1870290 - RNA, 16 nt, Salmonella typhimurium LT2
uucuguauaauuauuu

SEQ ID NO: 1870291 - RNA, 23 nt, Salmonella typhimurium LT2
uucuggccguuuucaaacaaaca

SEQ ID NO: 1870292 - RNA, 15 nt, Salmonella typhimurium LT2
uucuuaauggauucu

SEQ ID NO: 1870293 - RNA, 14 nt, Salmonella typhimurium LT2
uucuuagaauagca

SEQ ID NO: 1870294 - RNA, 13 nt, Salmonella typhimurium LT2
uucuucucuucuu

SEQ ID NO: 1870295 - RNA, 13 nt, Salmonella typhimurium LT2
uucuucugaauau

SEQ ID NO: 1870296 - RNA, 18 nt, Salmonella typhimurium LT2
uucuucuggcucagacca

SEQ ID NO: 1870297 - RNA, 12 nt, Salmonella typhimurium LT2
uucuucuucacg

SEQ ID NO: 1870298 - RNA, 21 nt, Salmonella typhimurium LT2
uucuucgucgucuucauccca

SEQ ID NO: 1870299 - RNA, 18 nt, Salmonella typhimurium LT2
uucuucggcucagacagu

SEQ ID NO: 1870300 - RNA, 21 nt, Salmonella typhimurium LT2
uucuucccaccggacgaaaaa

SEQ ID NO: 1870301 - RNA, 22 nt, Salmonella typhimurium LT2
uucuucccaccggacgaaaaau

SEQ ID NO: 1870302 - RNA, 12 nt, Salmonella typhimurium LT2
uucuuccucucg

SEQ ID NO: 1870303 - RNA, 22 nt, Salmonella typhimurium LT2
uucuuccgcaauaugcgucagc

SEQ ID NO: 1870304 - RNA, 17 nt, Salmonella typhimurium LT2
uucuucaagccaggcuu

SEQ ID NO: 1870305 - RNA, 23 nt, Salmonella typhimurium LT2
uucuucauauuguagguuuuccu

SEQ ID NO: 1870306 - RNA, 13 nt, Salmonella typhimurium LT2
uucuucaucuuca

SEQ ID NO: 1870307 - RNA, 21 nt, Salmonella typhimurium LT2
uucuccccgcgcgaucucuuu

SEQ ID NO: 1870308 - RNA, 23 nt, Salmonella typhimurium LT2
uucucccgccagaugcagcggca

SEQ ID NO: 1870309 - RNA, 15 nt, Salmonella typhimurium LT2
uucucccuacugcuu

SEQ ID NO: 1870310 - RNA, 17 nt, Salmonella typhimurium LT2
uucucccugccaggcca

SEQ ID NO: 1870311 - RNA, 22 nt, Salmonella typhimurium LT2
uucuccgggauagcaaucucgc

SEQ ID NO: 1870312 - RNA, 22 nt, Salmonella typhimurium LT2
uucuccugcgccagccggauac

SEQ ID NO: 1870313 - RNA, 13 nt, Salmonella typhimurium LT2
uucugaauaaauu

SEQ ID NO: 1870314 - RNA, 12 nt, Salmonella typhimurium LT2
uucugaauaaua

SEQ ID NO: 1870315 - RNA, 13 nt, Salmonella typhimurium LT2
uucugaauaauau

SEQ ID NO: 1870316 - RNA, 14 nt, Salmonella typhimurium LT2
uucucuuuuauuau

SEQ ID NO: 1870317 - RNA, 18 nt, Salmonella typhimurium LT2
uucugaacagcggcggca

SEQ ID NO: 1870318 - RNA, 23 nt, Salmonella typhimurium LT2
uucuccuucauauuucaagccgc

SEQ ID NO: 1870319 - RNA, 15 nt, Salmonella typhimurium LT2
uucugaauuucacgc

SEQ ID NO: 1870320 - RNA, 18 nt, Salmonella typhimurium LT2
uucugaccgcauuuucuc

SEQ ID NO: 1870321 - RNA, 22 nt, Salmonella typhimurium LT2
uucuggacgggcuaucaauaug

SEQ ID NO: 1870322 - RNA, 12 nt, Salmonella typhimurium LT2
uucuggaaguag

SEQ ID NO: 1870323 - RNA, 18 nt, Salmonella typhimurium LT2
uucuggagaguauuuccu

SEQ ID NO: 1870324 - RNA, 16 nt, Salmonella typhimurium LT2
uucuaucuuucagacc

SEQ ID NO: 1870325 - RNA, 15 nt, Salmonella typhimurium LT2
uucucaaagugcgcc

SEQ ID NO: 1870326 - RNA, 19 nt, Salmonella typhimurium LT2
uucuccagaucgcauaagc

SEQ ID NO: 1870327 - RNA, 21 nt, Salmonella typhimurium LT2
uucuaaaaguaagcuauguuu

SEQ ID NO: 1870328 - RNA, 11 nt, Salmonella typhimurium LT2
uucguuuuccg

SEQ ID NO: 1870329 - RNA, 19 nt, Salmonella typhimurium LT2
uucuacucuucacccuucu

SEQ ID NO: 1870330 - RNA, 18 nt, Salmonella typhimurium LT2
uucuacuuccaccaccuc

SEQ ID NO: 1870331 - RNA, 18 nt, Salmonella typhimurium LT2
uucuacucugcucgccag

SEQ ID NO: 1870332 - RNA, 22 nt, Salmonella typhimurium LT2
uugugagcuauacgguaaauca

SEQ ID NO: 1870333 - RNA, 22 nt, Salmonella typhimurium LT2
uugugcuuauggguuuccucca

SEQ ID NO: 1870334 - RNA, 12 nt, Salmonella typhimurium LT2
uugugcuuuagc

SEQ ID NO: 1870335 - RNA, 15 nt, Salmonella typhimurium LT2
uuguggcaauauuuu

SEQ ID NO: 1870336 - RNA, 18 nt, Salmonella typhimurium LT2
uuguggcaauauuuugua

SEQ ID NO: 1870337 - RNA, 13 nt, Salmonella typhimurium LT2
uugucuucuuucg

SEQ ID NO: 1870338 - RNA, 17 nt, Salmonella typhimurium LT2
uugugacgaaaaaagac

SEQ ID NO: 1870339 - RNA, 22 nt, Salmonella typhimurium LT2
uugucugaugauccucggccua

SEQ ID NO: 1870340 - RNA, 13 nt, Salmonella typhimurium LT2
uugucuuaaauau

SEQ ID NO: 1870341 - RNA, 14 nt, Salmonella typhimurium LT2
uugucugaccgggc

SEQ ID NO: 1870342 - RNA, 14 nt, Salmonella typhimurium LT2
uugucuaacuuacc

SEQ ID NO: 1870343 - RNA, 15 nt, Salmonella typhimurium LT2
uuguuaacgcaaggu

SEQ ID NO: 1870344 - RNA, 19 nt, Salmonella typhimurium LT2
uuguuccugcuggcaaaac

SEQ ID NO: 1870345 - RNA, 18 nt, Salmonella typhimurium LT2
uuguucgucuuuugaaua

SEQ ID NO: 1870346 - RNA, 16 nt, Salmonella typhimurium LT2
uuguucgucuuuugaa

SEQ ID NO: 1870347 - RNA, 21 nt, Salmonella typhimurium LT2
uuguugaaacaucauuucuac

SEQ ID NO: 1870348 - RNA, 20 nt, Salmonella typhimurium LT2
uuguuuuaaauucaaccagu

SEQ ID NO: 1870349 - RNA, 18 nt, Salmonella typhimurium LT2
uuguuuguggcaaaguac

SEQ ID NO: 1870350 - RNA, 20 nt, Salmonella typhimurium LT2
uugguuucgccuaagcccac

SEQ ID NO: 1870351 - RNA, 19 nt, Salmonella typhimurium LT2
uuguaaaaccgacuaucag

SEQ ID NO: 1870352 - RNA, 12 nt, Salmonella typhimurium LT2
uuguaacagcag

SEQ ID NO: 1870353 - RNA, 19 nt, Salmonella typhimurium LT2
uuguacaaaaaaugugagc

SEQ ID NO: 1870354 - RNA, 15 nt, Salmonella typhimurium LT2
uuguaggcaggaauu

SEQ ID NO: 1870355 - RNA, 13 nt, Salmonella typhimurium LT2
uuguagaccugau

SEQ ID NO: 1870356 - RNA, 20 nt, Salmonella typhimurium LT2
uuguacagcaauaaaaggaa

SEQ ID NO: 1870357 - RNA, 15 nt, Salmonella typhimurium LT2
uuguacagcuugccg

SEQ ID NO: 1870358 - RNA, 16 nt, Salmonella typhimurium LT2
uuguacagcaauaaaa

SEQ ID NO: 1870359 - RNA, 17 nt, Salmonella typhimurium LT2
uuguacagcuugccguc

SEQ ID NO: 1870360 - RNA, 23 nt, Salmonella typhimurium LT2
uugucagcugaacagucccacca

SEQ ID NO: 1870361 - RNA, 14 nt, Salmonella typhimurium LT2
uugucaggccgcgu

SEQ ID NO: 1870362 - RNA, 15 nt, Salmonella typhimurium LT2
uugucagcauaaagc

SEQ ID NO: 1870363 - RNA, 14 nt, Salmonella typhimurium LT2
uugucaccaauaau

SEQ ID NO: 1870364 - RNA, 15 nt, Salmonella typhimurium LT2
uugucaccaauaauu

SEQ ID NO: 1870365 - RNA, 20 nt, Salmonella typhimurium LT2
uugucacuauucuuaucauu

SEQ ID NO: 1870366 - RNA, 19 nt, Salmonella typhimurium LT2
uuguauuuaccgacauccg

SEQ ID NO: 1870367 - RNA, 16 nt, Salmonella typhimurium LT2
uuguaucagcauuuac

SEQ ID NO: 1870368 - RNA, 13 nt, Salmonella typhimurium LT2
uuguccggcagaa

SEQ ID NO: 1870369 - RNA, 17 nt, Salmonella typhimurium LT2
uugucaucagucucaaa

SEQ ID NO: 1870370 - RNA, 15 nt, Salmonella typhimurium LT2
uugucaucagucuca

SEQ ID NO: 1870371 - RNA, 23 nt, Salmonella typhimurium LT2
uuguccccaucuuuaaaucccuc

SEQ ID NO: 1870372 - RNA, 13 nt, Salmonella typhimurium LT2
uugucccaggcca

SEQ ID NO: 1870373 - RNA, 17 nt, Salmonella typhimurium LT2
uuguccauaaaaugaug

SEQ ID NO: 1870374 - RNA, 16 nt, Salmonella typhimurium LT2
uuuaagcauccaggaa

SEQ ID NO: 1870375 - RNA, 19 nt, Salmonella typhimurium LT2
uuuaagacuuuuuaauuca

SEQ ID NO: 1870376 - RNA, 18 nt, Salmonella typhimurium LT2
uuuaagccgauugaauaa

SEQ ID NO: 1870377 - RNA, 17 nt, Salmonella typhimurium LT2
uuuaagcgccuccacaa

SEQ ID NO: 1870378 - RNA, 19 nt, Salmonella typhimurium LT2
uuuaaggcggcaaagauaa

SEQ ID NO: 1870379 - RNA, 15 nt, Salmonella typhimurium LT2
uuuaaggacauucag

SEQ ID NO: 1870380 - RNA, 16 nt, Salmonella typhimurium LT2
uuuaaggcggcaaaga

SEQ ID NO: 1870381 - RNA, 18 nt, Salmonella typhimurium LT2
uuuaaugcuuuccagcca

SEQ ID NO: 1870382 - RNA, 13 nt, Salmonella typhimurium LT2
uuuaaugauguag

SEQ ID NO: 1870383 - RNA, 22 nt, Salmonella typhimurium LT2
uuuacguaacugcgguaaauaa

SEQ ID NO: 1870384 - RNA, 16 nt, Salmonella typhimurium LT2
uuuacguucgaugauu

SEQ ID NO: 1870385 - RNA, 17 nt, Salmonella typhimurium LT2
uuuacuauagauauuaa

SEQ ID NO: 1870386 - RNA, 16 nt, Salmonella typhimurium LT2
uuuacuuaauucugcu

SEQ ID NO: 1870387 - RNA, 17 nt, Salmonella typhimurium LT2
uuuagaacuaucugaaa

SEQ ID NO: 1870388 - RNA, 12 nt, Salmonella typhimurium LT2
uuuacuuucauu

SEQ ID NO: 1870389 - RNA, 18 nt, Salmonella typhimurium LT2
uuuaccgccgcuuuucag

SEQ ID NO: 1870390 - RNA, 13 nt, Salmonella typhimurium LT2
uuuaccgcaauaa

SEQ ID NO: 1870391 - RNA, 18 nt, Salmonella typhimurium LT2
uuuaccuguacccgguac

SEQ ID NO: 1870392 - RNA, 22 nt, Salmonella typhimurium LT2
uuuacaggcgauuuuuuacugu

SEQ ID NO: 1870393 - RNA, 12 nt, Salmonella typhimurium LT2
uuuacaguaucu

SEQ ID NO: 1870394 - RNA, 17 nt, Salmonella typhimurium LT2
uuuaaugcuauuugugg

SEQ ID NO: 1870395 - RNA, 14 nt, Salmonella typhimurium LT2
uuuauuacgcuucu

SEQ ID NO: 1870396 - RNA, 16 nt, Salmonella typhimurium LT2
uuuaugggcauuucau

SEQ ID NO: 1870397 - RNA, 17 nt, Salmonella typhimurium LT2
uuuaucgaucuccaucu

SEQ ID NO: 1870398 - RNA, 14 nt, Salmonella typhimurium LT2
uuuaucggccagca

SEQ ID NO: 1870399 - RNA, 16 nt, Salmonella typhimurium LT2
uuuaugggaaaauucc

SEQ ID NO: 1870400 - RNA, 19 nt, Salmonella typhimurium LT2
uuuaugcuguagugaggcu

SEQ ID NO: 1870401 - RNA, 23 nt, Salmonella typhimurium LT2
uuuauccggaugaaacgcaucca

SEQ ID NO: 1870402 - RNA, 17 nt, Salmonella typhimurium LT2
uuuauccauuucaucag

SEQ ID NO: 1870403 - RNA, 18 nt, Salmonella typhimurium LT2
uuuaucgaaguaauaaaa

SEQ ID NO: 1870404 - RNA, 23 nt, Salmonella typhimurium LT2
uuuaucgaaguaauaaaaaacaa

SEQ ID NO: 1870405 - RNA, 13 nt, Salmonella typhimurium LT2
uuuaucgacacua

SEQ ID NO: 1870406 - RNA, 21 nt, Salmonella typhimurium LT2
uuuauauucugggcuuacuuu

SEQ ID NO: 1870407 - RNA, 19 nt, Salmonella typhimurium LT2
uuuagcauaacguuuccuu

SEQ ID NO: 1870408 - RNA, 14 nt, Salmonella typhimurium LT2
uuuagccagcagcg

SEQ ID NO: 1870409 - RNA, 19 nt, Salmonella typhimurium LT2
uuuauaacuaaacucaucu

SEQ ID NO: 1870410 - RNA, 21 nt, Salmonella typhimurium LT2
uugagcgccuuaucgacggcg

SEQ ID NO: 1870411 - RNA, 15 nt, Salmonella typhimurium LT2
uugaggaaauucugg

SEQ ID NO: 1870412 - RNA, 15 nt, Salmonella typhimurium LT2
uugaggauugccgcc

SEQ ID NO: 1870413 - RNA, 18 nt, Salmonella typhimurium LT2
uugauaccuuuaaccucu

SEQ ID NO: 1870414 - RNA, 20 nt, Salmonella typhimurium LT2
uugauacucugcuuuuucac

SEQ ID NO: 1870415 - RNA, 20 nt, Salmonella typhimurium LT2
uugauagcgaucagcgccac

SEQ ID NO: 1870416 - RNA, 12 nt, Salmonella typhimurium LT2
uugaucugcuug

SEQ ID NO: 1870417 - RNA, 17 nt, Salmonella typhimurium LT2
uugaucguaaaaugaaa

SEQ ID NO: 1870418 - RNA, 12 nt, Salmonella typhimurium LT2
uugcagcgccau

SEQ ID NO: 1870419 - RNA, 17 nt, Salmonella typhimurium LT2
uugcaggaagggcagca

SEQ ID NO: 1870420 - RNA, 16 nt, Salmonella typhimurium LT2
uugccacgccauacgu

SEQ ID NO: 1870421 - RNA, 13 nt, Salmonella typhimurium LT2
uugccacuggccu

SEQ ID NO: 1870422 - RNA, 23 nt, Salmonella typhimurium LT2
uugccacuggcuuuccugaucaa

SEQ ID NO: 1870423 - RNA, 13 nt, Salmonella typhimurium LT2
uugccacugccac

SEQ ID NO: 1870424 - RNA, 14 nt, Salmonella typhimurium LT2
uugcaugaccaucc

SEQ ID NO: 1870425 - RNA, 23 nt, Salmonella typhimurium LT2
uugcauauaaggcccauacccca

SEQ ID NO: 1870426 - RNA, 13 nt, Salmonella typhimurium LT2
uugcauacauaaa

SEQ ID NO: 1870427 - RNA, 22 nt, Salmonella typhimurium LT2
uugcggaauacacgaacacaga

SEQ ID NO: 1870428 - RNA, 18 nt, Salmonella typhimurium LT2
uugcgcgucucucccuca

SEQ ID NO: 1870429 - RNA, 15 nt, Salmonella typhimurium LT2
uugcggcgcagggcg

SEQ ID NO: 1870430 - RNA, 20 nt, Salmonella typhimurium LT2
uugcgggccucguuaaaauc

SEQ ID NO: 1870431 - RNA, 14 nt, Salmonella typhimurium LT2
uugcgcgccacgcc

SEQ ID NO: 1870432 - RNA, 15 nt, Salmonella typhimurium LT2
uugcgcgccacgccc

SEQ ID NO: 1870433 - RNA, 20 nt, Salmonella typhimurium LT2
uugcgcgguuaacagccgcu

SEQ ID NO: 1870434 - RNA, 21 nt, Salmonella typhimurium LT2
uugcgacaagcucauuuccca

SEQ ID NO: 1870435 - RNA, 14 nt, Salmonella typhimurium LT2
uugcgacaggcugc

SEQ ID NO: 1870436 - RNA, 19 nt, Salmonella typhimurium LT2
uugcgacaggcugccgacu

SEQ ID NO: 1870437 - RNA, 16 nt, Salmonella typhimurium LT2
uugcgaaaaagugaua

SEQ ID NO: 1870438 - RNA, 15 nt, Salmonella typhimurium LT2
uugccguuaacugcu

SEQ ID NO: 1870439 - RNA, 12 nt, Salmonella typhimurium LT2
uugccuuucaau

SEQ ID NO: 1870440 - RNA, 16 nt, Salmonella typhimurium LT2
uugccgucaacacgca

SEQ ID NO: 1870441 - RNA, 20 nt, Salmonella typhimurium LT2
uugccauucgccagcccgau

SEQ ID NO: 1870442 - RNA, 19 nt, Salmonella typhimurium LT2
uugccaugaugagcgccau

SEQ ID NO: 1870443 - RNA, 15 nt, Salmonella typhimurium LT2
uugccagugaaaaaa

SEQ ID NO: 1870444 - RNA, 12 nt, Salmonella typhimurium LT2
uugccauacgcc

SEQ ID NO: 1870445 - RNA, 18 nt, Salmonella typhimurium LT2
uuggaaacuaugcaaaac

SEQ ID NO: 1870446 - RNA, 19 nt, Salmonella typhimurium LT2
uuggagaggaauuguccac

SEQ ID NO: 1870447 - RNA, 15 nt, Salmonella typhimurium LT2
uuggcagacaaccau

SEQ ID NO: 1870448 - RNA, 19 nt, Salmonella typhimurium LT2
uuggcauagccaguggaac

SEQ ID NO: 1870449 - RNA, 14 nt, Salmonella typhimurium LT2
uuggcaaucacaag

SEQ ID NO: 1870450 - RNA, 15 nt, Salmonella typhimurium LT2
uuggcaaaaaaggcc

SEQ ID NO: 1870451 - RNA, 19 nt, Salmonella typhimurium LT2
uuggaugaaccauaucaaa

SEQ ID NO: 1870452 - RNA, 16 nt, Salmonella typhimurium LT2
uuggcaaaccccugcu

SEQ ID NO: 1870453 - RNA, 23 nt, Salmonella typhimurium LT2
uuggcaaacugccgguaaagaaa

SEQ ID NO: 1870454 - RNA, 12 nt, Salmonella typhimurium LT2
uuggcaaauccg

SEQ ID NO: 1870455 - RNA, 14 nt, Salmonella typhimurium LT2
uuggaucgacgcug

SEQ ID NO: 1870456 - RNA, 23 nt, Salmonella typhimurium LT2
uugcuucgcucucgugccaguaa

SEQ ID NO: 1870457 - RNA, 14 nt, Salmonella typhimurium LT2
uugcuuucuugaau

SEQ ID NO: 1870458 - RNA, 17 nt, Salmonella typhimurium LT2
uugcuuuauuuuuaauu

SEQ ID NO: 1870459 - RNA, 17 nt, Salmonella typhimurium LT2
uugcuuuucaucaccau

SEQ ID NO: 1870460 - RNA, 17 nt, Salmonella typhimurium LT2
uugcuguuaauuucccg

SEQ ID NO: 1870461 - RNA, 17 nt, Salmonella typhimurium LT2
uugcugugaagcaauuc

SEQ ID NO: 1870462 - RNA, 16 nt, Salmonella typhimurium LT2
uugcuuaccuuguucu

SEQ ID NO: 1870463 - RNA, 16 nt, Salmonella typhimurium LT2
uugcuuauccggccua

SEQ ID NO: 1870464 - RNA, 15 nt, Salmonella typhimurium LT2
uugcguaagcagcug

SEQ ID NO: 1870465 - RNA, 17 nt, Salmonella typhimurium LT2
uugcuauagcccacgca

SEQ ID NO: 1870466 - RNA, 14 nt, Salmonella typhimurium LT2
uugcugcuguauuu

SEQ ID NO: 1870467 - RNA, 15 nt, Salmonella typhimurium LT2
uugcuauugaaaaaa

SEQ ID NO: 1870468 - RNA, 17 nt, Salmonella typhimurium LT2
uugcugguagacaaaca

SEQ ID NO: 1870469 - RNA, 17 nt, Salmonella typhimurium LT2
uugcuggcuugcucagg

SEQ ID NO: 1870470 - RNA, 23 nt, Salmonella typhimurium LT2
uugcuggcucaggcguugacuua

SEQ ID NO: 1870471 - RNA, 17 nt, Salmonella typhimurium LT2
uugcugguuaacucuuu

SEQ ID NO: 1870472 - RNA, 18 nt, Salmonella typhimurium LT2
uuggcguaaaucaggcca

SEQ ID NO: 1870473 - RNA, 22 nt, Salmonella typhimurium LT2
uuggcgaggaacaucagccagc

SEQ ID NO: 1870474 - RNA, 16 nt, Salmonella typhimurium LT2
uuggcgaucagcggca

SEQ ID NO: 1870475 - RNA, 14 nt, Salmonella typhimurium LT2
uuggcgcgucauca

SEQ ID NO: 1870476 - RNA, 15 nt, Salmonella typhimurium LT2
uuggccagcauggcg

SEQ ID NO: 1870477 - RNA, 11 nt, Salmonella typhimurium LT2
uuggccagcgu

SEQ ID NO: 1870478 - RNA, 14 nt, Salmonella typhimurium LT2
uugguaucugcaau

SEQ ID NO: 1870479 - RNA, 17 nt, Salmonella typhimurium LT2
uugguaauccacgccaa

SEQ ID NO: 1870480 - RNA, 19 nt, Salmonella typhimurium LT2
uugguuagggaucaucuuc

SEQ ID NO: 1870481 - RNA, 16 nt, Salmonella typhimurium LT2
uugguuaacuucaagg

SEQ ID NO: 1870482 - RNA, 22 nt, Salmonella typhimurium LT2
uugguuaacuucaagguuaugc

SEQ ID NO: 1870483 - RNA, 17 nt, Salmonella typhimurium LT2
uugguuauccagcagcc

SEQ ID NO: 1870484 - RNA, 16 nt, Salmonella typhimurium LT2
uugguucauaccaggu

SEQ ID NO: 1870485 - RNA, 21 nt, Salmonella typhimurium LT2
uuggugauuaacagcgccauc

SEQ ID NO: 1870486 - RNA, 21 nt, Salmonella typhimurium LT2
aauaauugagcgcaaaacgcu

SEQ ID NO: 1870487 - RNA, 18 nt, Salmonella typhimurium LT2
aauaauuuaaaauucaga

SEQ ID NO: 1870488 - RNA, 20 nt, Salmonella typhimurium LT2
aauaauucucaauuucguau

SEQ ID NO: 1870489 - RNA, 15 nt, Salmonella typhimurium LT2
aauaauuaacccaca

SEQ ID NO: 1870490 - RNA, 17 nt, Salmonella typhimurium LT2
aauaauguaaaaaaaua

SEQ ID NO: 1870491 - RNA, 18 nt, Salmonella typhimurium LT2
aauaauguaaaaaaauaa

SEQ ID NO: 1870492 - RNA, 22 nt, Salmonella typhimurium LT2
aauaauggcgcgaaaacagcug

SEQ ID NO: 1870493 - RNA, 20 nt, Salmonella typhimurium LT2
aauaaucgcgagaaaauaga

SEQ ID NO: 1870494 - RNA, 18 nt, Salmonella typhimurium LT2
aauaaucgcgagaaaaua

SEQ ID NO: 1870495 - RNA, 13 nt, Salmonella typhimurium LT2
aauaaucgccgga

SEQ ID NO: 1870496 - RNA, 18 nt, Salmonella typhimurium LT2
aauaaucgaacugacggu

SEQ ID NO: 1870497 - RNA, 12 nt, Salmonella typhimurium LT2
aauaaucccaaa

SEQ ID NO: 1870498 - RNA, 18 nt, Salmonella typhimurium LT2
aauaauggcgcgaaaaca

SEQ ID NO: 1870499 - RNA, 20 nt, Salmonella typhimurium LT2
aauaauggcgcgaaaacagc

SEQ ID NO: 1870500 - RNA, 21 nt, Salmonella typhimurium LT2
aauaaugcaggcuauccacaa

SEQ ID NO: 1870501 - RNA, 13 nt, Salmonella typhimurium LT2
aauaaggcuggca

SEQ ID NO: 1870502 - RNA, 12 nt, Salmonella typhimurium LT2
aauaagcgaauu

SEQ ID NO: 1870503 - RNA, 22 nt, Salmonella typhimurium LT2
aauaagcagaacguagcccauu

SEQ ID NO: 1870504 - RNA, 18 nt, Salmonella typhimurium LT2
aauaaucagaucaauacg

SEQ ID NO: 1870505 - RNA, 20 nt, Salmonella typhimurium LT2
aauaauauguuccacaauca

SEQ ID NO: 1870506 - RNA, 12 nt, Salmonella typhimurium LT2
aauaauauccug

SEQ ID NO: 1870507 - RNA, 18 nt, Salmonella typhimurium LT2
aaguugacuuuuacgcca

SEQ ID NO: 1870508 - RNA, 13 nt, Salmonella typhimurium LT2
aauaaauaccaca

SEQ ID NO: 1870509 - RNA, 14 nt, Salmonella typhimurium LT2
aauaaaugccgcaa

SEQ ID NO: 1870510 - RNA, 17 nt, Salmonella typhimurium LT2
aauaaaugccgcaauaa

SEQ ID NO: 1870511 - RNA, 23 nt, Salmonella typhimurium LT2
aauaaauugaauucgcuaauaaa

SEQ ID NO: 1870512 - RNA, 16 nt, Salmonella typhimurium LT2
aauaaauuuucauuau

SEQ ID NO: 1870513 - RNA, 19 nt, Salmonella typhimurium LT2
aauaaauuuucauuauaaa

SEQ ID NO: 1870514 - RNA, 22 nt, Salmonella typhimurium LT2
aauaaauuuucauuauaaaacu

SEQ ID NO: 1870515 - RNA, 20 nt, Salmonella typhimurium LT2
aauaagacauggaguuccag

SEQ ID NO: 1870516 - RNA, 20 nt, Salmonella typhimurium LT2
aauaacgccagaucucacaa

SEQ ID NO: 1870517 - RNA, 19 nt, Salmonella typhimurium LT2
aauaaccucaacgucgcuc

SEQ ID NO: 1870518 - RNA, 17 nt, Salmonella typhimurium LT2
aauaaccgccagcagca

SEQ ID NO: 1870519 - RNA, 14 nt, Salmonella typhimurium LT2
aauaaccgccgauu

SEQ ID NO: 1870520 - RNA, 15 nt, Salmonella typhimurium LT2
aauaaccccaagcaa

SEQ ID NO: 1870521 - RNA, 22 nt, Salmonella typhimurium LT2
aauaacaucguaaaucaaauga

SEQ ID NO: 1870522 - RNA, 12 nt, Salmonella typhimurium LT2
aauaacaucuuc

SEQ ID NO: 1870523 - RNA, 18 nt, Salmonella typhimurium LT2
aauaaccagccccagaaa

SEQ ID NO: 1870524 - RNA, 18 nt, Salmonella typhimurium LT2
aauagcacaucagccaac

SEQ ID NO: 1870525 - RNA, 15 nt, Salmonella typhimurium LT2
aauagcagcguuuug

SEQ ID NO: 1870526 - RNA, 23 nt, Salmonella typhimurium LT2
aauagcaucaauuucucuuuuau

SEQ ID NO: 1870527 - RNA, 18 nt, Salmonella typhimurium LT2
aauagauaugaaagaagg

SEQ ID NO: 1870528 - RNA, 14 nt, Salmonella typhimurium LT2
aauagcaagggcaa

SEQ ID NO: 1870529 - RNA, 15 nt, Salmonella typhimurium LT2
aauagcaaugaagca

SEQ ID NO: 1870530 - RNA, 15 nt, Salmonella typhimurium LT2
aauacuuuccagcug

SEQ ID NO: 1870531 - RNA, 20 nt, Salmonella typhimurium LT2
aauagagugcgauuugacau

SEQ ID NO: 1870532 - RNA, 15 nt, Salmonella typhimurium LT2
aauagaacccaaagc

SEQ ID NO: 1870533 - RNA, 21 nt, Salmonella typhimurium LT2
aauacccuuaugauagccguu

SEQ ID NO: 1870534 - RNA, 19 nt, Salmonella typhimurium LT2
aauaccuaacucuuccgca

SEQ ID NO: 1870535 - RNA, 19 nt, Salmonella typhimurium LT2
aauaccuuaguaaaaccga

SEQ ID NO: 1870536 - RNA, 20 nt, Salmonella typhimurium LT2
aauaccuuauucagcccacg

SEQ ID NO: 1870537 - RNA, 23 nt, Salmonella typhimurium LT2
aauacgcggcacguuuuccaggu

SEQ ID NO: 1870538 - RNA, 18 nt, Salmonella typhimurium LT2
aauacggagcaaaaaacg

SEQ ID NO: 1870539 - RNA, 15 nt, Salmonella typhimurium LT2
aauaauuucuucuuu

SEQ ID NO: 1870540 - RNA, 20 nt, Salmonella typhimurium LT2
aauaccaccugccaaagcug

SEQ ID NO: 1870541 - RNA, 15 nt, Salmonella typhimurium LT2
aauaccacaucagac

SEQ ID NO: 1870542 - RNA, 23 nt, Salmonella typhimurium LT2
aauaccacaacaagaauauauuc

SEQ ID NO: 1870543 - RNA, 16 nt, Salmonella typhimurium LT2
aauaccgaacaaugug

SEQ ID NO: 1870544 - RNA, 20 nt, Salmonella typhimurium LT2
aauaccacaaauuuugauaa

SEQ ID NO: 1870545 - RNA, 21 nt, Salmonella typhimurium LT2
aauaccacaaauuuugauaaa

SEQ ID NO: 1870546 - RNA, 13 nt, Salmonella typhimurium LT2
aauaccacaaauu

SEQ ID NO: 1870547 - RNA, 13 nt, Salmonella typhimurium LT2
aauaccaauaaga

SEQ ID NO: 1870548 - RNA, 22 nt, Salmonella typhimurium LT2
aauaucauuagcgucauacuua

SEQ ID NO: 1870549 - RNA, 23 nt, Salmonella typhimurium LT2
aauauccccaucccagaccauuc

SEQ ID NO: 1870550 - RNA, 14 nt, Salmonella typhimurium LT2
aauauccagacugu

SEQ ID NO: 1870551 - RNA, 17 nt, Salmonella typhimurium LT2
aauaugcuggcuuaacu

SEQ ID NO: 1870552 - RNA, 13 nt, Salmonella typhimurium LT2
aauaugccaggca

SEQ ID NO: 1870553 - RNA, 14 nt, Salmonella typhimurium LT2
aauaugccaggcau

SEQ ID NO: 1870554 - RNA, 23 nt, Salmonella typhimurium LT2
aauaugccggccgcaguuuucca

SEQ ID NO: 1870555 - RNA, 15 nt, Salmonella typhimurium LT2
aauaugcgcaaucac

SEQ ID NO: 1870556 - RNA, 17 nt, Salmonella typhimurium LT2
aauaugcgucagauaaa

SEQ ID NO: 1870557 - RNA, 23 nt, Salmonella typhimurium LT2
aauaucccgcaagaaacaggcug

SEQ ID NO: 1870558 - RNA, 22 nt, Salmonella typhimurium LT2
aauaucccuucucauggacaca

SEQ ID NO: 1870559 - RNA, 14 nt, Salmonella typhimurium LT2
aauagugcagaaag

SEQ ID NO: 1870560 - RNA, 19 nt, Salmonella typhimurium LT2
aauagcgccagaacugcgu

SEQ ID NO: 1870561 - RNA, 16 nt, Salmonella typhimurium LT2
aauagcgauacugacg

SEQ ID NO: 1870562 - RNA, 17 nt, Salmonella typhimurium LT2
aauagcgauucaucacu

SEQ ID NO: 1870563 - RNA, 19 nt, Salmonella typhimurium LT2
aauagccugggcaaggcug

SEQ ID NO: 1870564 - RNA, 23 nt, Salmonella typhimurium LT2
aauagccgggguaauauccauaa

SEQ ID NO: 1870565 - RNA, 22 nt, Salmonella typhimurium LT2
aauagccccucaauuauguauu

SEQ ID NO: 1870566 - RNA, 12 nt, Salmonella typhimurium LT2
aauagcccggcu

SEQ ID NO: 1870567 - RNA, 14 nt, Salmonella typhimurium LT2
aauauaaucuacca

SEQ ID NO: 1870568 - RNA, 23 nt, Salmonella typhimurium LT2
aauauaaugaguuaacuacagca

SEQ ID NO: 1870569 - RNA, 19 nt, Salmonella typhimurium LT2
aauauagcuaaugcaauaa

SEQ ID NO: 1870570 - RNA, 14 nt, Salmonella typhimurium LT2
aauauacgccaccu

SEQ ID NO: 1870571 - RNA, 18 nt, Salmonella typhimurium LT2
aauauaccgucagcacca

SEQ ID NO: 1870572 - RNA, 21 nt, Salmonella typhimurium LT2
aauauacucccgaauggcuuc

SEQ ID NO: 1870573 - RNA, 19 nt, Salmonella typhimurium LT2
aagccugauacuuuuacuc

SEQ ID NO: 1870574 - RNA, 18 nt, Salmonella typhimurium LT2
aagccggcgccauuucgc

SEQ ID NO: 1870575 - RNA, 14 nt, Salmonella typhimurium LT2
aagcgaaaauaaac

SEQ ID NO: 1870576 - RNA, 15 nt, Salmonella typhimurium LT2
aagcgaaaaaauaau

SEQ ID NO: 1870577 - RNA, 23 nt, Salmonella typhimurium LT2
aagccuuucuguucuuugauuag

SEQ ID NO: 1870578 - RNA, 15 nt, Salmonella typhimurium LT2
aagcgauaaagacag

SEQ ID NO: 1870579 - RNA, 17 nt, Salmonella typhimurium LT2
aagcgcaaaauagcagc

SEQ ID NO: 1870580 - RNA, 18 nt, Salmonella typhimurium LT2
aagcgauuuauccaccgc

SEQ ID NO: 1870581 - RNA, 23 nt, Salmonella typhimurium LT2
aagcgauguauuuauccacgccg

SEQ ID NO: 1870582 - RNA, 18 nt, Salmonella typhimurium LT2
aagcgauguaagaggccg

SEQ ID NO: 1870583 - RNA, 15 nt, Salmonella typhimurium LT2
aagccaggcuuuaaa

SEQ ID NO: 1870584 - RNA, 22 nt, Salmonella typhimurium LT2
aagaagggagguauaaucagca

SEQ ID NO: 1870585 - RNA, 19 nt, Salmonella typhimurium LT2
aagaaguaaacagaaucaa

SEQ ID NO: 1870586 - RNA, 20 nt, Salmonella typhimurium LT2
aagaagucugugaggaaagc

SEQ ID NO: 1870587 - RNA, 21 nt, Salmonella typhimurium LT2
aagaagucugugaggaaagcg

SEQ ID NO: 1870588 - RNA, 19 nt, Salmonella typhimurium LT2
aagccagccaaauagcgcc

SEQ ID NO: 1870589 - RNA, 20 nt, Salmonella typhimurium LT2
aagccagguugcgcccggcg

SEQ ID NO: 1870590 - RNA, 12 nt, Salmonella typhimurium LT2
aagcccacgccc

SEQ ID NO: 1870591 - RNA, 19 nt, Salmonella typhimurium LT2
aagcccuuucuuuuuuugu

SEQ ID NO: 1870592 - RNA, 16 nt, Salmonella typhimurium LT2
aagcccuuacaaaaau

SEQ ID NO: 1870593 - RNA, 18 nt, Salmonella typhimurium LT2
aagcccuuuaguaaaguu

SEQ ID NO: 1870594 - RNA, 17 nt, Salmonella typhimurium LT2
aagcccgcaaacagagc

SEQ ID NO: 1870595 - RNA, 18 nt, Salmonella typhimurium LT2
aagccccuggcgcgccag

SEQ ID NO: 1870596 - RNA, 12 nt, Salmonella typhimurium LT2
aagcccauggca

SEQ ID NO: 1870597 - RNA, 21 nt, Salmonella typhimurium LT2
aagccccccgcacagcacaua

SEQ ID NO: 1870598 - RNA, 13 nt, Salmonella typhimurium LT2
aagcgguaaaucg

SEQ ID NO: 1870599 - RNA, 16 nt, Salmonella typhimurium LT2
aagcggcugucaucaa

SEQ ID NO: 1870600 - RNA, 13 nt, Salmonella typhimurium LT2
aagcgcggacagc

SEQ ID NO: 1870601 - RNA, 15 nt, Salmonella typhimurium LT2
aagcgcgccgaaaau

SEQ ID NO: 1870602 - RNA, 13 nt, Salmonella typhimurium LT2
aagcgcgccauaa

SEQ ID NO: 1870603 - RNA, 18 nt, Salmonella typhimurium LT2
aagcgccuguucaacaug

SEQ ID NO: 1870604 - RNA, 16 nt, Salmonella typhimurium LT2
aagcgccuguucaaca

SEQ ID NO: 1870605 - RNA, 15 nt, Salmonella typhimurium LT2
aagcgcccgauaaua

SEQ ID NO: 1870606 - RNA, 21 nt, Salmonella typhimurium LT2
aagcgccauuaaaaaaggcag

SEQ ID NO: 1870607 - RNA, 23 nt, Salmonella typhimurium LT2
aagcgccacgguugucaaauuug

SEQ ID NO: 1870608 - RNA, 19 nt, Salmonella typhimurium LT2
aagcgccagauaugaucga

SEQ ID NO: 1870609 - RNA, 22 nt, Salmonella typhimurium LT2
aagcgcauccagcucuuucaau

SEQ ID NO: 1870610 - RNA, 18 nt, Salmonella typhimurium LT2
aagcgcaugguagaaguu

SEQ ID NO: 1870611 - RNA, 20 nt, Salmonella typhimurium LT2
aagcucaggccaaucacccc

SEQ ID NO: 1870612 - RNA, 15 nt, Salmonella typhimurium LT2
aagcucagccaggcg

SEQ ID NO: 1870613 - RNA, 21 nt, Salmonella typhimurium LT2
aagcucauuucccaauaguuu

SEQ ID NO: 1870614 - RNA, 17 nt, Salmonella typhimurium LT2
aagcucaacgcaggcug

SEQ ID NO: 1870615 - RNA, 13 nt, Salmonella typhimurium LT2
aagcucaccugcu

SEQ ID NO: 1870616 - RNA, 17 nt, Salmonella typhimurium LT2
aagcuauuucuguauaa

SEQ ID NO: 1870617 - RNA, 20 nt, Salmonella typhimurium LT2
aagcguuacggaaaaaauac

SEQ ID NO: 1870618 - RNA, 18 nt, Salmonella typhimurium LT2
aagcguagccgcgccaga

SEQ ID NO: 1870619 - RNA, 22 nt, Salmonella typhimurium LT2
aagcguagcgccaucaggcaac

SEQ ID NO: 1870620 - RNA, 18 nt, Salmonella typhimurium LT2
aagcgguguaaaagccag

SEQ ID NO: 1870621 - RNA, 17 nt, Salmonella typhimurium LT2
aagcgguuaagauacau

SEQ ID NO: 1870622 - RNA, 18 nt, Salmonella typhimurium LT2
aagcgguuaagauacaua

SEQ ID NO: 1870623 - RNA, 17 nt, Salmonella typhimurium LT2
aagcgguugcaacucca

SEQ ID NO: 1870624 - RNA, 15 nt, Salmonella typhimurium LT2
aagcguaacagcgcu

SEQ ID NO: 1870625 - RNA, 21 nt, Salmonella typhimurium LT2
aagcguuacggaaaaaauacu

SEQ ID NO: 1870626 - RNA, 16 nt, Salmonella typhimurium LT2
aagcguuguaacaaac

SEQ ID NO: 1870627 - RNA, 21 nt, Salmonella typhimurium LT2
aagcguuguacggauggggua

SEQ ID NO: 1870628 - RNA, 21 nt, Salmonella typhimurium LT2
aagcuucuuauuauccaggcg

SEQ ID NO: 1870629 - RNA, 14 nt, Salmonella typhimurium LT2
aagcuggcugacag

SEQ ID NO: 1870630 - RNA, 22 nt, Salmonella typhimurium LT2
aagcugggcgucaacgugaaaa

SEQ ID NO: 1870631 - RNA, 22 nt, Salmonella typhimurium LT2
aagcugguggcgaguccugccg

SEQ ID NO: 1870632 - RNA, 19 nt, Salmonella typhimurium LT2
aagcuggucgagauacugc

SEQ ID NO: 1870633 - RNA, 20 nt, Salmonella typhimurium LT2
aagcuuauaaacuucauccu

SEQ ID NO: 1870634 - RNA, 16 nt, Salmonella typhimurium LT2
aagcugaccagacagu

SEQ ID NO: 1870635 - RNA, 22 nt, Salmonella typhimurium LT2
aagcugaauaccugccccauaa

SEQ ID NO: 1870636 - RNA, 17 nt, Salmonella typhimurium LT2
aagcugauguucauuca

SEQ ID NO: 1870637 - RNA, 17 nt, Salmonella typhimurium LT2
aagugcgcacucagaaa

SEQ ID NO: 1870638 - RNA, 17 nt, Salmonella typhimurium LT2
aagucugugaggaaagc

SEQ ID NO: 1870639 - RNA, 21 nt, Salmonella typhimurium LT2
aagucugugaggaaagcgaaa

SEQ ID NO: 1870640 - RNA, 23 nt, Salmonella typhimurium LT2
aagucugugaggaaagcgaaaau

SEQ ID NO: 1870641 - RNA, 18 nt, Salmonella typhimurium LT2
aagucugagcgcaaacau

SEQ ID NO: 1870642 - RNA, 14 nt, Salmonella typhimurium LT2
aaguggugggugau

SEQ ID NO: 1870643 - RNA, 16 nt, Salmonella typhimurium LT2
aagugucgauaaccug

SEQ ID NO: 1870644 - RNA, 17 nt, Salmonella typhimurium LT2
aaguguaaguucauuua

SEQ ID NO: 1870645 - RNA, 21 nt, Salmonella typhimurium LT2
aaguguaaguucauuuaggcg

SEQ ID NO: 1870646 - RNA, 15 nt, Salmonella typhimurium LT2
aaguucaaacucauu

SEQ ID NO: 1870647 - RNA, 14 nt, Salmonella typhimurium LT2
aagucaaaauaaaa

SEQ ID NO: 1870648 - RNA, 15 nt, Salmonella typhimurium LT2
aagucaaaauaaaau

SEQ ID NO: 1870649 - RNA, 18 nt, Salmonella typhimurium LT2
aagucaucugccaguuau

SEQ ID NO: 1870650 - RNA, 14 nt, Salmonella typhimurium LT2
aagucaucugccag

SEQ ID NO: 1870651 - RNA, 17 nt, Salmonella typhimurium LT2
aagucgaaggcgcagcc

SEQ ID NO: 1870652 - RNA, 13 nt, Salmonella typhimurium LT2
aaguccuucuccu

SEQ ID NO: 1870653 - RNA, 23 nt, Salmonella typhimurium LT2
aaguccuucuccuucgccaaaau

SEQ ID NO: 1870654 - RNA, 20 nt, Salmonella typhimurium LT2
aagucaugagcuauuucagu

SEQ ID NO: 1870655 - RNA, 13 nt, Salmonella typhimurium LT2
aagucgcgcauaa

SEQ ID NO: 1870656 - RNA, 22 nt, Salmonella typhimurium LT2
aaguagccugccagcaacccac

SEQ ID NO: 1870657 - RNA, 14 nt, Salmonella typhimurium LT2
aaguagaucaccag

SEQ ID NO: 1870658 - RNA, 18 nt, Salmonella typhimurium LT2
aaguaggguugccagucg

SEQ ID NO: 1870659 - RNA, 18 nt, Salmonella typhimurium LT2
aaguauucgaugguguua

SEQ ID NO: 1870660 - RNA, 20 nt, Salmonella typhimurium LT2
aaguacggcaaaaauauuga

SEQ ID NO: 1870661 - RNA, 21 nt, Salmonella typhimurium LT2
aaguagaacuuccaacuaaag

SEQ ID NO: 1870662 - RNA, 22 nt, Salmonella typhimurium LT2
aaguaccgugaagaaacggaaa

SEQ ID NO: 1870663 - RNA, 22 nt, Salmonella typhimurium LT2
aaguaccagcgcgaacauuaca

SEQ ID NO: 1870664 - RNA, 18 nt, Salmonella typhimurium LT2
aaguaccacuaacagugc

SEQ ID NO: 1870665 - RNA, 19 nt, Salmonella typhimurium LT2
aaggguuuucgccuggcgg

SEQ ID NO: 1870666 - RNA, 13 nt, Salmonella typhimurium LT2
aagguccagggaa

SEQ ID NO: 1870667 - RNA, 18 nt, Salmonella typhimurium LT2
aaggucgauauuuaauga

SEQ ID NO: 1870668 - RNA, 19 nt, Salmonella typhimurium LT2
aaggucaucacaucccagc

SEQ ID NO: 1870669 - RNA, 20 nt, Salmonella typhimurium LT2
aaguaaagauuuuuauuaaa

SEQ ID NO: 1870670 - RNA, 21 nt, Salmonella typhimurium LT2
aaggcgguuuuauugucagaa

SEQ ID NO: 1870671 - RNA, 17 nt, Salmonella typhimurium LT2
aaggcguugaugaaggu

SEQ ID NO: 1870672 - RNA, 21 nt, Salmonella typhimurium LT2
aagggaaaagccauugccgcg

SEQ ID NO: 1870673 - RNA, 17 nt, Salmonella typhimurium LT2
aaggcggcaaagauaau

SEQ ID NO: 1870674 - RNA, 22 nt, Salmonella typhimurium LT2
aaggggccacaggcggcauggg

SEQ ID NO: 1870675 - RNA, 13 nt, Salmonella typhimurium LT2
aaggguaagcaau

SEQ ID NO: 1870676 - RNA, 18 nt, Salmonella typhimurium LT2
aaggguauacaaaaaaga

SEQ ID NO: 1870677 - RNA, 14 nt, Salmonella typhimurium LT2
aaggguaccugggc

SEQ ID NO: 1870678 - RNA, 15 nt, Salmonella typhimurium LT2
aagggcaccagcaac

SEQ ID NO: 1870679 - RNA, 18 nt, Salmonella typhimurium LT2
aaggggauaacaaccagg

SEQ ID NO: 1870680 - RNA, 14 nt, Salmonella typhimurium LT2
aagggcaagggcaa

SEQ ID NO: 1870681 - RNA, 14 nt, Salmonella typhimurium LT2
aagggaccgcgaag

SEQ ID NO: 1870682 - RNA, 20 nt, Salmonella typhimurium LT2
aagggauaagaaagauaaaa

SEQ ID NO: 1870683 - RNA, 16 nt, Salmonella typhimurium LT2
aauugcugaugucugc

SEQ ID NO: 1870684 - RNA, 11 nt, Salmonella typhimurium LT2
aauugcugaag

SEQ ID NO: 1870685 - RNA, 16 nt, Salmonella typhimurium LT2
aauugccgucgccgga

SEQ ID NO: 1870686 - RNA, 17 nt, Salmonella typhimurium LT2
aauugcccccuuuuuau

SEQ ID NO: 1870687 - RNA, 20 nt, Salmonella typhimurium LT2
aauucuucguaggcaacaau

SEQ ID NO: 1870688 - RNA, 17 nt, Salmonella typhimurium LT2
aauucuucgaaugucuc

SEQ ID NO: 1870689 - RNA, 23 nt, Salmonella typhimurium LT2
aauucuuggaaaauugcgaggug

SEQ ID NO: 1870690 - RNA, 23 nt, Salmonella typhimurium LT2
aauugaaauacucuuugaacagc

SEQ ID NO: 1870691 - RNA, 15 nt, Salmonella typhimurium LT2
aauugaaaaccauaa

SEQ ID NO: 1870692 - RNA, 19 nt, Salmonella typhimurium LT2
aauugaagaguuugaucau

SEQ ID NO: 1870693 - RNA, 16 nt, Salmonella typhimurium LT2
aauugaagaguuugau

SEQ ID NO: 1870694 - RNA, 18 nt, Salmonella typhimurium LT2
aauugauaauaaccgucu

SEQ ID NO: 1870695 - RNA, 23 nt, Salmonella typhimurium LT2
aauugacuggauuuuugacuaaa

SEQ ID NO: 1870696 - RNA, 22 nt, Salmonella typhimurium LT2
aauuuaugauuuuaacaucacc

SEQ ID NO: 1870697 - RNA, 20 nt, Salmonella typhimurium LT2
aauuuaauugauaucgcaac

SEQ ID NO: 1870698 - RNA, 13 nt, Salmonella typhimurium LT2
aauuuaauaauaa

SEQ ID NO: 1870699 - RNA, 16 nt, Salmonella typhimurium LT2
aauuuaauaauaaauu

SEQ ID NO: 1870700 - RNA, 23 nt, Salmonella typhimurium LT2
aauuuaaaguaaggcugauuaua

SEQ ID NO: 1870701 - RNA, 16 nt, Salmonella typhimurium LT2
aauuguuuaaaaacag

SEQ ID NO: 1870702 - RNA, 17 nt, Salmonella typhimurium LT2
aauuguuugguuuugaa

SEQ ID NO: 1870703 - RNA, 13 nt, Salmonella typhimurium LT2
aauugguagacgc

SEQ ID NO: 1870704 - RNA, 14 nt, Salmonella typhimurium LT2
aauugguuauauua

SEQ ID NO: 1870705 - RNA, 15 nt, Salmonella typhimurium LT2
aauuguccacccucc

SEQ ID NO: 1870706 - RNA, 12 nt, Salmonella typhimurium LT2
aauucaaucacu

SEQ ID NO: 1870707 - RNA, 15 nt, Salmonella typhimurium LT2
aauucaccaaauccu

SEQ ID NO: 1870708 - RNA, 21 nt, Salmonella typhimurium LT2
aauuauugcguugcuuuauaa

SEQ ID NO: 1870709 - RNA, 12 nt, Salmonella typhimurium LT2
aauuauuuaagc

SEQ ID NO: 1870710 - RNA, 19 nt, Salmonella typhimurium LT2
aauuaucauguauuguuag

SEQ ID NO: 1870711 - RNA, 11 nt, Salmonella typhimurium LT2
aauuauauacg

SEQ ID NO: 1870712 - RNA, 17 nt, Salmonella typhimurium LT2
aauuaugaccaauguua

SEQ ID NO: 1870713 - RNA, 14 nt, Salmonella typhimurium LT2
aauuauuaccaaug

SEQ ID NO: 1870714 - RNA, 13 nt, Salmonella typhimurium LT2
aauuaaccgauaa

SEQ ID NO: 1870715 - RNA, 15 nt, Salmonella typhimurium LT2
aauguaagaauaaca

SEQ ID NO: 1870716 - RNA, 22 nt, Salmonella typhimurium LT2
aauuacguuggggauaaccaga

SEQ ID NO: 1870717 - RNA, 17 nt, Salmonella typhimurium LT2
aauuacgcacacuugcu

SEQ ID NO: 1870718 - RNA, 16 nt, Salmonella typhimurium LT2
aauuagcgcgaaauaa

SEQ ID NO: 1870719 - RNA, 17 nt, Salmonella typhimurium LT2
aauuccuuguuuuaacg

SEQ ID NO: 1870720 - RNA, 16 nt, Salmonella typhimurium LT2
aauuccugacugcgcg

SEQ ID NO: 1870721 - RNA, 16 nt, Salmonella typhimurium LT2
aauuccugccagagac

SEQ ID NO: 1870722 - RNA, 16 nt, Salmonella typhimurium LT2
aauucguccagaugac

SEQ ID NO: 1870723 - RNA, 19 nt, Salmonella typhimurium LT2
aauucgcguucagaaaugu

SEQ ID NO: 1870724 - RNA, 15 nt, Salmonella typhimurium LT2
aauucgcagagcgca

SEQ ID NO: 1870725 - RNA, 21 nt, Salmonella typhimurium LT2
aauucucagaaacaacacaaa

SEQ ID NO: 1870726 - RNA, 19 nt, Salmonella typhimurium LT2
aauuccggcacaaccuggc

SEQ ID NO: 1870727 - RNA, 17 nt, Salmonella typhimurium LT2
aauuccggcgaaaaacc

SEQ ID NO: 1870728 - RNA, 14 nt, Salmonella typhimurium LT2
aauuccaggaugac

SEQ ID NO: 1870729 - RNA, 20 nt, Salmonella typhimurium LT2
aauucauuacgaaguuuaau

SEQ ID NO: 1870730 - RNA, 23 nt, Salmonella typhimurium LT2
aauucauuacgaaguuuaauuca

SEQ ID NO: 1870731 - RNA, 15 nt, Salmonella typhimurium LT2
aauucauaacaccaa

SEQ ID NO: 1870732 - RNA, 18 nt, Salmonella typhimurium LT2
aauucacgcuucucuggc

SEQ ID NO: 1870733 - RNA, 22 nt, Salmonella typhimurium LT2
aauucagacugcgcauuaacac

SEQ ID NO: 1870734 - RNA, 15 nt, Salmonella typhimurium LT2
aaugcgcuagcuggc

SEQ ID NO: 1870735 - RNA, 14 nt, Salmonella typhimurium LT2
aaugcguaaaaagc

SEQ ID NO: 1870736 - RNA, 20 nt, Salmonella typhimurium LT2
aaugcgucggcaccauuccc

SEQ ID NO: 1870737 - RNA, 16 nt, Salmonella typhimurium LT2
aaugcgugagcagggg

SEQ ID NO: 1870738 - RNA, 14 nt, Salmonella typhimurium LT2
aauggaacugccug

SEQ ID NO: 1870739 - RNA, 14 nt, Salmonella typhimurium LT2
aauggacaaguaaa

SEQ ID NO: 1870740 - RNA, 10 nt, Salmonella typhimurium LT2
aaugcuuucc

SEQ ID NO: 1870741 - RNA, 17 nt, Salmonella typhimurium LT2
aaugcuuucgccagccg

SEQ ID NO: 1870742 - RNA, 22 nt, Salmonella typhimurium LT2
aauggccgcagcgccauaaaaa

SEQ ID NO: 1870743 - RNA, 15 nt, Salmonella typhimurium LT2
aauggccaccagcac

SEQ ID NO: 1870744 - RNA, 17 nt, Salmonella typhimurium LT2
aauggccaccagcacaa

SEQ ID NO: 1870745 - RNA, 12 nt, Salmonella typhimurium LT2
aauggcgaaaaa

SEQ ID NO: 1870746 - RNA, 23 nt, Salmonella typhimurium LT2
aauggcgauaauagaaccgaaca

SEQ ID NO: 1870747 - RNA, 17 nt, Salmonella typhimurium LT2
aauggauagagucgaua

SEQ ID NO: 1870748 - RNA, 18 nt, Salmonella typhimurium LT2
aauggcaggcagcagaua

SEQ ID NO: 1870749 - RNA, 17 nt, Salmonella typhimurium LT2
aauguaaaaaaauaaaa

SEQ ID NO: 1870750 - RNA, 12 nt, Salmonella typhimurium LT2
aaugcccggcgc

SEQ ID NO: 1870751 - RNA, 11 nt, Salmonella typhimurium LT2
aaugcccuucu

SEQ ID NO: 1870752 - RNA, 16 nt, Salmonella typhimurium LT2
aaugcccguugacgaa

SEQ ID NO: 1870753 - RNA, 21 nt, Salmonella typhimurium LT2
aaugcccgucccauuucugga

SEQ ID NO: 1870754 - RNA, 20 nt, Salmonella typhimurium LT2
aaugccgauagucuccgcca

SEQ ID NO: 1870755 - RNA, 18 nt, Salmonella typhimurium LT2
aaugccgcccaggauaca

SEQ ID NO: 1870756 - RNA, 15 nt, Salmonella typhimurium LT2
aaugccaaaauggac

SEQ ID NO: 1870757 - RNA, 20 nt, Salmonella typhimurium LT2
aaugccaaaauggacagggu

SEQ ID NO: 1870758 - RNA, 20 nt, Salmonella typhimurium LT2
aaugccacgagaaauccaca

SEQ ID NO: 1870759 - RNA, 15 nt, Salmonella typhimurium LT2
aaugcaucuucacug

SEQ ID NO: 1870760 - RNA, 19 nt, Salmonella typhimurium LT2
aaugcauggcagauaaacc

SEQ ID NO: 1870761 - RNA, 14 nt, Salmonella typhimurium LT2
aaugcauuggccag

SEQ ID NO: 1870762 - RNA, 23 nt, Salmonella typhimurium LT2
aaugcauuggccagcguggauga

SEQ ID NO: 1870763 - RNA, 13 nt, Salmonella typhimurium LT2
aaugcgagcaaaa

SEQ ID NO: 1870764 - RNA, 15 nt, Salmonella typhimurium LT2
aaugcgacagcggca

SEQ ID NO: 1870765 - RNA, 18 nt, Salmonella typhimurium LT2
aaugcgccccggcggcgu

SEQ ID NO: 1870766 - RNA, 15 nt, Salmonella typhimurium LT2
aaugcgccccggcgg

SEQ ID NO: 1870767 - RNA, 14 nt, Salmonella typhimurium LT2
aaugccugaccaac

SEQ ID NO: 1870768 - RNA, 22 nt, Salmonella typhimurium LT2
aaugccugacgccaccacgccg

SEQ ID NO: 1870769 - RNA, 14 nt, Salmonella typhimurium LT2
aaugccucuuguuu

SEQ ID NO: 1870770 - RNA, 20 nt, Salmonella typhimurium LT2
aaugccucuuguuucaccuc

SEQ ID NO: 1870771 - RNA, 13 nt, Salmonella typhimurium LT2
aaugccuguuuau

SEQ ID NO: 1870772 - RNA, 20 nt, Salmonella typhimurium LT2
aaugccuggagccagccuga

SEQ ID NO: 1870773 - RNA, 23 nt, Salmonella typhimurium LT2
aaugccguuaccguucaggcaaa

SEQ ID NO: 1870774 - RNA, 15 nt, Salmonella typhimurium LT2
aaugccucauuaaaa

SEQ ID NO: 1870775 - RNA, 19 nt, Salmonella typhimurium LT2
aaugccucauuaaaaaaac

SEQ ID NO: 1870776 - RNA, 15 nt, Salmonella typhimurium LT2
aaugaccucaagaau

SEQ ID NO: 1870777 - RNA, 22 nt, Salmonella typhimurium LT2
aaugaaucaucgguaaaugcuu

SEQ ID NO: 1870778 - RNA, 15 nt, Salmonella typhimurium LT2
aaugagcaucuaccc

SEQ ID NO: 1870779 - RNA, 20 nt, Salmonella typhimurium LT2
aaugacgagcggugcaaaaa

SEQ ID NO: 1870780 - RNA, 15 nt, Salmonella typhimurium LT2
aaugacggaccaaca

SEQ ID NO: 1870781 - RNA, 20 nt, Salmonella typhimurium LT2
aaugacggaccaacaaccca

SEQ ID NO: 1870782 - RNA, 21 nt, Salmonella typhimurium LT2
aaugaucguaugcagccaggc

SEQ ID NO: 1870783 - RNA, 19 nt, Salmonella typhimurium LT2
aaugaucagcaaaauagug

SEQ ID NO: 1870784 - RNA, 24 nt, Salmonella typhimurium LT2
aaugagcggaacgcguuccacgau

SEQ ID NO: 1870785 - RNA, 18 nt, Salmonella typhimurium LT2
aaugagcugucgccugcu

SEQ ID NO: 1870786 - RNA, 22 nt, Salmonella typhimurium LT2
aaugauggcgagaguuugugau

SEQ ID NO: 1870787 - RNA, 19 nt, Salmonella typhimurium LT2
aaugcaaauuauuuuaugu

SEQ ID NO: 1870788 - RNA, 16 nt, Salmonella typhimurium LT2
aaugcaaagaaaaaca

SEQ ID NO: 1870789 - RNA, 18 nt, Salmonella typhimurium LT2
aaugauuuuuauaaaauu

SEQ ID NO: 1870790 - RNA, 22 nt, Salmonella typhimurium LT2
aaugaaaucgucgccaacaccg

SEQ ID NO: 1870791 - RNA, 15 nt, Salmonella typhimurium LT2
aaucuuaccuguucc

SEQ ID NO: 1870792 - RNA, 21 nt, Salmonella typhimurium LT2
aaucuggugauaaagcagacc

SEQ ID NO: 1870793 - RNA, 19 nt, Salmonella typhimurium LT2
aaucuggugauaaagcaga

SEQ ID NO: 1870794 - RNA, 18 nt, Salmonella typhimurium LT2
aaucuggucggugauaua

SEQ ID NO: 1870795 - RNA, 19 nt, Salmonella typhimurium LT2
aaucuggucggugauauau

SEQ ID NO: 1870796 - RNA, 15 nt, Salmonella typhimurium LT2
aaucuguucugucca

SEQ ID NO: 1870797 - RNA, 23 nt, Salmonella typhimurium LT2
aaucuguucuguccauguuuuau

SEQ ID NO: 1870798 - RNA, 14 nt, Salmonella typhimurium LT2
aaucccuucuuuua

SEQ ID NO: 1870799 - RNA, 21 nt, Salmonella typhimurium LT2
aauccgccagugaauccacca

SEQ ID NO: 1870800 - RNA, 17 nt, Salmonella typhimurium LT2
aaucccacgccgcugau

SEQ ID NO: 1870801 - RNA, 17 nt, Salmonella typhimurium LT2
aaucccccugccacaac

SEQ ID NO: 1870802 - RNA, 16 nt, Salmonella typhimurium LT2
aauccccccuuuaccc

SEQ ID NO: 1870803 - RNA, 23 nt, Salmonella typhimurium LT2
aauccccccuuuacccaccagcc

SEQ ID NO: 1870804 - RNA, 19 nt, Salmonella typhimurium LT2
aauccccccuuuuuugcug

SEQ ID NO: 1870805 - RNA, 21 nt, Salmonella typhimurium LT2
aaucccgcaucacccgcauau

SEQ ID NO: 1870806 - RNA, 20 nt, Salmonella typhimurium LT2
aaucccguaccggaaauaaa

SEQ ID NO: 1870807 - RNA, 21 nt, Salmonella typhimurium LT2
aauccggcugccugccggauu

SEQ ID NO: 1870808 - RNA, 18 nt, Salmonella typhimurium LT2
aauccggccugucaggau

SEQ ID NO: 1870809 - RNA, 15 nt, Salmonella typhimurium LT2
aauccgugguuuuac

SEQ ID NO: 1870810 - RNA, 17 nt, Salmonella typhimurium LT2
aauccgguuuucguuaa

SEQ ID NO: 1870811 - RNA, 21 nt, Salmonella typhimurium LT2
aauccucuaccggaaaacagc

SEQ ID NO: 1870812 - RNA, 19 nt, Salmonella typhimurium LT2
aauccucuaccggaaaaca

SEQ ID NO: 1870813 - RNA, 15 nt, Salmonella typhimurium LT2
aauccucacugccga

SEQ ID NO: 1870814 - RNA, 18 nt, Salmonella typhimurium LT2
aaucgcgagccuucaaca

SEQ ID NO: 1870815 - RNA, 21 nt, Salmonella typhimurium LT2
aaucgcgagaaaauagaggaa

SEQ ID NO: 1870816 - RNA, 11 nt, Salmonella typhimurium LT2
aaucgccgcuu

SEQ ID NO: 1870817 - RNA, 15 nt, Salmonella typhimurium LT2
aaucgccgccgccag

SEQ ID NO: 1870818 - RNA, 17 nt, Salmonella typhimurium LT2
aaucgccgugaucccaa

SEQ ID NO: 1870819 - RNA, 15 nt, Salmonella typhimurium LT2
aaucgccucaaccaa

SEQ ID NO: 1870820 - RNA, 23 nt, Salmonella typhimurium LT2
aauccuguuccaucguauagcga

SEQ ID NO: 1870821 - RNA, 23 nt, Salmonella typhimurium LT2
aauccuucuaccuucacccccau

SEQ ID NO: 1870822 - RNA, 19 nt, Salmonella typhimurium LT2
aauccuuccuccaccacca

SEQ ID NO: 1870823 - RNA, 12 nt, Salmonella typhimurium LT2
aauccuucuucc

SEQ ID NO: 1870824 - RNA, 18 nt, Salmonella typhimurium LT2
aauccuuguccauguaaa

SEQ ID NO: 1870825 - RNA, 23 nt, Salmonella typhimurium LT2
aauccuuguccauguaaacucca

SEQ ID NO: 1870826 - RNA, 18 nt, Salmonella typhimurium LT2
aaucgccaccguaacuaa

SEQ ID NO: 1870827 - RNA, 11 nt, Salmonella typhimurium LT2
aaucgcugccu

SEQ ID NO: 1870828 - RNA, 14 nt, Salmonella typhimurium LT2
aaucgcucuugcac

SEQ ID NO: 1870829 - RNA, 21 nt, Salmonella typhimurium LT2
aaucgcucuugcacaauacuu

SEQ ID NO: 1870830 - RNA, 19 nt, Salmonella typhimurium LT2
aaucgucccacaugaacuc

SEQ ID NO: 1870831 - RNA, 19 nt, Salmonella typhimurium LT2
aaucuaccauugauaccaa

SEQ ID NO: 1870832 - RNA, 17 nt, Salmonella typhimurium LT2
aauccaugagaagaaaa

SEQ ID NO: 1870833 - RNA, 18 nt, Salmonella typhimurium LT2
aauccaugagaagaaaaa

SEQ ID NO: 1870834 - RNA, 14 nt, Salmonella typhimurium LT2
aauccaggaauuuu

SEQ ID NO: 1870835 - RNA, 15 nt, Salmonella typhimurium LT2
aauccagauccgguu

SEQ ID NO: 1870836 - RNA, 12 nt, Salmonella typhimurium LT2
aauccaccagcg

SEQ ID NO: 1870837 - RNA, 15 nt, Salmonella typhimurium LT2
aaucauuuguacaaa

SEQ ID NO: 1870838 - RNA, 15 nt, Salmonella typhimurium LT2
aaucauuucauuaau

SEQ ID NO: 1870839 - RNA, 18 nt, Salmonella typhimurium LT2
aaucauugugguuucccu

SEQ ID NO: 1870840 - RNA, 15 nt, Salmonella typhimurium LT2
aauauuaaagaugcc

SEQ ID NO: 1870841 - RNA, 17 nt, Salmonella typhimurium LT2
aauauguuccacaauca

SEQ ID NO: 1870842 - RNA, 21 nt, Salmonella typhimurium LT2
aauauguuguggcaauauuuu

SEQ ID NO: 1870843 - RNA, 18 nt, Salmonella typhimurium LT2
aaucaguacugcgcccgc

SEQ ID NO: 1870844 - RNA, 22 nt, Salmonella typhimurium LT2
aaucauacauagcaggccauaa

SEQ ID NO: 1870845 - RNA, 17 nt, Salmonella typhimurium LT2
aaucauauaaaacagcc

SEQ ID NO: 1870846 - RNA, 13 nt, Salmonella typhimurium LT2
aaucaugucaaau

SEQ ID NO: 1870847 - RNA, 15 nt, Salmonella typhimurium LT2
aaucauguuuuucuc

SEQ ID NO: 1870848 - RNA, 14 nt, Salmonella typhimurium LT2
aaucaugagcgcaa

SEQ ID NO: 1870849 - RNA, 19 nt, Salmonella typhimurium LT2
aaucauuacggcgcuuucg

SEQ ID NO: 1870850 - RNA, 18 nt, Salmonella typhimurium LT2
aaucauucgagaugcaua

SEQ ID NO: 1870851 - RNA, 15 nt, Salmonella typhimurium LT2
aaucauugcguucag

SEQ ID NO: 1870852 - RNA, 16 nt, Salmonella typhimurium LT2
aaccuguuaucaggau

SEQ ID NO: 1870853 - RNA, 23 nt, Salmonella typhimurium LT2
aaccuuacucgcuguacuucccu

SEQ ID NO: 1870854 - RNA, 20 nt, Salmonella typhimurium LT2
aaccuucaagaaucaauaua

SEQ ID NO: 1870855 - RNA, 15 nt, Salmonella typhimurium LT2
aaccuucauaaauac

SEQ ID NO: 1870856 - RNA, 12 nt, Salmonella typhimurium LT2
aaccuucaaguu

SEQ ID NO: 1870857 - RNA, 12 nt, Salmonella typhimurium LT2
aaccuugcgccu

SEQ ID NO: 1870858 - RNA, 20 nt, Salmonella typhimurium LT2
aaccuugguuuucaagaacc

SEQ ID NO: 1870859 - RNA, 20 nt, Salmonella typhimurium LT2
aacgaaagcucaggcgggga

SEQ ID NO: 1870860 - RNA, 19 nt, Salmonella typhimurium LT2
aacgaaccauuugccugcc

SEQ ID NO: 1870861 - RNA, 19 nt, Salmonella typhimurium LT2
aacgaaacccaaauaacca

SEQ ID NO: 1870862 - RNA, 20 nt, Salmonella typhimurium LT2
aacgaacgcggaucagacgg

SEQ ID NO: 1870863 - RNA, 19 nt, Salmonella typhimurium LT2
aacgaaucaccucgcuucc

SEQ ID NO: 1870864 - RNA, 22 nt, Salmonella typhimurium LT2
aacgaaucgcugcgccagcagc

SEQ ID NO: 1870865 - RNA, 14 nt, Salmonella typhimurium LT2
aacgacccccacca

SEQ ID NO: 1870866 - RNA, 14 nt, Salmonella typhimurium LT2
aacgaccagaauca

SEQ ID NO: 1870867 - RNA, 20 nt, Salmonella typhimurium LT2
aaccuccggcuaugccggag

SEQ ID NO: 1870868 - RNA, 19 nt, Salmonella typhimurium LT2
aaccuccggcuaugccgga

SEQ ID NO: 1870869 - RNA, 19 nt, Salmonella typhimurium LT2
aaccuccgcaccuucauca

SEQ ID NO: 1870870 - RNA, 19 nt, Salmonella typhimurium LT2
aaccucaucccggcuuaaa

SEQ ID NO: 1870871 - RNA, 19 nt, Salmonella typhimurium LT2
aaccucauuucucaaaaac

SEQ ID NO: 1870872 - RNA, 22 nt, Salmonella typhimurium LT2
aaccucauuucucaaaaacacc

SEQ ID NO: 1870873 - RNA, 20 nt, Salmonella typhimurium LT2
aaccucggcuugcuucaucu

SEQ ID NO: 1870874 - RNA, 17 nt, Salmonella typhimurium LT2
aaccucggcuugcuuca

SEQ ID NO: 1870875 - RNA, 17 nt, Salmonella typhimurium LT2
aaccucuauaguaaauu

SEQ ID NO: 1870876 - RNA, 12 nt, Salmonella typhimurium LT2
aaccugaacaau

SEQ ID NO: 1870877 - RNA, 14 nt, Salmonella typhimurium LT2
aaccugauauugcg

SEQ ID NO: 1870878 - RNA, 18 nt, Salmonella typhimurium LT2
aaccugauccaggaaacg

SEQ ID NO: 1870879 - RNA, 20 nt, Salmonella typhimurium LT2
aaccugcaaaaaaagaaaaa

SEQ ID NO: 1870880 - RNA, 13 nt, Salmonella typhimurium LT2
aaccugagcgcga

SEQ ID NO: 1870881 - RNA, 21 nt, Salmonella typhimurium LT2
aaccugcgccgcgauaaagaa

SEQ ID NO: 1870882 - RNA, 21 nt, Salmonella typhimurium LT2
aaccugcucggcuaucgccac

SEQ ID NO: 1870883 - RNA, 21 nt, Salmonella typhimurium LT2
aaccugcguuacggucgauuu

SEQ ID NO: 1870884 - RNA, 12 nt, Salmonella typhimurium LT2
aaccuaaauaaa

SEQ ID NO: 1870885 - RNA, 15 nt, Salmonella typhimurium LT2
aaccuaaauaaauac

SEQ ID NO: 1870886 - RNA, 13 nt, Salmonella typhimurium LT2
aaccuaaccaaac

SEQ ID NO: 1870887 - RNA, 16 nt, Salmonella typhimurium LT2
aaccuauuuugcaaaa

SEQ ID NO: 1870888 - RNA, 19 nt, Salmonella typhimurium LT2
aaccucaccguccgccagg

SEQ ID NO: 1870889 - RNA, 15 nt, Salmonella typhimurium LT2
aaccucacggagaaa

SEQ ID NO: 1870890 - RNA, 21 nt, Salmonella typhimurium LT2
aaccucacggagaaaagcgaa

SEQ ID NO: 1870891 - RNA, 16 nt, Salmonella typhimurium LT2
aaccguuggggaaaau

SEQ ID NO: 1870892 - RNA, 17 nt, Salmonella typhimurium LT2
aaccguggcaccccucu

SEQ ID NO: 1870893 - RNA, 19 nt, Salmonella typhimurium LT2
aaccgucacgaucuggcaa

SEQ ID NO: 1870894 - RNA, 14 nt, Salmonella typhimurium LT2
aacgcagcaucgcc

SEQ ID NO: 1870895 - RNA, 16 nt, Salmonella typhimurium LT2
aacgcagcauccacgc

SEQ ID NO: 1870896 - RNA, 18 nt, Salmonella typhimurium LT2
aacgcagcgcgcguagca

SEQ ID NO: 1870897 - RNA, 18 nt, Salmonella typhimurium LT2
aacgcaucaaauaccuuu

SEQ ID NO: 1870898 - RNA, 14 nt, Salmonella typhimurium LT2
aacgcacuaccaga

SEQ ID NO: 1870899 - RNA, 18 nt, Salmonella typhimurium LT2
aacgauucguaaauugac

SEQ ID NO: 1870900 - RNA, 17 nt, Salmonella typhimurium LT2
aacgacgcauaaaaaau

SEQ ID NO: 1870901 - RNA, 21 nt, Salmonella typhimurium LT2
aacgacuacguucaucaggca

SEQ ID NO: 1870902 - RNA, 17 nt, Salmonella typhimurium LT2
aacgacguuuuccaguu

SEQ ID NO: 1870903 - RNA, 13 nt, Salmonella typhimurium LT2
aacgagauucaau

SEQ ID NO: 1870904 - RNA, 18 nt, Salmonella typhimurium LT2
aacgaucccuaauaaaau

SEQ ID NO: 1870905 - RNA, 19 nt, Salmonella typhimurium LT2
aacgauacagcacggcagu

SEQ ID NO: 1870906 - RNA, 20 nt, Salmonella typhimurium LT2
aacgauaauaucgucaccag

SEQ ID NO: 1870907 - RNA, 22 nt, Salmonella typhimurium LT2
aacgccugccgcgcccaguuuc

SEQ ID NO: 1870908 - RNA, 18 nt, Salmonella typhimurium LT2
aacgccuuccugccagca

SEQ ID NO: 1870909 - RNA, 19 nt, Salmonella typhimurium LT2
aacgccuuccugccagcac

SEQ ID NO: 1870910 - RNA, 11 nt, Salmonella typhimurium LT2
aacgccuguag

SEQ ID NO: 1870911 - RNA, 18 nt, Salmonella typhimurium LT2
aacgccugaugcugcgca

SEQ ID NO: 1870912 - RNA, 13 nt, Salmonella typhimurium LT2
aacgccugcacca

SEQ ID NO: 1870913 - RNA, 23 nt, Salmonella typhimurium LT2
aacgccuccauuuuggggaaaau

SEQ ID NO: 1870914 - RNA, 11 nt, Salmonella typhimurium LT2
aacgcgaaaau

SEQ ID NO: 1870915 - RNA, 15 nt, Salmonella typhimurium LT2
aacgcgaagauuaau

SEQ ID NO: 1870916 - RNA, 18 nt, Salmonella typhimurium LT2
aacgcgcaucaacgccag

SEQ ID NO: 1870917 - RNA, 15 nt, Salmonella typhimurium LT2
aacgccgggccugcc

SEQ ID NO: 1870918 - RNA, 16 nt, Salmonella typhimurium LT2
aacgccgggaacuuuc

SEQ ID NO: 1870919 - RNA, 22 nt, Salmonella typhimurium LT2
aacgccgucacaaagcccaccg

SEQ ID NO: 1870920 - RNA, 18 nt, Salmonella typhimurium LT2
aacgccguuaccagcauc

SEQ ID NO: 1870921 - RNA, 17 nt, Salmonella typhimurium LT2
aacgccguuaccagcau

SEQ ID NO: 1870922 - RNA, 16 nt, Salmonella typhimurium LT2
aacgccgccugcgcca

SEQ ID NO: 1870923 - RNA, 23 nt, Salmonella typhimurium LT2
aacgccgcgcaaagcaauaccac

SEQ ID NO: 1870924 - RNA, 16 nt, Salmonella typhimurium LT2
aacgccgcgcguaaau

SEQ ID NO: 1870925 - RNA, 18 nt, Salmonella typhimurium LT2
aacgcauccaggcgaaau

SEQ ID NO: 1870926 - RNA, 14 nt, Salmonella typhimurium LT2
aacgcauccagcgc

SEQ ID NO: 1870927 - RNA, 21 nt, Salmonella typhimurium LT2
aacgccaccgcuaccugcccu

SEQ ID NO: 1870928 - RNA, 18 nt, Salmonella typhimurium LT2
aacgccaaucacuuuacu

SEQ ID NO: 1870929 - RNA, 16 nt, Salmonella typhimurium LT2
aacgccaagcgcggca

SEQ ID NO: 1870930 - RNA, 21 nt, Salmonella typhimurium LT2
aacgccaagcgcggcagcagc

SEQ ID NO: 1870931 - RNA, 23 nt, Salmonella typhimurium LT2
aacgccaagcgcggcagcagcuu

SEQ ID NO: 1870932 - RNA, 20 nt, Salmonella typhimurium LT2
aacgccccucgguuuauccc

SEQ ID NO: 1870933 - RNA, 16 nt, Salmonella typhimurium LT2
aacgccccuucaucag

SEQ ID NO: 1870934 - RNA, 15 nt, Salmonella typhimurium LT2
aacgccaggcaaccu

SEQ ID NO: 1870935 - RNA, 16 nt, Salmonella typhimurium LT2
aacgcauuggcaauga

SEQ ID NO: 1870936 - RNA, 19 nt, Salmonella typhimurium LT2
aacgccagaucucacaaga

SEQ ID NO: 1870937 - RNA, 22 nt, Salmonella typhimurium LT2
aacggaucagccugagcgccag

SEQ ID NO: 1870938 - RNA, 20 nt, Salmonella typhimurium LT2
aacggaugcgccaucccaug

SEQ ID NO: 1870939 - RNA, 13 nt, Salmonella typhimurium LT2
aacggaugaaagc

SEQ ID NO: 1870940 - RNA, 21 nt, Salmonella typhimurium LT2
aacggagauauagaccagcgc

SEQ ID NO: 1870941 - RNA, 22 nt, Salmonella typhimurium LT2
aacggcaacaguaccugauaaa

SEQ ID NO: 1870942 - RNA, 16 nt, Salmonella typhimurium LT2
aacggaaccaaaauag

SEQ ID NO: 1870943 - RNA, 13 nt, Salmonella typhimurium LT2
aacggaaccaaau

SEQ ID NO: 1870944 - RNA, 23 nt, Salmonella typhimurium LT2
aacggaauguuccccguugagaa

SEQ ID NO: 1870945 - RNA, 17 nt, Salmonella typhimurium LT2
aacgcuugacucugaag

SEQ ID NO: 1870946 - RNA, 14 nt, Salmonella typhimurium LT2
aacgcuugagcagg

SEQ ID NO: 1870947 - RNA, 15 nt, Salmonella typhimurium LT2
aacgcuuaaucccuu

SEQ ID NO: 1870948 - RNA, 22 nt, Salmonella typhimurium LT2
aacgcuguugccgcugcuggca

SEQ ID NO: 1870949 - RNA, 14 nt, Salmonella typhimurium LT2
aacgcucgcuuaau

SEQ ID NO: 1870950 - RNA, 18 nt, Salmonella typhimurium LT2
aacgcguucauccagcgc

SEQ ID NO: 1870951 - RNA, 23 nt, Salmonella typhimurium LT2
aacgcguuaucgggaugccagau

SEQ ID NO: 1870952 - RNA, 22 nt, Salmonella typhimurium LT2
aacgcuggccgcaaauccacug

SEQ ID NO: 1870953 - RNA, 20 nt, Salmonella typhimurium LT2
aacgcuggcuggguaaaauc

SEQ ID NO: 1870954 - RNA, 12 nt, Salmonella typhimurium LT2
aacgcuggucag

SEQ ID NO: 1870955 - RNA, 16 nt, Salmonella typhimurium LT2
aacgcugagucagaaa

SEQ ID NO: 1870956 - RNA, 13 nt, Salmonella typhimurium LT2
aacgcugauacug

SEQ ID NO: 1870957 - RNA, 22 nt, Salmonella typhimurium LT2
aacgcucuuaccgcuaaaauac

SEQ ID NO: 1870958 - RNA, 12 nt, Salmonella typhimurium LT2
aacgcggccugg

SEQ ID NO: 1870959 - RNA, 18 nt, Salmonella typhimurium LT2
aacgcgccaugcgcggca

SEQ ID NO: 1870960 - RNA, 13 nt, Salmonella typhimurium LT2
aacgcgccacgcg

SEQ ID NO: 1870961 - RNA, 12 nt, Salmonella typhimurium LT2
aacgcgccgagg

SEQ ID NO: 1870962 - RNA, 21 nt, Salmonella typhimurium LT2
aacgcgcgucgcuaaucagca

SEQ ID NO: 1870963 - RNA, 22 nt, Salmonella typhimurium LT2
aacgggacggcggccagcauuu

SEQ ID NO: 1870964 - RNA, 12 nt, Salmonella typhimurium LT2
aacggcucugca

SEQ ID NO: 1870965 - RNA, 18 nt, Salmonella typhimurium LT2
aacggcugacgcccauca

SEQ ID NO: 1870966 - RNA, 15 nt, Salmonella typhimurium LT2
aacggcgcuuuuaaa

SEQ ID NO: 1870967 - RNA, 20 nt, Salmonella typhimurium LT2
aacggcgcuuuuaaaauaaa

SEQ ID NO: 1870968 - RNA, 14 nt, Salmonella typhimurium LT2
aacggcauccauuu

SEQ ID NO: 1870969 - RNA, 19 nt, Salmonella typhimurium LT2
aacguagcccauugucauc

SEQ ID NO: 1870970 - RNA, 14 nt, Salmonella typhimurium LT2
aacguaaauaccca

SEQ ID NO: 1870971 - RNA, 14 nt, Salmonella typhimurium LT2
aacgguuuauaccg

SEQ ID NO: 1870972 - RNA, 14 nt, Salmonella typhimurium LT2
aacggggaaccagc

SEQ ID NO: 1870973 - RNA, 17 nt, Salmonella typhimurium LT2
aacguugguucggcgga

SEQ ID NO: 1870974 - RNA, 14 nt, Salmonella typhimurium LT2
aacguuugccagcg

SEQ ID NO: 1870975 - RNA, 18 nt, Salmonella typhimurium LT2
aacguuuguaacagcagg

SEQ ID NO: 1870976 - RNA, 20 nt, Salmonella typhimurium LT2
aacguugcuuauucagucug

SEQ ID NO: 1870977 - RNA, 15 nt, Salmonella typhimurium LT2
aacguuaccuuuaau

SEQ ID NO: 1870978 - RNA, 14 nt, Salmonella typhimurium LT2
aacgucuugccaug

SEQ ID NO: 1870979 - RNA, 12 nt, Salmonella typhimurium LT2
aacgucgucauu

SEQ ID NO: 1870980 - RNA, 19 nt, Salmonella typhimurium LT2
aacgucuuuuuccagcagc

SEQ ID NO: 1870981 - RNA, 20 nt, Salmonella typhimurium LT2
aacgugaaaaaucccccauu

SEQ ID NO: 1870982 - RNA, 23 nt, Salmonella typhimurium LT2
aacgucccgacgaauaacaaaau

SEQ ID NO: 1870983 - RNA, 19 nt, Salmonella typhimurium LT2
aacguccggugaucggcuu

SEQ ID NO: 1870984 - RNA, 22 nt, Salmonella typhimurium LT2
aacguccuaggacgaaaaauga

SEQ ID NO: 1870985 - RNA, 21 nt, Salmonella typhimurium LT2
aacguccucggacgaaaaaug

SEQ ID NO: 1870986 - RNA, 18 nt, Salmonella typhimurium LT2
aacgucaguggaaaacag

SEQ ID NO: 1870987 - RNA, 11 nt, Salmonella typhimurium LT2
aacgucaguac

SEQ ID NO: 1870988 - RNA, 14 nt, Salmonella typhimurium LT2
aacuagcaaaacau

SEQ ID NO: 1870989 - RNA, 20 nt, Salmonella typhimurium LT2
aacuagccauauaugaaauc

SEQ ID NO: 1870990 - RNA, 21 nt, Salmonella typhimurium LT2
aacuagcccuuaggaggggcu

SEQ ID NO: 1870991 - RNA, 17 nt, Salmonella typhimurium LT2
aacuauaggaaaauaau

SEQ ID NO: 1870992 - RNA, 18 nt, Salmonella typhimurium LT2
aacuauaggaaaauaaug

SEQ ID NO: 1870993 - RNA, 22 nt, Salmonella typhimurium LT2
aacuaauggcgcagcaguugca

SEQ ID NO: 1870994 - RNA, 12 nt, Salmonella typhimurium LT2
aacuaaggggac

SEQ ID NO: 1870995 - RNA, 14 nt, Salmonella typhimurium LT2
aacuaaagcgaauu

SEQ ID NO: 1870996 - RNA, 16 nt, Salmonella typhimurium LT2
aacucagcgccagcgc

SEQ ID NO: 1870997 - RNA, 15 nt, Salmonella typhimurium LT2
aacucacgcaacaac

SEQ ID NO: 1870998 - RNA, 24 nt, Salmonella typhimurium LT2
aacucagagagauccugagaaauc

SEQ ID NO: 1870999 - RNA, 13 nt, Salmonella typhimurium LT2
aacucagaggcgg

SEQ ID NO: 1871000 - RNA, 20 nt, Salmonella typhimurium LT2
aacucaucgcuuagcggcuc

SEQ ID NO: 1871001 - RNA, 13 nt, Salmonella typhimurium LT2
aacucaucacagc

SEQ ID NO: 1871002 - RNA, 14 nt, Salmonella typhimurium LT2
aacucaucgccagc

SEQ ID NO: 1871003 - RNA, 18 nt, Salmonella typhimurium LT2
aacucaucggaacaguaa

SEQ ID NO: 1871004 - RNA, 21 nt, Salmonella typhimurium LT2
aacuauugcugcccccggcgc

SEQ ID NO: 1871005 - RNA, 21 nt, Salmonella typhimurium LT2
aacuauaauugcuuuuuucca

SEQ ID NO: 1871006 - RNA, 14 nt, Salmonella typhimurium LT2
aacucacauauuca

SEQ ID NO: 1871007 - RNA, 14 nt, Salmonella typhimurium LT2
aacucugcucuuug

SEQ ID NO: 1871008 - RNA, 19 nt, Salmonella typhimurium LT2
aacucugcuuuuauuuuca

SEQ ID NO: 1871009 - RNA, 23 nt, Salmonella typhimurium LT2
aacucuuucagaccauaguccau

SEQ ID NO: 1871010 - RNA, 19 nt, Salmonella typhimurium LT2
aacucuuuugcagcaaaua

SEQ ID NO: 1871011 - RNA, 15 nt, Salmonella typhimurium LT2
aacucuauuaaaaua

SEQ ID NO: 1871012 - RNA, 16 nt, Salmonella typhimurium LT2
aacucuauuaaaauaa

SEQ ID NO: 1871013 - RNA, 19 nt, Salmonella typhimurium LT2
aacucuauaucgacaggcg

SEQ ID NO: 1871014 - RNA, 13 nt, Salmonella typhimurium LT2
aacucucccaacu

SEQ ID NO: 1871015 - RNA, 19 nt, Salmonella typhimurium LT2
aacuccccuguuugcauca

SEQ ID NO: 1871016 - RNA, 11 nt, Salmonella typhimurium LT2
aacuccagcac

SEQ ID NO: 1871017 - RNA, 21 nt, Salmonella typhimurium LT2
aacuccggacguacccaggcg

SEQ ID NO: 1871018 - RNA, 16 nt, Salmonella typhimurium LT2
aacucccggcggaaau

SEQ ID NO: 1871019 - RNA, 15 nt, Salmonella typhimurium LT2
aacuccucuuccgac

SEQ ID NO: 1871020 - RNA, 20 nt, Salmonella typhimurium LT2
aacucgugaagaucagcaga

SEQ ID NO: 1871021 - RNA, 15 nt, Salmonella typhimurium LT2
aacugcgccugcuca

SEQ ID NO: 1871022 - RNA, 17 nt, Salmonella typhimurium LT2
aacugcgaaaucaccga

SEQ ID NO: 1871023 - RNA, 16 nt, Salmonella typhimurium LT2
aacugcgccaaaucgg

SEQ ID NO: 1871024 - RNA, 17 nt, Salmonella typhimurium LT2
aacugcgcgccgcccug

SEQ ID NO: 1871025 - RNA, 21 nt, Salmonella typhimurium LT2
aacugcggaauuuuauccugg

SEQ ID NO: 1871026 - RNA, 18 nt, Salmonella typhimurium LT2
aacugcggcuuuuucacg

SEQ ID NO: 1871027 - RNA, 15 nt, Salmonella typhimurium LT2
aacugcugccgcagc

SEQ ID NO: 1871028 - RNA, 16 nt, Salmonella typhimurium LT2
aacugcucuaccaacu

SEQ ID NO: 1871029 - RNA, 22 nt, Salmonella typhimurium LT2
aacugcuggcgagcagaaaaag

SEQ ID NO: 1871030 - RNA, 18 nt, Salmonella typhimurium LT2
aacugcgguaaauaaugc

SEQ ID NO: 1871031 - RNA, 14 nt, Salmonella typhimurium LT2
aacugccaaaccac

SEQ ID NO: 1871032 - RNA, 18 nt, Salmonella typhimurium LT2
aacugauucaaaagguga

SEQ ID NO: 1871033 - RNA, 20 nt, Salmonella typhimurium LT2
aacugauggcgcuaagccag

SEQ ID NO: 1871034 - RNA, 15 nt, Salmonella typhimurium LT2
aacugagcgccaauu

SEQ ID NO: 1871035 - RNA, 21 nt, Salmonella typhimurium LT2
aacugaacccaucgccccgaa

SEQ ID NO: 1871036 - RNA, 23 nt, Salmonella typhimurium LT2
aacugacguuagucauauucagc

SEQ ID NO: 1871037 - RNA, 13 nt, Salmonella typhimurium LT2
aacugaauuucau

SEQ ID NO: 1871038 - RNA, 22 nt, Salmonella typhimurium LT2
aacugaauuucauccccggcgc

SEQ ID NO: 1871039 - RNA, 12 nt, Salmonella typhimurium LT2
aacuuaaauaaa

SEQ ID NO: 1871040 - RNA, 22 nt, Salmonella typhimurium LT2
aacuguguacgccaagcugcaa

SEQ ID NO: 1871041 - RNA, 23 nt, Salmonella typhimurium LT2
aacugggcuugcauugcuuuuag

SEQ ID NO: 1871042 - RNA, 17 nt, Salmonella typhimurium LT2
aacuggccacagcaaau

SEQ ID NO: 1871043 - RNA, 11 nt, Salmonella typhimurium LT2
aacuggcggcu

SEQ ID NO: 1871044 - RNA, 15 nt, Salmonella typhimurium LT2
aacuggcggcucagg

SEQ ID NO: 1871045 - RNA, 15 nt, Salmonella typhimurium LT2
aacugggugccauga

SEQ ID NO: 1871046 - RNA, 19 nt, Salmonella typhimurium LT2
aacuggcaagcgcuaagca

SEQ ID NO: 1871047 - RNA, 16 nt, Salmonella typhimurium LT2
aacuggauuccuggcu

SEQ ID NO: 1871048 - RNA, 14 nt, Salmonella typhimurium LT2
aacuggaaggcuuc

SEQ ID NO: 1871049 - RNA, 14 nt, Salmonella typhimurium LT2
aacuggacaacauu

SEQ ID NO: 1871050 - RNA, 12 nt, Salmonella typhimurium LT2
aacuggaaaaag

SEQ ID NO: 1871051 - RNA, 21 nt, Salmonella typhimurium LT2
aacugcuuaaggcaaacaagg

SEQ ID NO: 1871052 - RNA, 13 nt, Salmonella typhimurium LT2
aacuucugcaggg

SEQ ID NO: 1871053 - RNA, 13 nt, Salmonella typhimurium LT2
aacuucgauaaua

SEQ ID NO: 1871054 - RNA, 19 nt, Salmonella typhimurium LT2
aacuucgauaauaaaauau

SEQ ID NO: 1871055 - RNA, 13 nt, Salmonella typhimurium LT2
aacuuccuuugcc

SEQ ID NO: 1871056 - RNA, 11 nt, Salmonella typhimurium LT2
aacuucaccag

SEQ ID NO: 1871057 - RNA, 20 nt, Salmonella typhimurium LT2
aacuuaucauuuuuucuaag

SEQ ID NO: 1871058 - RNA, 22 nt, Salmonella typhimurium LT2
aacuuaucauuuuuucuaagau

SEQ ID NO: 1871059 - RNA, 15 nt, Salmonella typhimurium LT2
aacuuucagaauaau

SEQ ID NO: 1871060 - RNA, 11 nt, Salmonella typhimurium LT2
aacuuuccaac

SEQ ID NO: 1871061 - RNA, 22 nt, Salmonella typhimurium LT2
aacuuucgggcaaacugaacug

SEQ ID NO: 1871062 - RNA, 15 nt, Salmonella typhimurium LT2
aacuuuacuuaguau

SEQ ID NO: 1871063 - RNA, 18 nt, Salmonella typhimurium LT2
aacuuuuggugcccaucg

SEQ ID NO: 1871064 - RNA, 13 nt, Salmonella typhimurium LT2
aacuuguaaaaau

SEQ ID NO: 1871065 - RNA, 18 nt, Salmonella typhimurium LT2
aagaacacaggcagccag

SEQ ID NO: 1871066 - RNA, 17 nt, Salmonella typhimurium LT2
aagaaauugggcuucca

SEQ ID NO: 1871067 - RNA, 20 nt, Salmonella typhimurium LT2
aagaacgccgcaaacgccga

SEQ ID NO: 1871068 - RNA, 15 nt, Salmonella typhimurium LT2
aagaacguguuuuuc

SEQ ID NO: 1871069 - RNA, 19 nt, Salmonella typhimurium LT2
aagaagcgcacuuuccaua

SEQ ID NO: 1871070 - RNA, 16 nt, Salmonella typhimurium LT2
aagaagaaaccgcaga

SEQ ID NO: 1871071 - RNA, 22 nt, Salmonella typhimurium LT2
aagaacugcaaauaccacauca

SEQ ID NO: 1871072 - RNA, 18 nt, Salmonella typhimurium LT2
aagaagaggaugcuccgc

SEQ ID NO: 1871073 - RNA, 18 nt, Salmonella typhimurium LT2
aagaaaccgcagaaaaag

SEQ ID NO: 1871074 - RNA, 11 nt, Salmonella typhimurium LT2
aagaaauccca

SEQ ID NO: 1871075 - RNA, 13 nt, Salmonella typhimurium LT2
aaauugcugaugu

SEQ ID NO: 1871076 - RNA, 18 nt, Salmonella typhimurium LT2
aaauugguuauauuacug

SEQ ID NO: 1871077 - RNA, 14 nt, Salmonella typhimurium LT2
aaauuuaauauaug

SEQ ID NO: 1871078 - RNA, 22 nt, Salmonella typhimurium LT2
aaauuguugcugcguuucauuc

SEQ ID NO: 1871079 - RNA, 20 nt, Salmonella typhimurium LT2
aaauuuccgcagccagaauc

SEQ ID NO: 1871080 - RNA, 17 nt, Salmonella typhimurium LT2
aaauuucaguauuacua

SEQ ID NO: 1871081 - RNA, 19 nt, Salmonella typhimurium LT2
aaauuuccuccgccgauaa

SEQ ID NO: 1871082 - RNA, 22 nt, Salmonella typhimurium LT2
aaauuucaacccgaucgccauc

SEQ ID NO: 1871083 - RNA, 23 nt, Salmonella typhimurium LT2
aaauuucacgucacguucauccu

SEQ ID NO: 1871084 - RNA, 16 nt, Salmonella typhimurium LT2
aaauuugcagcgcugu

SEQ ID NO: 1871085 - RNA, 21 nt, Salmonella typhimurium LT2
aaauuugcugccaucgcacag

SEQ ID NO: 1871086 - RNA, 16 nt, Salmonella typhimurium LT2
aaauuuguuuaaucau

SEQ ID NO: 1871087 - RNA, 22 nt, Salmonella typhimurium LT2
aaauuuguuuaaucauaaaacc

SEQ ID NO: 1871088 - RNA, 22 nt, Salmonella typhimurium LT2
aaauuuucaauacgucauauca

SEQ ID NO: 1871089 - RNA, 12 nt, Salmonella typhimurium LT2
aaauuuucauua

SEQ ID NO: 1871090 - RNA, 14 nt, Salmonella typhimurium LT2
aacaacggcacaca

SEQ ID NO: 1871091 - RNA, 16 nt, Salmonella typhimurium LT2
aacaacaucugugaaa

SEQ ID NO: 1871092 - RNA, 16 nt, Salmonella typhimurium LT2
aacaacucuauuaaaa

SEQ ID NO: 1871093 - RNA, 18 nt, Salmonella typhimurium LT2
aacaacucuauuaaaaua

SEQ ID NO: 1871094 - RNA, 17 nt, Salmonella typhimurium LT2
aacaagcugauuuuucg

SEQ ID NO: 1871095 - RNA, 15 nt, Salmonella typhimurium LT2
aacaagcaaaccuau

SEQ ID NO: 1871096 - RNA, 17 nt, Salmonella typhimurium LT2
aacaagacgucucuuuc

SEQ ID NO: 1871097 - RNA, 19 nt, Salmonella typhimurium LT2
aacaaggcgcuaccaggau

SEQ ID NO: 1871098 - RNA, 16 nt, Salmonella typhimurium LT2
aacaauaaaguuauac

SEQ ID NO: 1871099 - RNA, 22 nt, Salmonella typhimurium LT2
aacaaaaagauauuauaaaaua

SEQ ID NO: 1871100 - RNA, 16 nt, Salmonella typhimurium LT2
aacaaaacggaauguu

SEQ ID NO: 1871101 - RNA, 19 nt, Salmonella typhimurium LT2
aacaaaccgauaaucacca

SEQ ID NO: 1871102 - RNA, 14 nt, Salmonella typhimurium LT2
aacaaaccaaacug

SEQ ID NO: 1871103 - RNA, 15 nt, Salmonella typhimurium LT2
aacaaacuccagcac

SEQ ID NO: 1871104 - RNA, 11 nt, Salmonella typhimurium LT2
aacaaaugaag

SEQ ID NO: 1871105 - RNA, 11 nt, Salmonella typhimurium LT2
aacaauuauau

SEQ ID NO: 1871106 - RNA, 17 nt, Salmonella typhimurium LT2
aacaaugggauaaaaug

SEQ ID NO: 1871107 - RNA, 22 nt, Salmonella typhimurium LT2
aacaauugugaugcauuuuguc

SEQ ID NO: 1871108 - RNA, 15 nt, Salmonella typhimurium LT2
aacaauuuacgcagc

SEQ ID NO: 1871109 - RNA, 17 nt, Salmonella typhimurium LT2
aacaauuugcccagcgc

SEQ ID NO: 1871110 - RNA, 21 nt, Salmonella typhimurium LT2
aacaauuucuacugauuuaac

SEQ ID NO: 1871111 - RNA, 19 nt, Salmonella typhimurium LT2
aacacacgcuuagcuugcc

SEQ ID NO: 1871112 - RNA, 18 nt, Salmonella typhimurium LT2
aacacacccuucucaggg

SEQ ID NO: 1871113 - RNA, 18 nt, Salmonella typhimurium LT2
aacacacaguugccuucg

SEQ ID NO: 1871114 - RNA, 17 nt, Salmonella typhimurium LT2
aacacacaguugccuuc

SEQ ID NO: 1871115 - RNA, 14 nt, Salmonella typhimurium LT2
aacacaaucacacc

SEQ ID NO: 1871116 - RNA, 15 nt, Salmonella typhimurium LT2
aacaaugccauuuuu

SEQ ID NO: 1871117 - RNA, 19 nt, Salmonella typhimurium LT2
aacaaucgccccaggccac

SEQ ID NO: 1871118 - RNA, 16 nt, Salmonella typhimurium LT2
aacaccuuauccggcc

SEQ ID NO: 1871119 - RNA, 20 nt, Salmonella typhimurium LT2
aacaccugcaucacgcccgg

SEQ ID NO: 1871120 - RNA, 16 nt, Salmonella typhimurium LT2
aacacacuuucugcuu

SEQ ID NO: 1871121 - RNA, 12 nt, Salmonella typhimurium LT2
aacacauccagc

SEQ ID NO: 1871122 - RNA, 19 nt, Salmonella typhimurium LT2
aacaccacaaagucgccuu

SEQ ID NO: 1871123 - RNA, 11 nt, Salmonella typhimurium LT2
aacaccagcac

SEQ ID NO: 1871124 - RNA, 19 nt, Salmonella typhimurium LT2
aacaccagggauuuugcuu

SEQ ID NO: 1871125 - RNA, 23 nt, Salmonella typhimurium LT2
aacaccagggauuuugcuuuuuc

SEQ ID NO: 1871126 - RNA, 17 nt, Salmonella typhimurium LT2
aacaccagcgauccaga

SEQ ID NO: 1871127 - RNA, 22 nt, Salmonella typhimurium LT2
aacagacaauuagcgacgcaua

SEQ ID NO: 1871128 - RNA, 17 nt, Salmonella typhimurium LT2
aacagaaaaaaugcacc

SEQ ID NO: 1871129 - RNA, 13 nt, Salmonella typhimurium LT2
aacagaguaaccc

SEQ ID NO: 1871130 - RNA, 11 nt, Salmonella typhimurium LT2
aacagaauaag

SEQ ID NO: 1871131 - RNA, 17 nt, Salmonella typhimurium LT2
aacagacgccuuucaga

SEQ ID NO: 1871132 - RNA, 12 nt, Salmonella typhimurium LT2
aacagagcaauu

SEQ ID NO: 1871133 - RNA, 13 nt, Salmonella typhimurium LT2
aacagauacugga

SEQ ID NO: 1871134 - RNA, 20 nt, Salmonella typhimurium LT2
aacagauaagcgucugcaau

SEQ ID NO: 1871135 - RNA, 18 nt, Salmonella typhimurium LT2
aacacgauggcaaauaau

SEQ ID NO: 1871136 - RNA, 13 nt, Salmonella typhimurium LT2
aacacgauuuuug

SEQ ID NO: 1871137 - RNA, 16 nt, Salmonella typhimurium LT2
aacacgacgcugccac

SEQ ID NO: 1871138 - RNA, 21 nt, Salmonella typhimurium LT2
aacacgccguugauaauaaau

SEQ ID NO: 1871139 - RNA, 21 nt, Salmonella typhimurium LT2
aacacgccgccuaucgccagc

SEQ ID NO: 1871140 - RNA, 20 nt, Salmonella typhimurium LT2
aacacgccuggcgcuuuaaa

SEQ ID NO: 1871141 - RNA, 14 nt, Salmonella typhimurium LT2
aacacggcugucgg

SEQ ID NO: 1871142 - RNA, 22 nt, Salmonella typhimurium LT2
aacagcauugaggcuacccaga

SEQ ID NO: 1871143 - RNA, 14 nt, Salmonella typhimurium LT2
aacagccagcgagc

SEQ ID NO: 1871144 - RNA, 14 nt, Salmonella typhimurium LT2
aacagcaccagcag

SEQ ID NO: 1871145 - RNA, 14 nt, Salmonella typhimurium LT2
aacagcaauguuuc

SEQ ID NO: 1871146 - RNA, 20 nt, Salmonella typhimurium LT2
aacagcacguuauucuccag

SEQ ID NO: 1871147 - RNA, 12 nt, Salmonella typhimurium LT2
aacagcaggacc

SEQ ID NO: 1871148 - RNA, 13 nt, Salmonella typhimurium LT2
aacagcaggaccc

SEQ ID NO: 1871149 - RNA, 12 nt, Salmonella typhimurium LT2
aacagcgcucca

SEQ ID NO: 1871150 - RNA, 19 nt, Salmonella typhimurium LT2
aacagcgcuaucaggaaga

SEQ ID NO: 1871151 - RNA, 13 nt, Salmonella typhimurium LT2
aacagccauaaug

SEQ ID NO: 1871152 - RNA, 14 nt, Salmonella typhimurium LT2
aacagcuugaucau

SEQ ID NO: 1871153 - RNA, 23 nt, Salmonella typhimurium LT2
aacaggcugcguaacgcgccgga

SEQ ID NO: 1871154 - RNA, 19 nt, Salmonella typhimurium LT2
aacaggcuuuucaggcugu

SEQ ID NO: 1871155 - RNA, 14 nt, Salmonella typhimurium LT2
aacaggccgcgaaa

SEQ ID NO: 1871156 - RNA, 13 nt, Salmonella typhimurium LT2
aacaggcgaaaac

SEQ ID NO: 1871157 - RNA, 19 nt, Salmonella typhimurium LT2
aacaggcgcaggcauuaaa

SEQ ID NO: 1871158 - RNA, 23 nt, Salmonella typhimurium LT2
aacaggcgcaggcauuaaaaaaa

SEQ ID NO: 1871159 - RNA, 20 nt, Salmonella typhimurium LT2
aacaggccaaacccugcgcc

SEQ ID NO: 1871160 - RNA, 15 nt, Salmonella typhimurium LT2
aacaguaccugauaa

SEQ ID NO: 1871161 - RNA, 20 nt, Salmonella typhimurium LT2
aacagggcggccuccuggcu

SEQ ID NO: 1871162 - RNA, 18 nt, Salmonella typhimurium LT2
aacaggguuucucgggag

SEQ ID NO: 1871163 - RNA, 18 nt, Salmonella typhimurium LT2
aacagggggcgcaucacu

SEQ ID NO: 1871164 - RNA, 18 nt, Salmonella typhimurium LT2
aacagggugacucauuuc

SEQ ID NO: 1871165 - RNA, 13 nt, Salmonella typhimurium LT2
aacaguucagaca

SEQ ID NO: 1871166 - RNA, 21 nt, Salmonella typhimurium LT2
aacaguguaaacgccagauaa

SEQ ID NO: 1871167 - RNA, 23 nt, Salmonella typhimurium LT2
aacagugauuacaaaaugugcaa

SEQ ID NO: 1871168 - RNA, 22 nt, Salmonella typhimurium LT2
aacagucgcgccgugcccagca

SEQ ID NO: 1871169 - RNA, 22 nt, Salmonella typhimurium LT2
aacaucauucccguaucuucau

SEQ ID NO: 1871170 - RNA, 19 nt, Salmonella typhimurium LT2
aacaucagaaaaaagccaa

SEQ ID NO: 1871171 - RNA, 23 nt, Salmonella typhimurium LT2
aacaucagcccuaucgcugcgcu

SEQ ID NO: 1871172 - RNA, 11 nt, Salmonella typhimurium LT2
aacaucagccg

SEQ ID NO: 1871173 - RNA, 14 nt, Salmonella typhimurium LT2
aacaucagcgcuac

SEQ ID NO: 1871174 - RNA, 20 nt, Salmonella typhimurium LT2
aacaucagcgcuaccagcgc

SEQ ID NO: 1871175 - RNA, 16 nt, Salmonella typhimurium LT2
aacaucaccuuucauu

SEQ ID NO: 1871176 - RNA, 13 nt, Salmonella typhimurium LT2
aacauauuuuuau

SEQ ID NO: 1871177 - RNA, 12 nt, Salmonella typhimurium LT2
aacauauuuuua

SEQ ID NO: 1871178 - RNA, 18 nt, Salmonella typhimurium LT2
aacauauggcccauuacu

SEQ ID NO: 1871179 - RNA, 17 nt, Salmonella typhimurium LT2
aacauaugggcaaaaac

SEQ ID NO: 1871180 - RNA, 17 nt, Salmonella typhimurium LT2
aacauaucuccucugcc

SEQ ID NO: 1871181 - RNA, 20 nt, Salmonella typhimurium LT2
aacauaucuccucugccaug

SEQ ID NO: 1871182 - RNA, 21 nt, Salmonella typhimurium LT2
aacauaucuccucugccauga

SEQ ID NO: 1871183 - RNA, 18 nt, Salmonella typhimurium LT2
aacauauccgcgcaaagg

SEQ ID NO: 1871184 - RNA, 22 nt, Salmonella typhimurium LT2
aacauagcuaaauuaaaaauaa

SEQ ID NO: 1871185 - RNA, 18 nt, Salmonella typhimurium LT2
aacauagcggcaaggaaa

SEQ ID NO: 1871186 - RNA, 13 nt, Salmonella typhimurium LT2
aacauaauaaagc

SEQ ID NO: 1871187 - RNA, 22 nt, Salmonella typhimurium LT2
aacauuccgcccaggaacauga

SEQ ID NO: 1871188 - RNA, 19 nt, Salmonella typhimurium LT2
aacauuauggcgugaugcu

SEQ ID NO: 1871189 - RNA, 19 nt, Salmonella typhimurium LT2
aacauugguuaucaaaaac

SEQ ID NO: 1871190 - RNA, 18 nt, Salmonella typhimurium LT2
aacauuuuuguaauacag

SEQ ID NO: 1871191 - RNA, 12 nt, Salmonella typhimurium LT2
aaccaaugcagc

SEQ ID NO: 1871192 - RNA, 16 nt, Salmonella typhimurium LT2
aaccaacgacccccac

SEQ ID NO: 1871193 - RNA, 16 nt, Salmonella typhimurium LT2
aacauggggagcagca

SEQ ID NO: 1871194 - RNA, 20 nt, Salmonella typhimurium LT2
aacauggguuugacccauuu

SEQ ID NO: 1871195 - RNA, 23 nt, Salmonella typhimurium LT2
aacaugcccaccggaccuaauaa

SEQ ID NO: 1871196 - RNA, 14 nt, Salmonella typhimurium LT2
aacaugcuggauga

SEQ ID NO: 1871197 - RNA, 19 nt, Salmonella typhimurium LT2
aacauuacaauguacagaa

SEQ ID NO: 1871198 - RNA, 16 nt, Salmonella typhimurium LT2
aacaucguaaaucaaa

SEQ ID NO: 1871199 - RNA, 16 nt, Salmonella typhimurium LT2
aacaucgagcuuugac

SEQ ID NO: 1871200 - RNA, 16 nt, Salmonella typhimurium LT2
aacaugaaauggcaug

SEQ ID NO: 1871201 - RNA, 14 nt, Salmonella typhimurium LT2
aacaugaccagcgc

SEQ ID NO: 1871202 - RNA, 16 nt, Salmonella typhimurium LT2
aacaugaccagcgcaa

SEQ ID NO: 1871203 - RNA, 11 nt, Salmonella typhimurium LT2
aacaucuguga

SEQ ID NO: 1871204 - RNA, 12 nt, Salmonella typhimurium LT2
aacaucugugaa

SEQ ID NO: 1871205 - RNA, 16 nt, Salmonella typhimurium LT2
aacaucugugaaaacg

SEQ ID NO: 1871206 - RNA, 13 nt, Salmonella typhimurium LT2
aacccgccacagg

SEQ ID NO: 1871207 - RNA, 13 nt, Salmonella typhimurium LT2
aacccguccggca

SEQ ID NO: 1871208 - RNA, 22 nt, Salmonella typhimurium LT2
aacccggugaaaaacaucggca

SEQ ID NO: 1871209 - RNA, 17 nt, Salmonella typhimurium LT2
aacccggcuaaaugacg

SEQ ID NO: 1871210 - RNA, 23 nt, Salmonella typhimurium LT2
aacccauggcuuacgguuguuuc

SEQ ID NO: 1871211 - RNA, 15 nt, Salmonella typhimurium LT2
aaccccaucccggca

SEQ ID NO: 1871212 - RNA, 23 nt, Salmonella typhimurium LT2
aacccgaucgccauccugcaccg

SEQ ID NO: 1871213 - RNA, 21 nt, Salmonella typhimurium LT2
aaccccuguucaaaagccugu

SEQ ID NO: 1871214 - RNA, 23 nt, Salmonella typhimurium LT2
aaccgacugucgaaaccagcaua

SEQ ID NO: 1871215 - RNA, 16 nt, Salmonella typhimurium LT2
aaccgacccaaaaaug

SEQ ID NO: 1871216 - RNA, 13 nt, Salmonella typhimurium LT2
aaccgaccgcgau

SEQ ID NO: 1871217 - RNA, 16 nt, Salmonella typhimurium LT2
aaccgaacaacgccag

SEQ ID NO: 1871218 - RNA, 19 nt, Salmonella typhimurium LT2
aaccgcgccaaagauaaga

SEQ ID NO: 1871219 - RNA, 16 nt, Salmonella typhimurium LT2
aaccgcgauaaaccug

SEQ ID NO: 1871220 - RNA, 22 nt, Salmonella typhimurium LT2
aaccgccugcacugguagaaaa

SEQ ID NO: 1871221 - RNA, 16 nt, Salmonella typhimurium LT2
aaccgccguuuugauu

SEQ ID NO: 1871222 - RNA, 15 nt, Salmonella typhimurium LT2
aaccgccgcccauca

SEQ ID NO: 1871223 - RNA, 17 nt, Salmonella typhimurium LT2
aaccgccgcgauagacc

SEQ ID NO: 1871224 - RNA, 14 nt, Salmonella typhimurium LT2
aaccgcgcguaaau

SEQ ID NO: 1871225 - RNA, 19 nt, Salmonella typhimurium LT2
aaccgcgcuggaaagcggc

SEQ ID NO: 1871226 - RNA, 14 nt, Salmonella typhimurium LT2
aaccgcugaccauc

SEQ ID NO: 1871227 - RNA, 19 nt, Salmonella typhimurium LT2
aaccgcagaaaaagccccc

SEQ ID NO: 1871228 - RNA, 14 nt, Salmonella typhimurium LT2
aaccgccagaugau

SEQ ID NO: 1871229 - RNA, 13 nt, Salmonella typhimurium LT2
aaccgccagcagc

SEQ ID NO: 1871230 - RNA, 17 nt, Salmonella typhimurium LT2
aaccgcagaaaaagccc

SEQ ID NO: 1871231 - RNA, 21 nt, Salmonella typhimurium LT2
aaccggcgcgccuuccagcaa

SEQ ID NO: 1871232 - RNA, 23 nt, Salmonella typhimurium LT2
aaccggcgauguuggcgcccuga

SEQ ID NO: 1871233 - RNA, 23 nt, Salmonella typhimurium LT2
aaccggcaacucgccgguuuuuu

SEQ ID NO: 1871234 - RNA, 15 nt, Salmonella typhimurium LT2
aaccggcaugaagac

SEQ ID NO: 1871235 - RNA, 18 nt, Salmonella typhimurium LT2
aaccggcaacucgccggu

SEQ ID NO: 1871236 - RNA, 20 nt, Salmonella typhimurium LT2
aaccggaccagcacaaaaaa

SEQ ID NO: 1871237 - RNA, 17 nt, Salmonella typhimurium LT2
aaccggaacggacgugc

SEQ ID NO: 1871238 - RNA, 20 nt, Salmonella typhimurium LT2
aaccggucaggcagcagacc

SEQ ID NO: 1871239 - RNA, 23 nt, Salmonella typhimurium LT2
aaccggguugcggaagcuuuuag

SEQ ID NO: 1871240 - RNA, 13 nt, Salmonella typhimurium LT2
aaccggguuuuuc

SEQ ID NO: 1871241 - RNA, 22 nt, Salmonella typhimurium LT2
aaccguaucacuguaaaaggga

SEQ ID NO: 1871242 - RNA, 22 nt, Salmonella typhimurium LT2
aaccgguuugucauucgccuca

SEQ ID NO: 1871243 - RNA, 22 nt, Salmonella typhimurium LT2
aaccgguggucaucgcggccag

SEQ ID NO: 1871244 - RNA, 14 nt, Salmonella typhimurium LT2
aaccaggcauuuuc

SEQ ID NO: 1871245 - RNA, 12 nt, Salmonella typhimurium LT2
aaccaggccaga

SEQ ID NO: 1871246 - RNA, 11 nt, Salmonella typhimurium LT2
aaccaggcaac

SEQ ID NO: 1871247 - RNA, 14 nt, Salmonella typhimurium LT2
aaccaggcgaaaau

SEQ ID NO: 1871248 - RNA, 17 nt, Salmonella typhimurium LT2
aaccagcgcggccagaa

SEQ ID NO: 1871249 - RNA, 15 nt, Salmonella typhimurium LT2
aaccagcuauccagc

SEQ ID NO: 1871250 - RNA, 22 nt, Salmonella typhimurium LT2
aaccagauaccccgccaaaccg

SEQ ID NO: 1871251 - RNA, 15 nt, Salmonella typhimurium LT2
aaccagcaguccugc

SEQ ID NO: 1871252 - RNA, 11 nt, Salmonella typhimurium LT2
aaccagcgaaa

SEQ ID NO: 1871253 - RNA, 23 nt, Salmonella typhimurium LT2
aaccagacgguuuauccccgcug

SEQ ID NO: 1871254 - RNA, 15 nt, Salmonella typhimurium LT2
aaccagacccgcugc

SEQ ID NO: 1871255 - RNA, 14 nt, Salmonella typhimurium LT2
aaccagaauuuguu

SEQ ID NO: 1871256 - RNA, 15 nt, Salmonella typhimurium LT2
aaccacaaguuuauc

SEQ ID NO: 1871257 - RNA, 21 nt, Salmonella typhimurium LT2
aaccaccggcgcgccagcgca

SEQ ID NO: 1871258 - RNA, 20 nt, Salmonella typhimurium LT2
aaccaccauacccaacagca

SEQ ID NO: 1871259 - RNA, 14 nt, Salmonella typhimurium LT2
aaccacgauaaaga

SEQ ID NO: 1871260 - RNA, 20 nt, Salmonella typhimurium LT2
aaccacggagagacaguuca

SEQ ID NO: 1871261 - RNA, 14 nt, Salmonella typhimurium LT2
aaccauaauaaaua

SEQ ID NO: 1871262 - RNA, 14 nt, Salmonella typhimurium LT2
aaccauaauaaugc

SEQ ID NO: 1871263 - RNA, 16 nt, Salmonella typhimurium LT2
aaccauaauaaugcca

SEQ ID NO: 1871264 - RNA, 18 nt, Salmonella typhimurium LT2
aaccauaauaaugccaaa

SEQ ID NO: 1871265 - RNA, 17 nt, Salmonella typhimurium LT2
aaccaucaguucagggc

SEQ ID NO: 1871266 - RNA, 12 nt, Salmonella typhimurium LT2
aaccauccauuc

SEQ ID NO: 1871267 - RNA, 16 nt, Salmonella typhimurium LT2
aaccaucgacccccac

SEQ ID NO: 1871268 - RNA, 18 nt, Salmonella typhimurium LT2
aaccaugauaucgccaau

SEQ ID NO: 1871269 - RNA, 21 nt, Salmonella typhimurium LT2
aaccauucccguaaaagaaga

SEQ ID NO: 1871270 - RNA, 16 nt, Salmonella typhimurium LT2
aacccaaauaaccaga

SEQ ID NO: 1871271 - RNA, 14 nt, Salmonella typhimurium LT2
aacccaaauccgca

SEQ ID NO: 1871272 - RNA, 17 nt, Salmonella typhimurium LT2
aaccauuugccugccgc

SEQ ID NO: 1871273 - RNA, 19 nt, Salmonella typhimurium LT2
aacccauauucgucuucau

SEQ ID NO: 1871274 - RNA, 14 nt, Salmonella typhimurium LT2
aacccaccagcagg

SEQ ID NO: 1871275 - RNA, 14 nt, Salmonella typhimurium LT2
accgcgcggcguuc

SEQ ID NO: 1871276 - RNA, 19 nt, Salmonella typhimurium LT2
accgcgcggcguucugcgc

SEQ ID NO: 1871277 - RNA, 19 nt, Salmonella typhimurium LT2
accgcgccggucgccagca

SEQ ID NO: 1871278 - RNA, 15 nt, Salmonella typhimurium LT2
accgcgcuccuggaa

SEQ ID NO: 1871279 - RNA, 18 nt, Salmonella typhimurium LT2
accgcggcaaccagccca

SEQ ID NO: 1871280 - RNA, 14 nt, Salmonella typhimurium LT2
accgcugaccauca

SEQ ID NO: 1871281 - RNA, 23 nt, Salmonella typhimurium LT2
accgccuucgcauauuguaccug

SEQ ID NO: 1871282 - RNA, 18 nt, Salmonella typhimurium LT2
accgccuucagcgcgccc

SEQ ID NO: 1871283 - RNA, 21 nt, Salmonella typhimurium LT2
accgccucgaccccuucgccu

SEQ ID NO: 1871284 - RNA, 20 nt, Salmonella typhimurium LT2
accgccuacacaaaaucauu

SEQ ID NO: 1871285 - RNA, 14 nt, Salmonella typhimurium LT2
accgccuccaggcc

SEQ ID NO: 1871286 - RNA, 22 nt, Salmonella typhimurium LT2
accccgcgccguucggaguuga

SEQ ID NO: 1871287 - RNA, 20 nt, Salmonella typhimurium LT2
accccgcaucgcccgccccc

SEQ ID NO: 1871288 - RNA, 19 nt, Salmonella typhimurium LT2
accccgccaucagacaggc

SEQ ID NO: 1871289 - RNA, 21 nt, Salmonella typhimurium LT2
accccgcagcgaaaauccagu

SEQ ID NO: 1871290 - RNA, 22 nt, Salmonella typhimurium LT2
accccugauaaugugagauucg

SEQ ID NO: 1871291 - RNA, 22 nt, Salmonella typhimurium LT2
accgaugcaaccgcucuccgca

SEQ ID NO: 1871292 - RNA, 16 nt, Salmonella typhimurium LT2
accgaugacaauaauc

SEQ ID NO: 1871293 - RNA, 15 nt, Salmonella typhimurium LT2
accgccagucccagc

SEQ ID NO: 1871294 - RNA, 16 nt, Salmonella typhimurium LT2
accgccauccggcauu

SEQ ID NO: 1871295 - RNA, 13 nt, Salmonella typhimurium LT2
accgcauuuucag

SEQ ID NO: 1871296 - RNA, 22 nt, Salmonella typhimurium LT2
accgcauuuucucgcgcagcca

SEQ ID NO: 1871297 - RNA, 14 nt, Salmonella typhimurium LT2
accgccaagcgcgg

SEQ ID NO: 1871298 - RNA, 18 nt, Salmonella typhimurium LT2
accgauguuggcgacaga

SEQ ID NO: 1871299 - RNA, 16 nt, Salmonella typhimurium LT2
accgcacaucacugcc

SEQ ID NO: 1871300 - RNA, 20 nt, Salmonella typhimurium LT2
accggauuggucugauucag

SEQ ID NO: 1871301 - RNA, 20 nt, Salmonella typhimurium LT2
accggcaaccaacgcccaac

SEQ ID NO: 1871302 - RNA, 13 nt, Salmonella typhimurium LT2
accggcacccagu

SEQ ID NO: 1871303 - RNA, 16 nt, Salmonella typhimurium LT2
accggcaucucaucuu

SEQ ID NO: 1871304 - RNA, 14 nt, Salmonella typhimurium LT2
accggcaucggcag

SEQ ID NO: 1871305 - RNA, 21 nt, Salmonella typhimurium LT2
accggcauacacgccgggcac

SEQ ID NO: 1871306 - RNA, 15 nt, Salmonella typhimurium LT2
accggcgucaucauu

SEQ ID NO: 1871307 - RNA, 16 nt, Salmonella typhimurium LT2
accggcguaauugcgc

SEQ ID NO: 1871308 - RNA, 19 nt, Salmonella typhimurium LT2
accggcguaauugcgccug

SEQ ID NO: 1871309 - RNA, 18 nt, Salmonella typhimurium LT2
accggcuaucagccgcca

SEQ ID NO: 1871310 - RNA, 17 nt, Salmonella typhimurium LT2
accggcgauguuggcgc

SEQ ID NO: 1871311 - RNA, 14 nt, Salmonella typhimurium LT2
accggcgcgcgcca

SEQ ID NO: 1871312 - RNA, 18 nt, Salmonella typhimurium LT2
accggccauugccgcgcc

SEQ ID NO: 1871313 - RNA, 21 nt, Salmonella typhimurium LT2
accgggagauuuccggcacca

SEQ ID NO: 1871314 - RNA, 20 nt, Salmonella typhimurium LT2
accgggcgaaagcacuucuc

SEQ ID NO: 1871315 - RNA, 14 nt, Salmonella typhimurium LT2
accggggcguucau

SEQ ID NO: 1871316 - RNA, 13 nt, Salmonella typhimurium LT2
accgggcuuuaau

SEQ ID NO: 1871317 - RNA, 12 nt, Salmonella typhimurium LT2
accgggcuaaac

SEQ ID NO: 1871318 - RNA, 22 nt, Salmonella typhimurium LT2
accgggcgcaaucaucaccacc

SEQ ID NO: 1871319 - RNA, 15 nt, Salmonella typhimurium LT2
accgguacucuucca

SEQ ID NO: 1871320 - RNA, 14 nt, Salmonella typhimurium LT2
accgguaugaaacg

SEQ ID NO: 1871321 - RNA, 14 nt, Salmonella typhimurium LT2
accggugcgcccca

SEQ ID NO: 1871322 - RNA, 15 nt, Salmonella typhimurium LT2
accggugcgccccag

SEQ ID NO: 1871323 - RNA, 16 nt, Salmonella typhimurium LT2
accggugcgccccagc

SEQ ID NO: 1871324 - RNA, 17 nt, Salmonella typhimurium LT2
accgguuuuuuccugca

SEQ ID NO: 1871325 - RNA, 19 nt, Salmonella typhimurium LT2
accgguuugucauucgccu

SEQ ID NO: 1871326 - RNA, 18 nt, Salmonella typhimurium LT2
accguaaacgccugcacc

SEQ ID NO: 1871327 - RNA, 19 nt, Salmonella typhimurium LT2
accguaaacgccugcacca

SEQ ID NO: 1871328 - RNA, 23 nt, Salmonella typhimurium LT2
accguaagcuuucugaauuucac

SEQ ID NO: 1871329 - RNA, 13 nt, Salmonella typhimurium LT2
accgucuugcugc

SEQ ID NO: 1871330 - RNA, 18 nt, Salmonella typhimurium LT2
accgucgcgcccuccucc

SEQ ID NO: 1871331 - RNA, 21 nt, Salmonella typhimurium LT2
accgucgcgcccuccuccagc

SEQ ID NO: 1871332 - RNA, 16 nt, Salmonella typhimurium LT2
accgucuccaugucac

SEQ ID NO: 1871333 - RNA, 14 nt, Salmonella typhimurium LT2
accgugcacgcugc

SEQ ID NO: 1871334 - RNA, 14 nt, Salmonella typhimurium LT2
accguauccgccac

SEQ ID NO: 1871335 - RNA, 21 nt, Salmonella typhimurium LT2
accguaucgcccagcuuaugc

SEQ ID NO: 1871336 - RNA, 18 nt, Salmonella typhimurium LT2
accguauuagcaaaucuu

SEQ ID NO: 1871337 - RNA, 21 nt, Salmonella typhimurium LT2
accgucaaaacgcccauccug

SEQ ID NO: 1871338 - RNA, 18 nt, Salmonella typhimurium LT2
accguauugccagaucug

SEQ ID NO: 1871339 - RNA, 17 nt, Salmonella typhimurium LT2
accguccaccagcacag

SEQ ID NO: 1871340 - RNA, 13 nt, Salmonella typhimurium LT2
accguccacaucc

SEQ ID NO: 1871341 - RNA, 13 nt, Salmonella typhimurium LT2
accgucgcccguc

SEQ ID NO: 1871342 - RNA, 23 nt, Salmonella typhimurium LT2
accguccgcucacgauaaugaac

SEQ ID NO: 1871343 - RNA, 15 nt, Salmonella typhimurium LT2
accguccccagccag

SEQ ID NO: 1871344 - RNA, 19 nt, Salmonella typhimurium LT2
accguccccagccagagau

SEQ ID NO: 1871345 - RNA, 13 nt, Salmonella typhimurium LT2
accgucagccacu

SEQ ID NO: 1871346 - RNA, 14 nt, Salmonella typhimurium LT2
accgucagauucug

SEQ ID NO: 1871347 - RNA, 17 nt, Salmonella typhimurium LT2
accuacuuuauuuuucg

SEQ ID NO: 1871348 - RNA, 23 nt, Salmonella typhimurium LT2
accuacaaucgucuucagcaauu

SEQ ID NO: 1871349 - RNA, 14 nt, Salmonella typhimurium LT2
accuacaaauuaca

SEQ ID NO: 1871350 - RNA, 16 nt, Salmonella typhimurium LT2
accuaauaaccagccc

SEQ ID NO: 1871351 - RNA, 17 nt, Salmonella typhimurium LT2
accguuggaauaaauca

SEQ ID NO: 1871352 - RNA, 18 nt, Salmonella typhimurium LT2
accguugcgcccaucauc

SEQ ID NO: 1871353 - RNA, 19 nt, Salmonella typhimurium LT2
accguucuuccuggggauc

SEQ ID NO: 1871354 - RNA, 20 nt, Salmonella typhimurium LT2
accguuuuuuuaugcagccg

SEQ ID NO: 1871355 - RNA, 12 nt, Salmonella typhimurium LT2
accguuuuccag

SEQ ID NO: 1871356 - RNA, 13 nt, Salmonella typhimurium LT2
accguuuugcaau

SEQ ID NO: 1871357 - RNA, 18 nt, Salmonella typhimurium LT2
accguuuuucaucaagag

SEQ ID NO: 1871358 - RNA, 15 nt, Salmonella typhimurium LT2
accuaaauaaauacc

SEQ ID NO: 1871359 - RNA, 20 nt, Salmonella typhimurium LT2
accuauuuuaaauucccagc

SEQ ID NO: 1871360 - RNA, 22 nt, Salmonella typhimurium LT2
accuaucggcucgcccgcgcuc

SEQ ID NO: 1871361 - RNA, 14 nt, Salmonella typhimurium LT2
accuauuuugcaaa

SEQ ID NO: 1871362 - RNA, 16 nt, Salmonella typhimurium LT2
accucaccguccgcca

SEQ ID NO: 1871363 - RNA, 21 nt, Salmonella typhimurium LT2
accucaccguccgccaggccc

SEQ ID NO: 1871364 - RNA, 20 nt, Salmonella typhimurium LT2
accucaugcuuaucgccaaa

SEQ ID NO: 1871365 - RNA, 13 nt, Salmonella typhimurium LT2
accucauccauca

SEQ ID NO: 1871366 - RNA, 13 nt, Salmonella typhimurium LT2
accucaucgcuac

SEQ ID NO: 1871367 - RNA, 14 nt, Salmonella typhimurium LT2
accucacggagaaa

SEQ ID NO: 1871368 - RNA, 14 nt, Salmonella typhimurium LT2
accuccgcccggug

SEQ ID NO: 1871369 - RNA, 19 nt, Salmonella typhimurium LT2
accuccgccaccagcgcuu

SEQ ID NO: 1871370 - RNA, 14 nt, Salmonella typhimurium LT2
accuccucucuucc

SEQ ID NO: 1871371 - RNA, 13 nt, Salmonella typhimurium LT2
accuccugcaucg

SEQ ID NO: 1871372 - RNA, 16 nt, Salmonella typhimurium LT2
accucgccacauucaa

SEQ ID NO: 1871373 - RNA, 23 nt, Salmonella typhimurium LT2
accugauauugcguaagcagcug

SEQ ID NO: 1871374 - RNA, 23 nt, Salmonella typhimurium LT2
accugauugauacgcgcccgauc

SEQ ID NO: 1871375 - RNA, 13 nt, Salmonella typhimurium LT2
accugcaaaaaaa

SEQ ID NO: 1871376 - RNA, 20 nt, Salmonella typhimurium LT2
accucuuuggcgcgaaccgu

SEQ ID NO: 1871377 - RNA, 18 nt, Salmonella typhimurium LT2
accugaauccagacuuuu

SEQ ID NO: 1871378 - RNA, 22 nt, Salmonella typhimurium LT2
accugaauccagacuuuuuugc

SEQ ID NO: 1871379 - RNA, 13 nt, Salmonella typhimurium LT2
accucuaaaugga

SEQ ID NO: 1871380 - RNA, 20 nt, Salmonella typhimurium LT2
accucgguauguccugccgc

SEQ ID NO: 1871381 - RNA, 12 nt, Salmonella typhimurium LT2
accucucaccgc

SEQ ID NO: 1871382 - RNA, 15 nt, Salmonella typhimurium LT2
accucuaccggggcg

SEQ ID NO: 1871383 - RNA, 15 nt, Salmonella typhimurium LT2
accucuuccccgguc

SEQ ID NO: 1871384 - RNA, 22 nt, Salmonella typhimurium LT2
accucuuccagcgucagcgaaa

SEQ ID NO: 1871385 - RNA, 19 nt, Salmonella typhimurium LT2
accuucaagaaucaauaua

SEQ ID NO: 1871386 - RNA, 15 nt, Salmonella typhimurium LT2
accuuaauccagccg

SEQ ID NO: 1871387 - RNA, 21 nt, Salmonella typhimurium LT2
accuuaauuugugauugcaga

SEQ ID NO: 1871388 - RNA, 20 nt, Salmonella typhimurium LT2
accuuacguuucucacuaau

SEQ ID NO: 1871389 - RNA, 17 nt, Salmonella typhimurium LT2
accuuaaggccuacgga

SEQ ID NO: 1871390 - RNA, 17 nt, Salmonella typhimurium LT2
accuguuucgccaggcc

SEQ ID NO: 1871391 - RNA, 16 nt, Salmonella typhimurium LT2
accuguguacacaauu

SEQ ID NO: 1871392 - RNA, 18 nt, Salmonella typhimurium LT2
accuggaaguuuugcugg

SEQ ID NO: 1871393 - RNA, 19 nt, Salmonella typhimurium LT2
accugcuguaccucuugcu

SEQ ID NO: 1871394 - RNA, 20 nt, Salmonella typhimurium LT2
accuggcguaguacgcgcgc

SEQ ID NO: 1871395 - RNA, 14 nt, Salmonella typhimurium LT2
accuggcuugaugu

SEQ ID NO: 1871396 - RNA, 12 nt, Salmonella typhimurium LT2
accugcaucacg

SEQ ID NO: 1871397 - RNA, 19 nt, Salmonella typhimurium LT2
accugccaguccgcccgcc

SEQ ID NO: 1871398 - RNA, 22 nt, Salmonella typhimurium LT2
accugcccauccuuucucuggu

SEQ ID NO: 1871399 - RNA, 23 nt, Salmonella typhimurium LT2
accugccccauaagcaaaggcgg

SEQ ID NO: 1871400 - RNA, 12 nt, Salmonella typhimurium LT2
accugccaggcu

SEQ ID NO: 1871401 - RNA, 18 nt, Salmonella typhimurium LT2
accugcauuuaucuuuaa

SEQ ID NO: 1871402 - RNA, 18 nt, Salmonella typhimurium LT2
accugcggcaauggcuca

SEQ ID NO: 1871403 - RNA, 17 nt, Salmonella typhimurium LT2
accugcggacuguucgg

SEQ ID NO: 1871404 - RNA, 15 nt, Salmonella typhimurium LT2
accugcggcgcgccc

SEQ ID NO: 1871405 - RNA, 21 nt, Salmonella typhimurium LT2
accugcgcugacggcggcaga

SEQ ID NO: 1871406 - RNA, 19 nt, Salmonella typhimurium LT2
accugcgacgcaugaaacg

SEQ ID NO: 1871407 - RNA, 18 nt, Salmonella typhimurium LT2
accugccgaccucacugg

SEQ ID NO: 1871408 - RNA, 19 nt, Salmonella typhimurium LT2
accugcgcaaucaugacag

SEQ ID NO: 1871409 - RNA, 22 nt, Salmonella typhimurium LT2
accugcgaaaagcgugcgccuu

SEQ ID NO: 1871410 - RNA, 14 nt, Salmonella typhimurium LT2
accugccugucuuu

SEQ ID NO: 1871411 - RNA, 14 nt, Salmonella typhimurium LT2
accuucuucgccaa

SEQ ID NO: 1871412 - RNA, 12 nt, Salmonella typhimurium LT2
accuucuucgcu

SEQ ID NO: 1871413 - RNA, 21 nt, Salmonella typhimurium LT2
accuucuucacuaaaaacagg

SEQ ID NO: 1871414 - RNA, 17 nt, Salmonella typhimurium LT2
accuucggucccaucgc

SEQ ID NO: 1871415 - RNA, 16 nt, Salmonella typhimurium LT2
accuucauccugauaa

SEQ ID NO: 1871416 - RNA, 22 nt, Salmonella typhimurium LT2
accuucccgcgauaaaaacagc

SEQ ID NO: 1871417 - RNA, 15 nt, Salmonella typhimurium LT2
accuucaccggauac

SEQ ID NO: 1871418 - RNA, 15 nt, Salmonella typhimurium LT2
accuucaccugaaua

SEQ ID NO: 1871419 - RNA, 15 nt, Salmonella typhimurium LT2
accuucacgccgcca

SEQ ID NO: 1871420 - RNA, 17 nt, Salmonella typhimurium LT2
accuucacauuggcaaa

SEQ ID NO: 1871421 - RNA, 20 nt, Salmonella typhimurium LT2
accuucagccagaguuuuaa

SEQ ID NO: 1871422 - RNA, 19 nt, Salmonella typhimurium LT2
accuucuugcucaaaaagc

SEQ ID NO: 1871423 - RNA, 17 nt, Salmonella typhimurium LT2
accuugugaauauauug

SEQ ID NO: 1871424 - RNA, 19 nt, Salmonella typhimurium LT2
accuuucuucucuucuuca

SEQ ID NO: 1871425 - RNA, 21 nt, Salmonella typhimurium LT2
accuuuucauuggucaguaag

SEQ ID NO: 1871426 - RNA, 20 nt, Salmonella typhimurium LT2
accuuuaaccucuuuuucau

SEQ ID NO: 1871427 - RNA, 12 nt, Salmonella typhimurium LT2
accuuuccaguc

SEQ ID NO: 1871428 - RNA, 15 nt, Salmonella typhimurium LT2
acgaaaaugcgccuu

SEQ ID NO: 1871429 - RNA, 21 nt, Salmonella typhimurium LT2
acgaaaucagagacaaauaca

SEQ ID NO: 1871430 - RNA, 23 nt, Salmonella typhimurium LT2
acgaaagcggcgaauauagcuaa

SEQ ID NO: 1871431 - RNA, 22 nt, Salmonella typhimurium LT2
acgaaacuuuucgcaagagcga

SEQ ID NO: 1871432 - RNA, 16 nt, Salmonella typhimurium LT2
acgaacaaaauagugc

SEQ ID NO: 1871433 - RNA, 20 nt, Salmonella typhimurium LT2
acgaccuuucgccgucaccu

SEQ ID NO: 1871434 - RNA, 17 nt, Salmonella typhimurium LT2
acgaccaugguucccgc

SEQ ID NO: 1871435 - RNA, 23 nt, Salmonella typhimurium LT2
acgaccacucuuuggacggcauc

SEQ ID NO: 1871436 - RNA, 24 nt, Salmonella typhimurium LT2
acgaccagaaucaucaugucguca

SEQ ID NO: 1871437 - RNA, 13 nt, Salmonella typhimurium LT2
acgaccaaacaag

SEQ ID NO: 1871438 - RNA, 22 nt, Salmonella typhimurium LT2
acgacggcaggggcgugauaaa

SEQ ID NO: 1871439 - RNA, 15 nt, Salmonella typhimurium LT2
acgacguccacaccu

SEQ ID NO: 1871440 - RNA, 20 nt, Salmonella typhimurium LT2
acgacucaauacauucagua

SEQ ID NO: 1871441 - RNA, 20 nt, Salmonella typhimurium LT2
acgacuaaaaaaaugcccgc

SEQ ID NO: 1871442 - RNA, 14 nt, Salmonella typhimurium LT2
acgacuacugaaaa

SEQ ID NO: 1871443 - RNA, 16 nt, Salmonella typhimurium LT2
acgacuucguuaguga

SEQ ID NO: 1871444 - RNA, 20 nt, Salmonella typhimurium LT2
acgaacgcuggcacuuuccg

SEQ ID NO: 1871445 - RNA, 14 nt, Salmonella typhimurium LT2
acgaaccgagcggu

SEQ ID NO: 1871446 - RNA, 19 nt, Salmonella typhimurium LT2
acgaaccauuugccugccg

SEQ ID NO: 1871447 - RNA, 16 nt, Salmonella typhimurium LT2
acgaacugcggcuuuu

SEQ ID NO: 1871448 - RNA, 16 nt, Salmonella typhimurium LT2
acgaaggggacaaaau

SEQ ID NO: 1871449 - RNA, 21 nt, Salmonella typhimurium LT2
acgaauuuacucgccaauauc

SEQ ID NO: 1871450 - RNA, 20 nt, Salmonella typhimurium LT2
acgaauuuggucguaagaau

SEQ ID NO: 1871451 - RNA, 22 nt, Salmonella typhimurium LT2
acgacagcgccaucagcaucau

SEQ ID NO: 1871452 - RNA, 13 nt, Salmonella typhimurium LT2
acgacagcgcugg

SEQ ID NO: 1871453 - RNA, 18 nt, Salmonella typhimurium LT2
acgacaggcagcgucagc

SEQ ID NO: 1871454 - RNA, 21 nt, Salmonella typhimurium LT2
acgacacccgauacacgccga

SEQ ID NO: 1871455 - RNA, 15 nt, Salmonella typhimurium LT2
acgacacauaaagcc

SEQ ID NO: 1871456 - RNA, 23 nt, Salmonella typhimurium LT2
acgaaugccgauagucuccgcca

SEQ ID NO: 1871457 - RNA, 19 nt, Salmonella typhimurium LT2
acgaaugucgcgucagguu

SEQ ID NO: 1871458 - RNA, 23 nt, Salmonella typhimurium LT2
acgaauuccuuuuuccgccaccu

SEQ ID NO: 1871459 - RNA, 15 nt, Salmonella typhimurium LT2
acgaagucuggcugc

SEQ ID NO: 1871460 - RNA, 18 nt, Salmonella typhimurium LT2
acgaauauucauuuccag

SEQ ID NO: 1871461 - RNA, 15 nt, Salmonella typhimurium LT2
acgauuaaccucacg

SEQ ID NO: 1871462 - RNA, 18 nt, Salmonella typhimurium LT2
acgauuaaccucacgcaa

SEQ ID NO: 1871463 - RNA, 19 nt, Salmonella typhimurium LT2
acgauuggccgucucuuuc

SEQ ID NO: 1871464 - RNA, 19 nt, Salmonella typhimurium LT2
acgcaacucacgccauucc

SEQ ID NO: 1871465 - RNA, 20 nt, Salmonella typhimurium LT2
acgcaacgcuucugagaauu

SEQ ID NO: 1871466 - RNA, 17 nt, Salmonella typhimurium LT2
acgcaacaacaggccag

SEQ ID NO: 1871467 - RNA, 19 nt, Salmonella typhimurium LT2
acgauuuugguagcgcuga

SEQ ID NO: 1871468 - RNA, 19 nt, Salmonella typhimurium LT2
acgaugugacuggggugag

SEQ ID NO: 1871469 - RNA, 15 nt, Salmonella typhimurium LT2
acgauggggaaaauu

SEQ ID NO: 1871470 - RNA, 22 nt, Salmonella typhimurium LT2
acgaugagcaaaguaaaacaag

SEQ ID NO: 1871471 - RNA, 20 nt, Salmonella typhimurium LT2
acgaugcauaugcacagcgc

SEQ ID NO: 1871472 - RNA, 18 nt, Salmonella typhimurium LT2
acgagugcguucuuccac

SEQ ID NO: 1871473 - RNA, 17 nt, Salmonella typhimurium LT2
acgagugcguucuucca

SEQ ID NO: 1871474 - RNA, 22 nt, Salmonella typhimurium LT2
acgaguuaucgauucugaauaa

SEQ ID NO: 1871475 - RNA, 14 nt, Salmonella typhimurium LT2
acgauaaauuucac

SEQ ID NO: 1871476 - RNA, 23 nt, Salmonella typhimurium LT2
acgaguugaauaacguguuaugc

SEQ ID NO: 1871477 - RNA, 14 nt, Salmonella typhimurium LT2
acgauaaagcuggg

SEQ ID NO: 1871478 - RNA, 19 nt, Salmonella typhimurium LT2
acgauaaagcugggucagg

SEQ ID NO: 1871479 - RNA, 17 nt, Salmonella typhimurium LT2
acgagcgacgaggcaug

SEQ ID NO: 1871480 - RNA, 14 nt, Salmonella typhimurium LT2
acgaucauuucacu

SEQ ID NO: 1871481 - RNA, 17 nt, Salmonella typhimurium LT2
acgaucccuaauaaaau

SEQ ID NO: 1871482 - RNA, 15 nt, Salmonella typhimurium LT2
acgaucgauaaagcg

SEQ ID NO: 1871483 - RNA, 22 nt, Salmonella typhimurium LT2
acgaucaaccgguuugucauuc

SEQ ID NO: 1871484 - RNA, 16 nt, Salmonella typhimurium LT2
acgaucaacagaccga

SEQ ID NO: 1871485 - RNA, 14 nt, Salmonella typhimurium LT2
acgauauucaagcu

SEQ ID NO: 1871486 - RNA, 14 nt, Salmonella typhimurium LT2
acgauaucaucuug

SEQ ID NO: 1871487 - RNA, 22 nt, Salmonella typhimurium LT2
acgauacagcacggcaguacac

SEQ ID NO: 1871488 - RNA, 18 nt, Salmonella typhimurium LT2
acgauacgucauaucauc

SEQ ID NO: 1871489 - RNA, 15 nt, Salmonella typhimurium LT2
accaaaguuaaucag

SEQ ID NO: 1871490 - RNA, 17 nt, Salmonella typhimurium LT2
accaaaaacgcccccag

SEQ ID NO: 1871491 - RNA, 15 nt, Salmonella typhimurium LT2
acauuuuuuucuugc

SEQ ID NO: 1871492 - RNA, 18 nt, Salmonella typhimurium LT2
acauuucaggcaaaaaaa

SEQ ID NO: 1871493 - RNA, 19 nt, Salmonella typhimurium LT2
acauuucaggcaaaaaaaa

SEQ ID NO: 1871494 - RNA, 17 nt, Salmonella typhimurium LT2
acauuuaucuuccggca

SEQ ID NO: 1871495 - RNA, 12 nt, Salmonella typhimurium LT2
acauguccagau

SEQ ID NO: 1871496 - RNA, 16 nt, Salmonella typhimurium LT2
acauggcaauggcuuc

SEQ ID NO: 1871497 - RNA, 23 nt, Salmonella typhimurium LT2
acaugguggagucuaaaaauaau

SEQ ID NO: 1871498 - RNA, 12 nt, Salmonella typhimurium LT2
accaaucaucac

SEQ ID NO: 1871499 - RNA, 17 nt, Salmonella typhimurium LT2
accacaugaccagcgcc

SEQ ID NO: 1871500 - RNA, 16 nt, Salmonella typhimurium LT2
accaagucucaagagu

SEQ ID NO: 1871501 - RNA, 19 nt, Salmonella typhimurium LT2
accaacgucgugccaguga

SEQ ID NO: 1871502 - RNA, 16 nt, Salmonella typhimurium LT2
accaacugccaaacca

SEQ ID NO: 1871503 - RNA, 15 nt, Salmonella typhimurium LT2
accaacgacccccac

SEQ ID NO: 1871504 - RNA, 22 nt, Salmonella typhimurium LT2
accaacgacccccaccauguca

SEQ ID NO: 1871505 - RNA, 17 nt, Salmonella typhimurium LT2
accaaccgugagcgcgc

SEQ ID NO: 1871506 - RNA, 19 nt, Salmonella typhimurium LT2
accagccuaccugccgcca

SEQ ID NO: 1871507 - RNA, 20 nt, Salmonella typhimurium LT2
accagaucaacaugguguuu

SEQ ID NO: 1871508 - RNA, 20 nt, Salmonella typhimurium LT2
accagaucggcaucuuuaac

SEQ ID NO: 1871509 - RNA, 22 nt, Salmonella typhimurium LT2
accagaguaaccacgauaaaga

SEQ ID NO: 1871510 - RNA, 21 nt, Salmonella typhimurium LT2
accagaaaaccgacagcaaua

SEQ ID NO: 1871511 - RNA, 13 nt, Salmonella typhimurium LT2
accagaaccucac

SEQ ID NO: 1871512 - RNA, 17 nt, Salmonella typhimurium LT2
accacugauuccagagc

SEQ ID NO: 1871513 - RNA, 14 nt, Salmonella typhimurium LT2
accagacugauaag

SEQ ID NO: 1871514 - RNA, 21 nt, Salmonella typhimurium LT2
accagacgcgaacguuugacc

SEQ ID NO: 1871515 - RNA, 22 nt, Salmonella typhimurium LT2
accagacgcuggcacuggcagc

SEQ ID NO: 1871516 - RNA, 16 nt, Salmonella typhimurium LT2
accagaccgacaagcc

SEQ ID NO: 1871517 - RNA, 21 nt, Salmonella typhimurium LT2
accagaccggcaucucaucuu

SEQ ID NO: 1871518 - RNA, 17 nt, Salmonella typhimurium LT2
accagaaucaccgacag

SEQ ID NO: 1871519 - RNA, 17 nt, Salmonella typhimurium LT2
accagaaucauuaauaa

SEQ ID NO: 1871520 - RNA, 18 nt, Salmonella typhimurium LT2
accacggauaagccagcc

SEQ ID NO: 1871521 - RNA, 14 nt, Salmonella typhimurium LT2
accacggcuucagc

SEQ ID NO: 1871522 - RNA, 15 nt, Salmonella typhimurium LT2
accacggcuucagcg

SEQ ID NO: 1871523 - RNA, 18 nt, Salmonella typhimurium LT2
accacugacacggaacaa

SEQ ID NO: 1871524 - RNA, 23 nt, Salmonella typhimurium LT2
accaccgaauuccgcuaaucuuu

SEQ ID NO: 1871525 - RNA, 14 nt, Salmonella typhimurium LT2
accacccugaaaag

SEQ ID NO: 1871526 - RNA, 21 nt, Salmonella typhimurium LT2
accaccggaugauucaguaaa

SEQ ID NO: 1871527 - RNA, 17 nt, Salmonella typhimurium LT2
accacccgugaaaaaug

SEQ ID NO: 1871528 - RNA, 18 nt, Salmonella typhimurium LT2
accacccgcggccagguc

SEQ ID NO: 1871529 - RNA, 16 nt, Salmonella typhimurium LT2
accaccccacagcaau

SEQ ID NO: 1871530 - RNA, 20 nt, Salmonella typhimurium LT2
accaguacccuguauuuuuu

SEQ ID NO: 1871531 - RNA, 15 nt, Salmonella typhimurium LT2
accaguaagagaaca

SEQ ID NO: 1871532 - RNA, 16 nt, Salmonella typhimurium LT2
accaguaagagaacaa

SEQ ID NO: 1871533 - RNA, 22 nt, Salmonella typhimurium LT2
accagugaacgucugcacggca

SEQ ID NO: 1871534 - RNA, 15 nt, Salmonella typhimurium LT2
accagugcaacgccu

SEQ ID NO: 1871535 - RNA, 18 nt, Salmonella typhimurium LT2
accaucagcgucagcacc

SEQ ID NO: 1871536 - RNA, 14 nt, Salmonella typhimurium LT2
accauauucacgca

SEQ ID NO: 1871537 - RNA, 16 nt, Salmonella typhimurium LT2
accauagcggcucagg

SEQ ID NO: 1871538 - RNA, 22 nt, Salmonella typhimurium LT2
accauaaacggcaccuggaagu

SEQ ID NO: 1871539 - RNA, 20 nt, Salmonella typhimurium LT2
accauaaacggcaccuggaa

SEQ ID NO: 1871540 - RNA, 19 nt, Salmonella typhimurium LT2
accauaaaugaaaccucaa

SEQ ID NO: 1871541 - RNA, 13 nt, Salmonella typhimurium LT2
accaguuuuuccg

SEQ ID NO: 1871542 - RNA, 22 nt, Salmonella typhimurium LT2
accauaccggugcgccccagca

SEQ ID NO: 1871543 - RNA, 23 nt, Salmonella typhimurium LT2
accauacggucgauaccaauucc

SEQ ID NO: 1871544 - RNA, 15 nt, Salmonella typhimurium LT2
accagcgcggcgcca

SEQ ID NO: 1871545 - RNA, 15 nt, Salmonella typhimurium LT2
accaggcaugcagcu

SEQ ID NO: 1871546 - RNA, 12 nt, Salmonella typhimurium LT2
accagcgcgcca

SEQ ID NO: 1871547 - RNA, 16 nt, Salmonella typhimurium LT2
accaggccgguaaagu

SEQ ID NO: 1871548 - RNA, 15 nt, Salmonella typhimurium LT2
accagcgcaguaaac

SEQ ID NO: 1871549 - RNA, 17 nt, Salmonella typhimurium LT2
accagcgauaaacgcca

SEQ ID NO: 1871550 - RNA, 20 nt, Salmonella typhimurium LT2
accagcgauaaacgccagcc

SEQ ID NO: 1871551 - RNA, 15 nt, Salmonella typhimurium LT2
accagcgaaaugaca

SEQ ID NO: 1871552 - RNA, 14 nt, Salmonella typhimurium LT2
accaguaaccgcca

SEQ ID NO: 1871553 - RNA, 15 nt, Salmonella typhimurium LT2
accaguaacggcagu

SEQ ID NO: 1871554 - RNA, 15 nt, Salmonella typhimurium LT2
accaguaaccgccac

SEQ ID NO: 1871555 - RNA, 16 nt, Salmonella typhimurium LT2
accagguugccagcgg

SEQ ID NO: 1871556 - RNA, 14 nt, Salmonella typhimurium LT2
accagguuuccaga

SEQ ID NO: 1871557 - RNA, 11 nt, Salmonella typhimurium LT2
acccccagcca

SEQ ID NO: 1871558 - RNA, 19 nt, Salmonella typhimurium LT2
acccccagcugacuggcag

SEQ ID NO: 1871559 - RNA, 20 nt, Salmonella typhimurium LT2
accccgauaaaccaggcagc

SEQ ID NO: 1871560 - RNA, 19 nt, Salmonella typhimurium LT2
acccccuuacuaagccagu

SEQ ID NO: 1871561 - RNA, 12 nt, Salmonella typhimurium LT2
acccccucagca

SEQ ID NO: 1871562 - RNA, 15 nt, Salmonella typhimurium LT2
accccaucccggcaa

SEQ ID NO: 1871563 - RNA, 16 nt, Salmonella typhimurium LT2
accccaggucagcagu

SEQ ID NO: 1871564 - RNA, 16 nt, Salmonella typhimurium LT2
accccagguugaugca

SEQ ID NO: 1871565 - RNA, 22 nt, Salmonella typhimurium LT2
accccaggcgauaccgcgcugg

SEQ ID NO: 1871566 - RNA, 19 nt, Salmonella typhimurium LT2
accccaaacaccaacaaag

SEQ ID NO: 1871567 - RNA, 15 nt, Salmonella typhimurium LT2
acccagcgcggccca

SEQ ID NO: 1871568 - RNA, 18 nt, Salmonella typhimurium LT2
accccaaaucagcaaaaa

SEQ ID NO: 1871569 - RNA, 20 nt, Salmonella typhimurium LT2
acccagccacaugauguugu

SEQ ID NO: 1871570 - RNA, 18 nt, Salmonella typhimurium LT2
acccagcgccaacgccac

SEQ ID NO: 1871571 - RNA, 18 nt, Salmonella typhimurium LT2
acccagaguuuguuguuu

SEQ ID NO: 1871572 - RNA, 16 nt, Salmonella typhimurium LT2
acccacuuugcuuuuc

SEQ ID NO: 1871573 - RNA, 18 nt, Salmonella typhimurium LT2
acccacuuugcuuuucug

SEQ ID NO: 1871574 - RNA, 13 nt, Salmonella typhimurium LT2
acccaccagcagg

SEQ ID NO: 1871575 - RNA, 16 nt, Salmonella typhimurium LT2
acccaccauaaaacca

SEQ ID NO: 1871576 - RNA, 15 nt, Salmonella typhimurium LT2
acccacaacgcacca

SEQ ID NO: 1871577 - RNA, 13 nt, Salmonella typhimurium LT2
acccacacauaga

SEQ ID NO: 1871578 - RNA, 15 nt, Salmonella typhimurium LT2
acccaaugauccgga

SEQ ID NO: 1871579 - RNA, 18 nt, Salmonella typhimurium LT2
accauucccguaaaagaa

SEQ ID NO: 1871580 - RNA, 16 nt, Salmonella typhimurium LT2
accauugcuaaaaaua

SEQ ID NO: 1871581 - RNA, 21 nt, Salmonella typhimurium LT2
accaucaggugaguaaauaaa

SEQ ID NO: 1871582 - RNA, 12 nt, Salmonella typhimurium LT2
accaucagcauc

SEQ ID NO: 1871583 - RNA, 19 nt, Salmonella typhimurium LT2
accaucauuaauauaaucc

SEQ ID NO: 1871584 - RNA, 16 nt, Salmonella typhimurium LT2
acagcccuuucaggaa

SEQ ID NO: 1871585 - RNA, 22 nt, Salmonella typhimurium LT2
acagcccauaccacaacagaau

SEQ ID NO: 1871586 - RNA, 16 nt, Salmonella typhimurium LT2
acagccgcauuuuuuc

SEQ ID NO: 1871587 - RNA, 20 nt, Salmonella typhimurium LT2
acagccgaucaggccgcaga

SEQ ID NO: 1871588 - RNA, 24 nt, Salmonella typhimurium LT2
acagccgcguugcgcugaaguaau

SEQ ID NO: 1871589 - RNA, 23 nt, Salmonella typhimurium LT2
acagccuuguuuaccgcaauaac

SEQ ID NO: 1871590 - RNA, 18 nt, Salmonella typhimurium LT2
acagcgagcuauccggca

SEQ ID NO: 1871591 - RNA, 22 nt, Salmonella typhimurium LT2
acagcguaguuuauucuucucc

SEQ ID NO: 1871592 - RNA, 14 nt, Salmonella typhimurium LT2
acagcguauuaagc

SEQ ID NO: 1871593 - RNA, 12 nt, Salmonella typhimurium LT2
acagcggagaga

SEQ ID NO: 1871594 - RNA, 15 nt, Salmonella typhimurium LT2
acagcguacaauggc

SEQ ID NO: 1871595 - RNA, 17 nt, Salmonella typhimurium LT2
acagcguacaauggcag

SEQ ID NO: 1871596 - RNA, 21 nt, Salmonella typhimurium LT2
acagcggcgcagacacugcca

SEQ ID NO: 1871597 - RNA, 15 nt, Salmonella typhimurium LT2
acagcgcaauaugca

SEQ ID NO: 1871598 - RNA, 15 nt, Salmonella typhimurium LT2
acagcgccagaauag

SEQ ID NO: 1871599 - RNA, 15 nt, Salmonella typhimurium LT2
acagcgcgaccagga

SEQ ID NO: 1871600 - RNA, 13 nt, Salmonella typhimurium LT2
acagcggagagac

SEQ ID NO: 1871601 - RNA, 14 nt, Salmonella typhimurium LT2
acagcuuuuacaac

SEQ ID NO: 1871602 - RNA, 20 nt, Salmonella typhimurium LT2
acagcuugcgcccaugcuca

SEQ ID NO: 1871603 - RNA, 19 nt, Salmonella typhimurium LT2
acagcuucgguccggcgcu

SEQ ID NO: 1871604 - RNA, 17 nt, Salmonella typhimurium LT2
acagcuuagauguaauu

SEQ ID NO: 1871605 - RNA, 21 nt, Salmonella typhimurium LT2
acagcuggcgauauccgugcc

SEQ ID NO: 1871606 - RNA, 19 nt, Salmonella typhimurium LT2
acaggaacaucguguccug

SEQ ID NO: 1871607 - RNA, 16 nt, Salmonella typhimurium LT2
acaggaauaaccacug

SEQ ID NO: 1871608 - RNA, 18 nt, Salmonella typhimurium LT2
acaggaagcggcuggguu

SEQ ID NO: 1871609 - RNA, 21 nt, Salmonella typhimurium LT2
acaggcaacguccuggugugu

SEQ ID NO: 1871610 - RNA, 20 nt, Salmonella typhimurium LT2
acaggccaacauagcggcaa

SEQ ID NO: 1871611 - RNA, 19 nt, Salmonella typhimurium LT2
acaggccaaacccugcgcc

SEQ ID NO: 1871612 - RNA, 18 nt, Salmonella typhimurium LT2
acaggcaugguuaacaau

SEQ ID NO: 1871613 - RNA, 23 nt, Salmonella typhimurium LT2
acaggcagcgucagcccaagcug

SEQ ID NO: 1871614 - RNA, 17 nt, Salmonella typhimurium LT2
acaggccgcgaaagcgg

SEQ ID NO: 1871615 - RNA, 15 nt, Salmonella typhimurium LT2
acaggccuggccuuc

SEQ ID NO: 1871616 - RNA, 16 nt, Salmonella typhimurium LT2
acaggccuggccuuca

SEQ ID NO: 1871617 - RNA, 20 nt, Salmonella typhimurium LT2
acagauggcgcuucguuucc

SEQ ID NO: 1871618 - RNA, 17 nt, Salmonella typhimurium LT2
acagauuggucagcagc

SEQ ID NO: 1871619 - RNA, 11 nt, Salmonella typhimurium LT2
acagcacauag

SEQ ID NO: 1871620 - RNA, 18 nt, Salmonella typhimurium LT2
acagcaauaucagccauu

SEQ ID NO: 1871621 - RNA, 16 nt, Salmonella typhimurium LT2
acagcaauaucagcca

SEQ ID NO: 1871622 - RNA, 13 nt, Salmonella typhimurium LT2
acagcaauguuuc

SEQ ID NO: 1871623 - RNA, 13 nt, Salmonella typhimurium LT2
acagaggaaugaa

SEQ ID NO: 1871624 - RNA, 21 nt, Salmonella typhimurium LT2
acagagucgcuuaucugcugc

SEQ ID NO: 1871625 - RNA, 21 nt, Salmonella typhimurium LT2
acagaugccuuguaagccgga

SEQ ID NO: 1871626 - RNA, 15 nt, Salmonella typhimurium LT2
acagccaaucauaaa

SEQ ID NO: 1871627 - RNA, 19 nt, Salmonella typhimurium LT2
acagccauaaugcugccag

SEQ ID NO: 1871628 - RNA, 19 nt, Salmonella typhimurium LT2
acagccauaccggcgcgcg

SEQ ID NO: 1871629 - RNA, 13 nt, Salmonella typhimurium LT2
acagccaguaaug

SEQ ID NO: 1871630 - RNA, 20 nt, Salmonella typhimurium LT2
acagcacuaacgaggccacc

SEQ ID NO: 1871631 - RNA, 23 nt, Salmonella typhimurium LT2
acagcacuacggauggcccugcc

SEQ ID NO: 1871632 - RNA, 18 nt, Salmonella typhimurium LT2
acagcagaauauugcuga

SEQ ID NO: 1871633 - RNA, 13 nt, Salmonella typhimurium LT2
acacucucuccag

SEQ ID NO: 1871634 - RNA, 14 nt, Salmonella typhimurium LT2
acacucuccucccc

SEQ ID NO: 1871635 - RNA, 15 nt, Salmonella typhimurium LT2
acacuccgcgcaugu

SEQ ID NO: 1871636 - RNA, 16 nt, Salmonella typhimurium LT2
aauuucaguauuacua

SEQ ID NO: 1871637 - RNA, 20 nt, Salmonella typhimurium LT2
aauuucacugucgccaggcc

SEQ ID NO: 1871638 - RNA, 14 nt, Salmonella typhimurium LT2
acacugacaauaaa

SEQ ID NO: 1871639 - RNA, 15 nt, Salmonella typhimurium LT2
acacugccaccgcuc

SEQ ID NO: 1871640 - RNA, 22 nt, Salmonella typhimurium LT2
acacuggaaacagccaaucaua

SEQ ID NO: 1871641 - RNA, 14 nt, Salmonella typhimurium LT2
acacuggaaacagc

SEQ ID NO: 1871642 - RNA, 20 nt, Salmonella typhimurium LT2
acagaaugcugaacagccgu

SEQ ID NO: 1871643 - RNA, 20 nt, Salmonella typhimurium LT2
acagacaucggagauuucau

SEQ ID NO: 1871644 - RNA, 16 nt, Salmonella typhimurium LT2
acagacaaugaauauu

SEQ ID NO: 1871645 - RNA, 14 nt, Salmonella typhimurium LT2
acagaccacagaua

SEQ ID NO: 1871646 - RNA, 18 nt, Salmonella typhimurium LT2
acacuucucaacauugac

SEQ ID NO: 1871647 - RNA, 21 nt, Salmonella typhimurium LT2
acacuugcagcucgcacugau

SEQ ID NO: 1871648 - RNA, 17 nt, Salmonella typhimurium LT2
acacuuucgcccggcgc

SEQ ID NO: 1871649 - RNA, 23 nt, Salmonella typhimurium LT2
acacuuugcgcggauugagcgaa

SEQ ID NO: 1871650 - RNA, 14 nt, Salmonella typhimurium LT2
acacuuucaucagc

SEQ ID NO: 1871651 - RNA, 14 nt, Salmonella typhimurium LT2
acauauucaauaau

SEQ ID NO: 1871652 - RNA, 16 nt, Salmonella typhimurium LT2
acauauugauagagca

SEQ ID NO: 1871653 - RNA, 12 nt, Salmonella typhimurium LT2
acauauuuuuau

SEQ ID NO: 1871654 - RNA, 14 nt, Salmonella typhimurium LT2
acaucaaaauuacc

SEQ ID NO: 1871655 - RNA, 13 nt, Salmonella typhimurium LT2
acaucagauaaac

SEQ ID NO: 1871656 - RNA, 13 nt, Salmonella typhimurium LT2
acauccacauagg

SEQ ID NO: 1871657 - RNA, 13 nt, Salmonella typhimurium LT2
acaucauuaucca

SEQ ID NO: 1871658 - RNA, 20 nt, Salmonella typhimurium LT2
acaucauuacgacgcgccag

SEQ ID NO: 1871659 - RNA, 14 nt, Salmonella typhimurium LT2
acaugaccgcacag

SEQ ID NO: 1871660 - RNA, 16 nt, Salmonella typhimurium LT2
acaucuuccaugccuu

SEQ ID NO: 1871661 - RNA, 22 nt, Salmonella typhimurium LT2
acaucugccgcuuugaggauca

SEQ ID NO: 1871662 - RNA, 22 nt, Salmonella typhimurium LT2
acaucucuucguguaacgcaua

SEQ ID NO: 1871663 - RNA, 15 nt, Salmonella typhimurium LT2
acaucuuauuucacc

SEQ ID NO: 1871664 - RNA, 16 nt, Salmonella typhimurium LT2
acaucugugaaaacgc

SEQ ID NO: 1871665 - RNA, 22 nt, Salmonella typhimurium LT2
acaucgcucgcgccacgcagau

SEQ ID NO: 1871666 - RNA, 22 nt, Salmonella typhimurium LT2
acaucgccguuccauuccagaa

SEQ ID NO: 1871667 - RNA, 17 nt, Salmonella typhimurium LT2
acaucguuggccgccag

SEQ ID NO: 1871668 - RNA, 20 nt, Salmonella typhimurium LT2
acauaauguaaaggugagcu

SEQ ID NO: 1871669 - RNA, 17 nt, Salmonella typhimurium LT2
acauaacagcagcagac

SEQ ID NO: 1871670 - RNA, 16 nt, Salmonella typhimurium LT2
acauaacaucucacua

SEQ ID NO: 1871671 - RNA, 16 nt, Salmonella typhimurium LT2
acauaaagauaaauaa

SEQ ID NO: 1871672 - RNA, 19 nt, Salmonella typhimurium LT2
acaguuaccgcacacgcaa

SEQ ID NO: 1871673 - RNA, 18 nt, Salmonella typhimurium LT2
acagugugccgucaucca

SEQ ID NO: 1871674 - RNA, 21 nt, Salmonella typhimurium LT2
acagugauuacaaaaugugca

SEQ ID NO: 1871675 - RNA, 14 nt, Salmonella typhimurium LT2
acagugaguacgca

SEQ ID NO: 1871676 - RNA, 22 nt, Salmonella typhimurium LT2
acagucaaacacgaccagcgac

SEQ ID NO: 1871677 - RNA, 19 nt, Salmonella typhimurium LT2
acaguccgggccgugacac

SEQ ID NO: 1871678 - RNA, 21 nt, Salmonella typhimurium LT2
acagugaagugugaacuaugc

SEQ ID NO: 1871679 - RNA, 16 nt, Salmonella typhimurium LT2
acagguucgaaucccg

SEQ ID NO: 1871680 - RNA, 18 nt, Salmonella typhimurium LT2
acagguugcguaacgcca

SEQ ID NO: 1871681 - RNA, 14 nt, Salmonella typhimurium LT2
acaguaccagcaga

SEQ ID NO: 1871682 - RNA, 19 nt, Salmonella typhimurium LT2
acaguaccagcagaacggu

SEQ ID NO: 1871683 - RNA, 21 nt, Salmonella typhimurium LT2
acaguauuuguucagacacau

SEQ ID NO: 1871684 - RNA, 16 nt, Salmonella typhimurium LT2
acaggcggaugaaaca

SEQ ID NO: 1871685 - RNA, 21 nt, Salmonella typhimurium LT2
acaggcgauucggacuaauac

SEQ ID NO: 1871686 - RNA, 16 nt, Salmonella typhimurium LT2
acaggcguguggcaua

SEQ ID NO: 1871687 - RNA, 18 nt, Salmonella typhimurium LT2
acaggcuauaacgcacca

SEQ ID NO: 1871688 - RNA, 21 nt, Salmonella typhimurium LT2
acaggcuauaacgcaccaccu

SEQ ID NO: 1871689 - RNA, 22 nt, Salmonella typhimurium LT2
acaggcuauaacgcaccaccug

SEQ ID NO: 1871690 - RNA, 21 nt, Salmonella typhimurium LT2
acaggcuucgguugccugcgu

SEQ ID NO: 1871691 - RNA, 11 nt, Salmonella typhimurium LT2
acagggcggca

SEQ ID NO: 1871692 - RNA, 23 nt, Salmonella typhimurium LT2
acagggcguuuuauaagccgcuc

SEQ ID NO: 1871693 - RNA, 14 nt, Salmonella typhimurium LT2
acagguaaaacaaa

SEQ ID NO: 1871694 - RNA, 21 nt, Salmonella typhimurium LT2
acaggggccuuuuuuucuccu

SEQ ID NO: 1871695 - RNA, 16 nt, Salmonella typhimurium LT2
acagggggaagcacau

SEQ ID NO: 1871696 - RNA, 14 nt, Salmonella typhimurium LT2
acagguacaggccg

SEQ ID NO: 1871697 - RNA, 15 nt, Salmonella typhimurium LT2
acagguacaggccgc

SEQ ID NO: 1871698 - RNA, 18 nt, Salmonella typhimurium LT2
acaggucgacgugaacug

SEQ ID NO: 1871699 - RNA, 20 nt, Salmonella typhimurium LT2
agaagcacgacacaaaagca

SEQ ID NO: 1871700 - RNA, 15 nt, Salmonella typhimurium LT2
agaagauuucuuaau

SEQ ID NO: 1871701 - RNA, 16 nt, Salmonella typhimurium LT2
agaacuuccaacuaaa

SEQ ID NO: 1871702 - RNA, 15 nt, Salmonella typhimurium LT2
agaacuuggcuuccu

SEQ ID NO: 1871703 - RNA, 20 nt, Salmonella typhimurium LT2
agaagaaaccgcagaaaaag

SEQ ID NO: 1871704 - RNA, 16 nt, Salmonella typhimurium LT2
agaagaauaagccgga

SEQ ID NO: 1871705 - RNA, 14 nt, Salmonella typhimurium LT2
agaauacgaauauu

SEQ ID NO: 1871706 - RNA, 22 nt, Salmonella typhimurium LT2
agaauacacuucucaacauuga

SEQ ID NO: 1871707 - RNA, 17 nt, Salmonella typhimurium LT2
agaaguaaacagaauca

SEQ ID NO: 1871708 - RNA, 20 nt, Salmonella typhimurium LT2
agaagguuauucgccuuuca

SEQ ID NO: 1871709 - RNA, 17 nt, Salmonella typhimurium LT2
agaaguagcagagaaaa

SEQ ID NO: 1871710 - RNA, 15 nt, Salmonella typhimurium LT2
agaagcuuaccaccu

SEQ ID NO: 1871711 - RNA, 13 nt, Salmonella typhimurium LT2
agaagcuuaccac

SEQ ID NO: 1871712 - RNA, 16 nt, Salmonella typhimurium LT2
agaauggaacaauaga

SEQ ID NO: 1871713 - RNA, 15 nt, Salmonella typhimurium LT2
agaaugcuccauugc

SEQ ID NO: 1871714 - RNA, 13 nt, Salmonella typhimurium LT2
agaauucgcaaug

SEQ ID NO: 1871715 - RNA, 13 nt, Salmonella typhimurium LT2
agaauuccaccuu

SEQ ID NO: 1871716 - RNA, 14 nt, Salmonella typhimurium LT2
agaauucguccaga

SEQ ID NO: 1871717 - RNA, 16 nt, Salmonella typhimurium LT2
agaauggccagcacaa

SEQ ID NO: 1871718 - RNA, 13 nt, Salmonella typhimurium LT2
agaaucgccaggc

SEQ ID NO: 1871719 - RNA, 22 nt, Salmonella typhimurium LT2
agaaucgccaggcgcagcaaac

SEQ ID NO: 1871720 - RNA, 20 nt, Salmonella typhimurium LT2
agaaucguggcgccaaaaag

SEQ ID NO: 1871721 - RNA, 21 nt, Salmonella typhimurium LT2
agaauccggcgcucaucagac

SEQ ID NO: 1871722 - RNA, 23 nt, Salmonella typhimurium LT2
agacccacauauugcgcuucacu

SEQ ID NO: 1871723 - RNA, 19 nt, Salmonella typhimurium LT2
agacccaguacaaacaaau

SEQ ID NO: 1871724 - RNA, 18 nt, Salmonella typhimurium LT2
agacccaguacaaacaaa

SEQ ID NO: 1871725 - RNA, 17 nt, Salmonella typhimurium LT2
agaccauauucacgcag

SEQ ID NO: 1871726 - RNA, 11 nt, Salmonella typhimurium LT2
agaccugagcc

SEQ ID NO: 1871727 - RNA, 12 nt, Salmonella typhimurium LT2
agaccuaaacca

SEQ ID NO: 1871728 - RNA, 19 nt, Salmonella typhimurium LT2
agaccugccugaucgccac

SEQ ID NO: 1871729 - RNA, 14 nt, Salmonella typhimurium LT2
agacguugggauua

SEQ ID NO: 1871730 - RNA, 13 nt, Salmonella typhimurium LT2
agaauuuccccag

SEQ ID NO: 1871731 - RNA, 17 nt, Salmonella typhimurium LT2
agaauuuccccaguuau

SEQ ID NO: 1871732 - RNA, 18 nt, Salmonella typhimurium LT2
agacaaccgggcaucacc

SEQ ID NO: 1871733 - RNA, 18 nt, Salmonella typhimurium LT2
agaauugcgccaccuuaa

SEQ ID NO: 1871734 - RNA, 18 nt, Salmonella typhimurium LT2
agaccaccccacagcaau

SEQ ID NO: 1871735 - RNA, 15 nt, Salmonella typhimurium LT2
agaccacgaaucagg

SEQ ID NO: 1871736 - RNA, 17 nt, Salmonella typhimurium LT2
agaccacgaaucaggau

SEQ ID NO: 1871737 - RNA, 15 nt, Salmonella typhimurium LT2
agacauauuuucucu

SEQ ID NO: 1871738 - RNA, 20 nt, Salmonella typhimurium LT2
agacagauaacaccagcgau

SEQ ID NO: 1871739 - RNA, 22 nt, Salmonella typhimurium LT2
agacacuggaaacagccaauca

SEQ ID NO: 1871740 - RNA, 11 nt, Salmonella typhimurium LT2
agacagaacag

SEQ ID NO: 1871741 - RNA, 21 nt, Salmonella typhimurium LT2
agaacccacuuugcuuuucug

SEQ ID NO: 1871742 - RNA, 13 nt, Salmonella typhimurium LT2
agaacaucaucuu

SEQ ID NO: 1871743 - RNA, 19 nt, Salmonella typhimurium LT2
agaacaugaaauggcauga

SEQ ID NO: 1871744 - RNA, 13 nt, Salmonella typhimurium LT2
agaaauucugcag

SEQ ID NO: 1871745 - RNA, 23 nt, Salmonella typhimurium LT2
agaaagucuuuuguuuuucucuu

SEQ ID NO: 1871746 - RNA, 23 nt, Salmonella typhimurium LT2
agaaccguugcgcccaucaucau

SEQ ID NO: 1871747 - RNA, 19 nt, Salmonella typhimurium LT2
agaacgccgggccugccag

SEQ ID NO: 1871748 - RNA, 13 nt, Salmonella typhimurium LT2
agaacgccgggcc

SEQ ID NO: 1871749 - RNA, 21 nt, Salmonella typhimurium LT2
agaacgacgcauaaaaaauga

SEQ ID NO: 1871750 - RNA, 20 nt, Salmonella typhimurium LT2
agaacgacgaauaagcugaa

SEQ ID NO: 1871751 - RNA, 22 nt, Salmonella typhimurium LT2
agaacugcugcauccgcgcuuu

SEQ ID NO: 1871752 - RNA, 22 nt, Salmonella typhimurium LT2
agaacugcaaauaccacaucag

SEQ ID NO: 1871753 - RNA, 16 nt, Salmonella typhimurium LT2
agaacuggcgcgauga

SEQ ID NO: 1871754 - RNA, 18 nt, Salmonella typhimurium LT2
agaacucguugccagaaa

SEQ ID NO: 1871755 - RNA, 14 nt, Salmonella typhimurium LT2
agaacgguuuaucc

SEQ ID NO: 1871756 - RNA, 23 nt, Salmonella typhimurium LT2
agaacucacauauucaauaauau

SEQ ID NO: 1871757 - RNA, 17 nt, Salmonella typhimurium LT2
acuuccuuugccuuucu

SEQ ID NO: 1871758 - RNA, 20 nt, Salmonella typhimurium LT2
acuucgaacugguuugucga

SEQ ID NO: 1871759 - RNA, 20 nt, Salmonella typhimurium LT2
acuucgccgggauaaaacac

SEQ ID NO: 1871760 - RNA, 14 nt, Salmonella typhimurium LT2
acuuuugccaggcg

SEQ ID NO: 1871761 - RNA, 20 nt, Salmonella typhimurium LT2
acuuuugccaggcggauaaa

SEQ ID NO: 1871762 - RNA, 13 nt, Salmonella typhimurium LT2
acuuuugaacaua

SEQ ID NO: 1871763 - RNA, 22 nt, Salmonella typhimurium LT2
acuuuuuggcuguugguaugca

SEQ ID NO: 1871764 - RNA, 18 nt, Salmonella typhimurium LT2
acuuuuugaucuaaaaau

SEQ ID NO: 1871765 - RNA, 22 nt, Salmonella typhimurium LT2
acuuuuugaucuaaaaauuaca

SEQ ID NO: 1871766 - RNA, 15 nt, Salmonella typhimurium LT2
agaaaaagucauuuu

SEQ ID NO: 1871767 - RNA, 19 nt, Salmonella typhimurium LT2
acuuuuuucaaauccagcu

SEQ ID NO: 1871768 - RNA, 20 nt, Salmonella typhimurium LT2
acuuuuuugccgagguggua

SEQ ID NO: 1871769 - RNA, 17 nt, Salmonella typhimurium LT2
agaaacugcuguagcac

SEQ ID NO: 1871770 - RNA, 22 nt, Salmonella typhimurium LT2
agaaaggcgcgcacaugcagcg

SEQ ID NO: 1871771 - RNA, 17 nt, Salmonella typhimurium LT2
agaaaccgcagaaaaag

SEQ ID NO: 1871772 - RNA, 15 nt, Salmonella typhimurium LT2
agagcgcgcucugcc

SEQ ID NO: 1871773 - RNA, 21 nt, Salmonella typhimurium LT2
agagcgcgcucugccuuuuuu

SEQ ID NO: 1871774 - RNA, 21 nt, Salmonella typhimurium LT2
agagcgauaaacucagcgcca

SEQ ID NO: 1871775 - RNA, 16 nt, Salmonella typhimurium LT2
agagcuuauuuugacu

SEQ ID NO: 1871776 - RNA, 14 nt, Salmonella typhimurium LT2
agagguaauuuggc

SEQ ID NO: 1871777 - RNA, 18 nt, Salmonella typhimurium LT2
agaguauaagcgccgcug

SEQ ID NO: 1871778 - RNA, 15 nt, Salmonella typhimurium LT2
agagucuaccgccgu

SEQ ID NO: 1871779 - RNA, 13 nt, Salmonella typhimurium LT2
agaguccagccau

SEQ ID NO: 1871780 - RNA, 22 nt, Salmonella typhimurium LT2
agaguccauucggccugcggug

SEQ ID NO: 1871781 - RNA, 19 nt, Salmonella typhimurium LT2
agacuacaugccaacuuua

SEQ ID NO: 1871782 - RNA, 19 nt, Salmonella typhimurium LT2
agagacuggcgacagccgc

SEQ ID NO: 1871783 - RNA, 20 nt, Salmonella typhimurium LT2
agacucaacugcgggaagua

SEQ ID NO: 1871784 - RNA, 18 nt, Salmonella typhimurium LT2
agacuauccguccucuuu

SEQ ID NO: 1871785 - RNA, 23 nt, Salmonella typhimurium LT2
agacuauccguccucuuucccuu

SEQ ID NO: 1871786 - RNA, 18 nt, Salmonella typhimurium LT2
agagaguuccuccuggcu

SEQ ID NO: 1871787 - RNA, 19 nt, Salmonella typhimurium LT2
agagagcgggccguggcca

SEQ ID NO: 1871788 - RNA, 20 nt, Salmonella typhimurium LT2
agagagauccugagaaauca

SEQ ID NO: 1871789 - RNA, 13 nt, Salmonella typhimurium LT2
agagauccagaac

SEQ ID NO: 1871790 - RNA, 23 nt, Salmonella typhimurium LT2
agagauaucccaucgacuuaaaa

SEQ ID NO: 1871791 - RNA, 19 nt, Salmonella typhimurium LT2
agauacugcgcguggcaaa

SEQ ID NO: 1871792 - RNA, 17 nt, Salmonella typhimurium LT2
agauacggauucuuaac

SEQ ID NO: 1871793 - RNA, 14 nt, Salmonella typhimurium LT2
agauagagaaggcu

SEQ ID NO: 1871794 - RNA, 17 nt, Salmonella typhimurium LT2
agauagcguauuauaaa

SEQ ID NO: 1871795 - RNA, 20 nt, Salmonella typhimurium LT2
agauaggcgcgaaauguccc

SEQ ID NO: 1871796 - RNA, 21 nt, Salmonella typhimurium LT2
agauagccugccagcaccagc

SEQ ID NO: 1871797 - RNA, 23 nt, Salmonella typhimurium LT2
agauaauuuucccaguucaucca

SEQ ID NO: 1871798 - RNA, 21 nt, Salmonella typhimurium LT2
agauaccuaucggaagaaaac

SEQ ID NO: 1871799 - RNA, 22 nt, Salmonella typhimurium LT2
agauacauucccuuugguggag

SEQ ID NO: 1871800 - RNA, 15 nt, Salmonella typhimurium LT2
agauaccaaauuacg

SEQ ID NO: 1871801 - RNA, 18 nt, Salmonella typhimurium LT2
agagugacgguuuucacu

SEQ ID NO: 1871802 - RNA, 20 nt, Salmonella typhimurium LT2
agagugacgguuuucacugg

SEQ ID NO: 1871803 - RNA, 20 nt, Salmonella typhimurium LT2
agagugauccaccaccagca

SEQ ID NO: 1871804 - RNA, 21 nt, Salmonella typhimurium LT2
agagucuuccgguaucccaaa

SEQ ID NO: 1871805 - RNA, 19 nt, Salmonella typhimurium LT2
agaguuguugaccaacaau

SEQ ID NO: 1871806 - RNA, 16 nt, Salmonella typhimurium LT2
agauauuauaaaauaa

SEQ ID NO: 1871807 - RNA, 15 nt, Salmonella typhimurium LT2
agauaucaaacacaa

SEQ ID NO: 1871808 - RNA, 18 nt, Salmonella typhimurium LT2
agauaucaaacacaaauu

SEQ ID NO: 1871809 - RNA, 22 nt, Salmonella typhimurium LT2
agauaucuguauaaauaaaauu

SEQ ID NO: 1871810 - RNA, 14 nt, Salmonella typhimurium LT2
agauauggcacuuu

SEQ ID NO: 1871811 - RNA, 17 nt, Salmonella typhimurium LT2
agauagucaucaccauu

SEQ ID NO: 1871812 - RNA, 16 nt, Salmonella typhimurium LT2
agauagucgaucccca

SEQ ID NO: 1871813 - RNA, 15 nt, Salmonella typhimurium LT2
agauagggccaggcg

SEQ ID NO: 1871814 - RNA, 21 nt, Salmonella typhimurium LT2
agauauaguuuuucaagaauu

SEQ ID NO: 1871815 - RNA, 21 nt, Salmonella typhimurium LT2
agauauuuuguuuuaaauuca

SEQ ID NO: 1871816 - RNA, 22 nt, Salmonella typhimurium LT2
agauauuuuguuuuaaauucaa

SEQ ID NO: 1871817 - RNA, 13 nt, Salmonella typhimurium LT2
agaucaaaaaucu

SEQ ID NO: 1871818 - RNA, 23 nt, Salmonella typhimurium LT2
agaucacgcugggcgaauaccca

SEQ ID NO: 1871819 - RNA, 20 nt, Salmonella typhimurium LT2
agaucagcagaacaaaggcu

SEQ ID NO: 1871820 - RNA, 19 nt, Salmonella typhimurium LT2
agaucaggaguaaauaaca

SEQ ID NO: 1871821 - RNA, 21 nt, Salmonella typhimurium LT2
agaucaggaguaaauaacaaa

SEQ ID NO: 1871822 - RNA, 13 nt, Salmonella typhimurium LT2
agaugcauaaaaa

SEQ ID NO: 1871823 - RNA, 17 nt, Salmonella typhimurium LT2
agaugcccgcagaucug

SEQ ID NO: 1871824 - RNA, 16 nt, Salmonella typhimurium LT2
agaugcauaaaaaaac

SEQ ID NO: 1871825 - RNA, 23 nt, Salmonella typhimurium LT2
agaugacgccauuggcucggcgu

SEQ ID NO: 1871826 - RNA, 14 nt, Salmonella typhimurium LT2
agaugaugauuuau

SEQ ID NO: 1871827 - RNA, 16 nt, Salmonella typhimurium LT2
agaucuucccaguuau

SEQ ID NO: 1871828 - RNA, 15 nt, Salmonella typhimurium LT2
agaucucuaucggca

SEQ ID NO: 1871829 - RNA, 18 nt, Salmonella typhimurium LT2
agaucugcauccggggcg

SEQ ID NO: 1871830 - RNA, 21 nt, Salmonella typhimurium LT2
agaucuggcgaaaguaaccaa

SEQ ID NO: 1871831 - RNA, 14 nt, Salmonella typhimurium LT2
agaucuuuuugcuc

SEQ ID NO: 1871832 - RNA, 16 nt, Salmonella typhimurium LT2
agaucuuucaccccca

SEQ ID NO: 1871833 - RNA, 21 nt, Salmonella typhimurium LT2
agaucuuucacccccagcuga

SEQ ID NO: 1871834 - RNA, 14 nt, Salmonella typhimurium LT2
agaugaacucgacg

SEQ ID NO: 1871835 - RNA, 21 nt, Salmonella typhimurium LT2
agaugaccaaagcuauucaca

SEQ ID NO: 1871836 - RNA, 14 nt, Salmonella typhimurium LT2
agaugaaugacugu

SEQ ID NO: 1871837 - RNA, 15 nt, Salmonella typhimurium LT2
agaugaaugacuguc

SEQ ID NO: 1871838 - RNA, 18 nt, Salmonella typhimurium LT2
agaucgccagcguuagca

SEQ ID NO: 1871839 - RNA, 19 nt, Salmonella typhimurium LT2
agaucgccgucgauuuaau

SEQ ID NO: 1871840 - RNA, 16 nt, Salmonella typhimurium LT2
agaucgcuuuccagcg

SEQ ID NO: 1871841 - RNA, 17 nt, Salmonella typhimurium LT2
agaucgguaauuuccac

SEQ ID NO: 1871842 - RNA, 19 nt, Salmonella typhimurium LT2
agaucguuauccagcagcc

SEQ ID NO: 1871843 - RNA, 20 nt, Salmonella typhimurium LT2
agaucguuauuaaacagaca

SEQ ID NO: 1871844 - RNA, 21 nt, Salmonella typhimurium LT2
agauccacugagcgcgccaug

SEQ ID NO: 1871845 - RNA, 21 nt, Salmonella typhimurium LT2
agauccauuaaaugcgccagc

SEQ ID NO: 1871846 - RNA, 18 nt, Salmonella typhimurium LT2
agauccuggcgaaagcga

SEQ ID NO: 1871847 - RNA, 17 nt, Salmonella typhimurium LT2
agauccuuaacgucaaa

SEQ ID NO: 1871848 - RNA, 23 nt, Salmonella typhimurium LT2
agauccugagaaaucaacgugac

SEQ ID NO: 1871849 - RNA, 13 nt, Salmonella typhimurium LT2
agauccgcaagag

SEQ ID NO: 1871850 - RNA, 21 nt, Salmonella typhimurium LT2
agaugcguuggcucgcugcca

SEQ ID NO: 1871851 - RNA, 21 nt, Salmonella typhimurium LT2
agaugcugucuuagugaaaua

SEQ ID NO: 1871852 - RNA, 16 nt, Salmonella typhimurium LT2
agaugcuuaaugcucu

SEQ ID NO: 1871853 - RNA, 16 nt, Salmonella typhimurium LT2
agauggcaagauuaac

SEQ ID NO: 1871854 - RNA, 16 nt, Salmonella typhimurium LT2
agauggcgcuaaaacc

SEQ ID NO: 1871855 - RNA, 16 nt, Salmonella typhimurium LT2
agauggcggcugcgcc

SEQ ID NO: 1871856 - RNA, 20 nt, Salmonella typhimurium LT2
agauuaauaauugagcgcaa

SEQ ID NO: 1871857 - RNA, 15 nt, Salmonella typhimurium LT2
agauuaaucagcaga

SEQ ID NO: 1871858 - RNA, 16 nt, Salmonella typhimurium LT2
agauuaacagcuucau

SEQ ID NO: 1871859 - RNA, 19 nt, Salmonella typhimurium LT2
agauguucuaucuuucaga

SEQ ID NO: 1871860 - RNA, 22 nt, Salmonella typhimurium LT2
agauguugagcaaugggaagga

SEQ ID NO: 1871861 - RNA, 20 nt, Salmonella typhimurium LT2
agauguugauacagaaaacc

SEQ ID NO: 1871862 - RNA, 21 nt, Salmonella typhimurium LT2
agauguuuuaaucucuucuau

SEQ ID NO: 1871863 - RNA, 17 nt, Salmonella typhimurium LT2
agauugacagaauaaug

SEQ ID NO: 1871864 - RNA, 14 nt, Salmonella typhimurium LT2
agauucuaacauaa

SEQ ID NO: 1871865 - RNA, 10 nt, Salmonella typhimurium LT2
agauucugau

SEQ ID NO: 1871866 - RNA, 21 nt, Salmonella typhimurium LT2
agauucugcgguaauaugcca

SEQ ID NO: 1871867 - RNA, 14 nt, Salmonella typhimurium LT2
agauugauuuauuc

SEQ ID NO: 1871868 - RNA, 21 nt, Salmonella typhimurium LT2
agauugaguuugauagcgcua

SEQ ID NO: 1871869 - RNA, 19 nt, Salmonella typhimurium LT2
agauugauaaucagcaaga

SEQ ID NO: 1871870 - RNA, 16 nt, Salmonella typhimurium LT2
agauuauacucaagaa

SEQ ID NO: 1871871 - RNA, 17 nt, Salmonella typhimurium LT2
agauuagccaggugacu

SEQ ID NO: 1871872 - RNA, 20 nt, Salmonella typhimurium LT2
agauuacucccuugccagcg

SEQ ID NO: 1871873 - RNA, 19 nt, Salmonella typhimurium LT2
agauucaccaccacccgau

SEQ ID NO: 1871874 - RNA, 12 nt, Salmonella typhimurium LT2
acuccuuuuacc

SEQ ID NO: 1871875 - RNA, 15 nt, Salmonella typhimurium LT2
acuccugggcaaaau

SEQ ID NO: 1871876 - RNA, 17 nt, Salmonella typhimurium LT2
acuccuuagauuaauca

SEQ ID NO: 1871877 - RNA, 19 nt, Salmonella typhimurium LT2
acucgaggaacuguucagc

SEQ ID NO: 1871878 - RNA, 11 nt, Salmonella typhimurium LT2
acuccugcaac

SEQ ID NO: 1871879 - RNA, 15 nt, Salmonella typhimurium LT2
acuccugcaacagaa

SEQ ID NO: 1871880 - RNA, 20 nt, Salmonella typhimurium LT2
acucaaggcuauuagccaaa

SEQ ID NO: 1871881 - RNA, 21 nt, Salmonella typhimurium LT2
acucaauaaccucuacacauu

SEQ ID NO: 1871882 - RNA, 22 nt, Salmonella typhimurium LT2
acucaaugacgacuaaaaaaau

SEQ ID NO: 1871883 - RNA, 22 nt, Salmonella typhimurium LT2
acucaaugacuuuaaugcccuc

SEQ ID NO: 1871884 - RNA, 18 nt, Salmonella typhimurium LT2
acuccuaagagaaaaccc

SEQ ID NO: 1871885 - RNA, 14 nt, Salmonella typhimurium LT2
acuccggugcccau

SEQ ID NO: 1871886 - RNA, 23 nt, Salmonella typhimurium LT2
acucuuuuuccgcgagagaaaaa

SEQ ID NO: 1871887 - RNA, 15 nt, Salmonella typhimurium LT2
acucuuuugcagcaa

SEQ ID NO: 1871888 - RNA, 16 nt, Salmonella typhimurium LT2
acucucuccaguuugc

SEQ ID NO: 1871889 - RNA, 15 nt, Salmonella typhimurium LT2
acucucucuguaaua

SEQ ID NO: 1871890 - RNA, 16 nt, Salmonella typhimurium LT2
acucugcucuuugaca

SEQ ID NO: 1871891 - RNA, 16 nt, Salmonella typhimurium LT2
acucggcgaucaccac

SEQ ID NO: 1871892 - RNA, 22 nt, Salmonella typhimurium LT2
acucgcuccuugauugcaagaa

SEQ ID NO: 1871893 - RNA, 22 nt, Salmonella typhimurium LT2
acucgaugagcaaugcagaagu

SEQ ID NO: 1871894 - RNA, 16 nt, Salmonella typhimurium LT2
acucgcugcgcucgcc

SEQ ID NO: 1871895 - RNA, 15 nt, Salmonella typhimurium LT2
acucgacuuuuuccg

SEQ ID NO: 1871896 - RNA, 19 nt, Salmonella typhimurium LT2
acugaucaguuugccuuua

SEQ ID NO: 1871897 - RNA, 20 nt, Salmonella typhimurium LT2
acugaucgcuggugcccggu

SEQ ID NO: 1871898 - RNA, 21 nt, Salmonella typhimurium LT2
acugauggaguuucaucagca

SEQ ID NO: 1871899 - RNA, 15 nt, Salmonella typhimurium LT2
acugaugugacauuu

SEQ ID NO: 1871900 - RNA, 24 nt, Salmonella typhimurium LT2
acugauggcguggcgcaguaaagg

SEQ ID NO: 1871901 - RNA, 13 nt, Salmonella typhimurium LT2
acugauggcuggc

SEQ ID NO: 1871902 - RNA, 15 nt, Salmonella typhimurium LT2
acugauuaauugcga

SEQ ID NO: 1871903 - RNA, 17 nt, Salmonella typhimurium LT2
acugauucaaaagguga

SEQ ID NO: 1871904 - RNA, 21 nt, Salmonella typhimurium LT2
acugcaaaggagguucaucau

SEQ ID NO: 1871905 - RNA, 20 nt, Salmonella typhimurium LT2
acugauuuugccgauacugc

SEQ ID NO: 1871906 - RNA, 22 nt, Salmonella typhimurium LT2
acugcaaccgacgaacaaaaua

SEQ ID NO: 1871907 - RNA, 13 nt, Salmonella typhimurium LT2
acugcaacgccag

SEQ ID NO: 1871908 - RNA, 19 nt, Salmonella typhimurium LT2
acugcaaauaccacaucag

SEQ ID NO: 1871909 - RNA, 15 nt, Salmonella typhimurium LT2
acugacugcugucau

SEQ ID NO: 1871910 - RNA, 17 nt, Salmonella typhimurium LT2
acugacuucaucaaaua

SEQ ID NO: 1871911 - RNA, 13 nt, Salmonella typhimurium LT2
acugaaaaucaaa

SEQ ID NO: 1871912 - RNA, 21 nt, Salmonella typhimurium LT2
acugaguauuggcaagaauca

SEQ ID NO: 1871913 - RNA, 15 nt, Salmonella typhimurium LT2
acugagugugucuuu

SEQ ID NO: 1871914 - RNA, 22 nt, Salmonella typhimurium LT2
acugaguuucaccgccagagca

SEQ ID NO: 1871915 - RNA, 16 nt, Salmonella typhimurium LT2
acugagcuaacgaccc

SEQ ID NO: 1871916 - RNA, 18 nt, Salmonella typhimurium LT2
acugauaagggccuucau

SEQ ID NO: 1871917 - RNA, 19 nt, Salmonella typhimurium LT2
acugauacuggauaaccgc

SEQ ID NO: 1871918 - RNA, 15 nt, Salmonella typhimurium LT2
acugauaguuuaaau

SEQ ID NO: 1871919 - RNA, 23 nt, Salmonella typhimurium LT2
acugauaucuaugguaauuuaaa

SEQ ID NO: 1871920 - RNA, 17 nt, Salmonella typhimurium LT2
acugauagcgaggcagc

SEQ ID NO: 1871921 - RNA, 16 nt, Salmonella typhimurium LT2
acugccguauccaggg

SEQ ID NO: 1871922 - RNA, 15 nt, Salmonella typhimurium LT2
acugccgcagccgcu

SEQ ID NO: 1871923 - RNA, 21 nt, Salmonella typhimurium LT2
acugccgcccaucgccacagc

SEQ ID NO: 1871924 - RNA, 21 nt, Salmonella typhimurium LT2
acugccgcagccgcucagggu

SEQ ID NO: 1871925 - RNA, 18 nt, Salmonella typhimurium LT2
acugcgcgaaauacggac

SEQ ID NO: 1871926 - RNA, 19 nt, Salmonella typhimurium LT2
acugcggagguuucuuuuu

SEQ ID NO: 1871927 - RNA, 20 nt, Salmonella typhimurium LT2
acugcgcucuaucaccgccc

SEQ ID NO: 1871928 - RNA, 22 nt, Salmonella typhimurium LT2
acugcgcgccgaagcugaccag

SEQ ID NO: 1871929 - RNA, 12 nt, Salmonella typhimurium LT2
acugcgcccgca

SEQ ID NO: 1871930 - RNA, 22 nt, Salmonella typhimurium LT2
acugcccaaauaaaagccgcca

SEQ ID NO: 1871931 - RNA, 12 nt, Salmonella typhimurium LT2
acugcccggcau

SEQ ID NO: 1871932 - RNA, 13 nt, Salmonella typhimurium LT2
acugcccggcaua

SEQ ID NO: 1871933 - RNA, 15 nt, Salmonella typhimurium LT2
acugcacgccagggu

SEQ ID NO: 1871934 - RNA, 22 nt, Salmonella typhimurium LT2
acuggcagccucguccugcaau

SEQ ID NO: 1871935 - RNA, 15 nt, Salmonella typhimurium LT2
acuggcauugugagc

SEQ ID NO: 1871936 - RNA, 12 nt, Salmonella typhimurium LT2
acuggccuccca

SEQ ID NO: 1871937 - RNA, 16 nt, Salmonella typhimurium LT2
acuggcgaccggcagc

SEQ ID NO: 1871938 - RNA, 18 nt, Salmonella typhimurium LT2
acuggccuuuuuuuuacc

SEQ ID NO: 1871939 - RNA, 14 nt, Salmonella typhimurium LT2
acuggcggcgggca

SEQ ID NO: 1871940 - RNA, 17 nt, Salmonella typhimurium LT2
acuggcuuuccugauca

SEQ ID NO: 1871941 - RNA, 15 nt, Salmonella typhimurium LT2
acuggcuuucaucca

SEQ ID NO: 1871942 - RNA, 20 nt, Salmonella typhimurium LT2
acuggguaaggcgcuugccu

SEQ ID NO: 1871943 - RNA, 19 nt, Salmonella typhimurium LT2
acugggucaaaaauuguug

SEQ ID NO: 1871944 - RNA, 20 nt, Salmonella typhimurium LT2
acuggugcccgcaaaaccuu

SEQ ID NO: 1871945 - RNA, 19 nt, Salmonella typhimurium LT2
acuggugcccgcaaaaccu

SEQ ID NO: 1871946 - RNA, 21 nt, Salmonella typhimurium LT2
acugguggcaagauaagccgu

SEQ ID NO: 1871947 - RNA, 14 nt, Salmonella typhimurium LT2
acugggugccauga

SEQ ID NO: 1871948 - RNA, 18 nt, Salmonella typhimurium LT2
acuggucaaacaaaucau

SEQ ID NO: 1871949 - RNA, 14 nt, Salmonella typhimurium LT2
acugcgugcuggcg

SEQ ID NO: 1871950 - RNA, 18 nt, Salmonella typhimurium LT2
acugcugacaaucagcac

SEQ ID NO: 1871951 - RNA, 20 nt, Salmonella typhimurium LT2
acugcugcguaaagaucugc

SEQ ID NO: 1871952 - RNA, 22 nt, Salmonella typhimurium LT2
acugcucuaccaacugagcuaa

SEQ ID NO: 1871953 - RNA, 19 nt, Salmonella typhimurium LT2
acugcucauaacccuccug

SEQ ID NO: 1871954 - RNA, 23 nt, Salmonella typhimurium LT2
acugcuuuuccggcagcgcauaa

SEQ ID NO: 1871955 - RNA, 14 nt, Salmonella typhimurium LT2
acugcuuugaucac

SEQ ID NO: 1871956 - RNA, 18 nt, Salmonella typhimurium LT2
acugcuuagcucaucagc

SEQ ID NO: 1871957 - RNA, 18 nt, Salmonella typhimurium LT2
acugcugcccuggaaccu

SEQ ID NO: 1871958 - RNA, 15 nt, Salmonella typhimurium LT2
acuggaauucguuac

SEQ ID NO: 1871959 - RNA, 22 nt, Salmonella typhimurium LT2
acuggacaacauuucgcacccu

SEQ ID NO: 1871960 - RNA, 15 nt, Salmonella typhimurium LT2
acuggaaacagccaa

SEQ ID NO: 1871961 - RNA, 14 nt, Salmonella typhimurium LT2
acuggaaaaagacc

SEQ ID NO: 1871962 - RNA, 21 nt, Salmonella typhimurium LT2
acugcuggcgagcagaaaaag

SEQ ID NO: 1871963 - RNA, 19 nt, Salmonella typhimurium LT2
acuggaaaagcgacauucc

SEQ ID NO: 1871964 - RNA, 12 nt, Salmonella typhimurium LT2
acuuaaauaaaa

SEQ ID NO: 1871965 - RNA, 11 nt, Salmonella typhimurium LT2
acuuaaaaaca

SEQ ID NO: 1871966 - RNA, 13 nt, Salmonella typhimurium LT2
acuuaaaaacaaa

SEQ ID NO: 1871967 - RNA, 17 nt, Salmonella typhimurium LT2
acugguuuguugcgucu

SEQ ID NO: 1871968 - RNA, 14 nt, Salmonella typhimurium LT2
acugucgccaggcc

SEQ ID NO: 1871969 - RNA, 16 nt, Salmonella typhimurium LT2
acugucgccaggccau

SEQ ID NO: 1871970 - RNA, 23 nt, Salmonella typhimurium LT2
acugucggcuauguagcgcugaa

SEQ ID NO: 1871971 - RNA, 17 nt, Salmonella typhimurium LT2
acuguucggcggggauc

SEQ ID NO: 1871972 - RNA, 19 nt, Salmonella typhimurium LT2
acuguuagcgaaacugccu

SEQ ID NO: 1871973 - RNA, 21 nt, Salmonella typhimurium LT2
acuguucaucaaagaaaacca

SEQ ID NO: 1871974 - RNA, 18 nt, Salmonella typhimurium LT2
acugucugaaucaaugca

SEQ ID NO: 1871975 - RNA, 16 nt, Salmonella typhimurium LT2
acuuaucaacuucuuc

SEQ ID NO: 1871976 - RNA, 22 nt, Salmonella typhimurium LT2
acuuaucagcguguuucaucuc

SEQ ID NO: 1871977 - RNA, 21 nt, Salmonella typhimurium LT2
acuuaucccacaacuguucuu

SEQ ID NO: 1871978 - RNA, 12 nt, Salmonella typhimurium LT2
acuuaucauuuu

SEQ ID NO: 1871979 - RNA, 12 nt, Salmonella typhimurium LT2
acuucaaucacu

SEQ ID NO: 1871980 - RNA, 15 nt, Salmonella typhimurium LT2
acuucacacgaacuu

SEQ ID NO: 1871981 - RNA, 18 nt, Salmonella typhimurium LT2
acuuccgcacgcgcgccc

SEQ ID NO: 1871982 - RNA, 17 nt, Salmonella typhimurium LT2
acuuccccuguaacugc

SEQ ID NO: 1871983 - RNA, 15 nt, Salmonella typhimurium LT2
acuuccgcaucaaua

SEQ ID NO: 1871984 - RNA, 20 nt, Salmonella typhimurium LT2
acuuccggcucgccacggcc

SEQ ID NO: 1871985 - RNA, 20 nt, Salmonella typhimurium LT2
acuuccgguauccguucauc

SEQ ID NO: 1871986 - RNA, 13 nt, Salmonella typhimurium LT2
acuucccacugua

SEQ ID NO: 1871987 - RNA, 14 nt, Salmonella typhimurium LT2
acuucccacuguaa

SEQ ID NO: 1871988 - RNA, 14 nt, Salmonella typhimurium LT2
acuucagccagcug

SEQ ID NO: 1871989 - RNA, 12 nt, Salmonella typhimurium LT2
acuucacgcugg

SEQ ID NO: 1871990 - RNA, 16 nt, Salmonella typhimurium LT2
acuucacgccauucca

SEQ ID NO: 1871991 - RNA, 22 nt, Salmonella typhimurium LT2
acguaauugccauuacgauaaa

SEQ ID NO: 1871992 - RNA, 13 nt, Salmonella typhimurium LT2
acguaauaccuga

SEQ ID NO: 1871993 - RNA, 12 nt, Salmonella typhimurium LT2
acguaauaccug

SEQ ID NO: 1871994 - RNA, 14 nt, Salmonella typhimurium LT2
acguaauauuaagc

SEQ ID NO: 1871995 - RNA, 13 nt, Salmonella typhimurium LT2
acguaccggcaac

SEQ ID NO: 1871996 - RNA, 14 nt, Salmonella typhimurium LT2
acgucgaugaaacg

SEQ ID NO: 1871997 - RNA, 18 nt, Salmonella typhimurium LT2
acgucgccuuccugcagg

SEQ ID NO: 1871998 - RNA, 17 nt, Salmonella typhimurium LT2
acgucgcgaagcugugc

SEQ ID NO: 1871999 - RNA, 13 nt, Salmonella typhimurium LT2
acgucgcaucacc

SEQ ID NO: 1872000 - RNA, 14 nt, Salmonella typhimurium LT2
acgucguaaaaccu

SEQ ID NO: 1872001 - RNA, 21 nt, Salmonella typhimurium LT2
acgucggugaaaaugaaaaau

SEQ ID NO: 1872002 - RNA, 13 nt, Salmonella typhimurium LT2
acgucugaagaag

SEQ ID NO: 1872003 - RNA, 22 nt, Salmonella typhimurium LT2
acgugcauuauuuuagugaaaa

SEQ ID NO: 1872004 - RNA, 18 nt, Salmonella typhimurium LT2
acgugccagaaacaagaa

SEQ ID NO: 1872005 - RNA, 17 nt, Salmonella typhimurium LT2
acgugcuccagcgccug

SEQ ID NO: 1872006 - RNA, 13 nt, Salmonella typhimurium LT2
acguuuuccugcg

SEQ ID NO: 1872007 - RNA, 17 nt, Salmonella typhimurium LT2
acguuuuuacucuuguu

SEQ ID NO: 1872008 - RNA, 18 nt, Salmonella typhimurium LT2
acguuggggauaaccaga

SEQ ID NO: 1872009 - RNA, 18 nt, Salmonella typhimurium LT2
acguuugaccugcagcuc

SEQ ID NO: 1872010 - RNA, 17 nt, Salmonella typhimurium LT2
acguuucuuucaucaga

SEQ ID NO: 1872011 - RNA, 16 nt, Salmonella typhimurium LT2
acguuugaacagcagc

SEQ ID NO: 1872012 - RNA, 23 nt, Salmonella typhimurium LT2
acguuuccggaaugagaugcacg

SEQ ID NO: 1872013 - RNA, 15 nt, Salmonella typhimurium LT2
acguuagccucgguc

SEQ ID NO: 1872014 - RNA, 14 nt, Salmonella typhimurium LT2
acguuauucuccag

SEQ ID NO: 1872015 - RNA, 15 nt, Salmonella typhimurium LT2
acuagacagccucuc

SEQ ID NO: 1872016 - RNA, 22 nt, Salmonella typhimurium LT2
acuacggguucuuguguugaaa

SEQ ID NO: 1872017 - RNA, 17 nt, Salmonella typhimurium LT2
acuaccggcaccagcaa

SEQ ID NO: 1872018 - RNA, 18 nt, Salmonella typhimurium LT2
acuaccagaaacaacacg

SEQ ID NO: 1872019 - RNA, 20 nt, Salmonella typhimurium LT2
acuacauagcuauauuuuuu

SEQ ID NO: 1872020 - RNA, 21 nt, Salmonella typhimurium LT2
acuaauuuaagcgauucuaaa

SEQ ID NO: 1872021 - RNA, 15 nt, Salmonella typhimurium LT2
acuaaaguuuauuua

SEQ ID NO: 1872022 - RNA, 16 nt, Salmonella typhimurium LT2
acuaaugccuggcagu

SEQ ID NO: 1872023 - RNA, 16 nt, Salmonella typhimurium LT2
acuauaacgcgcugcu

SEQ ID NO: 1872024 - RNA, 22 nt, Salmonella typhimurium LT2
acuaucaguuuuggcaaucaca

SEQ ID NO: 1872025 - RNA, 20 nt, Salmonella typhimurium LT2
acuaucacacugacaauaaa

SEQ ID NO: 1872026 - RNA, 16 nt, Salmonella typhimurium LT2
acuauccuggccugau

SEQ ID NO: 1872027 - RNA, 20 nt, Salmonella typhimurium LT2
acuauguugacgcuaaccuc

SEQ ID NO: 1872028 - RNA, 16 nt, Salmonella typhimurium LT2
acuauugucgucuggu

SEQ ID NO: 1872029 - RNA, 14 nt, Salmonella typhimurium LT2
acucaaaaagagga

SEQ ID NO: 1872030 - RNA, 23 nt, Salmonella typhimurium LT2
acucaaaccugcgccgcgauaaa

SEQ ID NO: 1872031 - RNA, 14 nt, Salmonella typhimurium LT2
acucaaagaaaaca

SEQ ID NO: 1872032 - RNA, 23 nt, Salmonella typhimurium LT2
acucaaaccccagauuacugccc

SEQ ID NO: 1872033 - RNA, 18 nt, Salmonella typhimurium LT2
acggcccguaauauugac

SEQ ID NO: 1872034 - RNA, 18 nt, Salmonella typhimurium LT2
acggcccguacugaaccc

SEQ ID NO: 1872035 - RNA, 14 nt, Salmonella typhimurium LT2
acggcccaggcauc

SEQ ID NO: 1872036 - RNA, 20 nt, Salmonella typhimurium LT2
acggccugcaaacgaaucac

SEQ ID NO: 1872037 - RNA, 13 nt, Salmonella typhimurium LT2
acggcgaccaaaa

SEQ ID NO: 1872038 - RNA, 15 nt, Salmonella typhimurium LT2
acggcgagaccauau

SEQ ID NO: 1872039 - RNA, 14 nt, Salmonella typhimurium LT2
acggcggaccccuc

SEQ ID NO: 1872040 - RNA, 22 nt, Salmonella typhimurium LT2
acggcaacggcgacaagaauau

SEQ ID NO: 1872041 - RNA, 18 nt, Salmonella typhimurium LT2
acggcaacggauuguggc

SEQ ID NO: 1872042 - RNA, 13 nt, Salmonella typhimurium LT2
acggcaacaguac

SEQ ID NO: 1872043 - RNA, 19 nt, Salmonella typhimurium LT2
acggcaaaaagcauaugcg

SEQ ID NO: 1872044 - RNA, 15 nt, Salmonella typhimurium LT2
acggauccagaacug

SEQ ID NO: 1872045 - RNA, 13 nt, Salmonella typhimurium LT2
acggaucagccug

SEQ ID NO: 1872046 - RNA, 16 nt, Salmonella typhimurium LT2
acggaucagccugagc

SEQ ID NO: 1872047 - RNA, 14 nt, Salmonella typhimurium LT2
acggcaaugaccgc

SEQ ID NO: 1872048 - RNA, 16 nt, Salmonella typhimurium LT2
acgcuuuugcgcacug

SEQ ID NO: 1872049 - RNA, 18 nt, Salmonella typhimurium LT2
acggacgcagaccaaaau

SEQ ID NO: 1872050 - RNA, 14 nt, Salmonella typhimurium LT2
acggacagaaaaaa

SEQ ID NO: 1872051 - RNA, 18 nt, Salmonella typhimurium LT2
acggaaccaaaugcccag

SEQ ID NO: 1872052 - RNA, 14 nt, Salmonella typhimurium LT2
acggaaccaaaaua

SEQ ID NO: 1872053 - RNA, 14 nt, Salmonella typhimurium LT2
acggaagguaauaa

SEQ ID NO: 1872054 - RNA, 19 nt, Salmonella typhimurium LT2
acggaagguaauaauccuc

SEQ ID NO: 1872055 - RNA, 23 nt, Salmonella typhimurium LT2
acgcugguuugugugcaggagca

SEQ ID NO: 1872056 - RNA, 17 nt, Salmonella typhimurium LT2
acgcugguuucggcauc

SEQ ID NO: 1872057 - RNA, 19 nt, Salmonella typhimurium LT2
acgcugguuugugugcagg

SEQ ID NO: 1872058 - RNA, 19 nt, Salmonella typhimurium LT2
acgcuggcacuuuccgguu

SEQ ID NO: 1872059 - RNA, 20 nt, Salmonella typhimurium LT2
acgcuggcaucaauauggau

SEQ ID NO: 1872060 - RNA, 17 nt, Salmonella typhimurium LT2
acgcuggcacuggcagc

SEQ ID NO: 1872061 - RNA, 14 nt, Salmonella typhimurium LT2
acgcuggcacagga

SEQ ID NO: 1872062 - RNA, 17 nt, Salmonella typhimurium LT2
acgcaauagaguaauga

SEQ ID NO: 1872063 - RNA, 20 nt, Salmonella typhimurium LT2
acgggggcgaucagcagguc

SEQ ID NO: 1872064 - RNA, 15 nt, Salmonella typhimurium LT2
acgggcuuccaguac

SEQ ID NO: 1872065 - RNA, 21 nt, Salmonella typhimurium LT2
acgggccuacgcgcauguucu

SEQ ID NO: 1872066 - RNA, 17 nt, Salmonella typhimurium LT2
acgggcggaggggagga

SEQ ID NO: 1872067 - RNA, 16 nt, Salmonella typhimurium LT2
acggcggaaagggccg

SEQ ID NO: 1872068 - RNA, 12 nt, Salmonella typhimurium LT2
acgguauuucca

SEQ ID NO: 1872069 - RNA, 22 nt, Salmonella typhimurium LT2
acgguaucagcgcguuuuccau

SEQ ID NO: 1872070 - RNA, 13 nt, Salmonella typhimurium LT2
acgguaugaaaca

SEQ ID NO: 1872071 - RNA, 21 nt, Salmonella typhimurium LT2
acgguauucguuaccagcauc

SEQ ID NO: 1872072 - RNA, 14 nt, Salmonella typhimurium LT2
acgguaccugaagc

SEQ ID NO: 1872073 - RNA, 14 nt, Salmonella typhimurium LT2
acgguaaguugaaa

SEQ ID NO: 1872074 - RNA, 21 nt, Salmonella typhimurium LT2
acgguaaguugaaaggaaagg

SEQ ID NO: 1872075 - RNA, 16 nt, Salmonella typhimurium LT2
acgguaaaccgcacgg

SEQ ID NO: 1872076 - RNA, 19 nt, Salmonella typhimurium LT2
acgguaaacgugccacagu

SEQ ID NO: 1872077 - RNA, 19 nt, Salmonella typhimurium LT2
acggguuuuacuggcgcgc

SEQ ID NO: 1872078 - RNA, 20 nt, Salmonella typhimurium LT2
acggguucuuguguugaaau

SEQ ID NO: 1872079 - RNA, 16 nt, Salmonella typhimurium LT2
acgggugaucuuuaua

SEQ ID NO: 1872080 - RNA, 19 nt, Salmonella typhimurium LT2
acgggucuacaucggaagc

SEQ ID NO: 1872081 - RNA, 23 nt, Salmonella typhimurium LT2
acgguuuuauccccuucaggaau

SEQ ID NO: 1872082 - RNA, 15 nt, Salmonella typhimurium LT2
acgguguggcccagc

SEQ ID NO: 1872083 - RNA, 15 nt, Salmonella typhimurium LT2
acggugugccugcgu

SEQ ID NO: 1872084 - RNA, 13 nt, Salmonella typhimurium LT2
acguaaagcuggc

SEQ ID NO: 1872085 - RNA, 13 nt, Salmonella typhimurium LT2
acguaaauaccca

SEQ ID NO: 1872086 - RNA, 13 nt, Salmonella typhimurium LT2
acguaaaucugaa

SEQ ID NO: 1872087 - RNA, 19 nt, Salmonella typhimurium LT2
acguaaaucugaaauaaaa

SEQ ID NO: 1872088 - RNA, 23 nt, Salmonella typhimurium LT2
acguaaaucugaaauaaaagcaa

SEQ ID NO: 1872089 - RNA, 17 nt, Salmonella typhimurium LT2
acguaaauuacuuauga

SEQ ID NO: 1872090 - RNA, 20 nt, Salmonella typhimurium LT2
acguaaauuacuuaugauau

SEQ ID NO: 1872091 - RNA, 15 nt, Salmonella typhimurium LT2
acgguuuuacaguua

SEQ ID NO: 1872092 - RNA, 14 nt, Salmonella typhimurium LT2
acguaacagacgca

SEQ ID NO: 1872093 - RNA, 22 nt, Salmonella typhimurium LT2
acguaauaaccaccggcgcgcc

SEQ ID NO: 1872094 - RNA, 21 nt, Salmonella typhimurium LT2
acguaacugcgguaaauaaug

SEQ ID NO: 1872095 - RNA, 17 nt, Salmonella typhimurium LT2
acguaacuaucuguucu

SEQ ID NO: 1872096 - RNA, 15 nt, Salmonella typhimurium LT2
acguaacuuauccac

SEQ ID NO: 1872097 - RNA, 19 nt, Salmonella typhimurium LT2
acgguccguuuucgccccc

SEQ ID NO: 1872098 - RNA, 20 nt, Salmonella typhimurium LT2
acggucauaucgucaucggu

SEQ ID NO: 1872099 - RNA, 20 nt, Salmonella typhimurium LT2
agguggcggaauugguagac

SEQ ID NO: 1872100 - RNA, 16 nt, Salmonella typhimurium LT2
agguggcuagcccgcu

SEQ ID NO: 1872101 - RNA, 17 nt, Salmonella typhimurium LT2
agguggcuagcccgcug

SEQ ID NO: 1872102 - RNA, 18 nt, Salmonella typhimurium LT2
agguggugcucuaaccaa

SEQ ID NO: 1872103 - RNA, 23 nt, Salmonella typhimurium LT2
agguggugcucuaaccaacugag

SEQ ID NO: 1872104 - RNA, 18 nt, Salmonella typhimurium LT2
aggugcggauaguccugc

SEQ ID NO: 1872105 - RNA, 23 nt, Salmonella typhimurium LT2
aggugauaccuguugcacgcaug

SEQ ID NO: 1872106 - RNA, 15 nt, Salmonella typhimurium LT2
aggugagcucuuucu

SEQ ID NO: 1872107 - RNA, 16 nt, Salmonella typhimurium LT2
aggugaauaccaaagc

SEQ ID NO: 1872108 - RNA, 17 nt, Salmonella typhimurium LT2
aggugauguccagacca

SEQ ID NO: 1872109 - RNA, 13 nt, Salmonella typhimurium LT2
aggucuggcaggg

SEQ ID NO: 1872110 - RNA, 18 nt, Salmonella typhimurium LT2
aggucuugccaacaaagg

SEQ ID NO: 1872111 - RNA, 22 nt, Salmonella typhimurium LT2
aggucuuuaucuaucaccgccu

SEQ ID NO: 1872112 - RNA, 19 nt, Salmonella typhimurium LT2
aggugaacauuacaaugua

SEQ ID NO: 1872113 - RNA, 22 nt, Salmonella typhimurium LT2
aggucguuaggccacuucacac

SEQ ID NO: 1872114 - RNA, 13 nt, Salmonella typhimurium LT2
aggucguuucccc

SEQ ID NO: 1872115 - RNA, 14 nt, Salmonella typhimurium LT2
aggucguuuccccc

SEQ ID NO: 1872116 - RNA, 22 nt, Salmonella typhimurium LT2
aggucgcuauccagcaguaaau

SEQ ID NO: 1872117 - RNA, 23 nt, Salmonella typhimurium LT2
aggucgcuauccagcaguaaaua

SEQ ID NO: 1872118 - RNA, 16 nt, Salmonella typhimurium LT2
aggucaucacauccca

SEQ ID NO: 1872119 - RNA, 17 nt, Salmonella typhimurium LT2
aggucaucacaucccag

SEQ ID NO: 1872120 - RNA, 17 nt, Salmonella typhimurium LT2
agguaggaaacuuauuu

SEQ ID NO: 1872121 - RNA, 23 nt, Salmonella typhimurium LT2
agguaccgcuuaaugaguacggg

SEQ ID NO: 1872122 - RNA, 11 nt, Salmonella typhimurium LT2
agguacugcau

SEQ ID NO: 1872123 - RNA, 20 nt, Salmonella typhimurium LT2
agguacgcguuucacaaccu

SEQ ID NO: 1872124 - RNA, 16 nt, Salmonella typhimurium LT2
aggucagcaguuuuuc

SEQ ID NO: 1872125 - RNA, 19 nt, Salmonella typhimurium LT2
aggucacgccggaaaucac

SEQ ID NO: 1872126 - RNA, 16 nt, Salmonella typhimurium LT2
aggucacaucaucgcc

SEQ ID NO: 1872127 - RNA, 14 nt, Salmonella typhimurium LT2
agguauuaaauaca

SEQ ID NO: 1872128 - RNA, 14 nt, Salmonella typhimurium LT2
agguauuuagccac

SEQ ID NO: 1872129 - RNA, 14 nt, Salmonella typhimurium LT2
agguauccgccaua

SEQ ID NO: 1872130 - RNA, 16 nt, Salmonella typhimurium LT2
agguauccuaaugcca

SEQ ID NO: 1872131 - RNA, 14 nt, Salmonella typhimurium LT2
agguauccagcaga

SEQ ID NO: 1872132 - RNA, 13 nt, Salmonella typhimurium LT2
agguauccagcag

SEQ ID NO: 1872133 - RNA, 13 nt, Salmonella typhimurium LT2
agggugccaggca

SEQ ID NO: 1872134 - RNA, 22 nt, Salmonella typhimurium LT2
agggucgccgcgcccagcagca

SEQ ID NO: 1872135 - RNA, 16 nt, Salmonella typhimurium LT2
aggguauugccgagcg

SEQ ID NO: 1872136 - RNA, 17 nt, Salmonella typhimurium LT2
aggguuagcgcguugag

SEQ ID NO: 1872137 - RNA, 13 nt, Salmonella typhimurium LT2
agguaagggugaa

SEQ ID NO: 1872138 - RNA, 18 nt, Salmonella typhimurium LT2
agguaaguguaaguucau

SEQ ID NO: 1872139 - RNA, 20 nt, Salmonella typhimurium LT2
agguaaaggucguuaggcca

SEQ ID NO: 1872140 - RNA, 20 nt, Salmonella typhimurium LT2
agguaaacgcgaccagcgca

SEQ ID NO: 1872141 - RNA, 22 nt, Salmonella typhimurium LT2
agguaaagagcggcuuauaaaa

SEQ ID NO: 1872142 - RNA, 13 nt, Salmonella typhimurium LT2
agguaacauacaa

SEQ ID NO: 1872143 - RNA, 19 nt, Salmonella typhimurium LT2
agguaacgccuggggggga

SEQ ID NO: 1872144 - RNA, 16 nt, Salmonella typhimurium LT2
agguuucuucaucaaa

SEQ ID NO: 1872145 - RNA, 20 nt, Salmonella typhimurium LT2
agguuugcgcggcggguaaa

SEQ ID NO: 1872146 - RNA, 17 nt, Salmonella typhimurium LT2
aguaaaaaaaaccguau

SEQ ID NO: 1872147 - RNA, 16 nt, Salmonella typhimurium LT2
aguaaaauuuuuuuca

SEQ ID NO: 1872148 - RNA, 15 nt, Salmonella typhimurium LT2
aguaaacagguaguc

SEQ ID NO: 1872149 - RNA, 18 nt, Salmonella typhimurium LT2
aguaaaacccaauaacug

SEQ ID NO: 1872150 - RNA, 15 nt, Salmonella typhimurium LT2
aguaaaguuauucac

SEQ ID NO: 1872151 - RNA, 23 nt, Salmonella typhimurium LT2
aguaaaccggucaggcagcagac

SEQ ID NO: 1872152 - RNA, 20 nt, Salmonella typhimurium LT2
aguaaacuccucuuccgaca

SEQ ID NO: 1872153 - RNA, 17 nt, Salmonella typhimurium LT2
aguaaagauuuuuauua

SEQ ID NO: 1872154 - RNA, 21 nt, Salmonella typhimurium LT2
aguaaagauuuuuauuaaaau

SEQ ID NO: 1872155 - RNA, 17 nt, Salmonella typhimurium LT2
agguguaucccuauucu

SEQ ID NO: 1872156 - RNA, 17 nt, Salmonella typhimurium LT2
aggugucagauccuuca

SEQ ID NO: 1872157 - RNA, 17 nt, Salmonella typhimurium LT2
agguguuuacgccgcca

SEQ ID NO: 1872158 - RNA, 21 nt, Salmonella typhimurium LT2
agguguuacgcgggucgagaa

SEQ ID NO: 1872159 - RNA, 22 nt, Salmonella typhimurium LT2
aggugugguacggcuuucacac

SEQ ID NO: 1872160 - RNA, 17 nt, Salmonella typhimurium LT2
agguuauucagguggau

SEQ ID NO: 1872161 - RNA, 20 nt, Salmonella typhimurium LT2
agguuaguaaugccuucuga

SEQ ID NO: 1872162 - RNA, 13 nt, Salmonella typhimurium LT2
agguuagcagcca

SEQ ID NO: 1872163 - RNA, 24 nt, Salmonella typhimurium LT2
agguuauuaaaaagccagcguaaa

SEQ ID NO: 1872164 - RNA, 13 nt, Salmonella typhimurium LT2
agguuaaccaugc

SEQ ID NO: 1872165 - RNA, 16 nt, Salmonella typhimurium LT2
agguuaaccaugcccg

SEQ ID NO: 1872166 - RNA, 15 nt, Salmonella typhimurium LT2
agguucccgccgcca

SEQ ID NO: 1872167 - RNA, 20 nt, Salmonella typhimurium LT2
agguucgggccaccuuccag

SEQ ID NO: 1872168 - RNA, 18 nt, Salmonella typhimurium LT2
agguucaccaccacccag

SEQ ID NO: 1872169 - RNA, 19 nt, Salmonella typhimurium LT2
agguucauauugcgccgca

SEQ ID NO: 1872170 - RNA, 15 nt, Salmonella typhimurium LT2
agguuccaggcacuc

SEQ ID NO: 1872171 - RNA, 14 nt, Salmonella typhimurium LT2
agguuggcugaggc

SEQ ID NO: 1872172 - RNA, 14 nt, Salmonella typhimurium LT2
agguugaugcaaau

SEQ ID NO: 1872173 - RNA, 17 nt, Salmonella typhimurium LT2
aguaauuuuuccgccuc

SEQ ID NO: 1872174 - RNA, 13 nt, Salmonella typhimurium LT2
aguaauuuuuccg

SEQ ID NO: 1872175 - RNA, 21 nt, Salmonella typhimurium LT2
aguacaaacaaauaaauccau

SEQ ID NO: 1872176 - RNA, 13 nt, Salmonella typhimurium LT2
aguacaagcaggc

SEQ ID NO: 1872177 - RNA, 17 nt, Salmonella typhimurium LT2
aguacaauuuccugcca

SEQ ID NO: 1872178 - RNA, 18 nt, Salmonella typhimurium LT2
aguacagggcgauuuccg

SEQ ID NO: 1872179 - RNA, 15 nt, Salmonella typhimurium LT2
aguacaggguuuguc

SEQ ID NO: 1872180 - RNA, 18 nt, Salmonella typhimurium LT2
aguacaggguuugucagc

SEQ ID NO: 1872181 - RNA, 22 nt, Salmonella typhimurium LT2
aguaccauaccggugcgcccca

SEQ ID NO: 1872182 - RNA, 21 nt, Salmonella typhimurium LT2
aguaauauaaccaauuuaaaa

SEQ ID NO: 1872183 - RNA, 12 nt, Salmonella typhimurium LT2
aguaauaaaaaa

SEQ ID NO: 1872184 - RNA, 21 nt, Salmonella typhimurium LT2
aguaauaaaaaacaacucuau

SEQ ID NO: 1872185 - RNA, 17 nt, Salmonella typhimurium LT2
aguaagcuauuucugua

SEQ ID NO: 1872186 - RNA, 17 nt, Salmonella typhimurium LT2
aguaaggcauaaugcca

SEQ ID NO: 1872187 - RNA, 17 nt, Salmonella typhimurium LT2
aguaaggcugauuauau

SEQ ID NO: 1872188 - RNA, 19 nt, Salmonella typhimurium LT2
aguaaggcugauuauauaa

SEQ ID NO: 1872189 - RNA, 17 nt, Salmonella typhimurium LT2
aguaacugguuaccaca

SEQ ID NO: 1872190 - RNA, 15 nt, Salmonella typhimurium LT2
aguaacgcuggaaga

SEQ ID NO: 1872191 - RNA, 18 nt, Salmonella typhimurium LT2
aguaacgcuggaagaggc

SEQ ID NO: 1872192 - RNA, 17 nt, Salmonella typhimurium LT2
aguaacgauacccacca

SEQ ID NO: 1872193 - RNA, 22 nt, Salmonella typhimurium LT2
aguaacccgauacccugagccc

SEQ ID NO: 1872194 - RNA, 16 nt, Salmonella typhimurium LT2
aguaaccuauuuuaaa

SEQ ID NO: 1872195 - RNA, 16 nt, Salmonella typhimurium LT2
aguaaccuuucaccuu

SEQ ID NO: 1872196 - RNA, 20 nt, Salmonella typhimurium LT2
aguaaccacgauaaagacac

SEQ ID NO: 1872197 - RNA, 15 nt, Salmonella typhimurium LT2
aguaaauuuacucag

SEQ ID NO: 1872198 - RNA, 21 nt, Salmonella typhimurium LT2
aguaaauuuacucaguuugcu

SEQ ID NO: 1872199 - RNA, 16 nt, Salmonella typhimurium LT2
aguaacaccgcggcgc

SEQ ID NO: 1872200 - RNA, 17 nt, Salmonella typhimurium LT2
aguaaauuauuccuuga

SEQ ID NO: 1872201 - RNA, 22 nt, Salmonella typhimurium LT2
aggcugacaaagguugcgccaa

SEQ ID NO: 1872202 - RNA, 22 nt, Salmonella typhimurium LT2
aggcuccgagacucaaagaaaa

SEQ ID NO: 1872203 - RNA, 20 nt, Salmonella typhimurium LT2
aggcuccgagacucaaagaa

SEQ ID NO: 1872204 - RNA, 19 nt, Salmonella typhimurium LT2
aggcuaugcucccccccuu

SEQ ID NO: 1872205 - RNA, 19 nt, Salmonella typhimurium LT2
aggcucaauaugccaggca

SEQ ID NO: 1872206 - RNA, 16 nt, Salmonella typhimurium LT2
aggcuauucaauauca

SEQ ID NO: 1872207 - RNA, 21 nt, Salmonella typhimurium LT2
aggcuacgguacugcccaccu

SEQ ID NO: 1872208 - RNA, 16 nt, Salmonella typhimurium LT2
aggcuaagaucgccuu

SEQ ID NO: 1872209 - RNA, 16 nt, Salmonella typhimurium LT2
aggcuacccagacaag

SEQ ID NO: 1872210 - RNA, 17 nt, Salmonella typhimurium LT2
aggcuacccagacaagc

SEQ ID NO: 1872211 - RNA, 22 nt, Salmonella typhimurium LT2
aggcuaacaguuggcuugccag

SEQ ID NO: 1872212 - RNA, 13 nt, Salmonella typhimurium LT2
aggcguuucaaca

SEQ ID NO: 1872213 - RNA, 15 nt, Salmonella typhimurium LT2
aggcguucaugccuu

SEQ ID NO: 1872214 - RNA, 18 nt, Salmonella typhimurium LT2
aggcguugaacauuucau

SEQ ID NO: 1872215 - RNA, 16 nt, Salmonella typhimurium LT2
aggcgugacguucagg

SEQ ID NO: 1872216 - RNA, 16 nt, Salmonella typhimurium LT2
aggcgugauugagcag

SEQ ID NO: 1872217 - RNA, 12 nt, Salmonella typhimurium LT2
aggcgugcagcg

SEQ ID NO: 1872218 - RNA, 16 nt, Salmonella typhimurium LT2
aggcggcuaccgccgu

SEQ ID NO: 1872219 - RNA, 20 nt, Salmonella typhimurium LT2
aggcggauacagcggcgcgc

SEQ ID NO: 1872220 - RNA, 18 nt, Salmonella typhimurium LT2
aggcgggcuuuuuuugcc

SEQ ID NO: 1872221 - RNA, 14 nt, Salmonella typhimurium LT2
aggcggucuggauu

SEQ ID NO: 1872222 - RNA, 18 nt, Salmonella typhimurium LT2
aggcgucauagccgcgcg

SEQ ID NO: 1872223 - RNA, 15 nt, Salmonella typhimurium LT2
aggcgucaaaacagg

SEQ ID NO: 1872224 - RNA, 13 nt, Salmonella typhimurium LT2
aggcggcaaagau

SEQ ID NO: 1872225 - RNA, 15 nt, Salmonella typhimurium LT2
aggcggcaauauccu

SEQ ID NO: 1872226 - RNA, 16 nt, Salmonella typhimurium LT2
aggcgcuugcgccgcc

SEQ ID NO: 1872227 - RNA, 16 nt, Salmonella typhimurium LT2
aggcgcuugugauauc

SEQ ID NO: 1872228 - RNA, 16 nt, Salmonella typhimurium LT2
aggcggaaaucagcac

SEQ ID NO: 1872229 - RNA, 20 nt, Salmonella typhimurium LT2
aggcgcuauucccaggcaaa

SEQ ID NO: 1872230 - RNA, 15 nt, Salmonella typhimurium LT2
aggcgcgcagcugcc

SEQ ID NO: 1872231 - RNA, 14 nt, Salmonella typhimurium LT2
aggcgacauauuuu

SEQ ID NO: 1872232 - RNA, 13 nt, Salmonella typhimurium LT2
aggcgaauagcgc

SEQ ID NO: 1872233 - RNA, 14 nt, Salmonella typhimurium LT2
aggcgacccauaac

SEQ ID NO: 1872234 - RNA, 18 nt, Salmonella typhimurium LT2
aggcgaccaauauccgca

SEQ ID NO: 1872235 - RNA, 21 nt, Salmonella typhimurium LT2
aggcgaaacggcggaaccauu

SEQ ID NO: 1872236 - RNA, 23 nt, Salmonella typhimurium LT2
aggccugauucaggucaugcagg

SEQ ID NO: 1872237 - RNA, 18 nt, Salmonella typhimurium LT2
aggccugcaaaccucucc

SEQ ID NO: 1872238 - RNA, 14 nt, Salmonella typhimurium LT2
aggccugauaagcg

SEQ ID NO: 1872239 - RNA, 15 nt, Salmonella typhimurium LT2
aggcgcgaaacgccu

SEQ ID NO: 1872240 - RNA, 18 nt, Salmonella typhimurium LT2
aggcgccgccauccggca

SEQ ID NO: 1872241 - RNA, 22 nt, Salmonella typhimurium LT2
aggcgccgcucaucaccagcag

SEQ ID NO: 1872242 - RNA, 19 nt, Salmonella typhimurium LT2
aggcgcaaaaaauauguuc

SEQ ID NO: 1872243 - RNA, 15 nt, Salmonella typhimurium LT2
aggcgauagccccag

SEQ ID NO: 1872244 - RNA, 22 nt, Salmonella typhimurium LT2
aggccgggaaaucuucuacuuc

SEQ ID NO: 1872245 - RNA, 23 nt, Salmonella typhimurium LT2
aggccguagcuaucgaucccaau

SEQ ID NO: 1872246 - RNA, 20 nt, Salmonella typhimurium LT2
aggccguuauugucaugcua

SEQ ID NO: 1872247 - RNA, 15 nt, Salmonella typhimurium LT2
aggccguuauccagu

SEQ ID NO: 1872248 - RNA, 20 nt, Salmonella typhimurium LT2
aggccguucauucgccccag

SEQ ID NO: 1872249 - RNA, 19 nt, Salmonella typhimurium LT2
aggccguugugucccugga

SEQ ID NO: 1872250 - RNA, 16 nt, Salmonella typhimurium LT2
aggccuaacacaugca

SEQ ID NO: 1872251 - RNA, 22 nt, Salmonella typhimurium LT2
aggccucuuucaugcggucuuc

SEQ ID NO: 1872252 - RNA, 14 nt, Salmonella typhimurium LT2
aggccggacaggcg

SEQ ID NO: 1872253 - RNA, 23 nt, Salmonella typhimurium LT2
aggccggauaagcgucagcgcca

SEQ ID NO: 1872254 - RNA, 15 nt, Salmonella typhimurium LT2
aggccggauaagccg

SEQ ID NO: 1872255 - RNA, 16 nt, Salmonella typhimurium LT2
aggccggcauaaugau

SEQ ID NO: 1872256 - RNA, 17 nt, Salmonella typhimurium LT2
aggccgccgcacaggcg

SEQ ID NO: 1872257 - RNA, 17 nt, Salmonella typhimurium LT2
aggccgccgggucagaa

SEQ ID NO: 1872258 - RNA, 21 nt, Salmonella typhimurium LT2
aggccgccgggucagaaaagc

SEQ ID NO: 1872259 - RNA, 21 nt, Salmonella typhimurium LT2
aggccgccagcgugacccaga

SEQ ID NO: 1872260 - RNA, 23 nt, Salmonella typhimurium LT2
agggcaggggccagcauaguaaa

SEQ ID NO: 1872261 - RNA, 13 nt, Salmonella typhimurium LT2
agggcggcuggau

SEQ ID NO: 1872262 - RNA, 16 nt, Salmonella typhimurium LT2
agggcggcaggaugaa

SEQ ID NO: 1872263 - RNA, 21 nt, Salmonella typhimurium LT2
agggcggcgcgcugccgcccu

SEQ ID NO: 1872264 - RNA, 23 nt, Salmonella typhimurium LT2
agggcgaacauuccgcccaggaa

SEQ ID NO: 1872265 - RNA, 22 nt, Salmonella typhimurium LT2
agggcgauauccagcgccagga

SEQ ID NO: 1872266 - RNA, 14 nt, Salmonella typhimurium LT2
aggguauacaaaaa

SEQ ID NO: 1872267 - RNA, 14 nt, Salmonella typhimurium LT2
aggguaccugggca

SEQ ID NO: 1872268 - RNA, 22 nt, Salmonella typhimurium LT2
agggguuuucgccagcaacgcc

SEQ ID NO: 1872269 - RNA, 17 nt, Salmonella typhimurium LT2
agggguugaugccgacc

SEQ ID NO: 1872270 - RNA, 22 nt, Salmonella typhimurium LT2
agggguuucaauuccacaggcg

SEQ ID NO: 1872271 - RNA, 23 nt, Salmonella typhimurium LT2
agggguuucaauuccacaggcgc

SEQ ID NO: 1872272 - RNA, 18 nt, Salmonella typhimurium LT2
aggggcucuaaaaaggaa

SEQ ID NO: 1872273 - RNA, 21 nt, Salmonella typhimurium LT2
aggggcuggcauuacgcuggc

SEQ ID NO: 1872274 - RNA, 17 nt, Salmonella typhimurium LT2
agggcgugacgcgccag

SEQ ID NO: 1872275 - RNA, 14 nt, Salmonella typhimurium LT2
agggcuuacucccu

SEQ ID NO: 1872276 - RNA, 20 nt, Salmonella typhimurium LT2
aggggaaaaggguggugaau

SEQ ID NO: 1872277 - RNA, 13 nt, Salmonella typhimurium LT2
aggggcaguaaau

SEQ ID NO: 1872278 - RNA, 14 nt, Salmonella typhimurium LT2
aggggcaguaaauu

SEQ ID NO: 1872279 - RNA, 22 nt, Salmonella typhimurium LT2
aggcuggguugauaccggagga

SEQ ID NO: 1872280 - RNA, 16 nt, Salmonella typhimurium LT2
aggcugggucaguggu

SEQ ID NO: 1872281 - RNA, 20 nt, Salmonella typhimurium LT2
aggcugcucauuucagcgag

SEQ ID NO: 1872282 - RNA, 14 nt, Salmonella typhimurium LT2
aggcugguuguggu

SEQ ID NO: 1872283 - RNA, 22 nt, Salmonella typhimurium LT2
aggcuggaauaaccggugccaa

SEQ ID NO: 1872284 - RNA, 17 nt, Salmonella typhimurium LT2
aggcuggaucaggcgcu

SEQ ID NO: 1872285 - RNA, 16 nt, Salmonella typhimurium LT2
aggcuggcaaagcagg

SEQ ID NO: 1872286 - RNA, 20 nt, Salmonella typhimurium LT2
aggcugcuugagccagugag

SEQ ID NO: 1872287 - RNA, 23 nt, Salmonella typhimurium LT2
aggcugccgacuacgccuccugc

SEQ ID NO: 1872288 - RNA, 15 nt, Salmonella typhimurium LT2
aggcugccgccagaa

SEQ ID NO: 1872289 - RNA, 14 nt, Salmonella typhimurium LT2
aggcuuccagauac

SEQ ID NO: 1872290 - RNA, 15 nt, Salmonella typhimurium LT2
aggcuuccagauaca

SEQ ID NO: 1872291 - RNA, 16 nt, Salmonella typhimurium LT2
aggcuucgacaaacag

SEQ ID NO: 1872292 - RNA, 21 nt, Salmonella typhimurium LT2
aggcuucacgccacaguuggu

SEQ ID NO: 1872293 - RNA, 13 nt, Salmonella typhimurium LT2
aggcuucacgcuc

SEQ ID NO: 1872294 - RNA, 15 nt, Salmonella typhimurium LT2
aggcuuccacgcacg

SEQ ID NO: 1872295 - RNA, 15 nt, Salmonella typhimurium LT2
aggcuugcgcucacc

SEQ ID NO: 1872296 - RNA, 17 nt, Salmonella typhimurium LT2
aggcuuuaugcugacaa

SEQ ID NO: 1872297 - RNA, 22 nt, Salmonella typhimurium LT2
agggauaagguugccaaaaaau

SEQ ID NO: 1872298 - RNA, 21 nt, Salmonella typhimurium LT2
agggauaagaaagauaaaaua

SEQ ID NO: 1872299 - RNA, 23 nt, Salmonella typhimurium LT2
agggauaacaguauuuguucaga

SEQ ID NO: 1872300 - RNA, 16 nt, Salmonella typhimurium LT2
agggaucaauguaaaa

SEQ ID NO: 1872301 - RNA, 21 nt, Salmonella typhimurium LT2
agggaggugcucucccagcug

SEQ ID NO: 1872302 - RNA, 23 nt, Salmonella typhimurium LT2
agggaggugcucucccagcugag

SEQ ID NO: 1872303 - RNA, 23 nt, Salmonella typhimurium LT2
agggaguaugcggucaaaagcug

SEQ ID NO: 1872304 - RNA, 13 nt, Salmonella typhimurium LT2
agggauuuugcuu

SEQ ID NO: 1872305 - RNA, 14 nt, Salmonella typhimurium LT2
agggauuaugcaga

SEQ ID NO: 1872306 - RNA, 15 nt, Salmonella typhimurium LT2
agggaccgcgaagau

SEQ ID NO: 1872307 - RNA, 18 nt, Salmonella typhimurium LT2
agggagcagacuguaaau

SEQ ID NO: 1872308 - RNA, 17 nt, Salmonella typhimurium LT2
agggaaaagccauugcc

SEQ ID NO: 1872309 - RNA, 14 nt, Salmonella typhimurium LT2
agggaaaagccauu

SEQ ID NO: 1872310 - RNA, 16 nt, Salmonella typhimurium LT2
aggcuuuucaggcugu

SEQ ID NO: 1872311 - RNA, 16 nt, Salmonella typhimurium LT2
aggcuuuugguucaaa

SEQ ID NO: 1872312 - RNA, 19 nt, Salmonella typhimurium LT2
aggcuuuuuaaucaaaaug

SEQ ID NO: 1872313 - RNA, 23 nt, Salmonella typhimurium LT2
agggaaaccauguugaucguaaa

SEQ ID NO: 1872314 - RNA, 14 nt, Salmonella typhimurium LT2
agggaacuccagca

SEQ ID NO: 1872315 - RNA, 17 nt, Salmonella typhimurium LT2
agggaacacggcaugaa

SEQ ID NO: 1872316 - RNA, 20 nt, Salmonella typhimurium LT2
agggaacacggcaugaagca

SEQ ID NO: 1872317 - RNA, 17 nt, Salmonella typhimurium LT2
agcuauccggcaacaug

SEQ ID NO: 1872318 - RNA, 19 nt, Salmonella typhimurium LT2
agcuaucgcgccggacagc

SEQ ID NO: 1872319 - RNA, 19 nt, Salmonella typhimurium LT2
agcuauccacgcagacgcc

SEQ ID NO: 1872320 - RNA, 19 nt, Salmonella typhimurium LT2
agcuauccagcuucugacg

SEQ ID NO: 1872321 - RNA, 18 nt, Salmonella typhimurium LT2
agcucaacgccuuuacaa

SEQ ID NO: 1872322 - RNA, 16 nt, Salmonella typhimurium LT2
agcucaccaccaccaa

SEQ ID NO: 1872323 - RNA, 17 nt, Salmonella typhimurium LT2
agcucaaacguaaagca

SEQ ID NO: 1872324 - RNA, 17 nt, Salmonella typhimurium LT2
agcucaaauaugauaug

SEQ ID NO: 1872325 - RNA, 22 nt, Salmonella typhimurium LT2
agcucaaaucgcggcgcugagu

SEQ ID NO: 1872326 - RNA, 17 nt, Salmonella typhimurium LT2
agcgugucgcagauacg

SEQ ID NO: 1872327 - RNA, 16 nt, Salmonella typhimurium LT2
agcgugucgcccggug

SEQ ID NO: 1872328 - RNA, 14 nt, Salmonella typhimurium LT2
agcguuaaacuggc

SEQ ID NO: 1872329 - RNA, 18 nt, Salmonella typhimurium LT2
agcguuaaacuggcggcg

SEQ ID NO: 1872330 - RNA, 18 nt, Salmonella typhimurium LT2
agcguuaaaucaacggca

SEQ ID NO: 1872331 - RNA, 17 nt, Salmonella typhimurium LT2
agcguuagcaacacaga

SEQ ID NO: 1872332 - RNA, 20 nt, Salmonella typhimurium LT2
agcguuacgggaacagaauu

SEQ ID NO: 1872333 - RNA, 16 nt, Salmonella typhimurium LT2
agcguucaaaaucaaa

SEQ ID NO: 1872334 - RNA, 18 nt, Salmonella typhimurium LT2
agcuaaguuuguaaaaua

SEQ ID NO: 1872335 - RNA, 22 nt, Salmonella typhimurium LT2
agcuaacgacccgaaguggugg

SEQ ID NO: 1872336 - RNA, 18 nt, Salmonella typhimurium LT2
agcuaauccccagcgcuc

SEQ ID NO: 1872337 - RNA, 14 nt, Salmonella typhimurium LT2
agcuaaugcaauaa

SEQ ID NO: 1872338 - RNA, 18 nt, Salmonella typhimurium LT2
agcuaaugcaauaaacua

SEQ ID NO: 1872339 - RNA, 17 nt, Salmonella typhimurium LT2
agcuaaucacccacuuc

SEQ ID NO: 1872340 - RNA, 22 nt, Salmonella typhimurium LT2
agcguggaaaacagcgccggca

SEQ ID NO: 1872341 - RNA, 19 nt, Salmonella typhimurium LT2
agcgucuguuucaacacau

SEQ ID NO: 1872342 - RNA, 16 nt, Salmonella typhimurium LT2
agcgucucagcaggcg

SEQ ID NO: 1872343 - RNA, 18 nt, Salmonella typhimurium LT2
agcgugccgguaaagggc

SEQ ID NO: 1872344 - RNA, 13 nt, Salmonella typhimurium LT2
agcguagcgccau

SEQ ID NO: 1872345 - RNA, 17 nt, Salmonella typhimurium LT2
agcguagcgccaucagg

SEQ ID NO: 1872346 - RNA, 20 nt, Salmonella typhimurium LT2
agcguauaauuaagcugcga

SEQ ID NO: 1872347 - RNA, 14 nt, Salmonella typhimurium LT2
agcguaguccaggu

SEQ ID NO: 1872348 - RNA, 22 nt, Salmonella typhimurium LT2
agcguaguuuauucuucuccuc

SEQ ID NO: 1872349 - RNA, 15 nt, Salmonella typhimurium LT2
agcguaucgccggcg

SEQ ID NO: 1872350 - RNA, 22 nt, Salmonella typhimurium LT2
agcgucgcgucagcaaaauggc

SEQ ID NO: 1872351 - RNA, 22 nt, Salmonella typhimurium LT2
agcgucgggccgcgcugcgccu

SEQ ID NO: 1872352 - RNA, 19 nt, Salmonella typhimurium LT2
agcgucguccagcccggcg

SEQ ID NO: 1872353 - RNA, 15 nt, Salmonella typhimurium LT2
agcgucuaaauuucg

SEQ ID NO: 1872354 - RNA, 17 nt, Salmonella typhimurium LT2
agcgggcuggcauucau

SEQ ID NO: 1872355 - RNA, 20 nt, Salmonella typhimurium LT2
agcgggcagcauugaccacc

SEQ ID NO: 1872356 - RNA, 20 nt, Salmonella typhimurium LT2
agcggucggagguucgaauc

SEQ ID NO: 1872357 - RNA, 19 nt, Salmonella typhimurium LT2
agcguaauggccaccagca

SEQ ID NO: 1872358 - RNA, 12 nt, Salmonella typhimurium LT2
agcggcguucaa

SEQ ID NO: 1872359 - RNA, 22 nt, Salmonella typhimurium LT2
agcggcguugcccaguacggcg

SEQ ID NO: 1872360 - RNA, 16 nt, Salmonella typhimurium LT2
agcggcggcaguaguc

SEQ ID NO: 1872361 - RNA, 22 nt, Salmonella typhimurium LT2
agcggcugacacucauccagac

SEQ ID NO: 1872362 - RNA, 14 nt, Salmonella typhimurium LT2
agcggcugcgccug

SEQ ID NO: 1872363 - RNA, 15 nt, Salmonella typhimurium LT2
agcgggaggcgguuc

SEQ ID NO: 1872364 - RNA, 18 nt, Salmonella typhimurium LT2
agcgggaccauacuggcg

SEQ ID NO: 1872365 - RNA, 19 nt, Salmonella typhimurium LT2
agcggcucauccagcaaca

SEQ ID NO: 1872366 - RNA, 20 nt, Salmonella typhimurium LT2
agcggaaucgcuuccugggu

SEQ ID NO: 1872367 - RNA, 20 nt, Salmonella typhimurium LT2
agcgcugucgccaucaccag

SEQ ID NO: 1872368 - RNA, 19 nt, Salmonella typhimurium LT2
agcggccaaagggagcaga

SEQ ID NO: 1872369 - RNA, 14 nt, Salmonella typhimurium LT2
agcggccaaaggga

SEQ ID NO: 1872370 - RNA, 16 nt, Salmonella typhimurium LT2
agcggcgcaggggcau

SEQ ID NO: 1872371 - RNA, 17 nt, Salmonella typhimurium LT2
agcggcgccaucaccau

SEQ ID NO: 1872372 - RNA, 19 nt, Salmonella typhimurium LT2
agcgcggcgugaucaaauu

SEQ ID NO: 1872373 - RNA, 16 nt, Salmonella typhimurium LT2
agcgcggcagcagcuu

SEQ ID NO: 1872374 - RNA, 15 nt, Salmonella typhimurium LT2
agcgcggcacaggcg

SEQ ID NO: 1872375 - RNA, 20 nt, Salmonella typhimurium LT2
agcgcuggcauuccccaucg

SEQ ID NO: 1872376 - RNA, 16 nt, Salmonella typhimurium LT2
agcgcugaugcaggca

SEQ ID NO: 1872377 - RNA, 16 nt, Salmonella typhimurium LT2
agcgcgcuccagacca

SEQ ID NO: 1872378 - RNA, 23 nt, Salmonella typhimurium LT2
agcgcgcgcuaauuuucagggug

SEQ ID NO: 1872379 - RNA, 18 nt, Salmonella typhimurium LT2
agcgcgcgacccagcgca

SEQ ID NO: 1872380 - RNA, 20 nt, Salmonella typhimurium LT2
agcgcgcaaucgggccugcu

SEQ ID NO: 1872381 - RNA, 21 nt, Salmonella typhimurium LT2
agcgcgccaauggccgccccc

SEQ ID NO: 1872382 - RNA, 19 nt, Salmonella typhimurium LT2
agcgcgcccgccaccagca

SEQ ID NO: 1872383 - RNA, 18 nt, Salmonella typhimurium LT2
agcgcgaugacgucacga

SEQ ID NO: 1872384 - RNA, 15 nt, Salmonella typhimurium LT2
agcucacgccaaaau

SEQ ID NO: 1872385 - RNA, 14 nt, Salmonella typhimurium LT2
agcucaccugcucg

SEQ ID NO: 1872386 - RNA, 19 nt, Salmonella typhimurium LT2
agcucaccugcucgcccug

SEQ ID NO: 1872387 - RNA, 22 nt, Salmonella typhimurium LT2
agcucacggauauugcccggcc

SEQ ID NO: 1872388 - RNA, 21 nt, Salmonella typhimurium LT2
agcucaggguccccauauccc

SEQ ID NO: 1872389 - RNA, 19 nt, Salmonella typhimurium LT2
agcucaguccagccgccgc

SEQ ID NO: 1872390 - RNA, 17 nt, Salmonella typhimurium LT2
agcucauacccuuccag

SEQ ID NO: 1872391 - RNA, 14 nt, Salmonella typhimurium LT2
agcucagcgcccca

SEQ ID NO: 1872392 - RNA, 22 nt, Salmonella typhimurium LT2
agcucucgccgguuggcaugau

SEQ ID NO: 1872393 - RNA, 17 nt, Salmonella typhimurium LT2
agcucucuuccagguua

SEQ ID NO: 1872394 - RNA, 20 nt, Salmonella typhimurium LT2
agcucugccgguuggccggc

SEQ ID NO: 1872395 - RNA, 16 nt, Salmonella typhimurium LT2
agcugcaccaggagca

SEQ ID NO: 1872396 - RNA, 15 nt, Salmonella typhimurium LT2
agcugaacgcgguga

SEQ ID NO: 1872397 - RNA, 17 nt, Salmonella typhimurium LT2
agcugaacgcggugacu

SEQ ID NO: 1872398 - RNA, 18 nt, Salmonella typhimurium LT2
agcugccacaccacaugc

SEQ ID NO: 1872399 - RNA, 22 nt, Salmonella typhimurium LT2
agcugucgccaccuuguaucau

SEQ ID NO: 1872400 - RNA, 17 nt, Salmonella typhimurium LT2
agcugugcguugucuac

SEQ ID NO: 1872401 - RNA, 17 nt, Salmonella typhimurium LT2
agcuuaaaaaauccugc

SEQ ID NO: 1872402 - RNA, 17 nt, Salmonella typhimurium LT2
agcugcgccauaccccg

SEQ ID NO: 1872403 - RNA, 22 nt, Salmonella typhimurium LT2
agcuggcggucgggaacgcugu

SEQ ID NO: 1872404 - RNA, 23 nt, Salmonella typhimurium LT2
agcuggcuuuauauaaaaaaugg

SEQ ID NO: 1872405 - RNA, 14 nt, Salmonella typhimurium LT2
agcugggucaggac

SEQ ID NO: 1872406 - RNA, 17 nt, Salmonella typhimurium LT2
agcugggucaggacaga

SEQ ID NO: 1872407 - RNA, 13 nt, Salmonella typhimurium LT2
agcuuauccugcc

SEQ ID NO: 1872408 - RNA, 22 nt, Salmonella typhimurium LT2
agcuuaucgccaaagauauagu

SEQ ID NO: 1872409 - RNA, 13 nt, Salmonella typhimurium LT2
agcuucaucauca

SEQ ID NO: 1872410 - RNA, 19 nt, Salmonella typhimurium LT2
agcuucaucaucagcagca

SEQ ID NO: 1872411 - RNA, 14 nt, Salmonella typhimurium LT2
agcuucugucccag

SEQ ID NO: 1872412 - RNA, 22 nt, Salmonella typhimurium LT2
agcuuugcguaaaaaaacauca

SEQ ID NO: 1872413 - RNA, 18 nt, Salmonella typhimurium LT2
agcuuugcgccagauaac

SEQ ID NO: 1872414 - RNA, 20 nt, Salmonella typhimurium LT2
agcuuuugcugcgccagcca

SEQ ID NO: 1872415 - RNA, 15 nt, Salmonella typhimurium LT2
agcuuuuccuguucg

SEQ ID NO: 1872416 - RNA, 20 nt, Salmonella typhimurium LT2
agcuuuucauauagucauaa

SEQ ID NO: 1872417 - RNA, 20 nt, Salmonella typhimurium LT2
agcuuuuccaccccagcauu

SEQ ID NO: 1872418 - RNA, 15 nt, Salmonella typhimurium LT2
agcuugcgcagagua

SEQ ID NO: 1872419 - RNA, 14 nt, Salmonella typhimurium LT2
agcuugaucaucag

SEQ ID NO: 1872420 - RNA, 16 nt, Salmonella typhimurium LT2
agcuugaucucucccu

SEQ ID NO: 1872421 - RNA, 14 nt, Salmonella typhimurium LT2
aggacguucuucuc

SEQ ID NO: 1872422 - RNA, 15 nt, Salmonella typhimurium LT2
aggacgaaaaaugaa

SEQ ID NO: 1872423 - RNA, 12 nt, Salmonella typhimurium LT2
aggacaucaaag

SEQ ID NO: 1872424 - RNA, 19 nt, Salmonella typhimurium LT2
aggacauucagcacgcuuu

SEQ ID NO: 1872425 - RNA, 15 nt, Salmonella typhimurium LT2
aggacuuaaaaacaa

SEQ ID NO: 1872426 - RNA, 15 nt, Salmonella typhimurium LT2
aggacucaaucacuu

SEQ ID NO: 1872427 - RNA, 14 nt, Salmonella typhimurium LT2
aggagacgccgccc

SEQ ID NO: 1872428 - RNA, 15 nt, Salmonella typhimurium LT2
aggagauaucaaaag

SEQ ID NO: 1872429 - RNA, 20 nt, Salmonella typhimurium LT2
aggagcauagauaacgaugu

SEQ ID NO: 1872430 - RNA, 14 nt, Salmonella typhimurium LT2
aggagaugucccac

SEQ ID NO: 1872431 - RNA, 18 nt, Salmonella typhimurium LT2
aggauaaccuuccggcac

SEQ ID NO: 1872432 - RNA, 16 nt, Salmonella typhimurium LT2
aggauacguucaucuu

SEQ ID NO: 1872433 - RNA, 20 nt, Salmonella typhimurium LT2
aggauagaaaacauauuggu

SEQ ID NO: 1872434 - RNA, 15 nt, Salmonella typhimurium LT2
aggauauagugaaga

SEQ ID NO: 1872435 - RNA, 15 nt, Salmonella typhimurium LT2
aggauagugauauag

SEQ ID NO: 1872436 - RNA, 17 nt, Salmonella typhimurium LT2
aggaucaguaacaggac

SEQ ID NO: 1872437 - RNA, 19 nt, Salmonella typhimurium LT2
aggagcgccguggaaaaga

SEQ ID NO: 1872438 - RNA, 15 nt, Salmonella typhimurium LT2
aggauaaaaucgcca

SEQ ID NO: 1872439 - RNA, 14 nt, Salmonella typhimurium LT2
aggaguaguuaaaa

SEQ ID NO: 1872440 - RNA, 14 nt, Salmonella typhimurium LT2
aggagguucaucau

SEQ ID NO: 1872441 - RNA, 16 nt, Salmonella typhimurium LT2
aggaaaucuuccaguu

SEQ ID NO: 1872442 - RNA, 12 nt, Salmonella typhimurium LT2
aggaaauucugg

SEQ ID NO: 1872443 - RNA, 23 nt, Salmonella typhimurium LT2
aggaacgcgcaguccguuuucaa

SEQ ID NO: 1872444 - RNA, 17 nt, Salmonella typhimurium LT2
aggaacuguucagccag

SEQ ID NO: 1872445 - RNA, 19 nt, Salmonella typhimurium LT2
aggaacugcggccagacga

SEQ ID NO: 1872446 - RNA, 22 nt, Salmonella typhimurium LT2
aggaaaagaccauccgguuuua

SEQ ID NO: 1872447 - RNA, 14 nt, Salmonella typhimurium LT2
aggaaaagcuguag

SEQ ID NO: 1872448 - RNA, 22 nt, Salmonella typhimurium LT2
agcuuuugcgcguuccccaaca

SEQ ID NO: 1872449 - RNA, 19 nt, Salmonella typhimurium LT2
agcuuuuuauuacuuucua

SEQ ID NO: 1872450 - RNA, 22 nt, Salmonella typhimurium LT2
aggaaacccucggcgaacaggc

SEQ ID NO: 1872451 - RNA, 13 nt, Salmonella typhimurium LT2
aggaaacgccagg

SEQ ID NO: 1872452 - RNA, 20 nt, Salmonella typhimurium LT2
aggaaacgcgccggaaggcg

SEQ ID NO: 1872453 - RNA, 21 nt, Salmonella typhimurium LT2
aggaaacagguacuuacccag

SEQ ID NO: 1872454 - RNA, 22 nt, Salmonella typhimurium LT2
aggaauuuucccauaaaagagc

SEQ ID NO: 1872455 - RNA, 14 nt, Salmonella typhimurium LT2
aggacaagcugcgc

SEQ ID NO: 1872456 - RNA, 22 nt, Salmonella typhimurium LT2
aggaauuacggacgauacaccu

SEQ ID NO: 1872457 - RNA, 19 nt, Salmonella typhimurium LT2
aggaagcugcgcagcacuu

SEQ ID NO: 1872458 - RNA, 13 nt, Salmonella typhimurium LT2
aggaaggagcaaa

SEQ ID NO: 1872459 - RNA, 15 nt, Salmonella typhimurium LT2
aggaaggagcaaaca

SEQ ID NO: 1872460 - RNA, 13 nt, Salmonella typhimurium LT2
aggaagucagcuu

SEQ ID NO: 1872461 - RNA, 19 nt, Salmonella typhimurium LT2
aggaaggggaaaagggugg

SEQ ID NO: 1872462 - RNA, 20 nt, Salmonella typhimurium LT2
aggccauuaagcuucgugag

SEQ ID NO: 1872463 - RNA, 23 nt, Salmonella typhimurium LT2
aggccaggcguuguccaguaagg

SEQ ID NO: 1872464 - RNA, 21 nt, Salmonella typhimurium LT2
aggccagcguuaccucuuucg

SEQ ID NO: 1872465 - RNA, 13 nt, Salmonella typhimurium LT2
aggccagccugau

SEQ ID NO: 1872466 - RNA, 12 nt, Salmonella typhimurium LT2
aggccagacuga

SEQ ID NO: 1872467 - RNA, 23 nt, Salmonella typhimurium LT2
aggcccgguggcgccgcgccacc

SEQ ID NO: 1872468 - RNA, 20 nt, Salmonella typhimurium LT2
aggcccgauaagcaaagcgc

SEQ ID NO: 1872469 - RNA, 14 nt, Salmonella typhimurium LT2
aggccccgccaucc

SEQ ID NO: 1872470 - RNA, 22 nt, Salmonella typhimurium LT2
aggcauagcaacgacgcaagca

SEQ ID NO: 1872471 - RNA, 16 nt, Salmonella typhimurium LT2
aggcauaaugccacga

SEQ ID NO: 1872472 - RNA, 14 nt, Salmonella typhimurium LT2
aggcaucagauaaa

SEQ ID NO: 1872473 - RNA, 23 nt, Salmonella typhimurium LT2
aggcaucaggcugguauaaaaac

SEQ ID NO: 1872474 - RNA, 23 nt, Salmonella typhimurium LT2
aggcauccgugaccugcugacua

SEQ ID NO: 1872475 - RNA, 22 nt, Salmonella typhimurium LT2
aggcaucgacgccagcggguga

SEQ ID NO: 1872476 - RNA, 15 nt, Salmonella typhimurium LT2
aggcaucgcgccgcc

SEQ ID NO: 1872477 - RNA, 19 nt, Salmonella typhimurium LT2
aggcaucgcugauaaaaac

SEQ ID NO: 1872478 - RNA, 22 nt, Salmonella typhimurium LT2
aggcagccggauuuuaaauugg

SEQ ID NO: 1872479 - RNA, 19 nt, Salmonella typhimurium LT2
aggcagccggauuuuaaau

SEQ ID NO: 1872480 - RNA, 18 nt, Salmonella typhimurium LT2
aggcagccggauuuuaaa

SEQ ID NO: 1872481 - RNA, 23 nt, Salmonella typhimurium LT2
aggcagccacaaugggggcauaa

SEQ ID NO: 1872482 - RNA, 18 nt, Salmonella typhimurium LT2
aggcagccagguccagau

SEQ ID NO: 1872483 - RNA, 17 nt, Salmonella typhimurium LT2
aggcagcgcgcugucuu

SEQ ID NO: 1872484 - RNA, 15 nt, Salmonella typhimurium LT2
aggcaggcauuggca

SEQ ID NO: 1872485 - RNA, 14 nt, Salmonella typhimurium LT2
aggcauuggacggg

SEQ ID NO: 1872486 - RNA, 13 nt, Salmonella typhimurium LT2
aggcauuggcauu

SEQ ID NO: 1872487 - RNA, 17 nt, Salmonella typhimurium LT2
aggcauuggcauucuuu

SEQ ID NO: 1872488 - RNA, 18 nt, Salmonella typhimurium LT2
aggcaugguuaacaauau

SEQ ID NO: 1872489 - RNA, 15 nt, Salmonella typhimurium LT2
aggcauuaaaaaaac

SEQ ID NO: 1872490 - RNA, 15 nt, Salmonella typhimurium LT2
aggcauggcagcagg

SEQ ID NO: 1872491 - RNA, 19 nt, Salmonella typhimurium LT2
aggcauuuaugccgccauc

SEQ ID NO: 1872492 - RNA, 12 nt, Salmonella typhimurium LT2
aggccaaacccu

SEQ ID NO: 1872493 - RNA, 22 nt, Salmonella typhimurium LT2
aggccaacauagcggcaaggaa

SEQ ID NO: 1872494 - RNA, 22 nt, Salmonella typhimurium LT2
aggccaaauagggguucauaag

SEQ ID NO: 1872495 - RNA, 16 nt, Salmonella typhimurium LT2
aggauguccaggcgac

SEQ ID NO: 1872496 - RNA, 19 nt, Salmonella typhimurium LT2
aggaugggaggcuauucaa

SEQ ID NO: 1872497 - RNA, 19 nt, Salmonella typhimurium LT2
aggaugugaggcagauacg

SEQ ID NO: 1872498 - RNA, 17 nt, Salmonella typhimurium LT2
aggaugcuccgccagag

SEQ ID NO: 1872499 - RNA, 15 nt, Salmonella typhimurium LT2
aggcaaaccagcacc

SEQ ID NO: 1872500 - RNA, 17 nt, Salmonella typhimurium LT2
aggcaaaaugccagccc

SEQ ID NO: 1872501 - RNA, 12 nt, Salmonella typhimurium LT2
aggcaaaccagc

SEQ ID NO: 1872502 - RNA, 15 nt, Salmonella typhimurium LT2
aggauucgccauucc

SEQ ID NO: 1872503 - RNA, 13 nt, Salmonella typhimurium LT2
aggauugcuguga

SEQ ID NO: 1872504 - RNA, 20 nt, Salmonella typhimurium LT2
aggauuauuggcaucauaaa

SEQ ID NO: 1872505 - RNA, 18 nt, Salmonella typhimurium LT2
aggcacuacggugugccu

SEQ ID NO: 1872506 - RNA, 19 nt, Salmonella typhimurium LT2
aggcacuacggugugccug

SEQ ID NO: 1872507 - RNA, 16 nt, Salmonella typhimurium LT2
aggcacguuauuggca

SEQ ID NO: 1872508 - RNA, 20 nt, Salmonella typhimurium LT2
aggcacuuuccagaccaaga

SEQ ID NO: 1872509 - RNA, 14 nt, Salmonella typhimurium LT2
aggcagcacaauca

SEQ ID NO: 1872510 - RNA, 18 nt, Salmonella typhimurium LT2
aggcacaacaauauucca

SEQ ID NO: 1872511 - RNA, 19 nt, Salmonella typhimurium LT2
aggcaauagaccagcggcc

SEQ ID NO: 1872512 - RNA, 19 nt, Salmonella typhimurium LT2
aggcaauaaaaaaggcaga

SEQ ID NO: 1872513 - RNA, 18 nt, Salmonella typhimurium LT2
aggcaauaugucuuaaac

SEQ ID NO: 1872514 - RNA, 17 nt, Salmonella typhimurium LT2
aggcaaugccuuuucac

SEQ ID NO: 1872515 - RNA, 21 nt, Salmonella typhimurium LT2
aggcaacgccgugagauguuc

SEQ ID NO: 1872516 - RNA, 21 nt, Salmonella typhimurium LT2
aggcaacagauugaugcccuc

SEQ ID NO: 1872517 - RNA, 19 nt, Salmonella typhimurium LT2
aggcaacaugaccagcgca

SEQ ID NO: 1872518 - RNA, 16 nt, Salmonella typhimurium LT2
aggcaacaauuucuac

SEQ ID NO: 1872519 - RNA, 11 nt, Salmonella typhimurium LT2
auaagcagaac

SEQ ID NO: 1872520 - RNA, 17 nt, Salmonella typhimurium LT2
auaagcacaccauuuca

SEQ ID NO: 1872521 - RNA, 17 nt, Salmonella typhimurium LT2
auaagccacuucaacca

SEQ ID NO: 1872522 - RNA, 12 nt, Salmonella typhimurium LT2
auaagccagccc

SEQ ID NO: 1872523 - RNA, 15 nt, Salmonella typhimurium LT2
auaagcgucugcaau

SEQ ID NO: 1872524 - RNA, 22 nt, Salmonella typhimurium LT2
auaagcguagcgccaucaggcu

SEQ ID NO: 1872525 - RNA, 14 nt, Salmonella typhimurium LT2
auaagcgucagcgc

SEQ ID NO: 1872526 - RNA, 15 nt, Salmonella typhimurium LT2
auaagcgcucaggca

SEQ ID NO: 1872527 - RNA, 19 nt, Salmonella typhimurium LT2
auaagcugcgacaacaagu

SEQ ID NO: 1872528 - RNA, 14 nt, Salmonella typhimurium LT2
auaagcuuauaaac

SEQ ID NO: 1872529 - RNA, 13 nt, Salmonella typhimurium LT2
auaagaaucagau

SEQ ID NO: 1872530 - RNA, 15 nt, Salmonella typhimurium LT2
auaagagaaaauacc

SEQ ID NO: 1872531 - RNA, 18 nt, Salmonella typhimurium LT2
auaagcaaacagggggaa

SEQ ID NO: 1872532 - RNA, 14 nt, Salmonella typhimurium LT2
auaagcaauuacua

SEQ ID NO: 1872533 - RNA, 21 nt, Salmonella typhimurium LT2
auaaggcaccgaugacaauaa

SEQ ID NO: 1872534 - RNA, 14 nt, Salmonella typhimurium LT2
auaagggcucagca

SEQ ID NO: 1872535 - RNA, 16 nt, Salmonella typhimurium LT2
auaagggccggaaaaa

SEQ ID NO: 1872536 - RNA, 15 nt, Salmonella typhimurium LT2
auaagggcucagcau

SEQ ID NO: 1872537 - RNA, 18 nt, Salmonella typhimurium LT2
auaaggguaagcaauaug

SEQ ID NO: 1872538 - RNA, 23 nt, Salmonella typhimurium LT2
auaagguaacgcgaaaaaaagau

SEQ ID NO: 1872539 - RNA, 20 nt, Salmonella typhimurium LT2
auaaggucgcuauccagcag

SEQ ID NO: 1872540 - RNA, 14 nt, Salmonella typhimurium LT2
auaagucaugagcu

SEQ ID NO: 1872541 - RNA, 23 nt, Salmonella typhimurium LT2
auaauaaaugccgucgcuuucau

SEQ ID NO: 1872542 - RNA, 18 nt, Salmonella typhimurium LT2
auaauaaaauauuauuuu

SEQ ID NO: 1872543 - RNA, 17 nt, Salmonella typhimurium LT2
auaaguaccauugccca

SEQ ID NO: 1872544 - RNA, 15 nt, Salmonella typhimurium LT2
auaaucguguaaucu

SEQ ID NO: 1872545 - RNA, 22 nt, Salmonella typhimurium LT2
auaaucgguagcacuuuaaaca

SEQ ID NO: 1872546 - RNA, 17 nt, Salmonella typhimurium LT2
auaaucuugauccggcu

SEQ ID NO: 1872547 - RNA, 15 nt, Salmonella typhimurium LT2
auaaucgcccacuug

SEQ ID NO: 1872548 - RNA, 17 nt, Salmonella typhimurium LT2
auaaucagcaagaugac

SEQ ID NO: 1872549 - RNA, 14 nt, Salmonella typhimurium LT2
auaaucaccacgua

SEQ ID NO: 1872550 - RNA, 14 nt, Salmonella typhimurium LT2
auaaugcgccacca

SEQ ID NO: 1872551 - RNA, 20 nt, Salmonella typhimurium LT2
auaaugcuuaauucauaacg

SEQ ID NO: 1872552 - RNA, 19 nt, Salmonella typhimurium LT2
auaauggcgccgauaacac

SEQ ID NO: 1872553 - RNA, 19 nt, Salmonella typhimurium LT2
auaaugcuuucgccagccg

SEQ ID NO: 1872554 - RNA, 15 nt, Salmonella typhimurium LT2
auaaugccucauccg

SEQ ID NO: 1872555 - RNA, 19 nt, Salmonella typhimurium LT2
auaauggcgcgaaaacagc

SEQ ID NO: 1872556 - RNA, 14 nt, Salmonella typhimurium LT2
auaauggcccagcg

SEQ ID NO: 1872557 - RNA, 19 nt, Salmonella typhimurium LT2
auaauuaacagacaaugaa

SEQ ID NO: 1872558 - RNA, 24 nt, Salmonella typhimurium LT2
auaauuaacagacaaugaauauua

SEQ ID NO: 1872559 - RNA, 10 nt, Salmonella typhimurium LT2
auaauacacg

SEQ ID NO: 1872560 - RNA, 14 nt, Salmonella typhimurium LT2
auaauaauauccuu

SEQ ID NO: 1872561 - RNA, 16 nt, Salmonella typhimurium LT2
auaauaagaauuaccg

SEQ ID NO: 1872562 - RNA, 15 nt, Salmonella typhimurium LT2
auaauagaacccaaa

SEQ ID NO: 1872563 - RNA, 20 nt, Salmonella typhimurium LT2
auaauacgccggcaucauca

SEQ ID NO: 1872564 - RNA, 12 nt, Salmonella typhimurium LT2
auaauaccucaa

SEQ ID NO: 1872565 - RNA, 21 nt, Salmonella typhimurium LT2
auaauaccucaaauauugaau

SEQ ID NO: 1872566 - RNA, 13 nt, Salmonella typhimurium LT2
auaauaugcucaa

SEQ ID NO: 1872567 - RNA, 20 nt, Salmonella typhimurium LT2
auaauauguuccacaaucaa

SEQ ID NO: 1872568 - RNA, 14 nt, Salmonella typhimurium LT2
auaaauaaaauugu

SEQ ID NO: 1872569 - RNA, 16 nt, Salmonella typhimurium LT2
auaaagguauagugga

SEQ ID NO: 1872570 - RNA, 14 nt, Salmonella typhimurium LT2
auaaaggggugcuu

SEQ ID NO: 1872571 - RNA, 21 nt, Salmonella typhimurium LT2
auaaaggucacaucaucgcca

SEQ ID NO: 1872572 - RNA, 23 nt, Salmonella typhimurium LT2
auaaaggcuugacucaaaaagag

SEQ ID NO: 1872573 - RNA, 19 nt, Salmonella typhimurium LT2
auaaagccgcauuuuucca

SEQ ID NO: 1872574 - RNA, 12 nt, Salmonella typhimurium LT2
auaaagcagggc

SEQ ID NO: 1872575 - RNA, 15 nt, Salmonella typhimurium LT2
auaaagcuuucaucu

SEQ ID NO: 1872576 - RNA, 18 nt, Salmonella typhimurium LT2
auaaauaaggccugagcu

SEQ ID NO: 1872577 - RNA, 23 nt, Salmonella typhimurium LT2
auaaaucgccaccguaacuaaaa

SEQ ID NO: 1872578 - RNA, 21 nt, Salmonella typhimurium LT2
auaaacucuguguuaugaaug

SEQ ID NO: 1872579 - RNA, 16 nt, Salmonella typhimurium LT2
auaaacuacuggcugg

SEQ ID NO: 1872580 - RNA, 13 nt, Salmonella typhimurium LT2
auaaacgacauca

SEQ ID NO: 1872581 - RNA, 14 nt, Salmonella typhimurium LT2
auaaacgacaucaa

SEQ ID NO: 1872582 - RNA, 17 nt, Salmonella typhimurium LT2
auaaaccgaaaggguau

SEQ ID NO: 1872583 - RNA, 22 nt, Salmonella typhimurium LT2
auaaagauugguaucugcaauu

SEQ ID NO: 1872584 - RNA, 16 nt, Salmonella typhimurium LT2
auaaagcacagcccca

SEQ ID NO: 1872585 - RNA, 21 nt, Salmonella typhimurium LT2
auaaagagcaggccaaaaaag

SEQ ID NO: 1872586 - RNA, 14 nt, Salmonella typhimurium LT2
auaaaaauagcugg

SEQ ID NO: 1872587 - RNA, 20 nt, Salmonella typhimurium LT2
auaaaauuuugcauaaauaa

SEQ ID NO: 1872588 - RNA, 22 nt, Salmonella typhimurium LT2
auaaaauuuugcauaaauaaug

SEQ ID NO: 1872589 - RNA, 14 nt, Salmonella typhimurium LT2
auaaaccaacagcc

SEQ ID NO: 1872590 - RNA, 17 nt, Salmonella typhimurium LT2
auaaauguuuaucucau

SEQ ID NO: 1872591 - RNA, 19 nt, Salmonella typhimurium LT2
auaaauuuucauuauaaaa

SEQ ID NO: 1872592 - RNA, 21 nt, Salmonella typhimurium LT2
auaaauuuucauuauaaaacu

SEQ ID NO: 1872593 - RNA, 14 nt, Salmonella typhimurium LT2
auaaauuuuuuaac

SEQ ID NO: 1872594 - RNA, 21 nt, Salmonella typhimurium LT2
auaaauuuuuacccacgucau

SEQ ID NO: 1872595 - RNA, 15 nt, Salmonella typhimurium LT2
auaacaaaagcgguu

SEQ ID NO: 1872596 - RNA, 16 nt, Salmonella typhimurium LT2
auaacacaauacuuca

SEQ ID NO: 1872597 - RNA, 23 nt, Salmonella typhimurium LT2
auaacacaauacuucaaaugauu

SEQ ID NO: 1872598 - RNA, 20 nt, Salmonella typhimurium LT2
auaacauugguuaucaaaaa

SEQ ID NO: 1872599 - RNA, 21 nt, Salmonella typhimurium LT2
auaacauugguuaucaaaaac

SEQ ID NO: 1872600 - RNA, 12 nt, Salmonella typhimurium LT2
auaacccggcug

SEQ ID NO: 1872601 - RNA, 14 nt, Salmonella typhimurium LT2
auaaccaauaauug

SEQ ID NO: 1872602 - RNA, 14 nt, Salmonella typhimurium LT2
auaaccaauaaugc

SEQ ID NO: 1872603 - RNA, 14 nt, Salmonella typhimurium LT2
auaaccgcccgcgg

SEQ ID NO: 1872604 - RNA, 16 nt, Salmonella typhimurium LT2
auaaccgccagcagca

SEQ ID NO: 1872605 - RNA, 12 nt, Salmonella typhimurium LT2
auaacucuucau

SEQ ID NO: 1872606 - RNA, 21 nt, Salmonella typhimurium LT2
auaacuuccuuugccuuucuu

SEQ ID NO: 1872607 - RNA, 18 nt, Salmonella typhimurium LT2
auaacguuuaacgcgugc

SEQ ID NO: 1872608 - RNA, 15 nt, Salmonella typhimurium LT2
auaacucaauagcgg

SEQ ID NO: 1872609 - RNA, 14 nt, Salmonella typhimurium LT2
auaacuauaauugc

SEQ ID NO: 1872610 - RNA, 15 nt, Salmonella typhimurium LT2
auaacguguuaugcg

SEQ ID NO: 1872611 - RNA, 21 nt, Salmonella typhimurium LT2
auaaccucuacacauuuuaaa

SEQ ID NO: 1872612 - RNA, 21 nt, Salmonella typhimurium LT2
auaaccguagauuuucaucau

SEQ ID NO: 1872613 - RNA, 20 nt, Salmonella typhimurium LT2
auaaccggcgccaacaaucg

SEQ ID NO: 1872614 - RNA, 16 nt, Salmonella typhimurium LT2
auaaccuauuuugcaa

SEQ ID NO: 1872615 - RNA, 13 nt, Salmonella typhimurium LT2
agucuguuuuucg

SEQ ID NO: 1872616 - RNA, 21 nt, Salmonella typhimurium LT2
agucuggcugcggccuccgca

SEQ ID NO: 1872617 - RNA, 11 nt, Salmonella typhimurium LT2
agucuuccugc

SEQ ID NO: 1872618 - RNA, 21 nt, Salmonella typhimurium LT2
agugaccacgguuaucuggcg

SEQ ID NO: 1872619 - RNA, 23 nt, Salmonella typhimurium LT2
agugacgacgccagauaaggcuc

SEQ ID NO: 1872620 - RNA, 17 nt, Salmonella typhimurium LT2
agugacgacggcagggg

SEQ ID NO: 1872621 - RNA, 22 nt, Salmonella typhimurium LT2
agugacagaggaaugaaaacga

SEQ ID NO: 1872622 - RNA, 12 nt, Salmonella typhimurium LT2
agugaaaaaaag

SEQ ID NO: 1872623 - RNA, 17 nt, Salmonella typhimurium LT2
agucuuuuguuuuucuc

SEQ ID NO: 1872624 - RNA, 19 nt, Salmonella typhimurium LT2
agucgacagcccgccagca

SEQ ID NO: 1872625 - RNA, 16 nt, Salmonella typhimurium LT2
aguccguuuaaagaca

SEQ ID NO: 1872626 - RNA, 22 nt, Salmonella typhimurium LT2
aguccguggcacgguaaacucc

SEQ ID NO: 1872627 - RNA, 15 nt, Salmonella typhimurium LT2
aguaccgaacagcca

SEQ ID NO: 1872628 - RNA, 21 nt, Salmonella typhimurium LT2
aguaccgaacagccaggcuuu

SEQ ID NO: 1872629 - RNA, 19 nt, Salmonella typhimurium LT2
aguaccgaacagccaggcu

SEQ ID NO: 1872630 - RNA, 14 nt, Salmonella typhimurium LT2
aguccggcgaaaaa

SEQ ID NO: 1872631 - RNA, 22 nt, Salmonella typhimurium LT2
aguccgggugcaaacccaucuc

SEQ ID NO: 1872632 - RNA, 15 nt, Salmonella typhimurium LT2
agucguuauaauccu

SEQ ID NO: 1872633 - RNA, 12 nt, Salmonella typhimurium LT2
agucgccaggca

SEQ ID NO: 1872634 - RNA, 15 nt, Salmonella typhimurium LT2
agucuaaaaauaauu

SEQ ID NO: 1872635 - RNA, 20 nt, Salmonella typhimurium LT2
agucuaaccgaugcccggca

SEQ ID NO: 1872636 - RNA, 16 nt, Salmonella typhimurium LT2
agucuaauaacacaau

SEQ ID NO: 1872637 - RNA, 20 nt, Salmonella typhimurium LT2
aguggauagaguuaaaaggu

SEQ ID NO: 1872638 - RNA, 15 nt, Salmonella typhimurium LT2
agugcgcacucagaa

SEQ ID NO: 1872639 - RNA, 11 nt, Salmonella typhimurium LT2
agugcgccgcc

SEQ ID NO: 1872640 - RNA, 18 nt, Salmonella typhimurium LT2
agugcaguauugcaccag

SEQ ID NO: 1872641 - RNA, 21 nt, Salmonella typhimurium LT2
agugagcgauugcuggccuag

SEQ ID NO: 1872642 - RNA, 20 nt, Salmonella typhimurium LT2
agugacgguuuucacuggca

SEQ ID NO: 1872643 - RNA, 22 nt, Salmonella typhimurium LT2
aguguaaaaauuuuugaucugc

SEQ ID NO: 1872644 - RNA, 14 nt, Salmonella typhimurium LT2
agugucgauaaccu

SEQ ID NO: 1872645 - RNA, 18 nt, Salmonella typhimurium LT2
agugucgauaaccuggau

SEQ ID NO: 1872646 - RNA, 23 nt, Salmonella typhimurium LT2
aguguccuuacggacgugggggu

SEQ ID NO: 1872647 - RNA, 22 nt, Salmonella typhimurium LT2
agugguucguccaucaguucuu

SEQ ID NO: 1872648 - RNA, 16 nt, Salmonella typhimurium LT2
agugguucuggcggcg

SEQ ID NO: 1872649 - RNA, 15 nt, Salmonella typhimurium LT2
agugguuccauucca

SEQ ID NO: 1872650 - RNA, 17 nt, Salmonella typhimurium LT2
aguggugggugaugacg

SEQ ID NO: 1872651 - RNA, 14 nt, Salmonella typhimurium LT2
aguggugggugaug

SEQ ID NO: 1872652 - RNA, 16 nt, Salmonella typhimurium LT2
agugggaucagguaag

SEQ ID NO: 1872653 - RNA, 20 nt, Salmonella typhimurium LT2
aguggggaaaaaccccuggu

SEQ ID NO: 1872654 - RNA, 18 nt, Salmonella typhimurium LT2
aguucgguuacaugcuga

SEQ ID NO: 1872655 - RNA, 19 nt, Salmonella typhimurium LT2
aguucgguuacaugcugaa

SEQ ID NO: 1872656 - RNA, 17 nt, Salmonella typhimurium LT2
aguuccaggacggacau

SEQ ID NO: 1872657 - RNA, 20 nt, Salmonella typhimurium LT2
aguuccacauaaaguagcca

SEQ ID NO: 1872658 - RNA, 14 nt, Salmonella typhimurium LT2
aguucaaucagguu

SEQ ID NO: 1872659 - RNA, 23 nt, Salmonella typhimurium LT2
aguuauaaauccccgccgccauc

SEQ ID NO: 1872660 - RNA, 21 nt, Salmonella typhimurium LT2
agugugucuuuuacgccagga

SEQ ID NO: 1872661 - RNA, 18 nt, Salmonella typhimurium LT2
agugugcucguuuuuaua

SEQ ID NO: 1872662 - RNA, 22 nt, Salmonella typhimurium LT2
agugugcaaacgauaaaagcuc

SEQ ID NO: 1872663 - RNA, 16 nt, Salmonella typhimurium LT2
aguguuagcucuuauu

SEQ ID NO: 1872664 - RNA, 21 nt, Salmonella typhimurium LT2
aguguuauauucccgaaaggu

SEQ ID NO: 1872665 - RNA, 16 nt, Salmonella typhimurium LT2
aguuagcgaccgcgcc

SEQ ID NO: 1872666 - RNA, 15 nt, Salmonella typhimurium LT2
aguuagcgcccauaa

SEQ ID NO: 1872667 - RNA, 19 nt, Salmonella typhimurium LT2
aguuacgcacgccagauaa

SEQ ID NO: 1872668 - RNA, 14 nt, Salmonella typhimurium LT2
aguguuuccauaca

SEQ ID NO: 1872669 - RNA, 14 nt, Salmonella typhimurium LT2
aguuacguuugcag

SEQ ID NO: 1872670 - RNA, 22 nt, Salmonella typhimurium LT2
aguuguuuauuccauucaucga

SEQ ID NO: 1872671 - RNA, 15 nt, Salmonella typhimurium LT2
aguuuaauucuuuga

SEQ ID NO: 1872672 - RNA, 18 nt, Salmonella typhimurium LT2
aguuuaaacacucuccac

SEQ ID NO: 1872673 - RNA, 15 nt, Salmonella typhimurium LT2
aguuuaaagccaauc

SEQ ID NO: 1872674 - RNA, 16 nt, Salmonella typhimurium LT2
aguuggcauaaugaac

SEQ ID NO: 1872675 - RNA, 14 nt, Salmonella typhimurium LT2
aguuguuccagcag

SEQ ID NO: 1872676 - RNA, 17 nt, Salmonella typhimurium LT2
aguuguucacgggaacg

SEQ ID NO: 1872677 - RNA, 15 nt, Salmonella typhimurium LT2
aguugcugauuaaaa

SEQ ID NO: 1872678 - RNA, 21 nt, Salmonella typhimurium LT2
aguugcugauuaaaaucauua

SEQ ID NO: 1872679 - RNA, 15 nt, Salmonella typhimurium LT2
aguugcuuaccuugu

SEQ ID NO: 1872680 - RNA, 19 nt, Salmonella typhimurium LT2
aguugcacccgaacaacaa

SEQ ID NO: 1872681 - RNA, 18 nt, Salmonella typhimurium LT2
aguucuucccugcaauau

SEQ ID NO: 1872682 - RNA, 23 nt, Salmonella typhimurium LT2
aguucuucccaccggacgaaaaa

SEQ ID NO: 1872683 - RNA, 19 nt, Salmonella typhimurium LT2
aguucuucaucccacucaa

SEQ ID NO: 1872684 - RNA, 16 nt, Salmonella typhimurium LT2
aguugaacgguaaaca

SEQ ID NO: 1872685 - RNA, 20 nt, Salmonella typhimurium LT2
aguuuugcuucaugcacaaa

SEQ ID NO: 1872686 - RNA, 16 nt, Salmonella typhimurium LT2
aguuuugcuucaugca

SEQ ID NO: 1872687 - RNA, 20 nt, Salmonella typhimurium LT2
aguuuuuuuaagaaggucag

SEQ ID NO: 1872688 - RNA, 13 nt, Salmonella typhimurium LT2
aguuuuuuuaaaa

SEQ ID NO: 1872689 - RNA, 18 nt, Salmonella typhimurium LT2
aguuuugcauucugcaac

SEQ ID NO: 1872690 - RNA, 15 nt, Salmonella typhimurium LT2
aguuucguuaccccg

SEQ ID NO: 1872691 - RNA, 22 nt, Salmonella typhimurium LT2
aguuugucuucgaugcgcucau

SEQ ID NO: 1872692 - RNA, 15 nt, Salmonella typhimurium LT2
aguuuguccauuucu

SEQ ID NO: 1872693 - RNA, 16 nt, Salmonella typhimurium LT2
aguuugauagcgcuau

SEQ ID NO: 1872694 - RNA, 22 nt, Salmonella typhimurium LT2
aguuugauagcgcuauguaaga

SEQ ID NO: 1872695 - RNA, 14 nt, Salmonella typhimurium LT2
aguuucuuaccuac

SEQ ID NO: 1872696 - RNA, 19 nt, Salmonella typhimurium LT2
aguuucuguucgaccguca

SEQ ID NO: 1872697 - RNA, 21 nt, Salmonella typhimurium LT2
aguuucuuuuuccaaauaguu

SEQ ID NO: 1872698 - RNA, 17 nt, Salmonella typhimurium LT2
aucacgcauaucccacu

SEQ ID NO: 1872699 - RNA, 17 nt, Salmonella typhimurium LT2
aucacgccguccagcac

SEQ ID NO: 1872700 - RNA, 23 nt, Salmonella typhimurium LT2
aucacgcugggcgaauacccagc

SEQ ID NO: 1872701 - RNA, 23 nt, Salmonella typhimurium LT2
aucaccugcuggcggcguaagcg

SEQ ID NO: 1872702 - RNA, 17 nt, Salmonella typhimurium LT2
aucacugauauaacccu

SEQ ID NO: 1872703 - RNA, 21 nt, Salmonella typhimurium LT2
aucacuaucaguuuuggcaau

SEQ ID NO: 1872704 - RNA, 14 nt, Salmonella typhimurium LT2
aucacuaauuugcg

SEQ ID NO: 1872705 - RNA, 13 nt, Salmonella typhimurium LT2
aucacuaauuugc

SEQ ID NO: 1872706 - RNA, 15 nt, Salmonella typhimurium LT2
aucacuaagaccagc

SEQ ID NO: 1872707 - RNA, 19 nt, Salmonella typhimurium LT2
aucacguuuugcagcgcca

SEQ ID NO: 1872708 - RNA, 12 nt, Salmonella typhimurium LT2
aucaccagcacc

SEQ ID NO: 1872709 - RNA, 13 nt, Salmonella typhimurium LT2
aucaccaucccau

SEQ ID NO: 1872710 - RNA, 21 nt, Salmonella typhimurium LT2
aucaccaucguugccagcggc

SEQ ID NO: 1872711 - RNA, 17 nt, Salmonella typhimurium LT2
aucaccauucccagcgc

SEQ ID NO: 1872712 - RNA, 18 nt, Salmonella typhimurium LT2
aucaccauucccagcgcc

SEQ ID NO: 1872713 - RNA, 19 nt, Salmonella typhimurium LT2
aucaccauucccagcgccc

SEQ ID NO: 1872714 - RNA, 19 nt, Salmonella typhimurium LT2
aucacccugaauuucaaua

SEQ ID NO: 1872715 - RNA, 21 nt, Salmonella typhimurium LT2
aucaccgcggcaaccagccca

SEQ ID NO: 1872716 - RNA, 18 nt, Salmonella typhimurium LT2
aucaccgccagucccagc

SEQ ID NO: 1872717 - RNA, 19 nt, Salmonella typhimurium LT2
aucaccucgcuucccugac

SEQ ID NO: 1872718 - RNA, 15 nt, Salmonella typhimurium LT2
aucaccggcauuuca

SEQ ID NO: 1872719 - RNA, 16 nt, Salmonella typhimurium LT2
aucacaucccagcaga

SEQ ID NO: 1872720 - RNA, 20 nt, Salmonella typhimurium LT2
aucagcaaacgaccuuucgc

SEQ ID NO: 1872721 - RNA, 13 nt, Salmonella typhimurium LT2
aucagcaauaauu

SEQ ID NO: 1872722 - RNA, 21 nt, Salmonella typhimurium LT2
aucagcaagaugacccauuua

SEQ ID NO: 1872723 - RNA, 15 nt, Salmonella typhimurium LT2
aucagcaccacgccc

SEQ ID NO: 1872724 - RNA, 17 nt, Salmonella typhimurium LT2
aucagcacacuacacag

SEQ ID NO: 1872725 - RNA, 19 nt, Salmonella typhimurium LT2
aucagcacgcggaacacgg

SEQ ID NO: 1872726 - RNA, 17 nt, Salmonella typhimurium LT2
aucagcaguugcgacug

SEQ ID NO: 1872727 - RNA, 19 nt, Salmonella typhimurium LT2
aucagcauuggucaucgcc

SEQ ID NO: 1872728 - RNA, 17 nt, Salmonella typhimurium LT2
aucagcgauugcgccag

SEQ ID NO: 1872729 - RNA, 14 nt, Salmonella typhimurium LT2
aucagcgacucauu

SEQ ID NO: 1872730 - RNA, 13 nt, Salmonella typhimurium LT2
aucagcgacuggu

SEQ ID NO: 1872731 - RNA, 15 nt, Salmonella typhimurium LT2
aucagcgaaggcaac

SEQ ID NO: 1872732 - RNA, 22 nt, Salmonella typhimurium LT2
aucagcccgauacccgcccaga

SEQ ID NO: 1872733 - RNA, 19 nt, Salmonella typhimurium LT2
aucagccccagcaccagag

SEQ ID NO: 1872734 - RNA, 13 nt, Salmonella typhimurium LT2
aucagccagcauc

SEQ ID NO: 1872735 - RNA, 18 nt, Salmonella typhimurium LT2
aucagcgccaccacaaac

SEQ ID NO: 1872736 - RNA, 15 nt, Salmonella typhimurium LT2
aucagcgccagcccu

SEQ ID NO: 1872737 - RNA, 24 nt, Salmonella typhimurium LT2
aucagcggcugcaaagcaucugcc

SEQ ID NO: 1872738 - RNA, 15 nt, Salmonella typhimurium LT2
aucagcgcuaccagc

SEQ ID NO: 1872739 - RNA, 14 nt, Salmonella typhimurium LT2
aucagcgcgcucca

SEQ ID NO: 1872740 - RNA, 20 nt, Salmonella typhimurium LT2
aucagcgcgcuccagaccac

SEQ ID NO: 1872741 - RNA, 15 nt, Salmonella typhimurium LT2
aucagcggcagcucg

SEQ ID NO: 1872742 - RNA, 18 nt, Salmonella typhimurium LT2
aucagcggcagcucgugc

SEQ ID NO: 1872743 - RNA, 14 nt, Salmonella typhimurium LT2
aucagagacaaaua

SEQ ID NO: 1872744 - RNA, 18 nt, Salmonella typhimurium LT2
aucagagacaaauacaug

SEQ ID NO: 1872745 - RNA, 19 nt, Salmonella typhimurium LT2
aucagauacggcuccagca

SEQ ID NO: 1872746 - RNA, 13 nt, Salmonella typhimurium LT2
aucagauaaccug

SEQ ID NO: 1872747 - RNA, 15 nt, Salmonella typhimurium LT2
aucagauuguugccg

SEQ ID NO: 1872748 - RNA, 17 nt, Salmonella typhimurium LT2
aucagaugugguauuuu

SEQ ID NO: 1872749 - RNA, 13 nt, Salmonella typhimurium LT2
aucagaccgacaa

SEQ ID NO: 1872750 - RNA, 12 nt, Salmonella typhimurium LT2
aucagacaggca

SEQ ID NO: 1872751 - RNA, 14 nt, Salmonella typhimurium LT2
aucagacuaucuuc

SEQ ID NO: 1872752 - RNA, 15 nt, Salmonella typhimurium LT2
aucagacugguuguu

SEQ ID NO: 1872753 - RNA, 18 nt, Salmonella typhimurium LT2
aucagaccgagacccagc

SEQ ID NO: 1872754 - RNA, 20 nt, Salmonella typhimurium LT2
aucagaccgagacccagcgc

SEQ ID NO: 1872755 - RNA, 16 nt, Salmonella typhimurium LT2
aucagaccgauaaaua

SEQ ID NO: 1872756 - RNA, 20 nt, Salmonella typhimurium LT2
aucacuggagcgcauuuuac

SEQ ID NO: 1872757 - RNA, 19 nt, Salmonella typhimurium LT2
aucacugucagaaauuaaa

SEQ ID NO: 1872758 - RNA, 12 nt, Salmonella typhimurium LT2
aucacuuaucaa

SEQ ID NO: 1872759 - RNA, 14 nt, Salmonella typhimurium LT2
aucacuuccgccac

SEQ ID NO: 1872760 - RNA, 13 nt, Salmonella typhimurium LT2
aucacuuucaguu

SEQ ID NO: 1872761 - RNA, 15 nt, Salmonella typhimurium LT2
aucagaagaagacaa

SEQ ID NO: 1872762 - RNA, 21 nt, Salmonella typhimurium LT2
aucagaacucacauauucaau

SEQ ID NO: 1872763 - RNA, 14 nt, Salmonella typhimurium LT2
aucagaaaaaauua

SEQ ID NO: 1872764 - RNA, 19 nt, Salmonella typhimurium LT2
aucagaaaaaagccaagca

SEQ ID NO: 1872765 - RNA, 21 nt, Salmonella typhimurium LT2
aucaagcuuugcguaaaaaaa

SEQ ID NO: 1872766 - RNA, 15 nt, Salmonella typhimurium LT2
aucaagguugcucag

SEQ ID NO: 1872767 - RNA, 17 nt, Salmonella typhimurium LT2
aucaagauugaguccau

SEQ ID NO: 1872768 - RNA, 17 nt, Salmonella typhimurium LT2
aucaacgccuccaggcu

SEQ ID NO: 1872769 - RNA, 20 nt, Salmonella typhimurium LT2
aucaacgccgcgccaucagg

SEQ ID NO: 1872770 - RNA, 18 nt, Salmonella typhimurium LT2
aucaacgccauaauccac

SEQ ID NO: 1872771 - RNA, 22 nt, Salmonella typhimurium LT2
aucaaaccauucccgucccugc

SEQ ID NO: 1872772 - RNA, 20 nt, Salmonella typhimurium LT2
aucaaacugaaaaucaaaua

SEQ ID NO: 1872773 - RNA, 21 nt, Salmonella typhimurium LT2
aucaaacuuuuaaauugaaga

SEQ ID NO: 1872774 - RNA, 15 nt, Salmonella typhimurium LT2
aucaacgaaaucaga

SEQ ID NO: 1872775 - RNA, 16 nt, Salmonella typhimurium LT2
aucaacccucccugca

SEQ ID NO: 1872776 - RNA, 12 nt, Salmonella typhimurium LT2
aucaaccgguuu

SEQ ID NO: 1872777 - RNA, 14 nt, Salmonella typhimurium LT2
aucaaccaccuuca

SEQ ID NO: 1872778 - RNA, 19 nt, Salmonella typhimurium LT2
aucaauggugaauuugcug

SEQ ID NO: 1872779 - RNA, 12 nt, Salmonella typhimurium LT2
aucaaugcccag

SEQ ID NO: 1872780 - RNA, 22 nt, Salmonella typhimurium LT2
aucaaugcccagcgcaaucacg

SEQ ID NO: 1872781 - RNA, 12 nt, Salmonella typhimurium LT2
aucaauagcaag

SEQ ID NO: 1872782 - RNA, 15 nt, Salmonella typhimurium LT2
aucacagacagaugc

SEQ ID NO: 1872783 - RNA, 17 nt, Salmonella typhimurium LT2
aucacacugacaauaaa

SEQ ID NO: 1872784 - RNA, 13 nt, Salmonella typhimurium LT2
aucacacaaguca

SEQ ID NO: 1872785 - RNA, 15 nt, Salmonella typhimurium LT2
aucacacccagcgcg

SEQ ID NO: 1872786 - RNA, 21 nt, Salmonella typhimurium LT2
aucacaaucagccacggcaac

SEQ ID NO: 1872787 - RNA, 23 nt, Salmonella typhimurium LT2
aucacaauuacgcaagagagcaa

SEQ ID NO: 1872788 - RNA, 19 nt, Salmonella typhimurium LT2
aucaauuuuucgcccgguu

SEQ ID NO: 1872789 - RNA, 20 nt, Salmonella typhimurium LT2
aucacaacguaaugaucaug

SEQ ID NO: 1872790 - RNA, 23 nt, Salmonella typhimurium LT2
aucaauuucucuuuuauuauuuu

SEQ ID NO: 1872791 - RNA, 16 nt, Salmonella typhimurium LT2
aucaauuuuaauuuaa

SEQ ID NO: 1872792 - RNA, 19 nt, Salmonella typhimurium LT2
aucaauuuuaauuuaauaa

SEQ ID NO: 1872793 - RNA, 21 nt, Salmonella typhimurium LT2
aucaauuuuaauuuaauaaua

SEQ ID NO: 1872794 - RNA, 12 nt, Salmonella typhimurium LT2
aucaauuuuucg

SEQ ID NO: 1872795 - RNA, 22 nt, Salmonella typhimurium LT2
auauucaacgaaugccugcaua

SEQ ID NO: 1872796 - RNA, 22 nt, Salmonella typhimurium LT2
auauuauugacgcuuucuuccc

SEQ ID NO: 1872797 - RNA, 15 nt, Salmonella typhimurium LT2
auauuauuuuuuuau

SEQ ID NO: 1872798 - RNA, 13 nt, Salmonella typhimurium LT2
auauucagaauuu

SEQ ID NO: 1872799 - RNA, 14 nt, Salmonella typhimurium LT2
auaugagcacagcc

SEQ ID NO: 1872800 - RNA, 12 nt, Salmonella typhimurium LT2
auauuauucugu

SEQ ID NO: 1872801 - RNA, 15 nt, Salmonella typhimurium LT2
auauuauugcccuuu

SEQ ID NO: 1872802 - RNA, 20 nt, Salmonella typhimurium LT2
auauucuguuagcgcccucu

SEQ ID NO: 1872803 - RNA, 21 nt, Salmonella typhimurium LT2
auauugcauuugcguccauau

SEQ ID NO: 1872804 - RNA, 18 nt, Salmonella typhimurium LT2
auauugauggccacaucg

SEQ ID NO: 1872805 - RNA, 18 nt, Salmonella typhimurium LT2
auauucgcagcucugugu

SEQ ID NO: 1872806 - RNA, 22 nt, Salmonella typhimurium LT2
auauucguccuuuaucagaugu

SEQ ID NO: 1872807 - RNA, 16 nt, Salmonella typhimurium LT2
aucaaaaaaaaccaga

SEQ ID NO: 1872808 - RNA, 13 nt, Salmonella typhimurium LT2
auauuuuucuaau

SEQ ID NO: 1872809 - RNA, 13 nt, Salmonella typhimurium LT2
auauuuuuucccc

SEQ ID NO: 1872810 - RNA, 15 nt, Salmonella typhimurium LT2
aucaaaaaccuuggu

SEQ ID NO: 1872811 - RNA, 16 nt, Salmonella typhimurium LT2
auauuuuguaggccua

SEQ ID NO: 1872812 - RNA, 20 nt, Salmonella typhimurium LT2
auauuuuguaggccuaaaaa

SEQ ID NO: 1872813 - RNA, 23 nt, Salmonella typhimurium LT2
auauuuuguaggccuaaaaauag

SEQ ID NO: 1872814 - RNA, 13 nt, Salmonella typhimurium LT2
auauuuuguaguu

SEQ ID NO: 1872815 - RNA, 18 nt, Salmonella typhimurium LT2
auauuuucuugcuacaua

SEQ ID NO: 1872816 - RNA, 21 nt, Salmonella typhimurium LT2
auauuuucuugcuacauaucu

SEQ ID NO: 1872817 - RNA, 23 nt, Salmonella typhimurium LT2
auauugugccucuuuuuucgcca

SEQ ID NO: 1872818 - RNA, 15 nt, Salmonella typhimurium LT2
auauugucauaaugu

SEQ ID NO: 1872819 - RNA, 16 nt, Salmonella typhimurium LT2
auauuuucaggcaccg

SEQ ID NO: 1872820 - RNA, 21 nt, Salmonella typhimurium LT2
auauuuuauuuccaauguaaa

SEQ ID NO: 1872821 - RNA, 22 nt, Salmonella typhimurium LT2
auacugaaauccgacaauuuuc

SEQ ID NO: 1872822 - RNA, 22 nt, Salmonella typhimurium LT2
auacugaacuauaggaaaauaa

SEQ ID NO: 1872823 - RNA, 21 nt, Salmonella typhimurium LT2
auacugaagauaaacagcagc

SEQ ID NO: 1872824 - RNA, 13 nt, Salmonella typhimurium LT2
auacugauaaaaa

SEQ ID NO: 1872825 - RNA, 17 nt, Salmonella typhimurium LT2
auacuguacgcccagcc

SEQ ID NO: 1872826 - RNA, 20 nt, Salmonella typhimurium LT2
auacuggucgcgucaauauu

SEQ ID NO: 1872827 - RNA, 18 nt, Salmonella typhimurium LT2
auacuggccgguuuuaaa

SEQ ID NO: 1872828 - RNA, 16 nt, Salmonella typhimurium LT2
auacugugggauuuuu

SEQ ID NO: 1872829 - RNA, 18 nt, Salmonella typhimurium LT2
auacugugggauuuuugg

SEQ ID NO: 1872830 - RNA, 19 nt, Salmonella typhimurium LT2
auacugugucgggccaggc

SEQ ID NO: 1872831 - RNA, 22 nt, Salmonella typhimurium LT2
auacgucgugacccacacauag

SEQ ID NO: 1872832 - RNA, 13 nt, Salmonella typhimurium LT2
auacguuaacccg

SEQ ID NO: 1872833 - RNA, 18 nt, Salmonella typhimurium LT2
auacucacgaauaagaau

SEQ ID NO: 1872834 - RNA, 16 nt, Salmonella typhimurium LT2
auacucaauauccugc

SEQ ID NO: 1872835 - RNA, 18 nt, Salmonella typhimurium LT2
auacucuuugaacagcca

SEQ ID NO: 1872836 - RNA, 22 nt, Salmonella typhimurium LT2
auacucuuggagagcaucaucu

SEQ ID NO: 1872837 - RNA, 14 nt, Salmonella typhimurium LT2
auacucugcuuuuu

SEQ ID NO: 1872838 - RNA, 20 nt, Salmonella typhimurium LT2
auacucugcuuuuucacccu

SEQ ID NO: 1872839 - RNA, 12 nt, Salmonella typhimurium LT2
auaccuucuucg

SEQ ID NO: 1872840 - RNA, 21 nt, Salmonella typhimurium LT2
auaccuucccgcgauaaaaac

SEQ ID NO: 1872841 - RNA, 21 nt, Salmonella typhimurium LT2
auaccuucgugaugugguugu

SEQ ID NO: 1872842 - RNA, 21 nt, Salmonella typhimurium LT2
auaccuucuucacuaaaaaca

SEQ ID NO: 1872843 - RNA, 22 nt, Salmonella typhimurium LT2
auacgagcgggucaggaaacug

SEQ ID NO: 1872844 - RNA, 12 nt, Salmonella typhimurium LT2
auacgcaccagc

SEQ ID NO: 1872845 - RNA, 13 nt, Salmonella typhimurium LT2
auacgccacgcuc

SEQ ID NO: 1872846 - RNA, 13 nt, Salmonella typhimurium LT2
auacgcagcacuu

SEQ ID NO: 1872847 - RNA, 18 nt, Salmonella typhimurium LT2
auacgccgccagcaauac

SEQ ID NO: 1872848 - RNA, 22 nt, Salmonella typhimurium LT2
auacgccgcuggugcuguuuuu

SEQ ID NO: 1872849 - RNA, 19 nt, Salmonella typhimurium LT2
auacgucauaucauccagc

SEQ ID NO: 1872850 - RNA, 15 nt, Salmonella typhimurium LT2
auacguaauaccuga

SEQ ID NO: 1872851 - RNA, 17 nt, Salmonella typhimurium LT2
auacgguaaaucauuug

SEQ ID NO: 1872852 - RNA, 16 nt, Salmonella typhimurium LT2
auacggcuccagcaca

SEQ ID NO: 1872853 - RNA, 15 nt, Salmonella typhimurium LT2
auacggggucuaagg

SEQ ID NO: 1872854 - RNA, 13 nt, Salmonella typhimurium LT2
auaccucauuuca

SEQ ID NO: 1872855 - RNA, 18 nt, Salmonella typhimurium LT2
auaccguccaccagcaca

SEQ ID NO: 1872856 - RNA, 23 nt, Salmonella typhimurium LT2
auaccggugcgccccagcaugag

SEQ ID NO: 1872857 - RNA, 13 nt, Salmonella typhimurium LT2
auaccguccacca

SEQ ID NO: 1872858 - RNA, 20 nt, Salmonella typhimurium LT2
auaccuccucucuuccuccu

SEQ ID NO: 1872859 - RNA, 15 nt, Salmonella typhimurium LT2
auaccggcaucacgc

SEQ ID NO: 1872860 - RNA, 19 nt, Salmonella typhimurium LT2
auaccggcaacgccgggaa

SEQ ID NO: 1872861 - RNA, 15 nt, Salmonella typhimurium LT2
auaccggaggagugc

SEQ ID NO: 1872862 - RNA, 14 nt, Salmonella typhimurium LT2
auaccggauugcuc

SEQ ID NO: 1872863 - RNA, 15 nt, Salmonella typhimurium LT2
auaccggauugcucg

SEQ ID NO: 1872864 - RNA, 20 nt, Salmonella typhimurium LT2
auaccgcuuuguaaaacauu

SEQ ID NO: 1872865 - RNA, 18 nt, Salmonella typhimurium LT2
auagauccggauugauau

SEQ ID NO: 1872866 - RNA, 16 nt, Salmonella typhimurium LT2
auagaugggauggucu

SEQ ID NO: 1872867 - RNA, 15 nt, Salmonella typhimurium LT2
auagaguaauacauc

SEQ ID NO: 1872868 - RNA, 14 nt, Salmonella typhimurium LT2
auagaguuaaaagg

SEQ ID NO: 1872869 - RNA, 14 nt, Salmonella typhimurium LT2
auagagaaaucaac

SEQ ID NO: 1872870 - RNA, 17 nt, Salmonella typhimurium LT2
auagagacugccgccgu

SEQ ID NO: 1872871 - RNA, 18 nt, Salmonella typhimurium LT2
auagagcaaucuggcagu

SEQ ID NO: 1872872 - RNA, 14 nt, Salmonella typhimurium LT2
auagagcaucaacc

SEQ ID NO: 1872873 - RNA, 12 nt, Salmonella typhimurium LT2
auacuuuuacuc

SEQ ID NO: 1872874 - RNA, 21 nt, Salmonella typhimurium LT2
auacuugcugcuaugaaaaau

SEQ ID NO: 1872875 - RNA, 16 nt, Salmonella typhimurium LT2
auagcaggagauauag

SEQ ID NO: 1872876 - RNA, 17 nt, Salmonella typhimurium LT2
auagccauugcugcuau

SEQ ID NO: 1872877 - RNA, 23 nt, Salmonella typhimurium LT2
auagccauugcugcuauauaaca

SEQ ID NO: 1872878 - RNA, 17 nt, Salmonella typhimurium LT2
auagccagcccccugcc

SEQ ID NO: 1872879 - RNA, 18 nt, Salmonella typhimurium LT2
auagccagcccccugcca

SEQ ID NO: 1872880 - RNA, 13 nt, Salmonella typhimurium LT2
auagccauuuaau

SEQ ID NO: 1872881 - RNA, 19 nt, Salmonella typhimurium LT2
auagcccagcgugccugcc

SEQ ID NO: 1872882 - RNA, 19 nt, Salmonella typhimurium LT2
auagccaucggcauaaccc

SEQ ID NO: 1872883 - RNA, 12 nt, Salmonella typhimurium LT2
auagcccggcuu

SEQ ID NO: 1872884 - RNA, 22 nt, Salmonella typhimurium LT2
auagcccggcauguccaucaga

SEQ ID NO: 1872885 - RNA, 14 nt, Salmonella typhimurium LT2
auagcgcggaauau

SEQ ID NO: 1872886 - RNA, 14 nt, Salmonella typhimurium LT2
auagcgcgcuaaac

SEQ ID NO: 1872887 - RNA, 15 nt, Salmonella typhimurium LT2
auagcccguuaugcc

SEQ ID NO: 1872888 - RNA, 22 nt, Salmonella typhimurium LT2
auagcggggacuguggaagaga

SEQ ID NO: 1872889 - RNA, 14 nt, Salmonella typhimurium LT2
auagcggguaaaca

SEQ ID NO: 1872890 - RNA, 21 nt, Salmonella typhimurium LT2
auagcggacuuccuucuaccg

SEQ ID NO: 1872891 - RNA, 18 nt, Salmonella typhimurium LT2
auagcuguuccgcaacac

SEQ ID NO: 1872892 - RNA, 20 nt, Salmonella typhimurium LT2
auagcuggcuuuauauaaaa

SEQ ID NO: 1872893 - RNA, 18 nt, Salmonella typhimurium LT2
auagcuggcugucuuccg

SEQ ID NO: 1872894 - RNA, 13 nt, Salmonella typhimurium LT2
auaggaaaauaau

SEQ ID NO: 1872895 - RNA, 15 nt, Salmonella typhimurium LT2
auagcuaaugcaaua

SEQ ID NO: 1872896 - RNA, 16 nt, Salmonella typhimurium LT2
auagcugagacucagu

SEQ ID NO: 1872897 - RNA, 17 nt, Salmonella typhimurium LT2
auagcugcugacguaaa

SEQ ID NO: 1872898 - RNA, 19 nt, Salmonella typhimurium LT2
auagcugcugacguaaauu

SEQ ID NO: 1872899 - RNA, 20 nt, Salmonella typhimurium LT2
auaucuguauaaauaaaauu

SEQ ID NO: 1872900 - RNA, 18 nt, Salmonella typhimurium LT2
auaugacguauugaaaau

SEQ ID NO: 1872901 - RNA, 17 nt, Salmonella typhimurium LT2
auauccacguuccgcaa

SEQ ID NO: 1872902 - RNA, 14 nt, Salmonella typhimurium LT2
auaucauucuguuc

SEQ ID NO: 1872903 - RNA, 14 nt, Salmonella typhimurium LT2
auaucgccauucac

SEQ ID NO: 1872904 - RNA, 20 nt, Salmonella typhimurium LT2
auaucaaacacaaauuucga

SEQ ID NO: 1872905 - RNA, 18 nt, Salmonella typhimurium LT2
auaucaccaucuuuuugc

SEQ ID NO: 1872906 - RNA, 17 nt, Salmonella typhimurium LT2
auaucacuaucaguuuu

SEQ ID NO: 1872907 - RNA, 22 nt, Salmonella typhimurium LT2
auaucauuagcgucauacuuaa

SEQ ID NO: 1872908 - RNA, 19 nt, Salmonella typhimurium LT2
auaucauuaugucauagca

SEQ ID NO: 1872909 - RNA, 19 nt, Salmonella typhimurium LT2
auaucagacgcgcaaaacu

SEQ ID NO: 1872910 - RNA, 18 nt, Salmonella typhimurium LT2
auauauuacgacugcacc

SEQ ID NO: 1872911 - RNA, 13 nt, Salmonella typhimurium LT2
auauacuucauca

SEQ ID NO: 1872912 - RNA, 17 nt, Salmonella typhimurium LT2
auaguaacguaugcugg

SEQ ID NO: 1872913 - RNA, 16 nt, Salmonella typhimurium LT2
auaggcggcaaauaaa

SEQ ID NO: 1872914 - RNA, 20 nt, Salmonella typhimurium LT2
auagguuaagccaaacucac

SEQ ID NO: 1872915 - RNA, 22 nt, Salmonella typhimurium LT2
auagguugaauaaccauacuga

SEQ ID NO: 1872916 - RNA, 12 nt, Salmonella typhimurium LT2
auaggcgccgcc

SEQ ID NO: 1872917 - RNA, 17 nt, Salmonella typhimurium LT2
auaggcgcaucugaaaa

SEQ ID NO: 1872918 - RNA, 21 nt, Salmonella typhimurium LT2
auaggcucaauaugccaggca

SEQ ID NO: 1872919 - RNA, 12 nt, Salmonella typhimurium LT2
auaggccaggcu

SEQ ID NO: 1872920 - RNA, 13 nt, Salmonella typhimurium LT2
auaggccaggcua

SEQ ID NO: 1872921 - RNA, 19 nt, Salmonella typhimurium LT2
auaggauguugcugcugcg

SEQ ID NO: 1872922 - RNA, 18 nt, Salmonella typhimurium LT2
auagugagcgacuucaaa

SEQ ID NO: 1872923 - RNA, 12 nt, Salmonella typhimurium LT2
auagugcagaaa

SEQ ID NO: 1872924 - RNA, 20 nt, Salmonella typhimurium LT2
auagugucgccauaaaucag

SEQ ID NO: 1872925 - RNA, 23 nt, Salmonella typhimurium LT2
auaguggcgcgacgcgucaguga

SEQ ID NO: 1872926 - RNA, 16 nt, Salmonella typhimurium LT2
auaguuuuuaauucca

SEQ ID NO: 1872927 - RNA, 18 nt, Salmonella typhimurium LT2
auaguuuuuaauuccacc

SEQ ID NO: 1872928 - RNA, 19 nt, Salmonella typhimurium LT2
auaguuuuucaagaauuac

SEQ ID NO: 1872929 - RNA, 22 nt, Salmonella typhimurium LT2
auaguguucauucguuuugcug

SEQ ID NO: 1872930 - RNA, 12 nt, Salmonella typhimurium LT2
auauaacagaau

SEQ ID NO: 1872931 - RNA, 21 nt, Salmonella typhimurium LT2
auauaaauuucauccaugcca

SEQ ID NO: 1872932 - RNA, 16 nt, Salmonella typhimurium LT2
auuaucgaaauagcgg

SEQ ID NO: 1872933 - RNA, 15 nt, Salmonella typhimurium LT2
auuauccggcaucaa

SEQ ID NO: 1872934 - RNA, 23 nt, Salmonella typhimurium LT2
auuauccagccgaaguucauaaa

SEQ ID NO: 1872935 - RNA, 11 nt, Salmonella typhimurium LT2
auuaucaccau

SEQ ID NO: 1872936 - RNA, 15 nt, Salmonella typhimurium LT2
auuaugaauaaccau

SEQ ID NO: 1872937 - RNA, 21 nt, Salmonella typhimurium LT2
auuauuggcuuuguaaauacu

SEQ ID NO: 1872938 - RNA, 22 nt, Salmonella typhimurium LT2
auuauugucuuuguugccuucg

SEQ ID NO: 1872939 - RNA, 16 nt, Salmonella typhimurium LT2
auuaugccugucauca

SEQ ID NO: 1872940 - RNA, 13 nt, Salmonella typhimurium LT2
auuaugccgacca

SEQ ID NO: 1872941 - RNA, 16 nt, Salmonella typhimurium LT2
auuauggcgugaugcu

SEQ ID NO: 1872942 - RNA, 15 nt, Salmonella typhimurium LT2
auuaugggcaaugau

SEQ ID NO: 1872943 - RNA, 23 nt, Salmonella typhimurium LT2
auuauuuuuucuuuaauuaaauu

SEQ ID NO: 1872944 - RNA, 17 nt, Salmonella typhimurium LT2
auuauuuuagugaaaaa

SEQ ID NO: 1872945 - RNA, 17 nt, Salmonella typhimurium LT2
auucaaucuggugacga

SEQ ID NO: 1872946 - RNA, 11 nt, Salmonella typhimurium LT2
auucaaucacu

SEQ ID NO: 1872947 - RNA, 11 nt, Salmonella typhimurium LT2
auucaauauug

SEQ ID NO: 1872948 - RNA, 15 nt, Salmonella typhimurium LT2
auucaacgcaucaaa

SEQ ID NO: 1872949 - RNA, 14 nt, Salmonella typhimurium LT2
auucaacguauuaa

SEQ ID NO: 1872950 - RNA, 23 nt, Salmonella typhimurium LT2
auucaccuggaaaggcuuuuuaa

SEQ ID NO: 1872951 - RNA, 19 nt, Salmonella typhimurium LT2
auucaccgugccaccggug

SEQ ID NO: 1872952 - RNA, 14 nt, Salmonella typhimurium LT2
auucaccaaauccu

SEQ ID NO: 1872953 - RNA, 21 nt, Salmonella typhimurium LT2
auucacaccaaugucauauuu

SEQ ID NO: 1872954 - RNA, 15 nt, Salmonella typhimurium LT2
auucacaccuuuaua

SEQ ID NO: 1872955 - RNA, 18 nt, Salmonella typhimurium LT2
auucaauuucccuuugcc

SEQ ID NO: 1872956 - RNA, 19 nt, Salmonella typhimurium LT2
auucacuuuccgaaucagg

SEQ ID NO: 1872957 - RNA, 18 nt, Salmonella typhimurium LT2
auucacgacaugagauaa

SEQ ID NO: 1872958 - RNA, 20 nt, Salmonella typhimurium LT2
auucacgacaugagauaaug

SEQ ID NO: 1872959 - RNA, 22 nt, Salmonella typhimurium LT2
auucacgcgauugucauccccc

SEQ ID NO: 1872960 - RNA, 20 nt, Salmonella typhimurium LT2
auucacucugaaaaauuuuc

SEQ ID NO: 1872961 - RNA, 18 nt, Salmonella typhimurium LT2
auucacucgccggguuuu

SEQ ID NO: 1872962 - RNA, 18 nt, Salmonella typhimurium LT2
auuacaucaauaaacauu

SEQ ID NO: 1872963 - RNA, 15 nt, Salmonella typhimurium LT2
auuacaucaaaugaa

SEQ ID NO: 1872964 - RNA, 19 nt, Salmonella typhimurium LT2
auuacagcauguucaugcg

SEQ ID NO: 1872965 - RNA, 16 nt, Salmonella typhimurium LT2
auuaauucaugugaaa

SEQ ID NO: 1872966 - RNA, 18 nt, Salmonella typhimurium LT2
auuaauuuauccaacagg

SEQ ID NO: 1872967 - RNA, 23 nt, Salmonella typhimurium LT2
auuacgccaucagcauuuucaca

SEQ ID NO: 1872968 - RNA, 23 nt, Salmonella typhimurium LT2
auuacgauugcgccaucuaaauu

SEQ ID NO: 1872969 - RNA, 15 nt, Salmonella typhimurium LT2
auuacggguaaugau

SEQ ID NO: 1872970 - RNA, 20 nt, Salmonella typhimurium LT2
auuacggacgauacaccuuc

SEQ ID NO: 1872971 - RNA, 22 nt, Salmonella typhimurium LT2
auuacucgccugcgcuuugugc

SEQ ID NO: 1872972 - RNA, 17 nt, Salmonella typhimurium LT2
auuacguucaacgggaa

SEQ ID NO: 1872973 - RNA, 22 nt, Salmonella typhimurium LT2
auuacguuggggauaaccagaa

SEQ ID NO: 1872974 - RNA, 16 nt, Salmonella typhimurium LT2
auuaccggcugccgau

SEQ ID NO: 1872975 - RNA, 21 nt, Salmonella typhimurium LT2
auuaccuucgcguaaugcaau

SEQ ID NO: 1872976 - RNA, 18 nt, Salmonella typhimurium LT2
auuacgaaaaggucuuuc

SEQ ID NO: 1872977 - RNA, 13 nt, Salmonella typhimurium LT2
auuaccuuuacau

SEQ ID NO: 1872978 - RNA, 22 nt, Salmonella typhimurium LT2
auuaccccguggugggguuccc

SEQ ID NO: 1872979 - RNA, 12 nt, Salmonella typhimurium LT2
auuaccccagca

SEQ ID NO: 1872980 - RNA, 20 nt, Salmonella typhimurium LT2
auuaccgcucguuaacccaa

SEQ ID NO: 1872981 - RNA, 21 nt, Salmonella typhimurium LT2
auuaccccuggugggguuccc

SEQ ID NO: 1872982 - RNA, 14 nt, Salmonella typhimurium LT2
auuaccagcaauaa

SEQ ID NO: 1872983 - RNA, 22 nt, Salmonella typhimurium LT2
auuagcgacgcauacucuugga

SEQ ID NO: 1872984 - RNA, 22 nt, Salmonella typhimurium LT2
auuagccuuccuggggaacaga

SEQ ID NO: 1872985 - RNA, 16 nt, Salmonella typhimurium LT2
auuagagacaugguaa

SEQ ID NO: 1872986 - RNA, 12 nt, Salmonella typhimurium LT2
auuagaauagcc

SEQ ID NO: 1872987 - RNA, 20 nt, Salmonella typhimurium LT2
auuacugcgugcuggcggcc

SEQ ID NO: 1872988 - RNA, 21 nt, Salmonella typhimurium LT2
auuauauagucaaugcccccg

SEQ ID NO: 1872989 - RNA, 13 nt, Salmonella typhimurium LT2
auuauauaauauc

SEQ ID NO: 1872990 - RNA, 21 nt, Salmonella typhimurium LT2
auuauauaacacgauuuuugu

SEQ ID NO: 1872991 - RNA, 18 nt, Salmonella typhimurium LT2
auuauauucguccuuuau

SEQ ID NO: 1872992 - RNA, 21 nt, Salmonella typhimurium LT2
auuauauguuucuguauuuuc

SEQ ID NO: 1872993 - RNA, 19 nt, Salmonella typhimurium LT2
auuauacuugcugcuauga

SEQ ID NO: 1872994 - RNA, 18 nt, Salmonella typhimurium LT2
auuauaacgugacuguca

SEQ ID NO: 1872995 - RNA, 13 nt, Salmonella typhimurium LT2
auuaggcuggguc

SEQ ID NO: 1872996 - RNA, 20 nt, Salmonella typhimurium LT2
auuagguuacguugucacaa

SEQ ID NO: 1872997 - RNA, 20 nt, Salmonella typhimurium LT2
auuagucugccauuuccuga

SEQ ID NO: 1872998 - RNA, 17 nt, Salmonella typhimurium LT2
auguugccggauagcuc

SEQ ID NO: 1872999 - RNA, 14 nt, Salmonella typhimurium LT2
auguugcugcugcg

SEQ ID NO: 1873000 - RNA, 17 nt, Salmonella typhimurium LT2
auguugcguaaauaaau

SEQ ID NO: 1873001 - RNA, 14 nt, Salmonella typhimurium LT2
auguuguuugaaaa

SEQ ID NO: 1873002 - RNA, 15 nt, Salmonella typhimurium LT2
auguuguuccagagu

SEQ ID NO: 1873003 - RNA, 17 nt, Salmonella typhimurium LT2
auguuguggcaauauuu

SEQ ID NO: 1873004 - RNA, 20 nt, Salmonella typhimurium LT2
auguuggauugcauccaacu

SEQ ID NO: 1873005 - RNA, 23 nt, Salmonella typhimurium LT2
auguuuucuuaacguuaagcaua

SEQ ID NO: 1873006 - RNA, 14 nt, Salmonella typhimurium LT2
auguuucuucgccc

SEQ ID NO: 1873007 - RNA, 17 nt, Salmonella typhimurium LT2
auguuucuguauuuucu

SEQ ID NO: 1873008 - RNA, 21 nt, Salmonella typhimurium LT2
auguuuaaucaacggguuaaa

SEQ ID NO: 1873009 - RNA, 17 nt, Salmonella typhimurium LT2
auuaaacguuauucauu

SEQ ID NO: 1873010 - RNA, 21 nt, Salmonella typhimurium LT2
auuaaaucagaugacaaugac

SEQ ID NO: 1873011 - RNA, 17 nt, Salmonella typhimurium LT2
auuaaaagaccccauuu

SEQ ID NO: 1873012 - RNA, 12 nt, Salmonella typhimurium LT2
auuaaaaccauu

SEQ ID NO: 1873013 - RNA, 12 nt, Salmonella typhimurium LT2
auuaaaauaaau

SEQ ID NO: 1873014 - RNA, 16 nt, Salmonella typhimurium LT2
auuaaaauaaauuaau

SEQ ID NO: 1873015 - RNA, 12 nt, Salmonella typhimurium LT2
auuaaaaugaug

SEQ ID NO: 1873016 - RNA, 18 nt, Salmonella typhimurium LT2
auguuuuuaucagcuugc

SEQ ID NO: 1873017 - RNA, 19 nt, Salmonella typhimurium LT2
auguuuuuaucagcuugcc

SEQ ID NO: 1873018 - RNA, 12 nt, Salmonella typhimurium LT2
auuaaguuuuuu

SEQ ID NO: 1873019 - RNA, 14 nt, Salmonella typhimurium LT2
auuaaguugaugaa

SEQ ID NO: 1873020 - RNA, 16 nt, Salmonella typhimurium LT2
auuaagccuuuuuaaa

SEQ ID NO: 1873021 - RNA, 19 nt, Salmonella typhimurium LT2
auuaagccuuuuuaaauau

SEQ ID NO: 1873022 - RNA, 22 nt, Salmonella typhimurium LT2
auuaagccuuuuuaaauauuaa

SEQ ID NO: 1873023 - RNA, 17 nt, Salmonella typhimurium LT2
auuaagggacgguaaau

SEQ ID NO: 1873024 - RNA, 16 nt, Salmonella typhimurium LT2
auuaaguuuuuuuaaa

SEQ ID NO: 1873025 - RNA, 14 nt, Salmonella typhimurium LT2
auuaauaugcgcaa

SEQ ID NO: 1873026 - RNA, 22 nt, Salmonella typhimurium LT2
auuaaucacaaugucaucaaga

SEQ ID NO: 1873027 - RNA, 23 nt, Salmonella typhimurium LT2
auuaaucacaaugucaucaagau

SEQ ID NO: 1873028 - RNA, 21 nt, Salmonella typhimurium LT2
auuaauccccggcgaaagaaa

SEQ ID NO: 1873029 - RNA, 21 nt, Salmonella typhimurium LT2
auuaaucagcagauagccugc

SEQ ID NO: 1873030 - RNA, 19 nt, Salmonella typhimurium LT2
auuaauaugcgcaaucacc

SEQ ID NO: 1873031 - RNA, 15 nt, Salmonella typhimurium LT2
auuaauauuuuauca

SEQ ID NO: 1873032 - RNA, 18 nt, Salmonella typhimurium LT2
auuaaugcuccaauaaau

SEQ ID NO: 1873033 - RNA, 17 nt, Salmonella typhimurium LT2
auuaaugcgaaaauaaa

SEQ ID NO: 1873034 - RNA, 17 nt, Salmonella typhimurium LT2
auuaaugcuccaauaaa

SEQ ID NO: 1873035 - RNA, 18 nt, Salmonella typhimurium LT2
auuaaaugcgccagcggc

SEQ ID NO: 1873036 - RNA, 13 nt, Salmonella typhimurium LT2
auuaacaaauaaa

SEQ ID NO: 1873037 - RNA, 11 nt, Salmonella typhimurium LT2
auuaacaucag

SEQ ID NO: 1873038 - RNA, 12 nt, Salmonella typhimurium LT2
auuaacucauca

SEQ ID NO: 1873039 - RNA, 22 nt, Salmonella typhimurium LT2
auuaacuauugacgaauagcug

SEQ ID NO: 1873040 - RNA, 16 nt, Salmonella typhimurium LT2
auuaacgacaaaaaua

SEQ ID NO: 1873041 - RNA, 23 nt, Salmonella typhimurium LT2
auuaacguuuguagaugaacucg

SEQ ID NO: 1873042 - RNA, 15 nt, Salmonella typhimurium LT2
auuaacgcgaaaaua

SEQ ID NO: 1873043 - RNA, 22 nt, Salmonella typhimurium LT2
augguuaaauuaaauaacaaau

SEQ ID NO: 1873044 - RNA, 14 nt, Salmonella typhimurium LT2
augguuaaauucau

SEQ ID NO: 1873045 - RNA, 20 nt, Salmonella typhimurium LT2
auggucgaaaauaucggccu

SEQ ID NO: 1873046 - RNA, 16 nt, Salmonella typhimurium LT2
augguauaugggcaau

SEQ ID NO: 1873047 - RNA, 21 nt, Salmonella typhimurium LT2
auggucgcgccgucgccugcc

SEQ ID NO: 1873048 - RNA, 15 nt, Salmonella typhimurium LT2
auggucgguauuauc

SEQ ID NO: 1873049 - RNA, 19 nt, Salmonella typhimurium LT2
auggucguauuuuggcgcu

SEQ ID NO: 1873050 - RNA, 14 nt, Salmonella typhimurium LT2
auggucuccagcaa

SEQ ID NO: 1873051 - RNA, 14 nt, Salmonella typhimurium LT2
augguaauauuaaa

SEQ ID NO: 1873052 - RNA, 13 nt, Salmonella typhimurium LT2
augguaauuuaaa

SEQ ID NO: 1873053 - RNA, 14 nt, Salmonella typhimurium LT2
augguaauuuaaag

SEQ ID NO: 1873054 - RNA, 24 nt, Salmonella typhimurium LT2
augguagcugcggcuauauaaaau

SEQ ID NO: 1873055 - RNA, 20 nt, Salmonella typhimurium LT2
augguacucaacaucauuaa

SEQ ID NO: 1873056 - RNA, 22 nt, Salmonella typhimurium LT2
augguauaaaucccggugggga

SEQ ID NO: 1873057 - RNA, 15 nt, Salmonella typhimurium LT2
augggcuucuucacu

SEQ ID NO: 1873058 - RNA, 23 nt, Salmonella typhimurium LT2
augguaaaauuauugugagaaaa

SEQ ID NO: 1873059 - RNA, 17 nt, Salmonella typhimurium LT2
auggguuccaguugcac

SEQ ID NO: 1873060 - RNA, 16 nt, Salmonella typhimurium LT2
augggcggccugcgcc

SEQ ID NO: 1873061 - RNA, 18 nt, Salmonella typhimurium LT2
augggccuacgccuggau

SEQ ID NO: 1873062 - RNA, 17 nt, Salmonella typhimurium LT2
augggccuacgccugga

SEQ ID NO: 1873063 - RNA, 17 nt, Salmonella typhimurium LT2
auggcugagaaucaccu

SEQ ID NO: 1873064 - RNA, 21 nt, Salmonella typhimurium LT2
auggcggcuuggcuguagaua

SEQ ID NO: 1873065 - RNA, 19 nt, Salmonella typhimurium LT2
auggcggcgugaccgccuu

SEQ ID NO: 1873066 - RNA, 22 nt, Salmonella typhimurium LT2
auggcggauuccaguagcgcgc

SEQ ID NO: 1873067 - RNA, 17 nt, Salmonella typhimurium LT2
auggcggccagauggca

SEQ ID NO: 1873068 - RNA, 18 nt, Salmonella typhimurium LT2
auggcgggccugugccug

SEQ ID NO: 1873069 - RNA, 14 nt, Salmonella typhimurium LT2
auggccauagacuu

SEQ ID NO: 1873070 - RNA, 17 nt, Salmonella typhimurium LT2
auggcccacguaagugg

SEQ ID NO: 1873071 - RNA, 18 nt, Salmonella typhimurium LT2
auggcgcgccacuucuuu

SEQ ID NO: 1873072 - RNA, 20 nt, Salmonella typhimurium LT2
auggcgcgccacuucuuuga

SEQ ID NO: 1873073 - RNA, 16 nt, Salmonella typhimurium LT2
auggcgcgcgccgccu

SEQ ID NO: 1873074 - RNA, 18 nt, Salmonella typhimurium LT2
auggcgcgaaaacagcug

SEQ ID NO: 1873075 - RNA, 15 nt, Salmonella typhimurium LT2
auggcgcugcgcgca

SEQ ID NO: 1873076 - RNA, 18 nt, Salmonella typhimurium LT2
auggcggaguaccgccuu

SEQ ID NO: 1873077 - RNA, 15 nt, Salmonella typhimurium LT2
auggcagauaaacca

SEQ ID NO: 1873078 - RNA, 20 nt, Salmonella typhimurium LT2
auggcacuggcgacggcauc

SEQ ID NO: 1873079 - RNA, 19 nt, Salmonella typhimurium LT2
auggcaguauaaauaccuu

SEQ ID NO: 1873080 - RNA, 22 nt, Salmonella typhimurium LT2
auggcauaacgcuguagcguuu

SEQ ID NO: 1873081 - RNA, 22 nt, Salmonella typhimurium LT2
auggccaauguacguaaaacca

SEQ ID NO: 1873082 - RNA, 17 nt, Salmonella typhimurium LT2
augccuuuuucaacagc

SEQ ID NO: 1873083 - RNA, 14 nt, Salmonella typhimurium LT2
augcgauguaaaaa

SEQ ID NO: 1873084 - RNA, 14 nt, Salmonella typhimurium LT2
augcgcaaaucaaa

SEQ ID NO: 1873085 - RNA, 18 nt, Salmonella typhimurium LT2
auguccaucagauucaac

SEQ ID NO: 1873086 - RNA, 17 nt, Salmonella typhimurium LT2
augucccgauauugguc

SEQ ID NO: 1873087 - RNA, 17 nt, Salmonella typhimurium LT2
auguccgauagcauuau

SEQ ID NO: 1873088 - RNA, 19 nt, Salmonella typhimurium LT2
auguccaggcgacaugaca

SEQ ID NO: 1873089 - RNA, 14 nt, Salmonella typhimurium LT2
augucaugaagcuc

SEQ ID NO: 1873090 - RNA, 14 nt, Salmonella typhimurium LT2
auguaguaaauagg

SEQ ID NO: 1873091 - RNA, 21 nt, Salmonella typhimurium LT2
auguaguaaauaggagaugca

SEQ ID NO: 1873092 - RNA, 18 nt, Salmonella typhimurium LT2
auguaaugcuugcugcuu

SEQ ID NO: 1873093 - RNA, 22 nt, Salmonella typhimurium LT2
auguaagacagcgcgcccagca

SEQ ID NO: 1873094 - RNA, 21 nt, Salmonella typhimurium LT2
augguuacuccucuuucccuu

SEQ ID NO: 1873095 - RNA, 13 nt, Salmonella typhimurium LT2
augugacauuuuc

SEQ ID NO: 1873096 - RNA, 14 nt, Salmonella typhimurium LT2
augugacauuuucg

SEQ ID NO: 1873097 - RNA, 20 nt, Salmonella typhimurium LT2
augucuuuuucagucaucau

SEQ ID NO: 1873098 - RNA, 16 nt, Salmonella typhimurium LT2
augugauuagcccacc

SEQ ID NO: 1873099 - RNA, 17 nt, Salmonella typhimurium LT2
auguuaaaagagaaaaa

SEQ ID NO: 1873100 - RNA, 18 nt, Salmonella typhimurium LT2
auguuaaaagagaaaaag

SEQ ID NO: 1873101 - RNA, 17 nt, Salmonella typhimurium LT2
auguguuugagcagccc

SEQ ID NO: 1873102 - RNA, 13 nt, Salmonella typhimurium LT2
augugguauuuuc

SEQ ID NO: 1873103 - RNA, 22 nt, Salmonella typhimurium LT2
auguuaaauacgccgccagcaa

SEQ ID NO: 1873104 - RNA, 19 nt, Salmonella typhimurium LT2
auguuaacgucgucauuca

SEQ ID NO: 1873105 - RNA, 22 nt, Salmonella typhimurium LT2
auguuaauaccagcgccaauca

SEQ ID NO: 1873106 - RNA, 17 nt, Salmonella typhimurium LT2
augugcaggcuuuuuca

SEQ ID NO: 1873107 - RNA, 13 nt, Salmonella typhimurium LT2
aucucauaaaccg

SEQ ID NO: 1873108 - RNA, 18 nt, Salmonella typhimurium LT2
aucucaggguguuuuuau

SEQ ID NO: 1873109 - RNA, 18 nt, Salmonella typhimurium LT2
aucucagauaauagcugc

SEQ ID NO: 1873110 - RNA, 14 nt, Salmonella typhimurium LT2
aucucaaugaugcc

SEQ ID NO: 1873111 - RNA, 18 nt, Salmonella typhimurium LT2
aucucauuguauuucuca

SEQ ID NO: 1873112 - RNA, 18 nt, Salmonella typhimurium LT2
aucucauaaacgccugga

SEQ ID NO: 1873113 - RNA, 19 nt, Salmonella typhimurium LT2
aucucaucagacuguaugu

SEQ ID NO: 1873114 - RNA, 22 nt, Salmonella typhimurium LT2
aucuccagcgcauugcccuucg

SEQ ID NO: 1873115 - RNA, 23 nt, Salmonella typhimurium LT2
aucucccaggccgccaccgccuc

SEQ ID NO: 1873116 - RNA, 16 nt, Salmonella typhimurium LT2
aucuccaucauuuccg

SEQ ID NO: 1873117 - RNA, 17 nt, Salmonella typhimurium LT2
aucuccggcgcugcgcu

SEQ ID NO: 1873118 - RNA, 22 nt, Salmonella typhimurium LT2
aucuccugcgauagcugcugac

SEQ ID NO: 1873119 - RNA, 23 nt, Salmonella typhimurium LT2
aucuccucgccguaaaauucacu

SEQ ID NO: 1873120 - RNA, 12 nt, Salmonella typhimurium LT2
aucuccugacau

SEQ ID NO: 1873121 - RNA, 15 nt, Salmonella typhimurium LT2
aucucaagccccaug

SEQ ID NO: 1873122 - RNA, 15 nt, Salmonella typhimurium LT2
aucucaagcgccgcc

SEQ ID NO: 1873123 - RNA, 17 nt, Salmonella typhimurium LT2
aucucaagcgccgccgc

SEQ ID NO: 1873124 - RNA, 22 nt, Salmonella typhimurium LT2
aucucaagcgccgccgcauuuu

SEQ ID NO: 1873125 - RNA, 15 nt, Salmonella typhimurium LT2
aucucaagagugaac

SEQ ID NO: 1873126 - RNA, 14 nt, Salmonella typhimurium LT2
aucuauuauuuuuc

SEQ ID NO: 1873127 - RNA, 17 nt, Salmonella typhimurium LT2
aucuauuauuuuucuau

SEQ ID NO: 1873128 - RNA, 16 nt, Salmonella typhimurium LT2
aucuauauauucuucu

SEQ ID NO: 1873129 - RNA, 19 nt, Salmonella typhimurium LT2
aucuauccaauaauaagaa

SEQ ID NO: 1873130 - RNA, 18 nt, Salmonella typhimurium LT2
aucuacgacaaaggcaaa

SEQ ID NO: 1873131 - RNA, 14 nt, Salmonella typhimurium LT2
aucuacuaucaucu

SEQ ID NO: 1873132 - RNA, 17 nt, Salmonella typhimurium LT2
aucucgugaucgccaaa

SEQ ID NO: 1873133 - RNA, 12 nt, Salmonella typhimurium LT2
aucucgccuggc

SEQ ID NO: 1873134 - RNA, 13 nt, Salmonella typhimurium LT2
aucucgcuaauca

SEQ ID NO: 1873135 - RNA, 16 nt, Salmonella typhimurium LT2
aucucugucgaccauc

SEQ ID NO: 1873136 - RNA, 13 nt, Salmonella typhimurium LT2
aucugaaaaaccu

SEQ ID NO: 1873137 - RNA, 21 nt, Salmonella typhimurium LT2
aucucuuccaggauacacaug

SEQ ID NO: 1873138 - RNA, 18 nt, Salmonella typhimurium LT2
aucugaaauaaaagcaau

SEQ ID NO: 1873139 - RNA, 19 nt, Salmonella typhimurium LT2
aucugacagccaaacugcu

SEQ ID NO: 1873140 - RNA, 22 nt, Salmonella typhimurium LT2
aucugacagccaaacugcugua

SEQ ID NO: 1873141 - RNA, 16 nt, Salmonella typhimurium LT2
aucugaccaugccagc

SEQ ID NO: 1873142 - RNA, 13 nt, Salmonella typhimurium LT2
aucugaguauuua

SEQ ID NO: 1873143 - RNA, 15 nt, Salmonella typhimurium LT2
aucugaguauuuaca

SEQ ID NO: 1873144 - RNA, 16 nt, Salmonella typhimurium LT2
aucugauauaucuuca

SEQ ID NO: 1873145 - RNA, 14 nt, Salmonella typhimurium LT2
aucugaugauuaau

SEQ ID NO: 1873146 - RNA, 13 nt, Salmonella typhimurium LT2
aucugcaaaauau

SEQ ID NO: 1873147 - RNA, 17 nt, Salmonella typhimurium LT2
aucugcccuuucuuaug

SEQ ID NO: 1873148 - RNA, 21 nt, Salmonella typhimurium LT2
aucugcgccgacauucccugc

SEQ ID NO: 1873149 - RNA, 16 nt, Salmonella typhimurium LT2
aucugcgcccauuucc

SEQ ID NO: 1873150 - RNA, 15 nt, Salmonella typhimurium LT2
aucugcauaggcuuu

SEQ ID NO: 1873151 - RNA, 20 nt, Salmonella typhimurium LT2
aucugcauguaguaagccau

SEQ ID NO: 1873152 - RNA, 17 nt, Salmonella typhimurium LT2
aucugcacguaccugcu

SEQ ID NO: 1873153 - RNA, 13 nt, Salmonella typhimurium LT2
aucugcccuuucu

SEQ ID NO: 1873154 - RNA, 13 nt, Salmonella typhimurium LT2
aucugccauuucu

SEQ ID NO: 1873155 - RNA, 16 nt, Salmonella typhimurium LT2
aucugccauuucugcu

SEQ ID NO: 1873156 - RNA, 22 nt, Salmonella typhimurium LT2
aucgggacgaucaccaucccau

SEQ ID NO: 1873157 - RNA, 13 nt, Salmonella typhimurium LT2
aucggcuugccuu

SEQ ID NO: 1873158 - RNA, 16 nt, Salmonella typhimurium LT2
aucgggcaauccauua

SEQ ID NO: 1873159 - RNA, 15 nt, Salmonella typhimurium LT2
aucgggcuuccagcg

SEQ ID NO: 1873160 - RNA, 14 nt, Salmonella typhimurium LT2
aucgggccuccgcg

SEQ ID NO: 1873161 - RNA, 13 nt, Salmonella typhimurium LT2
aucgggccugcuc

SEQ ID NO: 1873162 - RNA, 23 nt, Salmonella typhimurium LT2
aucgguaggccggauaaggcauu

SEQ ID NO: 1873163 - RNA, 19 nt, Salmonella typhimurium LT2
aucggcaaacgccgccugg

SEQ ID NO: 1873164 - RNA, 11 nt, Salmonella typhimurium LT2
aucggcaaaca

SEQ ID NO: 1873165 - RNA, 15 nt, Salmonella typhimurium LT2
aucggcaagcaucug

SEQ ID NO: 1873166 - RNA, 13 nt, Salmonella typhimurium LT2
aucggccagcagg

SEQ ID NO: 1873167 - RNA, 13 nt, Salmonella typhimurium LT2
aucggauccaucg

SEQ ID NO: 1873168 - RNA, 13 nt, Salmonella typhimurium LT2
aucgcuaaucagg

SEQ ID NO: 1873169 - RNA, 19 nt, Salmonella typhimurium LT2
aucggagggggaggcaggc

SEQ ID NO: 1873170 - RNA, 17 nt, Salmonella typhimurium LT2
aucggauuuacagggga

SEQ ID NO: 1873171 - RNA, 19 nt, Salmonella typhimurium LT2
aucgcggucagcggcgcgc

SEQ ID NO: 1873172 - RNA, 16 nt, Salmonella typhimurium LT2
aucgcguacaggaugu

SEQ ID NO: 1873173 - RNA, 17 nt, Salmonella typhimurium LT2
aucgcgucucccagaug

SEQ ID NO: 1873174 - RNA, 20 nt, Salmonella typhimurium LT2
aucgcguuuuccagcauccu

SEQ ID NO: 1873175 - RNA, 21 nt, Salmonella typhimurium LT2
aucgcuaaccaggccagaugc

SEQ ID NO: 1873176 - RNA, 17 nt, Salmonella typhimurium LT2
aucgcuaaacauauacc

SEQ ID NO: 1873177 - RNA, 15 nt, Salmonella typhimurium LT2
aucgcuaauuuuuaa

SEQ ID NO: 1873178 - RNA, 14 nt, Salmonella typhimurium LT2
aucguugccgccgu

SEQ ID NO: 1873179 - RNA, 15 nt, Salmonella typhimurium LT2
aucguucgcggaacg

SEQ ID NO: 1873180 - RNA, 18 nt, Salmonella typhimurium LT2
aucguucgccagugacaa

SEQ ID NO: 1873181 - RNA, 20 nt, Salmonella typhimurium LT2
aucuaaauuucaguauuacu

SEQ ID NO: 1873182 - RNA, 23 nt, Salmonella typhimurium LT2
aucgucgcgaucgcgccagccuu

SEQ ID NO: 1873183 - RNA, 16 nt, Salmonella typhimurium LT2
aucgucgccagaccca

SEQ ID NO: 1873184 - RNA, 16 nt, Salmonella typhimurium LT2
aucgucaugucucaga

SEQ ID NO: 1873185 - RNA, 19 nt, Salmonella typhimurium LT2
aucgucccacaugaacucg

SEQ ID NO: 1873186 - RNA, 16 nt, Salmonella typhimurium LT2
aucgugguuggcauau

SEQ ID NO: 1873187 - RNA, 23 nt, Salmonella typhimurium LT2
aucgugccguccggcaucacaaa

SEQ ID NO: 1873188 - RNA, 12 nt, Salmonella typhimurium LT2
aucguguggcug

SEQ ID NO: 1873189 - RNA, 22 nt, Salmonella typhimurium LT2
aucguguggcuguuaguaaaca

SEQ ID NO: 1873190 - RNA, 17 nt, Salmonella typhimurium LT2
aucguuacccaucaccu

SEQ ID NO: 1873191 - RNA, 23 nt, Salmonella typhimurium LT2
aucguuacccuauuuugcgccug

SEQ ID NO: 1873192 - RNA, 14 nt, Salmonella typhimurium LT2
aucgagagcgggug

SEQ ID NO: 1873193 - RNA, 13 nt, Salmonella typhimurium LT2
aucgagauaagau

SEQ ID NO: 1873194 - RNA, 15 nt, Salmonella typhimurium LT2
aucgagaucagacuu

SEQ ID NO: 1873195 - RNA, 22 nt, Salmonella typhimurium LT2
aucgaaaucucgcuaaucauca

SEQ ID NO: 1873196 - RNA, 13 nt, Salmonella typhimurium LT2
aucgaaaaccggu

SEQ ID NO: 1873197 - RNA, 23 nt, Salmonella typhimurium LT2
aucagcugcugcgcuuuccaggc

SEQ ID NO: 1873198 - RNA, 23 nt, Salmonella typhimurium LT2
aucagcguuucgccguaaaacaa

SEQ ID NO: 1873199 - RNA, 21 nt, Salmonella typhimurium LT2
aucgauagcauuuuuacucag

SEQ ID NO: 1873200 - RNA, 15 nt, Salmonella typhimurium LT2
aucgauauaaugccu

SEQ ID NO: 1873201 - RNA, 14 nt, Salmonella typhimurium LT2
aucgauaagccagc

SEQ ID NO: 1873202 - RNA, 15 nt, Salmonella typhimurium LT2
aucgcaaauucugua

SEQ ID NO: 1873203 - RNA, 20 nt, Salmonella typhimurium LT2
aucgagucaggcgccagagu

SEQ ID NO: 1873204 - RNA, 15 nt, Salmonella typhimurium LT2
aucgaggccaccaaa

SEQ ID NO: 1873205 - RNA, 18 nt, Salmonella typhimurium LT2
aucgagcggcaguagcag

SEQ ID NO: 1873206 - RNA, 22 nt, Salmonella typhimurium LT2
aucgcgagcaauuuccucugcc

SEQ ID NO: 1873207 - RNA, 14 nt, Salmonella typhimurium LT2
aucgcgacuucaau

SEQ ID NO: 1873208 - RNA, 17 nt, Salmonella typhimurium LT2
aucgcgcaauuacucuu

SEQ ID NO: 1873209 - RNA, 16 nt, Salmonella typhimurium LT2
aucgcgauccagcccc

SEQ ID NO: 1873210 - RNA, 18 nt, Salmonella typhimurium LT2
aucgcgauccugaaaugc

SEQ ID NO: 1873211 - RNA, 13 nt, Salmonella typhimurium LT2
aucgccucaacca

SEQ ID NO: 1873212 - RNA, 21 nt, Salmonella typhimurium LT2
aucgccucaacgcucauaccu

SEQ ID NO: 1873213 - RNA, 22 nt, Salmonella typhimurium LT2
aucgccgugaucgaggcgcugg

SEQ ID NO: 1873214 - RNA, 16 nt, Salmonella typhimurium LT2
aucgccgggaacagaa

SEQ ID NO: 1873215 - RNA, 17 nt, Salmonella typhimurium LT2
aucgcgccuccccugcc

SEQ ID NO: 1873216 - RNA, 13 nt, Salmonella typhimurium LT2
aucgcgccaggcu

SEQ ID NO: 1873217 - RNA, 23 nt, Salmonella typhimurium LT2
aucgcgggcaaucaaaugcgcau

SEQ ID NO: 1873218 - RNA, 14 nt, Salmonella typhimurium LT2
aucgcauaaauauc

SEQ ID NO: 1873219 - RNA, 19 nt, Salmonella typhimurium LT2
aucgccccgaccaggauga

SEQ ID NO: 1873220 - RNA, 22 nt, Salmonella typhimurium LT2
aucgccgguagcuucagcggcg

SEQ ID NO: 1873221 - RNA, 14 nt, Salmonella typhimurium LT2
aucuuuccggaacg

SEQ ID NO: 1873222 - RNA, 17 nt, Salmonella typhimurium LT2
aucuuuaccaaugugca

SEQ ID NO: 1873223 - RNA, 16 nt, Salmonella typhimurium LT2
aucuugacaugaaaaa

SEQ ID NO: 1873224 - RNA, 18 nt, Salmonella typhimurium LT2
aucuuuaaacuuuuuuau

SEQ ID NO: 1873225 - RNA, 17 nt, Salmonella typhimurium LT2
aucuugauaucaucauc

SEQ ID NO: 1873226 - RNA, 17 nt, Salmonella typhimurium LT2
aucuugauuacagucuc

SEQ ID NO: 1873227 - RNA, 20 nt, Salmonella typhimurium LT2
aucugcgugaugcaucagaa

SEQ ID NO: 1873228 - RNA, 16 nt, Salmonella typhimurium LT2
aucugggucaggaacu

SEQ ID NO: 1873229 - RNA, 18 nt, Salmonella typhimurium LT2
aucuggcugcguaaaauc

SEQ ID NO: 1873230 - RNA, 11 nt, Salmonella typhimurium LT2
aucuucuuccg

SEQ ID NO: 1873231 - RNA, 13 nt, Salmonella typhimurium LT2
aucuucugcugcu

SEQ ID NO: 1873232 - RNA, 22 nt, Salmonella typhimurium LT2
augaaacgugaaauauuucuuu

SEQ ID NO: 1873233 - RNA, 18 nt, Salmonella typhimurium LT2
augaaaccgcccugcagg

SEQ ID NO: 1873234 - RNA, 19 nt, Salmonella typhimurium LT2
augaaaccgcccugcaggc

SEQ ID NO: 1873235 - RNA, 13 nt, Salmonella typhimurium LT2
augaaaccccaaa

SEQ ID NO: 1873236 - RNA, 22 nt, Salmonella typhimurium LT2
augaaaauaugaugcuaucuuu

SEQ ID NO: 1873237 - RNA, 14 nt, Salmonella typhimurium LT2
aucuuuuccugaag

SEQ ID NO: 1873238 - RNA, 18 nt, Salmonella typhimurium LT2
augaagcaagugcuggag

SEQ ID NO: 1873239 - RNA, 11 nt, Salmonella typhimurium LT2
augaagccuua

SEQ ID NO: 1873240 - RNA, 23 nt, Salmonella typhimurium LT2
augaagccuuagcgggaggcggu

SEQ ID NO: 1873241 - RNA, 14 nt, Salmonella typhimurium LT2
augaagcucaacau

SEQ ID NO: 1873242 - RNA, 19 nt, Salmonella typhimurium LT2
augaaggauuguacuuauu

SEQ ID NO: 1873243 - RNA, 16 nt, Salmonella typhimurium LT2
augaagcggaaaggac

SEQ ID NO: 1873244 - RNA, 22 nt, Salmonella typhimurium LT2
augaaaucgucgccaacaccga

SEQ ID NO: 1873245 - RNA, 15 nt, Salmonella typhimurium LT2
augaaaucacccaga

SEQ ID NO: 1873246 - RNA, 18 nt, Salmonella typhimurium LT2
augagaaaaggaagaaua

SEQ ID NO: 1873247 - RNA, 16 nt, Salmonella typhimurium LT2
augacuuuuuugccaa

SEQ ID NO: 1873248 - RNA, 20 nt, Salmonella typhimurium LT2
augaccaucaaauaauacgc

SEQ ID NO: 1873249 - RNA, 15 nt, Salmonella typhimurium LT2
augacgcgcaggccg

SEQ ID NO: 1873250 - RNA, 14 nt, Salmonella typhimurium LT2
augacgcaggcgca

SEQ ID NO: 1873251 - RNA, 15 nt, Salmonella typhimurium LT2
augaguacggaacaa

SEQ ID NO: 1873252 - RNA, 22 nt, Salmonella typhimurium LT2
augaguacggaacaaaacggaa

SEQ ID NO: 1873253 - RNA, 12 nt, Salmonella typhimurium LT2
augagacaaaac

SEQ ID NO: 1873254 - RNA, 19 nt, Salmonella typhimurium LT2
augagaugcaggccaagca

SEQ ID NO: 1873255 - RNA, 15 nt, Salmonella typhimurium LT2
augaauaaucucugc

SEQ ID NO: 1873256 - RNA, 23 nt, Salmonella typhimurium LT2
augaauaccaaaucucaagagug

SEQ ID NO: 1873257 - RNA, 22 nt, Salmonella typhimurium LT2
augaauaaccucccgccggggc

SEQ ID NO: 1873258 - RNA, 12 nt, Salmonella typhimurium LT2
augaauaaccuc

SEQ ID NO: 1873259 - RNA, 13 nt, Salmonella typhimurium LT2
augaauaaaaaac

SEQ ID NO: 1873260 - RNA, 20 nt, Salmonella typhimurium LT2
augaauagccccucaauuau

SEQ ID NO: 1873261 - RNA, 14 nt, Salmonella typhimurium LT2
augacauucccauu

SEQ ID NO: 1873262 - RNA, 19 nt, Salmonella typhimurium LT2
augaccaccgcaucggcau

SEQ ID NO: 1873263 - RNA, 19 nt, Salmonella typhimurium LT2
augaauuucuucaucccag

SEQ ID NO: 1873264 - RNA, 20 nt, Salmonella typhimurium LT2
augaaugacaguucccugcu

SEQ ID NO: 1873265 - RNA, 14 nt, Salmonella typhimurium LT2
augaaugacugucc

SEQ ID NO: 1873266 - RNA, 23 nt, Salmonella typhimurium LT2
augauguccgccuugaggcguuu

SEQ ID NO: 1873267 - RNA, 18 nt, Salmonella typhimurium LT2
augauuucacccagaguu

SEQ ID NO: 1873268 - RNA, 14 nt, Salmonella typhimurium LT2
augcaacuggcaag

SEQ ID NO: 1873269 - RNA, 14 nt, Salmonella typhimurium LT2
augcaaccccugac

SEQ ID NO: 1873270 - RNA, 14 nt, Salmonella typhimurium LT2
augauuuuaacauc

SEQ ID NO: 1873271 - RNA, 18 nt, Salmonella typhimurium LT2
augcaaagaaaaacagga

SEQ ID NO: 1873272 - RNA, 17 nt, Salmonella typhimurium LT2
augauggggucacaggu

SEQ ID NO: 1873273 - RNA, 19 nt, Salmonella typhimurium LT2
augauaagcacuauuauau

SEQ ID NO: 1873274 - RNA, 20 nt, Salmonella typhimurium LT2
augauaaccgccgccaaacu

SEQ ID NO: 1873275 - RNA, 15 nt, Salmonella typhimurium LT2
augaucuuuccuuuu

SEQ ID NO: 1873276 - RNA, 14 nt, Salmonella typhimurium LT2
augccaaccaccgc

SEQ ID NO: 1873277 - RNA, 21 nt, Salmonella typhimurium LT2
augccaaguaauaaagagaac

SEQ ID NO: 1873278 - RNA, 21 nt, Salmonella typhimurium LT2
augccacgccccuaaggcagc

SEQ ID NO: 1873279 - RNA, 12 nt, Salmonella typhimurium LT2
augccacaggcu

SEQ ID NO: 1873280 - RNA, 22 nt, Salmonella typhimurium LT2
augccaccagccuaaaaacaga

SEQ ID NO: 1873281 - RNA, 15 nt, Salmonella typhimurium LT2
augccagcucaaauc

SEQ ID NO: 1873282 - RNA, 15 nt, Salmonella typhimurium LT2
augcacaacacgcuu

SEQ ID NO: 1873283 - RNA, 18 nt, Salmonella typhimurium LT2
augcacaaccagcggcac

SEQ ID NO: 1873284 - RNA, 13 nt, Salmonella typhimurium LT2
augcagccaggcc

SEQ ID NO: 1873285 - RNA, 21 nt, Salmonella typhimurium LT2
augcagcaucaugucacccac

SEQ ID NO: 1873286 - RNA, 15 nt, Salmonella typhimurium LT2
augcagguucccgcc

SEQ ID NO: 1873287 - RNA, 22 nt, Salmonella typhimurium LT2
augcaguagugugguauucagc

SEQ ID NO: 1873288 - RNA, 19 nt, Salmonella typhimurium LT2
augcaggcuauccacaacg

SEQ ID NO: 1873289 - RNA, 18 nt, Salmonella typhimurium LT2
augcaggcauaaaaaaga

SEQ ID NO: 1873290 - RNA, 22 nt, Salmonella typhimurium LT2
augcaggcggucgaaacacgaa

SEQ ID NO: 1873291 - RNA, 21 nt, Salmonella typhimurium LT2
augcagcggaauuaacugcac

SEQ ID NO: 1873292 - RNA, 16 nt, Salmonella typhimurium LT2
augccccagaaaaugc

SEQ ID NO: 1873293 - RNA, 18 nt, Salmonella typhimurium LT2
augcccacgcuucccagc

SEQ ID NO: 1873294 - RNA, 23 nt, Salmonella typhimurium LT2
augcccaccggaccuaauaacca

SEQ ID NO: 1873295 - RNA, 14 nt, Salmonella typhimurium LT2
augcccacaggcag

SEQ ID NO: 1873296 - RNA, 18 nt, Salmonella typhimurium LT2
augccauguuucuuuuaa

SEQ ID NO: 1873297 - RNA, 19 nt, Salmonella typhimurium LT2
augccaucggccagcaggc

SEQ ID NO: 1873298 - RNA, 12 nt, Salmonella typhimurium LT2
augccaucagag

SEQ ID NO: 1873299 - RNA, 19 nt, Salmonella typhimurium LT2
augccgcacuccccagaau

SEQ ID NO: 1873300 - RNA, 15 nt, Salmonella typhimurium LT2
augccgcauaaaauu

SEQ ID NO: 1873301 - RNA, 15 nt, Salmonella typhimurium LT2
augccgccgcaacac

SEQ ID NO: 1873302 - RNA, 22 nt, Salmonella typhimurium LT2
augcccggcuggcgauuauucc

SEQ ID NO: 1873303 - RNA, 17 nt, Salmonella typhimurium LT2
augcccgucccauuucu

SEQ ID NO: 1873304 - RNA, 21 nt, Salmonella typhimurium LT2
augccuguguaucgcccugcc

SEQ ID NO: 1873305 - RNA, 22 nt, Salmonella typhimurium LT2
augccuuauccggccugcaggc

SEQ ID NO: 1873306 - RNA, 20 nt, Salmonella typhimurium LT2
augccugcgcauccucuuuc

SEQ ID NO: 1873307 - RNA, 14 nt, Salmonella typhimurium LT2
augccugccgggcc

SEQ ID NO: 1873308 - RNA, 12 nt, Salmonella typhimurium LT2
augccuggcagu

SEQ ID NO: 1873309 - RNA, 22 nt, Salmonella typhimurium LT2
augccucguuucccucauauuu

SEQ ID NO: 1873310 - RNA, 18 nt, Salmonella typhimurium LT2
augccguuuuaacgucau

SEQ ID NO: 1873311 - RNA, 19 nt, Salmonella typhimurium LT2
augccucgaaaauauauuc

SEQ ID NO: 1873312 - RNA, 16 nt, Salmonella typhimurium LT2
augccucauuaaaaaa

SEQ ID NO: 1873313 - RNA, 18 nt, Salmonella typhimurium LT2
augccugaaagcaaguau

SEQ ID NO: 1873314 - RNA, 15 nt, Salmonella typhimurium LT2
augccuaacccuuuu

SEQ ID NO: 1873315 - RNA, 18 nt, Salmonella typhimurium LT2
augccguuuucauccauu

SEQ ID NO: 1873316 - RNA, 24 nt, Salmonella typhimurium LT2
augccuaaaccgacaauauucgcc

SEQ ID NO: 1873317 - RNA, 21 nt, Salmonella typhimurium LT2
augccguucuuuaaucagauu

SEQ ID NO: 1873318 - RNA, 23 nt, Salmonella typhimurium LT2
augccggccgcaguuuuccagcg

SEQ ID NO: 1873319 - RNA, 17 nt, Salmonella typhimurium LT2
augccguagccaaguau

SEQ ID NO: 1873320 - RNA, 15 nt, Salmonella typhimurium LT2
augccgucaucagca

SEQ ID NO: 1873321 - RNA, 22 nt, Salmonella typhimurium LT2
augccguuaccguucaggcaaa

SEQ ID NO: 1873322 - RNA, 23 nt, Salmonella typhimurium LT2
augccggggcgcuucgcuugccc

SEQ ID NO: 1873323 - RNA, 18 nt, Salmonella typhimurium LT2
auucaggcuggcaaagca

SEQ ID NO: 1873324 - RNA, 19 nt, Salmonella typhimurium LT2
auucaggcuggcaaagcag

SEQ ID NO: 1873325 - RNA, 11 nt, Salmonella typhimurium LT2
auucagguaau

SEQ ID NO: 1873326 - RNA, 19 nt, Salmonella typhimurium LT2
auucagcgcuuagcggcac

SEQ ID NO: 1873327 - RNA, 21 nt, Salmonella typhimurium LT2
auucagguuauuugccucugg

SEQ ID NO: 1873328 - RNA, 12 nt, Salmonella typhimurium LT2
auucuauucuug

SEQ ID NO: 1873329 - RNA, 14 nt, Salmonella typhimurium LT2
auucucgcacuuua

SEQ ID NO: 1873330 - RNA, 17 nt, Salmonella typhimurium LT2
auucucccugccaggcc

SEQ ID NO: 1873331 - RNA, 18 nt, Salmonella typhimurium LT2
auucugguaguaagucag

SEQ ID NO: 1873332 - RNA, 19 nt, Salmonella typhimurium LT2
auucugggcuuacuuucca

SEQ ID NO: 1873333 - RNA, 22 nt, Salmonella typhimurium LT2
auucuguaucgcuuauuuucgu

SEQ ID NO: 1873334 - RNA, 15 nt, Salmonella typhimurium LT2
auucuguuuguuuuu

SEQ ID NO: 1873335 - RNA, 17 nt, Salmonella typhimurium LT2
auugaaguucuucccac

SEQ ID NO: 1873336 - RNA, 18 nt, Salmonella typhimurium LT2
auugacgggaaaucuccc

SEQ ID NO: 1873337 - RNA, 13 nt, Salmonella typhimurium LT2
auugagcagggac

SEQ ID NO: 1873338 - RNA, 13 nt, Salmonella typhimurium LT2
auugagccacuca

SEQ ID NO: 1873339 - RNA, 17 nt, Salmonella typhimurium LT2
auugacuggauuuuuga

SEQ ID NO: 1873340 - RNA, 14 nt, Salmonella typhimurium LT2
auugacuucaacgc

SEQ ID NO: 1873341 - RNA, 23 nt, Salmonella typhimurium LT2
auugaagcgauauucgguaagcu

SEQ ID NO: 1873342 - RNA, 16 nt, Salmonella typhimurium LT2
auugaaaaccauaaua

SEQ ID NO: 1873343 - RNA, 13 nt, Salmonella typhimurium LT2
auucuuaucugug

SEQ ID NO: 1873344 - RNA, 14 nt, Salmonella typhimurium LT2
auucuuaucauuua

SEQ ID NO: 1873345 - RNA, 15 nt, Salmonella typhimurium LT2
auucuuaucauuuag

SEQ ID NO: 1873346 - RNA, 15 nt, Salmonella typhimurium LT2
auugccgcacauguu

SEQ ID NO: 1873347 - RNA, 21 nt, Salmonella typhimurium LT2
auugccguuguugucaauauc

SEQ ID NO: 1873348 - RNA, 15 nt, Salmonella typhimurium LT2
auugcccuuuuguuu

SEQ ID NO: 1873349 - RNA, 23 nt, Salmonella typhimurium LT2
auugcccuggauuagucugccau

SEQ ID NO: 1873350 - RNA, 16 nt, Salmonella typhimurium LT2
auugccccauguucag

SEQ ID NO: 1873351 - RNA, 23 nt, Salmonella typhimurium LT2
auugccccccagccauaauacaa

SEQ ID NO: 1873352 - RNA, 19 nt, Salmonella typhimurium LT2
auugccauguuaauaccag

SEQ ID NO: 1873353 - RNA, 20 nt, Salmonella typhimurium LT2
auugcagacgcuccuccaau

SEQ ID NO: 1873354 - RNA, 18 nt, Salmonella typhimurium LT2
auugaggcuacccagaca

SEQ ID NO: 1873355 - RNA, 15 nt, Salmonella typhimurium LT2
auugaggcuacccag

SEQ ID NO: 1873356 - RNA, 23 nt, Salmonella typhimurium LT2
auugagguguuuccagugcagcu

SEQ ID NO: 1873357 - RNA, 13 nt, Salmonella typhimurium LT2
auugauuuuucug

SEQ ID NO: 1873358 - RNA, 15 nt, Salmonella typhimurium LT2
auugauuuuucuggu

SEQ ID NO: 1873359 - RNA, 13 nt, Salmonella typhimurium LT2
auugcaagaauau

SEQ ID NO: 1873360 - RNA, 17 nt, Salmonella typhimurium LT2
auugcaacgaucccuaa

SEQ ID NO: 1873361 - RNA, 20 nt, Salmonella typhimurium LT2
auuggcaaaccccugcucgc

SEQ ID NO: 1873362 - RNA, 14 nt, Salmonella typhimurium LT2
auuggcaaacugcc

SEQ ID NO: 1873363 - RNA, 20 nt, Salmonella typhimurium LT2
auuggcuuuguaaauacuga

SEQ ID NO: 1873364 - RNA, 19 nt, Salmonella typhimurium LT2
auuggguaguaauauuaaa

SEQ ID NO: 1873365 - RNA, 15 nt, Salmonella typhimurium LT2
auuggguaauuuuuu

SEQ ID NO: 1873366 - RNA, 22 nt, Salmonella typhimurium LT2
auugcuucguggcaaucagcaa

SEQ ID NO: 1873367 - RNA, 16 nt, Salmonella typhimurium LT2
auugcgaauaaaacug

SEQ ID NO: 1873368 - RNA, 12 nt, Salmonella typhimurium LT2
auugccuuucaa

SEQ ID NO: 1873369 - RNA, 18 nt, Salmonella typhimurium LT2
auugcgaauaaaacugcc

SEQ ID NO: 1873370 - RNA, 17 nt, Salmonella typhimurium LT2
auugcgaauaaaacugc

SEQ ID NO: 1873371 - RNA, 19 nt, Salmonella typhimurium LT2
auugccuggcagcuugccu

SEQ ID NO: 1873372 - RNA, 23 nt, Salmonella typhimurium LT2
auugccugauggcgcuacgccug

SEQ ID NO: 1873373 - RNA, 16 nt, Salmonella typhimurium LT2
auugcgauaugcuguu

SEQ ID NO: 1873374 - RNA, 21 nt, Salmonella typhimurium LT2
auugcgaucuccuuuaaugaa

SEQ ID NO: 1873375 - RNA, 13 nt, Salmonella typhimurium LT2
auugcguugcuuu

SEQ ID NO: 1873376 - RNA, 15 nt, Salmonella typhimurium LT2
auugcuguuaauuuc

SEQ ID NO: 1873377 - RNA, 23 nt, Salmonella typhimurium LT2
auugcuguaggcacuuuccagac

SEQ ID NO: 1873378 - RNA, 14 nt, Salmonella typhimurium LT2
auugcuguccaggu

SEQ ID NO: 1873379 - RNA, 16 nt, Salmonella typhimurium LT2
auugcuguaaaccggu

SEQ ID NO: 1873380 - RNA, 17 nt, Salmonella typhimurium LT2
auugcucagguuauacu

SEQ ID NO: 1873381 - RNA, 19 nt, Salmonella typhimurium LT2
auuucaggcaaaaaaaacc

SEQ ID NO: 1873382 - RNA, 17 nt, Salmonella typhimurium LT2
auuucaggcaaaggaau

SEQ ID NO: 1873383 - RNA, 14 nt, Salmonella typhimurium LT2
auuucaaucaucau

SEQ ID NO: 1873384 - RNA, 17 nt, Salmonella typhimurium LT2
auuucaauaaucccuuc

SEQ ID NO: 1873385 - RNA, 18 nt, Salmonella typhimurium LT2
auuuauuuucggacacgc

SEQ ID NO: 1873386 - RNA, 14 nt, Salmonella typhimurium LT2
auuuauccacgccg

SEQ ID NO: 1873387 - RNA, 14 nt, Salmonella typhimurium LT2
auuuauccagcagg

SEQ ID NO: 1873388 - RNA, 13 nt, Salmonella typhimurium LT2
auuuauccaguaa

SEQ ID NO: 1873389 - RNA, 13 nt, Salmonella typhimurium LT2
auuuauagcaaau

SEQ ID NO: 1873390 - RNA, 18 nt, Salmonella typhimurium LT2
auuuaucgaucuccaucu

SEQ ID NO: 1873391 - RNA, 23 nt, Salmonella typhimurium LT2
auuuauaaaauauuuaacuuaaa

SEQ ID NO: 1873392 - RNA, 13 nt, Salmonella typhimurium LT2
auuuauaacguau

SEQ ID NO: 1873393 - RNA, 13 nt, Salmonella typhimurium LT2
auuuaauauauga

SEQ ID NO: 1873394 - RNA, 23 nt, Salmonella typhimurium LT2
auuguggcguaaacgccauuccu

SEQ ID NO: 1873395 - RNA, 19 nt, Salmonella typhimurium LT2
auugugccccgcgcgccug

SEQ ID NO: 1873396 - RNA, 21 nt, Salmonella typhimurium LT2
auugugguaagcaaucaaggu

SEQ ID NO: 1873397 - RNA, 15 nt, Salmonella typhimurium LT2
auugugcagccaugu

SEQ ID NO: 1873398 - RNA, 16 nt, Salmonella typhimurium LT2
auugugagaaaagcag

SEQ ID NO: 1873399 - RNA, 17 nt, Salmonella typhimurium LT2
auugucuuaaauaugaa

SEQ ID NO: 1873400 - RNA, 20 nt, Salmonella typhimurium LT2
auugucaugcuaaaacagau

SEQ ID NO: 1873401 - RNA, 22 nt, Salmonella typhimurium LT2
auugucauaaugucccugccac

SEQ ID NO: 1873402 - RNA, 23 nt, Salmonella typhimurium LT2
auuguccuuuaucugcccuuucu

SEQ ID NO: 1873403 - RNA, 16 nt, Salmonella typhimurium LT2
auuguccacccuccca

SEQ ID NO: 1873404 - RNA, 12 nt, Salmonella typhimurium LT2
auuguaaaaccg

SEQ ID NO: 1873405 - RNA, 13 nt, Salmonella typhimurium LT2
auugguaaauccg

SEQ ID NO: 1873406 - RNA, 13 nt, Salmonella typhimurium LT2
auuguagguuuuc

SEQ ID NO: 1873407 - RNA, 16 nt, Salmonella typhimurium LT2
auuguagguuuuccuc

SEQ ID NO: 1873408 - RNA, 15 nt, Salmonella typhimurium LT2
auuguguuacaugua

SEQ ID NO: 1873409 - RNA, 15 nt, Salmonella typhimurium LT2
auuguuuggugcuga

SEQ ID NO: 1873410 - RNA, 18 nt, Salmonella typhimurium LT2
auuuaaacgggguaaacu

SEQ ID NO: 1873411 - RNA, 18 nt, Salmonella typhimurium LT2
auuguuugaaaaggaaaa

SEQ ID NO: 1873412 - RNA, 20 nt, Salmonella typhimurium LT2
auuuaacgaguugaauaacg

SEQ ID NO: 1873413 - RNA, 14 nt, Salmonella typhimurium LT2
auuuucaccuggau

SEQ ID NO: 1873414 - RNA, 12 nt, Salmonella typhimurium LT2
auuuucaccucc

SEQ ID NO: 1873415 - RNA, 13 nt, Salmonella typhimurium LT2
auuuucaccucca

SEQ ID NO: 1873416 - RNA, 19 nt, Salmonella typhimurium LT2
auuuuaaccuuauauaugu

SEQ ID NO: 1873417 - RNA, 20 nt, Salmonella typhimurium LT2
auuuuaaauugguuauauua

SEQ ID NO: 1873418 - RNA, 14 nt, Salmonella typhimurium LT2
auuuuacgagaacc

SEQ ID NO: 1873419 - RNA, 22 nt, Salmonella typhimurium LT2
auuuuguugcuccagcaucaca

SEQ ID NO: 1873420 - RNA, 24 nt, Salmonella typhimurium LT2
auuuuguugcuccagcaucacauc

SEQ ID NO: 1873421 - RNA, 18 nt, Salmonella typhimurium LT2
auuuuguugcuccagcau

SEQ ID NO: 1873422 - RNA, 23 nt, Salmonella typhimurium LT2
auuuuguggugggccucaauaua

SEQ ID NO: 1873423 - RNA, 16 nt, Salmonella typhimurium LT2
auuuugauaaaaacac

SEQ ID NO: 1873424 - RNA, 14 nt, Salmonella typhimurium LT2
auuuucuucaucaa

SEQ ID NO: 1873425 - RNA, 14 nt, Salmonella typhimurium LT2
auuuucaucauauc

SEQ ID NO: 1873426 - RNA, 21 nt, Salmonella typhimurium LT2
auuuucaucauaucugauaaa

SEQ ID NO: 1873427 - RNA, 19 nt, Salmonella typhimurium LT2
auuuucaugauauucuguc

SEQ ID NO: 1873428 - RNA, 22 nt, Salmonella typhimurium LT2
auuuucggcugacgcgcuauca

SEQ ID NO: 1873429 - RNA, 18 nt, Salmonella typhimurium LT2
auuucuccugcgccagcc

SEQ ID NO: 1873430 - RNA, 17 nt, Salmonella typhimurium LT2
auuucuccgcccaucca

SEQ ID NO: 1873431 - RNA, 20 nt, Salmonella typhimurium LT2
auuucuccugcgccagccgg

SEQ ID NO: 1873432 - RNA, 14 nt, Salmonella typhimurium LT2
auuucucaggcauc

SEQ ID NO: 1873433 - RNA, 15 nt, Salmonella typhimurium LT2
auuucaucuaucugc

SEQ ID NO: 1873434 - RNA, 22 nt, Salmonella typhimurium LT2
auuucaucuauuauuuuucuau

SEQ ID NO: 1873435 - RNA, 11 nt, Salmonella typhimurium LT2
auuucaucuac

SEQ ID NO: 1873436 - RNA, 16 nt, Salmonella typhimurium LT2
auuucuugcaauagcg

SEQ ID NO: 1873437 - RNA, 16 nt, Salmonella typhimurium LT2
auuucuugaucaaucu

SEQ ID NO: 1873438 - RNA, 13 nt, Salmonella typhimurium LT2
auuucuuccauua

SEQ ID NO: 1873439 - RNA, 14 nt, Salmonella typhimurium LT2
auuucuucauccca

SEQ ID NO: 1873440 - RNA, 23 nt, Salmonella typhimurium LT2
auuugaaggacugauacagccaa

SEQ ID NO: 1873441 - RNA, 21 nt, Salmonella typhimurium LT2
auuugaacucuuccagauacg

SEQ ID NO: 1873442 - RNA, 20 nt, Salmonella typhimurium LT2
auuuguaugacaaauaaaau

SEQ ID NO: 1873443 - RNA, 22 nt, Salmonella typhimurium LT2
auuugugagcuauacgguaaau

SEQ ID NO: 1873444 - RNA, 19 nt, Salmonella typhimurium LT2
auuugugauugcagauaau

SEQ ID NO: 1873445 - RNA, 13 nt, Salmonella typhimurium LT2
auuuguuaucuac

SEQ ID NO: 1873446 - RNA, 15 nt, Salmonella typhimurium LT2
auuuguuaucuacag

SEQ ID NO: 1873447 - RNA, 22 nt, Salmonella typhimurium LT2
auuugcgggaacauaugcacau

SEQ ID NO: 1873448 - RNA, 14 nt, Salmonella typhimurium LT2
auuugcgccgccgu

SEQ ID NO: 1873449 - RNA, 13 nt, Salmonella typhimurium LT2
auuugauggcuaa

SEQ ID NO: 1873450 - RNA, 23 nt, Salmonella typhimurium LT2
auuugauggcuaauauccagcca

SEQ ID NO: 1873451 - RNA, 17 nt, Salmonella typhimurium LT2
auuugaugccuggcagu

SEQ ID NO: 1873452 - RNA, 18 nt, Salmonella typhimurium LT2
caaaacagauuaaaaagc

SEQ ID NO: 1873453 - RNA, 15 nt, Salmonella typhimurium LT2
caaaaauuuaagcca

SEQ ID NO: 1873454 - RNA, 21 nt, Salmonella typhimurium LT2
caaaacgccgguacuggagac

SEQ ID NO: 1873455 - RNA, 17 nt, Salmonella typhimurium LT2
caaaacgcauccagcgc

SEQ ID NO: 1873456 - RNA, 15 nt, Salmonella typhimurium LT2
caaaacccaccagca

SEQ ID NO: 1873457 - RNA, 18 nt, Salmonella typhimurium LT2
caaaacgugguaaaaagc

SEQ ID NO: 1873458 - RNA, 22 nt, Salmonella typhimurium LT2
caaaagaggaaguugcucccgc

SEQ ID NO: 1873459 - RNA, 16 nt, Salmonella typhimurium LT2
caaaagagaucgaaca

SEQ ID NO: 1873460 - RNA, 22 nt, Salmonella typhimurium LT2
caaaagauuuaucaauuuuuaa

SEQ ID NO: 1873461 - RNA, 15 nt, Salmonella typhimurium LT2
caaaagccagauaaa

SEQ ID NO: 1873462 - RNA, 21 nt, Salmonella typhimurium LT2
caaaagcauugugaggaaccu

SEQ ID NO: 1873463 - RNA, 22 nt, Salmonella typhimurium LT2
caaaaaauauagccauuuaaug

SEQ ID NO: 1873464 - RNA, 15 nt, Salmonella typhimurium LT2
caaaaagauauuaua

SEQ ID NO: 1873465 - RNA, 14 nt, Salmonella typhimurium LT2
caaaaagaggaaag

SEQ ID NO: 1873466 - RNA, 21 nt, Salmonella typhimurium LT2
caaaaagcgcgccgaaaauau

SEQ ID NO: 1873467 - RNA, 15 nt, Salmonella typhimurium LT2
caaaaagcgcgcggc

SEQ ID NO: 1873468 - RNA, 20 nt, Salmonella typhimurium LT2
caaaaagaacucacucagug

SEQ ID NO: 1873469 - RNA, 15 nt, Salmonella typhimurium LT2
caaaaacgcccccag

SEQ ID NO: 1873470 - RNA, 22 nt, Salmonella typhimurium LT2
caaaaaucaugcucauaaugga

SEQ ID NO: 1873471 - RNA, 14 nt, Salmonella typhimurium LT2
caaaaauccuucuu

SEQ ID NO: 1873472 - RNA, 20 nt, Salmonella typhimurium LT2
caaaaaguauuguuuuuaug

SEQ ID NO: 1873473 - RNA, 14 nt, Salmonella typhimurium LT2
caaaaauaaaaaaa

SEQ ID NO: 1873474 - RNA, 23 nt, Salmonella typhimurium LT2
caaaaaagacagcaucuaauuaa

SEQ ID NO: 1873475 - RNA, 12 nt, Salmonella typhimurium LT2
caaaaaaagcca

SEQ ID NO: 1873476 - RNA, 19 nt, Salmonella typhimurium LT2
caaaaaaaucccaaccuug

SEQ ID NO: 1873477 - RNA, 13 nt, Salmonella typhimurium LT2
caaaaaaaaccag

SEQ ID NO: 1873478 - RNA, 19 nt, Salmonella typhimurium LT2
auuuuuuuugccugaaacg

SEQ ID NO: 1873479 - RNA, 23 nt, Salmonella typhimurium LT2
auuuuuuucucgauaucuucccc

SEQ ID NO: 1873480 - RNA, 15 nt, Salmonella typhimurium LT2
auuuuuuucagccuu

SEQ ID NO: 1873481 - RNA, 13 nt, Salmonella typhimurium LT2
auuuuuuccauuc

SEQ ID NO: 1873482 - RNA, 14 nt, Salmonella typhimurium LT2
auuuuuuguaucca

SEQ ID NO: 1873483 - RNA, 17 nt, Salmonella typhimurium LT2
auuuuuuguauccacca

SEQ ID NO: 1873484 - RNA, 13 nt, Salmonella typhimurium LT2
auuuuuuuacauu

SEQ ID NO: 1873485 - RNA, 20 nt, Salmonella typhimurium LT2
auuuuuuuauauucgcucau

SEQ ID NO: 1873486 - RNA, 16 nt, Salmonella typhimurium LT2
auuuuuuuaucuucca

SEQ ID NO: 1873487 - RNA, 14 nt, Salmonella typhimurium LT2
auuuuucugguaaa

SEQ ID NO: 1873488 - RNA, 20 nt, Salmonella typhimurium LT2
auuuuucuggcuucuuaaaa

SEQ ID NO: 1873489 - RNA, 15 nt, Salmonella typhimurium LT2
auuuuucgaucuucu

SEQ ID NO: 1873490 - RNA, 18 nt, Salmonella typhimurium LT2
auuuuucgccagguacau

SEQ ID NO: 1873491 - RNA, 10 nt, Salmonella typhimurium LT2
auuuuuccuu

SEQ ID NO: 1873492 - RNA, 15 nt, Salmonella typhimurium LT2
auuuuucccuggccg

SEQ ID NO: 1873493 - RNA, 18 nt, Salmonella typhimurium LT2
auuuuucccuggccggaa

SEQ ID NO: 1873494 - RNA, 16 nt, Salmonella typhimurium LT2
auuuuucccaucaauc

SEQ ID NO: 1873495 - RNA, 13 nt, Salmonella typhimurium LT2
auuuuuccagcau

SEQ ID NO: 1873496 - RNA, 18 nt, Salmonella typhimurium LT2
auuuuucagauagcgaac

SEQ ID NO: 1873497 - RNA, 14 nt, Salmonella typhimurium LT2
auuuuuaaaccaac

SEQ ID NO: 1873498 - RNA, 16 nt, Salmonella typhimurium LT2
auuuuugaucucuuua

SEQ ID NO: 1873499 - RNA, 16 nt, Salmonella typhimurium LT2
auuuuugugaacuugu

SEQ ID NO: 1873500 - RNA, 23 nt, Salmonella typhimurium LT2
auuuuuguuaauucuauucuugu

SEQ ID NO: 1873501 - RNA, 22 nt, Salmonella typhimurium LT2
caaucucgcaagauuccagaua

SEQ ID NO: 1873502 - RNA, 14 nt, Salmonella typhimurium LT2
caaucuccuccggc

SEQ ID NO: 1873503 - RNA, 22 nt, Salmonella typhimurium LT2
caaucuccuccggcuucagcaa

SEQ ID NO: 1873504 - RNA, 20 nt, Salmonella typhimurium LT2
caaucucuggccaggcauug

SEQ ID NO: 1873505 - RNA, 12 nt, Salmonella typhimurium LT2
caaucuccuccg

SEQ ID NO: 1873506 - RNA, 14 nt, Salmonella typhimurium LT2
caaucuggugacga

SEQ ID NO: 1873507 - RNA, 20 nt, Salmonella typhimurium LT2
caaucugguggcguuccuua

SEQ ID NO: 1873508 - RNA, 18 nt, Salmonella typhimurium LT2
caaucugguggcguuccu

SEQ ID NO: 1873509 - RNA, 15 nt, Salmonella typhimurium LT2
caaucucaaugaugc

SEQ ID NO: 1873510 - RNA, 13 nt, Salmonella typhimurium LT2
caaucuaagagcc

SEQ ID NO: 1873511 - RNA, 14 nt, Salmonella typhimurium LT2
caaucgagaagcca

SEQ ID NO: 1873512 - RNA, 16 nt, Salmonella typhimurium LT2
caaucgagaucagacu

SEQ ID NO: 1873513 - RNA, 16 nt, Salmonella typhimurium LT2
caaucgccccaggcca

SEQ ID NO: 1873514 - RNA, 17 nt, Salmonella typhimurium LT2
caaucgcaaauugcugu

SEQ ID NO: 1873515 - RNA, 22 nt, Salmonella typhimurium LT2
caauccugucgucaccagcagg

SEQ ID NO: 1873516 - RNA, 23 nt, Salmonella typhimurium LT2
caauccugucgucaccagcaggu

SEQ ID NO: 1873517 - RNA, 20 nt, Salmonella typhimurium LT2
caauccuucuaccuucaccc

SEQ ID NO: 1873518 - RNA, 20 nt, Salmonella typhimurium LT2
caauccuggcgcacauugcu

SEQ ID NO: 1873519 - RNA, 17 nt, Salmonella typhimurium LT2
caaucgcugccuugagu

SEQ ID NO: 1873520 - RNA, 18 nt, Salmonella typhimurium LT2
caaucgcuaucugacagc

SEQ ID NO: 1873521 - RNA, 19 nt, Salmonella typhimurium LT2
caaucgcuaucugacagcc

SEQ ID NO: 1873522 - RNA, 16 nt, Salmonella typhimurium LT2
caaucgcguuuuccag

SEQ ID NO: 1873523 - RNA, 13 nt, Salmonella typhimurium LT2
caaucgccugcaa

SEQ ID NO: 1873524 - RNA, 20 nt, Salmonella typhimurium LT2
caaucgccugccguaacgcc

SEQ ID NO: 1873525 - RNA, 23 nt, Salmonella typhimurium LT2
caaucggcgauaaaccaacagcc

SEQ ID NO: 1873526 - RNA, 14 nt, Salmonella typhimurium LT2
caaucgucacuuca

SEQ ID NO: 1873527 - RNA, 13 nt, Salmonella typhimurium LT2
caaucauaauaaa

SEQ ID NO: 1873528 - RNA, 20 nt, Salmonella typhimurium LT2
caaucaaauccaacucaguu

SEQ ID NO: 1873529 - RNA, 17 nt, Salmonella typhimurium LT2
caaucaacgcauuauau

SEQ ID NO: 1873530 - RNA, 21 nt, Salmonella typhimurium LT2
caaucaucagaccgauaaaua

SEQ ID NO: 1873531 - RNA, 12 nt, Salmonella typhimurium LT2
caaucaucacca

SEQ ID NO: 1873532 - RNA, 14 nt, Salmonella typhimurium LT2
caaucaucagaaga

SEQ ID NO: 1873533 - RNA, 12 nt, Salmonella typhimurium LT2
caauauuuugua

SEQ ID NO: 1873534 - RNA, 22 nt, Salmonella typhimurium LT2
caauauuuuguaggccuaaaaa

SEQ ID NO: 1873535 - RNA, 23 nt, Salmonella typhimurium LT2
caaucaacaccagcagcgcggcg

SEQ ID NO: 1873536 - RNA, 13 nt, Salmonella typhimurium LT2
caauauucuggcu

SEQ ID NO: 1873537 - RNA, 15 nt, Salmonella typhimurium LT2
caauauuaaugcugc

SEQ ID NO: 1873538 - RNA, 17 nt, Salmonella typhimurium LT2
caauauucacacgaauu

SEQ ID NO: 1873539 - RNA, 16 nt, Salmonella typhimurium LT2
caauauucaugcuuuc

SEQ ID NO: 1873540 - RNA, 23 nt, Salmonella typhimurium LT2
caauauugaacauuuuuucagcc

SEQ ID NO: 1873541 - RNA, 20 nt, Salmonella typhimurium LT2
caaucauugugguuucccug

SEQ ID NO: 1873542 - RNA, 16 nt, Salmonella typhimurium LT2
caaucauucuuauucg

SEQ ID NO: 1873543 - RNA, 17 nt, Salmonella typhimurium LT2
caauccacggguuacaa

SEQ ID NO: 1873544 - RNA, 14 nt, Salmonella typhimurium LT2
caaucccgcgcugc

SEQ ID NO: 1873545 - RNA, 16 nt, Salmonella typhimurium LT2
caauccgcggcaaauc

SEQ ID NO: 1873546 - RNA, 13 nt, Salmonella typhimurium LT2
caaugaucagacg

SEQ ID NO: 1873547 - RNA, 20 nt, Salmonella typhimurium LT2
caaugagauccacugagcgc

SEQ ID NO: 1873548 - RNA, 20 nt, Salmonella typhimurium LT2
caaugcaaacgacacauaaa

SEQ ID NO: 1873549 - RNA, 13 nt, Salmonella typhimurium LT2
caaugcaaagaaa

SEQ ID NO: 1873550 - RNA, 15 nt, Salmonella typhimurium LT2
caaugccaccagcgc

SEQ ID NO: 1873551 - RNA, 20 nt, Salmonella typhimurium LT2
caaugcacugcgaaaagagg

SEQ ID NO: 1873552 - RNA, 22 nt, Salmonella typhimurium LT2
caaucugguggcguuccuuauc

SEQ ID NO: 1873553 - RNA, 21 nt, Salmonella typhimurium LT2
caaucuuuagcaccuuacgaa

SEQ ID NO: 1873554 - RNA, 17 nt, Salmonella typhimurium LT2
caaugaccgcaauuaaa

SEQ ID NO: 1873555 - RNA, 19 nt, Salmonella typhimurium LT2
caaugaccgcaauuaaaug

SEQ ID NO: 1873556 - RNA, 13 nt, Salmonella typhimurium LT2
caaugaacaguuu

SEQ ID NO: 1873557 - RNA, 18 nt, Salmonella typhimurium LT2
caaugaagcauaaaaaga

SEQ ID NO: 1873558 - RNA, 17 nt, Salmonella typhimurium LT2
caaugaccacaaauucu

SEQ ID NO: 1873559 - RNA, 14 nt, Salmonella typhimurium LT2
caaugcuggcaggc

SEQ ID NO: 1873560 - RNA, 15 nt, Salmonella typhimurium LT2
caaugcgcuccagcu

SEQ ID NO: 1873561 - RNA, 21 nt, Salmonella typhimurium LT2
caaugcgcuuuuuuugcccuu

SEQ ID NO: 1873562 - RNA, 23 nt, Salmonella typhimurium LT2
caaugcggcgugcggcuguguuc

SEQ ID NO: 1873563 - RNA, 14 nt, Salmonella typhimurium LT2
caaugcgcuuuuuu

SEQ ID NO: 1873564 - RNA, 18 nt, Salmonella typhimurium LT2
caaugccuaacccuuuuc

SEQ ID NO: 1873565 - RNA, 21 nt, Salmonella typhimurium LT2
caaugccgcgagaaauaccaa

SEQ ID NO: 1873566 - RNA, 15 nt, Salmonella typhimurium LT2
caaugcccuuaaauc

SEQ ID NO: 1873567 - RNA, 15 nt, Salmonella typhimurium LT2
caaugcccacgccgu

SEQ ID NO: 1873568 - RNA, 21 nt, Salmonella typhimurium LT2
caauggccccuggcugaaagc

SEQ ID NO: 1873569 - RNA, 20 nt, Salmonella typhimurium LT2
caauggcgacgaucagcgcc

SEQ ID NO: 1873570 - RNA, 18 nt, Salmonella typhimurium LT2
caauggcgucaaacagcu

SEQ ID NO: 1873571 - RNA, 11 nt, Salmonella typhimurium LT2
caaugggaagg

SEQ ID NO: 1873572 - RNA, 17 nt, Salmonella typhimurium LT2
caaugguugccuggugu

SEQ ID NO: 1873573 - RNA, 21 nt, Salmonella typhimurium LT2
caaugucauacuuaccuggcg

SEQ ID NO: 1873574 - RNA, 17 nt, Salmonella typhimurium LT2
caauguacguaaaacca

SEQ ID NO: 1873575 - RNA, 14 nt, Salmonella typhimurium LT2
caauguaaauuaau

SEQ ID NO: 1873576 - RNA, 18 nt, Salmonella typhimurium LT2
caauguacguaaaaccag

SEQ ID NO: 1873577 - RNA, 15 nt, Salmonella typhimurium LT2
caaguauaugucuga

SEQ ID NO: 1873578 - RNA, 12 nt, Salmonella typhimurium LT2
caaguuuauccg

SEQ ID NO: 1873579 - RNA, 15 nt, Salmonella typhimurium LT2
caauaaacaguuccg

SEQ ID NO: 1873580 - RNA, 23 nt, Salmonella typhimurium LT2
caauaaaacagggcuucuuuacc

SEQ ID NO: 1873581 - RNA, 13 nt, Salmonella typhimurium LT2
caauaaaauaucc

SEQ ID NO: 1873582 - RNA, 16 nt, Salmonella typhimurium LT2
caauaaacauuuuuuu

SEQ ID NO: 1873583 - RNA, 15 nt, Salmonella typhimurium LT2
caauaaacgggcagc

SEQ ID NO: 1873584 - RNA, 12 nt, Salmonella typhimurium LT2
caauaaacuggc

SEQ ID NO: 1873585 - RNA, 15 nt, Salmonella typhimurium LT2
caauaaaguuuauuu

SEQ ID NO: 1873586 - RNA, 21 nt, Salmonella typhimurium LT2
caauaaagccgcauuuuucca

SEQ ID NO: 1873587 - RNA, 12 nt, Salmonella typhimurium LT2
caauaaaguuau

SEQ ID NO: 1873588 - RNA, 17 nt, Salmonella typhimurium LT2
caauaaaucguguggcu

SEQ ID NO: 1873589 - RNA, 19 nt, Salmonella typhimurium LT2
caauaagggucgcgcugua

SEQ ID NO: 1873590 - RNA, 14 nt, Salmonella typhimurium LT2
caauaacaggcaca

SEQ ID NO: 1873591 - RNA, 16 nt, Salmonella typhimurium LT2
caauaacaggcacagu

SEQ ID NO: 1873592 - RNA, 14 nt, Salmonella typhimurium LT2
caauaacagccagc

SEQ ID NO: 1873593 - RNA, 13 nt, Salmonella typhimurium LT2
caauaauaagaau

SEQ ID NO: 1873594 - RNA, 15 nt, Salmonella typhimurium LT2
caauaauaagaauua

SEQ ID NO: 1873595 - RNA, 18 nt, Salmonella typhimurium LT2
caauauccucgcauccuc

SEQ ID NO: 1873596 - RNA, 15 nt, Salmonella typhimurium LT2
caauauccccagccc

SEQ ID NO: 1873597 - RNA, 21 nt, Salmonella typhimurium LT2
caauaucagccauuaaccaga

SEQ ID NO: 1873598 - RNA, 19 nt, Salmonella typhimurium LT2
caauaucgcggcaaagaaa

SEQ ID NO: 1873599 - RNA, 19 nt, Salmonella typhimurium LT2
caauauccucgcauccucc

SEQ ID NO: 1873600 - RNA, 20 nt, Salmonella typhimurium LT2
caauauuacaaagcaguaaa

SEQ ID NO: 1873601 - RNA, 22 nt, Salmonella typhimurium LT2
caauagguuggcuuuuuuaugc

SEQ ID NO: 1873602 - RNA, 20 nt, Salmonella typhimurium LT2
caauaggcgcucuggcgaau

SEQ ID NO: 1873603 - RNA, 22 nt, Salmonella typhimurium LT2
caauaauuucgcuacucagcgu

SEQ ID NO: 1873604 - RNA, 13 nt, Salmonella typhimurium LT2
caauaauauuguc

SEQ ID NO: 1873605 - RNA, 18 nt, Salmonella typhimurium LT2
caauagcgagaggcaauu

SEQ ID NO: 1873606 - RNA, 15 nt, Salmonella typhimurium LT2
caauagcgauacuga

SEQ ID NO: 1873607 - RNA, 17 nt, Salmonella typhimurium LT2
caauagcgauucaucac

SEQ ID NO: 1873608 - RNA, 15 nt, Salmonella typhimurium LT2
caauagcgcuaaaca

SEQ ID NO: 1873609 - RNA, 20 nt, Salmonella typhimurium LT2
caauagcgcuaaacagcgcc

SEQ ID NO: 1873610 - RNA, 20 nt, Salmonella typhimurium LT2
caauacuccacaguucaaug

SEQ ID NO: 1873611 - RNA, 18 nt, Salmonella typhimurium LT2
caauacugauuuugccga

SEQ ID NO: 1873612 - RNA, 22 nt, Salmonella typhimurium LT2
caagcaguaugcccccuccagc

SEQ ID NO: 1873613 - RNA, 23 nt, Salmonella typhimurium LT2
caagcaguaugcccccuccagcc

SEQ ID NO: 1873614 - RNA, 21 nt, Salmonella typhimurium LT2
caagcaggcuaugcucccccc

SEQ ID NO: 1873615 - RNA, 15 nt, Salmonella typhimurium LT2
caagcacauagcuga

SEQ ID NO: 1873616 - RNA, 17 nt, Salmonella typhimurium LT2
caagccgcaacgccucu

SEQ ID NO: 1873617 - RNA, 21 nt, Salmonella typhimurium LT2
caagccccccgcacagcacau

SEQ ID NO: 1873618 - RNA, 20 nt, Salmonella typhimurium LT2
caagcgguuugaaaauggcg

SEQ ID NO: 1873619 - RNA, 15 nt, Salmonella typhimurium LT2
caagcgcuucguuga

SEQ ID NO: 1873620 - RNA, 18 nt, Salmonella typhimurium LT2
caaggcgcuauccuggua

SEQ ID NO: 1873621 - RNA, 15 nt, Salmonella typhimurium LT2
caaggcgcagaacca

SEQ ID NO: 1873622 - RNA, 19 nt, Salmonella typhimurium LT2
caaggcgcagaaccauacu

SEQ ID NO: 1873623 - RNA, 21 nt, Salmonella typhimurium LT2
caaggguaauggcuguuuucg

SEQ ID NO: 1873624 - RNA, 15 nt, Salmonella typhimurium LT2
caaagugauuauaaa

SEQ ID NO: 1873625 - RNA, 16 nt, Salmonella typhimurium LT2
caaaguuaaucagcgc

SEQ ID NO: 1873626 - RNA, 19 nt, Salmonella typhimurium LT2
caaauagcguguguuuucc

SEQ ID NO: 1873627 - RNA, 18 nt, Salmonella typhimurium LT2
caaauagggguucauaag

SEQ ID NO: 1873628 - RNA, 12 nt, Salmonella typhimurium LT2
caaagaaaacca

SEQ ID NO: 1873629 - RNA, 23 nt, Salmonella typhimurium LT2
caaaagcgguaauaacugacaga

SEQ ID NO: 1873630 - RNA, 20 nt, Salmonella typhimurium LT2
caaaagcgguuaagauacau

SEQ ID NO: 1873631 - RNA, 23 nt, Salmonella typhimurium LT2
caaaagcgguuaagauacauauc

SEQ ID NO: 1873632 - RNA, 23 nt, Salmonella typhimurium LT2
caaaagcuuuucgcuugcggcug

SEQ ID NO: 1873633 - RNA, 18 nt, Salmonella typhimurium LT2
caaaaggcuggaacagau

SEQ ID NO: 1873634 - RNA, 20 nt, Salmonella typhimurium LT2
caaaaggcgccgcuuccccc

SEQ ID NO: 1873635 - RNA, 22 nt, Salmonella typhimurium LT2
caaaaggccuuuuuuuuaugcg

SEQ ID NO: 1873636 - RNA, 15 nt, Salmonella typhimurium LT2
caaaaggcccugucu

SEQ ID NO: 1873637 - RNA, 18 nt, Salmonella typhimurium LT2
caaaaggcccugucuucc

SEQ ID NO: 1873638 - RNA, 16 nt, Salmonella typhimurium LT2
caaagcccaucagcgc

SEQ ID NO: 1873639 - RNA, 17 nt, Salmonella typhimurium LT2
caaagccugcuggaaag

SEQ ID NO: 1873640 - RNA, 20 nt, Salmonella typhimurium LT2
caaagccgccauccggccug

SEQ ID NO: 1873641 - RNA, 14 nt, Salmonella typhimurium LT2
caaagcaaucgcca

SEQ ID NO: 1873642 - RNA, 16 nt, Salmonella typhimurium LT2
caaagcagauagagca

SEQ ID NO: 1873643 - RNA, 23 nt, Salmonella typhimurium LT2
caaagcagauagagcauaauaaa

SEQ ID NO: 1873644 - RNA, 13 nt, Salmonella typhimurium LT2
caaagcaaaaaau

SEQ ID NO: 1873645 - RNA, 22 nt, Salmonella typhimurium LT2
caaaucgucagccgccaguuca

SEQ ID NO: 1873646 - RNA, 16 nt, Salmonella typhimurium LT2
caaaucaccacauggc

SEQ ID NO: 1873647 - RNA, 17 nt, Salmonella typhimurium LT2
caaaucaccacauggcc

SEQ ID NO: 1873648 - RNA, 15 nt, Salmonella typhimurium LT2
caaaucagacgcuuc

SEQ ID NO: 1873649 - RNA, 17 nt, Salmonella typhimurium LT2
caaauuaucuguugaua

SEQ ID NO: 1873650 - RNA, 24 nt, Salmonella typhimurium LT2
caaauuaucuguugauaaaacacu

SEQ ID NO: 1873651 - RNA, 17 nt, Salmonella typhimurium LT2
caaauuacgcacacuug

SEQ ID NO: 1873652 - RNA, 18 nt, Salmonella typhimurium LT2
caaaugauaauaugcuca

SEQ ID NO: 1873653 - RNA, 15 nt, Salmonella typhimurium LT2
caaaugaccucaaga

SEQ ID NO: 1873654 - RNA, 14 nt, Salmonella typhimurium LT2
caaaugauuuuuau

SEQ ID NO: 1873655 - RNA, 16 nt, Salmonella typhimurium LT2
caaaugauuuuuauaa

SEQ ID NO: 1873656 - RNA, 18 nt, Salmonella typhimurium LT2
caaaugauuuuuauaaaa

SEQ ID NO: 1873657 - RNA, 17 nt, Salmonella typhimurium LT2
caacagcucgccaugca

SEQ ID NO: 1873658 - RNA, 15 nt, Salmonella typhimurium LT2
caacacuuugcgcug

SEQ ID NO: 1873659 - RNA, 15 nt, Salmonella typhimurium LT2
caacagaaggccugu

SEQ ID NO: 1873660 - RNA, 15 nt, Salmonella typhimurium LT2
caacacgauccccau

SEQ ID NO: 1873661 - RNA, 14 nt, Salmonella typhimurium LT2
caacaccagcagcg

SEQ ID NO: 1873662 - RNA, 14 nt, Salmonella typhimurium LT2
caacaccagcacug

SEQ ID NO: 1873663 - RNA, 17 nt, Salmonella typhimurium LT2
caacacaaucaggcgca

SEQ ID NO: 1873664 - RNA, 23 nt, Salmonella typhimurium LT2
caacaaugucgccucccgauggu

SEQ ID NO: 1873665 - RNA, 17 nt, Salmonella typhimurium LT2
caacaaucgggaacagc

SEQ ID NO: 1873666 - RNA, 16 nt, Salmonella typhimurium LT2
caacaauauuccauau

SEQ ID NO: 1873667 - RNA, 18 nt, Salmonella typhimurium LT2
caaauuugcugccaucgc

SEQ ID NO: 1873668 - RNA, 15 nt, Salmonella typhimurium LT2
caacucuucaacggu

SEQ ID NO: 1873669 - RNA, 19 nt, Salmonella typhimurium LT2
caacucugugagcgucaua

SEQ ID NO: 1873670 - RNA, 17 nt, Salmonella typhimurium LT2
caacugauucaaaaggu

SEQ ID NO: 1873671 - RNA, 17 nt, Salmonella typhimurium LT2
caacugccggggaagua

SEQ ID NO: 1873672 - RNA, 18 nt, Salmonella typhimurium LT2
caacugcgggaaguagca

SEQ ID NO: 1873673 - RNA, 15 nt, Salmonella typhimurium LT2
caacugcuaguggau

SEQ ID NO: 1873674 - RNA, 22 nt, Salmonella typhimurium LT2
caacuguuuuaccaaaucaaua

SEQ ID NO: 1873675 - RNA, 19 nt, Salmonella typhimurium LT2
caacuguuuuucacuaauc

SEQ ID NO: 1873676 - RNA, 22 nt, Salmonella typhimurium LT2
caacuguucuucgcuuucgaca

SEQ ID NO: 1873677 - RNA, 15 nt, Salmonella typhimurium LT2
caacugggcuugcau

SEQ ID NO: 1873678 - RNA, 17 nt, Salmonella typhimurium LT2
caacuguacgccacggc

SEQ ID NO: 1873679 - RNA, 17 nt, Salmonella typhimurium LT2
caacuguaccugaucca

SEQ ID NO: 1873680 - RNA, 15 nt, Salmonella typhimurium LT2
caacuguauuuugaa

SEQ ID NO: 1873681 - RNA, 17 nt, Salmonella typhimurium LT2
caacgccaucagccgcg

SEQ ID NO: 1873682 - RNA, 17 nt, Salmonella typhimurium LT2
caacgcgugauccacag

SEQ ID NO: 1873683 - RNA, 19 nt, Salmonella typhimurium LT2
caacgcguucauccagcgc

SEQ ID NO: 1873684 - RNA, 15 nt, Salmonella typhimurium LT2
caacgccaagcgcgg

SEQ ID NO: 1873685 - RNA, 17 nt, Salmonella typhimurium LT2
caacgccaagcgcggca

SEQ ID NO: 1873686 - RNA, 19 nt, Salmonella typhimurium LT2
caacgccaagcgcggcagc

SEQ ID NO: 1873687 - RNA, 20 nt, Salmonella typhimurium LT2
caacgccagguagccgacgg

SEQ ID NO: 1873688 - RNA, 12 nt, Salmonella typhimurium LT2
caacgccacugc

SEQ ID NO: 1873689 - RNA, 17 nt, Salmonella typhimurium LT2
caaccucacuguugaua

SEQ ID NO: 1873690 - RNA, 21 nt, Salmonella typhimurium LT2
caaccucauuucucaaaaaca

SEQ ID NO: 1873691 - RNA, 20 nt, Salmonella typhimurium LT2
caaccugagauggcacaaua

SEQ ID NO: 1873692 - RNA, 16 nt, Salmonella typhimurium LT2
caaccguuucuuuuuc

SEQ ID NO: 1873693 - RNA, 17 nt, Salmonella typhimurium LT2
caacgcucagaccgauc

SEQ ID NO: 1873694 - RNA, 13 nt, Salmonella typhimurium LT2
caacgcuccagca

SEQ ID NO: 1873695 - RNA, 15 nt, Salmonella typhimurium LT2
caacggcacacaggc

SEQ ID NO: 1873696 - RNA, 19 nt, Salmonella typhimurium LT2
caacgcuuuagugccgcca

SEQ ID NO: 1873697 - RNA, 15 nt, Salmonella typhimurium LT2
caacguccgcagccg

SEQ ID NO: 1873698 - RNA, 20 nt, Salmonella typhimurium LT2
caacgucgugccagugaugc

SEQ ID NO: 1873699 - RNA, 15 nt, Salmonella typhimurium LT2
caacgucaagacgcu

SEQ ID NO: 1873700 - RNA, 12 nt, Salmonella typhimurium LT2
caacgucauccc

SEQ ID NO: 1873701 - RNA, 23 nt, Salmonella typhimurium LT2
caacguaggccggguaaggcgaa

SEQ ID NO: 1873702 - RNA, 18 nt, Salmonella typhimurium LT2
caacggcgccgugagcug

SEQ ID NO: 1873703 - RNA, 22 nt, Salmonella typhimurium LT2
caacguaaugaucaugcugcac

SEQ ID NO: 1873704 - RNA, 19 nt, Salmonella typhimurium LT2
caacaugucgagaaaauag

SEQ ID NO: 1873705 - RNA, 23 nt, Salmonella typhimurium LT2
caacauugccggcaucauucugc

SEQ ID NO: 1873706 - RNA, 24 nt, Salmonella typhimurium LT2
caacagggcggccuccuggcuuac

SEQ ID NO: 1873707 - RNA, 14 nt, Salmonella typhimurium LT2
caacagguaccccg

SEQ ID NO: 1873708 - RNA, 13 nt, Salmonella typhimurium LT2
caacaucuuugcc

SEQ ID NO: 1873709 - RNA, 18 nt, Salmonella typhimurium LT2
caaccagaaugcccaggc

SEQ ID NO: 1873710 - RNA, 20 nt, Salmonella typhimurium LT2
caaccagaaugcccaggccc

SEQ ID NO: 1873711 - RNA, 16 nt, Salmonella typhimurium LT2
caaccagaacacccag

SEQ ID NO: 1873712 - RNA, 18 nt, Salmonella typhimurium LT2
caaccagcaaugagacaa

SEQ ID NO: 1873713 - RNA, 18 nt, Salmonella typhimurium LT2
caaccagccgaucagcgc

SEQ ID NO: 1873714 - RNA, 14 nt, Salmonella typhimurium LT2
caaccaggauucaa

SEQ ID NO: 1873715 - RNA, 17 nt, Salmonella typhimurium LT2
caaccaggcaaaccagc

SEQ ID NO: 1873716 - RNA, 21 nt, Salmonella typhimurium LT2
caaccaggcaaaccagcaccg

SEQ ID NO: 1873717 - RNA, 14 nt, Salmonella typhimurium LT2
caaccaccagcagu

SEQ ID NO: 1873718 - RNA, 20 nt, Salmonella typhimurium LT2
caaccacggauaagccagcc

SEQ ID NO: 1873719 - RNA, 18 nt, Salmonella typhimurium LT2
caaccgcauccugaagcg

SEQ ID NO: 1873720 - RNA, 16 nt, Salmonella typhimurium LT2
caaccgccugcguuug

SEQ ID NO: 1873721 - RNA, 14 nt, Salmonella typhimurium LT2
caaccgccugcacu

SEQ ID NO: 1873722 - RNA, 16 nt, Salmonella typhimurium LT2
caacccuuuggccacc

SEQ ID NO: 1873723 - RNA, 17 nt, Salmonella typhimurium LT2
caaccgacgaacaaaau

SEQ ID NO: 1873724 - RNA, 19 nt, Salmonella typhimurium LT2
caaccgguaucaaacccuu

SEQ ID NO: 1873725 - RNA, 17 nt, Salmonella typhimurium LT2
caaccguauccagacca

SEQ ID NO: 1873726 - RNA, 20 nt, Salmonella typhimurium LT2
caacccgcaagcauaaaaaa

SEQ ID NO: 1873727 - RNA, 16 nt, Salmonella typhimurium LT2
caacccgaccuacaaa

SEQ ID NO: 1873728 - RNA, 12 nt, Salmonella typhimurium LT2
caaccccugacg

SEQ ID NO: 1873729 - RNA, 19 nt, Salmonella typhimurium LT2
caacccuauugccacaaua

SEQ ID NO: 1873730 - RNA, 20 nt, Salmonella typhimurium LT2
caaccccaaacaccaacaaa

SEQ ID NO: 1873731 - RNA, 14 nt, Salmonella typhimurium LT2
caacccaaaggcca

SEQ ID NO: 1873732 - RNA, 19 nt, Salmonella typhimurium LT2
caaccaguuaauuucuuuc

SEQ ID NO: 1873733 - RNA, 21 nt, Salmonella typhimurium LT2
caaccaguuaauuucuuucca

SEQ ID NO: 1873734 - RNA, 18 nt, Salmonella typhimurium LT2
cagcgcuccaccaaccag

SEQ ID NO: 1873735 - RNA, 15 nt, Salmonella typhimurium LT2
cagcgcuccaccaac

SEQ ID NO: 1873736 - RNA, 23 nt, Salmonella typhimurium LT2
cagcgcuccaccaaccaggcaaa

SEQ ID NO: 1873737 - RNA, 23 nt, Salmonella typhimurium LT2
cagcgcugcuguaacagacgcag

SEQ ID NO: 1873738 - RNA, 15 nt, Salmonella typhimurium LT2
cagcgcuauccggcc

SEQ ID NO: 1873739 - RNA, 17 nt, Salmonella typhimurium LT2
cagcgcuaucaggaaga

SEQ ID NO: 1873740 - RNA, 20 nt, Salmonella typhimurium LT2
cagcgcuaccagcgcggcgc

SEQ ID NO: 1873741 - RNA, 19 nt, Salmonella typhimurium LT2
cagcgcuaacggcgguacc

SEQ ID NO: 1873742 - RNA, 22 nt, Salmonella typhimurium LT2
cagcgcuaccagcgcggcgcca

SEQ ID NO: 1873743 - RNA, 23 nt, Salmonella typhimurium LT2
cagcgcuucucuuuccaguuggc

SEQ ID NO: 1873744 - RNA, 20 nt, Salmonella typhimurium LT2
cagcgcuguuuuuccgcuuu

SEQ ID NO: 1873745 - RNA, 21 nt, Salmonella typhimurium LT2
cagcgcugucgccaucaccag

SEQ ID NO: 1873746 - RNA, 23 nt, Salmonella typhimurium LT2
cagcgcuuugccgcugcugccuu

SEQ ID NO: 1873747 - RNA, 16 nt, Salmonella typhimurium LT2
cagcgcuuuugccgcg

SEQ ID NO: 1873748 - RNA, 20 nt, Salmonella typhimurium LT2
cagcgcuuuugccgcgccca

SEQ ID NO: 1873749 - RNA, 18 nt, Salmonella typhimurium LT2
cagcgcuuugccgcugcu

SEQ ID NO: 1873750 - RNA, 20 nt, Salmonella typhimurium LT2
cagcggaaagugaaggccag

SEQ ID NO: 1873751 - RNA, 20 nt, Salmonella typhimurium LT2
cagcggaagggccuuuggca

SEQ ID NO: 1873752 - RNA, 20 nt, Salmonella typhimurium LT2
cagcggaauccccgccgcca

SEQ ID NO: 1873753 - RNA, 13 nt, Salmonella typhimurium LT2
cagcggaaucccc

SEQ ID NO: 1873754 - RNA, 20 nt, Salmonella typhimurium LT2
cagcggacacccgcagccgg

SEQ ID NO: 1873755 - RNA, 23 nt, Salmonella typhimurium LT2
cagcggauugccauacacgcggc

SEQ ID NO: 1873756 - RNA, 22 nt, Salmonella typhimurium LT2
cagcggagaguugaaaccgcgc

SEQ ID NO: 1873757 - RNA, 20 nt, Salmonella typhimurium LT2
cagcggagaucgcuuuccag

SEQ ID NO: 1873758 - RNA, 17 nt, Salmonella typhimurium LT2
cagcggcaagcgcgcca

SEQ ID NO: 1873759 - RNA, 15 nt, Salmonella typhimurium LT2
cagcggcaccccuuc

SEQ ID NO: 1873760 - RNA, 22 nt, Salmonella typhimurium LT2
cagcggcccgcgcugaauggca

SEQ ID NO: 1873761 - RNA, 16 nt, Salmonella typhimurium LT2
cagcggccacagccag

SEQ ID NO: 1873762 - RNA, 15 nt, Salmonella typhimurium LT2
cagcggcaguaaauu

SEQ ID NO: 1873763 - RNA, 21 nt, Salmonella typhimurium LT2
cagcggcaggauccccauccc

SEQ ID NO: 1873764 - RNA, 18 nt, Salmonella typhimurium LT2
cagcgcgauacgcagaac

SEQ ID NO: 1873765 - RNA, 21 nt, Salmonella typhimurium LT2
cagcgcgaguauucgcgcccu

SEQ ID NO: 1873766 - RNA, 15 nt, Salmonella typhimurium LT2
cagcgcgcaaaaacc

SEQ ID NO: 1873767 - RNA, 14 nt, Salmonella typhimurium LT2
cagcgcgccgcagc

SEQ ID NO: 1873768 - RNA, 19 nt, Salmonella typhimurium LT2
cagcgcgcccgccaccagc

SEQ ID NO: 1873769 - RNA, 17 nt, Salmonella typhimurium LT2
cagcgccucggcgccca

SEQ ID NO: 1873770 - RNA, 19 nt, Salmonella typhimurium LT2
cagcgccucggcgcccagc

SEQ ID NO: 1873771 - RNA, 20 nt, Salmonella typhimurium LT2
cagcgccucggcgcccagcg

SEQ ID NO: 1873772 - RNA, 23 nt, Salmonella typhimurium LT2
cagcgccucggcgcccagcgugc

SEQ ID NO: 1873773 - RNA, 16 nt, Salmonella typhimurium LT2
cagcgccugcgcggca

SEQ ID NO: 1873774 - RNA, 21 nt, Salmonella typhimurium LT2
cagcgcgacauggcccauuuc

SEQ ID NO: 1873775 - RNA, 17 nt, Salmonella typhimurium LT2
cagcgcgguuuccacac

SEQ ID NO: 1873776 - RNA, 15 nt, Salmonella typhimurium LT2
cagcgcggcacacag

SEQ ID NO: 1873777 - RNA, 18 nt, Salmonella typhimurium LT2
cagcgcgcgugggaacag

SEQ ID NO: 1873778 - RNA, 15 nt, Salmonella typhimurium LT2
cagcgcgcuccagac

SEQ ID NO: 1873779 - RNA, 17 nt, Salmonella typhimurium LT2
cagcgcgcuccagacca

SEQ ID NO: 1873780 - RNA, 20 nt, Salmonella typhimurium LT2
cagcgcggaaggaccgucgc

SEQ ID NO: 1873781 - RNA, 12 nt, Salmonella typhimurium LT2
cagcgcgcggcu

SEQ ID NO: 1873782 - RNA, 13 nt, Salmonella typhimurium LT2
cagcgcgcguaac

SEQ ID NO: 1873783 - RNA, 13 nt, Salmonella typhimurium LT2
cagcgcgcgcagg

SEQ ID NO: 1873784 - RNA, 19 nt, Salmonella typhimurium LT2
cagcgauauuucuccgccc

SEQ ID NO: 1873785 - RNA, 18 nt, Salmonella typhimurium LT2
cagcgauccagccgcagu

SEQ ID NO: 1873786 - RNA, 14 nt, Salmonella typhimurium LT2
cagcgauauuucuc

SEQ ID NO: 1873787 - RNA, 14 nt, Salmonella typhimurium LT2
cagcgauagucguu

SEQ ID NO: 1873788 - RNA, 17 nt, Salmonella typhimurium LT2
cagcgauaaacgccagc

SEQ ID NO: 1873789 - RNA, 20 nt, Salmonella typhimurium LT2
cagcgauaaacgccagcccu

SEQ ID NO: 1873790 - RNA, 19 nt, Salmonella typhimurium LT2
cagcgauaaccgccgccgc

SEQ ID NO: 1873791 - RNA, 18 nt, Salmonella typhimurium LT2
cagcgaugagcgccagca

SEQ ID NO: 1873792 - RNA, 19 nt, Salmonella typhimurium LT2
cagcgaucugucgccgcgu

SEQ ID NO: 1873793 - RNA, 13 nt, Salmonella typhimurium LT2
cagcgauccugcg

SEQ ID NO: 1873794 - RNA, 14 nt, Salmonella typhimurium LT2
cagcgcaacgcgca

SEQ ID NO: 1873795 - RNA, 20 nt, Salmonella typhimurium LT2
cagcgcaaaguuuucuuccg

SEQ ID NO: 1873796 - RNA, 21 nt, Salmonella typhimurium LT2
cagcgauuuuuacgccauuca

SEQ ID NO: 1873797 - RNA, 13 nt, Salmonella typhimurium LT2
cagcgcaaacuca

SEQ ID NO: 1873798 - RNA, 16 nt, Salmonella typhimurium LT2
cagcgcaccaaaguua

SEQ ID NO: 1873799 - RNA, 19 nt, Salmonella typhimurium LT2
cagcgcaccaaaguuaauc

SEQ ID NO: 1873800 - RNA, 17 nt, Salmonella typhimurium LT2
cagcgcaaucugcucga

SEQ ID NO: 1873801 - RNA, 20 nt, Salmonella typhimurium LT2
cagcgcauuaccgccgccuu

SEQ ID NO: 1873802 - RNA, 16 nt, Salmonella typhimurium LT2
cagcgccaacgccacu

SEQ ID NO: 1873803 - RNA, 21 nt, Salmonella typhimurium LT2
cagcgccaacgccacugccau

SEQ ID NO: 1873804 - RNA, 16 nt, Salmonella typhimurium LT2
cagcgccaccacaaac

SEQ ID NO: 1873805 - RNA, 13 nt, Salmonella typhimurium LT2
cagcgccaauacc

SEQ ID NO: 1873806 - RNA, 21 nt, Salmonella typhimurium LT2
cagcgccaccacaaacgccgu

SEQ ID NO: 1873807 - RNA, 14 nt, Salmonella typhimurium LT2
cagcgcauacgcuu

SEQ ID NO: 1873808 - RNA, 18 nt, Salmonella typhimurium LT2
cagcgcagucagugaaaa

SEQ ID NO: 1873809 - RNA, 21 nt, Salmonella typhimurium LT2
cagcgcaucgcccugccagug

SEQ ID NO: 1873810 - RNA, 21 nt, Salmonella typhimurium LT2
cagcgcaucauccccaccacu

SEQ ID NO: 1873811 - RNA, 16 nt, Salmonella typhimurium LT2
cagcgcagcguggccu

SEQ ID NO: 1873812 - RNA, 22 nt, Salmonella typhimurium LT2
cagcgccauauaaauuucaucc

SEQ ID NO: 1873813 - RNA, 18 nt, Salmonella typhimurium LT2
cagcgccaguuuuucccg

SEQ ID NO: 1873814 - RNA, 15 nt, Salmonella typhimurium LT2
cagcgccaucaggaa

SEQ ID NO: 1873815 - RNA, 17 nt, Salmonella typhimurium LT2
cagcgccaucaggcccc

SEQ ID NO: 1873816 - RNA, 23 nt, Salmonella typhimurium LT2
cagcgccaucugcucgcgcggca

SEQ ID NO: 1873817 - RNA, 15 nt, Salmonella typhimurium LT2
cagcgcccccagcaa

SEQ ID NO: 1873818 - RNA, 15 nt, Salmonella typhimurium LT2
cagcgcccagcagcu

SEQ ID NO: 1873819 - RNA, 23 nt, Salmonella typhimurium LT2
cagcgccagaauagacgccaugu

SEQ ID NO: 1873820 - RNA, 13 nt, Salmonella typhimurium LT2
cagcgccagcccu

SEQ ID NO: 1873821 - RNA, 14 nt, Salmonella typhimurium LT2
cagcgccagcccug

SEQ ID NO: 1873822 - RNA, 15 nt, Salmonella typhimurium LT2
cagcgccagccgcgc

SEQ ID NO: 1873823 - RNA, 15 nt, Salmonella typhimurium LT2
cagcgccagcuccau

SEQ ID NO: 1873824 - RNA, 21 nt, Salmonella typhimurium LT2
cagcgccagcugcgucauguc

SEQ ID NO: 1873825 - RNA, 20 nt, Salmonella typhimurium LT2
cagcgccggauaauccagac

SEQ ID NO: 1873826 - RNA, 16 nt, Salmonella typhimurium LT2
cagcgccgcgggcugg

SEQ ID NO: 1873827 - RNA, 14 nt, Salmonella typhimurium LT2
cagcgccgcgggcu

SEQ ID NO: 1873828 - RNA, 14 nt, Salmonella typhimurium LT2
cagcgccgcgccga

SEQ ID NO: 1873829 - RNA, 14 nt, Salmonella typhimurium LT2
cagcgccgcgccgu

SEQ ID NO: 1873830 - RNA, 18 nt, Salmonella typhimurium LT2
cagcgccgcgaaugugcc

SEQ ID NO: 1873831 - RNA, 23 nt, Salmonella typhimurium LT2
cagcgccgcgacaagcaguaugc

SEQ ID NO: 1873832 - RNA, 16 nt, Salmonella typhimurium LT2
cagccguuucuugucu

SEQ ID NO: 1873833 - RNA, 15 nt, Salmonella typhimurium LT2
cagccuaguucugcg

SEQ ID NO: 1873834 - RNA, 13 nt, Salmonella typhimurium LT2
cagccugaaucag

SEQ ID NO: 1873835 - RNA, 16 nt, Salmonella typhimurium LT2
cagccguaccacccgu

SEQ ID NO: 1873836 - RNA, 15 nt, Salmonella typhimurium LT2
cagccguaccacccg

SEQ ID NO: 1873837 - RNA, 20 nt, Salmonella typhimurium LT2
cagccugagcgccagcgugc

SEQ ID NO: 1873838 - RNA, 23 nt, Salmonella typhimurium LT2
cagccugcccgccugauuuccca

SEQ ID NO: 1873839 - RNA, 21 nt, Salmonella typhimurium LT2
cagccugaggaugauacugcu

SEQ ID NO: 1873840 - RNA, 15 nt, Salmonella typhimurium LT2
cagccuggcugaacc

SEQ ID NO: 1873841 - RNA, 19 nt, Salmonella typhimurium LT2
cagccuggagagcagcgcc

SEQ ID NO: 1873842 - RNA, 15 nt, Salmonella typhimurium LT2
cagccuguccagaua

SEQ ID NO: 1873843 - RNA, 18 nt, Salmonella typhimurium LT2
cagccuugauaccgccgc

SEQ ID NO: 1873844 - RNA, 18 nt, Salmonella typhimurium LT2
cagccuuuucauauggaa

SEQ ID NO: 1873845 - RNA, 13 nt, Salmonella typhimurium LT2
cagccuuuuucuc

SEQ ID NO: 1873846 - RNA, 14 nt, Salmonella typhimurium LT2
cagccuuuuucucg

SEQ ID NO: 1873847 - RNA, 17 nt, Salmonella typhimurium LT2
cagcgaccacgccaccg

SEQ ID NO: 1873848 - RNA, 23 nt, Salmonella typhimurium LT2
cagcgacccuucauacugcggau

SEQ ID NO: 1873849 - RNA, 15 nt, Salmonella typhimurium LT2
cagcgacacuccgcg

SEQ ID NO: 1873850 - RNA, 19 nt, Salmonella typhimurium LT2
cagcgacacuccgcgcaug

SEQ ID NO: 1873851 - RNA, 19 nt, Salmonella typhimurium LT2
cagcgaaacgcgcuaucaa

SEQ ID NO: 1873852 - RNA, 14 nt, Salmonella typhimurium LT2
cagcgaaaugacag

SEQ ID NO: 1873853 - RNA, 18 nt, Salmonella typhimurium LT2
cagcgaaaugacagccac

SEQ ID NO: 1873854 - RNA, 22 nt, Salmonella typhimurium LT2
cagcgaaaugacagccaccagc

SEQ ID NO: 1873855 - RNA, 16 nt, Salmonella typhimurium LT2
cagcgaaccgcagcgu

SEQ ID NO: 1873856 - RNA, 15 nt, Salmonella typhimurium LT2
cagcgagccuuccau

SEQ ID NO: 1873857 - RNA, 17 nt, Salmonella typhimurium LT2
cagcgagcgcaguccag

SEQ ID NO: 1873858 - RNA, 15 nt, Salmonella typhimurium LT2
cagcgagauggcuuu

SEQ ID NO: 1873859 - RNA, 20 nt, Salmonella typhimurium LT2
cagcgaguuccaccauaggc

SEQ ID NO: 1873860 - RNA, 22 nt, Salmonella typhimurium LT2
cagcgaguuccaccauaggcca

SEQ ID NO: 1873861 - RNA, 19 nt, Salmonella typhimurium LT2
cagcgaggaaaacgcuucu

SEQ ID NO: 1873862 - RNA, 17 nt, Salmonella typhimurium LT2
cagcgagcuacaggugc

SEQ ID NO: 1873863 - RNA, 14 nt, Salmonella typhimurium LT2
cagcgacucauuca

SEQ ID NO: 1873864 - RNA, 16 nt, Salmonella typhimurium LT2
cagcgacguaaugauc

SEQ ID NO: 1873865 - RNA, 15 nt, Salmonella typhimurium LT2
cagcgagaagucggc

SEQ ID NO: 1873866 - RNA, 20 nt, Salmonella typhimurium LT2
cagcgacuucaggcgcuaag

SEQ ID NO: 1873867 - RNA, 15 nt, Salmonella typhimurium LT2
cagcgacgcccagug

SEQ ID NO: 1873868 - RNA, 18 nt, Salmonella typhimurium LT2
cagcgacggaaccgucuu

SEQ ID NO: 1873869 - RNA, 20 nt, Salmonella typhimurium LT2
cagcgacggaaccgucuugu

SEQ ID NO: 1873870 - RNA, 13 nt, Salmonella typhimurium LT2
cagcgacgccaga

SEQ ID NO: 1873871 - RNA, 22 nt, Salmonella typhimurium LT2
cagccgcuuuccgccgccgcca

SEQ ID NO: 1873872 - RNA, 21 nt, Salmonella typhimurium LT2
cagccgcguugcgcugaagua

SEQ ID NO: 1873873 - RNA, 16 nt, Salmonella typhimurium LT2
cagccgggcaggaaaa

SEQ ID NO: 1873874 - RNA, 17 nt, Salmonella typhimurium LT2
cagccgguauccagcgc

SEQ ID NO: 1873875 - RNA, 21 nt, Salmonella typhimurium LT2
cagccgcccgcgauaaaaauc

SEQ ID NO: 1873876 - RNA, 21 nt, Salmonella typhimurium LT2
cagccgcggcgcuuucgccac

SEQ ID NO: 1873877 - RNA, 17 nt, Salmonella typhimurium LT2
cagccgcgccaucuccu

SEQ ID NO: 1873878 - RNA, 22 nt, Salmonella typhimurium LT2
cagccgccauccggcaucucuu

SEQ ID NO: 1873879 - RNA, 18 nt, Salmonella typhimurium LT2
cagccgccaucaggcaug

SEQ ID NO: 1873880 - RNA, 12 nt, Salmonella typhimurium LT2
cagccgcaucuu

SEQ ID NO: 1873881 - RNA, 14 nt, Salmonella typhimurium LT2
cagccgcauuuuuu

SEQ ID NO: 1873882 - RNA, 12 nt, Salmonella typhimurium LT2
cagccgccacca

SEQ ID NO: 1873883 - RNA, 13 nt, Salmonella typhimurium LT2
cagccgccaaaaa

SEQ ID NO: 1873884 - RNA, 19 nt, Salmonella typhimurium LT2
cagccgcagccaccccggc

SEQ ID NO: 1873885 - RNA, 17 nt, Salmonella typhimurium LT2
cagccgauuucauacca

SEQ ID NO: 1873886 - RNA, 21 nt, Salmonella typhimurium LT2
cagccgcauaauagcgccaga

SEQ ID NO: 1873887 - RNA, 13 nt, Salmonella typhimurium LT2
cagccgacgcauu

SEQ ID NO: 1873888 - RNA, 17 nt, Salmonella typhimurium LT2
cagccgaucaucacgaa

SEQ ID NO: 1873889 - RNA, 22 nt, Salmonella typhimurium LT2
cagccgaucguucaccgcacug

SEQ ID NO: 1873890 - RNA, 20 nt, Salmonella typhimurium LT2
cagccgaucuauuucauaau

SEQ ID NO: 1873891 - RNA, 19 nt, Salmonella typhimurium LT2
cagcccguucucgccgcgu

SEQ ID NO: 1873892 - RNA, 23 nt, Salmonella typhimurium LT2
cagcccuaaauggagcgagcugg

SEQ ID NO: 1873893 - RNA, 15 nt, Salmonella typhimurium LT2
cagcccugugccgcu

SEQ ID NO: 1873894 - RNA, 12 nt, Salmonella typhimurium LT2
cagcccuuccag

SEQ ID NO: 1873895 - RNA, 16 nt, Salmonella typhimurium LT2
cagcccuuccagcgga

SEQ ID NO: 1873896 - RNA, 23 nt, Salmonella typhimurium LT2
cagcccuuucaggaauuuaucaa

SEQ ID NO: 1873897 - RNA, 21 nt, Salmonella typhimurium LT2
cagcccugccaccagcguacc

SEQ ID NO: 1873898 - RNA, 17 nt, Salmonella typhimurium LT2
cagcccgauacccgccc

SEQ ID NO: 1873899 - RNA, 20 nt, Salmonella typhimurium LT2
cagcccgaucaucuccugua

SEQ ID NO: 1873900 - RNA, 19 nt, Salmonella typhimurium LT2
cagcccgaucaucuccugu

SEQ ID NO: 1873901 - RNA, 22 nt, Salmonella typhimurium LT2
cagcccgaucggcuggcauuuu

SEQ ID NO: 1873902 - RNA, 17 nt, Salmonella typhimurium LT2
cagcccgcucguuucaa

SEQ ID NO: 1873903 - RNA, 12 nt, Salmonella typhimurium LT2
cagcccgcgaac

SEQ ID NO: 1873904 - RNA, 19 nt, Salmonella typhimurium LT2
cagcccgcgaacgccaggc

SEQ ID NO: 1873905 - RNA, 18 nt, Salmonella typhimurium LT2
cagcccggcgcacacccu

SEQ ID NO: 1873906 - RNA, 21 nt, Salmonella typhimurium LT2
cagcccggcgcacacccugca

SEQ ID NO: 1873907 - RNA, 16 nt, Salmonella typhimurium LT2
cagcacgaugcauaug

SEQ ID NO: 1873908 - RNA, 12 nt, Salmonella typhimurium LT2
cagcacgccacc

SEQ ID NO: 1873909 - RNA, 22 nt, Salmonella typhimurium LT2
cagcacgccaccgggcuuuaau

SEQ ID NO: 1873910 - RNA, 12 nt, Salmonella typhimurium LT2
cagcaccugcuc

SEQ ID NO: 1873911 - RNA, 21 nt, Salmonella typhimurium LT2
cagcaccucaucccccagccg

SEQ ID NO: 1873912 - RNA, 20 nt, Salmonella typhimurium LT2
cagcaccgguuuuuccgcuu

SEQ ID NO: 1873913 - RNA, 22 nt, Salmonella typhimurium LT2
cagcaccgccagcgcauucccc

SEQ ID NO: 1873914 - RNA, 17 nt, Salmonella typhimurium LT2
cagcaccaucuuuuccg

SEQ ID NO: 1873915 - RNA, 20 nt, Salmonella typhimurium LT2
cagcacccagcgaauuauga

SEQ ID NO: 1873916 - RNA, 13 nt, Salmonella typhimurium LT2
cagcaccauggcu

SEQ ID NO: 1873917 - RNA, 18 nt, Salmonella typhimurium LT2
cagcaccauggcuaucca

SEQ ID NO: 1873918 - RNA, 23 nt, Salmonella typhimurium LT2
cagcaccauguugaccagguugc

SEQ ID NO: 1873919 - RNA, 16 nt, Salmonella typhimurium LT2
cagcacuucccacugu

SEQ ID NO: 1873920 - RNA, 17 nt, Salmonella typhimurium LT2
cagcagacaaccgacgc

SEQ ID NO: 1873921 - RNA, 16 nt, Salmonella typhimurium LT2
cagcagacaggugaac

SEQ ID NO: 1873922 - RNA, 23 nt, Salmonella typhimurium LT2
cagcagauagccugccagcacca

SEQ ID NO: 1873923 - RNA, 22 nt, Salmonella typhimurium LT2
cagcagacugccuacgcggcca

SEQ ID NO: 1873924 - RNA, 23 nt, Salmonella typhimurium LT2
cagcagacgagaaacgcuuucug

SEQ ID NO: 1873925 - RNA, 23 nt, Salmonella typhimurium LT2
cagcagcacacgcuucugguugu

SEQ ID NO: 1873926 - RNA, 23 nt, Salmonella typhimurium LT2
cagcacgccuaacgaaccauuug

SEQ ID NO: 1873927 - RNA, 19 nt, Salmonella typhimurium LT2
cagcacgcgcugcgccgca

SEQ ID NO: 1873928 - RNA, 14 nt, Salmonella typhimurium LT2
cagcacgcggaaca

SEQ ID NO: 1873929 - RNA, 15 nt, Salmonella typhimurium LT2
cagcacguuauucuc

SEQ ID NO: 1873930 - RNA, 14 nt, Salmonella typhimurium LT2
cagcacuacggcaa

SEQ ID NO: 1873931 - RNA, 22 nt, Salmonella typhimurium LT2
cagcagcgacguaaugaucagc

SEQ ID NO: 1873932 - RNA, 15 nt, Salmonella typhimurium LT2
cagcagcgagauggc

SEQ ID NO: 1873933 - RNA, 15 nt, Salmonella typhimurium LT2
cagcagccaugccag

SEQ ID NO: 1873934 - RNA, 13 nt, Salmonella typhimurium LT2
cagcagcagacag

SEQ ID NO: 1873935 - RNA, 16 nt, Salmonella typhimurium LT2
cagcagcgcuuucuuc

SEQ ID NO: 1873936 - RNA, 13 nt, Salmonella typhimurium LT2
cagcagcgcgccg

SEQ ID NO: 1873937 - RNA, 12 nt, Salmonella typhimurium LT2
cagcagcgggcu

SEQ ID NO: 1873938 - RNA, 18 nt, Salmonella typhimurium LT2
cagcagcguuggccgccu

SEQ ID NO: 1873939 - RNA, 21 nt, Salmonella typhimurium LT2
cagcagcguuggccgccucgc

SEQ ID NO: 1873940 - RNA, 17 nt, Salmonella typhimurium LT2
cagcagcuccccgccgc

SEQ ID NO: 1873941 - RNA, 17 nt, Salmonella typhimurium LT2
cagcagcuucaugcauc

SEQ ID NO: 1873942 - RNA, 17 nt, Salmonella typhimurium LT2
cagcagcuugcgaucca

SEQ ID NO: 1873943 - RNA, 16 nt, Salmonella typhimurium LT2
cagcaggacgcgcacu

SEQ ID NO: 1873944 - RNA, 21 nt, Salmonella typhimurium LT2
cagcagggauauacaaauauc

SEQ ID NO: 1873945 - RNA, 16 nt, Salmonella typhimurium LT2
cagcagggccacaacg

SEQ ID NO: 1873946 - RNA, 19 nt, Salmonella typhimurium LT2
cagcagguaaacagacaau

SEQ ID NO: 1873947 - RNA, 23 nt, Salmonella typhimurium LT2
cagcagggcguuuuccagcgcgc

SEQ ID NO: 1873948 - RNA, 15 nt, Salmonella typhimurium LT2
cagcaggccuccgaa

SEQ ID NO: 1873949 - RNA, 18 nt, Salmonella typhimurium LT2
cagcaguuuuucaaucuu

SEQ ID NO: 1873950 - RNA, 18 nt, Salmonella typhimurium LT2
cagcaguuuguccauuuc

SEQ ID NO: 1873951 - RNA, 14 nt, Salmonella typhimurium LT2
cagcaguucuacgc

SEQ ID NO: 1873952 - RNA, 16 nt, Salmonella typhimurium LT2
cagcaguuccaccagu

SEQ ID NO: 1873953 - RNA, 18 nt, Salmonella typhimurium LT2
cagcaguggcucagucag

SEQ ID NO: 1873954 - RNA, 23 nt, Salmonella typhimurium LT2
cagcaguggcucagucagucccg

SEQ ID NO: 1873955 - RNA, 14 nt, Salmonella typhimurium LT2
cagccagcccagcg

SEQ ID NO: 1873956 - RNA, 15 nt, Salmonella typhimurium LT2
cagccagcccagcgc

SEQ ID NO: 1873957 - RNA, 13 nt, Salmonella typhimurium LT2
cagccagcccagc

SEQ ID NO: 1873958 - RNA, 17 nt, Salmonella typhimurium LT2
cagccagacggcgccca

SEQ ID NO: 1873959 - RNA, 18 nt, Salmonella typhimurium LT2
cagccacggaauaucuuu

SEQ ID NO: 1873960 - RNA, 21 nt, Salmonella typhimurium LT2
cagccacgguguggcccagcg

SEQ ID NO: 1873961 - RNA, 19 nt, Salmonella typhimurium LT2
cagccacguaaagacgacg

SEQ ID NO: 1873962 - RNA, 17 nt, Salmonella typhimurium LT2
cagccacggcaacgccg

SEQ ID NO: 1873963 - RNA, 16 nt, Salmonella typhimurium LT2
cagccacggcgcacac

SEQ ID NO: 1873964 - RNA, 19 nt, Salmonella typhimurium LT2
cagccacggcgcacacgcc

SEQ ID NO: 1873965 - RNA, 16 nt, Salmonella typhimurium LT2
cagccagaacucaucu

SEQ ID NO: 1873966 - RNA, 13 nt, Salmonella typhimurium LT2
cagccagaagccc

SEQ ID NO: 1873967 - RNA, 18 nt, Salmonella typhimurium LT2
cagccacuucuuccagcg

SEQ ID NO: 1873968 - RNA, 12 nt, Salmonella typhimurium LT2
cagccacucccg

SEQ ID NO: 1873969 - RNA, 16 nt, Salmonella typhimurium LT2
cagccacugcgccauu

SEQ ID NO: 1873970 - RNA, 14 nt, Salmonella typhimurium LT2
cagccagcugcugg

SEQ ID NO: 1873971 - RNA, 17 nt, Salmonella typhimurium LT2
cagccaggcggcaaagu

SEQ ID NO: 1873972 - RNA, 17 nt, Salmonella typhimurium LT2
cagccaggaauauacca

SEQ ID NO: 1873973 - RNA, 14 nt, Salmonella typhimurium LT2
cagccagccggaga

SEQ ID NO: 1873974 - RNA, 17 nt, Salmonella typhimurium LT2
cagccagcucaccagcc

SEQ ID NO: 1873975 - RNA, 12 nt, Salmonella typhimurium LT2
cagccagcgcca

SEQ ID NO: 1873976 - RNA, 14 nt, Salmonella typhimurium LT2
cagccagcgccccu

SEQ ID NO: 1873977 - RNA, 21 nt, Salmonella typhimurium LT2
cagccagguauuuagccacgc

SEQ ID NO: 1873978 - RNA, 17 nt, Salmonella typhimurium LT2
cagccaggucugaacca

SEQ ID NO: 1873979 - RNA, 12 nt, Salmonella typhimurium LT2
cagccaguccuc

SEQ ID NO: 1873980 - RNA, 16 nt, Salmonella typhimurium LT2
cagccagucgccaggc

SEQ ID NO: 1873981 - RNA, 16 nt, Salmonella typhimurium LT2
cagccccagcaccaga

SEQ ID NO: 1873982 - RNA, 16 nt, Salmonella typhimurium LT2
cagccccagcgccagc

SEQ ID NO: 1873983 - RNA, 17 nt, Salmonella typhimurium LT2
cagccccagcgccagcc

SEQ ID NO: 1873984 - RNA, 13 nt, Salmonella typhimurium LT2
cagccccagcgcc

SEQ ID NO: 1873985 - RNA, 14 nt, Salmonella typhimurium LT2
cagccccagcgcca

SEQ ID NO: 1873986 - RNA, 19 nt, Salmonella typhimurium LT2
cagcccaucggucgcgcgc

SEQ ID NO: 1873987 - RNA, 24 nt, Salmonella typhimurium LT2
cagcccaucuuuuuccugcaugau

SEQ ID NO: 1873988 - RNA, 20 nt, Salmonella typhimurium LT2
cagcccauaccacaacagaa

SEQ ID NO: 1873989 - RNA, 16 nt, Salmonella typhimurium LT2
cagccauuaauuucuu

SEQ ID NO: 1873990 - RNA, 15 nt, Salmonella typhimurium LT2
cagccauucgccacu

SEQ ID NO: 1873991 - RNA, 23 nt, Salmonella typhimurium LT2
cagccauucggguaauucaaucu

SEQ ID NO: 1873992 - RNA, 13 nt, Salmonella typhimurium LT2
cagccaugccagc

SEQ ID NO: 1873993 - RNA, 23 nt, Salmonella typhimurium LT2
cagccauaaucaguacugcgccc

SEQ ID NO: 1873994 - RNA, 21 nt, Salmonella typhimurium LT2
cagccauaccggcgcgcgcca

SEQ ID NO: 1873995 - RNA, 19 nt, Salmonella typhimurium LT2
cagcaucgccaucaacucc

SEQ ID NO: 1873996 - RNA, 15 nt, Salmonella typhimurium LT2
cagcaucgccaucaa

SEQ ID NO: 1873997 - RNA, 14 nt, Salmonella typhimurium LT2
cagcaucgaccagg

SEQ ID NO: 1873998 - RNA, 15 nt, Salmonella typhimurium LT2
cagcaucuaauuaaa

SEQ ID NO: 1873999 - RNA, 20 nt, Salmonella typhimurium LT2
cagcaugaauaaccucccgc

SEQ ID NO: 1874000 - RNA, 17 nt, Salmonella typhimurium LT2
cagcaucuuaugcgcaa

SEQ ID NO: 1874001 - RNA, 17 nt, Salmonella typhimurium LT2
cagcaucuuuggcuuua

SEQ ID NO: 1874002 - RNA, 24 nt, Salmonella typhimurium LT2
cagcaucugcggcuuucaucauuc

SEQ ID NO: 1874003 - RNA, 14 nt, Salmonella typhimurium LT2
cagcaucugcggcu

SEQ ID NO: 1874004 - RNA, 16 nt, Salmonella typhimurium LT2
cagcaugagccagccc

SEQ ID NO: 1874005 - RNA, 14 nt, Salmonella typhimurium LT2
cagcaugcccgcca

SEQ ID NO: 1874006 - RNA, 20 nt, Salmonella typhimurium LT2
cagcaucaucucccaggccg

SEQ ID NO: 1874007 - RNA, 14 nt, Salmonella typhimurium LT2
cagcaucaucuccc

SEQ ID NO: 1874008 - RNA, 17 nt, Salmonella typhimurium LT2
cagcaucaucucccagg

SEQ ID NO: 1874009 - RNA, 19 nt, Salmonella typhimurium LT2
cagcauaauaaagcagcgg

SEQ ID NO: 1874010 - RNA, 23 nt, Salmonella typhimurium LT2
cagcauaauauccugcaccgccu

SEQ ID NO: 1874011 - RNA, 23 nt, Salmonella typhimurium LT2
cagcauaauauucauaacgccga

SEQ ID NO: 1874012 - RNA, 18 nt, Salmonella typhimurium LT2
cagcauaauauucauaac

SEQ ID NO: 1874013 - RNA, 15 nt, Salmonella typhimurium LT2
cagcauauccagcgc

SEQ ID NO: 1874014 - RNA, 17 nt, Salmonella typhimurium LT2
cagcauacgucugcgcu

SEQ ID NO: 1874015 - RNA, 21 nt, Salmonella typhimurium LT2
cagcauacgccgcuggugcug

SEQ ID NO: 1874016 - RNA, 18 nt, Salmonella typhimurium LT2
cagcauauuuuccggcgu

SEQ ID NO: 1874017 - RNA, 17 nt, Salmonella typhimurium LT2
cagcauauccagcgccu

SEQ ID NO: 1874018 - RNA, 23 nt, Salmonella typhimurium LT2
cagcauaucgauagcaucgguca

SEQ ID NO: 1874019 - RNA, 16 nt, Salmonella typhimurium LT2
cagcauuucaaagcgu

SEQ ID NO: 1874020 - RNA, 21 nt, Salmonella typhimurium LT2
cagcauuggugagagaguugc

SEQ ID NO: 1874021 - RNA, 14 nt, Salmonella typhimurium LT2
cagcauuuccgccg

SEQ ID NO: 1874022 - RNA, 20 nt, Salmonella typhimurium LT2
cagcauuuccgccgccuucu

SEQ ID NO: 1874023 - RNA, 13 nt, Salmonella typhimurium LT2
cagcauuucuuca

SEQ ID NO: 1874024 - RNA, 20 nt, Salmonella typhimurium LT2
cagcauugagcaacccuaaa

SEQ ID NO: 1874025 - RNA, 14 nt, Salmonella typhimurium LT2
cagcauugaggcua

SEQ ID NO: 1874026 - RNA, 19 nt, Salmonella typhimurium LT2
cagcauugaggcuacccag

SEQ ID NO: 1874027 - RNA, 17 nt, Salmonella typhimurium LT2
cagcauuaacccggccc

SEQ ID NO: 1874028 - RNA, 14 nt, Salmonella typhimurium LT2
cagcauuacccccg

SEQ ID NO: 1874029 - RNA, 17 nt, Salmonella typhimurium LT2
cagcauuacccccgcca

SEQ ID NO: 1874030 - RNA, 13 nt, Salmonella typhimurium LT2
cagcauuaagauc

SEQ ID NO: 1874031 - RNA, 15 nt, Salmonella typhimurium LT2
cagcauggcgccugc

SEQ ID NO: 1874032 - RNA, 15 nt, Salmonella typhimurium LT2
cagccacacacuguu

SEQ ID NO: 1874033 - RNA, 20 nt, Salmonella typhimurium LT2
cagccacacacuguuuaaug

SEQ ID NO: 1874034 - RNA, 21 nt, Salmonella typhimurium LT2
cagccaaucauaaacgccuga

SEQ ID NO: 1874035 - RNA, 19 nt, Salmonella typhimurium LT2
cagccacaagagcagcaac

SEQ ID NO: 1874036 - RNA, 13 nt, Salmonella typhimurium LT2
cagccacacacug

SEQ ID NO: 1874037 - RNA, 22 nt, Salmonella typhimurium LT2
cagccaaaaauaacgcccugcg

SEQ ID NO: 1874038 - RNA, 21 nt, Salmonella typhimurium LT2
cagccaaaaauaacgcccugc

SEQ ID NO: 1874039 - RNA, 19 nt, Salmonella typhimurium LT2
cagcauuuucacaaccgcu

SEQ ID NO: 1874040 - RNA, 12 nt, Salmonella typhimurium LT2
cagccaaacagu

SEQ ID NO: 1874041 - RNA, 16 nt, Salmonella typhimurium LT2
cagccaacaaagaggc

SEQ ID NO: 1874042 - RNA, 21 nt, Salmonella typhimurium LT2
cagaugcgccagauucaugau

SEQ ID NO: 1874043 - RNA, 20 nt, Salmonella typhimurium LT2
cagaugcuuaaugcucugcu

SEQ ID NO: 1874044 - RNA, 21 nt, Salmonella typhimurium LT2
cagaugcugucuuagugaaau

SEQ ID NO: 1874045 - RNA, 22 nt, Salmonella typhimurium LT2
cagauggcgauucauaugcgcc

SEQ ID NO: 1874046 - RNA, 19 nt, Salmonella typhimurium LT2
cagaugcagguucccgccc

SEQ ID NO: 1874047 - RNA, 23 nt, Salmonella typhimurium LT2
cagaugcccguaaagcucgacaa

SEQ ID NO: 1874048 - RNA, 21 nt, Salmonella typhimurium LT2
cagaucgucggcguucaacac

SEQ ID NO: 1874049 - RNA, 22 nt, Salmonella typhimurium LT2
cagaucguccauuggcgggcga

SEQ ID NO: 1874050 - RNA, 14 nt, Salmonella typhimurium LT2
cagaucucacaaga

SEQ ID NO: 1874051 - RNA, 22 nt, Salmonella typhimurium LT2
cagaucuuauaugagcgggccg

SEQ ID NO: 1874052 - RNA, 17 nt, Salmonella typhimurium LT2
cagaucuuuauccugca

SEQ ID NO: 1874053 - RNA, 21 nt, Salmonella typhimurium LT2
cagaucuuuauccugcacgaa

SEQ ID NO: 1874054 - RNA, 17 nt, Salmonella typhimurium LT2
cagaucuuuuugcuccu

SEQ ID NO: 1874055 - RNA, 15 nt, Salmonella typhimurium LT2
cagaucuucagaggc

SEQ ID NO: 1874056 - RNA, 19 nt, Salmonella typhimurium LT2
cagaucgccaaagucauug

SEQ ID NO: 1874057 - RNA, 20 nt, Salmonella typhimurium LT2
cagaucgccaaagucauugc

SEQ ID NO: 1874058 - RNA, 19 nt, Salmonella typhimurium LT2
cagaucggcagacaguuuc

SEQ ID NO: 1874059 - RNA, 18 nt, Salmonella typhimurium LT2
cagaucgcggcaauggcu

SEQ ID NO: 1874060 - RNA, 13 nt, Salmonella typhimurium LT2
cagauucuucugc

SEQ ID NO: 1874061 - RNA, 23 nt, Salmonella typhimurium LT2
cagauuccccaaucccaccacuu

SEQ ID NO: 1874062 - RNA, 14 nt, Salmonella typhimurium LT2
cagauuacuaugag

SEQ ID NO: 1874063 - RNA, 22 nt, Salmonella typhimurium LT2
cagauuaccggcaauagucucc

SEQ ID NO: 1874064 - RNA, 16 nt, Salmonella typhimurium LT2
cagauuauuucacuuc

SEQ ID NO: 1874065 - RNA, 20 nt, Salmonella typhimurium LT2
cagauggugauagcgcgcca

SEQ ID NO: 1874066 - RNA, 19 nt, Salmonella typhimurium LT2
cagaugucgcggauaugca

SEQ ID NO: 1874067 - RNA, 14 nt, Salmonella typhimurium LT2
cagauguugauaca

SEQ ID NO: 1874068 - RNA, 23 nt, Salmonella typhimurium LT2
cagauguugagcaaugggaagga

SEQ ID NO: 1874069 - RNA, 17 nt, Salmonella typhimurium LT2
cagaugugguauuuucu

SEQ ID NO: 1874070 - RNA, 17 nt, Salmonella typhimurium LT2
cagauuucgcaacagca

SEQ ID NO: 1874071 - RNA, 16 nt, Salmonella typhimurium LT2
cagauugcgaaagaau

SEQ ID NO: 1874072 - RNA, 22 nt, Salmonella typhimurium LT2
cagcaaaaucacgcacacgucu

SEQ ID NO: 1874073 - RNA, 18 nt, Salmonella typhimurium LT2
cagcaaaaagaaucgcca

SEQ ID NO: 1874074 - RNA, 21 nt, Salmonella typhimurium LT2
cagcaaaaagaaucgccaggc

SEQ ID NO: 1874075 - RNA, 15 nt, Salmonella typhimurium LT2
cagauuuuuaauguc

SEQ ID NO: 1874076 - RNA, 15 nt, Salmonella typhimurium LT2
cagauuuucuuuaau

SEQ ID NO: 1874077 - RNA, 22 nt, Salmonella typhimurium LT2
cagauuuucauuuagcgccugu

SEQ ID NO: 1874078 - RNA, 22 nt, Salmonella typhimurium LT2
cagcacaaugccuucugcgccc

SEQ ID NO: 1874079 - RNA, 13 nt, Salmonella typhimurium LT2
cagcaauucugcu

SEQ ID NO: 1874080 - RNA, 22 nt, Salmonella typhimurium LT2
cagcaauuucucgcccgccaga

SEQ ID NO: 1874081 - RNA, 16 nt, Salmonella typhimurium LT2
cagcaaugcacugcga

SEQ ID NO: 1874082 - RNA, 23 nt, Salmonella typhimurium LT2
cagcaauggacaaguaaaccggu

SEQ ID NO: 1874083 - RNA, 20 nt, Salmonella typhimurium LT2
cagcaauuccgccaucucau

SEQ ID NO: 1874084 - RNA, 20 nt, Salmonella typhimurium LT2
cagcaaugccgccgccaggu

SEQ ID NO: 1874085 - RNA, 20 nt, Salmonella typhimurium LT2
cagcaaugauaacggcgcca

SEQ ID NO: 1874086 - RNA, 15 nt, Salmonella typhimurium LT2
cagcaaugagcaggc

SEQ ID NO: 1874087 - RNA, 18 nt, Salmonella typhimurium LT2
cagcaaugagcaggcccg

SEQ ID NO: 1874088 - RNA, 18 nt, Salmonella typhimurium LT2
cagcaaugagacaacggc

SEQ ID NO: 1874089 - RNA, 18 nt, Salmonella typhimurium LT2
cagcaauaacaggcacag

SEQ ID NO: 1874090 - RNA, 17 nt, Salmonella typhimurium LT2
cagcacauagccuaaug

SEQ ID NO: 1874091 - RNA, 21 nt, Salmonella typhimurium LT2
cagcacagcgguagcaucuca

SEQ ID NO: 1874092 - RNA, 17 nt, Salmonella typhimurium LT2
cagcacaugauguuuua

SEQ ID NO: 1874093 - RNA, 14 nt, Salmonella typhimurium LT2
cagcacaugcaauu

SEQ ID NO: 1874094 - RNA, 13 nt, Salmonella typhimurium LT2
cagcaccacgccc

SEQ ID NO: 1874095 - RNA, 14 nt, Salmonella typhimurium LT2
cagcaccagcgaga

SEQ ID NO: 1874096 - RNA, 13 nt, Salmonella typhimurium LT2
cagcaacgcccag

SEQ ID NO: 1874097 - RNA, 14 nt, Salmonella typhimurium LT2
cagcaacgccagcg

SEQ ID NO: 1874098 - RNA, 19 nt, Salmonella typhimurium LT2
cagcaacacuuugcgcugc

SEQ ID NO: 1874099 - RNA, 16 nt, Salmonella typhimurium LT2
cagcaacagaaguuca

SEQ ID NO: 1874100 - RNA, 21 nt, Salmonella typhimurium LT2
cagcaacaaaccgauaaucac

SEQ ID NO: 1874101 - RNA, 15 nt, Salmonella typhimurium LT2
cagcaauaaaaggaa

SEQ ID NO: 1874102 - RNA, 15 nt, Salmonella typhimurium LT2
cagcaauaacacagg

SEQ ID NO: 1874103 - RNA, 22 nt, Salmonella typhimurium LT2
cagcaauaacacaggcggcgcu

SEQ ID NO: 1874104 - RNA, 17 nt, Salmonella typhimurium LT2
cagcaaggcugccgcca

SEQ ID NO: 1874105 - RNA, 18 nt, Salmonella typhimurium LT2
cagcaacugcgcgcgggu

SEQ ID NO: 1874106 - RNA, 19 nt, Salmonella typhimurium LT2
cagcaacuugaaguaugaa

SEQ ID NO: 1874107 - RNA, 22 nt, Salmonella typhimurium LT2
cagcaacgugaacugcgccugc

SEQ ID NO: 1874108 - RNA, 21 nt, Salmonella typhimurium LT2
cagcaacguuuguaacagcag

SEQ ID NO: 1874109 - RNA, 20 nt, Salmonella typhimurium LT2
cagcaacgggacggcggcca

SEQ ID NO: 1874110 - RNA, 22 nt, Salmonella typhimurium LT2
cagcaacgggacggcggccagc

SEQ ID NO: 1874111 - RNA, 14 nt, Salmonella typhimurium LT2
cagcaacggcugau

SEQ ID NO: 1874112 - RNA, 16 nt, Salmonella typhimurium LT2
cagagcgauaaagaac

SEQ ID NO: 1874113 - RNA, 20 nt, Salmonella typhimurium LT2
cagagcgccggcaaagccau

SEQ ID NO: 1874114 - RNA, 22 nt, Salmonella typhimurium LT2
cagagcgcgcuggcaagcgcca

SEQ ID NO: 1874115 - RNA, 13 nt, Salmonella typhimurium LT2
cagagcggcaaca

SEQ ID NO: 1874116 - RNA, 23 nt, Salmonella typhimurium LT2
cagaggcuaaucaggaagaaaga

SEQ ID NO: 1874117 - RNA, 23 nt, Salmonella typhimurium LT2
cagaggcacgguauuaacggcga

SEQ ID NO: 1874118 - RNA, 20 nt, Salmonella typhimurium LT2
cagaggaucuggacgccaau

SEQ ID NO: 1874119 - RNA, 21 nt, Salmonella typhimurium LT2
cagagcuuuggcgacuuuuuu

SEQ ID NO: 1874120 - RNA, 20 nt, Salmonella typhimurium LT2
cagagcucgucaaaaaucac

SEQ ID NO: 1874121 - RNA, 18 nt, Salmonella typhimurium LT2
cagagcucgucaaaaauc

SEQ ID NO: 1874122 - RNA, 18 nt, Salmonella typhimurium LT2
cagaguucuuuugaggcu

SEQ ID NO: 1874123 - RNA, 12 nt, Salmonella typhimurium LT2
cagauaaaccac

SEQ ID NO: 1874124 - RNA, 20 nt, Salmonella typhimurium LT2
cagauaaagcuucugcgccu

SEQ ID NO: 1874125 - RNA, 14 nt, Salmonella typhimurium LT2
cagauaaaggauug

SEQ ID NO: 1874126 - RNA, 13 nt, Salmonella typhimurium LT2
cagaguccagcgg

SEQ ID NO: 1874127 - RNA, 20 nt, Salmonella typhimurium LT2
cagaguaaccacgauaaaga

SEQ ID NO: 1874128 - RNA, 21 nt, Salmonella typhimurium LT2
cagaguaacccgauacccuga

SEQ ID NO: 1874129 - RNA, 18 nt, Salmonella typhimurium LT2
cagagguaagauguucua

SEQ ID NO: 1874130 - RNA, 17 nt, Salmonella typhimurium LT2
cagauacggcuccagca

SEQ ID NO: 1874131 - RNA, 19 nt, Salmonella typhimurium LT2
cagauacgucuuacgccau

SEQ ID NO: 1874132 - RNA, 20 nt, Salmonella typhimurium LT2
cagauacgucuuacgccaug

SEQ ID NO: 1874133 - RNA, 16 nt, Salmonella typhimurium LT2
cagauacggcgcgucg

SEQ ID NO: 1874134 - RNA, 21 nt, Salmonella typhimurium LT2
cagauaccgaccgugagaauc

SEQ ID NO: 1874135 - RNA, 20 nt, Salmonella typhimurium LT2
cagauagcaaaaaagcgccu

SEQ ID NO: 1874136 - RNA, 21 nt, Salmonella typhimurium LT2
cagauagagcauaauaaaaau

SEQ ID NO: 1874137 - RNA, 13 nt, Salmonella typhimurium LT2
cagauagcgcugc

SEQ ID NO: 1874138 - RNA, 19 nt, Salmonella typhimurium LT2
cagauagcgcugcgccaga

SEQ ID NO: 1874139 - RNA, 15 nt, Salmonella typhimurium LT2
cagauagcguaaccg

SEQ ID NO: 1874140 - RNA, 15 nt, Salmonella typhimurium LT2
cagauagcuuccaug

SEQ ID NO: 1874141 - RNA, 17 nt, Salmonella typhimurium LT2
cagauaacccggcgcag

SEQ ID NO: 1874142 - RNA, 16 nt, Salmonella typhimurium LT2
cagauaacaggcaauu

SEQ ID NO: 1874143 - RNA, 23 nt, Salmonella typhimurium LT2
cagauaauuuugcauaccaaguu

SEQ ID NO: 1874144 - RNA, 23 nt, Salmonella typhimurium LT2
cagauacacgcccucucgccaaa

SEQ ID NO: 1874145 - RNA, 21 nt, Salmonella typhimurium LT2
cagauaagcucuccuggaugc

SEQ ID NO: 1874146 - RNA, 22 nt, Salmonella typhimurium LT2
cagauaaugaucaacgcggcga

SEQ ID NO: 1874147 - RNA, 16 nt, Salmonella typhimurium LT2
cagauccaucgccugc

SEQ ID NO: 1874148 - RNA, 19 nt, Salmonella typhimurium LT2
cagauccagcgccguugcg

SEQ ID NO: 1874149 - RNA, 14 nt, Salmonella typhimurium LT2
cagauccaaauggc

SEQ ID NO: 1874150 - RNA, 21 nt, Salmonella typhimurium LT2
cagauaucccugcaaacugug

SEQ ID NO: 1874151 - RNA, 22 nt, Salmonella typhimurium LT2
cagauaguaaugcucaacucug

SEQ ID NO: 1874152 - RNA, 19 nt, Salmonella typhimurium LT2
cagauaguggcugaggccg

SEQ ID NO: 1874153 - RNA, 22 nt, Salmonella typhimurium LT2
cagauaguauuucccuucccag

SEQ ID NO: 1874154 - RNA, 19 nt, Salmonella typhimurium LT2
cagauaggcggcaaauaaa

SEQ ID NO: 1874155 - RNA, 19 nt, Salmonella typhimurium LT2
cagauagugaucgggcuga

SEQ ID NO: 1874156 - RNA, 23 nt, Salmonella typhimurium LT2
cagacgagaaacgcuuucugggg

SEQ ID NO: 1874157 - RNA, 19 nt, Salmonella typhimurium LT2
cagacgaccguaauagcaa

SEQ ID NO: 1874158 - RNA, 23 nt, Salmonella typhimurium LT2
cagacgaauaaucucaucgccuu

SEQ ID NO: 1874159 - RNA, 22 nt, Salmonella typhimurium LT2
cagacgaagaguucaacgccga

SEQ ID NO: 1874160 - RNA, 19 nt, Salmonella typhimurium LT2
cagacgaaaaugcgccuua

SEQ ID NO: 1874161 - RNA, 23 nt, Salmonella typhimurium LT2
cagaccugaauauucggcuccag

SEQ ID NO: 1874162 - RNA, 13 nt, Salmonella typhimurium LT2
cagaccuuuccag

SEQ ID NO: 1874163 - RNA, 19 nt, Salmonella typhimurium LT2
cagacgcuccgcaguaauc

SEQ ID NO: 1874164 - RNA, 19 nt, Salmonella typhimurium LT2
cagacgcugauagccacgg

SEQ ID NO: 1874165 - RNA, 20 nt, Salmonella typhimurium LT2
cagacgcgugauacaggcau

SEQ ID NO: 1874166 - RNA, 16 nt, Salmonella typhimurium LT2
cagacgcgcagcaccg

SEQ ID NO: 1874167 - RNA, 16 nt, Salmonella typhimurium LT2
cagacgccgcgccgcg

SEQ ID NO: 1874168 - RNA, 13 nt, Salmonella typhimurium LT2
cagacucaacugc

SEQ ID NO: 1874169 - RNA, 15 nt, Salmonella typhimurium LT2
cagacucagccaggu

SEQ ID NO: 1874170 - RNA, 15 nt, Salmonella typhimurium LT2
cagacucgcuucacg

SEQ ID NO: 1874171 - RNA, 19 nt, Salmonella typhimurium LT2
cagacucgcuucacgcgga

SEQ ID NO: 1874172 - RNA, 12 nt, Salmonella typhimurium LT2
cagacuaucuuc

SEQ ID NO: 1874173 - RNA, 16 nt, Salmonella typhimurium LT2
cagacggcgaaucaau

SEQ ID NO: 1874174 - RNA, 22 nt, Salmonella typhimurium LT2
cagacgcuucauugguuaauuc

SEQ ID NO: 1874175 - RNA, 18 nt, Salmonella typhimurium LT2
cagacggcuccagcgcca

SEQ ID NO: 1874176 - RNA, 16 nt, Salmonella typhimurium LT2
cagacguuacaucucc

SEQ ID NO: 1874177 - RNA, 18 nt, Salmonella typhimurium LT2
cagacguuacaucuccug

SEQ ID NO: 1874178 - RNA, 14 nt, Salmonella typhimurium LT2
cagacgguuuaucc

SEQ ID NO: 1874179 - RNA, 16 nt, Salmonella typhimurium LT2
cagagccaacagaaga

SEQ ID NO: 1874180 - RNA, 18 nt, Salmonella typhimurium LT2
cagagcaucaauggugaa

SEQ ID NO: 1874181 - RNA, 14 nt, Salmonella typhimurium LT2
cagagcauaaaaau

SEQ ID NO: 1874182 - RNA, 23 nt, Salmonella typhimurium LT2
cagagcccagcgcgauacgcaga

SEQ ID NO: 1874183 - RNA, 15 nt, Salmonella typhimurium LT2
cagagauaauuuucc

SEQ ID NO: 1874184 - RNA, 14 nt, Salmonella typhimurium LT2
cagagauccacauu

SEQ ID NO: 1874185 - RNA, 16 nt, Salmonella typhimurium LT2
cagacuucauuuucca

SEQ ID NO: 1874186 - RNA, 18 nt, Salmonella typhimurium LT2
cagacuguaaaucugccg

SEQ ID NO: 1874187 - RNA, 19 nt, Salmonella typhimurium LT2
cagacugaauaaaggguuu

SEQ ID NO: 1874188 - RNA, 17 nt, Salmonella typhimurium LT2
cagaccaaaaucaaacu

SEQ ID NO: 1874189 - RNA, 18 nt, Salmonella typhimurium LT2
cagaccaaaaucaaacug

SEQ ID NO: 1874190 - RNA, 20 nt, Salmonella typhimurium LT2
cagacaugaccgcacagcag

SEQ ID NO: 1874191 - RNA, 17 nt, Salmonella typhimurium LT2
cagacauauuuucucug

SEQ ID NO: 1874192 - RNA, 14 nt, Salmonella typhimurium LT2
cagacaucaucgaa

SEQ ID NO: 1874193 - RNA, 15 nt, Salmonella typhimurium LT2
cagacaugcacaugg

SEQ ID NO: 1874194 - RNA, 17 nt, Salmonella typhimurium LT2
cagacaggcuuuaaagu

SEQ ID NO: 1874195 - RNA, 15 nt, Salmonella typhimurium LT2
cagacacggucgccu

SEQ ID NO: 1874196 - RNA, 23 nt, Salmonella typhimurium LT2
cagacaggcaugguuaacaauau

SEQ ID NO: 1874197 - RNA, 20 nt, Salmonella typhimurium LT2
cagacagccgacggcaaaaa

SEQ ID NO: 1874198 - RNA, 21 nt, Salmonella typhimurium LT2
cagacagccgaucaggccgca

SEQ ID NO: 1874199 - RNA, 17 nt, Salmonella typhimurium LT2
cagacagauaacaccag

SEQ ID NO: 1874200 - RNA, 19 nt, Salmonella typhimurium LT2
cagacagauaacaccagcg

SEQ ID NO: 1874201 - RNA, 22 nt, Salmonella typhimurium LT2
cagacagauaacaccagcgauc

SEQ ID NO: 1874202 - RNA, 19 nt, Salmonella typhimurium LT2
cagacacuggaaacagcca

SEQ ID NO: 1874203 - RNA, 22 nt, Salmonella typhimurium LT2
cagacacuggaaacagccaauc

SEQ ID NO: 1874204 - RNA, 17 nt, Salmonella typhimurium LT2
cagaccacgaaucagga

SEQ ID NO: 1874205 - RNA, 13 nt, Salmonella typhimurium LT2
cagaccaccagcg

SEQ ID NO: 1874206 - RNA, 19 nt, Salmonella typhimurium LT2
cagaccaccccacagcaau

SEQ ID NO: 1874207 - RNA, 15 nt, Salmonella typhimurium LT2
cagaccacagauaaa

SEQ ID NO: 1874208 - RNA, 16 nt, Salmonella typhimurium LT2
cagaccagucggacag

SEQ ID NO: 1874209 - RNA, 23 nt, Salmonella typhimurium LT2
cagacccaguacaaacaaauaaa

SEQ ID NO: 1874210 - RNA, 22 nt, Salmonella typhimurium LT2
cagaccgaucucaugcaacugg

SEQ ID NO: 1874211 - RNA, 17 nt, Salmonella typhimurium LT2
cagaccgaucucaugca

SEQ ID NO: 1874212 - RNA, 20 nt, Salmonella typhimurium LT2
cagaccgaucucaugcaacu

SEQ ID NO: 1874213 - RNA, 21 nt, Salmonella typhimurium LT2
cagacccgcguacaggaagcc

SEQ ID NO: 1874214 - RNA, 15 nt, Salmonella typhimurium LT2
cagacccgcaaacca

SEQ ID NO: 1874215 - RNA, 17 nt, Salmonella typhimurium LT2
cagaccgucaugacguc

SEQ ID NO: 1874216 - RNA, 17 nt, Salmonella typhimurium LT2
cagaccggcaucucauc

SEQ ID NO: 1874217 - RNA, 14 nt, Salmonella typhimurium LT2
cagaccggauugcc

SEQ ID NO: 1874218 - RNA, 21 nt, Salmonella typhimurium LT2
cagaauccgucagguuuuuug

SEQ ID NO: 1874219 - RNA, 13 nt, Salmonella typhimurium LT2
cagaaucaggcca

SEQ ID NO: 1874220 - RNA, 14 nt, Salmonella typhimurium LT2
cagaaucaucaugu

SEQ ID NO: 1874221 - RNA, 20 nt, Salmonella typhimurium LT2
cagaauaaacggcagggcag

SEQ ID NO: 1874222 - RNA, 14 nt, Salmonella typhimurium LT2
cagaauaacgucgc

SEQ ID NO: 1874223 - RNA, 22 nt, Salmonella typhimurium LT2
cagaaucaccgacagcaccgcc

SEQ ID NO: 1874224 - RNA, 13 nt, Salmonella typhimurium LT2
cagaaucaauaaa

SEQ ID NO: 1874225 - RNA, 15 nt, Salmonella typhimurium LT2
cagaauaucuuuuac

SEQ ID NO: 1874226 - RNA, 16 nt, Salmonella typhimurium LT2
cagacaacgccgccug

SEQ ID NO: 1874227 - RNA, 15 nt, Salmonella typhimurium LT2
cagacaaccagcagg

SEQ ID NO: 1874228 - RNA, 19 nt, Salmonella typhimurium LT2
cagacaaccauauuuaugc

SEQ ID NO: 1874229 - RNA, 12 nt, Salmonella typhimurium LT2
cagacaaugaau

SEQ ID NO: 1874230 - RNA, 16 nt, Salmonella typhimurium LT2
cagaauugcgccaccu

SEQ ID NO: 1874231 - RNA, 15 nt, Salmonella typhimurium LT2
cagaauuuaaaaauc

SEQ ID NO: 1874232 - RNA, 21 nt, Salmonella typhimurium LT2
cagaauuucgcccuguauaca

SEQ ID NO: 1874233 - RNA, 21 nt, Salmonella typhimurium LT2
cagaauuaacucaucacagcc

SEQ ID NO: 1874234 - RNA, 18 nt, Salmonella typhimurium LT2
cagaauuaacucaucaca

SEQ ID NO: 1874235 - RNA, 19 nt, Salmonella typhimurium LT2
cagaauggcgaucaccgca

SEQ ID NO: 1874236 - RNA, 15 nt, Salmonella typhimurium LT2
cagaaugcccugcug

SEQ ID NO: 1874237 - RNA, 20 nt, Salmonella typhimurium LT2
cagaaugcccugcuguucca

SEQ ID NO: 1874238 - RNA, 15 nt, Salmonella typhimurium LT2
cagaaugcccagcaa

SEQ ID NO: 1874239 - RNA, 17 nt, Salmonella typhimurium LT2
cagaaugcguaaaaagc

SEQ ID NO: 1874240 - RNA, 23 nt, Salmonella typhimurium LT2
cagaaggcuugauacugaggauu

SEQ ID NO: 1874241 - RNA, 19 nt, Salmonella typhimurium LT2
cagaaggccagugguaaaa

SEQ ID NO: 1874242 - RNA, 17 nt, Salmonella typhimurium LT2
cagaaguccccagccgc

SEQ ID NO: 1874243 - RNA, 20 nt, Salmonella typhimurium LT2
cagaagugccaguaacucau

SEQ ID NO: 1874244 - RNA, 15 nt, Salmonella typhimurium LT2
cagaaggcaugggga

SEQ ID NO: 1874245 - RNA, 14 nt, Salmonella typhimurium LT2
cagaagcuaaggga

SEQ ID NO: 1874246 - RNA, 22 nt, Salmonella typhimurium LT2
cagaagcuguaaccuacgccaa

SEQ ID NO: 1874247 - RNA, 12 nt, Salmonella typhimurium LT2
cagaagagaaug

SEQ ID NO: 1874248 - RNA, 23 nt, Salmonella typhimurium LT2
cagaagaguuaacuucuccucca

SEQ ID NO: 1874249 - RNA, 16 nt, Salmonella typhimurium LT2
cagaagcacuucucca

SEQ ID NO: 1874250 - RNA, 20 nt, Salmonella typhimurium LT2
cagaacucaucuucuuuuuc

SEQ ID NO: 1874251 - RNA, 15 nt, Salmonella typhimurium LT2
cagaacugcguaagc

SEQ ID NO: 1874252 - RNA, 15 nt, Salmonella typhimurium LT2
cagaagaaucugccu

SEQ ID NO: 1874253 - RNA, 16 nt, Salmonella typhimurium LT2
cagaagaaucugccuu

SEQ ID NO: 1874254 - RNA, 18 nt, Salmonella typhimurium LT2
cagaagaaucugccuuuu

SEQ ID NO: 1874255 - RNA, 20 nt, Salmonella typhimurium LT2
cagaagaagguaaaaguagg

SEQ ID NO: 1874256 - RNA, 13 nt, Salmonella typhimurium LT2
cagaacgagagga

SEQ ID NO: 1874257 - RNA, 15 nt, Salmonella typhimurium LT2
cagaacgagaggagg

SEQ ID NO: 1874258 - RNA, 19 nt, Salmonella typhimurium LT2
cagaacgcuuuugcgcacu

SEQ ID NO: 1874259 - RNA, 15 nt, Salmonella typhimurium LT2
cagaaccgccgcgau

SEQ ID NO: 1874260 - RNA, 22 nt, Salmonella typhimurium LT2
cagaaacaagaagcacgacaca

SEQ ID NO: 1874261 - RNA, 20 nt, Salmonella typhimurium LT2
cagaaaaugcucaguauggc

SEQ ID NO: 1874262 - RNA, 11 nt, Salmonella typhimurium LT2
cagaaaagcuu

SEQ ID NO: 1874263 - RNA, 19 nt, Salmonella typhimurium LT2
cagaaacaucgguaauagc

SEQ ID NO: 1874264 - RNA, 14 nt, Salmonella typhimurium LT2
cagaaauaaaauac

SEQ ID NO: 1874265 - RNA, 15 nt, Salmonella typhimurium LT2
cagaaaggcgugcag

SEQ ID NO: 1874266 - RNA, 18 nt, Salmonella typhimurium LT2
cagaacaaacuuauccca

SEQ ID NO: 1874267 - RNA, 15 nt, Salmonella typhimurium LT2
cagaacaucaucuuc

SEQ ID NO: 1874268 - RNA, 21 nt, Salmonella typhimurium LT2
cagaacaucuaccgcauacug

SEQ ID NO: 1874269 - RNA, 19 nt, Salmonella typhimurium LT2
cagaacaugaaauggcaug

SEQ ID NO: 1874270 - RNA, 22 nt, Salmonella typhimurium LT2
cagaacaugaaauggcaugagc

SEQ ID NO: 1874271 - RNA, 16 nt, Salmonella typhimurium LT2
cagaaaucgccgggcu

SEQ ID NO: 1874272 - RNA, 12 nt, Salmonella typhimurium LT2
cagaaauuaaau

SEQ ID NO: 1874273 - RNA, 22 nt, Salmonella typhimurium LT2
cagaaauccgcgaauaccuucc

SEQ ID NO: 1874274 - RNA, 15 nt, Salmonella typhimurium LT2
cagaaauaaaauacu

SEQ ID NO: 1874275 - RNA, 12 nt, Salmonella typhimurium LT2
cacugccaccgc

SEQ ID NO: 1874276 - RNA, 19 nt, Salmonella typhimurium LT2
cacugccacgagccuucug

SEQ ID NO: 1874277 - RNA, 21 nt, Salmonella typhimurium LT2
cacugccacgagccuucuggc

SEQ ID NO: 1874278 - RNA, 21 nt, Salmonella typhimurium LT2
cacugcauaaauaucugcauu

SEQ ID NO: 1874279 - RNA, 14 nt, Salmonella typhimurium LT2
cacugcauuacucg

SEQ ID NO: 1874280 - RNA, 21 nt, Salmonella typhimurium LT2
cacugcccucaaguuauguua

SEQ ID NO: 1874281 - RNA, 15 nt, Salmonella typhimurium LT2
cacugcccagagaau

SEQ ID NO: 1874282 - RNA, 15 nt, Salmonella typhimurium LT2
cacugcggacauuuu

SEQ ID NO: 1874283 - RNA, 16 nt, Salmonella typhimurium LT2
cacugcggacauuuuc

SEQ ID NO: 1874284 - RNA, 22 nt, Salmonella typhimurium LT2
caaugucuuuauccgccagcca

SEQ ID NO: 1874285 - RNA, 23 nt, Salmonella typhimurium LT2
caauguugaaucccacgccgcug

SEQ ID NO: 1874286 - RNA, 14 nt, Salmonella typhimurium LT2
caauguucaugcgc

SEQ ID NO: 1874287 - RNA, 21 nt, Salmonella typhimurium LT2
caauguugaaucccacgccgc

SEQ ID NO: 1874288 - RNA, 21 nt, Salmonella typhimurium LT2
cacuuacgguuuuaacaaccc

SEQ ID NO: 1874289 - RNA, 17 nt, Salmonella typhimurium LT2
cacuuaccaaucgcggc

SEQ ID NO: 1874290 - RNA, 23 nt, Salmonella typhimurium LT2
cacuuaauacucgccccguuccu

SEQ ID NO: 1874291 - RNA, 21 nt, Salmonella typhimurium LT2
cacuuaaguaaagauuuuuau

SEQ ID NO: 1874292 - RNA, 21 nt, Salmonella typhimurium LT2
cacuguuuaaugcuuucaaua

SEQ ID NO: 1874293 - RNA, 22 nt, Salmonella typhimurium LT2
cacuguuugcugacaaucugcu

SEQ ID NO: 1874294 - RNA, 21 nt, Salmonella typhimurium LT2
cacuggugacaucgccaacgc

SEQ ID NO: 1874295 - RNA, 13 nt, Salmonella typhimurium LT2
cacuguaaaaggg

SEQ ID NO: 1874296 - RNA, 14 nt, Salmonella typhimurium LT2
cacuguaaaaggga

SEQ ID NO: 1874297 - RNA, 16 nt, Salmonella typhimurium LT2
cacuggaaacagccaa

SEQ ID NO: 1874298 - RNA, 20 nt, Salmonella typhimurium LT2
cacuggaauucguuaccucg

SEQ ID NO: 1874299 - RNA, 13 nt, Salmonella typhimurium LT2
cacuggcagagac

SEQ ID NO: 1874300 - RNA, 16 nt, Salmonella typhimurium LT2
cacugcuguguccagg

SEQ ID NO: 1874301 - RNA, 23 nt, Salmonella typhimurium LT2
cacugcuguguccaggucaucac

SEQ ID NO: 1874302 - RNA, 20 nt, Salmonella typhimurium LT2
cacuggccucccaguucccu

SEQ ID NO: 1874303 - RNA, 19 nt, Salmonella typhimurium LT2
cacuggccucccaguuccc

SEQ ID NO: 1874304 - RNA, 16 nt, Salmonella typhimurium LT2
cacuggcccccuguuc

SEQ ID NO: 1874305 - RNA, 14 nt, Salmonella typhimurium LT2
cacuggcgcuggcu

SEQ ID NO: 1874306 - RNA, 20 nt, Salmonella typhimurium LT2
cacugggcgaagguggcgga

SEQ ID NO: 1874307 - RNA, 14 nt, Salmonella typhimurium LT2
cacuucaucaucau

SEQ ID NO: 1874308 - RNA, 22 nt, Salmonella typhimurium LT2
cacuucauccuuuacgcugccu

SEQ ID NO: 1874309 - RNA, 16 nt, Salmonella typhimurium LT2
cacuucacaaacaauu

SEQ ID NO: 1874310 - RNA, 16 nt, Salmonella typhimurium LT2
cacuucagccagcugc

SEQ ID NO: 1874311 - RNA, 20 nt, Salmonella typhimurium LT2
cacuucagccagcugcuggc

SEQ ID NO: 1874312 - RNA, 16 nt, Salmonella typhimurium LT2
cacuuccagccacggc

SEQ ID NO: 1874313 - RNA, 11 nt, Salmonella typhimurium LT2
cacuuaugguc

SEQ ID NO: 1874314 - RNA, 23 nt, Salmonella typhimurium LT2
cacuucuuucacugucauggcua

SEQ ID NO: 1874315 - RNA, 14 nt, Salmonella typhimurium LT2
cacuugagaaauua

SEQ ID NO: 1874316 - RNA, 23 nt, Salmonella typhimurium LT2
cacuucugaguucggcauggggu

SEQ ID NO: 1874317 - RNA, 13 nt, Salmonella typhimurium LT2
cacuucugacaga

SEQ ID NO: 1874318 - RNA, 14 nt, Salmonella typhimurium LT2
cacuucgauaaacg

SEQ ID NO: 1874319 - RNA, 16 nt, Salmonella typhimurium LT2
cacuucgauaacauca

SEQ ID NO: 1874320 - RNA, 17 nt, Salmonella typhimurium LT2
cacuuccugaaucacca

SEQ ID NO: 1874321 - RNA, 20 nt, Salmonella typhimurium LT2
cacuuccugaaucaccagcc

SEQ ID NO: 1874322 - RNA, 22 nt, Salmonella typhimurium LT2
cacuuccugaaucaccagccga

SEQ ID NO: 1874323 - RNA, 15 nt, Salmonella typhimurium LT2
cacuuccugcuccuu

SEQ ID NO: 1874324 - RNA, 17 nt, Salmonella typhimurium LT2
cacuuccgccaccacgc

SEQ ID NO: 1874325 - RNA, 18 nt, Salmonella typhimurium LT2
cacuuccgccaccacgcc

SEQ ID NO: 1874326 - RNA, 12 nt, Salmonella typhimurium LT2
cacuuucuugcc

SEQ ID NO: 1874327 - RNA, 17 nt, Salmonella typhimurium LT2
cacuuucuugccacugg

SEQ ID NO: 1874328 - RNA, 21 nt, Salmonella typhimurium LT2
cacuuucucggcuuuccagcu

SEQ ID NO: 1874329 - RNA, 17 nt, Salmonella typhimurium LT2
cacuuucucggcuuucc

SEQ ID NO: 1874330 - RNA, 21 nt, Salmonella typhimurium LT2
cacuuuucuuuccugcaaauu

SEQ ID NO: 1874331 - RNA, 15 nt, Salmonella typhimurium LT2
cacuuugcgccgcca

SEQ ID NO: 1874332 - RNA, 18 nt, Salmonella typhimurium LT2
cagaaaaaaugcaccgcc

SEQ ID NO: 1874333 - RNA, 22 nt, Salmonella typhimurium LT2
cagaaaaaauaguaaaguuuau

SEQ ID NO: 1874334 - RNA, 22 nt, Salmonella typhimurium LT2
cacuuuuucucuuaucgccgcc

SEQ ID NO: 1874335 - RNA, 18 nt, Salmonella typhimurium LT2
cagaaaaaucagcauuac

SEQ ID NO: 1874336 - RNA, 15 nt, Salmonella typhimurium LT2
cagaaaaccggcaaa

SEQ ID NO: 1874337 - RNA, 16 nt, Salmonella typhimurium LT2
cagaaaagaaccgacu

SEQ ID NO: 1874338 - RNA, 13 nt, Salmonella typhimurium LT2
cacuugauucugc

SEQ ID NO: 1874339 - RNA, 16 nt, Salmonella typhimurium LT2
cacuugauucugcagc

SEQ ID NO: 1874340 - RNA, 13 nt, Salmonella typhimurium LT2
cacuuuccagccc

SEQ ID NO: 1874341 - RNA, 20 nt, Salmonella typhimurium LT2
cacuuuacugaauaacagca

SEQ ID NO: 1874342 - RNA, 13 nt, Salmonella typhimurium LT2
cacuuucagauac

SEQ ID NO: 1874343 - RNA, 14 nt, Salmonella typhimurium LT2
cacuuucagauacc

SEQ ID NO: 1874344 - RNA, 17 nt, Salmonella typhimurium LT2
cacuuuccgaaucaggc

SEQ ID NO: 1874345 - RNA, 19 nt, Salmonella typhimurium LT2
cacuuuaauacccgacagc

SEQ ID NO: 1874346 - RNA, 19 nt, Salmonella typhimurium LT2
cacuuuacugaauaacagc

SEQ ID NO: 1874347 - RNA, 22 nt, Salmonella typhimurium LT2
cacuuuaccaggcauaauggaa

SEQ ID NO: 1874348 - RNA, 22 nt, Salmonella typhimurium LT2
cacuuuacugaauaacagcacc

SEQ ID NO: 1874349 - RNA, 21 nt, Salmonella typhimurium LT2
caggcaggcccgcgcuuuaau

SEQ ID NO: 1874350 - RNA, 17 nt, Salmonella typhimurium LT2
caggccgccaccgccuc

SEQ ID NO: 1874351 - RNA, 14 nt, Salmonella typhimurium LT2
caggccgccaccgc

SEQ ID NO: 1874352 - RNA, 13 nt, Salmonella typhimurium LT2
caggccgccaccg

SEQ ID NO: 1874353 - RNA, 13 nt, Salmonella typhimurium LT2
caggccgccgccu

SEQ ID NO: 1874354 - RNA, 22 nt, Salmonella typhimurium LT2
caggccggauggcggcuuugaa

SEQ ID NO: 1874355 - RNA, 15 nt, Salmonella typhimurium LT2
caggccggcagccug

SEQ ID NO: 1874356 - RNA, 19 nt, Salmonella typhimurium LT2
caggcggcuuuuucaucau

SEQ ID NO: 1874357 - RNA, 15 nt, Salmonella typhimurium LT2
caggcggucagggug

SEQ ID NO: 1874358 - RNA, 22 nt, Salmonella typhimurium LT2
caggcggguauggcgccaauau

SEQ ID NO: 1874359 - RNA, 16 nt, Salmonella typhimurium LT2
caggcuaugcuccccc

SEQ ID NO: 1874360 - RNA, 16 nt, Salmonella typhimurium LT2
caggcguuacgcgcca

SEQ ID NO: 1874361 - RNA, 14 nt, Salmonella typhimurium LT2
caggcguucauaaa

SEQ ID NO: 1874362 - RNA, 20 nt, Salmonella typhimurium LT2
caggcguguggcauaaauaa

SEQ ID NO: 1874363 - RNA, 21 nt, Salmonella typhimurium LT2
caggcguguggcauaaauaaa

SEQ ID NO: 1874364 - RNA, 22 nt, Salmonella typhimurium LT2
caggcguguggcauaaauaaac

SEQ ID NO: 1874365 - RNA, 19 nt, Salmonella typhimurium LT2
caggcguuguccaguaagg

SEQ ID NO: 1874366 - RNA, 22 nt, Salmonella typhimurium LT2
caggcguugaccgcuucgccuu

SEQ ID NO: 1874367 - RNA, 19 nt, Salmonella typhimurium LT2
caggcgcgaccucaucaaa

SEQ ID NO: 1874368 - RNA, 15 nt, Salmonella typhimurium LT2
caggcgcggcgcgcu

SEQ ID NO: 1874369 - RNA, 14 nt, Salmonella typhimurium LT2
caggcgccagaguc

SEQ ID NO: 1874370 - RNA, 18 nt, Salmonella typhimurium LT2
caggccgucggcgccagc

SEQ ID NO: 1874371 - RNA, 13 nt, Salmonella typhimurium LT2
caggcgcaggcau

SEQ ID NO: 1874372 - RNA, 17 nt, Salmonella typhimurium LT2
caggguccccauauccc

SEQ ID NO: 1874373 - RNA, 16 nt, Salmonella typhimurium LT2
cagggucgauucccag

SEQ ID NO: 1874374 - RNA, 23 nt, Salmonella typhimurium LT2
cagggucuuauuucuccugcgcc

SEQ ID NO: 1874375 - RNA, 20 nt, Salmonella typhimurium LT2
cagggugacucauuucaaca

SEQ ID NO: 1874376 - RNA, 23 nt, Salmonella typhimurium LT2
caggggggaaaugagaaaaggaa

SEQ ID NO: 1874377 - RNA, 21 nt, Salmonella typhimurium LT2
cagggcgggauccccugcucc

SEQ ID NO: 1874378 - RNA, 20 nt, Salmonella typhimurium LT2
cagggcgucccgucccacca

SEQ ID NO: 1874379 - RNA, 14 nt, Salmonella typhimurium LT2
cagggcguaagcgc

SEQ ID NO: 1874380 - RNA, 14 nt, Salmonella typhimurium LT2
cagggcggcgcgcu

SEQ ID NO: 1874381 - RNA, 17 nt, Salmonella typhimurium LT2
cagggcggccuccuggc

SEQ ID NO: 1874382 - RNA, 21 nt, Salmonella typhimurium LT2
cagggcugcuggugcgccugu

SEQ ID NO: 1874383 - RNA, 19 nt, Salmonella typhimurium LT2
cagggcugcuggccuucca

SEQ ID NO: 1874384 - RNA, 19 nt, Salmonella typhimurium LT2
cagggcugaaucggcaccu

SEQ ID NO: 1874385 - RNA, 16 nt, Salmonella typhimurium LT2
cagggccaaucagaau

SEQ ID NO: 1874386 - RNA, 19 nt, Salmonella typhimurium LT2
cagggaacacccgcccggu

SEQ ID NO: 1874387 - RNA, 16 nt, Salmonella typhimurium LT2
cagggacuccugcgcc

SEQ ID NO: 1874388 - RNA, 19 nt, Salmonella typhimurium LT2
cagggacuccugcgccgga

SEQ ID NO: 1874389 - RNA, 19 nt, Salmonella typhimurium LT2
cagggacgcauccugcacu

SEQ ID NO: 1874390 - RNA, 20 nt, Salmonella typhimurium LT2
cagggacgauaggcgcguca

SEQ ID NO: 1874391 - RNA, 15 nt, Salmonella typhimurium LT2
cagggaauaugcuga

SEQ ID NO: 1874392 - RNA, 19 nt, Salmonella typhimurium LT2
cagggaacguugcgccaug

SEQ ID NO: 1874393 - RNA, 13 nt, Salmonella typhimurium LT2
cagggcggaagca

SEQ ID NO: 1874394 - RNA, 16 nt, Salmonella typhimurium LT2
cagggcgaugccccca

SEQ ID NO: 1874395 - RNA, 17 nt, Salmonella typhimurium LT2
cagggcgaugcccccag

SEQ ID NO: 1874396 - RNA, 19 nt, Salmonella typhimurium LT2
cagggcgaugcccccagac

SEQ ID NO: 1874397 - RNA, 18 nt, Salmonella typhimurium LT2
cagggccgcgagaacuuc

SEQ ID NO: 1874398 - RNA, 22 nt, Salmonella typhimurium LT2
cagcuccaugucuugcuaucaa

SEQ ID NO: 1874399 - RNA, 13 nt, Salmonella typhimurium LT2
cagcuccaugucu

SEQ ID NO: 1874400 - RNA, 16 nt, Salmonella typhimurium LT2
cagcuccagcucaggg

SEQ ID NO: 1874401 - RNA, 23 nt, Salmonella typhimurium LT2
cagcuccagcucaggguccccau

SEQ ID NO: 1874402 - RNA, 19 nt, Salmonella typhimurium LT2
cagcucaaccgcgcggcgu

SEQ ID NO: 1874403 - RNA, 16 nt, Salmonella typhimurium LT2
cagcucaagcgccgcg

SEQ ID NO: 1874404 - RNA, 18 nt, Salmonella typhimurium LT2
cagcucaauaucauagug

SEQ ID NO: 1874405 - RNA, 21 nt, Salmonella typhimurium LT2
cagcucaauaucauagugccg

SEQ ID NO: 1874406 - RNA, 18 nt, Salmonella typhimurium LT2
cagcucaaaucgcggcgc

SEQ ID NO: 1874407 - RNA, 21 nt, Salmonella typhimurium LT2
cagcucauuuuuacagacacg

SEQ ID NO: 1874408 - RNA, 14 nt, Salmonella typhimurium LT2
cagcuccccgccgc

SEQ ID NO: 1874409 - RNA, 15 nt, Salmonella typhimurium LT2
cagcuccccgccgcg

SEQ ID NO: 1874410 - RNA, 16 nt, Salmonella typhimurium LT2
cagcuccccgccgcgg

SEQ ID NO: 1874411 - RNA, 22 nt, Salmonella typhimurium LT2
cagcucgcacugauagccgcca

SEQ ID NO: 1874412 - RNA, 19 nt, Salmonella typhimurium LT2
cagcggcgguuauccgcca

SEQ ID NO: 1874413 - RNA, 14 nt, Salmonella typhimurium LT2
cagcggcucgcguu

SEQ ID NO: 1874414 - RNA, 16 nt, Salmonella typhimurium LT2
cagcuauccagcuucu

SEQ ID NO: 1874415 - RNA, 19 nt, Salmonella typhimurium LT2
cagcggcgccaucaccauc

SEQ ID NO: 1874416 - RNA, 13 nt, Salmonella typhimurium LT2
cagcggcgcgcca

SEQ ID NO: 1874417 - RNA, 17 nt, Salmonella typhimurium LT2
cagcuuaucugaccaug

SEQ ID NO: 1874418 - RNA, 16 nt, Salmonella typhimurium LT2
cagcuuaucuuuuucg

SEQ ID NO: 1874419 - RNA, 18 nt, Salmonella typhimurium LT2
cagcuuaauuguugcgug

SEQ ID NO: 1874420 - RNA, 21 nt, Salmonella typhimurium LT2
cagcuguuuaagcgccuccac

SEQ ID NO: 1874421 - RNA, 20 nt, Salmonella typhimurium LT2
cagcuguuuaagcgccucca

SEQ ID NO: 1874422 - RNA, 19 nt, Salmonella typhimurium LT2
cagcuguuuaagcgccucc

SEQ ID NO: 1874423 - RNA, 20 nt, Salmonella typhimurium LT2
cagcuucacgaagucuggcu

SEQ ID NO: 1874424 - RNA, 11 nt, Salmonella typhimurium LT2
cagcugcugcg

SEQ ID NO: 1874425 - RNA, 13 nt, Salmonella typhimurium LT2
caggacaaaaggc

SEQ ID NO: 1874426 - RNA, 17 nt, Salmonella typhimurium LT2
caggacaucaaaggcag

SEQ ID NO: 1874427 - RNA, 21 nt, Salmonella typhimurium LT2
caggaauaacaucguaaauca

SEQ ID NO: 1874428 - RNA, 18 nt, Salmonella typhimurium LT2
caggaccaaaacaauacu

SEQ ID NO: 1874429 - RNA, 19 nt, Salmonella typhimurium LT2
caggaaccguccggguucu

SEQ ID NO: 1874430 - RNA, 13 nt, Salmonella typhimurium LT2
caggaagcggcug

SEQ ID NO: 1874431 - RNA, 15 nt, Salmonella typhimurium LT2
caggaagaguaucuc

SEQ ID NO: 1874432 - RNA, 15 nt, Salmonella typhimurium LT2
caggacuuaaaaaca

SEQ ID NO: 1874433 - RNA, 17 nt, Salmonella typhimurium LT2
caggacuuaaaaacaaa

SEQ ID NO: 1874434 - RNA, 13 nt, Salmonella typhimurium LT2
caggacugacugc

SEQ ID NO: 1874435 - RNA, 21 nt, Salmonella typhimurium LT2
caggacguugccgcccaccug

SEQ ID NO: 1874436 - RNA, 18 nt, Salmonella typhimurium LT2
caggagcaaaccgaccca

SEQ ID NO: 1874437 - RNA, 22 nt, Salmonella typhimurium LT2
caggagaucuuuccauuucagc

SEQ ID NO: 1874438 - RNA, 12 nt, Salmonella typhimurium LT2
caggauaaagac

SEQ ID NO: 1874439 - RNA, 17 nt, Salmonella typhimurium LT2
caggagucuguuuuucg

SEQ ID NO: 1874440 - RNA, 14 nt, Salmonella typhimurium LT2
caggaggccugaau

SEQ ID NO: 1874441 - RNA, 18 nt, Salmonella typhimurium LT2
caggaggcaaaaugccag

SEQ ID NO: 1874442 - RNA, 18 nt, Salmonella typhimurium LT2
caggagcggaagaggcgu

SEQ ID NO: 1874443 - RNA, 13 nt, Salmonella typhimurium LT2
caggaucuucauc

SEQ ID NO: 1874444 - RNA, 20 nt, Salmonella typhimurium LT2
caggauguccgguugcauug

SEQ ID NO: 1874445 - RNA, 22 nt, Salmonella typhimurium LT2
caggauguaagacagcgcgccc

SEQ ID NO: 1874446 - RNA, 20 nt, Salmonella typhimurium LT2
caggaugugaggcagauacg

SEQ ID NO: 1874447 - RNA, 20 nt, Salmonella typhimurium LT2
caggaucgggaucagcgcgc

SEQ ID NO: 1874448 - RNA, 15 nt, Salmonella typhimurium LT2
caggaucggaagcga

SEQ ID NO: 1874449 - RNA, 22 nt, Salmonella typhimurium LT2
caggaucgguaaacgccccuuc

SEQ ID NO: 1874450 - RNA, 13 nt, Salmonella typhimurium LT2
caggcagaaauaa

SEQ ID NO: 1874451 - RNA, 15 nt, Salmonella typhimurium LT2
caggcagaaauaacu

SEQ ID NO: 1874452 - RNA, 17 nt, Salmonella typhimurium LT2
caggauucgaaccugcg

SEQ ID NO: 1874453 - RNA, 18 nt, Salmonella typhimurium LT2
caggauuauuacagacag

SEQ ID NO: 1874454 - RNA, 19 nt, Salmonella typhimurium LT2
cagucugcagaccuguucu

SEQ ID NO: 1874455 - RNA, 14 nt, Salmonella typhimurium LT2
cagucgcuccacca

SEQ ID NO: 1874456 - RNA, 12 nt, Salmonella typhimurium LT2
cagucgcugagu

SEQ ID NO: 1874457 - RNA, 23 nt, Salmonella typhimurium LT2
cagucgaacauccuugcacgcca

SEQ ID NO: 1874458 - RNA, 15 nt, Salmonella typhimurium LT2
caguccuuucgaugc

SEQ ID NO: 1874459 - RNA, 14 nt, Salmonella typhimurium LT2
caguccucgcccac

SEQ ID NO: 1874460 - RNA, 14 nt, Salmonella typhimurium LT2
caguccugccccug

SEQ ID NO: 1874461 - RNA, 18 nt, Salmonella typhimurium LT2
caguccugccccugccag

SEQ ID NO: 1874462 - RNA, 21 nt, Salmonella typhimurium LT2
caguccugccccugccagcgu

SEQ ID NO: 1874463 - RNA, 16 nt, Salmonella typhimurium LT2
cagucgauguggccuu

SEQ ID NO: 1874464 - RNA, 20 nt, Salmonella typhimurium LT2
cagucgauguggccuuccuc

SEQ ID NO: 1874465 - RNA, 18 nt, Salmonella typhimurium LT2
cagucagcaauuaacaaa

SEQ ID NO: 1874466 - RNA, 14 nt, Salmonella typhimurium LT2
cagucagccuugac

SEQ ID NO: 1874467 - RNA, 17 nt, Salmonella typhimurium LT2
cagucaucgcgccaaac

SEQ ID NO: 1874468 - RNA, 21 nt, Salmonella typhimurium LT2
caguggacuaugcuccaguug

SEQ ID NO: 1874469 - RNA, 21 nt, Salmonella typhimurium LT2
caguggagacacuucagccgg

SEQ ID NO: 1874470 - RNA, 16 nt, Salmonella typhimurium LT2
caguguaaacgccaga

SEQ ID NO: 1874471 - RNA, 23 nt, Salmonella typhimurium LT2
cagugcaguauugcaccaggaag

SEQ ID NO: 1874472 - RNA, 16 nt, Salmonella typhimurium LT2
cagugcacugccugau

SEQ ID NO: 1874473 - RNA, 13 nt, Salmonella typhimurium LT2
cagugcauagcag

SEQ ID NO: 1874474 - RNA, 14 nt, Salmonella typhimurium LT2
caguggaaaacagc

SEQ ID NO: 1874475 - RNA, 16 nt, Salmonella typhimurium LT2
caguggaacaaacgca

SEQ ID NO: 1874476 - RNA, 22 nt, Salmonella typhimurium LT2
caguggaacaacucucccaacu

SEQ ID NO: 1874477 - RNA, 17 nt, Salmonella typhimurium LT2
cagugaacacccugccc

SEQ ID NO: 1874478 - RNA, 17 nt, Salmonella typhimurium LT2
cagugaacguucacuaa

SEQ ID NO: 1874479 - RNA, 22 nt, Salmonella typhimurium LT2
cagugaauguccccugacagag

SEQ ID NO: 1874480 - RNA, 18 nt, Salmonella typhimurium LT2
cagugaauuaugaccaau

SEQ ID NO: 1874481 - RNA, 18 nt, Salmonella typhimurium LT2
cagugaaaccggcgcgcc

SEQ ID NO: 1874482 - RNA, 17 nt, Salmonella typhimurium LT2
cagugaaaaaccgaucu

SEQ ID NO: 1874483 - RNA, 19 nt, Salmonella typhimurium LT2
cagugaaaccggcgcgccu

SEQ ID NO: 1874484 - RNA, 19 nt, Salmonella typhimurium LT2
cagugagcgauugcuggcc

SEQ ID NO: 1874485 - RNA, 13 nt, Salmonella typhimurium LT2
cagugauaaagcc

SEQ ID NO: 1874486 - RNA, 15 nt, Salmonella typhimurium LT2
cagugaccagcauca

SEQ ID NO: 1874487 - RNA, 15 nt, Salmonella typhimurium LT2
cagugacauuuaucu

SEQ ID NO: 1874488 - RNA, 13 nt, Salmonella typhimurium LT2
cagugacaaugua

SEQ ID NO: 1874489 - RNA, 20 nt, Salmonella typhimurium LT2
cagugacacguaccugccug

SEQ ID NO: 1874490 - RNA, 17 nt, Salmonella typhimurium LT2
cagugacagaggaauga

SEQ ID NO: 1874491 - RNA, 12 nt, Salmonella typhimurium LT2
cagucaccagca

SEQ ID NO: 1874492 - RNA, 19 nt, Salmonella typhimurium LT2
caguauaauuucaggcugc

SEQ ID NO: 1874493 - RNA, 18 nt, Salmonella typhimurium LT2
caguagauggcgcuaaaa

SEQ ID NO: 1874494 - RNA, 17 nt, Salmonella typhimurium LT2
caguacuuucaccugca

SEQ ID NO: 1874495 - RNA, 17 nt, Salmonella typhimurium LT2
caguaguuccuggagaa

SEQ ID NO: 1874496 - RNA, 22 nt, Salmonella typhimurium LT2
caguaguuaccguaaucaucgc

SEQ ID NO: 1874497 - RNA, 20 nt, Salmonella typhimurium LT2
caguaagauuugcgccgccg

SEQ ID NO: 1874498 - RNA, 22 nt, Salmonella typhimurium LT2
caguaauauaaccaauuuaaaa

SEQ ID NO: 1874499 - RNA, 20 nt, Salmonella typhimurium LT2
caguaauauccccaucccag

SEQ ID NO: 1874500 - RNA, 17 nt, Salmonella typhimurium LT2
caguaagacaaaaaugg

SEQ ID NO: 1874501 - RNA, 13 nt, Salmonella typhimurium LT2
caguaacugcaaa

SEQ ID NO: 1874502 - RNA, 15 nt, Salmonella typhimurium LT2
caguaacuucagcau

SEQ ID NO: 1874503 - RNA, 22 nt, Salmonella typhimurium LT2
caguaacuucagcaucaucucc

SEQ ID NO: 1874504 - RNA, 14 nt, Salmonella typhimurium LT2
caguaacguucuuc

SEQ ID NO: 1874505 - RNA, 17 nt, Salmonella typhimurium LT2
caguaccggcaggacaa

SEQ ID NO: 1874506 - RNA, 22 nt, Salmonella typhimurium LT2
caguaccgccuucagcgcgccc

SEQ ID NO: 1874507 - RNA, 17 nt, Salmonella typhimurium LT2
caguacccgcacgcuuu

SEQ ID NO: 1874508 - RNA, 19 nt, Salmonella typhimurium LT2
caguacagccaaaaauaac

SEQ ID NO: 1874509 - RNA, 14 nt, Salmonella typhimurium LT2
caguaaaacccaau

SEQ ID NO: 1874510 - RNA, 18 nt, Salmonella typhimurium LT2
caguaaaacccaauaacu

SEQ ID NO: 1874511 - RNA, 16 nt, Salmonella typhimurium LT2
cagguguuaguguccu

SEQ ID NO: 1874512 - RNA, 17 nt, Salmonella typhimurium LT2
cagguguuaguguucuu

SEQ ID NO: 1874513 - RNA, 13 nt, Salmonella typhimurium LT2
cagguguuauuuu

SEQ ID NO: 1874514 - RNA, 18 nt, Salmonella typhimurium LT2
caggugucguuaaugcuc

SEQ ID NO: 1874515 - RNA, 21 nt, Salmonella typhimurium LT2
cagguugccgaugacucccag

SEQ ID NO: 1874516 - RNA, 22 nt, Salmonella typhimurium LT2
cagguaaaauuucucauuaaaa

SEQ ID NO: 1874517 - RNA, 18 nt, Salmonella typhimurium LT2
caggguuugccagcacca

SEQ ID NO: 1874518 - RNA, 18 nt, Salmonella typhimurium LT2
caggguuuucaggaagga

SEQ ID NO: 1874519 - RNA, 17 nt, Salmonella typhimurium LT2
caggguuugccagcacc

SEQ ID NO: 1874520 - RNA, 23 nt, Salmonella typhimurium LT2
caggguuauuuccgcuggccggu

SEQ ID NO: 1874521 - RNA, 22 nt, Salmonella typhimurium LT2
caggguuccguucccaaugcuu

SEQ ID NO: 1874522 - RNA, 19 nt, Salmonella typhimurium LT2
caggugcgagagcuguccu

SEQ ID NO: 1874523 - RNA, 16 nt, Salmonella typhimurium LT2
cauaacccuccugccu

SEQ ID NO: 1874524 - RNA, 21 nt, Salmonella typhimurium LT2
cauaacaacuauuuuuccggc

SEQ ID NO: 1874525 - RNA, 15 nt, Salmonella typhimurium LT2
cauaacaccaauacg

SEQ ID NO: 1874526 - RNA, 14 nt, Salmonella typhimurium LT2
cauaacaacuauuu

SEQ ID NO: 1874527 - RNA, 18 nt, Salmonella typhimurium LT2
cauaaauccggugcguuu

SEQ ID NO: 1874528 - RNA, 16 nt, Salmonella typhimurium LT2
cauaaauaguggcaaa

SEQ ID NO: 1874529 - RNA, 15 nt, Salmonella typhimurium LT2
cauaaaugcugauga

SEQ ID NO: 1874530 - RNA, 17 nt, Salmonella typhimurium LT2
cauaaauucgcagcguu

SEQ ID NO: 1874531 - RNA, 23 nt, Salmonella typhimurium LT2
cauaaauuggcucagaauuuaaa

SEQ ID NO: 1874532 - RNA, 12 nt, Salmonella typhimurium LT2
cauaaaaaagag

SEQ ID NO: 1874533 - RNA, 15 nt, Salmonella typhimurium LT2
cauaaaaaagaggaa

SEQ ID NO: 1874534 - RNA, 14 nt, Salmonella typhimurium LT2
cauaaaaaucauuc

SEQ ID NO: 1874535 - RNA, 19 nt, Salmonella typhimurium LT2
cauaaaccccgauaaacca

SEQ ID NO: 1874536 - RNA, 21 nt, Salmonella typhimurium LT2
cauaaacgacaucaauagcaa

SEQ ID NO: 1874537 - RNA, 20 nt, Salmonella typhimurium LT2
cauaaacgguuucagcagcg

SEQ ID NO: 1874538 - RNA, 16 nt, Salmonella typhimurium LT2
cauaaauacguaacac

SEQ ID NO: 1874539 - RNA, 21 nt, Salmonella typhimurium LT2
cauaaagauaaauaaaaaauu

SEQ ID NO: 1874540 - RNA, 20 nt, Salmonella typhimurium LT2
caguguuaaucucacgcuca

SEQ ID NO: 1874541 - RNA, 11 nt, Salmonella typhimurium LT2
cagugugcucg

SEQ ID NO: 1874542 - RNA, 20 nt, Salmonella typhimurium LT2
cagugugcucguuuuuauac

SEQ ID NO: 1874543 - RNA, 21 nt, Salmonella typhimurium LT2
cagugugcucguuuuuauaca

SEQ ID NO: 1874544 - RNA, 14 nt, Salmonella typhimurium LT2
cagugugccgucau

SEQ ID NO: 1874545 - RNA, 17 nt, Salmonella typhimurium LT2
caguguuucccaacaau

SEQ ID NO: 1874546 - RNA, 19 nt, Salmonella typhimurium LT2
caguuaacagaaugcugaa

SEQ ID NO: 1874547 - RNA, 17 nt, Salmonella typhimurium LT2
caguugaccaaacagca

SEQ ID NO: 1874548 - RNA, 19 nt, Salmonella typhimurium LT2
caguugaccaaacagcaau

SEQ ID NO: 1874549 - RNA, 12 nt, Salmonella typhimurium LT2
caguugcagcgc

SEQ ID NO: 1874550 - RNA, 14 nt, Salmonella typhimurium LT2
caguugcgacuggu

SEQ ID NO: 1874551 - RNA, 17 nt, Salmonella typhimurium LT2
caguugcauacggucaa

SEQ ID NO: 1874552 - RNA, 20 nt, Salmonella typhimurium LT2
caguugcgacuguucaucaa

SEQ ID NO: 1874553 - RNA, 20 nt, Salmonella typhimurium LT2
caguugcgucuuagaaaacc

SEQ ID NO: 1874554 - RNA, 21 nt, Salmonella typhimurium LT2
caguuguacuuguugcuggca

SEQ ID NO: 1874555 - RNA, 23 nt, Salmonella typhimurium LT2
caguugguuagagcacaucacuc

SEQ ID NO: 1874556 - RNA, 17 nt, Salmonella typhimurium LT2
caguuggucgcguuuac

SEQ ID NO: 1874557 - RNA, 18 nt, Salmonella typhimurium LT2
caguuggcgaccgcugca

SEQ ID NO: 1874558 - RNA, 22 nt, Salmonella typhimurium LT2
caguuggcuugccagcagauuu

SEQ ID NO: 1874559 - RNA, 22 nt, Salmonella typhimurium LT2
cauaaugauggggucacagguu

SEQ ID NO: 1874560 - RNA, 24 nt, Salmonella typhimurium LT2
cauacacgccgggcacgcugacca

SEQ ID NO: 1874561 - RNA, 15 nt, Salmonella typhimurium LT2
cauaacggcugucca

SEQ ID NO: 1874562 - RNA, 14 nt, Salmonella typhimurium LT2
cauaacgggaagcc

SEQ ID NO: 1874563 - RNA, 19 nt, Salmonella typhimurium LT2
cauaacguuguggaaugcc

SEQ ID NO: 1874564 - RNA, 20 nt, Salmonella typhimurium LT2
cauaacgcgcuggucagcag

SEQ ID NO: 1874565 - RNA, 17 nt, Salmonella typhimurium LT2
cauaacgaccaaacaag

SEQ ID NO: 1874566 - RNA, 23 nt, Salmonella typhimurium LT2
cauaaccggugccgaaaucauca

SEQ ID NO: 1874567 - RNA, 19 nt, Salmonella typhimurium LT2
cauacacugcauaaauauc

SEQ ID NO: 1874568 - RNA, 13 nt, Salmonella typhimurium LT2
cauacagcccgcg

SEQ ID NO: 1874569 - RNA, 14 nt, Salmonella typhimurium LT2
cauacagcacuucc

SEQ ID NO: 1874570 - RNA, 20 nt, Salmonella typhimurium LT2
cauacauuuuuguaauaaaa

SEQ ID NO: 1874571 - RNA, 16 nt, Salmonella typhimurium LT2
cauaccacaacagaau

SEQ ID NO: 1874572 - RNA, 19 nt, Salmonella typhimurium LT2
cauaccagcgaaaugcgaa

SEQ ID NO: 1874573 - RNA, 16 nt, Salmonella typhimurium LT2
cauaccagguuagcgu

SEQ ID NO: 1874574 - RNA, 22 nt, Salmonella typhimurium LT2
cauaccagguuagcgugaaucu

SEQ ID NO: 1874575 - RNA, 23 nt, Salmonella typhimurium LT2
cauacccuguucagcacccagag

SEQ ID NO: 1874576 - RNA, 13 nt, Salmonella typhimurium LT2
cauacccuuccag

SEQ ID NO: 1874577 - RNA, 17 nt, Salmonella typhimurium LT2
cauacccaacagcagac

SEQ ID NO: 1874578 - RNA, 14 nt, Salmonella typhimurium LT2
cauacgcgcaugaa

SEQ ID NO: 1874579 - RNA, 20 nt, Salmonella typhimurium LT2
cauacgggcaugaagaaaau

SEQ ID NO: 1874580 - RNA, 23 nt, Salmonella typhimurium LT2
cauacgggcaugaagaaaauacu

SEQ ID NO: 1874581 - RNA, 15 nt, Salmonella typhimurium LT2
cauaccgccaaucaa

SEQ ID NO: 1874582 - RNA, 15 nt, Salmonella typhimurium LT2
cauaccguuucaacu

SEQ ID NO: 1874583 - RNA, 21 nt, Salmonella typhimurium LT2
cauaccggugcgccccagcau

SEQ ID NO: 1874584 - RNA, 19 nt, Salmonella typhimurium LT2
cauaccggugcgccccagc

SEQ ID NO: 1874585 - RNA, 15 nt, Salmonella typhimurium LT2
cauaccgucagauuc

SEQ ID NO: 1874586 - RNA, 21 nt, Salmonella typhimurium LT2
cauacucacauucauaaaaga

SEQ ID NO: 1874587 - RNA, 17 nt, Salmonella typhimurium LT2
cauacucacgaauaaga

SEQ ID NO: 1874588 - RNA, 12 nt, Salmonella typhimurium LT2
cauacuauuucc

SEQ ID NO: 1874589 - RNA, 13 nt, Salmonella typhimurium LT2
cauacuguugguc

SEQ ID NO: 1874590 - RNA, 20 nt, Salmonella typhimurium LT2
cauacugcuuuuucggcuca

SEQ ID NO: 1874591 - RNA, 14 nt, Salmonella typhimurium LT2
cauacugcccagcc

SEQ ID NO: 1874592 - RNA, 15 nt, Salmonella typhimurium LT2
cauacucuccuccau

SEQ ID NO: 1874593 - RNA, 19 nt, Salmonella typhimurium LT2
caugcguugaaaaccugca

SEQ ID NO: 1874594 - RNA, 22 nt, Salmonella typhimurium LT2
caugcgggggaaucuuauuuuc

SEQ ID NO: 1874595 - RNA, 23 nt, Salmonella typhimurium LT2
caugcgggggaaucuuauuuucc

SEQ ID NO: 1874596 - RNA, 15 nt, Salmonella typhimurium LT2
caugcgggagcuugg

SEQ ID NO: 1874597 - RNA, 14 nt, Salmonella typhimurium LT2
caugcggaugcugc

SEQ ID NO: 1874598 - RNA, 18 nt, Salmonella typhimurium LT2
caugcggaugcugcgcca

SEQ ID NO: 1874599 - RNA, 12 nt, Salmonella typhimurium LT2
cauggaagaaaa

SEQ ID NO: 1874600 - RNA, 13 nt, Salmonella typhimurium LT2
cauggaagaaaau

SEQ ID NO: 1874601 - RNA, 17 nt, Salmonella typhimurium LT2
cauggaagaaaauauaa

SEQ ID NO: 1874602 - RNA, 22 nt, Salmonella typhimurium LT2
cauggagagcgauaaacucagc

SEQ ID NO: 1874603 - RNA, 18 nt, Salmonella typhimurium LT2
caugguaggccugauaag

SEQ ID NO: 1874604 - RNA, 20 nt, Salmonella typhimurium LT2
caugggcgcggcgaacuggu

SEQ ID NO: 1874605 - RNA, 19 nt, Salmonella typhimurium LT2
caugggcgucuuaaugcuc

SEQ ID NO: 1874606 - RNA, 18 nt, Salmonella typhimurium LT2
cauggcaggcagcacaau

SEQ ID NO: 1874607 - RNA, 18 nt, Salmonella typhimurium LT2
cauggcauacagcucguc

SEQ ID NO: 1874608 - RNA, 15 nt, Salmonella typhimurium LT2
cauggcagccccggc

SEQ ID NO: 1874609 - RNA, 18 nt, Salmonella typhimurium LT2
caugcgaucgggcaaucc

SEQ ID NO: 1874610 - RNA, 21 nt, Salmonella typhimurium LT2
caugccgaagacuccccugca

SEQ ID NO: 1874611 - RNA, 20 nt, Salmonella typhimurium LT2
caugcccaguuuacccagcg

SEQ ID NO: 1874612 - RNA, 14 nt, Salmonella typhimurium LT2
caugcccggcggcg

SEQ ID NO: 1874613 - RNA, 14 nt, Salmonella typhimurium LT2
caugcccgccagcg

SEQ ID NO: 1874614 - RNA, 21 nt, Salmonella typhimurium LT2
caugaaaaauguucagcgacc

SEQ ID NO: 1874615 - RNA, 13 nt, Salmonella typhimurium LT2
caugaaaacgaau

SEQ ID NO: 1874616 - RNA, 17 nt, Salmonella typhimurium LT2
caucuuuuugcucaagc

SEQ ID NO: 1874617 - RNA, 13 nt, Salmonella typhimurium LT2
caugaaaaaaacg

SEQ ID NO: 1874618 - RNA, 18 nt, Salmonella typhimurium LT2
caugaaaaauagacacaa

SEQ ID NO: 1874619 - RNA, 20 nt, Salmonella typhimurium LT2
caucuuuuaaaaucagauug

SEQ ID NO: 1874620 - RNA, 18 nt, Salmonella typhimurium LT2
caugcccaguucaaucaa

SEQ ID NO: 1874621 - RNA, 17 nt, Salmonella typhimurium LT2
cauguugcguaaauaaa

SEQ ID NO: 1874622 - RNA, 15 nt, Salmonella typhimurium LT2
cauguugcgguccuu

SEQ ID NO: 1874623 - RNA, 17 nt, Salmonella typhimurium LT2
cauguugccaugaucca

SEQ ID NO: 1874624 - RNA, 17 nt, Salmonella typhimurium LT2
cauguuuccccuucugg

SEQ ID NO: 1874625 - RNA, 15 nt, Salmonella typhimurium LT2
cauguuuccccuucu

SEQ ID NO: 1874626 - RNA, 12 nt, Salmonella typhimurium LT2
cauuaaaaaaac

SEQ ID NO: 1874627 - RNA, 21 nt, Salmonella typhimurium LT2
cauguuuuauacucaaaaaau

SEQ ID NO: 1874628 - RNA, 20 nt, Salmonella typhimurium LT2
cauuaaaaaaggcagccgaa

SEQ ID NO: 1874629 - RNA, 22 nt, Salmonella typhimurium LT2
caugucuucauguacccguuuc

SEQ ID NO: 1874630 - RNA, 16 nt, Salmonella typhimurium LT2
caugucguuagaacca

SEQ ID NO: 1874631 - RNA, 12 nt, Salmonella typhimurium LT2
caugucuucacu

SEQ ID NO: 1874632 - RNA, 23 nt, Salmonella typhimurium LT2
cauggucgccguccauuucaaug

SEQ ID NO: 1874633 - RNA, 20 nt, Salmonella typhimurium LT2
cauggucggacggacccuga

SEQ ID NO: 1874634 - RNA, 22 nt, Salmonella typhimurium LT2
cauggucugaacuaauugccug

SEQ ID NO: 1874635 - RNA, 24 nt, Salmonella typhimurium LT2
caugguguugguacacagcacaau

SEQ ID NO: 1874636 - RNA, 22 nt, Salmonella typhimurium LT2
caugguuaaaaucacuaagacc

SEQ ID NO: 1874637 - RNA, 13 nt, Salmonella typhimurium LT2
caugguugaaaaa

SEQ ID NO: 1874638 - RNA, 22 nt, Salmonella typhimurium LT2
caugguggagucuaaaaauaau

SEQ ID NO: 1874639 - RNA, 21 nt, Salmonella typhimurium LT2
cauuaccccagcaucucacgu

SEQ ID NO: 1874640 - RNA, 23 nt, Salmonella typhimurium LT2
cauuagacaguuuuuucguucca

SEQ ID NO: 1874641 - RNA, 22 nt, Salmonella typhimurium LT2
cauuagcaugggcuaaagcauc

SEQ ID NO: 1874642 - RNA, 23 nt, Salmonella typhimurium LT2
cauuaauggcgauaauagaaccg

SEQ ID NO: 1874643 - RNA, 18 nt, Salmonella typhimurium LT2
cauuaaugucaugaagcu

SEQ ID NO: 1874644 - RNA, 17 nt, Salmonella typhimurium LT2
cauuaauuucuuaccaa

SEQ ID NO: 1874645 - RNA, 18 nt, Salmonella typhimurium LT2
cauuacaauguacagaau

SEQ ID NO: 1874646 - RNA, 13 nt, Salmonella typhimurium LT2
cauuaacguccau

SEQ ID NO: 1874647 - RNA, 19 nt, Salmonella typhimurium LT2
cauuaaaugcgcccagccc

SEQ ID NO: 1874648 - RNA, 22 nt, Salmonella typhimurium LT2
cauuaacaucagaaaaaagcca

SEQ ID NO: 1874649 - RNA, 17 nt, Salmonella typhimurium LT2
cauuaaucgccauugca

SEQ ID NO: 1874650 - RNA, 19 nt, Salmonella typhimurium LT2
cauuaauaugcgcaaucac

SEQ ID NO: 1874651 - RNA, 14 nt, Salmonella typhimurium LT2
cauuaauauuuuau

SEQ ID NO: 1874652 - RNA, 18 nt, Salmonella typhimurium LT2
cauuuuggggaaaauacc

SEQ ID NO: 1874653 - RNA, 19 nt, Salmonella typhimurium LT2
cauuuugguuggcgacuuc

SEQ ID NO: 1874654 - RNA, 18 nt, Salmonella typhimurium LT2
cauuuuggccgcuuuagu

SEQ ID NO: 1874655 - RNA, 22 nt, Salmonella typhimurium LT2
cauuuugcgguuuuaauuucca

SEQ ID NO: 1874656 - RNA, 17 nt, Salmonella typhimurium LT2
cauuuugcgguuuuaau

SEQ ID NO: 1874657 - RNA, 15 nt, Salmonella typhimurium LT2
cauuuuccgcugucu

SEQ ID NO: 1874658 - RNA, 18 nt, Salmonella typhimurium LT2
cauuuucaccuggaugcu

SEQ ID NO: 1874659 - RNA, 14 nt, Salmonella typhimurium LT2
cauuuucaccugga

SEQ ID NO: 1874660 - RNA, 19 nt, Salmonella typhimurium LT2
cauuuuccggcgacgcuuu

SEQ ID NO: 1874661 - RNA, 16 nt, Salmonella typhimurium LT2
cauuuucuuucaucaa

SEQ ID NO: 1874662 - RNA, 19 nt, Salmonella typhimurium LT2
cauuuuauucauauuuaua

SEQ ID NO: 1874663 - RNA, 16 nt, Salmonella typhimurium LT2
cauuugcuuucaucaa

SEQ ID NO: 1874664 - RNA, 17 nt, Salmonella typhimurium LT2
cauuuggcuuaaauaau

SEQ ID NO: 1874665 - RNA, 16 nt, Salmonella typhimurium LT2
cauuugcgcacggcgc

SEQ ID NO: 1874666 - RNA, 13 nt, Salmonella typhimurium LT2
cauuugccgcgcc

SEQ ID NO: 1874667 - RNA, 16 nt, Salmonella typhimurium LT2
cauuugccugccgcag

SEQ ID NO: 1874668 - RNA, 15 nt, Salmonella typhimurium LT2
cauuuguacaaaaaa

SEQ ID NO: 1874669 - RNA, 13 nt, Salmonella typhimurium LT2
cauuuguuccucg

SEQ ID NO: 1874670 - RNA, 20 nt, Salmonella typhimurium LT2
cauuuguuccucgaaacgcu

SEQ ID NO: 1874671 - RNA, 21 nt, Salmonella typhimurium LT2
cauuucuucaagcguuuccag

SEQ ID NO: 1874672 - RNA, 16 nt, Salmonella typhimurium LT2
cauuucuucuucaagc

SEQ ID NO: 1874673 - RNA, 14 nt, Salmonella typhimurium LT2
cauuucuucuucaa

SEQ ID NO: 1874674 - RNA, 14 nt, Salmonella typhimurium LT2
cauuucuuccagca

SEQ ID NO: 1874675 - RNA, 17 nt, Salmonella typhimurium LT2
cauuucuuguugacgac

SEQ ID NO: 1874676 - RNA, 21 nt, Salmonella typhimurium LT2
cauuugaacucuuccagauac

SEQ ID NO: 1874677 - RNA, 11 nt, Salmonella typhimurium LT2
cauuugcaaug

SEQ ID NO: 1874678 - RNA, 17 nt, Salmonella typhimurium LT2
cauugaguuagugguca

SEQ ID NO: 1874679 - RNA, 18 nt, Salmonella typhimurium LT2
cauugagcauucuacagu

SEQ ID NO: 1874680 - RNA, 16 nt, Salmonella typhimurium LT2
cauugagcagccgacc

SEQ ID NO: 1874681 - RNA, 23 nt, Salmonella typhimurium LT2
cauugagcaucaaacuuuuaaau

SEQ ID NO: 1874682 - RNA, 20 nt, Salmonella typhimurium LT2
cauucugucagcaauugccu

SEQ ID NO: 1874683 - RNA, 22 nt, Salmonella typhimurium LT2
cauucuguuuucgagccuugcc

SEQ ID NO: 1874684 - RNA, 22 nt, Salmonella typhimurium LT2
cauugaccacuucaucgcugcu

SEQ ID NO: 1874685 - RNA, 19 nt, Salmonella typhimurium LT2
cauuaucgaugcguauuuc

SEQ ID NO: 1874686 - RNA, 14 nt, Salmonella typhimurium LT2
cauuaugaugaguu

SEQ ID NO: 1874687 - RNA, 23 nt, Salmonella typhimurium LT2
cauuaugaucgguuuuuuuagaa

SEQ ID NO: 1874688 - RNA, 19 nt, Salmonella typhimurium LT2
cauuaugaucgguuuuuuu

SEQ ID NO: 1874689 - RNA, 15 nt, Salmonella typhimurium LT2
cauucugaagccgau

SEQ ID NO: 1874690 - RNA, 17 nt, Salmonella typhimurium LT2
cauucuaccggcugugg

SEQ ID NO: 1874691 - RNA, 13 nt, Salmonella typhimurium LT2
cauuguuuacuuu

SEQ ID NO: 1874692 - RNA, 23 nt, Salmonella typhimurium LT2
cauuguucuguccggaagacagc

SEQ ID NO: 1874693 - RNA, 23 nt, Salmonella typhimurium LT2
cauuguccuuuaucugcccuuuc

SEQ ID NO: 1874694 - RNA, 14 nt, Salmonella typhimurium LT2
cauugucuuuuucu

SEQ ID NO: 1874695 - RNA, 19 nt, Salmonella typhimurium LT2
cauuggaaaaccccauccc

SEQ ID NO: 1874696 - RNA, 20 nt, Salmonella typhimurium LT2
cauuggaaaaccccaucccg

SEQ ID NO: 1874697 - RNA, 21 nt, Salmonella typhimurium LT2
cauugauauagaguccagcca

SEQ ID NO: 1874698 - RNA, 20 nt, Salmonella typhimurium LT2
cauugccguuaacugcugcu

SEQ ID NO: 1874699 - RNA, 23 nt, Salmonella typhimurium LT2
cauugccgcgccgacauagcuga

SEQ ID NO: 1874700 - RNA, 15 nt, Salmonella typhimurium LT2
cauugcgaguuaucu

SEQ ID NO: 1874701 - RNA, 14 nt, Salmonella typhimurium LT2
cauugcgagaaaaa

SEQ ID NO: 1874702 - RNA, 18 nt, Salmonella typhimurium LT2
cauugcgagaaaaaacuc

SEQ ID NO: 1874703 - RNA, 18 nt, Salmonella typhimurium LT2
cauugccuuucaauacuu

SEQ ID NO: 1874704 - RNA, 19 nt, Salmonella typhimurium LT2
cauugccuuucaauacuuc

SEQ ID NO: 1874705 - RNA, 15 nt, Salmonella typhimurium LT2
cauugcuuucuugaa

SEQ ID NO: 1874706 - RNA, 17 nt, Salmonella typhimurium LT2
cauugcuuucuugaauc

SEQ ID NO: 1874707 - RNA, 19 nt, Salmonella typhimurium LT2
cauaucguacugcuuuaau

SEQ ID NO: 1874708 - RNA, 23 nt, Salmonella typhimurium LT2
cauaucgucaucggucaguuugc

SEQ ID NO: 1874709 - RNA, 16 nt, Salmonella typhimurium LT2
cauaucuggacgggcc

SEQ ID NO: 1874710 - RNA, 23 nt, Salmonella typhimurium LT2
cauaucuggcgaggcuuuguccu

SEQ ID NO: 1874711 - RNA, 21 nt, Salmonella typhimurium LT2
cauaucuguuuggcaagggua

SEQ ID NO: 1874712 - RNA, 13 nt, Salmonella typhimurium LT2
cauaugcgcggcg

SEQ ID NO: 1874713 - RNA, 18 nt, Salmonella typhimurium LT2
cauauuaucgcgcugaau

SEQ ID NO: 1874714 - RNA, 14 nt, Salmonella typhimurium LT2
cauagaaaaagaac

SEQ ID NO: 1874715 - RNA, 20 nt, Salmonella typhimurium LT2
cauauaaaucaguuguacuu

SEQ ID NO: 1874716 - RNA, 13 nt, Salmonella typhimurium LT2
cauauaauccugc

SEQ ID NO: 1874717 - RNA, 14 nt, Salmonella typhimurium LT2
cauauaauacuuau

SEQ ID NO: 1874718 - RNA, 16 nt, Salmonella typhimurium LT2
cauauaacuuucaaua

SEQ ID NO: 1874719 - RNA, 14 nt, Salmonella typhimurium LT2
cauauacauaugga

SEQ ID NO: 1874720 - RNA, 15 nt, Salmonella typhimurium LT2
cauauaugaaaucgc

SEQ ID NO: 1874721 - RNA, 21 nt, Salmonella typhimurium LT2
cauauaugccggguggcggcu

SEQ ID NO: 1874722 - RNA, 22 nt, Salmonella typhimurium LT2
cauauauuccgggucguccuga

SEQ ID NO: 1874723 - RNA, 14 nt, Salmonella typhimurium LT2
caucaaacagcggc

SEQ ID NO: 1874724 - RNA, 21 nt, Salmonella typhimurium LT2
cauauuuucaacggcaucaau

SEQ ID NO: 1874725 - RNA, 18 nt, Salmonella typhimurium LT2
cauauuuuucacacauaa

SEQ ID NO: 1874726 - RNA, 18 nt, Salmonella typhimurium LT2
caucaccaucgccggaga

SEQ ID NO: 1874727 - RNA, 17 nt, Salmonella typhimurium LT2
caucaauaaagccgcau

SEQ ID NO: 1874728 - RNA, 15 nt, Salmonella typhimurium LT2
caucaauaccagccc

SEQ ID NO: 1874729 - RNA, 20 nt, Salmonella typhimurium LT2
caucaacuccggacguaccc

SEQ ID NO: 1874730 - RNA, 17 nt, Salmonella typhimurium LT2
caucauccugcagggua

SEQ ID NO: 1874731 - RNA, 22 nt, Salmonella typhimurium LT2
caucauccccaccacugauggc

SEQ ID NO: 1874732 - RNA, 22 nt, Salmonella typhimurium LT2
caucaucgaacgccgccugcgc

SEQ ID NO: 1874733 - RNA, 17 nt, Salmonella typhimurium LT2
caucaucggcacagcca

SEQ ID NO: 1874734 - RNA, 22 nt, Salmonella typhimurium LT2
caucaucgcuggugugcagcca

SEQ ID NO: 1874735 - RNA, 12 nt, Salmonella typhimurium LT2
caucaucgccag

SEQ ID NO: 1874736 - RNA, 19 nt, Salmonella typhimurium LT2
caucauaucccggcugaca

SEQ ID NO: 1874737 - RNA, 22 nt, Salmonella typhimurium LT2
caucauaucaauauguuccggc

SEQ ID NO: 1874738 - RNA, 16 nt, Salmonella typhimurium LT2
caucauaauccuuauu

SEQ ID NO: 1874739 - RNA, 13 nt, Salmonella typhimurium LT2
cauccacccuggc

SEQ ID NO: 1874740 - RNA, 17 nt, Salmonella typhimurium LT2
cauccaccaggcaugca

SEQ ID NO: 1874741 - RNA, 15 nt, Salmonella typhimurium LT2
cauccacgccacaau

SEQ ID NO: 1874742 - RNA, 15 nt, Salmonella typhimurium LT2
cauccacguaaauag

SEQ ID NO: 1874743 - RNA, 17 nt, Salmonella typhimurium LT2
caucauugauacuguac

SEQ ID NO: 1874744 - RNA, 17 nt, Salmonella typhimurium LT2
caucauuuucccacuga

SEQ ID NO: 1874745 - RNA, 13 nt, Salmonella typhimurium LT2
caucaucuugucc

SEQ ID NO: 1874746 - RNA, 19 nt, Salmonella typhimurium LT2
caucaucugccauuucugc

SEQ ID NO: 1874747 - RNA, 20 nt, Salmonella typhimurium LT2
caucaucuuguccucaucau

SEQ ID NO: 1874748 - RNA, 19 nt, Salmonella typhimurium LT2
caucaugacacuuuauucu

SEQ ID NO: 1874749 - RNA, 13 nt, Salmonella typhimurium LT2
caucaugaugauc

SEQ ID NO: 1874750 - RNA, 14 nt, Salmonella typhimurium LT2
caucauucccauug

SEQ ID NO: 1874751 - RNA, 15 nt, Salmonella typhimurium LT2
caucauucugcaggc

SEQ ID NO: 1874752 - RNA, 20 nt, Salmonella typhimurium LT2
caucaugcgcagaaacugau

SEQ ID NO: 1874753 - RNA, 20 nt, Salmonella typhimurium LT2
caucagguaguacaggguuu

SEQ ID NO: 1874754 - RNA, 15 nt, Salmonella typhimurium LT2
caucaggcauagcaa

SEQ ID NO: 1874755 - RNA, 19 nt, Salmonella typhimurium LT2
caucaggcauggcagcagg

SEQ ID NO: 1874756 - RNA, 14 nt, Salmonella typhimurium LT2
caucaggcacaaug

SEQ ID NO: 1874757 - RNA, 13 nt, Salmonella typhimurium LT2
caucagucucaaa

SEQ ID NO: 1874758 - RNA, 15 nt, Salmonella typhimurium LT2
caucaguacaaacgc

SEQ ID NO: 1874759 - RNA, 13 nt, Salmonella typhimurium LT2
caucauaaaaggc

SEQ ID NO: 1874760 - RNA, 22 nt, Salmonella typhimurium LT2
caucauaaaaggcaucgcucuu

SEQ ID NO: 1874761 - RNA, 16 nt, Salmonella typhimurium LT2
caucagccagcagcuc

SEQ ID NO: 1874762 - RNA, 12 nt, Salmonella typhimurium LT2
caucagccagca

SEQ ID NO: 1874763 - RNA, 16 nt, Salmonella typhimurium LT2
caucacggcagcaccg

SEQ ID NO: 1874764 - RNA, 19 nt, Salmonella typhimurium LT2
caucacggcagcaccgcug

SEQ ID NO: 1874765 - RNA, 16 nt, Salmonella typhimurium LT2
caucagcgccagcccu

SEQ ID NO: 1874766 - RNA, 17 nt, Salmonella typhimurium LT2
caucacgcaacggugag

SEQ ID NO: 1874767 - RNA, 14 nt, Salmonella typhimurium LT2
caucaccuccagca

SEQ ID NO: 1874768 - RNA, 16 nt, Salmonella typhimurium LT2
caucaccuggcaacau

SEQ ID NO: 1874769 - RNA, 16 nt, Salmonella typhimurium LT2
caucuauagccugcug

SEQ ID NO: 1874770 - RNA, 14 nt, Salmonella typhimurium LT2
caucucccaggccg

SEQ ID NO: 1874771 - RNA, 19 nt, Salmonella typhimurium LT2
caucucccaggccgccacc

SEQ ID NO: 1874772 - RNA, 17 nt, Salmonella typhimurium LT2
caucuauuauuuuucua

SEQ ID NO: 1874773 - RNA, 16 nt, Salmonella typhimurium LT2
caucuaccuucacaca

SEQ ID NO: 1874774 - RNA, 17 nt, Salmonella typhimurium LT2
caucuacuaucaucuga

SEQ ID NO: 1874775 - RNA, 21 nt, Salmonella typhimurium LT2
caucgggcuguuauucagcag

SEQ ID NO: 1874776 - RNA, 20 nt, Salmonella typhimurium LT2
caucgggcauuucaggcacu

SEQ ID NO: 1874777 - RNA, 15 nt, Salmonella typhimurium LT2
caucggucaguguuu

SEQ ID NO: 1874778 - RNA, 17 nt, Salmonella typhimurium LT2
caucggucaguuugccc

SEQ ID NO: 1874779 - RNA, 18 nt, Salmonella typhimurium LT2
caucgguguacggcguca

SEQ ID NO: 1874780 - RNA, 23 nt, Salmonella typhimurium LT2
caucggugacaaucucaaugcca

SEQ ID NO: 1874781 - RNA, 13 nt, Salmonella typhimurium LT2
caucgguuaucgg

SEQ ID NO: 1874782 - RNA, 16 nt, Salmonella typhimurium LT2
caucugccauuucugc

SEQ ID NO: 1874783 - RNA, 16 nt, Salmonella typhimurium LT2
caucugcuucaacagc

SEQ ID NO: 1874784 - RNA, 23 nt, Salmonella typhimurium LT2
caucugcuucaacagcggcggca

SEQ ID NO: 1874785 - RNA, 20 nt, Salmonella typhimurium LT2
caucugcguugcgcgcguca

SEQ ID NO: 1874786 - RNA, 17 nt, Salmonella typhimurium LT2
caucugcggcuuucauc

SEQ ID NO: 1874787 - RNA, 23 nt, Salmonella typhimurium LT2
caucugcggcuuucaucauucgc

SEQ ID NO: 1874788 - RNA, 23 nt, Salmonella typhimurium LT2
caucucgauaccgguaaucaaac

SEQ ID NO: 1874789 - RNA, 16 nt, Salmonella typhimurium LT2
caucucgaguaaucac

SEQ ID NO: 1874790 - RNA, 23 nt, Salmonella typhimurium LT2
caucuccucgcgcguuugcaaua

SEQ ID NO: 1874791 - RNA, 15 nt, Salmonella typhimurium LT2
caucuccuguaauga

SEQ ID NO: 1874792 - RNA, 16 nt, Salmonella typhimurium LT2
caucuccuuaacacaa

SEQ ID NO: 1874793 - RNA, 14 nt, Salmonella typhimurium LT2
caucuccggcgacc

SEQ ID NO: 1874794 - RNA, 22 nt, Salmonella typhimurium LT2
caucuccuccucauucagcggc

SEQ ID NO: 1874795 - RNA, 17 nt, Salmonella typhimurium LT2
caucuucacuucacaaa

SEQ ID NO: 1874796 - RNA, 13 nt, Salmonella typhimurium LT2
caucuucacuuca

SEQ ID NO: 1874797 - RNA, 17 nt, Salmonella typhimurium LT2
caucuucaccuuuccag

SEQ ID NO: 1874798 - RNA, 21 nt, Salmonella typhimurium LT2
caucuucaccgaugcccagcu

SEQ ID NO: 1874799 - RNA, 16 nt, Salmonella typhimurium LT2
caucuuauauuuuggu

SEQ ID NO: 1874800 - RNA, 12 nt, Salmonella typhimurium LT2
caucuuauauuu

SEQ ID NO: 1874801 - RNA, 23 nt, Salmonella typhimurium LT2
caucugugaaaacgccuuacggu

SEQ ID NO: 1874802 - RNA, 23 nt, Salmonella typhimurium LT2
caucugcuccggcguacgggcaa

SEQ ID NO: 1874803 - RNA, 22 nt, Salmonella typhimurium LT2
caucugggcugacaaaaauuua

SEQ ID NO: 1874804 - RNA, 21 nt, Salmonella typhimurium LT2
caucuuuaccaaugugcaaag

SEQ ID NO: 1874805 - RNA, 17 nt, Salmonella typhimurium LT2
caucuuuaaccgccugc

SEQ ID NO: 1874806 - RNA, 14 nt, Salmonella typhimurium LT2
caucuuugcaccgc

SEQ ID NO: 1874807 - RNA, 16 nt, Salmonella typhimurium LT2
caucuuugcaccgcua

SEQ ID NO: 1874808 - RNA, 21 nt, Salmonella typhimurium LT2
caucuuugcaccgcuaaaaaa

SEQ ID NO: 1874809 - RNA, 18 nt, Salmonella typhimurium LT2
caucuugaaugauuuugu

SEQ ID NO: 1874810 - RNA, 18 nt, Salmonella typhimurium LT2
caucgcguugcaaucgcc

SEQ ID NO: 1874811 - RNA, 15 nt, Salmonella typhimurium LT2
caucgcucaucagcu

SEQ ID NO: 1874812 - RNA, 20 nt, Salmonella typhimurium LT2
caucgcggucagcggcgcgc

SEQ ID NO: 1874813 - RNA, 24 nt, Salmonella typhimurium LT2
caucggcgaguuuggugcccgcgu

SEQ ID NO: 1874814 - RNA, 13 nt, Salmonella typhimurium LT2
caucgccugauga

SEQ ID NO: 1874815 - RNA, 20 nt, Salmonella typhimurium LT2
caucgcgaauuucaaucgcc

SEQ ID NO: 1874816 - RNA, 15 nt, Salmonella typhimurium LT2
caucgcgccuccccu

SEQ ID NO: 1874817 - RNA, 14 nt, Salmonella typhimurium LT2
caucgcgcuuaacu

SEQ ID NO: 1874818 - RNA, 12 nt, Salmonella typhimurium LT2
caucgacgccag

SEQ ID NO: 1874819 - RNA, 14 nt, Salmonella typhimurium LT2
caucgacagcgcca

SEQ ID NO: 1874820 - RNA, 16 nt, Salmonella typhimurium LT2
caucgacccccaccau

SEQ ID NO: 1874821 - RNA, 17 nt, Salmonella typhimurium LT2
caucgacccccaccaug

SEQ ID NO: 1874822 - RNA, 15 nt, Salmonella typhimurium LT2
caucgacuuaaaaga

SEQ ID NO: 1874823 - RNA, 13 nt, Salmonella typhimurium LT2
caucgccagccau

SEQ ID NO: 1874824 - RNA, 15 nt, Salmonella typhimurium LT2
caucgcccgccccca

SEQ ID NO: 1874825 - RNA, 12 nt, Salmonella typhimurium LT2
caucgcccaggu

SEQ ID NO: 1874826 - RNA, 23 nt, Salmonella typhimurium LT2
caucgacaagcuaauccccagcg

SEQ ID NO: 1874827 - RNA, 20 nt, Salmonella typhimurium LT2
caucgacaguaccagcagaa

SEQ ID NO: 1874828 - RNA, 21 nt, Salmonella typhimurium LT2
caucgacaguaccagcagaac

SEQ ID NO: 1874829 - RNA, 21 nt, Salmonella typhimurium LT2
caucgacauagcugaauaaaa

SEQ ID NO: 1874830 - RNA, 21 nt, Salmonella typhimurium LT2
caucgacaagcuaauccccag

SEQ ID NO: 1874831 - RNA, 19 nt, Salmonella typhimurium LT2
caucgacaaaggcaagauc

SEQ ID NO: 1874832 - RNA, 23 nt, Salmonella typhimurium LT2
cauccuuuacuauagauauuaaa

SEQ ID NO: 1874833 - RNA, 14 nt, Salmonella typhimurium LT2
cauccucacgcaac

SEQ ID NO: 1874834 - RNA, 13 nt, Salmonella typhimurium LT2
cauccucuuuccg

SEQ ID NO: 1874835 - RNA, 15 nt, Salmonella typhimurium LT2
cauccugcaaaagga

SEQ ID NO: 1874836 - RNA, 23 nt, Salmonella typhimurium LT2
cauccuguuuuuucagcgcgccg

SEQ ID NO: 1874837 - RNA, 15 nt, Salmonella typhimurium LT2
cauccuguucaagca

SEQ ID NO: 1874838 - RNA, 20 nt, Salmonella typhimurium LT2
cauccuguggguucaucgcc

SEQ ID NO: 1874839 - RNA, 17 nt, Salmonella typhimurium LT2
cauccgcccgacaucaa

SEQ ID NO: 1874840 - RNA, 19 nt, Salmonella typhimurium LT2
cauccgccagcgccucuuc

SEQ ID NO: 1874841 - RNA, 14 nt, Salmonella typhimurium LT2
cauccagagcaguc

SEQ ID NO: 1874842 - RNA, 21 nt, Salmonella typhimurium LT2
cauccgcuucggacuccugac

SEQ ID NO: 1874843 - RNA, 19 nt, Salmonella typhimurium LT2
cauccagacaugcacaugg

SEQ ID NO: 1874844 - RNA, 15 nt, Salmonella typhimurium LT2
cauccgccagcgccu

SEQ ID NO: 1874845 - RNA, 16 nt, Salmonella typhimurium LT2
cauccagaccugagcc

SEQ ID NO: 1874846 - RNA, 16 nt, Salmonella typhimurium LT2
cauccagacaugcaca

SEQ ID NO: 1874847 - RNA, 23 nt, Salmonella typhimurium LT2
cauccggcguguaaaccgccaga

SEQ ID NO: 1874848 - RNA, 15 nt, Salmonella typhimurium LT2
cauccgguuuuaaau

SEQ ID NO: 1874849 - RNA, 14 nt, Salmonella typhimurium LT2
ccgccaucgacagc

SEQ ID NO: 1874850 - RNA, 17 nt, Salmonella typhimurium LT2
ccgcccaacagggcggc

SEQ ID NO: 1874851 - RNA, 15 nt, Salmonella typhimurium LT2
ccgcccaaccagccc

SEQ ID NO: 1874852 - RNA, 19 nt, Salmonella typhimurium LT2
ccgccauacccggcuccca

SEQ ID NO: 1874853 - RNA, 15 nt, Salmonella typhimurium LT2
ccgccauaagaaugu

SEQ ID NO: 1874854 - RNA, 19 nt, Salmonella typhimurium LT2
ccgccauaaacgguuucag

SEQ ID NO: 1874855 - RNA, 19 nt, Salmonella typhimurium LT2
ccgccauccggcagugccg

SEQ ID NO: 1874856 - RNA, 19 nt, Salmonella typhimurium LT2
ccgccauccggcauuuuuu

SEQ ID NO: 1874857 - RNA, 17 nt, Salmonella typhimurium LT2
ccgccauccggcacagc

SEQ ID NO: 1874858 - RNA, 20 nt, Salmonella typhimurium LT2
ccgccgaacagacggcggcu

SEQ ID NO: 1874859 - RNA, 19 nt, Salmonella typhimurium LT2
ccgcccgcgcucccgccca

SEQ ID NO: 1874860 - RNA, 13 nt, Salmonella typhimurium LT2
ccgcccggcgucg

SEQ ID NO: 1874861 - RNA, 23 nt, Salmonella typhimurium LT2
ccgcccuucacaaccaucgucug

SEQ ID NO: 1874862 - RNA, 13 nt, Salmonella typhimurium LT2
ccgccaccgccgc

SEQ ID NO: 1874863 - RNA, 16 nt, Salmonella typhimurium LT2
ccgccagacucagcca

SEQ ID NO: 1874864 - RNA, 22 nt, Salmonella typhimurium LT2
ccgccagacucagccaggucug

SEQ ID NO: 1874865 - RNA, 16 nt, Salmonella typhimurium LT2
ccgccagaggcggcgc

SEQ ID NO: 1874866 - RNA, 15 nt, Salmonella typhimurium LT2
ccgccagcaaugccg

SEQ ID NO: 1874867 - RNA, 18 nt, Salmonella typhimurium LT2
ccgccagcaccaggcucg

SEQ ID NO: 1874868 - RNA, 14 nt, Salmonella typhimurium LT2
ccgccagcaccagg

SEQ ID NO: 1874869 - RNA, 13 nt, Salmonella typhimurium LT2
ccgccagcggcgc

SEQ ID NO: 1874870 - RNA, 17 nt, Salmonella typhimurium LT2
ccgccagcucgucggcc

SEQ ID NO: 1874871 - RNA, 20 nt, Salmonella typhimurium LT2
ccgccagcgacauggcgguc

SEQ ID NO: 1874872 - RNA, 21 nt, Salmonella typhimurium LT2
ccgcaccuggguauuccacug

SEQ ID NO: 1874873 - RNA, 17 nt, Salmonella typhimurium LT2
ccgcaccuggguauucc

SEQ ID NO: 1874874 - RNA, 14 nt, Salmonella typhimurium LT2
ccgcacauaaucac

SEQ ID NO: 1874875 - RNA, 17 nt, Salmonella typhimurium LT2
ccgcaaugaccacaaau

SEQ ID NO: 1874876 - RNA, 18 nt, Salmonella typhimurium LT2
ccgcaaucgcugccuuga

SEQ ID NO: 1874877 - RNA, 14 nt, Salmonella typhimurium LT2
ccgcacagcagaca

SEQ ID NO: 1874878 - RNA, 17 nt, Salmonella typhimurium LT2
ccgauggacucccaggu

SEQ ID NO: 1874879 - RNA, 21 nt, Salmonella typhimurium LT2
ccgcaauccuggcuucaaccu

SEQ ID NO: 1874880 - RNA, 17 nt, Salmonella typhimurium LT2
ccgcagccuaguucugc

SEQ ID NO: 1874881 - RNA, 15 nt, Salmonella typhimurium LT2
ccgcagcggaggcgu

SEQ ID NO: 1874882 - RNA, 15 nt, Salmonella typhimurium LT2
ccgcagaagccgguc

SEQ ID NO: 1874883 - RNA, 12 nt, Salmonella typhimurium LT2
ccgcacgcgcgc

SEQ ID NO: 1874884 - RNA, 22 nt, Salmonella typhimurium LT2
ccgcaccuggguauuccacugg

SEQ ID NO: 1874885 - RNA, 14 nt, Salmonella typhimurium LT2
ccgcagaaaaagcc

SEQ ID NO: 1874886 - RNA, 11 nt, Salmonella typhimurium LT2
ccgccaccacg

SEQ ID NO: 1874887 - RNA, 14 nt, Salmonella typhimurium LT2
ccgccaccacaaag

SEQ ID NO: 1874888 - RNA, 13 nt, Salmonella typhimurium LT2
ccgccaccacaaa

SEQ ID NO: 1874889 - RNA, 15 nt, Salmonella typhimurium LT2
ccgccacaggccaac

SEQ ID NO: 1874890 - RNA, 17 nt, Salmonella typhimurium LT2
ccgccaauuccugccag

SEQ ID NO: 1874891 - RNA, 23 nt, Salmonella typhimurium LT2
ccgccaauauccggcacgccagc

SEQ ID NO: 1874892 - RNA, 12 nt, Salmonella typhimurium LT2
ccgccaccagca

SEQ ID NO: 1874893 - RNA, 18 nt, Salmonella typhimurium LT2
ccgccaaagcgguccggc

SEQ ID NO: 1874894 - RNA, 24 nt, Salmonella typhimurium LT2
ccgccaaacugcgcgccgcccugc

SEQ ID NO: 1874895 - RNA, 14 nt, Salmonella typhimurium LT2
ccgccaaacgcggu

SEQ ID NO: 1874896 - RNA, 16 nt, Salmonella typhimurium LT2
ccgcauuuuuucuuca

SEQ ID NO: 1874897 - RNA, 22 nt, Salmonella typhimurium LT2
ccgccaaaauccggcccagcga

SEQ ID NO: 1874898 - RNA, 13 nt, Salmonella typhimurium LT2
ccgccaacgccaa

SEQ ID NO: 1874899 - RNA, 21 nt, Salmonella typhimurium LT2
ccgccaacgguaaguugaaag

SEQ ID NO: 1874900 - RNA, 16 nt, Salmonella typhimurium LT2
ccgccaauaaccaccu

SEQ ID NO: 1874901 - RNA, 14 nt, Salmonella typhimurium LT2
ccgcaucaaugccc

SEQ ID NO: 1874902 - RNA, 11 nt, Salmonella typhimurium LT2
ccgcaucccca

SEQ ID NO: 1874903 - RNA, 15 nt, Salmonella typhimurium LT2
ccgcaucacggcagc

SEQ ID NO: 1874904 - RNA, 19 nt, Salmonella typhimurium LT2
ccgcaucgcccgcccccaa

SEQ ID NO: 1874905 - RNA, 13 nt, Salmonella typhimurium LT2
cccucgcaccaaa

SEQ ID NO: 1874906 - RNA, 23 nt, Salmonella typhimurium LT2
cccuuguuauccuaaaucugcca

SEQ ID NO: 1874907 - RNA, 19 nt, Salmonella typhimurium LT2
cccuuucgacgucaccauc

SEQ ID NO: 1874908 - RNA, 16 nt, Salmonella typhimurium LT2
cccuuuacccaccagc

SEQ ID NO: 1874909 - RNA, 19 nt, Salmonella typhimurium LT2
cccuuucauuucugccugc

SEQ ID NO: 1874910 - RNA, 15 nt, Salmonella typhimurium LT2
ccgaaauccaccagc

SEQ ID NO: 1874911 - RNA, 20 nt, Salmonella typhimurium LT2
ccgaaagccgguaaucgauc

SEQ ID NO: 1874912 - RNA, 16 nt, Salmonella typhimurium LT2
cccuuuuucaauaagc

SEQ ID NO: 1874913 - RNA, 18 nt, Salmonella typhimurium LT2
cccuuuuuaaaaugaccg

SEQ ID NO: 1874914 - RNA, 17 nt, Salmonella typhimurium LT2
ccgacauagcugaacaa

SEQ ID NO: 1874915 - RNA, 16 nt, Salmonella typhimurium LT2
ccgacaggguuugcca

SEQ ID NO: 1874916 - RNA, 13 nt, Salmonella typhimurium LT2
ccgaccaguaaga

SEQ ID NO: 1874917 - RNA, 18 nt, Salmonella typhimurium LT2
ccgaccaggacaaaaggc

SEQ ID NO: 1874918 - RNA, 18 nt, Salmonella typhimurium LT2
ccgacaugacgccgcagc

SEQ ID NO: 1874919 - RNA, 18 nt, Salmonella typhimurium LT2
ccgacauugaccagugca

SEQ ID NO: 1874920 - RNA, 15 nt, Salmonella typhimurium LT2
ccgaccaccagcuug

SEQ ID NO: 1874921 - RNA, 17 nt, Salmonella typhimurium LT2
ccgaccaccagcuuguu

SEQ ID NO: 1874922 - RNA, 18 nt, Salmonella typhimurium LT2
ccgaccaauugcaggcag

SEQ ID NO: 1874923 - RNA, 12 nt, Salmonella typhimurium LT2
ccgaaucuugca

SEQ ID NO: 1874924 - RNA, 19 nt, Salmonella typhimurium LT2
ccgacaauauucgccgcga

SEQ ID NO: 1874925 - RNA, 20 nt, Salmonella typhimurium LT2
ccgacaauauucgccgcgau

SEQ ID NO: 1874926 - RNA, 16 nt, Salmonella typhimurium LT2
ccgacacauucaggcu

SEQ ID NO: 1874927 - RNA, 12 nt, Salmonella typhimurium LT2
ccgaccgccagg

SEQ ID NO: 1874928 - RNA, 15 nt, Salmonella typhimurium LT2
ccgaccgccaggucg

SEQ ID NO: 1874929 - RNA, 22 nt, Salmonella typhimurium LT2
ccgaccuggcggucggcuuugu

SEQ ID NO: 1874930 - RNA, 15 nt, Salmonella typhimurium LT2
ccgacgcucuuccuc

SEQ ID NO: 1874931 - RNA, 15 nt, Salmonella typhimurium LT2
ccgaccgucagcucc

SEQ ID NO: 1874932 - RNA, 23 nt, Salmonella typhimurium LT2
ccgacggcuucuucacgcagcgc

SEQ ID NO: 1874933 - RNA, 18 nt, Salmonella typhimurium LT2
ccgagcagccuggcggcu

SEQ ID NO: 1874934 - RNA, 15 nt, Salmonella typhimurium LT2
ccgacugccaccacg

SEQ ID NO: 1874935 - RNA, 20 nt, Salmonella typhimurium LT2
ccgacugucgaaaccagcau

SEQ ID NO: 1874936 - RNA, 15 nt, Salmonella typhimurium LT2
ccgauaacgcggccc

SEQ ID NO: 1874937 - RNA, 21 nt, Salmonella typhimurium LT2
ccgauaagcaagcgccaucgg

SEQ ID NO: 1874938 - RNA, 14 nt, Salmonella typhimurium LT2
ccgaguaacaccgc

SEQ ID NO: 1874939 - RNA, 15 nt, Salmonella typhimurium LT2
ccgagguucaccagc

SEQ ID NO: 1874940 - RNA, 15 nt, Salmonella typhimurium LT2
ccgauaaucaccagc

SEQ ID NO: 1874941 - RNA, 21 nt, Salmonella typhimurium LT2
ccgauaagcuuacgccaucgg

SEQ ID NO: 1874942 - RNA, 22 nt, Salmonella typhimurium LT2
ccgauagcgcggaauaucaauu

SEQ ID NO: 1874943 - RNA, 19 nt, Salmonella typhimurium LT2
ccgauagucuccgccaccu

SEQ ID NO: 1874944 - RNA, 23 nt, Salmonella typhimurium LT2
ccgauagcgaaacugauauuaga

SEQ ID NO: 1874945 - RNA, 15 nt, Salmonella typhimurium LT2
ccgauagcgccgcgc

SEQ ID NO: 1874946 - RNA, 17 nt, Salmonella typhimurium LT2
ccgcggcgaucuccuga

SEQ ID NO: 1874947 - RNA, 13 nt, Salmonella typhimurium LT2
ccgcgguccagcc

SEQ ID NO: 1874948 - RNA, 18 nt, Salmonella typhimurium LT2
ccgcuacaauccaggacg

SEQ ID NO: 1874949 - RNA, 20 nt, Salmonella typhimurium LT2
ccgcgugggacguuuggcuu

SEQ ID NO: 1874950 - RNA, 17 nt, Salmonella typhimurium LT2
ccgcgugaacacacccu

SEQ ID NO: 1874951 - RNA, 23 nt, Salmonella typhimurium LT2
ccgcuacguaaccggccagccug

SEQ ID NO: 1874952 - RNA, 21 nt, Salmonella typhimurium LT2
ccgcucaucgcgucucccaga

SEQ ID NO: 1874953 - RNA, 15 nt, Salmonella typhimurium LT2
ccgcuaucauaccua

SEQ ID NO: 1874954 - RNA, 22 nt, Salmonella typhimurium LT2
ccgcucggcauacaccgccagc

SEQ ID NO: 1874955 - RNA, 15 nt, Salmonella typhimurium LT2
ccgcucgccauaucu

SEQ ID NO: 1874956 - RNA, 19 nt, Salmonella typhimurium LT2
ccgcugcugccuuccaguu

SEQ ID NO: 1874957 - RNA, 19 nt, Salmonella typhimurium LT2
ccgcugcggucaggaauga

SEQ ID NO: 1874958 - RNA, 20 nt, Salmonella typhimurium LT2
ccgcugcgcucacgcggcgc

SEQ ID NO: 1874959 - RNA, 16 nt, Salmonella typhimurium LT2
ccgcuucgcgcgccag

SEQ ID NO: 1874960 - RNA, 15 nt, Salmonella typhimurium LT2
ccgcuguaauaccag

SEQ ID NO: 1874961 - RNA, 17 nt, Salmonella typhimurium LT2
ccgcugguugccuuccu

SEQ ID NO: 1874962 - RNA, 23 nt, Salmonella typhimurium LT2
ccgcgauaaagaauagccugggc

SEQ ID NO: 1874963 - RNA, 15 nt, Salmonella typhimurium LT2
ccgcgauaaccauca

SEQ ID NO: 1874964 - RNA, 16 nt, Salmonella typhimurium LT2
ccgcgcaaagcaauac

SEQ ID NO: 1874965 - RNA, 17 nt, Salmonella typhimurium LT2
ccgcgaaccggaccagc

SEQ ID NO: 1874966 - RNA, 16 nt, Salmonella typhimurium LT2
ccgcgacagucgcaga

SEQ ID NO: 1874967 - RNA, 20 nt, Salmonella typhimurium LT2
ccgccuggaacccaggcacc

SEQ ID NO: 1874968 - RNA, 16 nt, Salmonella typhimurium LT2
ccgccugccugcaacg

SEQ ID NO: 1874969 - RNA, 15 nt, Salmonella typhimurium LT2
ccgccuggcgcgacu

SEQ ID NO: 1874970 - RNA, 14 nt, Salmonella typhimurium LT2
ccgccgaugugcgc

SEQ ID NO: 1874971 - RNA, 15 nt, Salmonella typhimurium LT2
ccgccugccgcgccg

SEQ ID NO: 1874972 - RNA, 16 nt, Salmonella typhimurium LT2
ccgccugccgcgccgc

SEQ ID NO: 1874973 - RNA, 13 nt, Salmonella typhimurium LT2
ccgccgccgugcc

SEQ ID NO: 1874974 - RNA, 14 nt, Salmonella typhimurium LT2
ccgccgccgugccu

SEQ ID NO: 1874975 - RNA, 19 nt, Salmonella typhimurium LT2
ccgcgcuggauagcgagaa

SEQ ID NO: 1874976 - RNA, 18 nt, Salmonella typhimurium LT2
ccgcggagaucgcucccg

SEQ ID NO: 1874977 - RNA, 19 nt, Salmonella typhimurium LT2
ccgcggagaucgcucccgc

SEQ ID NO: 1874978 - RNA, 20 nt, Salmonella typhimurium LT2
ccgcgcuaucgggucugcgc

SEQ ID NO: 1874979 - RNA, 17 nt, Salmonella typhimurium LT2
ccgcgcucgugauugau

SEQ ID NO: 1874980 - RNA, 18 nt, Salmonella typhimurium LT2
ccgcgcuagugccgccag

SEQ ID NO: 1874981 - RNA, 15 nt, Salmonella typhimurium LT2
ccgcgccaccgggcc

SEQ ID NO: 1874982 - RNA, 20 nt, Salmonella typhimurium LT2
ccgcgccaccgggccgucag

SEQ ID NO: 1874983 - RNA, 16 nt, Salmonella typhimurium LT2
ccgcgccagaccgcuu

SEQ ID NO: 1874984 - RNA, 15 nt, Salmonella typhimurium LT2
ccgcgcgcauauggc

SEQ ID NO: 1874985 - RNA, 14 nt, Salmonella typhimurium LT2
ccgcgcggcguucu

SEQ ID NO: 1874986 - RNA, 16 nt, Salmonella typhimurium LT2
ccgcgcggcguucugc

SEQ ID NO: 1874987 - RNA, 13 nt, Salmonella typhimurium LT2
ccgcgcgccgccu

SEQ ID NO: 1874988 - RNA, 14 nt, Salmonella typhimurium LT2
ccgcgcgccgccuc

SEQ ID NO: 1874989 - RNA, 15 nt, Salmonella typhimurium LT2
ccgcgcgccagcgga

SEQ ID NO: 1874990 - RNA, 20 nt, Salmonella typhimurium LT2
ccgcgcgccagcggacucca

SEQ ID NO: 1874991 - RNA, 13 nt, Salmonella typhimurium LT2
ccggcgacucaug

SEQ ID NO: 1874992 - RNA, 17 nt, Salmonella typhimurium LT2
ccggcgagcgaugcugc

SEQ ID NO: 1874993 - RNA, 13 nt, Salmonella typhimurium LT2
ccggcgacccgcc

SEQ ID NO: 1874994 - RNA, 21 nt, Salmonella typhimurium LT2
ccggcgaccacuagcgccgcc

SEQ ID NO: 1874995 - RNA, 15 nt, Salmonella typhimurium LT2
ccggccugccccuga

SEQ ID NO: 1874996 - RNA, 23 nt, Salmonella typhimurium LT2
ccggccuacaccguuucugaucu

SEQ ID NO: 1874997 - RNA, 21 nt, Salmonella typhimurium LT2
ccggcgccaaucaccgccagc

SEQ ID NO: 1874998 - RNA, 16 nt, Salmonella typhimurium LT2
ccggcgauguuggcgc

SEQ ID NO: 1874999 - RNA, 13 nt, Salmonella typhimurium LT2
ccggcgauggugc

SEQ ID NO: 1875000 - RNA, 22 nt, Salmonella typhimurium LT2
ccggcgcaaacaguacgcccgc

SEQ ID NO: 1875001 - RNA, 18 nt, Salmonella typhimurium LT2
ccggcgcaaacacggcug

SEQ ID NO: 1875002 - RNA, 19 nt, Salmonella typhimurium LT2
ccggcgccagcucaacgcc

SEQ ID NO: 1875003 - RNA, 14 nt, Salmonella typhimurium LT2
ccggcgccauaauc

SEQ ID NO: 1875004 - RNA, 18 nt, Salmonella typhimurium LT2
ccggcgccagaagcuggc

SEQ ID NO: 1875005 - RNA, 13 nt, Salmonella typhimurium LT2
ccggcgccgccga

SEQ ID NO: 1875006 - RNA, 13 nt, Salmonella typhimurium LT2
ccggcgcgccagc

SEQ ID NO: 1875007 - RNA, 15 nt, Salmonella typhimurium LT2
ccggcgcgcgccagc

SEQ ID NO: 1875008 - RNA, 11 nt, Salmonella typhimurium LT2
ccggcgcgccu

SEQ ID NO: 1875009 - RNA, 17 nt, Salmonella typhimurium LT2
ccggcgcuggcgcacgc

SEQ ID NO: 1875010 - RNA, 12 nt, Salmonella typhimurium LT2
ccggcgcggcgc

SEQ ID NO: 1875011 - RNA, 13 nt, Salmonella typhimurium LT2
ccggcgcgggcau

SEQ ID NO: 1875012 - RNA, 14 nt, Salmonella typhimurium LT2
ccggcgcgggugau

SEQ ID NO: 1875013 - RNA, 19 nt, Salmonella typhimurium LT2
ccggauggcgcuaaugcuu

SEQ ID NO: 1875014 - RNA, 23 nt, Salmonella typhimurium LT2
ccggauggcgcugucgcuuauuc

SEQ ID NO: 1875015 - RNA, 23 nt, Salmonella typhimurium LT2
ccggauggcggcgugaccgccuu

SEQ ID NO: 1875016 - RNA, 22 nt, Salmonella typhimurium LT2
ccggauggcaguacagggcgau

SEQ ID NO: 1875017 - RNA, 22 nt, Salmonella typhimurium LT2
ccggaugcguguucagguuggc

SEQ ID NO: 1875018 - RNA, 16 nt, Salmonella typhimurium LT2
ccggaugcgccgugcu

SEQ ID NO: 1875019 - RNA, 18 nt, Salmonella typhimurium LT2
ccggaugcgccgugcuug

SEQ ID NO: 1875020 - RNA, 15 nt, Salmonella typhimurium LT2
ccggauugcccgcgg

SEQ ID NO: 1875021 - RNA, 18 nt, Salmonella typhimurium LT2
ccggaugacgcuucgcuu

SEQ ID NO: 1875022 - RNA, 20 nt, Salmonella typhimurium LT2
ccggaugaaacgcauccagc

SEQ ID NO: 1875023 - RNA, 17 nt, Salmonella typhimurium LT2
ccggaggaccugauuaa

SEQ ID NO: 1875024 - RNA, 17 nt, Salmonella typhimurium LT2
ccggagccggucggcgc

SEQ ID NO: 1875025 - RNA, 17 nt, Salmonella typhimurium LT2
ccggacgccguccaggc

SEQ ID NO: 1875026 - RNA, 13 nt, Salmonella typhimurium LT2
ccgcuucuuccau

SEQ ID NO: 1875027 - RNA, 16 nt, Salmonella typhimurium LT2
ccgcuugcaccauggc

SEQ ID NO: 1875028 - RNA, 17 nt, Salmonella typhimurium LT2
ccggccccgcgccagcc

SEQ ID NO: 1875029 - RNA, 12 nt, Salmonella typhimurium LT2
ccggcccuuccg

SEQ ID NO: 1875030 - RNA, 18 nt, Salmonella typhimurium LT2
ccggccauugccgcgccg

SEQ ID NO: 1875031 - RNA, 19 nt, Salmonella typhimurium LT2
ccggccagccugcgccagc

SEQ ID NO: 1875032 - RNA, 15 nt, Salmonella typhimurium LT2
ccggccagcgacagg

SEQ ID NO: 1875033 - RNA, 14 nt, Salmonella typhimurium LT2
ccggcaucggcagc

SEQ ID NO: 1875034 - RNA, 15 nt, Salmonella typhimurium LT2
ccggcaucacgccgg

SEQ ID NO: 1875035 - RNA, 19 nt, Salmonella typhimurium LT2
ccggcaguccgucgagcgc

SEQ ID NO: 1875036 - RNA, 23 nt, Salmonella typhimurium LT2
ccggcaguccuugcagccagaac

SEQ ID NO: 1875037 - RNA, 18 nt, Salmonella typhimurium LT2
ccggcaguugcugucgcu

SEQ ID NO: 1875038 - RNA, 23 nt, Salmonella typhimurium LT2
ccggcaaaggaauuacggacgau

SEQ ID NO: 1875039 - RNA, 16 nt, Salmonella typhimurium LT2
ccggcacauccagcug

SEQ ID NO: 1875040 - RNA, 21 nt, Salmonella typhimurium LT2
ccggcacaccggccauugccg

SEQ ID NO: 1875041 - RNA, 20 nt, Salmonella typhimurium LT2
ccggcacaccggccauugcc

SEQ ID NO: 1875042 - RNA, 13 nt, Salmonella typhimurium LT2
ccguucuuccugg

SEQ ID NO: 1875043 - RNA, 17 nt, Salmonella typhimurium LT2
ccguugauaauaaauug

SEQ ID NO: 1875044 - RNA, 23 nt, Salmonella typhimurium LT2
ccuaaaccaaacaccagaucauu

SEQ ID NO: 1875045 - RNA, 11 nt, Salmonella typhimurium LT2
ccuaaaaauag

SEQ ID NO: 1875046 - RNA, 19 nt, Salmonella typhimurium LT2
ccguuuuguugccgcccgu

SEQ ID NO: 1875047 - RNA, 15 nt, Salmonella typhimurium LT2
ccguuuacagccgcc

SEQ ID NO: 1875048 - RNA, 16 nt, Salmonella typhimurium LT2
ccguuguugcaccacc

SEQ ID NO: 1875049 - RNA, 22 nt, Salmonella typhimurium LT2
ccuaaaucugccaucagcaccu

SEQ ID NO: 1875050 - RNA, 18 nt, Salmonella typhimurium LT2
ccuaagagaaaaccccgu

SEQ ID NO: 1875051 - RNA, 20 nt, Salmonella typhimurium LT2
ccuaaagagggugaaccaaa

SEQ ID NO: 1875052 - RNA, 13 nt, Salmonella typhimurium LT2
ccuaaauaaauac

SEQ ID NO: 1875053 - RNA, 17 nt, Salmonella typhimurium LT2
ccuaaauaaauaccaaa

SEQ ID NO: 1875054 - RNA, 15 nt, Salmonella typhimurium LT2
ccuaauaaaauaacu

SEQ ID NO: 1875055 - RNA, 16 nt, Salmonella typhimurium LT2
ccuacaagauuugcaa

SEQ ID NO: 1875056 - RNA, 14 nt, Salmonella typhimurium LT2
ccuacaagccgccu

SEQ ID NO: 1875057 - RNA, 21 nt, Salmonella typhimurium LT2
ccuacaaagaacauaauaaaa

SEQ ID NO: 1875058 - RNA, 13 nt, Salmonella typhimurium LT2
ccuaauaaaauaa

SEQ ID NO: 1875059 - RNA, 15 nt, Salmonella typhimurium LT2
ccguuaucuuauaaa

SEQ ID NO: 1875060 - RNA, 21 nt, Salmonella typhimurium LT2
ccguuauacaucgcuuuccag

SEQ ID NO: 1875061 - RNA, 20 nt, Salmonella typhimurium LT2
ccguuagcgcucuucgcucc

SEQ ID NO: 1875062 - RNA, 19 nt, Salmonella typhimurium LT2
ccguggcugcgccugcgcg

SEQ ID NO: 1875063 - RNA, 15 nt, Salmonella typhimurium LT2
ccgucgcccguccgc

SEQ ID NO: 1875064 - RNA, 23 nt, Salmonella typhimurium LT2
ccgugaugcggacgcugacgcca

SEQ ID NO: 1875065 - RNA, 17 nt, Salmonella typhimurium LT2
ccuacacaaaaucauuc

SEQ ID NO: 1875066 - RNA, 14 nt, Salmonella typhimurium LT2
ccuacaccaccagc

SEQ ID NO: 1875067 - RNA, 17 nt, Salmonella typhimurium LT2
ccuacaccaccagcccg

SEQ ID NO: 1875068 - RNA, 17 nt, Salmonella typhimurium LT2
ccucaagaauaucuuua

SEQ ID NO: 1875069 - RNA, 24 nt, Salmonella typhimurium LT2
ccucaacgcucauaccuggcuuga

SEQ ID NO: 1875070 - RNA, 13 nt, Salmonella typhimurium LT2
ccucaaaacgggc

SEQ ID NO: 1875071 - RNA, 17 nt, Salmonella typhimurium LT2
ccuauuuugcaaaacug

SEQ ID NO: 1875072 - RNA, 17 nt, Salmonella typhimurium LT2
ccucaaaauagguguug

SEQ ID NO: 1875073 - RNA, 13 nt, Salmonella typhimurium LT2
ccucaaaccagga

SEQ ID NO: 1875074 - RNA, 21 nt, Salmonella typhimurium LT2
ccuauuucaguacagccaaaa

SEQ ID NO: 1875075 - RNA, 21 nt, Salmonella typhimurium LT2
ccuauguuaugcacaaccagc

SEQ ID NO: 1875076 - RNA, 16 nt, Salmonella typhimurium LT2
ccuauuaucggcacca

SEQ ID NO: 1875077 - RNA, 19 nt, Salmonella typhimurium LT2
ccuauuaucggcaccaucu

SEQ ID NO: 1875078 - RNA, 16 nt, Salmonella typhimurium LT2
ccucaccguccgccag

SEQ ID NO: 1875079 - RNA, 12 nt, Salmonella typhimurium LT2
ccucacuguuga

SEQ ID NO: 1875080 - RNA, 13 nt, Salmonella typhimurium LT2
ccucacugccgac

SEQ ID NO: 1875081 - RNA, 12 nt, Salmonella typhimurium LT2
ccucagaauccg

SEQ ID NO: 1875082 - RNA, 21 nt, Salmonella typhimurium LT2
ccggcgcuuuauacagauguc

SEQ ID NO: 1875083 - RNA, 16 nt, Salmonella typhimurium LT2
ccgggaucagcggcug

SEQ ID NO: 1875084 - RNA, 13 nt, Salmonella typhimurium LT2
ccgggaucagcgg

SEQ ID NO: 1875085 - RNA, 22 nt, Salmonella typhimurium LT2
ccgggguggauggcgcgggcag

SEQ ID NO: 1875086 - RNA, 16 nt, Salmonella typhimurium LT2
ccgggccugagcgcgc

SEQ ID NO: 1875087 - RNA, 17 nt, Salmonella typhimurium LT2
ccgggcgacacgcgcgc

SEQ ID NO: 1875088 - RNA, 14 nt, Salmonella typhimurium LT2
ccgggcgcccggcc

SEQ ID NO: 1875089 - RNA, 15 nt, Salmonella typhimurium LT2
ccgggcgcaaucauc

SEQ ID NO: 1875090 - RNA, 22 nt, Salmonella typhimurium LT2
ccgggcgcaccaguuccccaua

SEQ ID NO: 1875091 - RNA, 18 nt, Salmonella typhimurium LT2
ccggguggcggcuacgcc

SEQ ID NO: 1875092 - RNA, 17 nt, Salmonella typhimurium LT2
ccgguaagcgcagcgcc

SEQ ID NO: 1875093 - RNA, 13 nt, Salmonella typhimurium LT2
ccgguaaggccaa

SEQ ID NO: 1875094 - RNA, 23 nt, Salmonella typhimurium LT2
ccgggucggacgagcgcgucagc

SEQ ID NO: 1875095 - RNA, 21 nt, Salmonella typhimurium LT2
ccggucggguguucucauccc

SEQ ID NO: 1875096 - RNA, 15 nt, Salmonella typhimurium LT2
ccggucggcgcgucg

SEQ ID NO: 1875097 - RNA, 13 nt, Salmonella typhimurium LT2
ccggucauccagc

SEQ ID NO: 1875098 - RNA, 14 nt, Salmonella typhimurium LT2
ccggucaggcagca

SEQ ID NO: 1875099 - RNA, 22 nt, Salmonella typhimurium LT2
ccggucaucgcggaaagcaaug

SEQ ID NO: 1875100 - RNA, 15 nt, Salmonella typhimurium LT2
ccgguagccaggcgc

SEQ ID NO: 1875101 - RNA, 14 nt, Salmonella typhimurium LT2
ccgguacuggagac

SEQ ID NO: 1875102 - RNA, 18 nt, Salmonella typhimurium LT2
ccgguacgggcagcggcu

SEQ ID NO: 1875103 - RNA, 15 nt, Salmonella typhimurium LT2
ccgguguaaaaaaug

SEQ ID NO: 1875104 - RNA, 15 nt, Salmonella typhimurium LT2
ccgguguagcuggca

SEQ ID NO: 1875105 - RNA, 18 nt, Salmonella typhimurium LT2
ccgguggcgcuggcgcuu

SEQ ID NO: 1875106 - RNA, 14 nt, Salmonella typhimurium LT2
ccggugcgccccag

SEQ ID NO: 1875107 - RNA, 15 nt, Salmonella typhimurium LT2
ccggugcgccccagc

SEQ ID NO: 1875108 - RNA, 19 nt, Salmonella typhimurium LT2
ccggugcgagaaaaagcaa

SEQ ID NO: 1875109 - RNA, 23 nt, Salmonella typhimurium LT2
ccggugccguuaauuuucacgca

SEQ ID NO: 1875110 - RNA, 19 nt, Salmonella typhimurium LT2
ccggugcgggaagcgcgca

SEQ ID NO: 1875111 - RNA, 12 nt, Salmonella typhimurium LT2
ccgguugcgcug

SEQ ID NO: 1875112 - RNA, 20 nt, Salmonella typhimurium LT2
ccgguugcgcugguuggcgc

SEQ ID NO: 1875113 - RNA, 13 nt, Salmonella typhimurium LT2
ccgguugcgcgcu

SEQ ID NO: 1875114 - RNA, 19 nt, Salmonella typhimurium LT2
ccguaagcggcggaccagc

SEQ ID NO: 1875115 - RNA, 13 nt, Salmonella typhimurium LT2
ccgguuagcgccg

SEQ ID NO: 1875116 - RNA, 17 nt, Salmonella typhimurium LT2
ccguauccgccaccaug

SEQ ID NO: 1875117 - RNA, 19 nt, Salmonella typhimurium LT2
ccguauccgccaccaugau

SEQ ID NO: 1875118 - RNA, 15 nt, Salmonella typhimurium LT2
ccguauagccgcgcg

SEQ ID NO: 1875119 - RNA, 21 nt, Salmonella typhimurium LT2
ccguaccgcggcgcugcagau

SEQ ID NO: 1875120 - RNA, 15 nt, Salmonella typhimurium LT2
ccguacacaaucauc

SEQ ID NO: 1875121 - RNA, 19 nt, Salmonella typhimurium LT2
ccgucacgccgacgacagg

SEQ ID NO: 1875122 - RNA, 12 nt, Salmonella typhimurium LT2
ccgucacaaagc

SEQ ID NO: 1875123 - RNA, 16 nt, Salmonella typhimurium LT2
ccgucaugcuucaccu

SEQ ID NO: 1875124 - RNA, 17 nt, Salmonella typhimurium LT2
ccgucauccugcaacuc

SEQ ID NO: 1875125 - RNA, 20 nt, Salmonella typhimurium LT2
ccgucauaaaaucaaucugc

SEQ ID NO: 1875126 - RNA, 21 nt, Salmonella typhimurium LT2
ccgucauaaaaucaaucugca

SEQ ID NO: 1875127 - RNA, 20 nt, Salmonella typhimurium LT2
ccgucauauagccgcgcagu

SEQ ID NO: 1875128 - RNA, 14 nt, Salmonella typhimurium LT2
ccgucccuuccgcc

SEQ ID NO: 1875129 - RNA, 15 nt, Salmonella typhimurium LT2
ccguccgccaggccc

SEQ ID NO: 1875130 - RNA, 22 nt, Salmonella typhimurium LT2
ccgucccuaagccggcaggcag

SEQ ID NO: 1875131 - RNA, 13 nt, Salmonella typhimurium LT2
ccguccccagcca

SEQ ID NO: 1875132 - RNA, 20 nt, Salmonella typhimurium LT2
ccugacugcgcgccugcgcu

SEQ ID NO: 1875133 - RNA, 19 nt, Salmonella typhimurium LT2
ccugacuggcugagcucac

SEQ ID NO: 1875134 - RNA, 21 nt, Salmonella typhimurium LT2
ccugacuauugcugagcugac

SEQ ID NO: 1875135 - RNA, 13 nt, Salmonella typhimurium LT2
ccugacugaagac

SEQ ID NO: 1875136 - RNA, 17 nt, Salmonella typhimurium LT2
ccugacggcgcugucac

SEQ ID NO: 1875137 - RNA, 15 nt, Salmonella typhimurium LT2
ccugaauuucacgcu

SEQ ID NO: 1875138 - RNA, 13 nt, Salmonella typhimurium LT2
ccucuuccgccag

SEQ ID NO: 1875139 - RNA, 15 nt, Salmonella typhimurium LT2
ccugaccauugcugu

SEQ ID NO: 1875140 - RNA, 14 nt, Salmonella typhimurium LT2
ccugacagcaauga

SEQ ID NO: 1875141 - RNA, 20 nt, Salmonella typhimurium LT2
ccugacaaauuauaaacuac

SEQ ID NO: 1875142 - RNA, 16 nt, Salmonella typhimurium LT2
ccugagccgaaccccu

SEQ ID NO: 1875143 - RNA, 19 nt, Salmonella typhimurium LT2
ccugagcuuuccugacaaa

SEQ ID NO: 1875144 - RNA, 21 nt, Salmonella typhimurium LT2
ccugagcagacauauuuucuc

SEQ ID NO: 1875145 - RNA, 17 nt, Salmonella typhimurium LT2
ccugacuuuuccauacu

SEQ ID NO: 1875146 - RNA, 19 nt, Salmonella typhimurium LT2
ccugauagccguaaauaau

SEQ ID NO: 1875147 - RNA, 18 nt, Salmonella typhimurium LT2
ccugauaagcgcagcgcc

SEQ ID NO: 1875148 - RNA, 13 nt, Salmonella typhimurium LT2
ccugagucacaga

SEQ ID NO: 1875149 - RNA, 20 nt, Salmonella typhimurium LT2
ccugauaaccuauuuugcaa

SEQ ID NO: 1875150 - RNA, 21 nt, Salmonella typhimurium LT2
ccugauuaaguuuuuuuaaaa

SEQ ID NO: 1875151 - RNA, 22 nt, Salmonella typhimurium LT2
ccugauggcgcuacguuuaucu

SEQ ID NO: 1875152 - RNA, 17 nt, Salmonella typhimurium LT2
ccugauggcgcugcgcu

SEQ ID NO: 1875153 - RNA, 17 nt, Salmonella typhimurium LT2
ccugaugguuauuuucg

SEQ ID NO: 1875154 - RNA, 18 nt, Salmonella typhimurium LT2
ccugaugcgacgcuuacc

SEQ ID NO: 1875155 - RNA, 22 nt, Salmonella typhimurium LT2
ccugaugcgcguuuagcgccag

SEQ ID NO: 1875156 - RNA, 20 nt, Salmonella typhimurium LT2
ccugaugacggcugguaagg

SEQ ID NO: 1875157 - RNA, 17 nt, Salmonella typhimurium LT2
ccugaugacgcugcgcu

SEQ ID NO: 1875158 - RNA, 21 nt, Salmonella typhimurium LT2
ccugaucgcgcagacaguggc

SEQ ID NO: 1875159 - RNA, 22 nt, Salmonella typhimurium LT2
ccugaucggcggcccacucauc

SEQ ID NO: 1875160 - RNA, 19 nt, Salmonella typhimurium LT2
ccugauccugcaacagcac

SEQ ID NO: 1875161 - RNA, 13 nt, Salmonella typhimurium LT2
ccugaucccacag

SEQ ID NO: 1875162 - RNA, 19 nt, Salmonella typhimurium LT2
ccugauccagcucuucuuc

SEQ ID NO: 1875163 - RNA, 15 nt, Salmonella typhimurium LT2
ccugaucaaggcgca

SEQ ID NO: 1875164 - RNA, 16 nt, Salmonella typhimurium LT2
ccugauccagcucuuc

SEQ ID NO: 1875165 - RNA, 14 nt, Salmonella typhimurium LT2
ccugcaaaccucuc

SEQ ID NO: 1875166 - RNA, 20 nt, Salmonella typhimurium LT2
ccugcaaaccucucccccgc

SEQ ID NO: 1875167 - RNA, 16 nt, Salmonella typhimurium LT2
ccugcaaaaaaagaaa

SEQ ID NO: 1875168 - RNA, 20 nt, Salmonella typhimurium LT2
ccugauugauacgcgcccga

SEQ ID NO: 1875169 - RNA, 15 nt, Salmonella typhimurium LT2
ccugauuuaucacgu

SEQ ID NO: 1875170 - RNA, 14 nt, Salmonella typhimurium LT2
ccugccaccagcgu

SEQ ID NO: 1875171 - RNA, 17 nt, Salmonella typhimurium LT2
ccugcaggcgagugcua

SEQ ID NO: 1875172 - RNA, 12 nt, Salmonella typhimurium LT2
ccugcagggaau

SEQ ID NO: 1875173 - RNA, 23 nt, Salmonella typhimurium LT2
ccugcaggcggugcgcagccacg

SEQ ID NO: 1875174 - RNA, 20 nt, Salmonella typhimurium LT2
ccucggcaacauaccgggua

SEQ ID NO: 1875175 - RNA, 14 nt, Salmonella typhimurium LT2
ccucgucagugaac

SEQ ID NO: 1875176 - RNA, 22 nt, Salmonella typhimurium LT2
ccucgucaugcucgcuuuccau

SEQ ID NO: 1875177 - RNA, 19 nt, Salmonella typhimurium LT2
ccucugcgggcuccggacg

SEQ ID NO: 1875178 - RNA, 19 nt, Salmonella typhimurium LT2
ccucuuccaucagccaggc

SEQ ID NO: 1875179 - RNA, 14 nt, Salmonella typhimurium LT2
ccucugugccggcg

SEQ ID NO: 1875180 - RNA, 23 nt, Salmonella typhimurium LT2
ccucugccguagcguacuuucaa

SEQ ID NO: 1875181 - RNA, 20 nt, Salmonella typhimurium LT2
ccucuauccggaggccuucu

SEQ ID NO: 1875182 - RNA, 13 nt, Salmonella typhimurium LT2
ccucuaucuucuc

SEQ ID NO: 1875183 - RNA, 22 nt, Salmonella typhimurium LT2
ccucuaccggaaaacagccgcc

SEQ ID NO: 1875184 - RNA, 13 nt, Salmonella typhimurium LT2
ccucuaaauguug

SEQ ID NO: 1875185 - RNA, 17 nt, Salmonella typhimurium LT2
ccucgccccuucggggc

SEQ ID NO: 1875186 - RNA, 17 nt, Salmonella typhimurium LT2
ccucgcaaaacauggcu

SEQ ID NO: 1875187 - RNA, 23 nt, Salmonella typhimurium LT2
ccucgauuaccguguuuaccuuu

SEQ ID NO: 1875188 - RNA, 20 nt, Salmonella typhimurium LT2
ccucgauggcauuguccuuu

SEQ ID NO: 1875189 - RNA, 12 nt, Salmonella typhimurium LT2
ccucgcagacug

SEQ ID NO: 1875190 - RNA, 23 nt, Salmonella typhimurium LT2
ccucgcucucuuucaccagcgcc

SEQ ID NO: 1875191 - RNA, 14 nt, Salmonella typhimurium LT2
ccucgcugacgcca

SEQ ID NO: 1875192 - RNA, 23 nt, Salmonella typhimurium LT2
ccucgcugacgccagccagccgu

SEQ ID NO: 1875193 - RNA, 17 nt, Salmonella typhimurium LT2
ccucgcuuaaaccacca

SEQ ID NO: 1875194 - RNA, 21 nt, Salmonella typhimurium LT2
ccucgcucaccggccccggaa

SEQ ID NO: 1875195 - RNA, 11 nt, Salmonella typhimurium LT2
ccucagccacg

SEQ ID NO: 1875196 - RNA, 17 nt, Salmonella typhimurium LT2
ccucagcaaaaucacgc

SEQ ID NO: 1875197 - RNA, 14 nt, Salmonella typhimurium LT2
ccucauauuuguau

SEQ ID NO: 1875198 - RNA, 16 nt, Salmonella typhimurium LT2
ccugugaaguaaaaaa

SEQ ID NO: 1875199 - RNA, 16 nt, Salmonella typhimurium LT2
ccugucuuuucucucu

SEQ ID NO: 1875200 - RNA, 17 nt, Salmonella typhimurium LT2
ccugucuuuucucucuu

SEQ ID NO: 1875201 - RNA, 22 nt, Salmonella typhimurium LT2
ccugucugucaaaacccagccc

SEQ ID NO: 1875202 - RNA, 19 nt, Salmonella typhimurium LT2
ccugucugucgcgggcgaa

SEQ ID NO: 1875203 - RNA, 14 nt, Salmonella typhimurium LT2
ccugucuccgcagc

SEQ ID NO: 1875204 - RNA, 16 nt, Salmonella typhimurium LT2
ccuguaaacagaugcu

SEQ ID NO: 1875205 - RNA, 21 nt, Salmonella typhimurium LT2
ccuguucgcuuauuccuccgc

SEQ ID NO: 1875206 - RNA, 15 nt, Salmonella typhimurium LT2
ccuguucgccacccg

SEQ ID NO: 1875207 - RNA, 20 nt, Salmonella typhimurium LT2
ccuguuccagggcuuccaga

SEQ ID NO: 1875208 - RNA, 17 nt, Salmonella typhimurium LT2
ccuguucguaaucacuu

SEQ ID NO: 1875209 - RNA, 16 nt, Salmonella typhimurium LT2
ccuguugaacaauggu

SEQ ID NO: 1875210 - RNA, 21 nt, Salmonella typhimurium LT2
ccuguucaaguggcaaucgac

SEQ ID NO: 1875211 - RNA, 12 nt, Salmonella typhimurium LT2
ccugugcaauca

SEQ ID NO: 1875212 - RNA, 22 nt, Salmonella typhimurium LT2
ccuuaaucgacugcguuaucgc

SEQ ID NO: 1875213 - RNA, 22 nt, Salmonella typhimurium LT2
ccuuaauuucuuugccccauaa

SEQ ID NO: 1875214 - RNA, 18 nt, Salmonella typhimurium LT2
ccuuacaaaaaucaugcc

SEQ ID NO: 1875215 - RNA, 13 nt, Salmonella typhimurium LT2
ccuuacagggcaa

SEQ ID NO: 1875216 - RNA, 16 nt, Salmonella typhimurium LT2
ccuuaaucgacuucau

SEQ ID NO: 1875217 - RNA, 15 nt, Salmonella typhimurium LT2
ccuguuucgcccgcu

SEQ ID NO: 1875218 - RNA, 16 nt, Salmonella typhimurium LT2
ccuguuuaucugaugc

SEQ ID NO: 1875219 - RNA, 18 nt, Salmonella typhimurium LT2
ccuguugcacgcauggca

SEQ ID NO: 1875220 - RNA, 22 nt, Salmonella typhimurium LT2
ccuucagauucaaacugauaag

SEQ ID NO: 1875221 - RNA, 14 nt, Salmonella typhimurium LT2
ccuucagcgcgccc

SEQ ID NO: 1875222 - RNA, 16 nt, Salmonella typhimurium LT2
ccuucacccccaucgc

SEQ ID NO: 1875223 - RNA, 15 nt, Salmonella typhimurium LT2
ccuucacgccgccaa

SEQ ID NO: 1875224 - RNA, 14 nt, Salmonella typhimurium LT2
ccuucacgccgcca

SEQ ID NO: 1875225 - RNA, 13 nt, Salmonella typhimurium LT2
ccuucagacgcau

SEQ ID NO: 1875226 - RNA, 23 nt, Salmonella typhimurium LT2
ccuuacgguuacagcauccuuua

SEQ ID NO: 1875227 - RNA, 19 nt, Salmonella typhimurium LT2
ccuuacuaagccaguucuc

SEQ ID NO: 1875228 - RNA, 20 nt, Salmonella typhimurium LT2
ccuuacuaucccauuuuuug

SEQ ID NO: 1875229 - RNA, 17 nt, Salmonella typhimurium LT2
ccuuauucgguuuaucc

SEQ ID NO: 1875230 - RNA, 21 nt, Salmonella typhimurium LT2
ccuuauaggcgcaucugaaaa

SEQ ID NO: 1875231 - RNA, 22 nt, Salmonella typhimurium LT2
ccuuauccggccugcaggcaac

SEQ ID NO: 1875232 - RNA, 23 nt, Salmonella typhimurium LT2
ccuggaaaaaagcgcccagcgcc

SEQ ID NO: 1875233 - RNA, 11 nt, Salmonella typhimurium LT2
ccugcuucaga

SEQ ID NO: 1875234 - RNA, 22 nt, Salmonella typhimurium LT2
ccugcuucagacaacgccgccu

SEQ ID NO: 1875235 - RNA, 20 nt, Salmonella typhimurium LT2
ccugcuugucgaucaucaga

SEQ ID NO: 1875236 - RNA, 20 nt, Salmonella typhimurium LT2
ccugcuuggccugaagcugc

SEQ ID NO: 1875237 - RNA, 18 nt, Salmonella typhimurium LT2
ccugcuugucgaucauca

SEQ ID NO: 1875238 - RNA, 18 nt, Salmonella typhimurium LT2
ccugcugccaucgcuucu

SEQ ID NO: 1875239 - RNA, 23 nt, Salmonella typhimurium LT2
ccugcuggaaaggccgcgaaccg

SEQ ID NO: 1875240 - RNA, 16 nt, Salmonella typhimurium LT2
ccugcuuaaacagaau

SEQ ID NO: 1875241 - RNA, 16 nt, Salmonella typhimurium LT2
ccugccaggccggacu

SEQ ID NO: 1875242 - RNA, 21 nt, Salmonella typhimurium LT2
ccugccagcaacccaccugcc

SEQ ID NO: 1875243 - RNA, 20 nt, Salmonella typhimurium LT2
ccugccagcacagcgguagc

SEQ ID NO: 1875244 - RNA, 19 nt, Salmonella typhimurium LT2
ccugccagagacucucuuu

SEQ ID NO: 1875245 - RNA, 18 nt, Salmonella typhimurium LT2
ccugccauagcaucacca

SEQ ID NO: 1875246 - RNA, 18 nt, Salmonella typhimurium LT2
ccugccaguccgcccgcc

SEQ ID NO: 1875247 - RNA, 16 nt, Salmonella typhimurium LT2
ccugccaguccgcccg

SEQ ID NO: 1875248 - RNA, 19 nt, Salmonella typhimurium LT2
ccugcccacuuugccauga

SEQ ID NO: 1875249 - RNA, 15 nt, Salmonella typhimurium LT2
ccugcucccacagcu

SEQ ID NO: 1875250 - RNA, 16 nt, Salmonella typhimurium LT2
ccugcucccagauuaa

SEQ ID NO: 1875251 - RNA, 12 nt, Salmonella typhimurium LT2
ccugcuccacca

SEQ ID NO: 1875252 - RNA, 14 nt, Salmonella typhimurium LT2
ccugcuccaccagc

SEQ ID NO: 1875253 - RNA, 14 nt, Salmonella typhimurium LT2
ccugcuccgggcgg

SEQ ID NO: 1875254 - RNA, 19 nt, Salmonella typhimurium LT2
ccuggcccggcaguugcug

SEQ ID NO: 1875255 - RNA, 22 nt, Salmonella typhimurium LT2
ccuggcgaauaaaauucagcgc

SEQ ID NO: 1875256 - RNA, 19 nt, Salmonella typhimurium LT2
ccuggcgaauaaaauucag

SEQ ID NO: 1875257 - RNA, 14 nt, Salmonella typhimurium LT2
ccuggcgaauaaaa

SEQ ID NO: 1875258 - RNA, 21 nt, Salmonella typhimurium LT2
ccuggccgguaaauuucacuu

SEQ ID NO: 1875259 - RNA, 14 nt, Salmonella typhimurium LT2
ccuggcgcaguggc

SEQ ID NO: 1875260 - RNA, 22 nt, Salmonella typhimurium LT2
ccugguuaacccgguuuauccc

SEQ ID NO: 1875261 - RNA, 22 nt, Salmonella typhimurium LT2
ccugguguguaaauuuguuuaa

SEQ ID NO: 1875262 - RNA, 18 nt, Salmonella typhimurium LT2
ccuggucuauucguucuc

SEQ ID NO: 1875263 - RNA, 20 nt, Salmonella typhimurium LT2
ccuggcuucaaccuccugca

SEQ ID NO: 1875264 - RNA, 19 nt, Salmonella typhimurium LT2
ccuggcuuaccugcucugg

SEQ ID NO: 1875265 - RNA, 20 nt, Salmonella typhimurium LT2
ccuggcugucggcagaaccu

SEQ ID NO: 1875266 - RNA, 20 nt, Salmonella typhimurium LT2
ccuggcugaaagcaaccaga

SEQ ID NO: 1875267 - RNA, 20 nt, Salmonella typhimurium LT2
ccacugaguuucaccgccag

SEQ ID NO: 1875268 - RNA, 20 nt, Salmonella typhimurium LT2
ccacucacgcucgcggaagc

SEQ ID NO: 1875269 - RNA, 14 nt, Salmonella typhimurium LT2
ccacuagcgccgcc

SEQ ID NO: 1875270 - RNA, 15 nt, Salmonella typhimurium LT2
ccacucauccagcaa

SEQ ID NO: 1875271 - RNA, 14 nt, Salmonella typhimurium LT2
ccacgucagcccaa

SEQ ID NO: 1875272 - RNA, 15 nt, Salmonella typhimurium LT2
ccacuacgcagcucc

SEQ ID NO: 1875273 - RNA, 14 nt, Salmonella typhimurium LT2
ccacuaacuggcaa

SEQ ID NO: 1875274 - RNA, 16 nt, Salmonella typhimurium LT2
ccacgguguaccccgc

SEQ ID NO: 1875275 - RNA, 18 nt, Salmonella typhimurium LT2
ccacgguucucaccgugg

SEQ ID NO: 1875276 - RNA, 17 nt, Salmonella typhimurium LT2
ccacgguucacggccaa

SEQ ID NO: 1875277 - RNA, 22 nt, Salmonella typhimurium LT2
ccacgguucacggccaaagcgc

SEQ ID NO: 1875278 - RNA, 17 nt, Salmonella typhimurium LT2
ccacguaacucggcagc

SEQ ID NO: 1875279 - RNA, 14 nt, Salmonella typhimurium LT2
ccacgcgccgccga

SEQ ID NO: 1875280 - RNA, 19 nt, Salmonella typhimurium LT2
ccacgcggcguacgcugca

SEQ ID NO: 1875281 - RNA, 21 nt, Salmonella typhimurium LT2
ccacgcguacgguuacaaccc

SEQ ID NO: 1875282 - RNA, 15 nt, Salmonella typhimurium LT2
ccacgcgucagguua

SEQ ID NO: 1875283 - RNA, 22 nt, Salmonella typhimurium LT2
ccacgcuaacguccgccgucag

SEQ ID NO: 1875284 - RNA, 19 nt, Salmonella typhimurium LT2
ccacuuccagcgcgccguc

SEQ ID NO: 1875285 - RNA, 20 nt, Salmonella typhimurium LT2
ccacuucuuccagcggcagg

SEQ ID NO: 1875286 - RNA, 21 nt, Salmonella typhimurium LT2
ccacuucuuccagcggcaggc

SEQ ID NO: 1875287 - RNA, 16 nt, Salmonella typhimurium LT2
ccacuucuuccagcgu

SEQ ID NO: 1875288 - RNA, 19 nt, Salmonella typhimurium LT2
ccagaaguagcagagaaaa

SEQ ID NO: 1875289 - RNA, 23 nt, Salmonella typhimurium LT2
ccagaaguagcagagaaaagguu

SEQ ID NO: 1875290 - RNA, 21 nt, Salmonella typhimurium LT2
ccagaacaucaucuucugucc

SEQ ID NO: 1875291 - RNA, 15 nt, Salmonella typhimurium LT2
ccacuggguuuccca

SEQ ID NO: 1875292 - RNA, 19 nt, Salmonella typhimurium LT2
ccacuggcuuuccugauca

SEQ ID NO: 1875293 - RNA, 23 nt, Salmonella typhimurium LT2
ccacugguaggcauccagaugua

SEQ ID NO: 1875294 - RNA, 15 nt, Salmonella typhimurium LT2
ccacuguauuccguu

SEQ ID NO: 1875295 - RNA, 21 nt, Salmonella typhimurium LT2
ccacuucaacgccgcgcuucu

SEQ ID NO: 1875296 - RNA, 14 nt, Salmonella typhimurium LT2
ccacugugauacac

SEQ ID NO: 1875297 - RNA, 14 nt, Salmonella typhimurium LT2
ccacugcacgccag

SEQ ID NO: 1875298 - RNA, 13 nt, Salmonella typhimurium LT2
ccacuggcccccu

SEQ ID NO: 1875299 - RNA, 21 nt, Salmonella typhimurium LT2
ccacuggcagcgccugacggc

SEQ ID NO: 1875300 - RNA, 14 nt, Salmonella typhimurium LT2
ccacuggccuccca

SEQ ID NO: 1875301 - RNA, 14 nt, Salmonella typhimurium LT2
ccacgcaaaccgcu

SEQ ID NO: 1875302 - RNA, 11 nt, Salmonella typhimurium LT2
ccacgcagccg

SEQ ID NO: 1875303 - RNA, 17 nt, Salmonella typhimurium LT2
ccacgcaggcgaccucg

SEQ ID NO: 1875304 - RNA, 21 nt, Salmonella typhimurium LT2
ccacgccaauacgggagagcg

SEQ ID NO: 1875305 - RNA, 22 nt, Salmonella typhimurium LT2
ccacgccaaccaucggcacacu

SEQ ID NO: 1875306 - RNA, 14 nt, Salmonella typhimurium LT2
ccacgcgacgccag

SEQ ID NO: 1875307 - RNA, 20 nt, Salmonella typhimurium LT2
ccacgccgaccaccagcuug

SEQ ID NO: 1875308 - RNA, 16 nt, Salmonella typhimurium LT2
ccacgccgaguaauuu

SEQ ID NO: 1875309 - RNA, 20 nt, Salmonella typhimurium LT2
ccacgccgagaaacaccaga

SEQ ID NO: 1875310 - RNA, 18 nt, Salmonella typhimurium LT2
ccacgccgcuaucgacca

SEQ ID NO: 1875311 - RNA, 14 nt, Salmonella typhimurium LT2
ccacgccgccgcgu

SEQ ID NO: 1875312 - RNA, 12 nt, Salmonella typhimurium LT2
ccaccugcagca

SEQ ID NO: 1875313 - RNA, 15 nt, Salmonella typhimurium LT2
ccaccugcagcagcu

SEQ ID NO: 1875314 - RNA, 22 nt, Salmonella typhimurium LT2
ccaccggguccagucgcgccgc

SEQ ID NO: 1875315 - RNA, 18 nt, Salmonella typhimurium LT2
ccaccgguggcaucaagc

SEQ ID NO: 1875316 - RNA, 14 nt, Salmonella typhimurium LT2
ccaccgggccguca

SEQ ID NO: 1875317 - RNA, 15 nt, Salmonella typhimurium LT2
ccaccggggaucaag

SEQ ID NO: 1875318 - RNA, 15 nt, Salmonella typhimurium LT2
ccacgaaugccgaua

SEQ ID NO: 1875319 - RNA, 21 nt, Salmonella typhimurium LT2
cauuuuuugacaacaaaaaga

SEQ ID NO: 1875320 - RNA, 14 nt, Salmonella typhimurium LT2
cauuuuuuggugau

SEQ ID NO: 1875321 - RNA, 19 nt, Salmonella typhimurium LT2
ccacccgcgcgcuuuccac

SEQ ID NO: 1875322 - RNA, 17 nt, Salmonella typhimurium LT2
ccacccggcuuuuuuau

SEQ ID NO: 1875323 - RNA, 17 nt, Salmonella typhimurium LT2
ccaccgccgccaccaaa

SEQ ID NO: 1875324 - RNA, 16 nt, Salmonella typhimurium LT2
ccaccgcgcgcuuaau

SEQ ID NO: 1875325 - RNA, 12 nt, Salmonella typhimurium LT2
ccaccggcagcg

SEQ ID NO: 1875326 - RNA, 23 nt, Salmonella typhimurium LT2
ccagcccggaaauaaacgccagu

SEQ ID NO: 1875327 - RNA, 22 nt, Salmonella typhimurium LT2
ccagcccggcgcacacccugca

SEQ ID NO: 1875328 - RNA, 17 nt, Salmonella typhimurium LT2
ccagcccugccaccagc

SEQ ID NO: 1875329 - RNA, 22 nt, Salmonella typhimurium LT2
ccagcccugcgaucaucauucc

SEQ ID NO: 1875330 - RNA, 22 nt, Salmonella typhimurium LT2
ccagcccuaaaaauagcaccag

SEQ ID NO: 1875331 - RNA, 19 nt, Salmonella typhimurium LT2
ccagccgcgccaucuccuc

SEQ ID NO: 1875332 - RNA, 15 nt, Salmonella typhimurium LT2
ccagccgaucuauuu

SEQ ID NO: 1875333 - RNA, 12 nt, Salmonella typhimurium LT2
ccagccgcccgc

SEQ ID NO: 1875334 - RNA, 15 nt, Salmonella typhimurium LT2
ccagccgcagcucau

SEQ ID NO: 1875335 - RNA, 13 nt, Salmonella typhimurium LT2
ccagccgcugccu

SEQ ID NO: 1875336 - RNA, 18 nt, Salmonella typhimurium LT2
ccagccgcuuuccgccgc

SEQ ID NO: 1875337 - RNA, 23 nt, Salmonella typhimurium LT2
ccagccggagagcaguacgccaa

SEQ ID NO: 1875338 - RNA, 20 nt, Salmonella typhimurium LT2
ccagccauugcccggccucc

SEQ ID NO: 1875339 - RNA, 15 nt, Salmonella typhimurium LT2
ccagcauacaaagca

SEQ ID NO: 1875340 - RNA, 14 nt, Salmonella typhimurium LT2
ccagcauauccacc

SEQ ID NO: 1875341 - RNA, 16 nt, Salmonella typhimurium LT2
ccagcagguaucccaa

SEQ ID NO: 1875342 - RNA, 16 nt, Salmonella typhimurium LT2
ccagccuaccugccgc

SEQ ID NO: 1875343 - RNA, 23 nt, Salmonella typhimurium LT2
ccagcgaaaugacagccaccagc

SEQ ID NO: 1875344 - RNA, 15 nt, Salmonella typhimurium LT2
ccagcgacgcccagu

SEQ ID NO: 1875345 - RNA, 15 nt, Salmonella typhimurium LT2
ccagcgagccuucca

SEQ ID NO: 1875346 - RNA, 15 nt, Salmonella typhimurium LT2
ccagcgaaccgcagc

SEQ ID NO: 1875347 - RNA, 13 nt, Salmonella typhimurium LT2
ccagcgacaguag

SEQ ID NO: 1875348 - RNA, 23 nt, Salmonella typhimurium LT2
ccagcgacaguaguaucauccau

SEQ ID NO: 1875349 - RNA, 16 nt, Salmonella typhimurium LT2
ccagcgacaucccaga

SEQ ID NO: 1875350 - RNA, 17 nt, Salmonella typhimurium LT2
ccagcgcauuaccgccg

SEQ ID NO: 1875351 - RNA, 17 nt, Salmonella typhimurium LT2
ccagcgcauuccccacc

SEQ ID NO: 1875352 - RNA, 18 nt, Salmonella typhimurium LT2
ccagcgcaucgcccugcc

SEQ ID NO: 1875353 - RNA, 16 nt, Salmonella typhimurium LT2
ccagcgauccagaccg

SEQ ID NO: 1875354 - RNA, 22 nt, Salmonella typhimurium LT2
ccagcgaugagcgccagcaaca

SEQ ID NO: 1875355 - RNA, 16 nt, Salmonella typhimurium LT2
ccagcgaugagcgcca

SEQ ID NO: 1875356 - RNA, 16 nt, Salmonella typhimurium LT2
ccagcagggccacaac

SEQ ID NO: 1875357 - RNA, 23 nt, Salmonella typhimurium LT2
ccagcagcauaaaaccgccgccc

SEQ ID NO: 1875358 - RNA, 15 nt, Salmonella typhimurium LT2
ccagcagcauaaaac

SEQ ID NO: 1875359 - RNA, 14 nt, Salmonella typhimurium LT2
ccagcagcggcggg

SEQ ID NO: 1875360 - RNA, 22 nt, Salmonella typhimurium LT2
ccagcagcacaaaaaucaugcu

SEQ ID NO: 1875361 - RNA, 12 nt, Salmonella typhimurium LT2
ccagcaccagca

SEQ ID NO: 1875362 - RNA, 14 nt, Salmonella typhimurium LT2
ccagcaccagcagu

SEQ ID NO: 1875363 - RNA, 16 nt, Salmonella typhimurium LT2
ccagcaccagcagcgc

SEQ ID NO: 1875364 - RNA, 12 nt, Salmonella typhimurium LT2
ccagcaccagcg

SEQ ID NO: 1875365 - RNA, 22 nt, Salmonella typhimurium LT2
ccagcaccucaucccccagccg

SEQ ID NO: 1875366 - RNA, 15 nt, Salmonella typhimurium LT2
ccagcacgcacagcg

SEQ ID NO: 1875367 - RNA, 18 nt, Salmonella typhimurium LT2
ccagcacgcaggcauccg

SEQ ID NO: 1875368 - RNA, 16 nt, Salmonella typhimurium LT2
ccagcacgagugccag

SEQ ID NO: 1875369 - RNA, 15 nt, Salmonella typhimurium LT2
ccagcaacagcguac

SEQ ID NO: 1875370 - RNA, 22 nt, Salmonella typhimurium LT2
ccagcaaaucgcccaucacaug

SEQ ID NO: 1875371 - RNA, 16 nt, Salmonella typhimurium LT2
ccagcaccaacgccgc

SEQ ID NO: 1875372 - RNA, 17 nt, Salmonella typhimurium LT2
ccagcacagcccaguaa

SEQ ID NO: 1875373 - RNA, 15 nt, Salmonella typhimurium LT2
ccagcacagcccagu

SEQ ID NO: 1875374 - RNA, 24 nt, Salmonella typhimurium LT2
ccagcacauuacaggcaucuucca

SEQ ID NO: 1875375 - RNA, 19 nt, Salmonella typhimurium LT2
ccagcacagguacaggccg

SEQ ID NO: 1875376 - RNA, 21 nt, Salmonella typhimurium LT2
ccagcacagguacaggccgcc

SEQ ID NO: 1875377 - RNA, 16 nt, Salmonella typhimurium LT2
ccagauagggccaggc

SEQ ID NO: 1875378 - RNA, 22 nt, Salmonella typhimurium LT2
ccagauaucgcguacaggaugu

SEQ ID NO: 1875379 - RNA, 13 nt, Salmonella typhimurium LT2
ccagauacauggc

SEQ ID NO: 1875380 - RNA, 15 nt, Salmonella typhimurium LT2
ccagauaccccgcca

SEQ ID NO: 1875381 - RNA, 17 nt, Salmonella typhimurium LT2
ccagauagcccucuucc

SEQ ID NO: 1875382 - RNA, 19 nt, Salmonella typhimurium LT2
ccagaaccucacggagaaa

SEQ ID NO: 1875383 - RNA, 14 nt, Salmonella typhimurium LT2
ccagaguuuuaaaa

SEQ ID NO: 1875384 - RNA, 12 nt, Salmonella typhimurium LT2
ccagaaguagca

SEQ ID NO: 1875385 - RNA, 18 nt, Salmonella typhimurium LT2
ccagaauacacuucucaa

SEQ ID NO: 1875386 - RNA, 19 nt, Salmonella typhimurium LT2
ccagaaucaccgacagcac

SEQ ID NO: 1875387 - RNA, 14 nt, Salmonella typhimurium LT2
ccagaaucagugac

SEQ ID NO: 1875388 - RNA, 16 nt, Salmonella typhimurium LT2
ccagaaucaccucuuu

SEQ ID NO: 1875389 - RNA, 13 nt, Salmonella typhimurium LT2
ccagcaaaauaau

SEQ ID NO: 1875390 - RNA, 20 nt, Salmonella typhimurium LT2
ccagauugucgcaaaccacc

SEQ ID NO: 1875391 - RNA, 22 nt, Salmonella typhimurium LT2
ccagauugucgcaaaccaccgg

SEQ ID NO: 1875392 - RNA, 23 nt, Salmonella typhimurium LT2
ccagauugcucagguuauacugu

SEQ ID NO: 1875393 - RNA, 16 nt, Salmonella typhimurium LT2
ccagaugcgccaguac

SEQ ID NO: 1875394 - RNA, 15 nt, Salmonella typhimurium LT2
ccagaugcgccgcgc

SEQ ID NO: 1875395 - RNA, 18 nt, Salmonella typhimurium LT2
ccagauggcugcacccgg

SEQ ID NO: 1875396 - RNA, 17 nt, Salmonella typhimurium LT2
ccagauuacugcccuga

SEQ ID NO: 1875397 - RNA, 18 nt, Salmonella typhimurium LT2
ccagaugucaguaacagu

SEQ ID NO: 1875398 - RNA, 13 nt, Salmonella typhimurium LT2
ccauauucaguuu

SEQ ID NO: 1875399 - RNA, 19 nt, Salmonella typhimurium LT2
ccauaucguucaguuucaa

SEQ ID NO: 1875400 - RNA, 21 nt, Salmonella typhimurium LT2
ccauacauugaguaaauaaau

SEQ ID NO: 1875401 - RNA, 14 nt, Salmonella typhimurium LT2
ccauaucaaucaac

SEQ ID NO: 1875402 - RNA, 14 nt, Salmonella typhimurium LT2
ccauacacaccagc

SEQ ID NO: 1875403 - RNA, 15 nt, Salmonella typhimurium LT2
ccauacacaccagca

SEQ ID NO: 1875404 - RNA, 18 nt, Salmonella typhimurium LT2
ccauacacaccagcagga

SEQ ID NO: 1875405 - RNA, 16 nt, Salmonella typhimurium LT2
ccaucaggcaaucuuu

SEQ ID NO: 1875406 - RNA, 22 nt, Salmonella typhimurium LT2
ccaucaggcaaucuuuaacgcu

SEQ ID NO: 1875407 - RNA, 21 nt, Salmonella typhimurium LT2
ccaucagcgcgggauaacgca

SEQ ID NO: 1875408 - RNA, 22 nt, Salmonella typhimurium LT2
ccaucagcgucagcaccaguac

SEQ ID NO: 1875409 - RNA, 15 nt, Salmonella typhimurium LT2
ccaucagacaggcau

SEQ ID NO: 1875410 - RNA, 16 nt, Salmonella typhimurium LT2
ccaucagaucgaucuu

SEQ ID NO: 1875411 - RNA, 13 nt, Salmonella typhimurium LT2
ccaucagcaccuu

SEQ ID NO: 1875412 - RNA, 15 nt, Salmonella typhimurium LT2
ccaucagcaucauca

SEQ ID NO: 1875413 - RNA, 23 nt, Salmonella typhimurium LT2
ccaucagccgcgcuaucaaaaug

SEQ ID NO: 1875414 - RNA, 20 nt, Salmonella typhimurium LT2
ccaucagcgccagcccugcg

SEQ ID NO: 1875415 - RNA, 23 nt, Salmonella typhimurium LT2
ccaucgguucucugccaucaucc

SEQ ID NO: 1875416 - RNA, 15 nt, Salmonella typhimurium LT2
ccaucgguucucugc

SEQ ID NO: 1875417 - RNA, 22 nt, Salmonella typhimurium LT2
ccaucggcgauucaucgacaaa

SEQ ID NO: 1875418 - RNA, 15 nt, Salmonella typhimurium LT2
ccaucguccagccau

SEQ ID NO: 1875419 - RNA, 18 nt, Salmonella typhimurium LT2
ccaucgggcauucaguuu

SEQ ID NO: 1875420 - RNA, 15 nt, Salmonella typhimurium LT2
ccaucuuccggagua

SEQ ID NO: 1875421 - RNA, 16 nt, Salmonella typhimurium LT2
ccaucuuuaccaaugu

SEQ ID NO: 1875422 - RNA, 21 nt, Salmonella typhimurium LT2
ccaucggcacacuacgcagcg

SEQ ID NO: 1875423 - RNA, 23 nt, Salmonella typhimurium LT2
ccaucggcacacuacgcagcggu

SEQ ID NO: 1875424 - RNA, 15 nt, Salmonella typhimurium LT2
ccaucgccaguaccg

SEQ ID NO: 1875425 - RNA, 16 nt, Salmonella typhimurium LT2
ccaucggaguccagca

SEQ ID NO: 1875426 - RNA, 17 nt, Salmonella typhimurium LT2
ccaucgccacagcggaa

SEQ ID NO: 1875427 - RNA, 16 nt, Salmonella typhimurium LT2
ccaucgacgaaauggu

SEQ ID NO: 1875428 - RNA, 18 nt, Salmonella typhimurium LT2
ccauccggcacaaaauau

SEQ ID NO: 1875429 - RNA, 16 nt, Salmonella typhimurium LT2
ccauccggcaaaaagc

SEQ ID NO: 1875430 - RNA, 15 nt, Salmonella typhimurium LT2
ccauccggcaaaauu

SEQ ID NO: 1875431 - RNA, 16 nt, Salmonella typhimurium LT2
ccaucauuuccggcgg

SEQ ID NO: 1875432 - RNA, 22 nt, Salmonella typhimurium LT2
ccaucccugggccucgccccuu

SEQ ID NO: 1875433 - RNA, 18 nt, Salmonella typhimurium LT2
ccaucauguuaaugauuc

SEQ ID NO: 1875434 - RNA, 23 nt, Salmonella typhimurium LT2
ccaucaucaucggcacagccagu

SEQ ID NO: 1875435 - RNA, 15 nt, Salmonella typhimurium LT2
ccaguuucaaugccc

SEQ ID NO: 1875436 - RNA, 17 nt, Salmonella typhimurium LT2
ccauaacaacuauuuuu

SEQ ID NO: 1875437 - RNA, 18 nt, Salmonella typhimurium LT2
ccauaacauaucuccucu

SEQ ID NO: 1875438 - RNA, 22 nt, Salmonella typhimurium LT2
ccauaacauaucuccucugcca

SEQ ID NO: 1875439 - RNA, 13 nt, Salmonella typhimurium LT2
ccauaacccggcu

SEQ ID NO: 1875440 - RNA, 18 nt, Salmonella typhimurium LT2
ccaguugcauacauaaau

SEQ ID NO: 1875441 - RNA, 23 nt, Salmonella typhimurium LT2
ccaguugccaggguucaaccuga

SEQ ID NO: 1875442 - RNA, 19 nt, Salmonella typhimurium LT2
ccaguuggcagggcugaau

SEQ ID NO: 1875443 - RNA, 18 nt, Salmonella typhimurium LT2
ccaguuggcgaccgcugc

SEQ ID NO: 1875444 - RNA, 20 nt, Salmonella typhimurium LT2
ccaguuggcguaccaucagc

SEQ ID NO: 1875445 - RNA, 17 nt, Salmonella typhimurium LT2
ccaguuguuccagcagc

SEQ ID NO: 1875446 - RNA, 22 nt, Salmonella typhimurium LT2
ccagugcccgaacgcaauacug

SEQ ID NO: 1875447 - RNA, 15 nt, Salmonella typhimurium LT2
ccagugcaacgccuu

SEQ ID NO: 1875448 - RNA, 23 nt, Salmonella typhimurium LT2
ccaguucucaaucgccgcauggg

SEQ ID NO: 1875449 - RNA, 14 nt, Salmonella typhimurium LT2
ccagucaauaaaac

SEQ ID NO: 1875450 - RNA, 16 nt, Salmonella typhimurium LT2
ccagucaauaaaacag

SEQ ID NO: 1875451 - RNA, 23 nt, Salmonella typhimurium LT2
ccaggucgccgaugucaguucag

SEQ ID NO: 1875452 - RNA, 18 nt, Salmonella typhimurium LT2
ccaguagcgcgacgccaa

SEQ ID NO: 1875453 - RNA, 20 nt, Salmonella typhimurium LT2
ccaguagcgcgcccaugccg

SEQ ID NO: 1875454 - RNA, 13 nt, Salmonella typhimurium LT2
ccagugaaauaaa

SEQ ID NO: 1875455 - RNA, 15 nt, Salmonella typhimurium LT2
ccagugaaauaaaug

SEQ ID NO: 1875456 - RNA, 17 nt, Salmonella typhimurium LT2
ccagucuuccauuacaa

SEQ ID NO: 1875457 - RNA, 16 nt, Salmonella typhimurium LT2
ccagugaauccaccac

SEQ ID NO: 1875458 - RNA, 19 nt, Salmonella typhimurium LT2
ccagugacacguaccugcc

SEQ ID NO: 1875459 - RNA, 17 nt, Salmonella typhimurium LT2
ccagucguaguggauca

SEQ ID NO: 1875460 - RNA, 19 nt, Salmonella typhimurium LT2
ccagucgucaucccaguca

SEQ ID NO: 1875461 - RNA, 20 nt, Salmonella typhimurium LT2
ccagucgggaaacucgccgc

SEQ ID NO: 1875462 - RNA, 13 nt, Salmonella typhimurium LT2
ccagucggacagc

SEQ ID NO: 1875463 - RNA, 17 nt, Salmonella typhimurium LT2
ccagucggaaccggcaa

SEQ ID NO: 1875464 - RNA, 16 nt, Salmonella typhimurium LT2
ccagucgcuccaccac

SEQ ID NO: 1875465 - RNA, 15 nt, Salmonella typhimurium LT2
ccagucgacucaucu

SEQ ID NO: 1875466 - RNA, 18 nt, Salmonella typhimurium LT2
ccaguccugccccugcca

SEQ ID NO: 1875467 - RNA, 14 nt, Salmonella typhimurium LT2
ccaguccgugugcg

SEQ ID NO: 1875468 - RNA, 13 nt, Salmonella typhimurium LT2
ccagucccagcac

SEQ ID NO: 1875469 - RNA, 15 nt, Salmonella typhimurium LT2
ccaggcguccaguug

SEQ ID NO: 1875470 - RNA, 22 nt, Salmonella typhimurium LT2
ccaggcguuauuggcgcagcca

SEQ ID NO: 1875471 - RNA, 12 nt, Salmonella typhimurium LT2
ccaggccgcgcc

SEQ ID NO: 1875472 - RNA, 13 nt, Salmonella typhimurium LT2
ccaggccgcgccg

SEQ ID NO: 1875473 - RNA, 15 nt, Salmonella typhimurium LT2
ccaggccgccaccgc

SEQ ID NO: 1875474 - RNA, 21 nt, Salmonella typhimurium LT2
ccaggccguagcgcaucuccu

SEQ ID NO: 1875475 - RNA, 18 nt, Salmonella typhimurium LT2
ccaggccggcauaaugau

SEQ ID NO: 1875476 - RNA, 20 nt, Salmonella typhimurium LT2
ccagguauucuaacugaucc

SEQ ID NO: 1875477 - RNA, 16 nt, Salmonella typhimurium LT2
ccagguauuuagccac

SEQ ID NO: 1875478 - RNA, 21 nt, Salmonella typhimurium LT2
ccaggucagcggagaguugaa

SEQ ID NO: 1875479 - RNA, 21 nt, Salmonella typhimurium LT2
ccaggggcgaguuaagcgccc

SEQ ID NO: 1875480 - RNA, 22 nt, Salmonella typhimurium LT2
ccaggcaaagauuaccgggccc

SEQ ID NO: 1875481 - RNA, 17 nt, Salmonella typhimurium LT2
ccaggaugccaaccacc

SEQ ID NO: 1875482 - RNA, 19 nt, Salmonella typhimurium LT2
ccaggaugccaaccaccgc

SEQ ID NO: 1875483 - RNA, 21 nt, Salmonella typhimurium LT2
ccaggcauagaaaaagaacug

SEQ ID NO: 1875484 - RNA, 13 nt, Salmonella typhimurium LT2
ccaggcauagaaa

SEQ ID NO: 1875485 - RNA, 11 nt, Salmonella typhimurium LT2
ccaggcauccg

SEQ ID NO: 1875486 - RNA, 20 nt, Salmonella typhimurium LT2
ccaggcaucgacgccagcgg

SEQ ID NO: 1875487 - RNA, 18 nt, Salmonella typhimurium LT2
ccaggccaauuccgccau

SEQ ID NO: 1875488 - RNA, 23 nt, Salmonella typhimurium LT2
ccaggaaguaaauuauuccuuga

SEQ ID NO: 1875489 - RNA, 23 nt, Salmonella typhimurium LT2
ccaggacaacgccgguacgcagc

SEQ ID NO: 1875490 - RNA, 20 nt, Salmonella typhimurium LT2
ccagcugcgcgcuauuccag

SEQ ID NO: 1875491 - RNA, 21 nt, Salmonella typhimurium LT2
ccagcgcgccgccaacgccaa

SEQ ID NO: 1875492 - RNA, 15 nt, Salmonella typhimurium LT2
ccagcgcggcacagg

SEQ ID NO: 1875493 - RNA, 19 nt, Salmonella typhimurium LT2
ccagcgcgggcgaggccuc

SEQ ID NO: 1875494 - RNA, 23 nt, Salmonella typhimurium LT2
ccagcgcguaaauaccuuccggc

SEQ ID NO: 1875495 - RNA, 16 nt, Salmonella typhimurium LT2
ccagcgcgaauuugcc

SEQ ID NO: 1875496 - RNA, 16 nt, Salmonella typhimurium LT2
ccagcgccuucuucac

SEQ ID NO: 1875497 - RNA, 18 nt, Salmonella typhimurium LT2
ccagcgcgccgcagcgcc

SEQ ID NO: 1875498 - RNA, 15 nt, Salmonella typhimurium LT2
ccagcgcgccagcgc

SEQ ID NO: 1875499 - RNA, 14 nt, Salmonella typhimurium LT2
ccagcgcgccgcca

SEQ ID NO: 1875500 - RNA, 13 nt, Salmonella typhimurium LT2
ccagcgcgccguc

SEQ ID NO: 1875501 - RNA, 14 nt, Salmonella typhimurium LT2
ccagcgccagcucc

SEQ ID NO: 1875502 - RNA, 13 nt, Salmonella typhimurium LT2
ccagcgccagccg

SEQ ID NO: 1875503 - RNA, 15 nt, Salmonella typhimurium LT2
ccagcgcccccagca

SEQ ID NO: 1875504 - RNA, 19 nt, Salmonella typhimurium LT2
ccagcgccauaauccagaa

SEQ ID NO: 1875505 - RNA, 15 nt, Salmonella typhimurium LT2
ccagcgccaguacuu

SEQ ID NO: 1875506 - RNA, 16 nt, Salmonella typhimurium LT2
ccagcgccggacugac

SEQ ID NO: 1875507 - RNA, 22 nt, Salmonella typhimurium LT2
ccagcgccggauaauccagaca

SEQ ID NO: 1875508 - RNA, 18 nt, Salmonella typhimurium LT2
ccagcgccgcgacaagca

SEQ ID NO: 1875509 - RNA, 15 nt, Salmonella typhimurium LT2
ccagcuaaccuguuc

SEQ ID NO: 1875510 - RNA, 22 nt, Salmonella typhimurium LT2
ccagcucaaaugacgaauaccg

SEQ ID NO: 1875511 - RNA, 13 nt, Salmonella typhimurium LT2
ccagcuccuccga

SEQ ID NO: 1875512 - RNA, 16 nt, Salmonella typhimurium LT2
ccagcucaacgccuuu

SEQ ID NO: 1875513 - RNA, 18 nt, Salmonella typhimurium LT2
ccagcguuucuggaagua

SEQ ID NO: 1875514 - RNA, 14 nt, Salmonella typhimurium LT2
ccagcuaaccuguu

SEQ ID NO: 1875515 - RNA, 22 nt, Salmonella typhimurium LT2
ccagcuaaaccacggaaugaag

SEQ ID NO: 1875516 - RNA, 16 nt, Salmonella typhimurium LT2
ccagcguugaccagcc

SEQ ID NO: 1875517 - RNA, 21 nt, Salmonella typhimurium LT2
ccagcguugaccagccuaccu

SEQ ID NO: 1875518 - RNA, 16 nt, Salmonella typhimurium LT2
ccagcguuaaacuggc

SEQ ID NO: 1875519 - RNA, 13 nt, Salmonella typhimurium LT2
ccagcgugaaccu

SEQ ID NO: 1875520 - RNA, 22 nt, Salmonella typhimurium LT2
ccagcgucgucauagcguugau

SEQ ID NO: 1875521 - RNA, 22 nt, Salmonella typhimurium LT2
ccagcggcagaucguuuacgac

SEQ ID NO: 1875522 - RNA, 15 nt, Salmonella typhimurium LT2
ccagcgucacaggcu

SEQ ID NO: 1875523 - RNA, 16 nt, Salmonella typhimurium LT2
ccagcgcguuuuccau

SEQ ID NO: 1875524 - RNA, 18 nt, Salmonella typhimurium LT2
ccagcgcuauccaggccg

SEQ ID NO: 1875525 - RNA, 22 nt, Salmonella typhimurium LT2
ccagcggaugucggucaucagg

SEQ ID NO: 1875526 - RNA, 19 nt, Salmonella typhimurium LT2
ccagcggaacucaucauca

SEQ ID NO: 1875527 - RNA, 20 nt, Salmonella typhimurium LT2
ccagcggaacucaucaucaa

SEQ ID NO: 1875528 - RNA, 13 nt, Salmonella typhimurium LT2
cccgaaguggugg

SEQ ID NO: 1875529 - RNA, 22 nt, Salmonella typhimurium LT2
cccgaaaugguuccaggcgcgc

SEQ ID NO: 1875530 - RNA, 18 nt, Salmonella typhimurium LT2
ccccuuucgcaaucaugc

SEQ ID NO: 1875531 - RNA, 14 nt, Salmonella typhimurium LT2
ccccuuuuuugcug

SEQ ID NO: 1875532 - RNA, 15 nt, Salmonella typhimurium LT2
cccgacaucagauga

SEQ ID NO: 1875533 - RNA, 20 nt, Salmonella typhimurium LT2
cccgacacggcucgccuuug

SEQ ID NO: 1875534 - RNA, 14 nt, Salmonella typhimurium LT2
cccgaccaggacaa

SEQ ID NO: 1875535 - RNA, 20 nt, Salmonella typhimurium LT2
cccgaccaggacaaaaggcg

SEQ ID NO: 1875536 - RNA, 19 nt, Salmonella typhimurium LT2
cccgacugccaccacgcgg

SEQ ID NO: 1875537 - RNA, 17 nt, Salmonella typhimurium LT2
cccgacgaauaacaaaa

SEQ ID NO: 1875538 - RNA, 18 nt, Salmonella typhimurium LT2
ccccgcuucgucgccauc

SEQ ID NO: 1875539 - RNA, 20 nt, Salmonella typhimurium LT2
ccccugcccgcgaucgagcg

SEQ ID NO: 1875540 - RNA, 23 nt, Salmonella typhimurium LT2
ccccucggcagcaauacgcccgc

SEQ ID NO: 1875541 - RNA, 18 nt, Salmonella typhimurium LT2
ccccucggcagcaauacg

SEQ ID NO: 1875542 - RNA, 21 nt, Salmonella typhimurium LT2
ccccugaugcguauccagcgc

SEQ ID NO: 1875543 - RNA, 12 nt, Salmonella typhimurium LT2
ccccugacggga

SEQ ID NO: 1875544 - RNA, 19 nt, Salmonella typhimurium LT2
ccccugcagaugcugcugc

SEQ ID NO: 1875545 - RNA, 14 nt, Salmonella typhimurium LT2
cccgauaagcgccg

SEQ ID NO: 1875546 - RNA, 13 nt, Salmonella typhimurium LT2
cccgauacccuga

SEQ ID NO: 1875547 - RNA, 23 nt, Salmonella typhimurium LT2
cccgagcgacgcccugcccauga

SEQ ID NO: 1875548 - RNA, 18 nt, Salmonella typhimurium LT2
cccgagcggccaaaggga

SEQ ID NO: 1875549 - RNA, 16 nt, Salmonella typhimurium LT2
cccgcacgcuuucuuc

SEQ ID NO: 1875550 - RNA, 14 nt, Salmonella typhimurium LT2
cccgcacucgcgcu

SEQ ID NO: 1875551 - RNA, 21 nt, Salmonella typhimurium LT2
cccgaugucgccacgccgccc

SEQ ID NO: 1875552 - RNA, 20 nt, Salmonella typhimurium LT2
cccgauguccguuuuuucug

SEQ ID NO: 1875553 - RNA, 20 nt, Salmonella typhimurium LT2
cccgauucgcaugaauucaa

SEQ ID NO: 1875554 - RNA, 14 nt, Salmonella typhimurium LT2
cccgauucugccag

SEQ ID NO: 1875555 - RNA, 20 nt, Salmonella typhimurium LT2
cccgcaaacuaauggcgcag

SEQ ID NO: 1875556 - RNA, 21 nt, Salmonella typhimurium LT2
cccgcaaaccacgucugcgcu

SEQ ID NO: 1875557 - RNA, 22 nt, Salmonella typhimurium LT2
cccgcaaaccacgucugcgcuu

SEQ ID NO: 1875558 - RNA, 18 nt, Salmonella typhimurium LT2
cccgcaaacagagcgccg

SEQ ID NO: 1875559 - RNA, 16 nt, Salmonella typhimurium LT2
ccccaaguggaccggu

SEQ ID NO: 1875560 - RNA, 17 nt, Salmonella typhimurium LT2
ccccaaacaccaacaaa

SEQ ID NO: 1875561 - RNA, 14 nt, Salmonella typhimurium LT2
cccauuuuuuguau

SEQ ID NO: 1875562 - RNA, 22 nt, Salmonella typhimurium LT2
ccccaacgcgcuaucguugcgc

SEQ ID NO: 1875563 - RNA, 22 nt, Salmonella typhimurium LT2
ccccaccaugucaagguggugc

SEQ ID NO: 1875564 - RNA, 13 nt, Salmonella typhimurium LT2
ccccacgcccgcc

SEQ ID NO: 1875565 - RNA, 14 nt, Salmonella typhimurium LT2
cccauuaagcggga

SEQ ID NO: 1875566 - RNA, 14 nt, Salmonella typhimurium LT2
cccauguugcgccg

SEQ ID NO: 1875567 - RNA, 20 nt, Salmonella typhimurium LT2
cccauuacuccgcuauaaaa

SEQ ID NO: 1875568 - RNA, 18 nt, Salmonella typhimurium LT2
cccaggucgccgauguca

SEQ ID NO: 1875569 - RNA, 13 nt, Salmonella typhimurium LT2
cccaugaucaggc

SEQ ID NO: 1875570 - RNA, 21 nt, Salmonella typhimurium LT2
cccaugccgccugccgcgccg

SEQ ID NO: 1875571 - RNA, 18 nt, Salmonella typhimurium LT2
cccaugaugggcaagcgu

SEQ ID NO: 1875572 - RNA, 18 nt, Salmonella typhimurium LT2
cccaugauggugaacaga

SEQ ID NO: 1875573 - RNA, 18 nt, Salmonella typhimurium LT2
ccccgccaucuucacgca

SEQ ID NO: 1875574 - RNA, 19 nt, Salmonella typhimurium LT2
ccccgccaucagacaggca

SEQ ID NO: 1875575 - RNA, 13 nt, Salmonella typhimurium LT2
ccccgccccagca

SEQ ID NO: 1875576 - RNA, 24 nt, Salmonella typhimurium LT2
ccccgccauaauacacaauacgcc

SEQ ID NO: 1875577 - RNA, 13 nt, Salmonella typhimurium LT2
ccccgccgccagu

SEQ ID NO: 1875578 - RNA, 11 nt, Salmonella typhimurium LT2
ccccgccgcca

SEQ ID NO: 1875579 - RNA, 21 nt, Salmonella typhimurium LT2
ccccgcaucgcccgcccccaa

SEQ ID NO: 1875580 - RNA, 20 nt, Salmonella typhimurium LT2
ccccgaugucgccacgccgc

SEQ ID NO: 1875581 - RNA, 19 nt, Salmonella typhimurium LT2
ccccgaguaacaccgcggc

SEQ ID NO: 1875582 - RNA, 14 nt, Salmonella typhimurium LT2
cccccgagccagaa

SEQ ID NO: 1875583 - RNA, 19 nt, Salmonella typhimurium LT2
cccccaucgccagcacuuc

SEQ ID NO: 1875584 - RNA, 17 nt, Salmonella typhimurium LT2
ccccccuuuacccacca

SEQ ID NO: 1875585 - RNA, 17 nt, Salmonella typhimurium LT2
cccccauugccccaugu

SEQ ID NO: 1875586 - RNA, 12 nt, Salmonella typhimurium LT2
cccccaguuccu

SEQ ID NO: 1875587 - RNA, 11 nt, Salmonella typhimurium LT2
cccccagcuga

SEQ ID NO: 1875588 - RNA, 20 nt, Salmonella typhimurium LT2
cccccagggaugcgccacag

SEQ ID NO: 1875589 - RNA, 18 nt, Salmonella typhimurium LT2
cccccagccgcagccacc

SEQ ID NO: 1875590 - RNA, 23 nt, Salmonella typhimurium LT2
cccccacucuucaaacucuccug

SEQ ID NO: 1875591 - RNA, 12 nt, Salmonella typhimurium LT2
cccccaccaugu

SEQ ID NO: 1875592 - RNA, 13 nt, Salmonella typhimurium LT2
ccccagcaccaac

SEQ ID NO: 1875593 - RNA, 19 nt, Salmonella typhimurium LT2
ccccagaaucccgccuugc

SEQ ID NO: 1875594 - RNA, 17 nt, Salmonella typhimurium LT2
cccagcguaccacgccg

SEQ ID NO: 1875595 - RNA, 15 nt, Salmonella typhimurium LT2
cccagcguacugcca

SEQ ID NO: 1875596 - RNA, 14 nt, Salmonella typhimurium LT2
cccagcgucgccag

SEQ ID NO: 1875597 - RNA, 22 nt, Salmonella typhimurium LT2
cccagcgggugaugcgccagcc

SEQ ID NO: 1875598 - RNA, 21 nt, Salmonella typhimurium LT2
cccaggcaaaugauuaucucc

SEQ ID NO: 1875599 - RNA, 22 nt, Salmonella typhimurium LT2
cccaggggcgaguuaagcgccc

SEQ ID NO: 1875600 - RNA, 15 nt, Salmonella typhimurium LT2
cccagggcacgcucu

SEQ ID NO: 1875601 - RNA, 21 nt, Salmonella typhimurium LT2
cccaggccgccaccgccucgc

SEQ ID NO: 1875602 - RNA, 12 nt, Salmonella typhimurium LT2
cccaggccgcca

SEQ ID NO: 1875603 - RNA, 15 nt, Salmonella typhimurium LT2
cccagcgcuggcaga

SEQ ID NO: 1875604 - RNA, 12 nt, Salmonella typhimurium LT2
cccagcgcgccg

SEQ ID NO: 1875605 - RNA, 15 nt, Salmonella typhimurium LT2
cccagcgcgccgcag

SEQ ID NO: 1875606 - RNA, 22 nt, Salmonella typhimurium LT2
cccagcgcgaauuugccccaga

SEQ ID NO: 1875607 - RNA, 19 nt, Salmonella typhimurium LT2
cccagcgccagccgcgcca

SEQ ID NO: 1875608 - RNA, 17 nt, Salmonella typhimurium LT2
cccagcgcccccagcaa

SEQ ID NO: 1875609 - RNA, 12 nt, Salmonella typhimurium LT2
cccagcgccccc

SEQ ID NO: 1875610 - RNA, 19 nt, Salmonella typhimurium LT2
cccagcgauccagccgcag

SEQ ID NO: 1875611 - RNA, 20 nt, Salmonella typhimurium LT2
cccacucaaucauugucauu

SEQ ID NO: 1875612 - RNA, 12 nt, Salmonella typhimurium LT2
cccacgucagcc

SEQ ID NO: 1875613 - RNA, 19 nt, Salmonella typhimurium LT2
cccacucauccagcaaaau

SEQ ID NO: 1875614 - RNA, 16 nt, Salmonella typhimurium LT2
cccagccugcccgccu

SEQ ID NO: 1875615 - RNA, 14 nt, Salmonella typhimurium LT2
cccagcccugugcc

SEQ ID NO: 1875616 - RNA, 12 nt, Salmonella typhimurium LT2
cccagccgcagc

SEQ ID NO: 1875617 - RNA, 13 nt, Salmonella typhimurium LT2
cccagcagcagaa

SEQ ID NO: 1875618 - RNA, 21 nt, Salmonella typhimurium LT2
cccagcauauuuuccggcguc

SEQ ID NO: 1875619 - RNA, 14 nt, Salmonella typhimurium LT2
cccagcauauuaac

SEQ ID NO: 1875620 - RNA, 20 nt, Salmonella typhimurium LT2
cccagccccccuaaagcuca

SEQ ID NO: 1875621 - RNA, 20 nt, Salmonella typhimurium LT2
cccagcauauccaccaccag

SEQ ID NO: 1875622 - RNA, 18 nt, Salmonella typhimurium LT2
cccacacuaccaucggcg

SEQ ID NO: 1875623 - RNA, 14 nt, Salmonella typhimurium LT2
cccaacccgaccag

SEQ ID NO: 1875624 - RNA, 14 nt, Salmonella typhimurium LT2
cccaaccagcccag

SEQ ID NO: 1875625 - RNA, 12 nt, Salmonella typhimurium LT2
cccaaccagugg

SEQ ID NO: 1875626 - RNA, 16 nt, Salmonella typhimurium LT2
cccaacaucaguucag

SEQ ID NO: 1875627 - RNA, 15 nt, Salmonella typhimurium LT2
cccaacaccagcacu

SEQ ID NO: 1875628 - RNA, 19 nt, Salmonella typhimurium LT2
cccaaacgucguaaaaccu

SEQ ID NO: 1875629 - RNA, 14 nt, Salmonella typhimurium LT2
cccaccggaccgcc

SEQ ID NO: 1875630 - RNA, 15 nt, Salmonella typhimurium LT2
cccacgcccgccauc

SEQ ID NO: 1875631 - RNA, 22 nt, Salmonella typhimurium LT2
cccacgcggaaucgucacagac

SEQ ID NO: 1875632 - RNA, 20 nt, Salmonella typhimurium LT2
cccaccgccggauauguuuu

SEQ ID NO: 1875633 - RNA, 12 nt, Salmonella typhimurium LT2
cccaccgcgcac

SEQ ID NO: 1875634 - RNA, 12 nt, Salmonella typhimurium LT2
cccaccaccauu

SEQ ID NO: 1875635 - RNA, 12 nt, Salmonella typhimurium LT2
cccaaaauaauu

SEQ ID NO: 1875636 - RNA, 21 nt, Salmonella typhimurium LT2
ccauuuuuuuagcuuaaaaaa

SEQ ID NO: 1875637 - RNA, 10 nt, Salmonella typhimurium LT2
ccauuuuuac

SEQ ID NO: 1875638 - RNA, 11 nt, Salmonella typhimurium LT2
ccauuuuucag

SEQ ID NO: 1875639 - RNA, 19 nt, Salmonella typhimurium LT2
ccauuuuucgaucuucucc

SEQ ID NO: 1875640 - RNA, 18 nt, Salmonella typhimurium LT2
ccauuucuucuucaagcc

SEQ ID NO: 1875641 - RNA, 12 nt, Salmonella typhimurium LT2
ccauuuuaaccu

SEQ ID NO: 1875642 - RNA, 16 nt, Salmonella typhimurium LT2
ccauuuggcuuaaaua

SEQ ID NO: 1875643 - RNA, 14 nt, Salmonella typhimurium LT2
ccaucuuuuuccug

SEQ ID NO: 1875644 - RNA, 16 nt, Salmonella typhimurium LT2
ccauugaugccugccc

SEQ ID NO: 1875645 - RNA, 14 nt, Salmonella typhimurium LT2
ccauugagcagccg

SEQ ID NO: 1875646 - RNA, 20 nt, Salmonella typhimurium LT2
ccauugccgcgacaaaaagc

SEQ ID NO: 1875647 - RNA, 11 nt, Salmonella typhimurium LT2
ccauuucacaa

SEQ ID NO: 1875648 - RNA, 12 nt, Salmonella typhimurium LT2
ccauuucagccc

SEQ ID NO: 1875649 - RNA, 21 nt, Salmonella typhimurium LT2
cccggcggcgcgaugccugcc

SEQ ID NO: 1875650 - RNA, 21 nt, Salmonella typhimurium LT2
cccggcggguauggcaaugcc

SEQ ID NO: 1875651 - RNA, 19 nt, Salmonella typhimurium LT2
cccggcguaauccagcuuc

SEQ ID NO: 1875652 - RNA, 15 nt, Salmonella typhimurium LT2
cccggcguagcgcgc

SEQ ID NO: 1875653 - RNA, 17 nt, Salmonella typhimurium LT2
cccggcguaugccgggc

SEQ ID NO: 1875654 - RNA, 21 nt, Salmonella typhimurium LT2
cccggccguuaccguggcggc

SEQ ID NO: 1875655 - RNA, 9 nt, Salmonella typhimurium LT2
cccggccgc

SEQ ID NO: 1875656 - RNA, 15 nt, Salmonella typhimurium LT2
cccggcgaccacauu

SEQ ID NO: 1875657 - RNA, 15 nt, Salmonella typhimurium LT2
cccggcgacccgccc

SEQ ID NO: 1875658 - RNA, 21 nt, Salmonella typhimurium LT2
cccggcgccaaucaccgccag

SEQ ID NO: 1875659 - RNA, 17 nt, Salmonella typhimurium LT2
cccggcgcacacccugc

SEQ ID NO: 1875660 - RNA, 15 nt, Salmonella typhimurium LT2
cccgguccugcggug

SEQ ID NO: 1875661 - RNA, 19 nt, Salmonella typhimurium LT2
cccggucacauucucuucu

SEQ ID NO: 1875662 - RNA, 16 nt, Salmonella typhimurium LT2
cccggucaacgcgccg

SEQ ID NO: 1875663 - RNA, 19 nt, Salmonella typhimurium LT2
cccggugucaaagcgccag

SEQ ID NO: 1875664 - RNA, 22 nt, Salmonella typhimurium LT2
cccgguggcgccaugcuuuccg

SEQ ID NO: 1875665 - RNA, 17 nt, Salmonella typhimurium LT2
cccgguggcgccgcgcc

SEQ ID NO: 1875666 - RNA, 13 nt, Salmonella typhimurium LT2
cccggucggcgca

SEQ ID NO: 1875667 - RNA, 16 nt, Salmonella typhimurium LT2
cccggugagcgccgcg

SEQ ID NO: 1875668 - RNA, 17 nt, Salmonella typhimurium LT2
cccggugagcgccgcgc

SEQ ID NO: 1875669 - RNA, 14 nt, Salmonella typhimurium LT2
cccgggugcgcagc

SEQ ID NO: 1875670 - RNA, 12 nt, Salmonella typhimurium LT2
cccuccgccaua

SEQ ID NO: 1875671 - RNA, 21 nt, Salmonella typhimurium LT2
cccuccgcaucaaaaugaugu

SEQ ID NO: 1875672 - RNA, 17 nt, Salmonella typhimurium LT2
cccucgacaggaguaua

SEQ ID NO: 1875673 - RNA, 13 nt, Salmonella typhimurium LT2
cccuccagccagc

SEQ ID NO: 1875674 - RNA, 16 nt, Salmonella typhimurium LT2
cccuccagccagcgcc

SEQ ID NO: 1875675 - RNA, 18 nt, Salmonella typhimurium LT2
cccucaauaucuuugccu

SEQ ID NO: 1875676 - RNA, 22 nt, Salmonella typhimurium LT2
cccucaacgcccugcucccaca

SEQ ID NO: 1875677 - RNA, 14 nt, Salmonella typhimurium LT2
cccucaacgcgccc

SEQ ID NO: 1875678 - RNA, 16 nt, Salmonella typhimurium LT2
cccuaaggucacgccg

SEQ ID NO: 1875679 - RNA, 18 nt, Salmonella typhimurium LT2
cccuaacuggucaaacaa

SEQ ID NO: 1875680 - RNA, 20 nt, Salmonella typhimurium LT2
cccuaaaaauagcaccaggc

SEQ ID NO: 1875681 - RNA, 19 nt, Salmonella typhimurium LT2
cccguuuuucauccagcgg

SEQ ID NO: 1875682 - RNA, 15 nt, Salmonella typhimurium LT2
cccuaaagcucauca

SEQ ID NO: 1875683 - RNA, 15 nt, Salmonella typhimurium LT2
cccguucucgccgcg

SEQ ID NO: 1875684 - RNA, 14 nt, Salmonella typhimurium LT2
cccguuaaauacca

SEQ ID NO: 1875685 - RNA, 18 nt, Salmonella typhimurium LT2
cccguuggcuuuuguagg

SEQ ID NO: 1875686 - RNA, 21 nt, Salmonella typhimurium LT2
cccgucgccuguuucugcgcc

SEQ ID NO: 1875687 - RNA, 20 nt, Salmonella typhimurium LT2
cccgucgccuguuucugcgc

SEQ ID NO: 1875688 - RNA, 14 nt, Salmonella typhimurium LT2
cccguggcugcgcc

SEQ ID NO: 1875689 - RNA, 22 nt, Salmonella typhimurium LT2
cccguggugggguucccgagcg

SEQ ID NO: 1875690 - RNA, 23 nt, Salmonella typhimurium LT2
cccgguuuauccccgcuggcgcg

SEQ ID NO: 1875691 - RNA, 14 nt, Salmonella typhimurium LT2
cccguaauauugac

SEQ ID NO: 1875692 - RNA, 22 nt, Salmonella typhimurium LT2
cccgucaggcgcccgagcgccg

SEQ ID NO: 1875693 - RNA, 22 nt, Salmonella typhimurium LT2
cccguauucuuugcgccuuauu

SEQ ID NO: 1875694 - RNA, 21 nt, Salmonella typhimurium LT2
cccguauguaaacgcauuagu

SEQ ID NO: 1875695 - RNA, 13 nt, Salmonella typhimurium LT2
cccguccgcgcuc

SEQ ID NO: 1875696 - RNA, 23 nt, Salmonella typhimurium LT2
cccgcuccagaagcacuucucca

SEQ ID NO: 1875697 - RNA, 20 nt, Salmonella typhimurium LT2
cccgcugacguuggccgccg

SEQ ID NO: 1875698 - RNA, 15 nt, Salmonella typhimurium LT2
cccgcugaggccugc

SEQ ID NO: 1875699 - RNA, 16 nt, Salmonella typhimurium LT2
cccgcugcgccgcucc

SEQ ID NO: 1875700 - RNA, 16 nt, Salmonella typhimurium LT2
cccgcuggcgccaccg

SEQ ID NO: 1875701 - RNA, 16 nt, Salmonella typhimurium LT2
cccgcugcgucacgaa

SEQ ID NO: 1875702 - RNA, 15 nt, Salmonella typhimurium LT2
cccgcggcauggucu

SEQ ID NO: 1875703 - RNA, 17 nt, Salmonella typhimurium LT2
cccgcguuaagccccuc

SEQ ID NO: 1875704 - RNA, 23 nt, Salmonella typhimurium LT2
cccgcgugcggacguagggcugc

SEQ ID NO: 1875705 - RNA, 16 nt, Salmonella typhimurium LT2
cccgcguucugcugug

SEQ ID NO: 1875706 - RNA, 17 nt, Salmonella typhimurium LT2
cccgcgugaacacaccc

SEQ ID NO: 1875707 - RNA, 15 nt, Salmonella typhimurium LT2
cccgcuuucaccauc

SEQ ID NO: 1875708 - RNA, 21 nt, Salmonella typhimurium LT2
cccggaaauaaacgccagugg

SEQ ID NO: 1875709 - RNA, 16 nt, Salmonella typhimurium LT2
cccggagagagcaacu

SEQ ID NO: 1875710 - RNA, 20 nt, Salmonella typhimurium LT2
cccggaucgcuaauuuuuaa

SEQ ID NO: 1875711 - RNA, 21 nt, Salmonella typhimurium LT2
cccggaucggucugacgcaua

SEQ ID NO: 1875712 - RNA, 18 nt, Salmonella typhimurium LT2
cccggagggguuuucgcc

SEQ ID NO: 1875713 - RNA, 21 nt, Salmonella typhimurium LT2
cccggagagagcaacuggcaa

SEQ ID NO: 1875714 - RNA, 15 nt, Salmonella typhimurium LT2
cccggccaccgccug

SEQ ID NO: 1875715 - RNA, 21 nt, Salmonella typhimurium LT2
cccggcaauuaccgccagcgg

SEQ ID NO: 1875716 - RNA, 18 nt, Salmonella typhimurium LT2
cccggcaauuaccgccag

SEQ ID NO: 1875717 - RNA, 24 nt, Salmonella typhimurium LT2
cccggcaaccuuaaacaucgcccu

SEQ ID NO: 1875718 - RNA, 14 nt, Salmonella typhimurium LT2
cccggcagccccag

SEQ ID NO: 1875719 - RNA, 15 nt, Salmonella typhimurium LT2
cccgccagaccgaca

SEQ ID NO: 1875720 - RNA, 15 nt, Salmonella typhimurium LT2
cccgccaccgccagc

SEQ ID NO: 1875721 - RNA, 14 nt, Salmonella typhimurium LT2
cccgccaccgccgc

SEQ ID NO: 1875722 - RNA, 18 nt, Salmonella typhimurium LT2
cccgccaccaucuccuga

SEQ ID NO: 1875723 - RNA, 17 nt, Salmonella typhimurium LT2
cccgcaugguaaacgca

SEQ ID NO: 1875724 - RNA, 18 nt, Salmonella typhimurium LT2
cccgcauucgcggcaagc

SEQ ID NO: 1875725 - RNA, 10 nt, Salmonella typhimurium LT2
cccgcagcuu

SEQ ID NO: 1875726 - RNA, 15 nt, Salmonella typhimurium LT2
cccgcagccacuccc

SEQ ID NO: 1875727 - RNA, 15 nt, Salmonella typhimurium LT2
cccgcauauuuuucu

SEQ ID NO: 1875728 - RNA, 20 nt, Salmonella typhimurium LT2
cccgcaguagcuaaugauua

SEQ ID NO: 1875729 - RNA, 16 nt, Salmonella typhimurium LT2
cccgcccacaggcugc

SEQ ID NO: 1875730 - RNA, 19 nt, Salmonella typhimurium LT2
cccgccaucguccagccau

SEQ ID NO: 1875731 - RNA, 16 nt, Salmonella typhimurium LT2
cccgccauccggcauu

SEQ ID NO: 1875732 - RNA, 11 nt, Salmonella typhimurium LT2
cccgccaggcg

SEQ ID NO: 1875733 - RNA, 12 nt, Salmonella typhimurium LT2
cccgccagcaca

SEQ ID NO: 1875734 - RNA, 16 nt, Salmonella typhimurium LT2
cccgcccugcccgcca

SEQ ID NO: 1875735 - RNA, 15 nt, Salmonella typhimurium LT2
cccgccuugcggcgc

SEQ ID NO: 1875736 - RNA, 20 nt, Salmonella typhimurium LT2
cccgcgacgacaacgccugc

SEQ ID NO: 1875737 - RNA, 12 nt, Salmonella typhimurium LT2
cccgcgccagca

SEQ ID NO: 1875738 - RNA, 13 nt, Salmonella typhimurium LT2
cccgcgcauccca

SEQ ID NO: 1875739 - RNA, 22 nt, Salmonella typhimurium LT2
cccgccgcggcgguuauccucc

SEQ ID NO: 1875740 - RNA, 18 nt, Salmonella typhimurium LT2
cccgccgcgaccaacagc

SEQ ID NO: 1875741 - RNA, 23 nt, Salmonella typhimurium LT2
cccgccgcgauguuugcucgcca

SEQ ID NO: 1875742 - RNA, 18 nt, Salmonella typhimurium LT2
cccgccucaaaccaggaa

SEQ ID NO: 1875743 - RNA, 22 nt, Salmonella typhimurium LT2
cccgccgggcgucacccgccgg

SEQ ID NO: 1875744 - RNA, 23 nt, Salmonella typhimurium LT2
cccgccgggcgucacccgccggc

SEQ ID NO: 1875745 - RNA, 19 nt, Salmonella typhimurium LT2
cgguugccugcgucauccc

SEQ ID NO: 1875746 - RNA, 14 nt, Salmonella typhimurium LT2
cgguuucgaccagc

SEQ ID NO: 1875747 - RNA, 16 nt, Salmonella typhimurium LT2
cgguuguuuuucagau

SEQ ID NO: 1875748 - RNA, 22 nt, Salmonella typhimurium LT2
cgguuuuauaguagcgcgcgcu

SEQ ID NO: 1875749 - RNA, 21 nt, Salmonella typhimurium LT2
cgguuuuauuaacgugcugcc

SEQ ID NO: 1875750 - RNA, 16 nt, Salmonella typhimurium LT2
cguaaacacguuaucu

SEQ ID NO: 1875751 - RNA, 19 nt, Salmonella typhimurium LT2
cguaaccccugcccgcgau

SEQ ID NO: 1875752 - RNA, 12 nt, Salmonella typhimurium LT2
cguaaagcuggc

SEQ ID NO: 1875753 - RNA, 20 nt, Salmonella typhimurium LT2
cguaaaccccuucaccacuu

SEQ ID NO: 1875754 - RNA, 16 nt, Salmonella typhimurium LT2
cguaaacgcucgcuua

SEQ ID NO: 1875755 - RNA, 14 nt, Salmonella typhimurium LT2
cguaaagcauggcu

SEQ ID NO: 1875756 - RNA, 16 nt, Salmonella typhimurium LT2
cguaaagcgcauccag

SEQ ID NO: 1875757 - RNA, 13 nt, Salmonella typhimurium LT2
cgguuacuccuua

SEQ ID NO: 1875758 - RNA, 18 nt, Salmonella typhimurium LT2
cgguggguagcggcaauu

SEQ ID NO: 1875759 - RNA, 14 nt, Salmonella typhimurium LT2
cggugucagacacc

SEQ ID NO: 1875760 - RNA, 22 nt, Salmonella typhimurium LT2
cggucaagcuaaagauagccac

SEQ ID NO: 1875761 - RNA, 20 nt, Salmonella typhimurium LT2
cggucaacugaauuucaucc

SEQ ID NO: 1875762 - RNA, 15 nt, Salmonella typhimurium LT2
cggucauccagcggu

SEQ ID NO: 1875763 - RNA, 13 nt, Salmonella typhimurium LT2
cggucacccggca

SEQ ID NO: 1875764 - RNA, 17 nt, Salmonella typhimurium LT2
cggucauguuccaacaa

SEQ ID NO: 1875765 - RNA, 17 nt, Salmonella typhimurium LT2
cggucauuaauccccgg

SEQ ID NO: 1875766 - RNA, 22 nt, Salmonella typhimurium LT2
cggucauucauugucuuuuucu

SEQ ID NO: 1875767 - RNA, 20 nt, Salmonella typhimurium LT2
cggucgcuuuuugcgccagc

SEQ ID NO: 1875768 - RNA, 17 nt, Salmonella typhimurium LT2
cggugagaaacgcgcca

SEQ ID NO: 1875769 - RNA, 20 nt, Salmonella typhimurium LT2
cggucuccugaacgcccggc

SEQ ID NO: 1875770 - RNA, 18 nt, Salmonella typhimurium LT2
cggugaccugcauuuccc

SEQ ID NO: 1875771 - RNA, 23 nt, Salmonella typhimurium LT2
cggucguaaacacgacgccgccg

SEQ ID NO: 1875772 - RNA, 21 nt, Salmonella typhimurium LT2
cguagcuggucgccagcgccg

SEQ ID NO: 1875773 - RNA, 13 nt, Salmonella typhimurium LT2
cguagcuccagac

SEQ ID NO: 1875774 - RNA, 17 nt, Salmonella typhimurium LT2
cguagcguacugcagcg

SEQ ID NO: 1875775 - RNA, 22 nt, Salmonella typhimurium LT2
cguagccgcuuacucagccaga

SEQ ID NO: 1875776 - RNA, 20 nt, Salmonella typhimurium LT2
cguagcgcgcggauauggcg

SEQ ID NO: 1875777 - RNA, 23 nt, Salmonella typhimurium LT2
cguagcgaauaaucccggcgcca

SEQ ID NO: 1875778 - RNA, 13 nt, Salmonella typhimurium LT2
cguaggcggcgga

SEQ ID NO: 1875779 - RNA, 23 nt, Salmonella typhimurium LT2
cguagcuuugcgccagauaacca

SEQ ID NO: 1875780 - RNA, 19 nt, Salmonella typhimurium LT2
cguagcccagcgccgcauc

SEQ ID NO: 1875781 - RNA, 13 nt, Salmonella typhimurium LT2
cguagccagagcg

SEQ ID NO: 1875782 - RNA, 15 nt, Salmonella typhimurium LT2
cguaacguagcaauc

SEQ ID NO: 1875783 - RNA, 20 nt, Salmonella typhimurium LT2
cguacuuucaaacagcuggc

SEQ ID NO: 1875784 - RNA, 14 nt, Salmonella typhimurium LT2
cguacuuucgccag

SEQ ID NO: 1875785 - RNA, 15 nt, Salmonella typhimurium LT2
cguaacuaaaauacu

SEQ ID NO: 1875786 - RNA, 20 nt, Salmonella typhimurium LT2
cguaacggcugacgcccauc

SEQ ID NO: 1875787 - RNA, 15 nt, Salmonella typhimurium LT2
cguaguggcauggca

SEQ ID NO: 1875788 - RNA, 22 nt, Salmonella typhimurium LT2
cguaguagucaggaucgcuggc

SEQ ID NO: 1875789 - RNA, 19 nt, Salmonella typhimurium LT2
cguaguuggccuucuccgc

SEQ ID NO: 1875790 - RNA, 17 nt, Salmonella typhimurium LT2
cguagguucgacuccua

SEQ ID NO: 1875791 - RNA, 19 nt, Salmonella typhimurium LT2
cguauccaggguuuacugc

SEQ ID NO: 1875792 - RNA, 20 nt, Salmonella typhimurium LT2
cguauccccagucuuccugc

SEQ ID NO: 1875793 - RNA, 14 nt, Salmonella typhimurium LT2
cguaugcagccagg

SEQ ID NO: 1875794 - RNA, 20 nt, Salmonella typhimurium LT2
cguauuagcaaaucuucauu

SEQ ID NO: 1875795 - RNA, 22 nt, Salmonella typhimurium LT2
cguaugacguggccagcaugcc

SEQ ID NO: 1875796 - RNA, 20 nt, Salmonella typhimurium LT2
cguaucggugcguuuaaaga

SEQ ID NO: 1875797 - RNA, 22 nt, Salmonella typhimurium LT2
cguauucuuugcgccuuauuca

SEQ ID NO: 1875798 - RNA, 16 nt, Salmonella typhimurium LT2
cgucaaaaauaaaaaa

SEQ ID NO: 1875799 - RNA, 21 nt, Salmonella typhimurium LT2
cgucagcgauacgcacaucaa

SEQ ID NO: 1875800 - RNA, 13 nt, Salmonella typhimurium LT2
cgucagcgccucc

SEQ ID NO: 1875801 - RNA, 15 nt, Salmonella typhimurium LT2
cgucagcgccuccgc

SEQ ID NO: 1875802 - RNA, 20 nt, Salmonella typhimurium LT2
cgucagcguuuccggcgcuu

SEQ ID NO: 1875803 - RNA, 16 nt, Salmonella typhimurium LT2
cgucaggcgaagcucc

SEQ ID NO: 1875804 - RNA, 22 nt, Salmonella typhimurium LT2
cgucaggcgaagcuccgggcuc

SEQ ID NO: 1875805 - RNA, 15 nt, Salmonella typhimurium LT2
cgucaggaacgcggc

SEQ ID NO: 1875806 - RNA, 13 nt, Salmonella typhimurium LT2
cgucagccgccau

SEQ ID NO: 1875807 - RNA, 17 nt, Salmonella typhimurium LT2
cgucagacggcuccagc

SEQ ID NO: 1875808 - RNA, 19 nt, Salmonella typhimurium LT2
cgucagacggcuccagcgc

SEQ ID NO: 1875809 - RNA, 18 nt, Salmonella typhimurium LT2
cgucagaccggcaaucaa

SEQ ID NO: 1875810 - RNA, 16 nt, Salmonella typhimurium LT2
cgucauagccgcgcgu

SEQ ID NO: 1875811 - RNA, 18 nt, Salmonella typhimurium LT2
cgucaggguuuucaggaa

SEQ ID NO: 1875812 - RNA, 19 nt, Salmonella typhimurium LT2
cgucagguuuuuugugagu

SEQ ID NO: 1875813 - RNA, 12 nt, Salmonella typhimurium LT2
cgucaucaugcu

SEQ ID NO: 1875814 - RNA, 21 nt, Salmonella typhimurium LT2
cgucaucgcucaucucaagcc

SEQ ID NO: 1875815 - RNA, 18 nt, Salmonella typhimurium LT2
cgucaucgggcuguuauu

SEQ ID NO: 1875816 - RNA, 20 nt, Salmonella typhimurium LT2
cgucauccggcaaucaaacu

SEQ ID NO: 1875817 - RNA, 21 nt, Salmonella typhimurium LT2
cgucaaucaggaaagagccgc

SEQ ID NO: 1875818 - RNA, 18 nt, Salmonella typhimurium LT2
cgucaaugccgggcagac

SEQ ID NO: 1875819 - RNA, 15 nt, Salmonella typhimurium LT2
cgucaaugcugcuuu

SEQ ID NO: 1875820 - RNA, 16 nt, Salmonella typhimurium LT2
cgucaauuuccucgac

SEQ ID NO: 1875821 - RNA, 23 nt, Salmonella typhimurium LT2
cgucacaaaaacacccgcagccg

SEQ ID NO: 1875822 - RNA, 12 nt, Salmonella typhimurium LT2
cgucacaacagc

SEQ ID NO: 1875823 - RNA, 18 nt, Salmonella typhimurium LT2
cgucaccaccgcaggcag

SEQ ID NO: 1875824 - RNA, 14 nt, Salmonella typhimurium LT2
cgucaagaucgcgc

SEQ ID NO: 1875825 - RNA, 17 nt, Salmonella typhimurium LT2
cgucaacggcgcggcgu

SEQ ID NO: 1875826 - RNA, 14 nt, Salmonella typhimurium LT2
cgucaacgaccaga

SEQ ID NO: 1875827 - RNA, 16 nt, Salmonella typhimurium LT2
cgucaacaccuccagu

SEQ ID NO: 1875828 - RNA, 16 nt, Salmonella typhimurium LT2
cgucaaagaguuccug

SEQ ID NO: 1875829 - RNA, 18 nt, Salmonella typhimurium LT2
cgucaaacucuuccgggc

SEQ ID NO: 1875830 - RNA, 12 nt, Salmonella typhimurium LT2
cgucacgaccgg

SEQ ID NO: 1875831 - RNA, 18 nt, Salmonella typhimurium LT2
cgucacggcgacggccag

SEQ ID NO: 1875832 - RNA, 21 nt, Salmonella typhimurium LT2
cgucacgccuucauagagaag

SEQ ID NO: 1875833 - RNA, 15 nt, Salmonella typhimurium LT2
cgucacgauaguuuu

SEQ ID NO: 1875834 - RNA, 14 nt, Salmonella typhimurium LT2
cgucacuaacucca

SEQ ID NO: 1875835 - RNA, 16 nt, Salmonella typhimurium LT2
cgucacgguuuauccc

SEQ ID NO: 1875836 - RNA, 15 nt, Salmonella typhimurium LT2
cgucaccgccgcgcu

SEQ ID NO: 1875837 - RNA, 13 nt, Salmonella typhimurium LT2
cgucaccggcggc

SEQ ID NO: 1875838 - RNA, 15 nt, Salmonella typhimurium LT2
cgucaccgggcugca

SEQ ID NO: 1875839 - RNA, 23 nt, Salmonella typhimurium LT2
cgucaccacgguguaccccgccu

SEQ ID NO: 1875840 - RNA, 13 nt, Salmonella typhimurium LT2
cgucaccagcagg

SEQ ID NO: 1875841 - RNA, 16 nt, Salmonella typhimurium LT2
cgucacccgccggcag

SEQ ID NO: 1875842 - RNA, 13 nt, Salmonella typhimurium LT2
cgucaccgccagu

SEQ ID NO: 1875843 - RNA, 14 nt, Salmonella typhimurium LT2
cggcgcucgccagc

SEQ ID NO: 1875844 - RNA, 19 nt, Salmonella typhimurium LT2
cggcgcguuuuggcagaca

SEQ ID NO: 1875845 - RNA, 14 nt, Salmonella typhimurium LT2
cggcgcuaaccagc

SEQ ID NO: 1875846 - RNA, 15 nt, Salmonella typhimurium LT2
cggcgcuacggcgca

SEQ ID NO: 1875847 - RNA, 16 nt, Salmonella typhimurium LT2
cggcgcguucagcauc

SEQ ID NO: 1875848 - RNA, 13 nt, Salmonella typhimurium LT2
cggcgcggaaggg

SEQ ID NO: 1875849 - RNA, 16 nt, Salmonella typhimurium LT2
cggcgcgcugccgccc

SEQ ID NO: 1875850 - RNA, 17 nt, Salmonella typhimurium LT2
cggccugucuccgcagc

SEQ ID NO: 1875851 - RNA, 18 nt, Salmonella typhimurium LT2
cggccugucuccgcagca

SEQ ID NO: 1875852 - RNA, 18 nt, Salmonella typhimurium LT2
cggccuguaaacagaugc

SEQ ID NO: 1875853 - RNA, 21 nt, Salmonella typhimurium LT2
cggcguaauccagcuucaggc

SEQ ID NO: 1875854 - RNA, 13 nt, Salmonella typhimurium LT2
cggcggucugcgc

SEQ ID NO: 1875855 - RNA, 18 nt, Salmonella typhimurium LT2
cggcgggauuggucgcgc

SEQ ID NO: 1875856 - RNA, 22 nt, Salmonella typhimurium LT2
cggcgggauuggucgcgccgcg

SEQ ID NO: 1875857 - RNA, 16 nt, Salmonella typhimurium LT2
cggcgggagcucuacc

SEQ ID NO: 1875858 - RNA, 20 nt, Salmonella typhimurium LT2
cggcgggaaguuguuacgaa

SEQ ID NO: 1875859 - RNA, 22 nt, Salmonella typhimurium LT2
cggcgguaauuuacccggcggg

SEQ ID NO: 1875860 - RNA, 12 nt, Salmonella typhimurium LT2
cggcggcggcgg

SEQ ID NO: 1875861 - RNA, 17 nt, Salmonella typhimurium LT2
cggcguggcgcauucca

SEQ ID NO: 1875862 - RNA, 17 nt, Salmonella typhimurium LT2
cggcguaccgcgcgccc

SEQ ID NO: 1875863 - RNA, 21 nt, Salmonella typhimurium LT2
cggcucaaacggccugcgcug

SEQ ID NO: 1875864 - RNA, 16 nt, Salmonella typhimurium LT2
cggcuaccgaaggcgc

SEQ ID NO: 1875865 - RNA, 22 nt, Salmonella typhimurium LT2
cggcuaccucuuauccggcugc

SEQ ID NO: 1875866 - RNA, 16 nt, Salmonella typhimurium LT2
cggcucgccacggcca

SEQ ID NO: 1875867 - RNA, 18 nt, Salmonella typhimurium LT2
cggcuccuaccgccgcgu

SEQ ID NO: 1875868 - RNA, 13 nt, Salmonella typhimurium LT2
cggcucauccagc

SEQ ID NO: 1875869 - RNA, 21 nt, Salmonella typhimurium LT2
cggcuccggcaaaauggcgau

SEQ ID NO: 1875870 - RNA, 20 nt, Salmonella typhimurium LT2
cggcugcgccuuacccggcc

SEQ ID NO: 1875871 - RNA, 16 nt, Salmonella typhimurium LT2
cggcugcacaaaauac

SEQ ID NO: 1875872 - RNA, 18 nt, Salmonella typhimurium LT2
cggcugcacaaaauacug

SEQ ID NO: 1875873 - RNA, 11 nt, Salmonella typhimurium LT2
cggcugccagc

SEQ ID NO: 1875874 - RNA, 17 nt, Salmonella typhimurium LT2
cggcugcaucugcaucu

SEQ ID NO: 1875875 - RNA, 19 nt, Salmonella typhimurium LT2
cggcuguagccagccugaa

SEQ ID NO: 1875876 - RNA, 13 nt, Salmonella typhimurium LT2
cggcuguagccag

SEQ ID NO: 1875877 - RNA, 17 nt, Salmonella typhimurium LT2
cggcuguagccagccug

SEQ ID NO: 1875878 - RNA, 16 nt, Salmonella typhimurium LT2
cggcuuuccgcaccgc

SEQ ID NO: 1875879 - RNA, 16 nt, Salmonella typhimurium LT2
cggcuucgcuggucag

SEQ ID NO: 1875880 - RNA, 16 nt, Salmonella typhimurium LT2
cggcuucagcggcgca

SEQ ID NO: 1875881 - RNA, 17 nt, Salmonella typhimurium LT2
cggcuuacggcuauucu

SEQ ID NO: 1875882 - RNA, 14 nt, Salmonella typhimurium LT2
cggcuuccggcagc

SEQ ID NO: 1875883 - RNA, 19 nt, Salmonella typhimurium LT2
cggcuuaaugcccggcccg

SEQ ID NO: 1875884 - RNA, 15 nt, Salmonella typhimurium LT2
cggcuuaacgccagu

SEQ ID NO: 1875885 - RNA, 18 nt, Salmonella typhimurium LT2
cggcuuaaugcccggccc

SEQ ID NO: 1875886 - RNA, 20 nt, Salmonella typhimurium LT2
cggcuuacugcuucgcgccu

SEQ ID NO: 1875887 - RNA, 21 nt, Salmonella typhimurium LT2
cggcuuauccggccugcacga

SEQ ID NO: 1875888 - RNA, 22 nt, Salmonella typhimurium LT2
cggcuuaucguuaaggccugcg

SEQ ID NO: 1875889 - RNA, 22 nt, Salmonella typhimurium LT2
cggcuguguccgccaugugcug

SEQ ID NO: 1875890 - RNA, 14 nt, Salmonella typhimurium LT2
cgggcgacacgcgc

SEQ ID NO: 1875891 - RNA, 15 nt, Salmonella typhimurium LT2
cgggcgaccacccgc

SEQ ID NO: 1875892 - RNA, 22 nt, Salmonella typhimurium LT2
cgggccugauaagcacaggcca

SEQ ID NO: 1875893 - RNA, 15 nt, Salmonella typhimurium LT2
cgggcgauaaaccag

SEQ ID NO: 1875894 - RNA, 16 nt, Salmonella typhimurium LT2
cgggcgauaaaccagc

SEQ ID NO: 1875895 - RNA, 23 nt, Salmonella typhimurium LT2
cgggcgauaaccucucaccgccc

SEQ ID NO: 1875896 - RNA, 20 nt, Salmonella typhimurium LT2
cgggccgcgcugcgccugcu

SEQ ID NO: 1875897 - RNA, 13 nt, Salmonella typhimurium LT2
cgggccgcggcgg

SEQ ID NO: 1875898 - RNA, 20 nt, Salmonella typhimurium LT2
cgggccguugcugcgcaacg

SEQ ID NO: 1875899 - RNA, 19 nt, Salmonella typhimurium LT2
cgggccguggccaggaaua

SEQ ID NO: 1875900 - RNA, 12 nt, Salmonella typhimurium LT2
cgggccuccgcg

SEQ ID NO: 1875901 - RNA, 21 nt, Salmonella typhimurium LT2
cgggccguaaaguucccagcg

SEQ ID NO: 1875902 - RNA, 15 nt, Salmonella typhimurium LT2
cgggcacgcugacca

SEQ ID NO: 1875903 - RNA, 21 nt, Salmonella typhimurium LT2
cggcuuuugguuccuucagcu

SEQ ID NO: 1875904 - RNA, 22 nt, Salmonella typhimurium LT2
cgggaagaugugccacuccgcc

SEQ ID NO: 1875905 - RNA, 17 nt, Salmonella typhimurium LT2
cggggguaacaauaggc

SEQ ID NO: 1875906 - RNA, 15 nt, Salmonella typhimurium LT2
cgggguaaaauggac

SEQ ID NO: 1875907 - RNA, 23 nt, Salmonella typhimurium LT2
cgggcuuuugaauaaucccgcag

SEQ ID NO: 1875908 - RNA, 23 nt, Salmonella typhimurium LT2
cgggcuuccaguacgcugacgaa

SEQ ID NO: 1875909 - RNA, 17 nt, Salmonella typhimurium LT2
cgggcuuaacccaacgc

SEQ ID NO: 1875910 - RNA, 17 nt, Salmonella typhimurium LT2
cggguagaaauuccuuc

SEQ ID NO: 1875911 - RNA, 15 nt, Salmonella typhimurium LT2
cggguagagcuuuuc

SEQ ID NO: 1875912 - RNA, 19 nt, Salmonella typhimurium LT2
cggguauccauugccagau

SEQ ID NO: 1875913 - RNA, 20 nt, Salmonella typhimurium LT2
cggguauggcaaugcccccu

SEQ ID NO: 1875914 - RNA, 14 nt, Salmonella typhimurium LT2
cggguccgcccggc

SEQ ID NO: 1875915 - RNA, 19 nt, Salmonella typhimurium LT2
cgggcuaaaugcccacggc

SEQ ID NO: 1875916 - RNA, 19 nt, Salmonella typhimurium LT2
cgggcguuugugcgcgcca

SEQ ID NO: 1875917 - RNA, 23 nt, Salmonella typhimurium LT2
cgggcguuucacauuccggcgcg

SEQ ID NO: 1875918 - RNA, 24 nt, Salmonella typhimurium LT2
cgggcucgccgugccuggcgaacg

SEQ ID NO: 1875919 - RNA, 19 nt, Salmonella typhimurium LT2
cgggcguauagccaggcag

SEQ ID NO: 1875920 - RNA, 16 nt, Salmonella typhimurium LT2
cgggcgguugccacuc

SEQ ID NO: 1875921 - RNA, 17 nt, Salmonella typhimurium LT2
cgggcggcugucccaga

SEQ ID NO: 1875922 - RNA, 12 nt, Salmonella typhimurium LT2
cgggcgccacgu

SEQ ID NO: 1875923 - RNA, 15 nt, Salmonella typhimurium LT2
cgggcgcgcgcgcag

SEQ ID NO: 1875924 - RNA, 13 nt, Salmonella typhimurium LT2
cgcucucuuuuuu

SEQ ID NO: 1875925 - RNA, 18 nt, Salmonella typhimurium LT2
cgcucucuuuuggcgaca

SEQ ID NO: 1875926 - RNA, 16 nt, Salmonella typhimurium LT2
cgcugaagcccgcgau

SEQ ID NO: 1875927 - RNA, 23 nt, Salmonella typhimurium LT2
cgcugaaguaauguucaggguua

SEQ ID NO: 1875928 - RNA, 20 nt, Salmonella typhimurium LT2
cgcucuccuacaccaccagc

SEQ ID NO: 1875929 - RNA, 18 nt, Salmonella typhimurium LT2
cgcucuaucgccgcccgc

SEQ ID NO: 1875930 - RNA, 16 nt, Salmonella typhimurium LT2
cgcucuaucgccgccc

SEQ ID NO: 1875931 - RNA, 16 nt, Salmonella typhimurium LT2
cgcucguaggccagcg

SEQ ID NO: 1875932 - RNA, 14 nt, Salmonella typhimurium LT2
cgcugccacccggc

SEQ ID NO: 1875933 - RNA, 21 nt, Salmonella typhimurium LT2
cgcugccacacucucuccagu

SEQ ID NO: 1875934 - RNA, 15 nt, Salmonella typhimurium LT2
cgcugaccacgccgc

SEQ ID NO: 1875935 - RNA, 14 nt, Salmonella typhimurium LT2
cgcugaauggcaac

SEQ ID NO: 1875936 - RNA, 16 nt, Salmonella typhimurium LT2
cgcugacacgcgcagu

SEQ ID NO: 1875937 - RNA, 16 nt, Salmonella typhimurium LT2
cgcugauagccacggc

SEQ ID NO: 1875938 - RNA, 20 nt, Salmonella typhimurium LT2
cgcugauagccacggcgcau

SEQ ID NO: 1875939 - RNA, 20 nt, Salmonella typhimurium LT2
cgcugauacgcuggcacagg

SEQ ID NO: 1875940 - RNA, 15 nt, Salmonella typhimurium LT2
cgcugaguggcgggc

SEQ ID NO: 1875941 - RNA, 14 nt, Salmonella typhimurium LT2
cgcugccgcccuuu

SEQ ID NO: 1875942 - RNA, 18 nt, Salmonella typhimurium LT2
cgcugcgcuuaccgggcc

SEQ ID NO: 1875943 - RNA, 19 nt, Salmonella typhimurium LT2
cgcugcgcuuaccgggccu

SEQ ID NO: 1875944 - RNA, 18 nt, Salmonella typhimurium LT2
cgcugcgcucaucagacc

SEQ ID NO: 1875945 - RNA, 14 nt, Salmonella typhimurium LT2
cgcugcgcucgccc

SEQ ID NO: 1875946 - RNA, 17 nt, Salmonella typhimurium LT2
cgcugcgcucgcccuuc

SEQ ID NO: 1875947 - RNA, 12 nt, Salmonella typhimurium LT2
cgcugcgccgca

SEQ ID NO: 1875948 - RNA, 17 nt, Salmonella typhimurium LT2
cgcugcgccgcgccgcc

SEQ ID NO: 1875949 - RNA, 23 nt, Salmonella typhimurium LT2
cgcugcgcuuaccgggccgacag

SEQ ID NO: 1875950 - RNA, 17 nt, Salmonella typhimurium LT2
cgcugcggucaggaaug

SEQ ID NO: 1875951 - RNA, 18 nt, Salmonella typhimurium LT2
cgcugcguuugccgccuu

SEQ ID NO: 1875952 - RNA, 12 nt, Salmonella typhimurium LT2
cgcugcuccggc

SEQ ID NO: 1875953 - RNA, 18 nt, Salmonella typhimurium LT2
cgcuggaaccagguuucc

SEQ ID NO: 1875954 - RNA, 21 nt, Salmonella typhimurium LT2
cgcugcugcggcgucccccaa

SEQ ID NO: 1875955 - RNA, 23 nt, Salmonella typhimurium LT2
cgcuggagccuguuccagcugcg

SEQ ID NO: 1875956 - RNA, 16 nt, Salmonella typhimurium LT2
cgcuggcaauaaagca

SEQ ID NO: 1875957 - RNA, 21 nt, Salmonella typhimurium LT2
cgcuggcaauaaagcagggcg

SEQ ID NO: 1875958 - RNA, 15 nt, Salmonella typhimurium LT2
cgcuggcacuggcag

SEQ ID NO: 1875959 - RNA, 20 nt, Salmonella typhimurium LT2
cgcuggcgcaaagaaggcau

SEQ ID NO: 1875960 - RNA, 13 nt, Salmonella typhimurium LT2
cgcuggcgcugca

SEQ ID NO: 1875961 - RNA, 17 nt, Salmonella typhimurium LT2
cgcuuuuugcuucgcca

SEQ ID NO: 1875962 - RNA, 14 nt, Salmonella typhimurium LT2
cgcuuuuugcgcca

SEQ ID NO: 1875963 - RNA, 18 nt, Salmonella typhimurium LT2
cgcuuuuugcgccagcgc

SEQ ID NO: 1875964 - RNA, 13 nt, Salmonella typhimurium LT2
cgcuuuuccccgc

SEQ ID NO: 1875965 - RNA, 15 nt, Salmonella typhimurium LT2
cgcuuuuccccgcag

SEQ ID NO: 1875966 - RNA, 16 nt, Salmonella typhimurium LT2
cgcuuuuaggcugaaa

SEQ ID NO: 1875967 - RNA, 13 nt, Salmonella typhimurium LT2
cgcuuucauacga

SEQ ID NO: 1875968 - RNA, 14 nt, Salmonella typhimurium LT2
cgcuuuccagcggu

SEQ ID NO: 1875969 - RNA, 22 nt, Salmonella typhimurium LT2
cgcuuuccagguggugcaggcu

SEQ ID NO: 1875970 - RNA, 14 nt, Salmonella typhimurium LT2
cgcuuucccggcau

SEQ ID NO: 1875971 - RNA, 17 nt, Salmonella typhimurium LT2
cggaaacuauccuggcc

SEQ ID NO: 1875972 - RNA, 17 nt, Salmonella typhimurium LT2
cggaaagcaacagcaag

SEQ ID NO: 1875973 - RNA, 14 nt, Salmonella typhimurium LT2
cggaaaccccaggu

SEQ ID NO: 1875974 - RNA, 12 nt, Salmonella typhimurium LT2
cggaaaacguga

SEQ ID NO: 1875975 - RNA, 13 nt, Salmonella typhimurium LT2
cgcuugcauggca

SEQ ID NO: 1875976 - RNA, 18 nt, Salmonella typhimurium LT2
cgcuugcaugaccaucca

SEQ ID NO: 1875977 - RNA, 16 nt, Salmonella typhimurium LT2
cgcuugcaccauggcg

SEQ ID NO: 1875978 - RNA, 14 nt, Salmonella typhimurium LT2
cgcuuauccggccu

SEQ ID NO: 1875979 - RNA, 20 nt, Salmonella typhimurium LT2
cgcuuauucggcuuacccaa

SEQ ID NO: 1875980 - RNA, 19 nt, Salmonella typhimurium LT2
cgcuuaucccagccgcgau

SEQ ID NO: 1875981 - RNA, 14 nt, Salmonella typhimurium LT2
cgcuuaucaggccu

SEQ ID NO: 1875982 - RNA, 19 nt, Salmonella typhimurium LT2
cgcuuacucagccagauac

SEQ ID NO: 1875983 - RNA, 14 nt, Salmonella typhimurium LT2
cgcuuaccgggccu

SEQ ID NO: 1875984 - RNA, 21 nt, Salmonella typhimurium LT2
cgcuuaccacuuugcgcuccu

SEQ ID NO: 1875985 - RNA, 17 nt, Salmonella typhimurium LT2
cgcuuuaccgccuuccu

SEQ ID NO: 1875986 - RNA, 22 nt, Salmonella typhimurium LT2
cgcuuucagcgcaucgagauaa

SEQ ID NO: 1875987 - RNA, 21 nt, Salmonella typhimurium LT2
cgcuuucaaaaugacaaauuu

SEQ ID NO: 1875988 - RNA, 22 nt, Salmonella typhimurium LT2
cgcuuucaaaaugacaaauuua

SEQ ID NO: 1875989 - RNA, 22 nt, Salmonella typhimurium LT2
cgcugguuggcgcgcucgcauu

SEQ ID NO: 1875990 - RNA, 18 nt, Salmonella typhimurium LT2
cgcugguaauccguggca

SEQ ID NO: 1875991 - RNA, 17 nt, Salmonella typhimurium LT2
cgcuggucagcgcgcca

SEQ ID NO: 1875992 - RNA, 23 nt, Salmonella typhimurium LT2
cgcuggcugaaccccuguucaaa

SEQ ID NO: 1875993 - RNA, 20 nt, Salmonella typhimurium LT2
cgcuuaaugaggccaccagu

SEQ ID NO: 1875994 - RNA, 23 nt, Salmonella typhimurium LT2
cgcuuaaucaguugcaggaaggu

SEQ ID NO: 1875995 - RNA, 19 nt, Salmonella typhimurium LT2
cgcuguuuuuccgcuuuuu

SEQ ID NO: 1875996 - RNA, 19 nt, Salmonella typhimurium LT2
cgcugugauccauguugcc

SEQ ID NO: 1875997 - RNA, 15 nt, Salmonella typhimurium LT2
cgcggauugccgccc

SEQ ID NO: 1875998 - RNA, 21 nt, Salmonella typhimurium LT2
cgcggcaucguagucaggcag

SEQ ID NO: 1875999 - RNA, 15 nt, Salmonella typhimurium LT2
cgcggcaucagccug

SEQ ID NO: 1876000 - RNA, 22 nt, Salmonella typhimurium LT2
cgcggaucgucgccuugcgaca

SEQ ID NO: 1876001 - RNA, 21 nt, Salmonella typhimurium LT2
cgcgccgcuggcgaccagccu

SEQ ID NO: 1876002 - RNA, 22 nt, Salmonella typhimurium LT2
cgcggcgcugaguuucucccgc

SEQ ID NO: 1876003 - RNA, 15 nt, Salmonella typhimurium LT2
cgcggcgcucgccag

SEQ ID NO: 1876004 - RNA, 13 nt, Salmonella typhimurium LT2
cgcggcggaccgc

SEQ ID NO: 1876005 - RNA, 14 nt, Salmonella typhimurium LT2
cgcggcucaccagc

SEQ ID NO: 1876006 - RNA, 23 nt, Salmonella typhimurium LT2
cgcggcucaccagcugacgcagc

SEQ ID NO: 1876007 - RNA, 13 nt, Salmonella typhimurium LT2
cgcggcuccggcu

SEQ ID NO: 1876008 - RNA, 20 nt, Salmonella typhimurium LT2
cgcggcuguucaccacguua

SEQ ID NO: 1876009 - RNA, 15 nt, Salmonella typhimurium LT2
cgcggcugccggacu

SEQ ID NO: 1876010 - RNA, 23 nt, Salmonella typhimurium LT2
cgcggcgccgaagcaggcggaga

SEQ ID NO: 1876011 - RNA, 17 nt, Salmonella typhimurium LT2
cgcggcgcuacggcgca

SEQ ID NO: 1876012 - RNA, 14 nt, Salmonella typhimurium LT2
cgcgggccugccug

SEQ ID NO: 1876013 - RNA, 14 nt, Salmonella typhimurium LT2
cgcgucggacaggg

SEQ ID NO: 1876014 - RNA, 18 nt, Salmonella typhimurium LT2
cgcgugacgcaguaauac

SEQ ID NO: 1876015 - RNA, 17 nt, Salmonella typhimurium LT2
cgcgugauacaggcauc

SEQ ID NO: 1876016 - RNA, 15 nt, Salmonella typhimurium LT2
cgcgugcaagggaag

SEQ ID NO: 1876017 - RNA, 23 nt, Salmonella typhimurium LT2
cgcguuuuaaaccgcgauaaacc

SEQ ID NO: 1876018 - RNA, 13 nt, Salmonella typhimurium LT2
cgcguuuucucau

SEQ ID NO: 1876019 - RNA, 20 nt, Salmonella typhimurium LT2
cgcuaaacagcgccgcgaau

SEQ ID NO: 1876020 - RNA, 18 nt, Salmonella typhimurium LT2
cgcuaaaugggcaggaga

SEQ ID NO: 1876021 - RNA, 16 nt, Salmonella typhimurium LT2
cgcuaaccggcggcgu

SEQ ID NO: 1876022 - RNA, 22 nt, Salmonella typhimurium LT2
cgcuaaccagcgcuucgccugc

SEQ ID NO: 1876023 - RNA, 17 nt, Salmonella typhimurium LT2
cgcuaaccaggccagau

SEQ ID NO: 1876024 - RNA, 12 nt, Salmonella typhimurium LT2
cgcuaccuuuuu

SEQ ID NO: 1876025 - RNA, 21 nt, Salmonella typhimurium LT2
cgcuacucagcgucaucacag

SEQ ID NO: 1876026 - RNA, 15 nt, Salmonella typhimurium LT2
cgcuacugccgccau

SEQ ID NO: 1876027 - RNA, 18 nt, Salmonella typhimurium LT2
cgcuaucugcuccgccag

SEQ ID NO: 1876028 - RNA, 14 nt, Salmonella typhimurium LT2
cgcucacgcggcgc

SEQ ID NO: 1876029 - RNA, 13 nt, Salmonella typhimurium LT2
cgcucacgauaac

SEQ ID NO: 1876030 - RNA, 16 nt, Salmonella typhimurium LT2
cgcucaaaaaaggccc

SEQ ID NO: 1876031 - RNA, 16 nt, Salmonella typhimurium LT2
cgcucaacagccagaa

SEQ ID NO: 1876032 - RNA, 20 nt, Salmonella typhimurium LT2
cgcuauuccagagaguuuuc

SEQ ID NO: 1876033 - RNA, 18 nt, Salmonella typhimurium LT2
cgcuauuccagcuaccuc

SEQ ID NO: 1876034 - RNA, 18 nt, Salmonella typhimurium LT2
cgcgguauuucgccgccg

SEQ ID NO: 1876035 - RNA, 21 nt, Salmonella typhimurium LT2
cgcggucauaucuggacgggc

SEQ ID NO: 1876036 - RNA, 14 nt, Salmonella typhimurium LT2
cgcggucagcggcg

SEQ ID NO: 1876037 - RNA, 18 nt, Salmonella typhimurium LT2
cgcggucagcggcgcgcc

SEQ ID NO: 1876038 - RNA, 19 nt, Salmonella typhimurium LT2
cgcggucagcggcgcgccg

SEQ ID NO: 1876039 - RNA, 15 nt, Salmonella typhimurium LT2
cgcggucgccugccg

SEQ ID NO: 1876040 - RNA, 18 nt, Salmonella typhimurium LT2
cgcggucuuuuaaaagac

SEQ ID NO: 1876041 - RNA, 20 nt, Salmonella typhimurium LT2
cgcguaaauccacauuccag

SEQ ID NO: 1876042 - RNA, 23 nt, Salmonella typhimurium LT2
cgcgguuuucccuuuuggcgcag

SEQ ID NO: 1876043 - RNA, 17 nt, Salmonella typhimurium LT2
cgcgguugacggcuacu

SEQ ID NO: 1876044 - RNA, 13 nt, Salmonella typhimurium LT2
cgcgucccucucc

SEQ ID NO: 1876045 - RNA, 15 nt, Salmonella typhimurium LT2
cggcccacgcgcaga

SEQ ID NO: 1876046 - RNA, 18 nt, Salmonella typhimurium LT2
cggccauugccgcgccga

SEQ ID NO: 1876047 - RNA, 14 nt, Salmonella typhimurium LT2
cggcaucaggaaaa

SEQ ID NO: 1876048 - RNA, 16 nt, Salmonella typhimurium LT2
cggcaucauucugcag

SEQ ID NO: 1876049 - RNA, 14 nt, Salmonella typhimurium LT2
cggccagcgcaggc

SEQ ID NO: 1876050 - RNA, 16 nt, Salmonella typhimurium LT2
cggccagcgcaggcug

SEQ ID NO: 1876051 - RNA, 19 nt, Salmonella typhimurium LT2
cggccagcgagucgccgcu

SEQ ID NO: 1876052 - RNA, 18 nt, Salmonella typhimurium LT2
cggcccgugccagcuauc

SEQ ID NO: 1876053 - RNA, 19 nt, Salmonella typhimurium LT2
cggcccguacugaacccgg

SEQ ID NO: 1876054 - RNA, 20 nt, Salmonella typhimurium LT2
cggcccguacugaacccggg

SEQ ID NO: 1876055 - RNA, 14 nt, Salmonella typhimurium LT2
cggccugcgcugga

SEQ ID NO: 1876056 - RNA, 18 nt, Salmonella typhimurium LT2
cggccugcuuuaacgcgc

SEQ ID NO: 1876057 - RNA, 22 nt, Salmonella typhimurium LT2
cggccucuuuuuagcagcaaua

SEQ ID NO: 1876058 - RNA, 16 nt, Salmonella typhimurium LT2
cggccugcaggcaacg

SEQ ID NO: 1876059 - RNA, 16 nt, Salmonella typhimurium LT2
cggccuacaacucagc

SEQ ID NO: 1876060 - RNA, 18 nt, Salmonella typhimurium LT2
cggccuacaagccgccuc

SEQ ID NO: 1876061 - RNA, 20 nt, Salmonella typhimurium LT2
cggccuacaagccgccucgc

SEQ ID NO: 1876062 - RNA, 18 nt, Salmonella typhimurium LT2
cggccuaagaccagcacc

SEQ ID NO: 1876063 - RNA, 17 nt, Salmonella typhimurium LT2
cggccuacaaagccaaa

SEQ ID NO: 1876064 - RNA, 13 nt, Salmonella typhimurium LT2
cggccuccgguga

SEQ ID NO: 1876065 - RNA, 15 nt, Salmonella typhimurium LT2
cggccuccaccaccu

SEQ ID NO: 1876066 - RNA, 13 nt, Salmonella typhimurium LT2
cggccucccagcu

SEQ ID NO: 1876067 - RNA, 22 nt, Salmonella typhimurium LT2
cggccgcaguuuuccagcgccu

SEQ ID NO: 1876068 - RNA, 13 nt, Salmonella typhimurium LT2
cggcagcgcgcac

SEQ ID NO: 1876069 - RNA, 19 nt, Salmonella typhimurium LT2
cggcagacgauagcgggug

SEQ ID NO: 1876070 - RNA, 17 nt, Salmonella typhimurium LT2
cggcagccgccaccaca

SEQ ID NO: 1876071 - RNA, 16 nt, Salmonella typhimurium LT2
cggcagccgccaccac

SEQ ID NO: 1876072 - RNA, 15 nt, Salmonella typhimurium LT2
cggcaggccggcagc

SEQ ID NO: 1876073 - RNA, 17 nt, Salmonella typhimurium LT2
cggcaggccggcagccu

SEQ ID NO: 1876074 - RNA, 19 nt, Salmonella typhimurium LT2
cggcaggccggcagccugc

SEQ ID NO: 1876075 - RNA, 22 nt, Salmonella typhimurium LT2
cggcaggcaucgcgccgccggg

SEQ ID NO: 1876076 - RNA, 13 nt, Salmonella typhimurium LT2
cggcaggcaauac

SEQ ID NO: 1876077 - RNA, 19 nt, Salmonella typhimurium LT2
cggcaggaugaaugacugu

SEQ ID NO: 1876078 - RNA, 22 nt, Salmonella typhimurium LT2
cggcaggaugaaugacugucca

SEQ ID NO: 1876079 - RNA, 19 nt, Salmonella typhimurium LT2
cggcaggccuuucggcagc

SEQ ID NO: 1876080 - RNA, 19 nt, Salmonella typhimurium LT2
cggcaggccuaacacaugc

SEQ ID NO: 1876081 - RNA, 13 nt, Salmonella typhimurium LT2
cggcaggccgugg

SEQ ID NO: 1876082 - RNA, 20 nt, Salmonella typhimurium LT2
cggcaguguuucccaacaau

SEQ ID NO: 1876083 - RNA, 19 nt, Salmonella typhimurium LT2
cggcauaaaacgggucgcu

SEQ ID NO: 1876084 - RNA, 14 nt, Salmonella typhimurium LT2
cggcauaagccagc

SEQ ID NO: 1876085 - RNA, 17 nt, Salmonella typhimurium LT2
cggcauaagccagcccu

SEQ ID NO: 1876086 - RNA, 23 nt, Salmonella typhimurium LT2
cggcaggugauggcggcuuggcu

SEQ ID NO: 1876087 - RNA, 22 nt, Salmonella typhimurium LT2
cggcaguggcauguucccaugu

SEQ ID NO: 1876088 - RNA, 20 nt, Salmonella typhimurium LT2
cggcagucacuuucagauuu

SEQ ID NO: 1876089 - RNA, 18 nt, Salmonella typhimurium LT2
cggcaguaagccagcggg

SEQ ID NO: 1876090 - RNA, 20 nt, Salmonella typhimurium LT2
cggcaguaagccagcgggcg

SEQ ID NO: 1876091 - RNA, 17 nt, Salmonella typhimurium LT2
cggcaccccuucaggcg

SEQ ID NO: 1876092 - RNA, 13 nt, Salmonella typhimurium LT2
cggcaccagccag

SEQ ID NO: 1876093 - RNA, 11 nt, Salmonella typhimurium LT2
cggcaccagca

SEQ ID NO: 1876094 - RNA, 13 nt, Salmonella typhimurium LT2
cggcaccagaauc

SEQ ID NO: 1876095 - RNA, 17 nt, Salmonella typhimurium LT2
cggcacaucgcgcguga

SEQ ID NO: 1876096 - RNA, 24 nt, Salmonella typhimurium LT2
cggcaaaccaugaucgucaggcgc

SEQ ID NO: 1876097 - RNA, 23 nt, Salmonella typhimurium LT2
cggcaaccagcccaugaaugagc

SEQ ID NO: 1876098 - RNA, 22 nt, Salmonella typhimurium LT2
cggcaacccuuuggccaccagc

SEQ ID NO: 1876099 - RNA, 15 nt, Salmonella typhimurium LT2
cggcacgccagcgcc

SEQ ID NO: 1876100 - RNA, 13 nt, Salmonella typhimurium LT2
cggcacgcaggcu

SEQ ID NO: 1876101 - RNA, 18 nt, Salmonella typhimurium LT2
cggcacugcuuccugccg

SEQ ID NO: 1876102 - RNA, 22 nt, Salmonella typhimurium LT2
cggcagaaauuaaaucaucuug

SEQ ID NO: 1876103 - RNA, 22 nt, Salmonella typhimurium LT2
cggauugucaucugacugcgug

SEQ ID NO: 1876104 - RNA, 17 nt, Salmonella typhimurium LT2
cggauuggucugauuca

SEQ ID NO: 1876105 - RNA, 24 nt, Salmonella typhimurium LT2
cggauugccuucucugucgagcau

SEQ ID NO: 1876106 - RNA, 18 nt, Salmonella typhimurium LT2
cggauuuuaaauugguua

SEQ ID NO: 1876107 - RNA, 23 nt, Salmonella typhimurium LT2
cggcaaacacaaaaugcccuucu

SEQ ID NO: 1876108 - RNA, 23 nt, Salmonella typhimurium LT2
cggcaaacacaaucacacccagc

SEQ ID NO: 1876109 - RNA, 20 nt, Salmonella typhimurium LT2
cggauuauuggucagcaggc

SEQ ID NO: 1876110 - RNA, 14 nt, Salmonella typhimurium LT2
cggauuccagaaua

SEQ ID NO: 1876111 - RNA, 17 nt, Salmonella typhimurium LT2
cggaugcgccaucccau

SEQ ID NO: 1876112 - RNA, 14 nt, Salmonella typhimurium LT2
cggaugcgggccga

SEQ ID NO: 1876113 - RNA, 20 nt, Salmonella typhimurium LT2
cggaugcgacuccaggaaca

SEQ ID NO: 1876114 - RNA, 17 nt, Salmonella typhimurium LT2
cggaugccgcaucuuua

SEQ ID NO: 1876115 - RNA, 15 nt, Salmonella typhimurium LT2
cggaugcgccgugcu

SEQ ID NO: 1876116 - RNA, 20 nt, Salmonella typhimurium LT2
cggauggccugcucgauacc

SEQ ID NO: 1876117 - RNA, 14 nt, Salmonella typhimurium LT2
cggauggcgcugcg

SEQ ID NO: 1876118 - RNA, 22 nt, Salmonella typhimurium LT2
cggauggcguuuagcuggcggg

SEQ ID NO: 1876119 - RNA, 18 nt, Salmonella typhimurium LT2
cggaugguggcguaaaua

SEQ ID NO: 1876120 - RNA, 21 nt, Salmonella typhimurium LT2
cggaugaaacaguccggcgaa

SEQ ID NO: 1876121 - RNA, 17 nt, Salmonella typhimurium LT2
cggaugacacaucaccu

SEQ ID NO: 1876122 - RNA, 13 nt, Salmonella typhimurium LT2
cggaugaccagaa

SEQ ID NO: 1876123 - RNA, 16 nt, Salmonella typhimurium LT2
cggaugauucaguaaa

SEQ ID NO: 1876124 - RNA, 17 nt, Salmonella typhimurium LT2
cggaugauccucauaaa

SEQ ID NO: 1876125 - RNA, 15 nt, Salmonella typhimurium LT2
cggaaagaauaaucg

SEQ ID NO: 1876126 - RNA, 20 nt, Salmonella typhimurium LT2
cggaaaggacguucuucucc

SEQ ID NO: 1876127 - RNA, 12 nt, Salmonella typhimurium LT2
cggaaauggucg

SEQ ID NO: 1876128 - RNA, 20 nt, Salmonella typhimurium LT2
cggaaccuguucaugccaga

SEQ ID NO: 1876129 - RNA, 14 nt, Salmonella typhimurium LT2
cggaacggagagca

SEQ ID NO: 1876130 - RNA, 14 nt, Salmonella typhimurium LT2
cggagcaaaaaacg

SEQ ID NO: 1876131 - RNA, 22 nt, Salmonella typhimurium LT2
cggagcaaaaaacgagaacacc

SEQ ID NO: 1876132 - RNA, 15 nt, Salmonella typhimurium LT2
cggagcaucauuuuc

SEQ ID NO: 1876133 - RNA, 17 nt, Salmonella typhimurium LT2
cggagauuaacagcgcg

SEQ ID NO: 1876134 - RNA, 16 nt, Salmonella typhimurium LT2
cggagauggcgaagga

SEQ ID NO: 1876135 - RNA, 16 nt, Salmonella typhimurium LT2
cggaacuggugaaaca

SEQ ID NO: 1876136 - RNA, 19 nt, Salmonella typhimurium LT2
cggaacucacuugucuucu

SEQ ID NO: 1876137 - RNA, 21 nt, Salmonella typhimurium LT2
cggaacgucuuuuuccagcag

SEQ ID NO: 1876138 - RNA, 22 nt, Salmonella typhimurium LT2
cggaacgucuuuuuccagcagc

SEQ ID NO: 1876139 - RNA, 14 nt, Salmonella typhimurium LT2
cggaguugaugguu

SEQ ID NO: 1876140 - RNA, 15 nt, Salmonella typhimurium LT2
cggaggagugcgcca

SEQ ID NO: 1876141 - RNA, 23 nt, Salmonella typhimurium LT2
cggauaagguguuuacgccgcca

SEQ ID NO: 1876142 - RNA, 18 nt, Salmonella typhimurium LT2
cggauaaggcgcagccgc

SEQ ID NO: 1876143 - RNA, 22 nt, Salmonella typhimurium LT2
cggauaaggcgcagccgccauc

SEQ ID NO: 1876144 - RNA, 14 nt, Salmonella typhimurium LT2
cggauaaguaaguu

SEQ ID NO: 1876145 - RNA, 21 nt, Salmonella typhimurium LT2
cggauaagucgcgugaggcgu

SEQ ID NO: 1876146 - RNA, 22 nt, Salmonella typhimurium LT2
cggauaaauagugacgccgcca

SEQ ID NO: 1876147 - RNA, 13 nt, Salmonella typhimurium LT2
cggauaaauguuu

SEQ ID NO: 1876148 - RNA, 18 nt, Salmonella typhimurium LT2
cgcaguaauacgccgccg

SEQ ID NO: 1876149 - RNA, 16 nt, Salmonella typhimurium LT2
cgcagucaagcuugcc

SEQ ID NO: 1876150 - RNA, 14 nt, Salmonella typhimurium LT2
cgcauaaaaaauga

SEQ ID NO: 1876151 - RNA, 18 nt, Salmonella typhimurium LT2
cgcaguuuuccagcgccu

SEQ ID NO: 1876152 - RNA, 16 nt, Salmonella typhimurium LT2
cgcaggcggucagcac

SEQ ID NO: 1876153 - RNA, 18 nt, Salmonella typhimurium LT2
cgcaggcggucagcacag

SEQ ID NO: 1876154 - RNA, 23 nt, Salmonella typhimurium LT2
cgcaggcucgucguuuguccaac

SEQ ID NO: 1876155 - RNA, 13 nt, Salmonella typhimurium LT2
cgcaggagggagg

SEQ ID NO: 1876156 - RNA, 15 nt, Salmonella typhimurium LT2
cgcagcgcaacgccu

SEQ ID NO: 1876157 - RNA, 14 nt, Salmonella typhimurium LT2
cgcagcgccuucgc

SEQ ID NO: 1876158 - RNA, 22 nt, Salmonella typhimurium LT2
cgcagcgccuuauccaguacaa

SEQ ID NO: 1876159 - RNA, 19 nt, Salmonella typhimurium LT2
cgcagcgccauccggcaaa

SEQ ID NO: 1876160 - RNA, 21 nt, Salmonella typhimurium LT2
cgcagcgcgcugcaaaaugau

SEQ ID NO: 1876161 - RNA, 23 nt, Salmonella typhimurium LT2
cgcagcgcuuugccgcugcugcc

SEQ ID NO: 1876162 - RNA, 22 nt, Salmonella typhimurium LT2
cgcagcgaaaauccaguaauuu

SEQ ID NO: 1876163 - RNA, 18 nt, Salmonella typhimurium LT2
cgcagccuaguucugcgc

SEQ ID NO: 1876164 - RNA, 15 nt, Salmonella typhimurium LT2
cgcagccccagcgcc

SEQ ID NO: 1876165 - RNA, 16 nt, Salmonella typhimurium LT2
cgcagccgcucaauaa

SEQ ID NO: 1876166 - RNA, 23 nt, Salmonella typhimurium LT2
cgcagccacggcgcacacgccca

SEQ ID NO: 1876167 - RNA, 16 nt, Salmonella typhimurium LT2
cgcacuuuucccgcca

SEQ ID NO: 1876168 - RNA, 17 nt, Salmonella typhimurium LT2
cgcacuuugcagaccuu

SEQ ID NO: 1876169 - RNA, 16 nt, Salmonella typhimurium LT2
cgcagcagcuccccgc

SEQ ID NO: 1876170 - RNA, 19 nt, Salmonella typhimurium LT2
cgcacugauagccgccagu

SEQ ID NO: 1876171 - RNA, 14 nt, Salmonella typhimurium LT2
cgcacugcaucgaa

SEQ ID NO: 1876172 - RNA, 21 nt, Salmonella typhimurium LT2
cgcacucucaaacuauuuuua

SEQ ID NO: 1876173 - RNA, 13 nt, Salmonella typhimurium LT2
cgcacucgccgcc

SEQ ID NO: 1876174 - RNA, 22 nt, Salmonella typhimurium LT2
cgcacuggucgggcaggcuucc

SEQ ID NO: 1876175 - RNA, 12 nt, Salmonella typhimurium LT2
cgcacagcgcca

SEQ ID NO: 1876176 - RNA, 13 nt, Salmonella typhimurium LT2
cgcacaggccuga

SEQ ID NO: 1876177 - RNA, 15 nt, Salmonella typhimurium LT2
cgcacacuugcuccc

SEQ ID NO: 1876178 - RNA, 23 nt, Salmonella typhimurium LT2
cgcacagaaucgccguggcauua

SEQ ID NO: 1876179 - RNA, 20 nt, Salmonella typhimurium LT2
cgcacgccggccccgcuucc

SEQ ID NO: 1876180 - RNA, 15 nt, Salmonella typhimurium LT2
cgcaccuucaucauu

SEQ ID NO: 1876181 - RNA, 21 nt, Salmonella typhimurium LT2
cgcacgcgucaucggcgcgcu

SEQ ID NO: 1876182 - RNA, 13 nt, Salmonella typhimurium LT2
cgcacgcgcgccc

SEQ ID NO: 1876183 - RNA, 12 nt, Salmonella typhimurium LT2
cgcacgcgcgcc

SEQ ID NO: 1876184 - RNA, 14 nt, Salmonella typhimurium LT2
cgcacuccagaugc

SEQ ID NO: 1876185 - RNA, 13 nt, Salmonella typhimurium LT2
cgcacuccccaga

SEQ ID NO: 1876186 - RNA, 14 nt, Salmonella typhimurium LT2
cgcacucagaaaau

SEQ ID NO: 1876187 - RNA, 16 nt, Salmonella typhimurium LT2
cgcacgcugucgccgg

SEQ ID NO: 1876188 - RNA, 22 nt, Salmonella typhimurium LT2
cgcaaggcggcguuuuuuuauc

SEQ ID NO: 1876189 - RNA, 22 nt, Salmonella typhimurium LT2
cgcaaauccguugccgaagaaa

SEQ ID NO: 1876190 - RNA, 16 nt, Salmonella typhimurium LT2
cgcaacaacaggccag

SEQ ID NO: 1876191 - RNA, 17 nt, Salmonella typhimurium LT2
cgcaacgcgcaucaacg

SEQ ID NO: 1876192 - RNA, 23 nt, Salmonella typhimurium LT2
cgcaacgcuuaucaguccccaca

SEQ ID NO: 1876193 - RNA, 16 nt, Salmonella typhimurium LT2
cgcaacgucagcgauc

SEQ ID NO: 1876194 - RNA, 15 nt, Salmonella typhimurium LT2
cgcaacgucaguacg

SEQ ID NO: 1876195 - RNA, 22 nt, Salmonella typhimurium LT2
cgcaacgugcaggcgccgccau

SEQ ID NO: 1876196 - RNA, 23 nt, Salmonella typhimurium LT2
cgcaacguuucuuucaucagauc

SEQ ID NO: 1876197 - RNA, 21 nt, Salmonella typhimurium LT2
cgcaacguuucuuucaucaga

SEQ ID NO: 1876198 - RNA, 17 nt, Salmonella typhimurium LT2
cgauuaaugcuccaaua

SEQ ID NO: 1876199 - RNA, 16 nt, Salmonella typhimurium LT2
cgauucaaucugguga

SEQ ID NO: 1876200 - RNA, 19 nt, Salmonella typhimurium LT2
cgauucaccgugccaccgg

SEQ ID NO: 1876201 - RNA, 16 nt, Salmonella typhimurium LT2
cgcaaaauucacacca

SEQ ID NO: 1876202 - RNA, 22 nt, Salmonella typhimurium LT2
cgcaaaguuuucuuccgugccg

SEQ ID NO: 1876203 - RNA, 19 nt, Salmonella typhimurium LT2
cgcaaacugccaggcaauc

SEQ ID NO: 1876204 - RNA, 18 nt, Salmonella typhimurium LT2
cgcaaacgccugcuccgu

SEQ ID NO: 1876205 - RNA, 21 nt, Salmonella typhimurium LT2
cgcaaacgccgugaacgccaa

SEQ ID NO: 1876206 - RNA, 15 nt, Salmonella typhimurium LT2
cgcaaacaguacgcc

SEQ ID NO: 1876207 - RNA, 13 nt, Salmonella typhimurium LT2
cgauggugccgac

SEQ ID NO: 1876208 - RNA, 17 nt, Salmonella typhimurium LT2
cgaugcgguucaacgcg

SEQ ID NO: 1876209 - RNA, 23 nt, Salmonella typhimurium LT2
cgaugcgguucaacgcgcugcag

SEQ ID NO: 1876210 - RNA, 16 nt, Salmonella typhimurium LT2
cgaugaguucaguaug

SEQ ID NO: 1876211 - RNA, 14 nt, Salmonella typhimurium LT2
cgaugaugauuaau

SEQ ID NO: 1876212 - RNA, 19 nt, Salmonella typhimurium LT2
cgaugaugauuaaugcugc

SEQ ID NO: 1876213 - RNA, 15 nt, Salmonella typhimurium LT2
cgaugcgcuuuucca

SEQ ID NO: 1876214 - RNA, 19 nt, Salmonella typhimurium LT2
cgaugcgcguuuuccacca

SEQ ID NO: 1876215 - RNA, 22 nt, Salmonella typhimurium LT2
cgaucgcuuucgcuuucucuuc

SEQ ID NO: 1876216 - RNA, 16 nt, Salmonella typhimurium LT2
cgaucgcuaaucagga

SEQ ID NO: 1876217 - RNA, 21 nt, Salmonella typhimurium LT2
cgaucguuauuaagcagacug

SEQ ID NO: 1876218 - RNA, 18 nt, Salmonella typhimurium LT2
cgaucguagcaucucuuc

SEQ ID NO: 1876219 - RNA, 23 nt, Salmonella typhimurium LT2
cgaucguaaucacccgcuuccag

SEQ ID NO: 1876220 - RNA, 16 nt, Salmonella typhimurium LT2
cgaucuccgccgucgu

SEQ ID NO: 1876221 - RNA, 12 nt, Salmonella typhimurium LT2
cgaucuauuuca

SEQ ID NO: 1876222 - RNA, 18 nt, Salmonella typhimurium LT2
cgaucucaagcgccgccg

SEQ ID NO: 1876223 - RNA, 16 nt, Salmonella typhimurium LT2
cgaucuccaucuccag

SEQ ID NO: 1876224 - RNA, 20 nt, Salmonella typhimurium LT2
cgaugacgcgcagaauucug

SEQ ID NO: 1876225 - RNA, 14 nt, Salmonella typhimurium LT2
cgaugacucccagu

SEQ ID NO: 1876226 - RNA, 14 nt, Salmonella typhimurium LT2
cgaugacucauauu

SEQ ID NO: 1876227 - RNA, 13 nt, Salmonella typhimurium LT2
cgaucuucuccag

SEQ ID NO: 1876228 - RNA, 12 nt, Salmonella typhimurium LT2
cgaucugugucg

SEQ ID NO: 1876229 - RNA, 16 nt, Salmonella typhimurium LT2
cgauaucauucucuac

SEQ ID NO: 1876230 - RNA, 12 nt, Salmonella typhimurium LT2
cgaucagcgcca

SEQ ID NO: 1876231 - RNA, 15 nt, Salmonella typhimurium LT2
cgaucagcgccacca

SEQ ID NO: 1876232 - RNA, 22 nt, Salmonella typhimurium LT2
cgaucaugaaucgcgcgcgcca

SEQ ID NO: 1876233 - RNA, 13 nt, Salmonella typhimurium LT2
cgauccaggucuu

SEQ ID NO: 1876234 - RNA, 14 nt, Salmonella typhimurium LT2
cgaucccuaauaaa

SEQ ID NO: 1876235 - RNA, 21 nt, Salmonella typhimurium LT2
cgaucgaacgcuaaaucgccg

SEQ ID NO: 1876236 - RNA, 22 nt, Salmonella typhimurium LT2
cgauccuuuguaccuuuacccc

SEQ ID NO: 1876237 - RNA, 22 nt, Salmonella typhimurium LT2
ccuucagugauaaagcacagcc

SEQ ID NO: 1876238 - RNA, 15 nt, Salmonella typhimurium LT2
ccuucaucagccagc

SEQ ID NO: 1876239 - RNA, 17 nt, Salmonella typhimurium LT2
ccuucauauuucaagcc

SEQ ID NO: 1876240 - RNA, 21 nt, Salmonella typhimurium LT2
ccuucauauuucaagccgcag

SEQ ID NO: 1876241 - RNA, 23 nt, Salmonella typhimurium LT2
ccuucauucagaucaaaaaucug

SEQ ID NO: 1876242 - RNA, 21 nt, Salmonella typhimurium LT2
ccuucauuguccucggcaaca

SEQ ID NO: 1876243 - RNA, 23 nt, Salmonella typhimurium LT2
ccuucaugcaacacaaucuugau

SEQ ID NO: 1876244 - RNA, 14 nt, Salmonella typhimurium LT2
cgauaaacagauau

SEQ ID NO: 1876245 - RNA, 15 nt, Salmonella typhimurium LT2
cgauaaaccaggcag

SEQ ID NO: 1876246 - RNA, 16 nt, Salmonella typhimurium LT2
cgauaaaccaggcagc

SEQ ID NO: 1876247 - RNA, 12 nt, Salmonella typhimurium LT2
cgauaaagcugg

SEQ ID NO: 1876248 - RNA, 17 nt, Salmonella typhimurium LT2
cgauaaaguggcauccg

SEQ ID NO: 1876249 - RNA, 18 nt, Salmonella typhimurium LT2
cgauaaagcugggucagg

SEQ ID NO: 1876250 - RNA, 22 nt, Salmonella typhimurium LT2
cgauaaagcugggucaggacag

SEQ ID NO: 1876251 - RNA, 14 nt, Salmonella typhimurium LT2
cgauaaacgccagc

SEQ ID NO: 1876252 - RNA, 15 nt, Salmonella typhimurium LT2
cgauaaacucagcgc

SEQ ID NO: 1876253 - RNA, 19 nt, Salmonella typhimurium LT2
cgauaaacucagcgccagc

SEQ ID NO: 1876254 - RNA, 22 nt, Salmonella typhimurium LT2
cgauacggucaaggaaccaacg

SEQ ID NO: 1876255 - RNA, 17 nt, Salmonella typhimurium LT2
cgauacgucccugcugg

SEQ ID NO: 1876256 - RNA, 20 nt, Salmonella typhimurium LT2
cgauacgcgggccgcggcgc

SEQ ID NO: 1876257 - RNA, 13 nt, Salmonella typhimurium LT2
cgauaccggcaac

SEQ ID NO: 1876258 - RNA, 15 nt, Salmonella typhimurium LT2
cgauaacgcagcgcg

SEQ ID NO: 1876259 - RNA, 14 nt, Salmonella typhimurium LT2
cgauaaaucgccac

SEQ ID NO: 1876260 - RNA, 22 nt, Salmonella typhimurium LT2
cgauaaccggacgauuuaagcu

SEQ ID NO: 1876261 - RNA, 14 nt, Salmonella typhimurium LT2
cgauaaccagcgcg

SEQ ID NO: 1876262 - RNA, 15 nt, Salmonella typhimurium LT2
cgauaaccgccgccg

SEQ ID NO: 1876263 - RNA, 19 nt, Salmonella typhimurium LT2
cgauaaccgccgccgcgcu

SEQ ID NO: 1876264 - RNA, 19 nt, Salmonella typhimurium LT2
cgauaaccuguaaauaaua

SEQ ID NO: 1876265 - RNA, 16 nt, Salmonella typhimurium LT2
cgauauaccaugccgc

SEQ ID NO: 1876266 - RNA, 22 nt, Salmonella typhimurium LT2
cgauauagagcccucuauccac

SEQ ID NO: 1876267 - RNA, 22 nt, Salmonella typhimurium LT2
cgauacuccauugucggcagcg

SEQ ID NO: 1876268 - RNA, 13 nt, Salmonella typhimurium LT2
cgauacucugccc

SEQ ID NO: 1876269 - RNA, 15 nt, Salmonella typhimurium LT2
cgauacugacgagcg

SEQ ID NO: 1876270 - RNA, 22 nt, Salmonella typhimurium LT2
cgauacucacgacuuucaccag

SEQ ID NO: 1876271 - RNA, 22 nt, Salmonella typhimurium LT2
cgauacgcagaaccgccgcgau

SEQ ID NO: 1876272 - RNA, 22 nt, Salmonella typhimurium LT2
cgccccagaagagcgagucuuu

SEQ ID NO: 1876273 - RNA, 21 nt, Salmonella typhimurium LT2
cgcccauuagcauuccgcccg

SEQ ID NO: 1876274 - RNA, 22 nt, Salmonella typhimurium LT2
cgcccauuagcauuccgcccgc

SEQ ID NO: 1876275 - RNA, 17 nt, Salmonella typhimurium LT2
cgcccauuccgccugcc

SEQ ID NO: 1876276 - RNA, 15 nt, Salmonella typhimurium LT2
cgcccauuccgccug

SEQ ID NO: 1876277 - RNA, 16 nt, Salmonella typhimurium LT2
cgccccaaucgccagu

SEQ ID NO: 1876278 - RNA, 15 nt, Salmonella typhimurium LT2
cgccccaaucgccag

SEQ ID NO: 1876279 - RNA, 22 nt, Salmonella typhimurium LT2
cgcccccaugccgccugccgcg

SEQ ID NO: 1876280 - RNA, 22 nt, Salmonella typhimurium LT2
cgccccaguaacgcgccccaga

SEQ ID NO: 1876281 - RNA, 13 nt, Salmonella typhimurium LT2
cgcccccuccagu

SEQ ID NO: 1876282 - RNA, 17 nt, Salmonella typhimurium LT2
cgccccucgguuuaucc

SEQ ID NO: 1876283 - RNA, 19 nt, Salmonella typhimurium LT2
cgccccuucaucagccagc

SEQ ID NO: 1876284 - RNA, 22 nt, Salmonella typhimurium LT2
cgcccgauaauaucacucccgc

SEQ ID NO: 1876285 - RNA, 20 nt, Salmonella typhimurium LT2
cgcccgcuugcaccauggcg

SEQ ID NO: 1876286 - RNA, 17 nt, Salmonella typhimurium LT2
cgcccggauaacggcgc

SEQ ID NO: 1876287 - RNA, 12 nt, Salmonella typhimurium LT2
cgcccgcggcga

SEQ ID NO: 1876288 - RNA, 14 nt, Salmonella typhimurium LT2
cgcccgccgccagc

SEQ ID NO: 1876289 - RNA, 15 nt, Salmonella typhimurium LT2
cgcccgcccgccucg

SEQ ID NO: 1876290 - RNA, 13 nt, Salmonella typhimurium LT2
cgcccgccgcgag

SEQ ID NO: 1876291 - RNA, 14 nt, Salmonella typhimurium LT2
cgcccgccgcgagc

SEQ ID NO: 1876292 - RNA, 14 nt, Salmonella typhimurium LT2
cgcccgcaaaagcg

SEQ ID NO: 1876293 - RNA, 13 nt, Salmonella typhimurium LT2
cgccauccggcau

SEQ ID NO: 1876294 - RNA, 17 nt, Salmonella typhimurium LT2
cgccauccggcauuuuu

SEQ ID NO: 1876295 - RNA, 14 nt, Salmonella typhimurium LT2
cgccauccggcaac

SEQ ID NO: 1876296 - RNA, 14 nt, Salmonella typhimurium LT2
cgccauccggcaau

SEQ ID NO: 1876297 - RNA, 14 nt, Salmonella typhimurium LT2
cgccauccggcaaa

SEQ ID NO: 1876298 - RNA, 14 nt, Salmonella typhimurium LT2
cgccauccaccagg

SEQ ID NO: 1876299 - RNA, 16 nt, Salmonella typhimurium LT2
cgccaucgacagcagc

SEQ ID NO: 1876300 - RNA, 16 nt, Salmonella typhimurium LT2
cgccaucgacauauug

SEQ ID NO: 1876301 - RNA, 14 nt, Salmonella typhimurium LT2
cgccauccggccug

SEQ ID NO: 1876302 - RNA, 14 nt, Salmonella typhimurium LT2
cgccaucaggcaug

SEQ ID NO: 1876303 - RNA, 20 nt, Salmonella typhimurium LT2
cgccaucaggcaugccaaac

SEQ ID NO: 1876304 - RNA, 12 nt, Salmonella typhimurium LT2
cgccauccacgg

SEQ ID NO: 1876305 - RNA, 21 nt, Salmonella typhimurium LT2
cgccaucaggcaugccaaacc

SEQ ID NO: 1876306 - RNA, 14 nt, Salmonella typhimurium LT2
cgccaucaggccua

SEQ ID NO: 1876307 - RNA, 15 nt, Salmonella typhimurium LT2
cgccaucaggccuac

SEQ ID NO: 1876308 - RNA, 17 nt, Salmonella typhimurium LT2
cgccaucgccgccucgc

SEQ ID NO: 1876309 - RNA, 12 nt, Salmonella typhimurium LT2
cgccaucgccag

SEQ ID NO: 1876310 - RNA, 18 nt, Salmonella typhimurium LT2
cgccaucguuccgguucu

SEQ ID NO: 1876311 - RNA, 18 nt, Salmonella typhimurium LT2
cgccaugauucaucccgc

SEQ ID NO: 1876312 - RNA, 19 nt, Salmonella typhimurium LT2
cgccaugacgcaccgugga

SEQ ID NO: 1876313 - RNA, 16 nt, Salmonella typhimurium LT2
cgccaucuuucaccca

SEQ ID NO: 1876314 - RNA, 15 nt, Salmonella typhimurium LT2
cgccaucuucacgca

SEQ ID NO: 1876315 - RNA, 23 nt, Salmonella typhimurium LT2
cgccauuggcucggcgucauccc

SEQ ID NO: 1876316 - RNA, 16 nt, Salmonella typhimurium LT2
cgccauuugcgcggcu

SEQ ID NO: 1876317 - RNA, 20 nt, Salmonella typhimurium LT2
cgcccaaaaugcggcauccg

SEQ ID NO: 1876318 - RNA, 18 nt, Salmonella typhimurium LT2
cgcccaaccagcccaggu

SEQ ID NO: 1876319 - RNA, 22 nt, Salmonella typhimurium LT2
cgcccaaauaguccagcagcca

SEQ ID NO: 1876320 - RNA, 17 nt, Salmonella typhimurium LT2
cgcccacaaugacagaa

SEQ ID NO: 1876321 - RNA, 22 nt, Salmonella typhimurium LT2
cgcccacaggcugcggcacgcu

SEQ ID NO: 1876322 - RNA, 17 nt, Salmonella typhimurium LT2
cgccauucccgcgacgu

SEQ ID NO: 1876323 - RNA, 17 nt, Salmonella typhimurium LT2
cgccaugcuuuccgggc

SEQ ID NO: 1876324 - RNA, 11 nt, Salmonella typhimurium LT2
cgcccagcagc

SEQ ID NO: 1876325 - RNA, 20 nt, Salmonella typhimurium LT2
cgcccagcagggccacaacg

SEQ ID NO: 1876326 - RNA, 12 nt, Salmonella typhimurium LT2
cgcccagauguu

SEQ ID NO: 1876327 - RNA, 18 nt, Salmonella typhimurium LT2
cgcccagauauccgcgcu

SEQ ID NO: 1876328 - RNA, 18 nt, Salmonella typhimurium LT2
cgcccaccugcagcagcu

SEQ ID NO: 1876329 - RNA, 14 nt, Salmonella typhimurium LT2
cgcccacgcggcgu

SEQ ID NO: 1876330 - RNA, 13 nt, Salmonella typhimurium LT2
cgcccaggccuga

SEQ ID NO: 1876331 - RNA, 12 nt, Salmonella typhimurium LT2
cgcccaggccug

SEQ ID NO: 1876332 - RNA, 16 nt, Salmonella typhimurium LT2
cgcccaggucgcccag

SEQ ID NO: 1876333 - RNA, 12 nt, Salmonella typhimurium LT2
cgcccaggucug

SEQ ID NO: 1876334 - RNA, 23 nt, Salmonella typhimurium LT2
cgcccaggucugaugagcgcagc

SEQ ID NO: 1876335 - RNA, 20 nt, Salmonella typhimurium LT2
cgcccaucaauaccagcccc

SEQ ID NO: 1876336 - RNA, 22 nt, Salmonella typhimurium LT2
cgcccaucaauaccagccccac

SEQ ID NO: 1876337 - RNA, 12 nt, Salmonella typhimurium LT2
cgcccagucacg

SEQ ID NO: 1876338 - RNA, 14 nt, Salmonella typhimurium LT2
cgcccaucgccaca

SEQ ID NO: 1876339 - RNA, 18 nt, Salmonella typhimurium LT2
cgcccaucgccgccuccg

SEQ ID NO: 1876340 - RNA, 15 nt, Salmonella typhimurium LT2
cgcccaucacaugua

SEQ ID NO: 1876341 - RNA, 13 nt, Salmonella typhimurium LT2
cgccagccaaacc

SEQ ID NO: 1876342 - RNA, 14 nt, Salmonella typhimurium LT2
cgccagcauaucca

SEQ ID NO: 1876343 - RNA, 16 nt, Salmonella typhimurium LT2
cgccagcaguugcagc

SEQ ID NO: 1876344 - RNA, 23 nt, Salmonella typhimurium LT2
cgccagccugacgaccauugcca

SEQ ID NO: 1876345 - RNA, 23 nt, Salmonella typhimurium LT2
cgccagccgcgccaucuccuccu

SEQ ID NO: 1876346 - RNA, 15 nt, Salmonella typhimurium LT2
cgccagccgcgccau

SEQ ID NO: 1876347 - RNA, 13 nt, Salmonella typhimurium LT2
cgccagccgcagc

SEQ ID NO: 1876348 - RNA, 17 nt, Salmonella typhimurium LT2
cgccacgaguggcgcgg

SEQ ID NO: 1876349 - RNA, 13 nt, Salmonella typhimurium LT2
cgccaccuuugac

SEQ ID NO: 1876350 - RNA, 14 nt, Salmonella typhimurium LT2
cgccacgucggcga

SEQ ID NO: 1876351 - RNA, 15 nt, Salmonella typhimurium LT2
cgccacgguugucaa

SEQ ID NO: 1876352 - RNA, 22 nt, Salmonella typhimurium LT2
cgccacgguugucaaauuugcu

SEQ ID NO: 1876353 - RNA, 14 nt, Salmonella typhimurium LT2
cgccagcaccaggc

SEQ ID NO: 1876354 - RNA, 16 nt, Salmonella typhimurium LT2
cgccagcaccaggcuc

SEQ ID NO: 1876355 - RNA, 22 nt, Salmonella typhimurium LT2
cgccacucagcgcuguuuuucc

SEQ ID NO: 1876356 - RNA, 14 nt, Salmonella typhimurium LT2
cgccacuaccagcg

SEQ ID NO: 1876357 - RNA, 14 nt, Salmonella typhimurium LT2
cgccagcagcagcu

SEQ ID NO: 1876358 - RNA, 17 nt, Salmonella typhimurium LT2
cgccagcagcagcuugc

SEQ ID NO: 1876359 - RNA, 13 nt, Salmonella typhimurium LT2
cgccagcacuucc

SEQ ID NO: 1876360 - RNA, 22 nt, Salmonella typhimurium LT2
cgccacaaaggaucauuggcca

SEQ ID NO: 1876361 - RNA, 15 nt, Salmonella typhimurium LT2
cgccaaucuguaauu

SEQ ID NO: 1876362 - RNA, 16 nt, Salmonella typhimurium LT2
cgccaauuaaauaucc

SEQ ID NO: 1876363 - RNA, 22 nt, Salmonella typhimurium LT2
cgcauacaucgcagacauggca

SEQ ID NO: 1876364 - RNA, 16 nt, Salmonella typhimurium LT2
cgcauaagcuuauaaa

SEQ ID NO: 1876365 - RNA, 16 nt, Salmonella typhimurium LT2
cgcauaauccagcagg

SEQ ID NO: 1876366 - RNA, 17 nt, Salmonella typhimurium LT2
cgccacaccgagacaga

SEQ ID NO: 1876367 - RNA, 22 nt, Salmonella typhimurium LT2
cgccacagcggaauagacggcc

SEQ ID NO: 1876368 - RNA, 15 nt, Salmonella typhimurium LT2
cgccacaugcggcag

SEQ ID NO: 1876369 - RNA, 12 nt, Salmonella typhimurium LT2
cgccaccacaaa

SEQ ID NO: 1876370 - RNA, 12 nt, Salmonella typhimurium LT2
cgccaccaaaaa

SEQ ID NO: 1876371 - RNA, 22 nt, Salmonella typhimurium LT2
cgccaccgggccgucagggucu

SEQ ID NO: 1876372 - RNA, 21 nt, Salmonella typhimurium LT2
cgccaccugcguggucauccg

SEQ ID NO: 1876373 - RNA, 19 nt, Salmonella typhimurium LT2
cgccaccgggcaacacacg

SEQ ID NO: 1876374 - RNA, 22 nt, Salmonella typhimurium LT2
cgccaccgggcaacacacgcuu

SEQ ID NO: 1876375 - RNA, 21 nt, Salmonella typhimurium LT2
cgccaccaucgucgccagacc

SEQ ID NO: 1876376 - RNA, 17 nt, Salmonella typhimurium LT2
cgccaccauccggcgcu

SEQ ID NO: 1876377 - RNA, 20 nt, Salmonella typhimurium LT2
cgccaccacgcccaacgacc

SEQ ID NO: 1876378 - RNA, 14 nt, Salmonella typhimurium LT2
cgccaguaucggca

SEQ ID NO: 1876379 - RNA, 17 nt, Salmonella typhimurium LT2
cgccaguaucggcagga

SEQ ID NO: 1876380 - RNA, 17 nt, Salmonella typhimurium LT2
cgccagucaccagcagc

SEQ ID NO: 1876381 - RNA, 23 nt, Salmonella typhimurium LT2
cgccaguaauuuuucucccagca

SEQ ID NO: 1876382 - RNA, 15 nt, Salmonella typhimurium LT2
cgccagucccagcac

SEQ ID NO: 1876383 - RNA, 15 nt, Salmonella typhimurium LT2
cgccagucggucaac

SEQ ID NO: 1876384 - RNA, 11 nt, Salmonella typhimurium LT2
cgccagugaca

SEQ ID NO: 1876385 - RNA, 16 nt, Salmonella typhimurium LT2
cgccagugaauccacc

SEQ ID NO: 1876386 - RNA, 18 nt, Salmonella typhimurium LT2
cgccagugaauccaccac

SEQ ID NO: 1876387 - RNA, 22 nt, Salmonella typhimurium LT2
cgccagggcgggauccccugcu

SEQ ID NO: 1876388 - RNA, 14 nt, Salmonella typhimurium LT2
cgccaggcuaagau

SEQ ID NO: 1876389 - RNA, 23 nt, Salmonella typhimurium LT2
cgccaggucggcuuuuuuaugcc

SEQ ID NO: 1876390 - RNA, 17 nt, Salmonella typhimurium LT2
cgccauaauccacaacg

SEQ ID NO: 1876391 - RNA, 15 nt, Salmonella typhimurium LT2
cgccauaaagcugua

SEQ ID NO: 1876392 - RNA, 20 nt, Salmonella typhimurium LT2
cgccauaagcgaacaggccg

SEQ ID NO: 1876393 - RNA, 14 nt, Salmonella typhimurium LT2
cgccauaauacaca

SEQ ID NO: 1876394 - RNA, 16 nt, Salmonella typhimurium LT2
cgccauacuuacugcu

SEQ ID NO: 1876395 - RNA, 14 nt, Salmonella typhimurium LT2
cgccauauacgcca

SEQ ID NO: 1876396 - RNA, 20 nt, Salmonella typhimurium LT2
cgccauauaggcauguuccu

SEQ ID NO: 1876397 - RNA, 15 nt, Salmonella typhimurium LT2
cgccauauccaagcc

SEQ ID NO: 1876398 - RNA, 13 nt, Salmonella typhimurium LT2
cgccauaucggca

SEQ ID NO: 1876399 - RNA, 17 nt, Salmonella typhimurium LT2
cgccaucaccaggucaa

SEQ ID NO: 1876400 - RNA, 19 nt, Salmonella typhimurium LT2
cgccaguuugguuaauucc

SEQ ID NO: 1876401 - RNA, 17 nt, Salmonella typhimurium LT2
cgccaguuucuuuuucc

SEQ ID NO: 1876402 - RNA, 22 nt, Salmonella typhimurium LT2
cgccagugcuuuuaacgcuucc

SEQ ID NO: 1876403 - RNA, 22 nt, Salmonella typhimurium LT2
cgccaguucauucgccaccagg

SEQ ID NO: 1876404 - RNA, 17 nt, Salmonella typhimurium LT2
cgccaguuccaucauug

SEQ ID NO: 1876405 - RNA, 19 nt, Salmonella typhimurium LT2
cgccaguuccgccacggcg

SEQ ID NO: 1876406 - RNA, 17 nt, Salmonella typhimurium LT2
cgccaguucaauaucca

SEQ ID NO: 1876407 - RNA, 17 nt, Salmonella typhimurium LT2
cgccaguucauccagca

SEQ ID NO: 1876408 - RNA, 19 nt, Salmonella typhimurium LT2
cgccaggccaucgccgcca

SEQ ID NO: 1876409 - RNA, 11 nt, Salmonella typhimurium LT2
cgccaggccaa

SEQ ID NO: 1876410 - RNA, 13 nt, Salmonella typhimurium LT2
cgccaggcaaccu

SEQ ID NO: 1876411 - RNA, 14 nt, Salmonella typhimurium LT2
cgccaggcggccug

SEQ ID NO: 1876412 - RNA, 21 nt, Salmonella typhimurium LT2
cgccagcucaugcgcggcggg

SEQ ID NO: 1876413 - RNA, 19 nt, Salmonella typhimurium LT2
cgccagcuuaucgaccagc

SEQ ID NO: 1876414 - RNA, 18 nt, Salmonella typhimurium LT2
cgccagcgguguuugcca

SEQ ID NO: 1876415 - RNA, 13 nt, Salmonella typhimurium LT2
cgccagcggcagc

SEQ ID NO: 1876416 - RNA, 12 nt, Salmonella typhimurium LT2
cgccagcggcgc

SEQ ID NO: 1876417 - RNA, 13 nt, Salmonella typhimurium LT2
cgccagcgccgga

SEQ ID NO: 1876418 - RNA, 16 nt, Salmonella typhimurium LT2
cgccgaguaauuugaa

SEQ ID NO: 1876419 - RNA, 14 nt, Salmonella typhimurium LT2
cgccgauacugccc

SEQ ID NO: 1876420 - RNA, 19 nt, Salmonella typhimurium LT2
cgccgauagcggcggcgcg

SEQ ID NO: 1876421 - RNA, 21 nt, Salmonella typhimurium LT2
cgccgccaaacugcgcgccgc

SEQ ID NO: 1876422 - RNA, 20 nt, Salmonella typhimurium LT2
cgccgcaucuuuugccgcgg

SEQ ID NO: 1876423 - RNA, 22 nt, Salmonella typhimurium LT2
cgccgcauccuguaccaccacg

SEQ ID NO: 1876424 - RNA, 22 nt, Salmonella typhimurium LT2
cgccgccaaacugcgcgccgcc

SEQ ID NO: 1876425 - RNA, 15 nt, Salmonella typhimurium LT2
cgccgauuccugcug

SEQ ID NO: 1876426 - RNA, 23 nt, Salmonella typhimurium LT2
cgccgcacacguauaaacgccgc

SEQ ID NO: 1876427 - RNA, 22 nt, Salmonella typhimurium LT2
cgccgcaauuccugacugcgcg

SEQ ID NO: 1876428 - RNA, 18 nt, Salmonella typhimurium LT2
cgccgcaaugccgccugc

SEQ ID NO: 1876429 - RNA, 12 nt, Salmonella typhimurium LT2
cgccgcacuuca

SEQ ID NO: 1876430 - RNA, 15 nt, Salmonella typhimurium LT2
cgccgccgccaacgc

SEQ ID NO: 1876431 - RNA, 14 nt, Salmonella typhimurium LT2
cgccgccgccaacg

SEQ ID NO: 1876432 - RNA, 13 nt, Salmonella typhimurium LT2
cgccgccgccagg

SEQ ID NO: 1876433 - RNA, 15 nt, Salmonella typhimurium LT2
cgccgccgugccuga

SEQ ID NO: 1876434 - RNA, 13 nt, Salmonella typhimurium LT2
cgccgccgggcuu

SEQ ID NO: 1876435 - RNA, 13 nt, Salmonella typhimurium LT2
cgccgcccggcuu

SEQ ID NO: 1876436 - RNA, 16 nt, Salmonella typhimurium LT2
cgccgcccggcuucca

SEQ ID NO: 1876437 - RNA, 22 nt, Salmonella typhimurium LT2
cgccgccccaaaucucccccgg

SEQ ID NO: 1876438 - RNA, 13 nt, Salmonella typhimurium LT2
cgccgcccagcac

SEQ ID NO: 1876439 - RNA, 20 nt, Salmonella typhimurium LT2
cgccgccaggauaauaauga

SEQ ID NO: 1876440 - RNA, 14 nt, Salmonella typhimurium LT2
cgccgccaucggcg

SEQ ID NO: 1876441 - RNA, 14 nt, Salmonella typhimurium LT2
cgccgccaucacca

SEQ ID NO: 1876442 - RNA, 13 nt, Salmonella typhimurium LT2
cgccgccagccga

SEQ ID NO: 1876443 - RNA, 13 nt, Salmonella typhimurium LT2
cgccgagcgccgu

SEQ ID NO: 1876444 - RNA, 15 nt, Salmonella typhimurium LT2
cgccgagccgcccuu

SEQ ID NO: 1876445 - RNA, 13 nt, Salmonella typhimurium LT2
cgccgagccgccc

SEQ ID NO: 1876446 - RNA, 17 nt, Salmonella typhimurium LT2
cgccgacgcauccgcca

SEQ ID NO: 1876447 - RNA, 15 nt, Salmonella typhimurium LT2
cgccgaagcggcagu

SEQ ID NO: 1876448 - RNA, 18 nt, Salmonella typhimurium LT2
cgccgacaucgccaccgc

SEQ ID NO: 1876449 - RNA, 17 nt, Salmonella typhimurium LT2
cgccgacauucccugcg

SEQ ID NO: 1876450 - RNA, 18 nt, Salmonella typhimurium LT2
cgccgacaaauccuccgg

SEQ ID NO: 1876451 - RNA, 19 nt, Salmonella typhimurium LT2
cgccgacaaauccuccggc

SEQ ID NO: 1876452 - RNA, 17 nt, Salmonella typhimurium LT2
cgcccguacaccugcaa

SEQ ID NO: 1876453 - RNA, 17 nt, Salmonella typhimurium LT2
cgcccucauuccccauu

SEQ ID NO: 1876454 - RNA, 16 nt, Salmonella typhimurium LT2
cgcccugaagggcggc

SEQ ID NO: 1876455 - RNA, 15 nt, Salmonella typhimurium LT2
cgcccucgccacggu

SEQ ID NO: 1876456 - RNA, 15 nt, Salmonella typhimurium LT2
cgcccuguccuccau

SEQ ID NO: 1876457 - RNA, 15 nt, Salmonella typhimurium LT2
cgcccuuccgucagc

SEQ ID NO: 1876458 - RNA, 23 nt, Salmonella typhimurium LT2
cgcccugaggaguauuauccauu

SEQ ID NO: 1876459 - RNA, 14 nt, Salmonella typhimurium LT2
cgcccugcgcgccu

SEQ ID NO: 1876460 - RNA, 14 nt, Salmonella typhimurium LT2
cgcccugcgguagc

SEQ ID NO: 1876461 - RNA, 13 nt, Salmonella typhimurium LT2
cgcccugcuccca

SEQ ID NO: 1876462 - RNA, 17 nt, Salmonella typhimurium LT2
cgccgccuaucgccagc

SEQ ID NO: 1876463 - RNA, 15 nt, Salmonella typhimurium LT2
cgccgccucgcguag

SEQ ID NO: 1876464 - RNA, 18 nt, Salmonella typhimurium LT2
cgccgccucgaucuccuc

SEQ ID NO: 1876465 - RNA, 14 nt, Salmonella typhimurium LT2
cgccgccuccgccg

SEQ ID NO: 1876466 - RNA, 15 nt, Salmonella typhimurium LT2
cgccgccuccgccgc

SEQ ID NO: 1876467 - RNA, 16 nt, Salmonella typhimurium LT2
cgccgccuccgccgcu

SEQ ID NO: 1876468 - RNA, 16 nt, Salmonella typhimurium LT2
cgccgccugcgccagc

SEQ ID NO: 1876469 - RNA, 12 nt, Salmonella typhimurium LT2
cgccgccugaug

SEQ ID NO: 1876470 - RNA, 16 nt, Salmonella typhimurium LT2
cgccgccugcuccggg

SEQ ID NO: 1876471 - RNA, 20 nt, Salmonella typhimurium LT2
cgccgccugcuccgggcggu

SEQ ID NO: 1876472 - RNA, 14 nt, Salmonella typhimurium LT2
cgccgcgccgcccc

SEQ ID NO: 1876473 - RNA, 23 nt, Salmonella typhimurium LT2
cgccgcgccggacuccagcaacg

SEQ ID NO: 1876474 - RNA, 11 nt, Salmonella typhimurium LT2
cgccgcggcga

SEQ ID NO: 1876475 - RNA, 22 nt, Salmonella typhimurium LT2
cgccgcguaaauccacauucca

SEQ ID NO: 1876476 - RNA, 22 nt, Salmonella typhimurium LT2
cgccgcggcgguuauccuccgg

SEQ ID NO: 1876477 - RNA, 19 nt, Salmonella typhimurium LT2
cgccggaaagaaacgccgc

SEQ ID NO: 1876478 - RNA, 23 nt, Salmonella typhimurium LT2
cgccggaaagaaacgccgcgcaa

SEQ ID NO: 1876479 - RNA, 15 nt, Salmonella typhimurium LT2
cgccggaaauuugca

SEQ ID NO: 1876480 - RNA, 21 nt, Salmonella typhimurium LT2
cgccgcuuuaaucaccauggc

SEQ ID NO: 1876481 - RNA, 14 nt, Salmonella typhimurium LT2
cgccgcuuccaggc

SEQ ID NO: 1876482 - RNA, 13 nt, Salmonella typhimurium LT2
cgccgcuuccccc

SEQ ID NO: 1876483 - RNA, 23 nt, Salmonella typhimurium LT2
cgccgcuggcgcuuugccguucu

SEQ ID NO: 1876484 - RNA, 18 nt, Salmonella typhimurium LT2
cgccgcuaucgccgaccc

SEQ ID NO: 1876485 - RNA, 16 nt, Salmonella typhimurium LT2
cgccgcuacugccgcc

SEQ ID NO: 1876486 - RNA, 18 nt, Salmonella typhimurium LT2
cgccgcucuucagcgucc

SEQ ID NO: 1876487 - RNA, 20 nt, Salmonella typhimurium LT2
cgccggauuuaccagcgcuu

SEQ ID NO: 1876488 - RNA, 21 nt, Salmonella typhimurium LT2
cgccggcaacagguaccccgc

SEQ ID NO: 1876489 - RNA, 18 nt, Salmonella typhimurium LT2
cgccggauuuaccagcgc

SEQ ID NO: 1876490 - RNA, 19 nt, Salmonella typhimurium LT2
cgccggaucgggcuuccag

SEQ ID NO: 1876491 - RNA, 23 nt, Salmonella typhimurium LT2
cgccggaugacacaucaccucca

SEQ ID NO: 1876492 - RNA, 16 nt, Salmonella typhimurium LT2
cgccggagccgccugg

SEQ ID NO: 1876493 - RNA, 20 nt, Salmonella typhimurium LT2
cgccggagagcauuuguagc

SEQ ID NO: 1876494 - RNA, 12 nt, Salmonella typhimurium LT2
cgccggacggcg

SEQ ID NO: 1876495 - RNA, 22 nt, Salmonella typhimurium LT2
cgccggacuccagcaacgccgc

SEQ ID NO: 1876496 - RNA, 16 nt, Salmonella typhimurium LT2
cgccgguacgcagcag

SEQ ID NO: 1876497 - RNA, 15 nt, Salmonella typhimurium LT2
cgccgguacgcagca

SEQ ID NO: 1876498 - RNA, 15 nt, Salmonella typhimurium LT2
cgccggucgccagca

SEQ ID NO: 1876499 - RNA, 21 nt, Salmonella typhimurium LT2
cgccgguguuuagccugauac

SEQ ID NO: 1876500 - RNA, 22 nt, Salmonella typhimurium LT2
cgccggugucuccgucacuucc

SEQ ID NO: 1876501 - RNA, 22 nt, Salmonella typhimurium LT2
cgccguauucgacacaggcgug

SEQ ID NO: 1876502 - RNA, 19 nt, Salmonella typhimurium LT2
cgccguccauuucaaugca

SEQ ID NO: 1876503 - RNA, 18 nt, Salmonella typhimurium LT2
cgccguccagcaccaccu

SEQ ID NO: 1876504 - RNA, 12 nt, Salmonella typhimurium LT2
cgccgucauccg

SEQ ID NO: 1876505 - RNA, 16 nt, Salmonella typhimurium LT2
cgccggccccgcuucc

SEQ ID NO: 1876506 - RNA, 19 nt, Salmonella typhimurium LT2
cgccggcuucuuccggccc

SEQ ID NO: 1876507 - RNA, 18 nt, Salmonella typhimurium LT2
cgcgauguuugcucgcca

SEQ ID NO: 1876508 - RNA, 18 nt, Salmonella typhimurium LT2
cgcgaugugcuggggagc

SEQ ID NO: 1876509 - RNA, 21 nt, Salmonella typhimurium LT2
cgcgauggucuucuuucaggu

SEQ ID NO: 1876510 - RNA, 23 nt, Salmonella typhimurium LT2
cgcgcaaaacucugagcauacac

SEQ ID NO: 1876511 - RNA, 15 nt, Salmonella typhimurium LT2
cgcgcaaccgcauca

SEQ ID NO: 1876512 - RNA, 21 nt, Salmonella typhimurium LT2
cgcgcaaucagcaccgcgcgc

SEQ ID NO: 1876513 - RNA, 15 nt, Salmonella typhimurium LT2
cgcgcaaucgggccu

SEQ ID NO: 1876514 - RNA, 19 nt, Salmonella typhimurium LT2
cgcgcaaucgggccugcuc

SEQ ID NO: 1876515 - RNA, 14 nt, Salmonella typhimurium LT2
cgcgcaccccggcc

SEQ ID NO: 1876516 - RNA, 22 nt, Salmonella typhimurium LT2
cgcgaguguaaagauuaauaau

SEQ ID NO: 1876517 - RNA, 14 nt, Salmonella typhimurium LT2
cgcgaucacagaca

SEQ ID NO: 1876518 - RNA, 15 nt, Salmonella typhimurium LT2
cgcgauauccaccac

SEQ ID NO: 1876519 - RNA, 13 nt, Salmonella typhimurium LT2
cgcgauagcgcug

SEQ ID NO: 1876520 - RNA, 14 nt, Salmonella typhimurium LT2
cgcgaugacggcgc

SEQ ID NO: 1876521 - RNA, 20 nt, Salmonella typhimurium LT2
cgcgauccaacaauuauaua

SEQ ID NO: 1876522 - RNA, 22 nt, Salmonella typhimurium LT2
cgcgagaagcccggccacagcg

SEQ ID NO: 1876523 - RNA, 14 nt, Salmonella typhimurium LT2
cgcgagaaucgcca

SEQ ID NO: 1876524 - RNA, 24 nt, Salmonella typhimurium LT2
cgcgagaaucgccaggaucgccgc

SEQ ID NO: 1876525 - RNA, 21 nt, Salmonella typhimurium LT2
cgcgagaagcccggccacagc

SEQ ID NO: 1876526 - RNA, 16 nt, Salmonella typhimurium LT2
cgcgagaacugcugca

SEQ ID NO: 1876527 - RNA, 21 nt, Salmonella typhimurium LT2
cgcgagccuuuuaucaaugca

SEQ ID NO: 1876528 - RNA, 19 nt, Salmonella typhimurium LT2
cgcgagaaaauagaggaaa

SEQ ID NO: 1876529 - RNA, 19 nt, Salmonella typhimurium LT2
cgcgacucccaggcgcgca

SEQ ID NO: 1876530 - RNA, 15 nt, Salmonella typhimurium LT2
cgcgacauccgcuuu

SEQ ID NO: 1876531 - RNA, 19 nt, Salmonella typhimurium LT2
cgcgaccacgccagccagc

SEQ ID NO: 1876532 - RNA, 17 nt, Salmonella typhimurium LT2
cgcgacaaaaagcgcgc

SEQ ID NO: 1876533 - RNA, 21 nt, Salmonella typhimurium LT2
cgcgacaacgccggaccagac

SEQ ID NO: 1876534 - RNA, 14 nt, Salmonella typhimurium LT2
cgcgaccaguucac

SEQ ID NO: 1876535 - RNA, 19 nt, Salmonella typhimurium LT2
cgcgacgcccaccaguccc

SEQ ID NO: 1876536 - RNA, 23 nt, Salmonella typhimurium LT2
cgcgcauggcagggcgauaucca

SEQ ID NO: 1876537 - RNA, 18 nt, Salmonella typhimurium LT2
cgcgcaguucauccacgc

SEQ ID NO: 1876538 - RNA, 18 nt, Salmonella typhimurium LT2
cgcgcaguucaauauuca

SEQ ID NO: 1876539 - RNA, 13 nt, Salmonella typhimurium LT2
cgcgccacgccau

SEQ ID NO: 1876540 - RNA, 15 nt, Salmonella typhimurium LT2
cgcgccacgcccagc

SEQ ID NO: 1876541 - RNA, 11 nt, Salmonella typhimurium LT2
cgcgccaccgg

SEQ ID NO: 1876542 - RNA, 13 nt, Salmonella typhimurium LT2
cgcgccacuucca

SEQ ID NO: 1876543 - RNA, 12 nt, Salmonella typhimurium LT2
cgcgccagcagg

SEQ ID NO: 1876544 - RNA, 16 nt, Salmonella typhimurium LT2
cgcgcauuucugcugc

SEQ ID NO: 1876545 - RNA, 18 nt, Salmonella typhimurium LT2
cgcgccaauggccgcccc

SEQ ID NO: 1876546 - RNA, 17 nt, Salmonella typhimurium LT2
cgcgccaaugcgaaaau

SEQ ID NO: 1876547 - RNA, 14 nt, Salmonella typhimurium LT2
cgcgcacgcgcgcg

SEQ ID NO: 1876548 - RNA, 21 nt, Salmonella typhimurium LT2
cgcgcagagauagccagcgau

SEQ ID NO: 1876549 - RNA, 13 nt, Salmonella typhimurium LT2
cgcgcagcaggcc

SEQ ID NO: 1876550 - RNA, 15 nt, Salmonella typhimurium LT2
cgcgccgccugcgcu

SEQ ID NO: 1876551 - RNA, 13 nt, Salmonella typhimurium LT2
cgcgccgcgcagc

SEQ ID NO: 1876552 - RNA, 13 nt, Salmonella typhimurium LT2
cgcgccgccgccu

SEQ ID NO: 1876553 - RNA, 15 nt, Salmonella typhimurium LT2
cgcgccgccgccaac

SEQ ID NO: 1876554 - RNA, 22 nt, Salmonella typhimurium LT2
cgcgccgccaacgccaacauag

SEQ ID NO: 1876555 - RNA, 15 nt, Salmonella typhimurium LT2
cgcgccgccaacgau

SEQ ID NO: 1876556 - RNA, 13 nt, Salmonella typhimurium LT2
cgcgccgagagaa

SEQ ID NO: 1876557 - RNA, 16 nt, Salmonella typhimurium LT2
cgcgcccuccuccagc

SEQ ID NO: 1876558 - RNA, 22 nt, Salmonella typhimurium LT2
cgcgcccugcguuccgcucagc

SEQ ID NO: 1876559 - RNA, 14 nt, Salmonella typhimurium LT2
cgcgcccgccgcca

SEQ ID NO: 1876560 - RNA, 15 nt, Salmonella typhimurium LT2
cgcgcccgccgccaa

SEQ ID NO: 1876561 - RNA, 20 nt, Salmonella typhimurium LT2
cgcgcccgaucguccgccuc

SEQ ID NO: 1876562 - RNA, 17 nt, Salmonella typhimurium LT2
cgcgccaucuccuccuc

SEQ ID NO: 1876563 - RNA, 17 nt, Salmonella typhimurium LT2
cgcgccaucgucaccgg

SEQ ID NO: 1876564 - RNA, 22 nt, Salmonella typhimurium LT2
cgcgccaggucucauagcgccc

SEQ ID NO: 1876565 - RNA, 19 nt, Salmonella typhimurium LT2
cgcgccagucaucgccgcu

SEQ ID NO: 1876566 - RNA, 19 nt, Salmonella typhimurium LT2
cgcgccagcguggcuaacg

SEQ ID NO: 1876567 - RNA, 18 nt, Salmonella typhimurium LT2
cgcgccagcggacuccac

SEQ ID NO: 1876568 - RNA, 19 nt, Salmonella typhimurium LT2
cgcgccagcggacuccacg

SEQ ID NO: 1876569 - RNA, 14 nt, Salmonella typhimurium LT2
cgcgccagcucggu

SEQ ID NO: 1876570 - RNA, 18 nt, Salmonella typhimurium LT2
cgccucgcgauccgccag

SEQ ID NO: 1876571 - RNA, 19 nt, Salmonella typhimurium LT2
cgccucgcgcaccccggcc

SEQ ID NO: 1876572 - RNA, 15 nt, Salmonella typhimurium LT2
cgccucgaucuccuc

SEQ ID NO: 1876573 - RNA, 18 nt, Salmonella typhimurium LT2
cgccuccccugccggcgg

SEQ ID NO: 1876574 - RNA, 22 nt, Salmonella typhimurium LT2
cgccuccugccgaugccgccgc

SEQ ID NO: 1876575 - RNA, 17 nt, Salmonella typhimurium LT2
cgccuccggccugccug

SEQ ID NO: 1876576 - RNA, 18 nt, Salmonella typhimurium LT2
cgccuccggccugccugg

SEQ ID NO: 1876577 - RNA, 15 nt, Salmonella typhimurium LT2
cgccugaucgcgcag

SEQ ID NO: 1876578 - RNA, 15 nt, Salmonella typhimurium LT2
cgccugauucauucc

SEQ ID NO: 1876579 - RNA, 19 nt, Salmonella typhimurium LT2
cgccugaugcugcgcaucu

SEQ ID NO: 1876580 - RNA, 11 nt, Salmonella typhimurium LT2
cgccugcacca

SEQ ID NO: 1876581 - RNA, 12 nt, Salmonella typhimurium LT2
cgccugcagauu

SEQ ID NO: 1876582 - RNA, 12 nt, Salmonella typhimurium LT2
cgccucugucuu

SEQ ID NO: 1876583 - RNA, 21 nt, Salmonella typhimurium LT2
cgccucguuugcugagcagcc

SEQ ID NO: 1876584 - RNA, 18 nt, Salmonella typhimurium LT2
cgccucgcugacgccagc

SEQ ID NO: 1876585 - RNA, 21 nt, Salmonella typhimurium LT2
cgccguggcggugacuuccug

SEQ ID NO: 1876586 - RNA, 21 nt, Salmonella typhimurium LT2
cgccguguugugugccgcgcu

SEQ ID NO: 1876587 - RNA, 22 nt, Salmonella typhimurium LT2
cgccguguugugugccgcgcug

SEQ ID NO: 1876588 - RNA, 12 nt, Salmonella typhimurium LT2
cgccguuaaaua

SEQ ID NO: 1876589 - RNA, 23 nt, Salmonella typhimurium LT2
cgccgugcucauccaacugcgcc

SEQ ID NO: 1876590 - RNA, 16 nt, Salmonella typhimurium LT2
cgccgugcacuucugc

SEQ ID NO: 1876591 - RNA, 13 nt, Salmonella typhimurium LT2
cgccgucgcgcuu

SEQ ID NO: 1876592 - RNA, 14 nt, Salmonella typhimurium LT2
cgccuaccgcuucc

SEQ ID NO: 1876593 - RNA, 21 nt, Salmonella typhimurium LT2
cgccuaucgccagcaggguca

SEQ ID NO: 1876594 - RNA, 15 nt, Salmonella typhimurium LT2
cgccguuccauucaa

SEQ ID NO: 1876595 - RNA, 20 nt, Salmonella typhimurium LT2
cgccguugauuuucaggcag

SEQ ID NO: 1876596 - RNA, 21 nt, Salmonella typhimurium LT2
cgccugcggaaucuccggcga

SEQ ID NO: 1876597 - RNA, 13 nt, Salmonella typhimurium LT2
cgccugcgcgccu

SEQ ID NO: 1876598 - RNA, 19 nt, Salmonella typhimurium LT2
cgccugcugcuggacagga

SEQ ID NO: 1876599 - RNA, 16 nt, Salmonella typhimurium LT2
cgccugcgccagcgcc

SEQ ID NO: 1876600 - RNA, 18 nt, Salmonella typhimurium LT2
cgccugccgcgccgggag

SEQ ID NO: 1876601 - RNA, 14 nt, Salmonella typhimurium LT2
cgccugccgcgccu

SEQ ID NO: 1876602 - RNA, 15 nt, Salmonella typhimurium LT2
cgccugccgcgccgc

SEQ ID NO: 1876603 - RNA, 14 nt, Salmonella typhimurium LT2
cgccugccgcaugu

SEQ ID NO: 1876604 - RNA, 15 nt, Salmonella typhimurium LT2
cgccugccgcgccca

SEQ ID NO: 1876605 - RNA, 20 nt, Salmonella typhimurium LT2
cgccugcauaaacgcggcca

SEQ ID NO: 1876606 - RNA, 23 nt, Salmonella typhimurium LT2
cgccugcauaaacgcggccauca

SEQ ID NO: 1876607 - RNA, 20 nt, Salmonella typhimurium LT2
cgccugccauagcaucacca

SEQ ID NO: 1876608 - RNA, 13 nt, Salmonella typhimurium LT2
cgccugccagaua

SEQ ID NO: 1876609 - RNA, 15 nt, Salmonella typhimurium LT2
cgccuuagcgaccgc

SEQ ID NO: 1876610 - RNA, 15 nt, Salmonella typhimurium LT2
cgccuuacccggccu

SEQ ID NO: 1876611 - RNA, 22 nt, Salmonella typhimurium LT2
cgccugugcuuucgccaccagc

SEQ ID NO: 1876612 - RNA, 13 nt, Salmonella typhimurium LT2
cgccuguucauca

SEQ ID NO: 1876613 - RNA, 14 nt, Salmonella typhimurium LT2
cgccuuauucaggc

SEQ ID NO: 1876614 - RNA, 23 nt, Salmonella typhimurium LT2
cgccuuauucgguuuauccccgc

SEQ ID NO: 1876615 - RNA, 16 nt, Salmonella typhimurium LT2
cgccuuauccggccug

SEQ ID NO: 1876616 - RNA, 22 nt, Salmonella typhimurium LT2
cgccuuauccggccugucgcug

SEQ ID NO: 1876617 - RNA, 23 nt, Salmonella typhimurium LT2
cgccuucacacugcgccgccagc

SEQ ID NO: 1876618 - RNA, 22 nt, Salmonella typhimurium LT2
cgccuggcaacgucgacccgcc

SEQ ID NO: 1876619 - RNA, 19 nt, Salmonella typhimurium LT2
cgccuggccaggcuuucuu

SEQ ID NO: 1876620 - RNA, 23 nt, Salmonella typhimurium LT2
cgccuguaaugucuggugcagca

SEQ ID NO: 1876621 - RNA, 14 nt, Salmonella typhimurium LT2
cgccuguccggccu

SEQ ID NO: 1876622 - RNA, 15 nt, Salmonella typhimurium LT2
cgccuugcggcggcg

SEQ ID NO: 1876623 - RNA, 15 nt, Salmonella typhimurium LT2
cgccuuuucccccag

SEQ ID NO: 1876624 - RNA, 12 nt, Salmonella typhimurium LT2
cgcgaaaacagc

SEQ ID NO: 1876625 - RNA, 22 nt, Salmonella typhimurium LT2
cgccuugucgaaauggccaucc

SEQ ID NO: 1876626 - RNA, 15 nt, Salmonella typhimurium LT2
cgccuuucagauggu

SEQ ID NO: 1876627 - RNA, 20 nt, Salmonella typhimurium LT2
cgccuucgcggugaucccag

SEQ ID NO: 1876628 - RNA, 14 nt, Salmonella typhimurium LT2
cgccuuccugccag

SEQ ID NO: 1876629 - RNA, 15 nt, Salmonella typhimurium LT2
cgccuucuucaucuu

SEQ ID NO: 1876630 - RNA, 15 nt, Salmonella typhimurium LT2
cgccuucuucaccca

SEQ ID NO: 1876631 - RNA, 16 nt, Salmonella typhimurium LT2
cgccuucuucaucuuc

SEQ ID NO: 1876632 - RNA, 19 nt, Salmonella typhimurium LT2
cgccuugacgauaugcugc

SEQ ID NO: 1876633 - RNA, 18 nt, Salmonella typhimurium LT2
cgcgaaaacagcuggcga

SEQ ID NO: 1876634 - RNA, 23 nt, Salmonella typhimurium LT2
cgcgaaaauaccccagcgcgccg

SEQ ID NO: 1876635 - RNA, 22 nt, Salmonella typhimurium LT2
cgcgaaaucaaagaccuccgcc

SEQ ID NO: 1876636 - RNA, 20 nt, Salmonella typhimurium LT2
cgcgaauagccagacagccc

SEQ ID NO: 1876637 - RNA, 14 nt, Salmonella typhimurium LT2
cgcgaauauguucu

SEQ ID NO: 1876638 - RNA, 24 nt, Salmonella typhimurium LT2
cgcgaaucgacaauccgccacgcu

SEQ ID NO: 1876639 - RNA, 15 nt, Salmonella typhimurium LT2
cgcgaauuucaaucg

SEQ ID NO: 1876640 - RNA, 18 nt, Salmonella typhimurium LT2
cgcgaauuucaaucgcca

SEQ ID NO: 1876641 - RNA, 15 nt, Salmonella typhimurium LT2
cuugacaggaaacag

SEQ ID NO: 1876642 - RNA, 18 nt, Salmonella typhimurium LT2
cuugacgcuuugcauuau

SEQ ID NO: 1876643 - RNA, 15 nt, Salmonella typhimurium LT2
cuugaccagcacuuc

SEQ ID NO: 1876644 - RNA, 19 nt, Salmonella typhimurium LT2
cuucucaggcgagcccugu

SEQ ID NO: 1876645 - RNA, 23 nt, Salmonella typhimurium LT2
cuucuuugaccagcgacgaugaa

SEQ ID NO: 1876646 - RNA, 21 nt, Salmonella typhimurium LT2
cuucucccaacagacgaucua

SEQ ID NO: 1876647 - RNA, 18 nt, Salmonella typhimurium LT2
cuugaucaucagggcgaa

SEQ ID NO: 1876648 - RNA, 20 nt, Salmonella typhimurium LT2
cuugagaaauuauuuuaaau

SEQ ID NO: 1876649 - RNA, 22 nt, Salmonella typhimurium LT2
cuugacucaaaaagaggaaagc

SEQ ID NO: 1876650 - RNA, 21 nt, Salmonella typhimurium LT2
cuugagcaaaacacagcucaa

SEQ ID NO: 1876651 - RNA, 17 nt, Salmonella typhimurium LT2
cuugccgaauuuacugu

SEQ ID NO: 1876652 - RNA, 19 nt, Salmonella typhimurium LT2
cuugccacuacgcagcucc

SEQ ID NO: 1876653 - RNA, 14 nt, Salmonella typhimurium LT2
cuugccagugaaaa

SEQ ID NO: 1876654 - RNA, 17 nt, Salmonella typhimurium LT2
cuugccaugaaaacgaa

SEQ ID NO: 1876655 - RNA, 14 nt, Salmonella typhimurium LT2
cuugccacuggccu

SEQ ID NO: 1876656 - RNA, 15 nt, Salmonella typhimurium LT2
cuugccacuggccuc

SEQ ID NO: 1876657 - RNA, 19 nt, Salmonella typhimurium LT2
cuugccacuggccucccag

SEQ ID NO: 1876658 - RNA, 18 nt, Salmonella typhimurium LT2
cuugguaccaaacagcag

SEQ ID NO: 1876659 - RNA, 21 nt, Salmonella typhimurium LT2
cuugguuguuuccauuuuuac

SEQ ID NO: 1876660 - RNA, 20 nt, Salmonella typhimurium LT2
cuugucacgaaguuccagua

SEQ ID NO: 1876661 - RNA, 12 nt, Salmonella typhimurium LT2
cuuggucauaau

SEQ ID NO: 1876662 - RNA, 16 nt, Salmonella typhimurium LT2
cuugcuuuauuuuuaa

SEQ ID NO: 1876663 - RNA, 16 nt, Salmonella typhimurium LT2
cuuggcgaucaccagc

SEQ ID NO: 1876664 - RNA, 18 nt, Salmonella typhimurium LT2
cuuggcgaucaccagcac

SEQ ID NO: 1876665 - RNA, 16 nt, Salmonella typhimurium LT2
cuugcugcuaugaaaa

SEQ ID NO: 1876666 - RNA, 17 nt, Salmonella typhimurium LT2
cuugcugcuaugaaaaa

SEQ ID NO: 1876667 - RNA, 20 nt, Salmonella typhimurium LT2
cuugcgaucgggauuccagu

SEQ ID NO: 1876668 - RNA, 16 nt, Salmonella typhimurium LT2
cuugcgagcgucaguc

SEQ ID NO: 1876669 - RNA, 22 nt, Salmonella typhimurium LT2
cuugccgcgccagacgcccuuc

SEQ ID NO: 1876670 - RNA, 18 nt, Salmonella typhimurium LT2
cuugccgccugccugcaa

SEQ ID NO: 1876671 - RNA, 15 nt, Salmonella typhimurium LT2
cuuucagauaccaaa

SEQ ID NO: 1876672 - RNA, 17 nt, Salmonella typhimurium LT2
cuuucaggaauuuauca

SEQ ID NO: 1876673 - RNA, 13 nt, Salmonella typhimurium LT2
cuuucagcuuuuu

SEQ ID NO: 1876674 - RNA, 13 nt, Salmonella typhimurium LT2
cuuucagauuuuu

SEQ ID NO: 1876675 - RNA, 18 nt, Salmonella typhimurium LT2
cuuucaauccuucuucug

SEQ ID NO: 1876676 - RNA, 21 nt, Salmonella typhimurium LT2
cuuucaauacuucgacaauau

SEQ ID NO: 1876677 - RNA, 21 nt, Salmonella typhimurium LT2
cuuucaauagucgacagcccg

SEQ ID NO: 1876678 - RNA, 12 nt, Salmonella typhimurium LT2
cuuucaauaagc

SEQ ID NO: 1876679 - RNA, 14 nt, Salmonella typhimurium LT2
cuuuaggcaggaaa

SEQ ID NO: 1876680 - RNA, 18 nt, Salmonella typhimurium LT2
cuuuauccgccagccagu

SEQ ID NO: 1876681 - RNA, 20 nt, Salmonella typhimurium LT2
cuuuauaaaucaggaaaaag

SEQ ID NO: 1876682 - RNA, 14 nt, Salmonella typhimurium LT2
cuuuaugggcauuu

SEQ ID NO: 1876683 - RNA, 20 nt, Salmonella typhimurium LT2
cuuuaugggcauuucauuua

SEQ ID NO: 1876684 - RNA, 21 nt, Salmonella typhimurium LT2
cuuuauucuggccguuuucaa

SEQ ID NO: 1876685 - RNA, 14 nt, Salmonella typhimurium LT2
cuuuaucguaaccg

SEQ ID NO: 1876686 - RNA, 15 nt, Salmonella typhimurium LT2
cuuuacgcagcaaga

SEQ ID NO: 1876687 - RNA, 13 nt, Salmonella typhimurium LT2
cuuuacaccccac

SEQ ID NO: 1876688 - RNA, 21 nt, Salmonella typhimurium LT2
cuuuagauaauuucgcauaau

SEQ ID NO: 1876689 - RNA, 21 nt, Salmonella typhimurium LT2
cuuuacuuaguaucauauuuu

SEQ ID NO: 1876690 - RNA, 20 nt, Salmonella typhimurium LT2
cuuuaagccgauugaauaau

SEQ ID NO: 1876691 - RNA, 19 nt, Salmonella typhimurium LT2
cuugucgaaauggccaucc

SEQ ID NO: 1876692 - RNA, 23 nt, Salmonella typhimurium LT2
cuuuaacgccuucauauuaaauu

SEQ ID NO: 1876693 - RNA, 14 nt, Salmonella typhimurium LT2
cuuugcaacagggc

SEQ ID NO: 1876694 - RNA, 18 nt, Salmonella typhimurium LT2
cuuugcacguucugcugg

SEQ ID NO: 1876695 - RNA, 22 nt, Salmonella typhimurium LT2
cuuugaucagcacgcggaacac

SEQ ID NO: 1876696 - RNA, 15 nt, Salmonella typhimurium LT2
cuuugcccucaaaga

SEQ ID NO: 1876697 - RNA, 19 nt, Salmonella typhimurium LT2
cuuugcccggccaccgccu

SEQ ID NO: 1876698 - RNA, 16 nt, Salmonella typhimurium LT2
cuuugccaagaaacgc

SEQ ID NO: 1876699 - RNA, 22 nt, Salmonella typhimurium LT2
cuuugccguucucugacaaaau

SEQ ID NO: 1876700 - RNA, 21 nt, Salmonella typhimurium LT2
cuuugccgcugcugccuucca

SEQ ID NO: 1876701 - RNA, 14 nt, Salmonella typhimurium LT2
cuuugcgccgccag

SEQ ID NO: 1876702 - RNA, 21 nt, Salmonella typhimurium LT2
cuuugccuuuuucccacugcg

SEQ ID NO: 1876703 - RNA, 18 nt, Salmonella typhimurium LT2
cuuugcgauagcccggca

SEQ ID NO: 1876704 - RNA, 20 nt, Salmonella typhimurium LT2
cuuugcuuuguaaagcgcca

SEQ ID NO: 1876705 - RNA, 18 nt, Salmonella typhimurium LT2
cuuugcguaaaaaaacau

SEQ ID NO: 1876706 - RNA, 21 nt, Salmonella typhimurium LT2
cuuugcguaaaaaaacaucau

SEQ ID NO: 1876707 - RNA, 19 nt, Salmonella typhimurium LT2
cuuuggacggcaucaggaa

SEQ ID NO: 1876708 - RNA, 15 nt, Salmonella typhimurium LT2
cuuuggcaaaaaagg

SEQ ID NO: 1876709 - RNA, 22 nt, Salmonella typhimurium LT2
cuuuggcaggccucuaucuucu

SEQ ID NO: 1876710 - RNA, 23 nt, Salmonella typhimurium LT2
cuuuggccuggagaucagcaugg

SEQ ID NO: 1876711 - RNA, 20 nt, Salmonella typhimurium LT2
cuuugaacagccagaagccc

SEQ ID NO: 1876712 - RNA, 13 nt, Salmonella typhimurium LT2
cuuucuucucaac

SEQ ID NO: 1876713 - RNA, 22 nt, Salmonella typhimurium LT2
cuuugaccagcaucgccgguag

SEQ ID NO: 1876714 - RNA, 22 nt, Salmonella typhimurium LT2
cuuugagcaucaaacuuuuaaa

SEQ ID NO: 1876715 - RNA, 14 nt, Salmonella typhimurium LT2
cuuuccagcagcca

SEQ ID NO: 1876716 - RNA, 20 nt, Salmonella typhimurium LT2
cuuucggggagacgggcgga

SEQ ID NO: 1876717 - RNA, 22 nt, Salmonella typhimurium LT2
cuuucggguugcccugcuuguc

SEQ ID NO: 1876718 - RNA, 18 nt, Salmonella typhimurium LT2
cuuuccaaaauccaggga

SEQ ID NO: 1876719 - RNA, 15 nt, Salmonella typhimurium LT2
cuuuccaaagcgaag

SEQ ID NO: 1876720 - RNA, 16 nt, Salmonella typhimurium LT2
cuuuccaaagcgaagu

SEQ ID NO: 1876721 - RNA, 12 nt, Salmonella typhimurium LT2
cuuucuacaaau

SEQ ID NO: 1876722 - RNA, 13 nt, Salmonella typhimurium LT2
cuuagcuguuacg

SEQ ID NO: 1876723 - RNA, 17 nt, Salmonella typhimurium LT2
cuuaggggcucuuuuuu

SEQ ID NO: 1876724 - RNA, 18 nt, Salmonella typhimurium LT2
cuuaguaucauauuuucu

SEQ ID NO: 1876725 - RNA, 13 nt, Salmonella typhimurium LT2
cuuacugcugucc

SEQ ID NO: 1876726 - RNA, 15 nt, Salmonella typhimurium LT2
cuuaccgggcaucug

SEQ ID NO: 1876727 - RNA, 20 nt, Salmonella typhimurium LT2
cuuaccgcugauucuacucu

SEQ ID NO: 1876728 - RNA, 17 nt, Salmonella typhimurium LT2
cuuaccgcggucaccuu

SEQ ID NO: 1876729 - RNA, 23 nt, Salmonella typhimurium LT2
cuuacccggccuacacaucaucu

SEQ ID NO: 1876730 - RNA, 13 nt, Salmonella typhimurium LT2
cuuaccaaacagc

SEQ ID NO: 1876731 - RNA, 21 nt, Salmonella typhimurium LT2
cuuaaugaguacggguauucc

SEQ ID NO: 1876732 - RNA, 16 nt, Salmonella typhimurium LT2
cuuaaugcucugcugu

SEQ ID NO: 1876733 - RNA, 23 nt, Salmonella typhimurium LT2
cuuaauguuaacgucgucauuca

SEQ ID NO: 1876734 - RNA, 13 nt, Salmonella typhimurium LT2
cuuaauacagcaa

SEQ ID NO: 1876735 - RNA, 23 nt, Salmonella typhimurium LT2
cuuaauacccauuucuucuucaa

SEQ ID NO: 1876736 - RNA, 21 nt, Salmonella typhimurium LT2
cuuaauacccauuucuucuuc

SEQ ID NO: 1876737 - RNA, 16 nt, Salmonella typhimurium LT2
cuuaagggccauguuu

SEQ ID NO: 1876738 - RNA, 12 nt, Salmonella typhimurium LT2
cuuaacacaaac

SEQ ID NO: 1876739 - RNA, 11 nt, Salmonella typhimurium LT2
cuuaaauccgg

SEQ ID NO: 1876740 - RNA, 13 nt, Salmonella typhimurium LT2
cuuaaauuuuuaa

SEQ ID NO: 1876741 - RNA, 13 nt, Salmonella typhimurium LT2
cuuauguacaacc

SEQ ID NO: 1876742 - RNA, 12 nt, Salmonella typhimurium LT2
cuucaaauccgg

SEQ ID NO: 1876743 - RNA, 16 nt, Salmonella typhimurium LT2
cuuauugucgccgccg

SEQ ID NO: 1876744 - RNA, 23 nt, Salmonella typhimurium LT2
cuuauugugccgcggcuucauca

SEQ ID NO: 1876745 - RNA, 23 nt, Salmonella typhimurium LT2
cuucaauuccuggaacuggcucc

SEQ ID NO: 1876746 - RNA, 18 nt, Salmonella typhimurium LT2
cuucaaugucguuaucgc

SEQ ID NO: 1876747 - RNA, 18 nt, Salmonella typhimurium LT2
cuucaaugcgccccgucu

SEQ ID NO: 1876748 - RNA, 17 nt, Salmonella typhimurium LT2
cuucaaugggaaaaauu

SEQ ID NO: 1876749 - RNA, 23 nt, Salmonella typhimurium LT2
cuucaaugggaaaaauuugaucu

SEQ ID NO: 1876750 - RNA, 14 nt, Salmonella typhimurium LT2
cuucaccggcgugc

SEQ ID NO: 1876751 - RNA, 21 nt, Salmonella typhimurium LT2
cuucacgaagucuggcugcaa

SEQ ID NO: 1876752 - RNA, 15 nt, Salmonella typhimurium LT2
cuucaagaaguucca

SEQ ID NO: 1876753 - RNA, 14 nt, Salmonella typhimurium LT2
cuucaagaaucaau

SEQ ID NO: 1876754 - RNA, 23 nt, Salmonella typhimurium LT2
cuucaaggcucaauacgcauaau

SEQ ID NO: 1876755 - RNA, 14 nt, Salmonella typhimurium LT2
cuucaagccaggcu

SEQ ID NO: 1876756 - RNA, 18 nt, Salmonella typhimurium LT2
cuucaagccaggcuuuaa

SEQ ID NO: 1876757 - RNA, 21 nt, Salmonella typhimurium LT2
cuucaaccguuucuuuuucga

SEQ ID NO: 1876758 - RNA, 20 nt, Salmonella typhimurium LT2
cuucaaccugagauggcaca

SEQ ID NO: 1876759 - RNA, 19 nt, Salmonella typhimurium LT2
cuucaaccguuucuuuuuc

SEQ ID NO: 1876760 - RNA, 15 nt, Salmonella typhimurium LT2
cuucaacgccgcgcu

SEQ ID NO: 1876761 - RNA, 19 nt, Salmonella typhimurium LT2
cuucaacgcaggcgaaauc

SEQ ID NO: 1876762 - RNA, 20 nt, Salmonella typhimurium LT2
cuucaaccauugucuucuac

SEQ ID NO: 1876763 - RNA, 12 nt, Salmonella typhimurium LT2
cuucggcggccc

SEQ ID NO: 1876764 - RNA, 18 nt, Salmonella typhimurium LT2
cuucggcgccauuccugc

SEQ ID NO: 1876765 - RNA, 14 nt, Salmonella typhimurium LT2
cuucggucagaucc

SEQ ID NO: 1876766 - RNA, 18 nt, Salmonella typhimurium LT2
cuucggucagauccuggc

SEQ ID NO: 1876767 - RNA, 22 nt, Salmonella typhimurium LT2
cuucggcaaaauacucagcgaa

SEQ ID NO: 1876768 - RNA, 22 nt, Salmonella typhimurium LT2
cuucgcuuauccggccuacgau

SEQ ID NO: 1876769 - RNA, 18 nt, Salmonella typhimurium LT2
cuucggacuccugacgcu

SEQ ID NO: 1876770 - RNA, 15 nt, Salmonella typhimurium LT2
cuucgcuuagcuucc

SEQ ID NO: 1876771 - RNA, 18 nt, Salmonella typhimurium LT2
cuucgcucucgccacgcu

SEQ ID NO: 1876772 - RNA, 22 nt, Salmonella typhimurium LT2
cuucgcugaaaaugacuucauc

SEQ ID NO: 1876773 - RNA, 23 nt, Salmonella typhimurium LT2
cuucgcugaaaaugacuucaucg

SEQ ID NO: 1876774 - RNA, 16 nt, Salmonella typhimurium LT2
cuucgcguaaugcaau

SEQ ID NO: 1876775 - RNA, 21 nt, Salmonella typhimurium LT2
cuucgauaguccauuuuccua

SEQ ID NO: 1876776 - RNA, 12 nt, Salmonella typhimurium LT2
cuucgauaaacg

SEQ ID NO: 1876777 - RNA, 18 nt, Salmonella typhimurium LT2
cuucgauaacaucaagcc

SEQ ID NO: 1876778 - RNA, 14 nt, Salmonella typhimurium LT2
cuucgauaauaaaa

SEQ ID NO: 1876779 - RNA, 22 nt, Salmonella typhimurium LT2
cuucgaggauaaaaucgccaaa

SEQ ID NO: 1876780 - RNA, 14 nt, Salmonella typhimurium LT2
cuucgacaauauuu

SEQ ID NO: 1876781 - RNA, 17 nt, Salmonella typhimurium LT2
cuucgaaugucucaaua

SEQ ID NO: 1876782 - RNA, 16 nt, Salmonella typhimurium LT2
cuucuauuucuuuauu

SEQ ID NO: 1876783 - RNA, 18 nt, Salmonella typhimurium LT2
cuucuaccuucaccccca

SEQ ID NO: 1876784 - RNA, 21 nt, Salmonella typhimurium LT2
cuucuacgcgacgcauugcca

SEQ ID NO: 1876785 - RNA, 18 nt, Salmonella typhimurium LT2
cuucuaauuuuuccagca

SEQ ID NO: 1876786 - RNA, 16 nt, Salmonella typhimurium LT2
cuucuaauuccaggau

SEQ ID NO: 1876787 - RNA, 14 nt, Salmonella typhimurium LT2
cuucuaccgcuucg

SEQ ID NO: 1876788 - RNA, 19 nt, Salmonella typhimurium LT2
cuucuaacgcaacggaagg

SEQ ID NO: 1876789 - RNA, 23 nt, Salmonella typhimurium LT2
cuucguggaacugcagcgcgucg

SEQ ID NO: 1876790 - RNA, 17 nt, Salmonella typhimurium LT2
cuucgucgucuucaucc

SEQ ID NO: 1876791 - RNA, 19 nt, Salmonella typhimurium LT2
cuucgucgucuucauccca

SEQ ID NO: 1876792 - RNA, 14 nt, Salmonella typhimurium LT2
cuucgucuuuauuc

SEQ ID NO: 1876793 - RNA, 14 nt, Salmonella typhimurium LT2
cuucguucuguauc

SEQ ID NO: 1876794 - RNA, 21 nt, Salmonella typhimurium LT2
cuucguuuccugucucuauua

SEQ ID NO: 1876795 - RNA, 14 nt, Salmonella typhimurium LT2
cuucguauuucuuc

SEQ ID NO: 1876796 - RNA, 22 nt, Salmonella typhimurium LT2
cuucgguugccugcgucauccc

SEQ ID NO: 1876797 - RNA, 17 nt, Salmonella typhimurium LT2
cuucgucgaacgcgccg

SEQ ID NO: 1876798 - RNA, 14 nt, Salmonella typhimurium LT2
cuucccgcucauua

SEQ ID NO: 1876799 - RNA, 23 nt, Salmonella typhimurium LT2
cuucccgcaaacuggccacagca

SEQ ID NO: 1876800 - RNA, 20 nt, Salmonella typhimurium LT2
cuucccccguuugcaguccg

SEQ ID NO: 1876801 - RNA, 23 nt, Salmonella typhimurium LT2
cuuccccggcagccccaggccug

SEQ ID NO: 1876802 - RNA, 17 nt, Salmonella typhimurium LT2
cuuccccggucagucca

SEQ ID NO: 1876803 - RNA, 20 nt, Salmonella typhimurium LT2
cuuccccuuucaccagaaug

SEQ ID NO: 1876804 - RNA, 13 nt, Salmonella typhimurium LT2
cuuccaggguagc

SEQ ID NO: 1876805 - RNA, 19 nt, Salmonella typhimurium LT2
cuuccaggguagcgguggc

SEQ ID NO: 1876806 - RNA, 23 nt, Salmonella typhimurium LT2
cuucccccaaaaugccgcccauc

SEQ ID NO: 1876807 - RNA, 19 nt, Salmonella typhimurium LT2
cuuccagcgucacuggcca

SEQ ID NO: 1876808 - RNA, 15 nt, Salmonella typhimurium LT2
cuuccagcuccaucc

SEQ ID NO: 1876809 - RNA, 22 nt, Salmonella typhimurium LT2
cuuccaggauacacauggagaa

SEQ ID NO: 1876810 - RNA, 23 nt, Salmonella typhimurium LT2
cuuccgucaaaaaaucgaccaac

SEQ ID NO: 1876811 - RNA, 16 nt, Salmonella typhimurium LT2
cuuccuccaccaccau

SEQ ID NO: 1876812 - RNA, 22 nt, Salmonella typhimurium LT2
cuuccucaauauuaucuucguc

SEQ ID NO: 1876813 - RNA, 15 nt, Salmonella typhimurium LT2
cuuccugccaggccg

SEQ ID NO: 1876814 - RNA, 18 nt, Salmonella typhimurium LT2
cuuccugcgcugucacca

SEQ ID NO: 1876815 - RNA, 23 nt, Salmonella typhimurium LT2
cuuccugcgcugucaccagcagc

SEQ ID NO: 1876816 - RNA, 21 nt, Salmonella typhimurium LT2
cuuccuggaugcuuaaaaucc

SEQ ID NO: 1876817 - RNA, 20 nt, Salmonella typhimurium LT2
cuuccacccgggaagcccuu

SEQ ID NO: 1876818 - RNA, 17 nt, Salmonella typhimurium LT2
cuuccacgcacgccggc

SEQ ID NO: 1876819 - RNA, 12 nt, Salmonella typhimurium LT2
cuuccacugcgg

SEQ ID NO: 1876820 - RNA, 20 nt, Salmonella typhimurium LT2
cuuccacugguaggcaucca

SEQ ID NO: 1876821 - RNA, 15 nt, Salmonella typhimurium LT2
cuuccacgcacgccg

SEQ ID NO: 1876822 - RNA, 14 nt, Salmonella typhimurium LT2
cuuccagcagaucc

SEQ ID NO: 1876823 - RNA, 22 nt, Salmonella typhimurium LT2
cuuccagcacgauauccagcac

SEQ ID NO: 1876824 - RNA, 15 nt, Salmonella typhimurium LT2
cuuccagcaauucgu

SEQ ID NO: 1876825 - RNA, 19 nt, Salmonella typhimurium LT2
cuuccagcauucuauuguu

SEQ ID NO: 1876826 - RNA, 13 nt, Salmonella typhimurium LT2
cuuccagcggcag

SEQ ID NO: 1876827 - RNA, 20 nt, Salmonella typhimurium LT2
cuuccagcgcguccagcccg

SEQ ID NO: 1876828 - RNA, 24 nt, Salmonella typhimurium LT2
cuuccagcgcgccgucaucgcuca

SEQ ID NO: 1876829 - RNA, 14 nt, Salmonella typhimurium LT2
cuucaucuucaccu

SEQ ID NO: 1876830 - RNA, 19 nt, Salmonella typhimurium LT2
cuucaucguuuauuucguc

SEQ ID NO: 1876831 - RNA, 16 nt, Salmonella typhimurium LT2
cuucagacaacgccgc

SEQ ID NO: 1876832 - RNA, 18 nt, Salmonella typhimurium LT2
cuucaucgcgccuccccu

SEQ ID NO: 1876833 - RNA, 17 nt, Salmonella typhimurium LT2
cugccauuaucaccauu

SEQ ID NO: 1876834 - RNA, 16 nt, Salmonella typhimurium LT2
cugccauuaucaccau

SEQ ID NO: 1876835 - RNA, 23 nt, Salmonella typhimurium LT2
cugccauuaucaccauucccagc

SEQ ID NO: 1876836 - RNA, 14 nt, Salmonella typhimurium LT2
cugccauuucugcu

SEQ ID NO: 1876837 - RNA, 22 nt, Salmonella typhimurium LT2
cugcccaaauaaaagccgccau

SEQ ID NO: 1876838 - RNA, 19 nt, Salmonella typhimurium LT2
cugccacaauuugcagauu

SEQ ID NO: 1876839 - RNA, 17 nt, Salmonella typhimurium LT2
cugccacacucucucca

SEQ ID NO: 1876840 - RNA, 20 nt, Salmonella typhimurium LT2
cugccacaaccgcccccaac

SEQ ID NO: 1876841 - RNA, 13 nt, Salmonella typhimurium LT2
cugccagcacagc

SEQ ID NO: 1876842 - RNA, 20 nt, Salmonella typhimurium LT2
cugccagcaccagcagcgca

SEQ ID NO: 1876843 - RNA, 22 nt, Salmonella typhimurium LT2
cugccagcaugauaauggcaua

SEQ ID NO: 1876844 - RNA, 17 nt, Salmonella typhimurium LT2
cugccgcaaacgccugc

SEQ ID NO: 1876845 - RNA, 19 nt, Salmonella typhimurium LT2
cugccgcaaacgccugcuc

SEQ ID NO: 1876846 - RNA, 21 nt, Salmonella typhimurium LT2
cugcccgccacccuccgggcc

SEQ ID NO: 1876847 - RNA, 13 nt, Salmonella typhimurium LT2
cugcccgccaggg

SEQ ID NO: 1876848 - RNA, 22 nt, Salmonella typhimurium LT2
cugcccgccaggguaucaucaa

SEQ ID NO: 1876849 - RNA, 22 nt, Salmonella typhimurium LT2
cugcccgucuaaccgggccuga

SEQ ID NO: 1876850 - RNA, 17 nt, Salmonella typhimurium LT2
cugccccggugagcgcc

SEQ ID NO: 1876851 - RNA, 18 nt, Salmonella typhimurium LT2
cugccccggugagcgccg

SEQ ID NO: 1876852 - RNA, 17 nt, Salmonella typhimurium LT2
cugcauauuuuucauuc

SEQ ID NO: 1876853 - RNA, 13 nt, Salmonella typhimurium LT2
cugcauccgcuuu

SEQ ID NO: 1876854 - RNA, 12 nt, Salmonella typhimurium LT2
cugcauauuuuu

SEQ ID NO: 1876855 - RNA, 21 nt, Salmonella typhimurium LT2
cugcauacucacauucauaaa

SEQ ID NO: 1876856 - RNA, 19 nt, Salmonella typhimurium LT2
cugcagcgccaggaaggua

SEQ ID NO: 1876857 - RNA, 21 nt, Salmonella typhimurium LT2
cugcaggaaucgaaccugcaa

SEQ ID NO: 1876858 - RNA, 21 nt, Salmonella typhimurium LT2
cugcaucugcggucuccugaa

SEQ ID NO: 1876859 - RNA, 15 nt, Salmonella typhimurium LT2
cugcaucucauuaag

SEQ ID NO: 1876860 - RNA, 16 nt, Salmonella typhimurium LT2
cugccaacauggggag

SEQ ID NO: 1876861 - RNA, 22 nt, Salmonella typhimurium LT2
cugccaacgauauucgcugguc

SEQ ID NO: 1876862 - RNA, 21 nt, Salmonella typhimurium LT2
cugccaaccaucaacuccgga

SEQ ID NO: 1876863 - RNA, 16 nt, Salmonella typhimurium LT2
cugcaacagcaccagc

SEQ ID NO: 1876864 - RNA, 14 nt, Salmonella typhimurium LT2
cugcacaaucgcca

SEQ ID NO: 1876865 - RNA, 17 nt, Salmonella typhimurium LT2
cugcacaauaccaauaa

SEQ ID NO: 1876866 - RNA, 19 nt, Salmonella typhimurium LT2
cugcaaccgacgaacaaaa

SEQ ID NO: 1876867 - RNA, 18 nt, Salmonella typhimurium LT2
cugcaaaucuucggcaaa

SEQ ID NO: 1876868 - RNA, 23 nt, Salmonella typhimurium LT2
cugcaaaaguuugaccagcaaua

SEQ ID NO: 1876869 - RNA, 17 nt, Salmonella typhimurium LT2
cugcacccggagagaaa

SEQ ID NO: 1876870 - RNA, 12 nt, Salmonella typhimurium LT2
cugcaccgccug

SEQ ID NO: 1876871 - RNA, 23 nt, Salmonella typhimurium LT2
cugcacgccgcgcucgcucauca

SEQ ID NO: 1876872 - RNA, 19 nt, Salmonella typhimurium LT2
cugauguaccugcguuaaa

SEQ ID NO: 1876873 - RNA, 14 nt, Salmonella typhimurium LT2
cugauggcguucca

SEQ ID NO: 1876874 - RNA, 15 nt, Salmonella typhimurium LT2
cugauuauucaguac

SEQ ID NO: 1876875 - RNA, 17 nt, Salmonella typhimurium LT2
cugauuauucaguaccg

SEQ ID NO: 1876876 - RNA, 16 nt, Salmonella typhimurium LT2
cugcaaaaagccuugc

SEQ ID NO: 1876877 - RNA, 14 nt, Salmonella typhimurium LT2
cugauuuucuccag

SEQ ID NO: 1876878 - RNA, 15 nt, Salmonella typhimurium LT2
cugaugcgccuccac

SEQ ID NO: 1876879 - RNA, 19 nt, Salmonella typhimurium LT2
cugaugcuggcagaaggca

SEQ ID NO: 1876880 - RNA, 21 nt, Salmonella typhimurium LT2
cugauggcgaaaaugguuuug

SEQ ID NO: 1876881 - RNA, 14 nt, Salmonella typhimurium LT2
cugauggcgcagcg

SEQ ID NO: 1876882 - RNA, 17 nt, Salmonella typhimurium LT2
cugauggcgcugcgcuu

SEQ ID NO: 1876883 - RNA, 17 nt, Salmonella typhimurium LT2
cugaugcgcuauaaaaa

SEQ ID NO: 1876884 - RNA, 18 nt, Salmonella typhimurium LT2
cugaugcgucagauaaaa

SEQ ID NO: 1876885 - RNA, 19 nt, Salmonella typhimurium LT2
cugaugcguuguaccguuu

SEQ ID NO: 1876886 - RNA, 22 nt, Salmonella typhimurium LT2
cugaugaccgccgucauagcag

SEQ ID NO: 1876887 - RNA, 16 nt, Salmonella typhimurium LT2
cugaugacgcgccgga

SEQ ID NO: 1876888 - RNA, 16 nt, Salmonella typhimurium LT2
cugaugaaaggccauc

SEQ ID NO: 1876889 - RNA, 22 nt, Salmonella typhimurium LT2
cugcgucaugucguuagaacca

SEQ ID NO: 1876890 - RNA, 23 nt, Salmonella typhimurium LT2
cugcgucaacgcacuguaacgca

SEQ ID NO: 1876891 - RNA, 13 nt, Salmonella typhimurium LT2
cugcggccaugau

SEQ ID NO: 1876892 - RNA, 12 nt, Salmonella typhimurium LT2
cugcggcaggca

SEQ ID NO: 1876893 - RNA, 17 nt, Salmonella typhimurium LT2
cugcggauguuaaugaa

SEQ ID NO: 1876894 - RNA, 23 nt, Salmonella typhimurium LT2
cugcgcucaucagaccugggcga

SEQ ID NO: 1876895 - RNA, 15 nt, Salmonella typhimurium LT2
cugcgcucgcccuuc

SEQ ID NO: 1876896 - RNA, 23 nt, Salmonella typhimurium LT2
cugcgccugaaaggcacgcuccu

SEQ ID NO: 1876897 - RNA, 24 nt, Salmonella typhimurium LT2
cugcgcuuaucaggccuaccagcc

SEQ ID NO: 1876898 - RNA, 19 nt, Salmonella typhimurium LT2
cugcgcuuaucaggccuac

SEQ ID NO: 1876899 - RNA, 17 nt, Salmonella typhimurium LT2
cugcgcugacggcggca

SEQ ID NO: 1876900 - RNA, 16 nt, Salmonella typhimurium LT2
cugcgccgcgccgccc

SEQ ID NO: 1876901 - RNA, 17 nt, Salmonella typhimurium LT2
cugcgccgcgccgcccc

SEQ ID NO: 1876902 - RNA, 16 nt, Salmonella typhimurium LT2
cugcgccagcauggcg

SEQ ID NO: 1876903 - RNA, 13 nt, Salmonella typhimurium LT2
cugcgccagcaug

SEQ ID NO: 1876904 - RNA, 12 nt, Salmonella typhimurium LT2
cugcgccagccg

SEQ ID NO: 1876905 - RNA, 14 nt, Salmonella typhimurium LT2
cugcgccacgcgcu

SEQ ID NO: 1876906 - RNA, 14 nt, Salmonella typhimurium LT2
cugcgcaaucauga

SEQ ID NO: 1876907 - RNA, 16 nt, Salmonella typhimurium LT2
cugcgauguuauaacc

SEQ ID NO: 1876908 - RNA, 17 nt, Salmonella typhimurium LT2
cugcgaacagcgcucca

SEQ ID NO: 1876909 - RNA, 23 nt, Salmonella typhimurium LT2
cugcgaggucaccgggcgaaagc

SEQ ID NO: 1876910 - RNA, 14 nt, Salmonella typhimurium LT2
cugcgaggccaacg

SEQ ID NO: 1876911 - RNA, 13 nt, Salmonella typhimurium LT2
cugccgccaucgc

SEQ ID NO: 1876912 - RNA, 18 nt, Salmonella typhimurium LT2
cugccgccagcaguugca

SEQ ID NO: 1876913 - RNA, 22 nt, Salmonella typhimurium LT2
cugccgccauaacgccggcgcu

SEQ ID NO: 1876914 - RNA, 21 nt, Salmonella typhimurium LT2
cugccgccgucaucugcgccg

SEQ ID NO: 1876915 - RNA, 18 nt, Salmonella typhimurium LT2
cugccuuuuuuauugccu

SEQ ID NO: 1876916 - RNA, 19 nt, Salmonella typhimurium LT2
cugcgaagguuaagagggu

SEQ ID NO: 1876917 - RNA, 21 nt, Salmonella typhimurium LT2
cugcugcuugcuuuucaucac

SEQ ID NO: 1876918 - RNA, 14 nt, Salmonella typhimurium LT2
cugcuggccuucca

SEQ ID NO: 1876919 - RNA, 17 nt, Salmonella typhimurium LT2
cugcuggcgaugauaau

SEQ ID NO: 1876920 - RNA, 21 nt, Salmonella typhimurium LT2
cugcuguaugauuucacccag

SEQ ID NO: 1876921 - RNA, 20 nt, Salmonella typhimurium LT2
cugcuguagcgucucaucaa

SEQ ID NO: 1876922 - RNA, 19 nt, Salmonella typhimurium LT2
cugcugacguaaauucuga

SEQ ID NO: 1876923 - RNA, 11 nt, Salmonella typhimurium LT2
cugcugauaau

SEQ ID NO: 1876924 - RNA, 13 nt, Salmonella typhimurium LT2
cugcugaugccag

SEQ ID NO: 1876925 - RNA, 23 nt, Salmonella typhimurium LT2
cugcugauauuuucaccuccacg

SEQ ID NO: 1876926 - RNA, 15 nt, Salmonella typhimurium LT2
cugcugccgcagcac

SEQ ID NO: 1876927 - RNA, 14 nt, Salmonella typhimurium LT2
cugcugccagccgc

SEQ ID NO: 1876928 - RNA, 12 nt, Salmonella typhimurium LT2
cugcugcucccu

SEQ ID NO: 1876929 - RNA, 21 nt, Salmonella typhimurium LT2
cugcucguuaaauccucccau

SEQ ID NO: 1876930 - RNA, 20 nt, Salmonella typhimurium LT2
cugcucuaccaacugagcua

SEQ ID NO: 1876931 - RNA, 20 nt, Salmonella typhimurium LT2
cugcucuucuugcggugaga

SEQ ID NO: 1876932 - RNA, 17 nt, Salmonella typhimurium LT2
cugcugaccaaacugcg

SEQ ID NO: 1876933 - RNA, 17 nt, Salmonella typhimurium LT2
cugcugaaaugccuggu

SEQ ID NO: 1876934 - RNA, 18 nt, Salmonella typhimurium LT2
cugcucuuugacaaacgc

SEQ ID NO: 1876935 - RNA, 14 nt, Salmonella typhimurium LT2
cugcucgguaucgu

SEQ ID NO: 1876936 - RNA, 21 nt, Salmonella typhimurium LT2
cugcucggcuaucgccacuac

SEQ ID NO: 1876937 - RNA, 19 nt, Salmonella typhimurium LT2
cugcuccaguuucgccagc

SEQ ID NO: 1876938 - RNA, 18 nt, Salmonella typhimurium LT2
cugcuccggcuuaaugcc

SEQ ID NO: 1876939 - RNA, 22 nt, Salmonella typhimurium LT2
cugcuccggcuuaaugcccggc

SEQ ID NO: 1876940 - RNA, 16 nt, Salmonella typhimurium LT2
cugcgucgcuuccugu

SEQ ID NO: 1876941 - RNA, 18 nt, Salmonella typhimurium LT2
cugcguccauuuccccuc

SEQ ID NO: 1876942 - RNA, 16 nt, Salmonella typhimurium LT2
cugcgugaagacacaa

SEQ ID NO: 1876943 - RNA, 15 nt, Salmonella typhimurium LT2
cugcuccugcggcgu

SEQ ID NO: 1876944 - RNA, 23 nt, Salmonella typhimurium LT2
cugcuccugccagauuuucuuua

SEQ ID NO: 1876945 - RNA, 16 nt, Salmonella typhimurium LT2
cugcucgauaccuucc

SEQ ID NO: 1876946 - RNA, 23 nt, Salmonella typhimurium LT2
cugcucgauaccuuccgggccgg

SEQ ID NO: 1876947 - RNA, 16 nt, Salmonella typhimurium LT2
cuggaugacugaauua

SEQ ID NO: 1876948 - RNA, 14 nt, Salmonella typhimurium LT2
cuggaugacacagg

SEQ ID NO: 1876949 - RNA, 17 nt, Salmonella typhimurium LT2
cuggcaaaacgcaucca

SEQ ID NO: 1876950 - RNA, 23 nt, Salmonella typhimurium LT2
cuggcaaagcgucauguaaugcu

SEQ ID NO: 1876951 - RNA, 13 nt, Salmonella typhimurium LT2
cuggcaaacaagc

SEQ ID NO: 1876952 - RNA, 19 nt, Salmonella typhimurium LT2
cuggcaaaccggucggcgu

SEQ ID NO: 1876953 - RNA, 18 nt, Salmonella typhimurium LT2
cuggauuacaaaaauaga

SEQ ID NO: 1876954 - RNA, 23 nt, Salmonella typhimurium LT2
cuggauuuggcugccgagcagau

SEQ ID NO: 1876955 - RNA, 18 nt, Salmonella typhimurium LT2
cuggauuuaacggagcaa

SEQ ID NO: 1876956 - RNA, 14 nt, Salmonella typhimurium LT2
cugcuuaaacagaa

SEQ ID NO: 1876957 - RNA, 12 nt, Salmonella typhimurium LT2
cugcuucagcca

SEQ ID NO: 1876958 - RNA, 15 nt, Salmonella typhimurium LT2
cugcuuauucuuuuc

SEQ ID NO: 1876959 - RNA, 15 nt, Salmonella typhimurium LT2
cugcuucgcuggcgu

SEQ ID NO: 1876960 - RNA, 14 nt, Salmonella typhimurium LT2
cugcuuccugccgc

SEQ ID NO: 1876961 - RNA, 13 nt, Salmonella typhimurium LT2
cugcuucugcccc

SEQ ID NO: 1876962 - RNA, 13 nt, Salmonella typhimurium LT2
cuggauagagcau

SEQ ID NO: 1876963 - RNA, 21 nt, Salmonella typhimurium LT2
cuggaucacuuuugccgucag

SEQ ID NO: 1876964 - RNA, 16 nt, Salmonella typhimurium LT2
cuggaucagauucccc

SEQ ID NO: 1876965 - RNA, 22 nt, Salmonella typhimurium LT2
cuggaucaggcgcuugcgccgc

SEQ ID NO: 1876966 - RNA, 16 nt, Salmonella typhimurium LT2
cuggauagucuucaag

SEQ ID NO: 1876967 - RNA, 16 nt, Salmonella typhimurium LT2
cuggauagccucguug

SEQ ID NO: 1876968 - RNA, 16 nt, Salmonella typhimurium LT2
cuggcgacaucuggcu

SEQ ID NO: 1876969 - RNA, 19 nt, Salmonella typhimurium LT2
cuggcgaccagccugccgu

SEQ ID NO: 1876970 - RNA, 22 nt, Salmonella typhimurium LT2
cuggcgaccgccaccauccggc

SEQ ID NO: 1876971 - RNA, 11 nt, Salmonella typhimurium LT2
cuggcagagac

SEQ ID NO: 1876972 - RNA, 23 nt, Salmonella typhimurium LT2
cuggccacgccgaggcauucagc

SEQ ID NO: 1876973 - RNA, 22 nt, Salmonella typhimurium LT2
cuggcagccucguccugcaauu

SEQ ID NO: 1876974 - RNA, 20 nt, Salmonella typhimurium LT2
cuggcagcggaaaucagaua

SEQ ID NO: 1876975 - RNA, 14 nt, Salmonella typhimurium LT2
cuggccaguuucaa

SEQ ID NO: 1876976 - RNA, 16 nt, Salmonella typhimurium LT2
cuggcugaaccccugu

SEQ ID NO: 1876977 - RNA, 17 nt, Salmonella typhimurium LT2
cuggcugcugauggucu

SEQ ID NO: 1876978 - RNA, 15 nt, Salmonella typhimurium LT2
cuggcugcggccucc

SEQ ID NO: 1876979 - RNA, 14 nt, Salmonella typhimurium LT2
cuggcugcgccgcu

SEQ ID NO: 1876980 - RNA, 17 nt, Salmonella typhimurium LT2
cuggcuggcgcugacga

SEQ ID NO: 1876981 - RNA, 21 nt, Salmonella typhimurium LT2
cuggcuuguucaucgccgugg

SEQ ID NO: 1876982 - RNA, 13 nt, Salmonella typhimurium LT2
cuggcuugccaga

SEQ ID NO: 1876983 - RNA, 20 nt, Salmonella typhimurium LT2
cuggcuugauguagucgcuc

SEQ ID NO: 1876984 - RNA, 15 nt, Salmonella typhimurium LT2
cuggcuuacucgccc

SEQ ID NO: 1876985 - RNA, 15 nt, Salmonella typhimurium LT2
cuggcuaucgccgua

SEQ ID NO: 1876986 - RNA, 20 nt, Salmonella typhimurium LT2
cuggcguuuccgcuaccgcu

SEQ ID NO: 1876987 - RNA, 15 nt, Salmonella typhimurium LT2
cuggcguugcagguu

SEQ ID NO: 1876988 - RNA, 19 nt, Salmonella typhimurium LT2
cuggcucacugacuaucca

SEQ ID NO: 1876989 - RNA, 14 nt, Salmonella typhimurium LT2
cuggcucacugacu

SEQ ID NO: 1876990 - RNA, 22 nt, Salmonella typhimurium LT2
cuggcgcacgcgucaucggcgc

SEQ ID NO: 1876991 - RNA, 18 nt, Salmonella typhimurium LT2
cuggcgucgccaaagcag

SEQ ID NO: 1876992 - RNA, 19 nt, Salmonella typhimurium LT2
cuggcuuugcgccacuuca

SEQ ID NO: 1876993 - RNA, 16 nt, Salmonella typhimurium LT2
cuggcuuugcgccggc

SEQ ID NO: 1876994 - RNA, 18 nt, Salmonella typhimurium LT2
cugggauaagcagaacaa

SEQ ID NO: 1876995 - RNA, 19 nt, Salmonella typhimurium LT2
cugggcauuaccccagcau

SEQ ID NO: 1876996 - RNA, 23 nt, Salmonella typhimurium LT2
cugggcggcaacccgcuccagaa

SEQ ID NO: 1876997 - RNA, 21 nt, Salmonella typhimurium LT2
cugggccgccacgaccugcag

SEQ ID NO: 1876998 - RNA, 15 nt, Salmonella typhimurium LT2
cugggccggugcgau

SEQ ID NO: 1876999 - RNA, 21 nt, Salmonella typhimurium LT2
cugguuucggcaucccaggcg

SEQ ID NO: 1877000 - RNA, 15 nt, Salmonella typhimurium LT2
cugguuugucgauuu

SEQ ID NO: 1877001 - RNA, 18 nt, Salmonella typhimurium LT2
cugguuguccaccagcgc

SEQ ID NO: 1877002 - RNA, 14 nt, Salmonella typhimurium LT2
cugguuggcgcgcu

SEQ ID NO: 1877003 - RNA, 22 nt, Salmonella typhimurium LT2
cugguugucacggaucuucuuc

SEQ ID NO: 1877004 - RNA, 18 nt, Salmonella typhimurium LT2
cugguugcccauggcauc

SEQ ID NO: 1877005 - RNA, 14 nt, Salmonella typhimurium LT2
cugguugaccggaa

SEQ ID NO: 1877006 - RNA, 17 nt, Salmonella typhimurium LT2
cugguucgaauccaggu

SEQ ID NO: 1877007 - RNA, 13 nt, Salmonella typhimurium LT2
cugguucaacauc

SEQ ID NO: 1877008 - RNA, 20 nt, Salmonella typhimurium LT2
cugguuaaugaccugccgcg

SEQ ID NO: 1877009 - RNA, 15 nt, Salmonella typhimurium LT2
cugguuaauaauuuu

SEQ ID NO: 1877010 - RNA, 22 nt, Salmonella typhimurium LT2
cugguuaaugccuucgccgccg

SEQ ID NO: 1877011 - RNA, 17 nt, Salmonella typhimurium LT2
cugggucacgauaacca

SEQ ID NO: 1877012 - RNA, 14 nt, Salmonella typhimurium LT2
cugggucaggacag

SEQ ID NO: 1877013 - RNA, 18 nt, Salmonella typhimurium LT2
cuggguuccgggcgcacc

SEQ ID NO: 1877014 - RNA, 20 nt, Salmonella typhimurium LT2
cugguaaaacgauauugccu

SEQ ID NO: 1877015 - RNA, 23 nt, Salmonella typhimurium LT2
cugguaaauaacgggcgcgcgcg

SEQ ID NO: 1877016 - RNA, 21 nt, Salmonella typhimurium LT2
cuggguuuugucgguaauguc

SEQ ID NO: 1877017 - RNA, 13 nt, Salmonella typhimurium LT2
cuggugggguucc

SEQ ID NO: 1877018 - RNA, 22 nt, Salmonella typhimurium LT2
cugguguaaaccaggcauuuuc

SEQ ID NO: 1877019 - RNA, 18 nt, Salmonella typhimurium LT2
cugucauaggcgacaggc

SEQ ID NO: 1877020 - RNA, 12 nt, Salmonella typhimurium LT2
cugucaucauca

SEQ ID NO: 1877021 - RNA, 23 nt, Salmonella typhimurium LT2
cugucaucgaaggcgauaccggu

SEQ ID NO: 1877022 - RNA, 18 nt, Salmonella typhimurium LT2
cuguccacgacagaaccc

SEQ ID NO: 1877023 - RNA, 20 nt, Salmonella typhimurium LT2
cuguccacgacagaacccgg

SEQ ID NO: 1877024 - RNA, 23 nt, Salmonella typhimurium LT2
cugucauugggagcaaagcucac

SEQ ID NO: 1877025 - RNA, 20 nt, Salmonella typhimurium LT2
cuguagcgcuuuggagguca

SEQ ID NO: 1877026 - RNA, 16 nt, Salmonella typhimurium LT2
cuguagcgccgcuucc

SEQ ID NO: 1877027 - RNA, 19 nt, Salmonella typhimurium LT2
cuguagcguuucgcgcgcg

SEQ ID NO: 1877028 - RNA, 23 nt, Salmonella typhimurium LT2
cuguagcgucucaucaaaaaggc

SEQ ID NO: 1877029 - RNA, 22 nt, Salmonella typhimurium LT2
cuguagggcacugggcgauacc

SEQ ID NO: 1877030 - RNA, 23 nt, Salmonella typhimurium LT2
cuguaauagauaugaaagaagga

SEQ ID NO: 1877031 - RNA, 17 nt, Salmonella typhimurium LT2
cuguaacuucggccagc

SEQ ID NO: 1877032 - RNA, 23 nt, Salmonella typhimurium LT2
cuguagauagcuauccacgcaga

SEQ ID NO: 1877033 - RNA, 20 nt, Salmonella typhimurium LT2
cuguagcaguggagaggcca

SEQ ID NO: 1877034 - RNA, 22 nt, Salmonella typhimurium LT2
cuguagccagccugaacgggug

SEQ ID NO: 1877035 - RNA, 15 nt, Salmonella typhimurium LT2
cugucuuguuuuucu

SEQ ID NO: 1877036 - RNA, 11 nt, Salmonella typhimurium LT2
cugugaaaacg

SEQ ID NO: 1877037 - RNA, 14 nt, Salmonella typhimurium LT2
cugucuuguuuuuc

SEQ ID NO: 1877038 - RNA, 16 nt, Salmonella typhimurium LT2
cugugagccuaaaaca

SEQ ID NO: 1877039 - RNA, 13 nt, Salmonella typhimurium LT2
cugugaggaaagc

SEQ ID NO: 1877040 - RNA, 21 nt, Salmonella typhimurium LT2
cugugaggaaagcgaaaauaa

SEQ ID NO: 1877041 - RNA, 22 nt, Salmonella typhimurium LT2
cugucgaaaccagcauaaugag

SEQ ID NO: 1877042 - RNA, 23 nt, Salmonella typhimurium LT2
cuguccugacggcgacgcgccgu

SEQ ID NO: 1877043 - RNA, 21 nt, Salmonella typhimurium LT2
cuguccgccuuaucaggccug

SEQ ID NO: 1877044 - RNA, 18 nt, Salmonella typhimurium LT2
cugucuuagugaaauacc

SEQ ID NO: 1877045 - RNA, 19 nt, Salmonella typhimurium LT2
cugucgacuggccuuuuuu

SEQ ID NO: 1877046 - RNA, 19 nt, Salmonella typhimurium LT2
cugucgauaauauccagca

SEQ ID NO: 1877047 - RNA, 17 nt, Salmonella typhimurium LT2
cugucgauccccucuuc

SEQ ID NO: 1877048 - RNA, 19 nt, Salmonella typhimurium LT2
cugugccauauucucuggc

SEQ ID NO: 1877049 - RNA, 20 nt, Salmonella typhimurium LT2
cugugccaguaccgccgccg

SEQ ID NO: 1877050 - RNA, 21 nt, Salmonella typhimurium LT2
cugugccagcucguuauuucc

SEQ ID NO: 1877051 - RNA, 18 nt, Salmonella typhimurium LT2
cugugcauaucuggcgag

SEQ ID NO: 1877052 - RNA, 21 nt, Salmonella typhimurium LT2
cugugauccauguugccauga

SEQ ID NO: 1877053 - RNA, 21 nt, Salmonella typhimurium LT2
cugugccgcuggugcuacggg

SEQ ID NO: 1877054 - RNA, 18 nt, Salmonella typhimurium LT2
cugugcgaagguggcgga

SEQ ID NO: 1877055 - RNA, 17 nt, Salmonella typhimurium LT2
cugugccguugagcaca

SEQ ID NO: 1877056 - RNA, 12 nt, Salmonella typhimurium LT2
cuguuaaaaaau

SEQ ID NO: 1877057 - RNA, 16 nt, Salmonella typhimurium LT2
cuguuaauuucccgcu

SEQ ID NO: 1877058 - RNA, 13 nt, Salmonella typhimurium LT2
cuguuaucaggca

SEQ ID NO: 1877059 - RNA, 22 nt, Salmonella typhimurium LT2
cuguuacgcggucuuuuaaaag

SEQ ID NO: 1877060 - RNA, 13 nt, Salmonella typhimurium LT2
cuguuaguaaaca

SEQ ID NO: 1877061 - RNA, 13 nt, Salmonella typhimurium LT2
cuguucacaucca

SEQ ID NO: 1877062 - RNA, 17 nt, Salmonella typhimurium LT2
cuguucagccagcaagg

SEQ ID NO: 1877063 - RNA, 17 nt, Salmonella typhimurium LT2
cugugguugcccgcagg

SEQ ID NO: 1877064 - RNA, 24 nt, Salmonella typhimurium LT2
cuguguauucugcgccagccagcu

SEQ ID NO: 1877065 - RNA, 23 nt, Salmonella typhimurium LT2
cuguguagaaauucugcaggcca

SEQ ID NO: 1877066 - RNA, 20 nt, Salmonella typhimurium LT2
cuguguacgcguucugaaua

SEQ ID NO: 1877067 - RNA, 17 nt, Salmonella typhimurium LT2
cugugugggcacucgaa

SEQ ID NO: 1877068 - RNA, 17 nt, Salmonella typhimurium LT2
cuguggaggguaagaaa

SEQ ID NO: 1877069 - RNA, 20 nt, Salmonella typhimurium LT2
cuguggguugccauauuuuc

SEQ ID NO: 1877070 - RNA, 21 nt, Salmonella typhimurium LT2
cucccggaugcaccaucucuu

SEQ ID NO: 1877071 - RNA, 17 nt, Salmonella typhimurium LT2
cucccggcauguaggcc

SEQ ID NO: 1877072 - RNA, 15 nt, Salmonella typhimurium LT2
cuccccuuuuuucug

SEQ ID NO: 1877073 - RNA, 13 nt, Salmonella typhimurium LT2
cuccccgcgcgau

SEQ ID NO: 1877074 - RNA, 22 nt, Salmonella typhimurium LT2
cuccccgccccagcagcagccg

SEQ ID NO: 1877075 - RNA, 16 nt, Salmonella typhimurium LT2
cuccaccauaucgcag

SEQ ID NO: 1877076 - RNA, 18 nt, Salmonella typhimurium LT2
cuccacauauugagcuga

SEQ ID NO: 1877077 - RNA, 21 nt, Salmonella typhimurium LT2
cuccgcgcauguaaccaaagc

SEQ ID NO: 1877078 - RNA, 19 nt, Salmonella typhimurium LT2
cuccgcgauggucuucuuu

SEQ ID NO: 1877079 - RNA, 22 nt, Salmonella typhimurium LT2
cuccgcgauggucuucuuucag

SEQ ID NO: 1877080 - RNA, 16 nt, Salmonella typhimurium LT2
cuccgcgagcagccag

SEQ ID NO: 1877081 - RNA, 14 nt, Salmonella typhimurium LT2
cucccguuccaggc

SEQ ID NO: 1877082 - RNA, 20 nt, Salmonella typhimurium LT2
cucccguuucgacgggaggu

SEQ ID NO: 1877083 - RNA, 16 nt, Salmonella typhimurium LT2
cucccucaaccagggu

SEQ ID NO: 1877084 - RNA, 16 nt, Salmonella typhimurium LT2
cucccucacccuucac

SEQ ID NO: 1877085 - RNA, 14 nt, Salmonella typhimurium LT2
cuccggacguaccc

SEQ ID NO: 1877086 - RNA, 16 nt, Salmonella typhimurium LT2
cuccgcuauaaaaauu

SEQ ID NO: 1877087 - RNA, 20 nt, Salmonella typhimurium LT2
cuccugacauagcucacgca

SEQ ID NO: 1877088 - RNA, 15 nt, Salmonella typhimurium LT2
cuccuggauuuuacc

SEQ ID NO: 1877089 - RNA, 16 nt, Salmonella typhimurium LT2
cuccuggauuuuaccu

SEQ ID NO: 1877090 - RNA, 13 nt, Salmonella typhimurium LT2
cuccugcucccag

SEQ ID NO: 1877091 - RNA, 19 nt, Salmonella typhimurium LT2
cuccuccccggcgacccgc

SEQ ID NO: 1877092 - RNA, 16 nt, Salmonella typhimurium LT2
cucgaccuggugcuca

SEQ ID NO: 1877093 - RNA, 21 nt, Salmonella typhimurium LT2
cuccuuguaagggaggugcuc

SEQ ID NO: 1877094 - RNA, 23 nt, Salmonella typhimurium LT2
cuccuuguaagggaggugcucuc

SEQ ID NO: 1877095 - RNA, 23 nt, Salmonella typhimurium LT2
cuccuucuucgccgucauaaaac

SEQ ID NO: 1877096 - RNA, 15 nt, Salmonella typhimurium LT2
cuccuguaacagggg

SEQ ID NO: 1877097 - RNA, 20 nt, Salmonella typhimurium LT2
cucgccgacggucaaacuga

SEQ ID NO: 1877098 - RNA, 18 nt, Salmonella typhimurium LT2
cucgccgccucccccuca

SEQ ID NO: 1877099 - RNA, 17 nt, Salmonella typhimurium LT2
cucgccgccucccccuc

SEQ ID NO: 1877100 - RNA, 16 nt, Salmonella typhimurium LT2
cucgccgccucccccu

SEQ ID NO: 1877101 - RNA, 13 nt, Salmonella typhimurium LT2
cucgccgccuccc

SEQ ID NO: 1877102 - RNA, 23 nt, Salmonella typhimurium LT2
cucgccgcguuuaagccccuggc

SEQ ID NO: 1877103 - RNA, 13 nt, Salmonella typhimurium LT2
cucgccccuucgg

SEQ ID NO: 1877104 - RNA, 17 nt, Salmonella typhimurium LT2
cucgcagguacgacacc

SEQ ID NO: 1877105 - RNA, 20 nt, Salmonella typhimurium LT2
cucgcacugauagccgccag

SEQ ID NO: 1877106 - RNA, 15 nt, Salmonella typhimurium LT2
cucgcaagauuccag

SEQ ID NO: 1877107 - RNA, 13 nt, Salmonella typhimurium LT2
cucgaugauaaag

SEQ ID NO: 1877108 - RNA, 21 nt, Salmonella typhimurium LT2
cucgaggaacuguucagccag

SEQ ID NO: 1877109 - RNA, 17 nt, Salmonella typhimurium LT2
cucgagcauuugcgcuu

SEQ ID NO: 1877110 - RNA, 22 nt, Salmonella typhimurium LT2
cucggcgaggacccguggcugc

SEQ ID NO: 1877111 - RNA, 15 nt, Salmonella typhimurium LT2
cucggucaacauucc

SEQ ID NO: 1877112 - RNA, 23 nt, Salmonella typhimurium LT2
cucgguauaaauuuccgcagcca

SEQ ID NO: 1877113 - RNA, 16 nt, Salmonella typhimurium LT2
cucgguaaccauccau

SEQ ID NO: 1877114 - RNA, 13 nt, Salmonella typhimurium LT2
cucggcgagcagu

SEQ ID NO: 1877115 - RNA, 18 nt, Salmonella typhimurium LT2
cucggcauacaccgccag

SEQ ID NO: 1877116 - RNA, 21 nt, Salmonella typhimurium LT2
cucggcagcaauacgcccgcc

SEQ ID NO: 1877117 - RNA, 16 nt, Salmonella typhimurium LT2
cucgcgauccgccagc

SEQ ID NO: 1877118 - RNA, 21 nt, Salmonella typhimurium LT2
cucggugcauuugucgcuguu

SEQ ID NO: 1877119 - RNA, 15 nt, Salmonella typhimurium LT2
cucguaggccagcgc

SEQ ID NO: 1877120 - RNA, 17 nt, Salmonella typhimurium LT2
cucgucggccagcgccg

SEQ ID NO: 1877121 - RNA, 12 nt, Salmonella typhimurium LT2
cucuaaauguug

SEQ ID NO: 1877122 - RNA, 13 nt, Salmonella typhimurium LT2
cucuaaccaacug

SEQ ID NO: 1877123 - RNA, 18 nt, Salmonella typhimurium LT2
cucuggcggcgugauccc

SEQ ID NO: 1877124 - RNA, 22 nt, Salmonella typhimurium LT2
cucugguaguuguaauaaacag

SEQ ID NO: 1877125 - RNA, 18 nt, Salmonella typhimurium LT2
cucugccaguugcucaua

SEQ ID NO: 1877126 - RNA, 22 nt, Salmonella typhimurium LT2
cucuccugucguuagugggauc

SEQ ID NO: 1877127 - RNA, 12 nt, Salmonella typhimurium LT2
cucuccugaagc

SEQ ID NO: 1877128 - RNA, 14 nt, Salmonella typhimurium LT2
cucuccugaagcca

SEQ ID NO: 1877129 - RNA, 15 nt, Salmonella typhimurium LT2
cucuccuacaccacc

SEQ ID NO: 1877130 - RNA, 12 nt, Salmonella typhimurium LT2
cucucucuguaa

SEQ ID NO: 1877131 - RNA, 14 nt, Salmonella typhimurium LT2
cucucuuccuccug

SEQ ID NO: 1877132 - RNA, 19 nt, Salmonella typhimurium LT2
cucucuuucaccagcgcca

SEQ ID NO: 1877133 - RNA, 20 nt, Salmonella typhimurium LT2
cucucuuucaccagcgccag

SEQ ID NO: 1877134 - RNA, 18 nt, Salmonella typhimurium LT2
cucucaggcaguaacucu

SEQ ID NO: 1877135 - RNA, 13 nt, Salmonella typhimurium LT2
cucucauauucca

SEQ ID NO: 1877136 - RNA, 17 nt, Salmonella typhimurium LT2
cucuccagcaggguauu

SEQ ID NO: 1877137 - RNA, 14 nt, Salmonella typhimurium LT2
cucucccagcugag

SEQ ID NO: 1877138 - RNA, 13 nt, Salmonella typhimurium LT2
cucuccaguucug

SEQ ID NO: 1877139 - RNA, 21 nt, Salmonella typhimurium LT2
cucuccggcucgucccgcagc

SEQ ID NO: 1877140 - RNA, 23 nt, Salmonella typhimurium LT2
cucuccggcucgucccgcagcau

SEQ ID NO: 1877141 - RNA, 12 nt, Salmonella typhimurium LT2
cucucaccgccc

SEQ ID NO: 1877142 - RNA, 17 nt, Salmonella typhimurium LT2
cucucaccgcccaggcc

SEQ ID NO: 1877143 - RNA, 21 nt, Salmonella typhimurium LT2
cucucaacauaauaaagccgg

SEQ ID NO: 1877144 - RNA, 21 nt, Salmonella typhimurium LT2
cucuauaccauaaaugaaacc

SEQ ID NO: 1877145 - RNA, 22 nt, Salmonella typhimurium LT2
cucuauagcggucaaaauauaa

SEQ ID NO: 1877146 - RNA, 20 nt, Salmonella typhimurium LT2
cucuauuuuuucaaucaggu

SEQ ID NO: 1877147 - RNA, 12 nt, Salmonella typhimurium LT2
cucuauuuuuuu

SEQ ID NO: 1877148 - RNA, 18 nt, Salmonella typhimurium LT2
cugacacagaggaauauu

SEQ ID NO: 1877149 - RNA, 20 nt, Salmonella typhimurium LT2
cugacagagcucgucaaaaa

SEQ ID NO: 1877150 - RNA, 22 nt, Salmonella typhimurium LT2
cugacaaaucggcuccggcaaa

SEQ ID NO: 1877151 - RNA, 18 nt, Salmonella typhimurium LT2
cugacaaggcgaucucaa

SEQ ID NO: 1877152 - RNA, 18 nt, Salmonella typhimurium LT2
cugacagggucgcaauac

SEQ ID NO: 1877153 - RNA, 15 nt, Salmonella typhimurium LT2
cugacagugacggca

SEQ ID NO: 1877154 - RNA, 15 nt, Salmonella typhimurium LT2
cugacaggucggcgu

SEQ ID NO: 1877155 - RNA, 23 nt, Salmonella typhimurium LT2
cugacagagcucgucaaaaauca

SEQ ID NO: 1877156 - RNA, 17 nt, Salmonella typhimurium LT2
cugacagccaaacugcu

SEQ ID NO: 1877157 - RNA, 14 nt, Salmonella typhimurium LT2
cugaccaucaaucc

SEQ ID NO: 1877158 - RNA, 19 nt, Salmonella typhimurium LT2
cugaccaagcgucagcaug

SEQ ID NO: 1877159 - RNA, 17 nt, Salmonella typhimurium LT2
cugaccacgacgaccgc

SEQ ID NO: 1877160 - RNA, 15 nt, Salmonella typhimurium LT2
cugaccgcauuuucu

SEQ ID NO: 1877161 - RNA, 16 nt, Salmonella typhimurium LT2
cugaccgcguuuccac

SEQ ID NO: 1877162 - RNA, 21 nt, Salmonella typhimurium LT2
cugaauuuaauggucuuaaau

SEQ ID NO: 1877163 - RNA, 14 nt, Salmonella typhimurium LT2
cugaaugcucucau

SEQ ID NO: 1877164 - RNA, 20 nt, Salmonella typhimurium LT2
cugaaucuugcgcagcauau

SEQ ID NO: 1877165 - RNA, 13 nt, Salmonella typhimurium LT2
cugaaucaauagc

SEQ ID NO: 1877166 - RNA, 19 nt, Salmonella typhimurium LT2
cugaaucaauagcuggguc

SEQ ID NO: 1877167 - RNA, 22 nt, Salmonella typhimurium LT2
cugaaucaaugcaucuucacug

SEQ ID NO: 1877168 - RNA, 16 nt, Salmonella typhimurium LT2
cugaaucagcaucuua

SEQ ID NO: 1877169 - RNA, 22 nt, Salmonella typhimurium LT2
cugaauauucggcuccagauug

SEQ ID NO: 1877170 - RNA, 18 nt, Salmonella typhimurium LT2
cugaauauggccaguccc

SEQ ID NO: 1877171 - RNA, 19 nt, Salmonella typhimurium LT2
cugaauauucggcuccaga

SEQ ID NO: 1877172 - RNA, 21 nt, Salmonella typhimurium LT2
cugaauaaugguaaauuuauc

SEQ ID NO: 1877173 - RNA, 15 nt, Salmonella typhimurium LT2
cugaauaauauguaa

SEQ ID NO: 1877174 - RNA, 15 nt, Salmonella typhimurium LT2
cugaauaaauugaau

SEQ ID NO: 1877175 - RNA, 17 nt, Salmonella typhimurium LT2
cugaauaucgucaguau

SEQ ID NO: 1877176 - RNA, 17 nt, Salmonella typhimurium LT2
cugaauacccaacugua

SEQ ID NO: 1877177 - RNA, 16 nt, Salmonella typhimurium LT2
cugaauaccugcccca

SEQ ID NO: 1877178 - RNA, 17 nt, Salmonella typhimurium LT2
cugaauagcuuucaccg

SEQ ID NO: 1877179 - RNA, 15 nt, Salmonella typhimurium LT2
cugaauagccagccc

SEQ ID NO: 1877180 - RNA, 22 nt, Salmonella typhimurium LT2
cugaagcugccgucccagcgga

SEQ ID NO: 1877181 - RNA, 15 nt, Salmonella typhimurium LT2
cugaagcguauuucu

SEQ ID NO: 1877182 - RNA, 22 nt, Salmonella typhimurium LT2
cugaaggcgcuaugcugaucau

SEQ ID NO: 1877183 - RNA, 21 nt, Salmonella typhimurium LT2
cugaaguaucgacgcagacaa

SEQ ID NO: 1877184 - RNA, 15 nt, Salmonella typhimurium LT2
cugaagguuuuuccc

SEQ ID NO: 1877185 - RNA, 19 nt, Salmonella typhimurium LT2
cugacuacgguugccuuuc

SEQ ID NO: 1877186 - RNA, 16 nt, Salmonella typhimurium LT2
cugacguuggccgccg

SEQ ID NO: 1877187 - RNA, 17 nt, Salmonella typhimurium LT2
cugacguugcgaaucag

SEQ ID NO: 1877188 - RNA, 13 nt, Salmonella typhimurium LT2
cugacuauccaca

SEQ ID NO: 1877189 - RNA, 20 nt, Salmonella typhimurium LT2
cugacucgcgcaauauucca

SEQ ID NO: 1877190 - RNA, 16 nt, Salmonella typhimurium LT2
cugacggcgcugucac

SEQ ID NO: 1877191 - RNA, 22 nt, Salmonella typhimurium LT2
cugacgcguuuuuucaugaauc

SEQ ID NO: 1877192 - RNA, 14 nt, Salmonella typhimurium LT2
cugacgcugagcgg

SEQ ID NO: 1877193 - RNA, 22 nt, Salmonella typhimurium LT2
cugacggugauguuggcccgga

SEQ ID NO: 1877194 - RNA, 16 nt, Salmonella typhimurium LT2
cugacggugguaaauc

SEQ ID NO: 1877195 - RNA, 18 nt, Salmonella typhimurium LT2
cugacggugguaaaucag

SEQ ID NO: 1877196 - RNA, 17 nt, Salmonella typhimurium LT2
cugacguaaauucugau

SEQ ID NO: 1877197 - RNA, 19 nt, Salmonella typhimurium LT2
cugacgggcauuguuaauc

SEQ ID NO: 1877198 - RNA, 13 nt, Salmonella typhimurium LT2
cugaccuuaaucc

SEQ ID NO: 1877199 - RNA, 13 nt, Salmonella typhimurium LT2
cugaccuacaggc

SEQ ID NO: 1877200 - RNA, 18 nt, Salmonella typhimurium LT2
cugacgaaaacccgccac

SEQ ID NO: 1877201 - RNA, 18 nt, Salmonella typhimurium LT2
cugacgcccaucagcauc

SEQ ID NO: 1877202 - RNA, 14 nt, Salmonella typhimurium LT2
cugacgccagccag

SEQ ID NO: 1877203 - RNA, 15 nt, Salmonella typhimurium LT2
cugacgccagccagc

SEQ ID NO: 1877204 - RNA, 16 nt, Salmonella typhimurium LT2
cugacgccaggccauc

SEQ ID NO: 1877205 - RNA, 18 nt, Salmonella typhimurium LT2
cugacgcgccagcucauu

SEQ ID NO: 1877206 - RNA, 15 nt, Salmonella typhimurium LT2
cugacgaguggcgga

SEQ ID NO: 1877207 - RNA, 17 nt, Salmonella typhimurium LT2
cugacgacucucccauc

SEQ ID NO: 1877208 - RNA, 17 nt, Salmonella typhimurium LT2
cugacgaauagcgcgcu

SEQ ID NO: 1877209 - RNA, 13 nt, Salmonella typhimurium LT2
cugacugcauaau

SEQ ID NO: 1877210 - RNA, 19 nt, Salmonella typhimurium LT2
cugacugcauaauggugga

SEQ ID NO: 1877211 - RNA, 17 nt, Salmonella typhimurium LT2
cugacugccgccggcuu

SEQ ID NO: 1877212 - RNA, 16 nt, Salmonella typhimurium LT2
cugagaauuuccaguu

SEQ ID NO: 1877213 - RNA, 18 nt, Salmonella typhimurium LT2
cugagaauuuccaguuca

SEQ ID NO: 1877214 - RNA, 20 nt, Salmonella typhimurium LT2
cugagaauuuccaguucaau

SEQ ID NO: 1877215 - RNA, 13 nt, Salmonella typhimurium LT2
cugagacgccugc

SEQ ID NO: 1877216 - RNA, 16 nt, Salmonella typhimurium LT2
cugagacgccugcaga

SEQ ID NO: 1877217 - RNA, 18 nt, Salmonella typhimurium LT2
cugagacgcgaaacgaaa

SEQ ID NO: 1877218 - RNA, 17 nt, Salmonella typhimurium LT2
cugagaacuauuugccu

SEQ ID NO: 1877219 - RNA, 12 nt, Salmonella typhimurium LT2
cugagcagccag

SEQ ID NO: 1877220 - RNA, 13 nt, Salmonella typhimurium LT2
cugagcagccagc

SEQ ID NO: 1877221 - RNA, 15 nt, Salmonella typhimurium LT2
cugagcaaacucaau

SEQ ID NO: 1877222 - RNA, 18 nt, Salmonella typhimurium LT2
cugagaucaaacaagaga

SEQ ID NO: 1877223 - RNA, 13 nt, Salmonella typhimurium LT2
cugagaucaaaca

SEQ ID NO: 1877224 - RNA, 15 nt, Salmonella typhimurium LT2
cugagaugacgccau

SEQ ID NO: 1877225 - RNA, 22 nt, Salmonella typhimurium LT2
cugagcgcgcaaucgggccugc

SEQ ID NO: 1877226 - RNA, 14 nt, Salmonella typhimurium LT2
cugagcgccagcgu

SEQ ID NO: 1877227 - RNA, 18 nt, Salmonella typhimurium LT2
cugagccucuaaauguug

SEQ ID NO: 1877228 - RNA, 16 nt, Salmonella typhimurium LT2
cucugguuucccugcc

SEQ ID NO: 1877229 - RNA, 15 nt, Salmonella typhimurium LT2
cucuguugccgcccg

SEQ ID NO: 1877230 - RNA, 14 nt, Salmonella typhimurium LT2
cucuuauuguagug

SEQ ID NO: 1877231 - RNA, 17 nt, Salmonella typhimurium LT2
cucuucaucgcgccucc

SEQ ID NO: 1877232 - RNA, 23 nt, Salmonella typhimurium LT2
cucuucaucgcgccuccccugcc

SEQ ID NO: 1877233 - RNA, 15 nt, Salmonella typhimurium LT2
cucuucacccuucuu

SEQ ID NO: 1877234 - RNA, 17 nt, Salmonella typhimurium LT2
cucuucacccuucuucu

SEQ ID NO: 1877235 - RNA, 20 nt, Salmonella typhimurium LT2
cucuucaacggucucaggcu

SEQ ID NO: 1877236 - RNA, 19 nt, Salmonella typhimurium LT2
cucuuccccggucagucca

SEQ ID NO: 1877237 - RNA, 12 nt, Salmonella typhimurium LT2
cucuuccgccag

SEQ ID NO: 1877238 - RNA, 15 nt, Salmonella typhimurium LT2
cucuuccuccccagg

SEQ ID NO: 1877239 - RNA, 20 nt, Salmonella typhimurium LT2
cucuuccagcugcucuucuu

SEQ ID NO: 1877240 - RNA, 15 nt, Salmonella typhimurium LT2
cucuuccaucagcca

SEQ ID NO: 1877241 - RNA, 16 nt, Salmonella typhimurium LT2
cucuucgacaucuuca

SEQ ID NO: 1877242 - RNA, 14 nt, Salmonella typhimurium LT2
cucuucgacacauu

SEQ ID NO: 1877243 - RNA, 12 nt, Salmonella typhimurium LT2
cucuucgccaau

SEQ ID NO: 1877244 - RNA, 13 nt, Salmonella typhimurium LT2
cucuucgaugacc

SEQ ID NO: 1877245 - RNA, 17 nt, Salmonella typhimurium LT2
cucuuccuccccaggcg

SEQ ID NO: 1877246 - RNA, 20 nt, Salmonella typhimurium LT2
cucuugugcuuccagcucca

SEQ ID NO: 1877247 - RNA, 14 nt, Salmonella typhimurium LT2
cucuuuaccgccaa

SEQ ID NO: 1877248 - RNA, 15 nt, Salmonella typhimurium LT2
cucuuuaucaaacaa

SEQ ID NO: 1877249 - RNA, 13 nt, Salmonella typhimurium LT2
cucuuucagccgg

SEQ ID NO: 1877250 - RNA, 20 nt, Salmonella typhimurium LT2
cucuuucagccggcuaucuu

SEQ ID NO: 1877251 - RNA, 23 nt, Salmonella typhimurium LT2
cucuuucagccggcuaucuucuu

SEQ ID NO: 1877252 - RNA, 18 nt, Salmonella typhimurium LT2
cucuuucccuucacucuu

SEQ ID NO: 1877253 - RNA, 13 nt, Salmonella typhimurium LT2
cucuucggaggcc

SEQ ID NO: 1877254 - RNA, 12 nt, Salmonella typhimurium LT2
cucuucggcuuc

SEQ ID NO: 1877255 - RNA, 16 nt, Salmonella typhimurium LT2
cucuucugaccaucuu

SEQ ID NO: 1877256 - RNA, 11 nt, Salmonella typhimurium LT2
cucuucugcug

SEQ ID NO: 1877257 - RNA, 22 nt, Salmonella typhimurium LT2
cucuucuuuuaauugccaggcg

SEQ ID NO: 1877258 - RNA, 20 nt, Salmonella typhimurium LT2
cucuucuuugagcucccggu

SEQ ID NO: 1877259 - RNA, 17 nt, Salmonella typhimurium LT2
cucuucuggcucccgca

SEQ ID NO: 1877260 - RNA, 14 nt, Salmonella typhimurium LT2
cucuugcggcugca

SEQ ID NO: 1877261 - RNA, 12 nt, Salmonella typhimurium LT2
cugaaaugcccg

SEQ ID NO: 1877262 - RNA, 21 nt, Salmonella typhimurium LT2
cugaacgcaguuuaucagaag

SEQ ID NO: 1877263 - RNA, 15 nt, Salmonella typhimurium LT2
cugaacguauggcau

SEQ ID NO: 1877264 - RNA, 20 nt, Salmonella typhimurium LT2
cugaacguuuuagcauguaa

SEQ ID NO: 1877265 - RNA, 15 nt, Salmonella typhimurium LT2
cugaagacuggcaag

SEQ ID NO: 1877266 - RNA, 20 nt, Salmonella typhimurium LT2
cugaacuauaggaaaauaau

SEQ ID NO: 1877267 - RNA, 12 nt, Salmonella typhimurium LT2
cugaagcccgcg

SEQ ID NO: 1877268 - RNA, 16 nt, Salmonella typhimurium LT2
cugaagcccuuuagua

SEQ ID NO: 1877269 - RNA, 23 nt, Salmonella typhimurium LT2
cugaagcgcuucaccggcgugcg

SEQ ID NO: 1877270 - RNA, 14 nt, Salmonella typhimurium LT2
cugaagauaaaauu

SEQ ID NO: 1877271 - RNA, 16 nt, Salmonella typhimurium LT2
cugaagauaaaauugu

SEQ ID NO: 1877272 - RNA, 17 nt, Salmonella typhimurium LT2
cugaagauaaacagcag

SEQ ID NO: 1877273 - RNA, 19 nt, Salmonella typhimurium LT2
cugaaauaaaagcaaugua

SEQ ID NO: 1877274 - RNA, 21 nt, Salmonella typhimurium LT2
cugaaagcaccgguuaacaua

SEQ ID NO: 1877275 - RNA, 17 nt, Salmonella typhimurium LT2
cugaaacagaauaaacg

SEQ ID NO: 1877276 - RNA, 14 nt, Salmonella typhimurium LT2
cugaaaaucaaaaa

SEQ ID NO: 1877277 - RNA, 22 nt, Salmonella typhimurium LT2
cugaaaaguagcaagguaugua

SEQ ID NO: 1877278 - RNA, 21 nt, Salmonella typhimurium LT2
cucuuugaacagccagaagcc

SEQ ID NO: 1877279 - RNA, 15 nt, Salmonella typhimurium LT2
cucuuucgacuggac

SEQ ID NO: 1877280 - RNA, 14 nt, Salmonella typhimurium LT2
cucuuuugcuucaa

SEQ ID NO: 1877281 - RNA, 14 nt, Salmonella typhimurium LT2
cucuuuugcagcaa

SEQ ID NO: 1877282 - RNA, 13 nt, Salmonella typhimurium LT2
cugaaaaaucccc

SEQ ID NO: 1877283 - RNA, 20 nt, Salmonella typhimurium LT2
cucuuuuuccgccugaucuu

SEQ ID NO: 1877284 - RNA, 19 nt, Salmonella typhimurium LT2
cuacccgguguaaaaaaug

SEQ ID NO: 1877285 - RNA, 18 nt, Salmonella typhimurium LT2
cuacuggcugguuucucc

SEQ ID NO: 1877286 - RNA, 15 nt, Salmonella typhimurium LT2
cuacucuugagccag

SEQ ID NO: 1877287 - RNA, 14 nt, Salmonella typhimurium LT2
cuacucuugcgcca

SEQ ID NO: 1877288 - RNA, 22 nt, Salmonella typhimurium LT2
cuacucccgucgccuguuucug

SEQ ID NO: 1877289 - RNA, 17 nt, Salmonella typhimurium LT2
cuacuucaauuuuccag

SEQ ID NO: 1877290 - RNA, 15 nt, Salmonella typhimurium LT2
cuacuuuauuuuucg

SEQ ID NO: 1877291 - RNA, 16 nt, Salmonella typhimurium LT2
cuagacuacaugccaa

SEQ ID NO: 1877292 - RNA, 18 nt, Salmonella typhimurium LT2
cuacuuuuucccgcagcu

SEQ ID NO: 1877293 - RNA, 15 nt, Salmonella typhimurium LT2
cuagucaauaaagac

SEQ ID NO: 1877294 - RNA, 13 nt, Salmonella typhimurium LT2
cuaguccugauau

SEQ ID NO: 1877295 - RNA, 22 nt, Salmonella typhimurium LT2
cuagucaggcacaaaaaacaaa

SEQ ID NO: 1877296 - RNA, 21 nt, Salmonella typhimurium LT2
cuagcuuaucgccaaagauau

SEQ ID NO: 1877297 - RNA, 21 nt, Salmonella typhimurium LT2
cuagaugaugauuuaugaaua

SEQ ID NO: 1877298 - RNA, 20 nt, Salmonella typhimurium LT2
cuaucggcaaaccaugaucg

SEQ ID NO: 1877299 - RNA, 20 nt, Salmonella typhimurium LT2
cuaucgcuucucccugacug

SEQ ID NO: 1877300 - RNA, 21 nt, Salmonella typhimurium LT2
cuauccgccgccagccauaaa

SEQ ID NO: 1877301 - RNA, 22 nt, Salmonella typhimurium LT2
cuauccggaggccuucuuguuu

SEQ ID NO: 1877302 - RNA, 20 nt, Salmonella typhimurium LT2
cuaucgcgacggaccggcag

SEQ ID NO: 1877303 - RNA, 14 nt, Salmonella typhimurium LT2
cuauguacucugau

SEQ ID NO: 1877304 - RNA, 13 nt, Salmonella typhimurium LT2
cuaugccuggaug

SEQ ID NO: 1877305 - RNA, 12 nt, Salmonella typhimurium LT2
cuauucccaggc

SEQ ID NO: 1877306 - RNA, 14 nt, Salmonella typhimurium LT2
cuauucccaggcaa

SEQ ID NO: 1877307 - RNA, 20 nt, Salmonella typhimurium LT2
cuauucccaggcaaaugauu

SEQ ID NO: 1877308 - RNA, 18 nt, Salmonella typhimurium LT2
cuauuccagagaguuuuc

SEQ ID NO: 1877309 - RNA, 12 nt, Salmonella typhimurium LT2
cuauucagcagu

SEQ ID NO: 1877310 - RNA, 13 nt, Salmonella typhimurium LT2
cuauucuuaucau

SEQ ID NO: 1877311 - RNA, 22 nt, Salmonella typhimurium LT2
cuauuccgcgguguccugcuug

SEQ ID NO: 1877312 - RNA, 16 nt, Salmonella typhimurium LT2
cuauuaucggcaccau

SEQ ID NO: 1877313 - RNA, 14 nt, Salmonella typhimurium LT2
cuauucaauaucau

SEQ ID NO: 1877314 - RNA, 17 nt, Salmonella typhimurium LT2
cuauccagcaguaaaua

SEQ ID NO: 1877315 - RNA, 15 nt, Salmonella typhimurium LT2
cuauccacagcgaau

SEQ ID NO: 1877316 - RNA, 21 nt, Salmonella typhimurium LT2
cuauccaugcgucgagcgccg

SEQ ID NO: 1877317 - RNA, 19 nt, Salmonella typhimurium LT2
cuaucaguagcuuuuccgc

SEQ ID NO: 1877318 - RNA, 15 nt, Salmonella typhimurium LT2
cuaucacagcggcau

SEQ ID NO: 1877319 - RNA, 20 nt, Salmonella typhimurium LT2
cuaucaagggugcuggcaau

SEQ ID NO: 1877320 - RNA, 16 nt, Salmonella typhimurium LT2
cuaucagaaaaaauua

SEQ ID NO: 1877321 - RNA, 19 nt, Salmonella typhimurium LT2
cuauauuuuuuaucagacu

SEQ ID NO: 1877322 - RNA, 16 nt, Salmonella typhimurium LT2
cuauauuccagccagg

SEQ ID NO: 1877323 - RNA, 16 nt, Salmonella typhimurium LT2
cuauagccugcugggu

SEQ ID NO: 1877324 - RNA, 18 nt, Salmonella typhimurium LT2
cucacgaauaagaaucag

SEQ ID NO: 1877325 - RNA, 13 nt, Salmonella typhimurium LT2
cucaccgcccagg

SEQ ID NO: 1877326 - RNA, 17 nt, Salmonella typhimurium LT2
cucacgcaacaacaggc

SEQ ID NO: 1877327 - RNA, 16 nt, Salmonella typhimurium LT2
cucacggauauugccc

SEQ ID NO: 1877328 - RNA, 18 nt, Salmonella typhimurium LT2
cucacgcucauagccgcu

SEQ ID NO: 1877329 - RNA, 19 nt, Salmonella typhimurium LT2
cucacggcacgcccuucgu

SEQ ID NO: 1877330 - RNA, 12 nt, Salmonella typhimurium LT2
cucacggagaaa

SEQ ID NO: 1877331 - RNA, 21 nt, Salmonella typhimurium LT2
cucacgguuucuacuuccacc

SEQ ID NO: 1877332 - RNA, 22 nt, Salmonella typhimurium LT2
cucacgguuucuacuuccacca

SEQ ID NO: 1877333 - RNA, 15 nt, Salmonella typhimurium LT2
cucacguucagcgcg

SEQ ID NO: 1877334 - RNA, 20 nt, Salmonella typhimurium LT2
cucaagcguucucacggucu

SEQ ID NO: 1877335 - RNA, 15 nt, Salmonella typhimurium LT2
cucacaaugccgccc

SEQ ID NO: 1877336 - RNA, 19 nt, Salmonella typhimurium LT2
cucaagcggcaccacauua

SEQ ID NO: 1877337 - RNA, 14 nt, Salmonella typhimurium LT2
cucaagcgcagcac

SEQ ID NO: 1877338 - RNA, 22 nt, Salmonella typhimurium LT2
cucaagcgccgccgcauuuugc

SEQ ID NO: 1877339 - RNA, 18 nt, Salmonella typhimurium LT2
cucaagacgguuguuuuu

SEQ ID NO: 1877340 - RNA, 12 nt, Salmonella typhimurium LT2
cucaacuggaug

SEQ ID NO: 1877341 - RNA, 21 nt, Salmonella typhimurium LT2
cucaacacauaacgcccgaca

SEQ ID NO: 1877342 - RNA, 16 nt, Salmonella typhimurium LT2
cucaacaaacuuaauu

SEQ ID NO: 1877343 - RNA, 17 nt, Salmonella typhimurium LT2
cucaacaaacuuaauua

SEQ ID NO: 1877344 - RNA, 21 nt, Salmonella typhimurium LT2
cucaacaaacuuaauuauuaa

SEQ ID NO: 1877345 - RNA, 22 nt, Salmonella typhimurium LT2
cucaacgcguucauccagcgcg

SEQ ID NO: 1877346 - RNA, 18 nt, Salmonella typhimurium LT2
cucaacgccuuuacaauc

SEQ ID NO: 1877347 - RNA, 16 nt, Salmonella typhimurium LT2
cucaacgcucauaccu

SEQ ID NO: 1877348 - RNA, 13 nt, Salmonella typhimurium LT2
cucaacgcccugc

SEQ ID NO: 1877349 - RNA, 18 nt, Salmonella typhimurium LT2
cucauuaugccucccguu

SEQ ID NO: 1877350 - RNA, 14 nt, Salmonella typhimurium LT2
cucauauacccugc

SEQ ID NO: 1877351 - RNA, 15 nt, Salmonella typhimurium LT2
cucauauacccugcg

SEQ ID NO: 1877352 - RNA, 24 nt, Salmonella typhimurium LT2
cucauccaacugcgccugaagaua

SEQ ID NO: 1877353 - RNA, 14 nt, Salmonella typhimurium LT2
cucaugcguaaauc

SEQ ID NO: 1877354 - RNA, 17 nt, Salmonella typhimurium LT2
cucaucuucuuuuuccg

SEQ ID NO: 1877355 - RNA, 13 nt, Salmonella typhimurium LT2
cucaucuuuuaca

SEQ ID NO: 1877356 - RNA, 16 nt, Salmonella typhimurium LT2
cucaucccccagccgc

SEQ ID NO: 1877357 - RNA, 23 nt, Salmonella typhimurium LT2
cucagcgccacgcccaacauaaa

SEQ ID NO: 1877358 - RNA, 13 nt, Salmonella typhimurium LT2
cucagcgccccag

SEQ ID NO: 1877359 - RNA, 17 nt, Salmonella typhimurium LT2
cucagcgccccagccaa

SEQ ID NO: 1877360 - RNA, 19 nt, Salmonella typhimurium LT2
cucagcgccccagccaaag

SEQ ID NO: 1877361 - RNA, 17 nt, Salmonella typhimurium LT2
cucagcgucaucacagg

SEQ ID NO: 1877362 - RNA, 13 nt, Salmonella typhimurium LT2
cucaggcgagccc

SEQ ID NO: 1877363 - RNA, 19 nt, Salmonella typhimurium LT2
cucaguugguuagagcaca

SEQ ID NO: 1877364 - RNA, 21 nt, Salmonella typhimurium LT2
cucaguuugcugguuaacucu

SEQ ID NO: 1877365 - RNA, 21 nt, Salmonella typhimurium LT2
cucaguugcguucccaguucc

SEQ ID NO: 1877366 - RNA, 18 nt, Salmonella typhimurium LT2
cucaguucauuauuucau

SEQ ID NO: 1877367 - RNA, 15 nt, Salmonella typhimurium LT2
cucauaccgccgccc

SEQ ID NO: 1877368 - RNA, 18 nt, Salmonella typhimurium LT2
cucauaccgccgcccagc

SEQ ID NO: 1877369 - RNA, 16 nt, Salmonella typhimurium LT2
cucauaaugauggggu

SEQ ID NO: 1877370 - RNA, 23 nt, Salmonella typhimurium LT2
cucauaagacgcauuaacggcaa

SEQ ID NO: 1877371 - RNA, 14 nt, Salmonella typhimurium LT2
cucauagccgcuuu

SEQ ID NO: 1877372 - RNA, 13 nt, Salmonella typhimurium LT2
cucauagacugcc

SEQ ID NO: 1877373 - RNA, 16 nt, Salmonella typhimurium LT2
cuacagcaucccgcuc

SEQ ID NO: 1877374 - RNA, 21 nt, Salmonella typhimurium LT2
cuacagacgcauuaaaaugau

SEQ ID NO: 1877375 - RNA, 11 nt, Salmonella typhimurium LT2
cuaccaucggc

SEQ ID NO: 1877376 - RNA, 14 nt, Salmonella typhimurium LT2
cuaccagacacagu

SEQ ID NO: 1877377 - RNA, 19 nt, Salmonella typhimurium LT2
cuaccacucccaaauuuug

SEQ ID NO: 1877378 - RNA, 12 nt, Salmonella typhimurium LT2
cuaccaggauag

SEQ ID NO: 1877379 - RNA, 21 nt, Salmonella typhimurium LT2
cuaccagcgcuauccaggccg

SEQ ID NO: 1877380 - RNA, 20 nt, Salmonella typhimurium LT2
cuaccagcguaccgauaauu

SEQ ID NO: 1877381 - RNA, 19 nt, Salmonella typhimurium LT2
cuaccagcgcuauccaggc

SEQ ID NO: 1877382 - RNA, 20 nt, Salmonella typhimurium LT2
cuacaugccaacuuuacuua

SEQ ID NO: 1877383 - RNA, 18 nt, Salmonella typhimurium LT2
cuaauuuuacuuucauuc

SEQ ID NO: 1877384 - RNA, 16 nt, Salmonella typhimurium LT2
cuacaagauuugcaau

SEQ ID NO: 1877385 - RNA, 21 nt, Salmonella typhimurium LT2
cuacaaauuacacaauaucaa

SEQ ID NO: 1877386 - RNA, 18 nt, Salmonella typhimurium LT2
cuacaccguauccggccu

SEQ ID NO: 1877387 - RNA, 22 nt, Salmonella typhimurium LT2
cuacaccguuucugaucuguuu

SEQ ID NO: 1877388 - RNA, 19 nt, Salmonella typhimurium LT2
cuacaccccuucuggagaa

SEQ ID NO: 1877389 - RNA, 16 nt, Salmonella typhimurium LT2
cuacacgaauaccucu

SEQ ID NO: 1877390 - RNA, 22 nt, Salmonella typhimurium LT2
cuacacacucggugcauuuguc

SEQ ID NO: 1877391 - RNA, 19 nt, Salmonella typhimurium LT2
cuacacagcgcgaguauuc

SEQ ID NO: 1877392 - RNA, 20 nt, Salmonella typhimurium LT2
cuacacaagcuaaaaaccgc

SEQ ID NO: 1877393 - RNA, 16 nt, Salmonella typhimurium LT2
cuaauggcgguugcca

SEQ ID NO: 1877394 - RNA, 18 nt, Salmonella typhimurium LT2
cuaauggcgguugccacu

SEQ ID NO: 1877395 - RNA, 13 nt, Salmonella typhimurium LT2
cuaaugucagcuc

SEQ ID NO: 1877396 - RNA, 16 nt, Salmonella typhimurium LT2
cuaaugauuaucuuuu

SEQ ID NO: 1877397 - RNA, 14 nt, Salmonella typhimurium LT2
cuaaugccuggcag

SEQ ID NO: 1877398 - RNA, 13 nt, Salmonella typhimurium LT2
cuaauuaaaaaga

SEQ ID NO: 1877399 - RNA, 19 nt, Salmonella typhimurium LT2
cuaauuaaucugucgaugc

SEQ ID NO: 1877400 - RNA, 12 nt, Salmonella typhimurium LT2
cuaauuccagga

SEQ ID NO: 1877401 - RNA, 22 nt, Salmonella typhimurium LT2
cuaauucuucguaggcaacaau

SEQ ID NO: 1877402 - RNA, 22 nt, Salmonella typhimurium LT2
cuaauccccauuuuuuucagcc

SEQ ID NO: 1877403 - RNA, 17 nt, Salmonella typhimurium LT2
cuaaugacauagugcaa

SEQ ID NO: 1877404 - RNA, 17 nt, Salmonella typhimurium LT2
cuaaugagccagaugga

SEQ ID NO: 1877405 - RNA, 20 nt, Salmonella typhimurium LT2
cuaauauccagccacguugu

SEQ ID NO: 1877406 - RNA, 18 nt, Salmonella typhimurium LT2
cuaaucacccacuucuca

SEQ ID NO: 1877407 - RNA, 20 nt, Salmonella typhimurium LT2
cuaaucagcaacuuuuccgc

SEQ ID NO: 1877408 - RNA, 23 nt, Salmonella typhimurium LT2
cuaaaucaauacaggcgaccggg

SEQ ID NO: 1877409 - RNA, 14 nt, Salmonella typhimurium LT2
cuaaauccuugagu

SEQ ID NO: 1877410 - RNA, 15 nt, Salmonella typhimurium LT2
cuaacgucagcgcca

SEQ ID NO: 1877411 - RNA, 21 nt, Salmonella typhimurium LT2
cuaagagccuaucccaccagg

SEQ ID NO: 1877412 - RNA, 20 nt, Salmonella typhimurium LT2
cuaagggguugaugccgacc

SEQ ID NO: 1877413 - RNA, 20 nt, Salmonella typhimurium LT2
cuaaggcggugucaucuucu

SEQ ID NO: 1877414 - RNA, 21 nt, Salmonella typhimurium LT2
cuaagcagaacggcgauacuc

SEQ ID NO: 1877415 - RNA, 20 nt, Salmonella typhimurium LT2
cuaagaugacugcuuuuucu

SEQ ID NO: 1877416 - RNA, 22 nt, Salmonella typhimurium LT2
cuaagaugacugcuuuuucuag

SEQ ID NO: 1877417 - RNA, 20 nt, Salmonella typhimurium LT2
cuaauaaaauaacuauaauu

SEQ ID NO: 1877418 - RNA, 14 nt, Salmonella typhimurium LT2
cuaaguaaggagga

SEQ ID NO: 1877419 - RNA, 12 nt, Salmonella typhimurium LT2
cuaauaacacaa

SEQ ID NO: 1877420 - RNA, 14 nt, Salmonella typhimurium LT2
cuaauaacacaaua

SEQ ID NO: 1877421 - RNA, 13 nt, Salmonella typhimurium LT2
cguuuauucuuuu

SEQ ID NO: 1877422 - RNA, 15 nt, Salmonella typhimurium LT2
cguuucguguaaaug

SEQ ID NO: 1877423 - RNA, 19 nt, Salmonella typhimurium LT2
cguuucacaaccuccacgc

SEQ ID NO: 1877424 - RNA, 20 nt, Salmonella typhimurium LT2
cguuucacaucgcccacuaa

SEQ ID NO: 1877425 - RNA, 21 nt, Salmonella typhimurium LT2
cguugucauggcgccaccagc

SEQ ID NO: 1877426 - RNA, 22 nt, Salmonella typhimurium LT2
cguugcuggacauauuccagaa

SEQ ID NO: 1877427 - RNA, 15 nt, Salmonella typhimurium LT2
cguugugcugcggca

SEQ ID NO: 1877428 - RNA, 20 nt, Salmonella typhimurium LT2
cguuuucauuagccgccagc

SEQ ID NO: 1877429 - RNA, 18 nt, Salmonella typhimurium LT2
cguuuucauuagccgcca

SEQ ID NO: 1877430 - RNA, 20 nt, Salmonella typhimurium LT2
cguuuuauuugaugccuggc

SEQ ID NO: 1877431 - RNA, 14 nt, Salmonella typhimurium LT2
cguuugaacagcag

SEQ ID NO: 1877432 - RNA, 18 nt, Salmonella typhimurium LT2
cguuugacggauuuuuuu

SEQ ID NO: 1877433 - RNA, 23 nt, Salmonella typhimurium LT2
cguuugaaauaccaggcggcuuu

SEQ ID NO: 1877434 - RNA, 12 nt, Salmonella typhimurium LT2
cguuucucuugu

SEQ ID NO: 1877435 - RNA, 13 nt, Salmonella typhimurium LT2
cguuuugcagcgc

SEQ ID NO: 1877436 - RNA, 12 nt, Salmonella typhimurium LT2
cguuuugcaaug

SEQ ID NO: 1877437 - RNA, 20 nt, Salmonella typhimurium LT2
cguuuucccggcaauuaccg

SEQ ID NO: 1877438 - RNA, 15 nt, Salmonella typhimurium LT2
cguuuuccagcucac

SEQ ID NO: 1877439 - RNA, 12 nt, Salmonella typhimurium LT2
cguuuugcuguc

SEQ ID NO: 1877440 - RNA, 17 nt, Salmonella typhimurium LT2
cguuuuggcagcgcccg

SEQ ID NO: 1877441 - RNA, 19 nt, Salmonella typhimurium LT2
cuaaagucagcauaaaaaa

SEQ ID NO: 1877442 - RNA, 20 nt, Salmonella typhimurium LT2
cuaaauaaauaccaaagaac

SEQ ID NO: 1877443 - RNA, 16 nt, Salmonella typhimurium LT2
cuaaaauacccgaccc

SEQ ID NO: 1877444 - RNA, 15 nt, Salmonella typhimurium LT2
cguuuuucucaucaa

SEQ ID NO: 1877445 - RNA, 15 nt, Salmonella typhimurium LT2
cguugauagacgaca

SEQ ID NO: 1877446 - RNA, 13 nt, Salmonella typhimurium LT2
cguugauaucuuc

SEQ ID NO: 1877447 - RNA, 22 nt, Salmonella typhimurium LT2
cguugaguauugacgaaaagau

SEQ ID NO: 1877448 - RNA, 22 nt, Salmonella typhimurium LT2
cguugaugugcccguuccaggc

SEQ ID NO: 1877449 - RNA, 13 nt, Salmonella typhimurium LT2
cguugaucuccgc

SEQ ID NO: 1877450 - RNA, 15 nt, Salmonella typhimurium LT2
cguugacgugagaga

SEQ ID NO: 1877451 - RNA, 23 nt, Salmonella typhimurium LT2
cguugagcguguccucugcugcg

SEQ ID NO: 1877452 - RNA, 22 nt, Salmonella typhimurium LT2
cguugaccagccuaccugccgc

SEQ ID NO: 1877453 - RNA, 22 nt, Salmonella typhimurium LT2
cguucuaucagguaucccgcca

SEQ ID NO: 1877454 - RNA, 20 nt, Salmonella typhimurium LT2
cguucucacggucuccugaa

SEQ ID NO: 1877455 - RNA, 19 nt, Salmonella typhimurium LT2
cguugccgcccaccugcag

SEQ ID NO: 1877456 - RNA, 22 nt, Salmonella typhimurium LT2
cguugccgcccaccugcagcag

SEQ ID NO: 1877457 - RNA, 22 nt, Salmonella typhimurium LT2
cguugccaucgcacucuccggc

SEQ ID NO: 1877458 - RNA, 13 nt, Salmonella typhimurium LT2
cguugccagaguu

SEQ ID NO: 1877459 - RNA, 16 nt, Salmonella typhimurium LT2
cguugccagcggccag

SEQ ID NO: 1877460 - RNA, 17 nt, Salmonella typhimurium LT2
cguugcgaaucagguac

SEQ ID NO: 1877461 - RNA, 12 nt, Salmonella typhimurium LT2
cguugccgccgu

SEQ ID NO: 1877462 - RNA, 15 nt, Salmonella typhimurium LT2
cguuccgcucagcgu

SEQ ID NO: 1877463 - RNA, 19 nt, Salmonella typhimurium LT2
cguuccgcaaucgcugccu

SEQ ID NO: 1877464 - RNA, 15 nt, Salmonella typhimurium LT2
cguucauucccgcca

SEQ ID NO: 1877465 - RNA, 19 nt, Salmonella typhimurium LT2
cguucauucgccccagcau

SEQ ID NO: 1877466 - RNA, 13 nt, Salmonella typhimurium LT2
cguucggguuuuc

SEQ ID NO: 1877467 - RNA, 21 nt, Salmonella typhimurium LT2
cguccacacgccuggccaggc

SEQ ID NO: 1877468 - RNA, 22 nt, Salmonella typhimurium LT2
cguccaacuggcuuucauccaa

SEQ ID NO: 1877469 - RNA, 17 nt, Salmonella typhimurium LT2
cgucauucauggcgcgc

SEQ ID NO: 1877470 - RNA, 15 nt, Salmonella typhimurium LT2
cguuauccagcagcc

SEQ ID NO: 1877471 - RNA, 18 nt, Salmonella typhimurium LT2
cguuaucguagugccaca

SEQ ID NO: 1877472 - RNA, 11 nt, Salmonella typhimurium LT2
cguccaccagc

SEQ ID NO: 1877473 - RNA, 21 nt, Salmonella typhimurium LT2
cguuauaaggccugccguccu

SEQ ID NO: 1877474 - RNA, 19 nt, Salmonella typhimurium LT2
cguuauacaucgcuuucca

SEQ ID NO: 1877475 - RNA, 20 nt, Salmonella typhimurium LT2
cguuaucaaaaaaaaccaga

SEQ ID NO: 1877476 - RNA, 12 nt, Salmonella typhimurium LT2
aaaaaacaucau

SEQ ID NO: 1877477 - RNA, 11 nt, Salmonella typhimurium LT2
aaaaaagccau

SEQ ID NO: 1877478 - RNA, 22 nt, Salmonella typhimurium LT2
aaaaaagcugcgaucaaguuuu

SEQ ID NO: 1877479 - RNA, 13 nt, Salmonella typhimurium LT2
aaaaaaggcagcc

SEQ ID NO: 1877480 - RNA, 10 nt, Salmonella typhimurium LT2
aaaaaacagg

SEQ ID NO: 1877481 - RNA, 13 nt, Salmonella typhimurium LT2
aaaaaacaccugu

SEQ ID NO: 1877482 - RNA, 18 nt, Salmonella typhimurium LT2
aaaaaacaagauuaauuu

SEQ ID NO: 1877483 - RNA, 11 nt, Salmonella typhimurium LT2
aaaaaaccaga

SEQ ID NO: 1877484 - RNA, 14 nt, Salmonella typhimurium LT2
aaaaaaccagaauu

SEQ ID NO: 1877485 - RNA, 19 nt, Salmonella typhimurium LT2
aaaaaaccggcaacucgcc

SEQ ID NO: 1877486 - RNA, 21 nt, Salmonella typhimurium LT2
aaaaaagugauucacuuucuu

SEQ ID NO: 1877487 - RNA, 19 nt, Salmonella typhimurium LT2
aaaaacagcgcaauaugca

SEQ ID NO: 1877488 - RNA, 21 nt, Salmonella typhimurium LT2
aaaaacaggcgcaggcauuaa

SEQ ID NO: 1877489 - RNA, 23 nt, Salmonella typhimurium LT2
aaaaaauaugcaauuaauauauu

SEQ ID NO: 1877490 - RNA, 13 nt, Salmonella typhimurium LT2
aaaaaauauguuc

SEQ ID NO: 1877491 - RNA, 12 nt, Salmonella typhimurium LT2
aaaaaaucagca

SEQ ID NO: 1877492 - RNA, 21 nt, Salmonella typhimurium LT2
aaaaaauacugauaaaaaaca

SEQ ID NO: 1877493 - RNA, 17 nt, Salmonella typhimurium LT2
aaaaaauaguaaaguuu

SEQ ID NO: 1877494 - RNA, 12 nt, Salmonella typhimurium LT2
aaaaaauuacga

SEQ ID NO: 1877495 - RNA, 17 nt, Salmonella typhimurium LT2
aaaaaaugguuuuauuu

SEQ ID NO: 1877496 - RNA, 14 nt, Salmonella typhimurium LT2
aaaaacagccauaa

SEQ ID NO: 1877497 - RNA, 20 nt, Salmonella typhimurium LT2
aaaaacagccauaaugcugc

SEQ ID NO: 1877498 - RNA, 20 nt, Salmonella typhimurium LT2
aaaaacaacucuauuaaaau

SEQ ID NO: 1877499 - RNA, 14 nt, Salmonella typhimurium LT2
aaaaugcgcaugau

SEQ ID NO: 1877500 - RNA, 22 nt, Salmonella typhimurium LT2
aaaaugccgcccauccagagca

SEQ ID NO: 1877501 - RNA, 18 nt, Salmonella typhimurium LT2
aaaaugcggcauccggcu

SEQ ID NO: 1877502 - RNA, 15 nt, Salmonella typhimurium LT2
aaaauuauauucuaa

SEQ ID NO: 1877503 - RNA, 20 nt, Salmonella typhimurium LT2
aaaauuauccacaaacucca

SEQ ID NO: 1877504 - RNA, 20 nt, Salmonella typhimurium LT2
aaaauuauuggcuuuguaaa

SEQ ID NO: 1877505 - RNA, 15 nt, Salmonella typhimurium LT2
aaaauuauuuuaaau

SEQ ID NO: 1877506 - RNA, 22 nt, Salmonella typhimurium LT2
aaaaucggggucuuccagcaga

SEQ ID NO: 1877507 - RNA, 18 nt, Salmonella typhimurium LT2
aaaauccuucuuccauuc

SEQ ID NO: 1877508 - RNA, 19 nt, Salmonella typhimurium LT2
aaaauccugcacuuccagc

SEQ ID NO: 1877509 - RNA, 19 nt, Salmonella typhimurium LT2
aaaaucgucccuuuucccc

SEQ ID NO: 1877510 - RNA, 18 nt, Salmonella typhimurium LT2
aaaauucauuauaaaaca

SEQ ID NO: 1877511 - RNA, 23 nt, Salmonella typhimurium LT2
aaaauuuuuauagucuaauaaca

SEQ ID NO: 1877512 - RNA, 12 nt, Salmonella typhimurium LT2
aaacaacacacg

SEQ ID NO: 1877513 - RNA, 16 nt, Salmonella typhimurium LT2
aaacaaauaaauccau

SEQ ID NO: 1877514 - RNA, 15 nt, Salmonella typhimurium LT2
aaacaaaccaaacug

SEQ ID NO: 1877515 - RNA, 23 nt, Salmonella typhimurium LT2
aaaauauacaccugacggcagcc

SEQ ID NO: 1877516 - RNA, 19 nt, Salmonella typhimurium LT2
aaaauccggaucaucuuuu

SEQ ID NO: 1877517 - RNA, 21 nt, Salmonella typhimurium LT2
aaaauccggcugccugccgga

SEQ ID NO: 1877518 - RNA, 23 nt, Salmonella typhimurium LT2
aaaauccucuaccggaaaacagc

SEQ ID NO: 1877519 - RNA, 21 nt, Salmonella typhimurium LT2
aaaauccucuaccggaaaaca

SEQ ID NO: 1877520 - RNA, 18 nt, Salmonella typhimurium LT2
aaaaucccggcuggguuc

SEQ ID NO: 1877521 - RNA, 14 nt, Salmonella typhimurium LT2
aaaauaauugauaa

SEQ ID NO: 1877522 - RNA, 15 nt, Salmonella typhimurium LT2
aaaauaccccagcgc

SEQ ID NO: 1877523 - RNA, 16 nt, Salmonella typhimurium LT2
aaaauaccgcacauca

SEQ ID NO: 1877524 - RNA, 21 nt, Salmonella typhimurium LT2
aaaauagcccggcuucccauc

SEQ ID NO: 1877525 - RNA, 18 nt, Salmonella typhimurium LT2
aaaauaaaauuauauucu

SEQ ID NO: 1877526 - RNA, 12 nt, Salmonella typhimurium LT2
aaaauaaaauua

SEQ ID NO: 1877527 - RNA, 13 nt, Salmonella typhimurium LT2
aaaauaaaauuau

SEQ ID NO: 1877528 - RNA, 16 nt, Salmonella typhimurium LT2
aaaauaaugccucauu

SEQ ID NO: 1877529 - RNA, 23 nt, Salmonella typhimurium LT2
aaaauaaugccucauuaaaaaaa

SEQ ID NO: 1877530 - RNA, 13 nt, Salmonella typhimurium LT2
aaaagugccagca

SEQ ID NO: 1877531 - RNA, 19 nt, Salmonella typhimurium LT2
aaaaguguguaccagcaac

SEQ ID NO: 1877532 - RNA, 15 nt, Salmonella typhimurium LT2
aaaauaaaaaaggca

SEQ ID NO: 1877533 - RNA, 23 nt, Salmonella typhimurium LT2
aaaagugauucacuuucuugcca

SEQ ID NO: 1877534 - RNA, 16 nt, Salmonella typhimurium LT2
aaaaguauauaucccg

SEQ ID NO: 1877535 - RNA, 18 nt, Salmonella typhimurium LT2
aaaagccaagcacaaaaa

SEQ ID NO: 1877536 - RNA, 16 nt, Salmonella typhimurium LT2
aaaagccgugaauaaa

SEQ ID NO: 1877537 - RNA, 17 nt, Salmonella typhimurium LT2
aaaacugucccugaugu

SEQ ID NO: 1877538 - RNA, 13 nt, Salmonella typhimurium LT2
aaaacuucgauaa

SEQ ID NO: 1877539 - RNA, 18 nt, Salmonella typhimurium LT2
aaaacuucgauaauaaaa

SEQ ID NO: 1877540 - RNA, 14 nt, Salmonella typhimurium LT2
aaaacuacaacaau

SEQ ID NO: 1877541 - RNA, 16 nt, Salmonella typhimurium LT2
aaaacuaccgcgccag

SEQ ID NO: 1877542 - RNA, 21 nt, Salmonella typhimurium LT2
aaaacguuugcaaauagguuu

SEQ ID NO: 1877543 - RNA, 14 nt, Salmonella typhimurium LT2
aaaacguugcugga

SEQ ID NO: 1877544 - RNA, 22 nt, Salmonella typhimurium LT2
aaaacguagagugcuucuucaa

SEQ ID NO: 1877545 - RNA, 16 nt, Salmonella typhimurium LT2
aaaacgugauugcuga

SEQ ID NO: 1877546 - RNA, 22 nt, Salmonella typhimurium LT2
aaaacgguaugaaggaccaaca

SEQ ID NO: 1877547 - RNA, 16 nt, Salmonella typhimurium LT2
aaaacggcucaucagu

SEQ ID NO: 1877548 - RNA, 14 nt, Salmonella typhimurium LT2
aaaacggccaguga

SEQ ID NO: 1877549 - RNA, 18 nt, Salmonella typhimurium LT2
aaaaccaagcgcauggua

SEQ ID NO: 1877550 - RNA, 17 nt, Salmonella typhimurium LT2
aaaagcagaggccugaa

SEQ ID NO: 1877551 - RNA, 21 nt, Salmonella typhimurium LT2
aaaagcacaucaggaaaugaa

SEQ ID NO: 1877552 - RNA, 15 nt, Salmonella typhimurium LT2
aaaagaguaaaguua

SEQ ID NO: 1877553 - RNA, 17 nt, Salmonella typhimurium LT2
aaaagagcuuauuuuga

SEQ ID NO: 1877554 - RNA, 12 nt, Salmonella typhimurium LT2
aaaagaggaaag

SEQ ID NO: 1877555 - RNA, 15 nt, Salmonella typhimurium LT2
aaaagaacucacuca

SEQ ID NO: 1877556 - RNA, 13 nt, Salmonella typhimurium LT2
aaaagaagaaaaa

SEQ ID NO: 1877557 - RNA, 24 nt, Salmonella typhimurium LT2
aaaagaccuggggguaacacaaaa

SEQ ID NO: 1877558 - RNA, 22 nt, Salmonella typhimurium LT2
aaaagacggcuuuugguuccuu

SEQ ID NO: 1877559 - RNA, 22 nt, Salmonella typhimurium LT2
aaaacagaaccccaucgccuga

SEQ ID NO: 1877560 - RNA, 19 nt, Salmonella typhimurium LT2
aaaacacuaccagacacag

SEQ ID NO: 1877561 - RNA, 20 nt, Salmonella typhimurium LT2
aaaacaccuaacccaccaua

SEQ ID NO: 1877562 - RNA, 19 nt, Salmonella typhimurium LT2
aaaaauuuuugaucugcuu

SEQ ID NO: 1877563 - RNA, 21 nt, Salmonella typhimurium LT2
aaaaaucaugcucauaaugga

SEQ ID NO: 1877564 - RNA, 13 nt, Salmonella typhimurium LT2
aaaaauauagcca

SEQ ID NO: 1877565 - RNA, 17 nt, Salmonella typhimurium LT2
aaaaauacugauaaaaa

SEQ ID NO: 1877566 - RNA, 11 nt, Salmonella typhimurium LT2
aaaaauacuga

SEQ ID NO: 1877567 - RNA, 20 nt, Salmonella typhimurium LT2
aaaaaccauuuauaaaauau

SEQ ID NO: 1877568 - RNA, 11 nt, Salmonella typhimurium LT2
aaaaacaucau

SEQ ID NO: 1877569 - RNA, 15 nt, Salmonella typhimurium LT2
aaaaauaaaaaaacc

SEQ ID NO: 1877570 - RNA, 19 nt, Salmonella typhimurium LT2
aaacgccagcccuuccagc

SEQ ID NO: 1877571 - RNA, 15 nt, Salmonella typhimurium LT2
aaacgccgccuuagc

SEQ ID NO: 1877572 - RNA, 20 nt, Salmonella typhimurium LT2
aaacgcauacgcagcacuuu

SEQ ID NO: 1877573 - RNA, 18 nt, Salmonella typhimurium LT2
aaacgccacgauuaaccc

SEQ ID NO: 1877574 - RNA, 13 nt, Salmonella typhimurium LT2
aaacgcacccgcg

SEQ ID NO: 1877575 - RNA, 19 nt, Salmonella typhimurium LT2
aaacgacguccacaccuuc

SEQ ID NO: 1877576 - RNA, 21 nt, Salmonella typhimurium LT2
aaacgaaucaccucgcuuccc

SEQ ID NO: 1877577 - RNA, 14 nt, Salmonella typhimurium LT2
aaacgacauaaccg

SEQ ID NO: 1877578 - RNA, 20 nt, Salmonella typhimurium LT2
aaacgauauugccuuauuca

SEQ ID NO: 1877579 - RNA, 21 nt, Salmonella typhimurium LT2
aaacgaaacccaaauaaccag

SEQ ID NO: 1877580 - RNA, 13 nt, Salmonella typhimurium LT2
aaaccuuucuucu

SEQ ID NO: 1877581 - RNA, 16 nt, Salmonella typhimurium LT2
aaacaagauuaauuua

SEQ ID NO: 1877582 - RNA, 18 nt, Salmonella typhimurium LT2
aaaccugcaaaaaaagaa

SEQ ID NO: 1877583 - RNA, 15 nt, Salmonella typhimurium LT2
aaaccugaugcguca

SEQ ID NO: 1877584 - RNA, 20 nt, Salmonella typhimurium LT2
aaacaaggcgcuaccaggau

SEQ ID NO: 1877585 - RNA, 14 nt, Salmonella typhimurium LT2
aaacgucgaacaua

SEQ ID NO: 1877586 - RNA, 19 nt, Salmonella typhimurium LT2
aaacguagcguucauuccc

SEQ ID NO: 1877587 - RNA, 15 nt, Salmonella typhimurium LT2
aaacgguaugaaaca

SEQ ID NO: 1877588 - RNA, 14 nt, Salmonella typhimurium LT2
aaacggcuuuaauc

SEQ ID NO: 1877589 - RNA, 15 nt, Salmonella typhimurium LT2
aaacggcgguuuuuu

SEQ ID NO: 1877590 - RNA, 19 nt, Salmonella typhimurium LT2
aaacggcucgguuuauccc

SEQ ID NO: 1877591 - RNA, 14 nt, Salmonella typhimurium LT2
aaacgcuuucuggg

SEQ ID NO: 1877592 - RNA, 17 nt, Salmonella typhimurium LT2
aaacgcuccggcaggca

SEQ ID NO: 1877593 - RNA, 15 nt, Salmonella typhimurium LT2
aaacgcucgcgcugu

SEQ ID NO: 1877594 - RNA, 20 nt, Salmonella typhimurium LT2
aaacgcucgcgcuguucgcu

SEQ ID NO: 1877595 - RNA, 23 nt, Salmonella typhimurium LT2
aaacgcuaugccuggauguauaa

SEQ ID NO: 1877596 - RNA, 16 nt, Salmonella typhimurium LT2
aaacgcgucagcguuu

SEQ ID NO: 1877597 - RNA, 17 nt, Salmonella typhimurium LT2
aaacgcggacauauuuu

SEQ ID NO: 1877598 - RNA, 14 nt, Salmonella typhimurium LT2
aaacgcgccaggua

SEQ ID NO: 1877599 - RNA, 15 nt, Salmonella typhimurium LT2
aaacgccgucacaaa

SEQ ID NO: 1877600 - RNA, 23 nt, Salmonella typhimurium LT2
aaacgccugcccgguuaaggggc

SEQ ID NO: 1877601 - RNA, 22 nt, Salmonella typhimurium LT2
aaacuaccgcgccagccguagc

SEQ ID NO: 1877602 - RNA, 20 nt, Salmonella typhimurium LT2
aaacuacuggcugguuucuc

SEQ ID NO: 1877603 - RNA, 14 nt, Salmonella typhimurium LT2
aaacucaaucaggc

SEQ ID NO: 1877604 - RNA, 22 nt, Salmonella typhimurium LT2
aaacucaaagcguuauuugcau

SEQ ID NO: 1877605 - RNA, 19 nt, Salmonella typhimurium LT2
aaacuauuuuuagcccuug

SEQ ID NO: 1877606 - RNA, 19 nt, Salmonella typhimurium LT2
aaacucuguguuaugaaug

SEQ ID NO: 1877607 - RNA, 18 nt, Salmonella typhimurium LT2
aaacucgccgccaugacg

SEQ ID NO: 1877608 - RNA, 15 nt, Salmonella typhimurium LT2
aaacuccgcgcuggc

SEQ ID NO: 1877609 - RNA, 16 nt, Salmonella typhimurium LT2
aaacuccaccugaucg

SEQ ID NO: 1877610 - RNA, 14 nt, Salmonella typhimurium LT2
aaacuccagcggca

SEQ ID NO: 1877611 - RNA, 14 nt, Salmonella typhimurium LT2
aaacuccauuaaau

SEQ ID NO: 1877612 - RNA, 22 nt, Salmonella typhimurium LT2
aaacuccauuaaauuacuuguu

SEQ ID NO: 1877613 - RNA, 13 nt, Salmonella typhimurium LT2
aaacucagcaaua

SEQ ID NO: 1877614 - RNA, 23 nt, Salmonella typhimurium LT2
aaacucagcgccagcgcugacau

SEQ ID NO: 1877615 - RNA, 23 nt, Salmonella typhimurium LT2
aaacugcuggcgagcagaaaaag

SEQ ID NO: 1877616 - RNA, 15 nt, Salmonella typhimurium LT2
aaacuggccacagca

SEQ ID NO: 1877617 - RNA, 14 nt, Salmonella typhimurium LT2
aaacugcugacaau

SEQ ID NO: 1877618 - RNA, 21 nt, Salmonella typhimurium LT2
aaacugauaguuuaaauccag

SEQ ID NO: 1877619 - RNA, 19 nt, Salmonella typhimurium LT2
aaacugcauccccugcagg

SEQ ID NO: 1877620 - RNA, 20 nt, Salmonella typhimurium LT2
aaacuuaucauuuuuucuaa

SEQ ID NO: 1877621 - RNA, 16 nt, Salmonella typhimurium LT2
aaacuuaauuauuaau

SEQ ID NO: 1877622 - RNA, 23 nt, Salmonella typhimurium LT2
aaacuucgauaauaaaauauuau

SEQ ID NO: 1877623 - RNA, 15 nt, Salmonella typhimurium LT2
aaagauaaauaaaaa

SEQ ID NO: 1877624 - RNA, 17 nt, Salmonella typhimurium LT2
aaagauaaauaaaaaau

SEQ ID NO: 1877625 - RNA, 17 nt, Salmonella typhimurium LT2
aaagagugccagaaaca

SEQ ID NO: 1877626 - RNA, 19 nt, Salmonella typhimurium LT2
aaagagcaggccaaaaaag

SEQ ID NO: 1877627 - RNA, 23 nt, Salmonella typhimurium LT2
aaagagcaauauucuggcuuucu

SEQ ID NO: 1877628 - RNA, 22 nt, Salmonella typhimurium LT2
aaagagcuccccacgaaagucu

SEQ ID NO: 1877629 - RNA, 16 nt, Salmonella typhimurium LT2
aaagagaucgaacaau

SEQ ID NO: 1877630 - RNA, 23 nt, Salmonella typhimurium LT2
aaagagaacgacgcauaaaaaau

SEQ ID NO: 1877631 - RNA, 12 nt, Salmonella typhimurium LT2
aaagagaaaaaa

SEQ ID NO: 1877632 - RNA, 22 nt, Salmonella typhimurium LT2
aaagagaaaaagaagaaaaaau

SEQ ID NO: 1877633 - RNA, 18 nt, Salmonella typhimurium LT2
aaagaaggcuugguuguu

SEQ ID NO: 1877634 - RNA, 13 nt, Salmonella typhimurium LT2
aaacuuuuaaauu

SEQ ID NO: 1877635 - RNA, 16 nt, Salmonella typhimurium LT2
aaagaccuccgcccgg

SEQ ID NO: 1877636 - RNA, 14 nt, Salmonella typhimurium LT2
aaagaccuucuugc

SEQ ID NO: 1877637 - RNA, 21 nt, Salmonella typhimurium LT2
aaagaccuggggguaacacaa

SEQ ID NO: 1877638 - RNA, 17 nt, Salmonella typhimurium LT2
aaagccagauaaagcag

SEQ ID NO: 1877639 - RNA, 19 nt, Salmonella typhimurium LT2
aaagccacgguucucaccg

SEQ ID NO: 1877640 - RNA, 21 nt, Salmonella typhimurium LT2
aaagccaauccagaauaccag

SEQ ID NO: 1877641 - RNA, 23 nt, Salmonella typhimurium LT2
aaagcauggcuggcgguuuuugu

SEQ ID NO: 1877642 - RNA, 17 nt, Salmonella typhimurium LT2
aaagcaccgguuaacau

SEQ ID NO: 1877643 - RNA, 22 nt, Salmonella typhimurium LT2
aaagauuuaucaauuuuuaaaa

SEQ ID NO: 1877644 - RNA, 18 nt, Salmonella typhimurium LT2
aaagauuuuuauuaaaau

SEQ ID NO: 1877645 - RNA, 16 nt, Salmonella typhimurium LT2
aaagcaaaaaaugaca

SEQ ID NO: 1877646 - RNA, 23 nt, Salmonella typhimurium LT2
aaagauuuuuuucugacuauauc

SEQ ID NO: 1877647 - RNA, 15 nt, Salmonella typhimurium LT2
aaagauaaucugaau

SEQ ID NO: 1877648 - RNA, 19 nt, Salmonella typhimurium LT2
aaagauagccaccggcagc

SEQ ID NO: 1877649 - RNA, 20 nt, Salmonella typhimurium LT2
aaagcuggauaucacgcgcg

SEQ ID NO: 1877650 - RNA, 13 nt, Salmonella typhimurium LT2
aaagcuguagcau

SEQ ID NO: 1877651 - RNA, 13 nt, Salmonella typhimurium LT2
aaaggcagaagaa

SEQ ID NO: 1877652 - RNA, 13 nt, Salmonella typhimurium LT2
aaagccgcucgcc

SEQ ID NO: 1877653 - RNA, 17 nt, Salmonella typhimurium LT2
aaagcugcgaucaaguu

SEQ ID NO: 1877654 - RNA, 13 nt, Salmonella typhimurium LT2
aaagccgaccugg

SEQ ID NO: 1877655 - RNA, 13 nt, Salmonella typhimurium LT2
aaagcccaucagc

SEQ ID NO: 1877656 - RNA, 22 nt, Salmonella typhimurium LT2
aaaggggccugcacaauaccaa

SEQ ID NO: 1877657 - RNA, 18 nt, Salmonella typhimurium LT2
aaaggggagcccaguagc

SEQ ID NO: 1877658 - RNA, 21 nt, Salmonella typhimurium LT2
aaaggggagggcaacaaacau

SEQ ID NO: 1877659 - RNA, 18 nt, Salmonella typhimurium LT2
aaaggccuggcugagaaa

SEQ ID NO: 1877660 - RNA, 13 nt, Salmonella typhimurium LT2
aaaggcagccagg

SEQ ID NO: 1877661 - RNA, 15 nt, Salmonella typhimurium LT2
aaagggaauaauaca

SEQ ID NO: 1877662 - RNA, 16 nt, Salmonella typhimurium LT2
aaaguacuucacaauc

SEQ ID NO: 1877663 - RNA, 17 nt, Salmonella typhimurium LT2
aaaguacuggaauaucu

SEQ ID NO: 1877664 - RNA, 23 nt, Salmonella typhimurium LT2
aaaguaccagcgcgaacauuaca

SEQ ID NO: 1877665 - RNA, 17 nt, Salmonella typhimurium LT2
aaaguacaaugcaaaga

SEQ ID NO: 1877666 - RNA, 20 nt, Salmonella typhimurium LT2
aaaguacaaugcaaagaaaa

SEQ ID NO: 1877667 - RNA, 20 nt, Salmonella typhimurium LT2
aaagucaacugcucuaccaa

SEQ ID NO: 1877668 - RNA, 17 nt, Salmonella typhimurium LT2
aaaguauguuuugaaug

SEQ ID NO: 1877669 - RNA, 16 nt, Salmonella typhimurium LT2
aaagucaaaauaaaau

SEQ ID NO: 1877670 - RNA, 21 nt, Salmonella typhimurium LT2
aaaucagcaaucgcuggcgua

SEQ ID NO: 1877671 - RNA, 14 nt, Salmonella typhimurium LT2
aaaucaggaaaaag

SEQ ID NO: 1877672 - RNA, 13 nt, Salmonella typhimurium LT2
aaaucauaccagc

SEQ ID NO: 1877673 - RNA, 15 nt, Salmonella typhimurium LT2
aaaucauaccagcga

SEQ ID NO: 1877674 - RNA, 14 nt, Salmonella typhimurium LT2
aaaucaguuguacu

SEQ ID NO: 1877675 - RNA, 21 nt, Salmonella typhimurium LT2
aaaucacuggagcgcauuuua

SEQ ID NO: 1877676 - RNA, 14 nt, Salmonella typhimurium LT2
aaaucagcauuacc

SEQ ID NO: 1877677 - RNA, 12 nt, Salmonella typhimurium LT2
aaaucagcacaa

SEQ ID NO: 1877678 - RNA, 20 nt, Salmonella typhimurium LT2
aaaucagcaaaaacauuacc

SEQ ID NO: 1877679 - RNA, 12 nt, Salmonella typhimurium LT2
aaaucagacuaa

SEQ ID NO: 1877680 - RNA, 20 nt, Salmonella typhimurium LT2
aaaucacuaagaccagcauc

SEQ ID NO: 1877681 - RNA, 16 nt, Salmonella typhimurium LT2
aaaucacaucgccgga

SEQ ID NO: 1877682 - RNA, 18 nt, Salmonella typhimurium LT2
aaaucacccaacguucau

SEQ ID NO: 1877683 - RNA, 16 nt, Salmonella typhimurium LT2
aaauaguccagcagcc

SEQ ID NO: 1877684 - RNA, 16 nt, Salmonella typhimurium LT2
aaauaugcaauuaaua

SEQ ID NO: 1877685 - RNA, 22 nt, Salmonella typhimurium LT2
aaauaugcaauuaauauauuua

SEQ ID NO: 1877686 - RNA, 16 nt, Salmonella typhimurium LT2
aaauaugaaagagaaa

SEQ ID NO: 1877687 - RNA, 19 nt, Salmonella typhimurium LT2
aaauaugaagaaggccugu

SEQ ID NO: 1877688 - RNA, 16 nt, Salmonella typhimurium LT2
aaaucaaacagaauau

SEQ ID NO: 1877689 - RNA, 19 nt, Salmonella typhimurium LT2
aaaucaaacugauacugga

SEQ ID NO: 1877690 - RNA, 14 nt, Salmonella typhimurium LT2
aaauauuucuuuau

SEQ ID NO: 1877691 - RNA, 15 nt, Salmonella typhimurium LT2
aaauacgccagauaa

SEQ ID NO: 1877692 - RNA, 16 nt, Salmonella typhimurium LT2
aaauacgcucaauaua

SEQ ID NO: 1877693 - RNA, 23 nt, Salmonella typhimurium LT2
aaauacgcgcgccgccugcuccg

SEQ ID NO: 1877694 - RNA, 17 nt, Salmonella typhimurium LT2
aaauacggaccuggcgu

SEQ ID NO: 1877695 - RNA, 17 nt, Salmonella typhimurium LT2
aaauacggacgccagau

SEQ ID NO: 1877696 - RNA, 14 nt, Salmonella typhimurium LT2
aaauagcuggcugu

SEQ ID NO: 1877697 - RNA, 22 nt, Salmonella typhimurium LT2
aaauacugaacuauaggaaaau

SEQ ID NO: 1877698 - RNA, 13 nt, Salmonella typhimurium LT2
aaauaaaauuaua

SEQ ID NO: 1877699 - RNA, 15 nt, Salmonella typhimurium LT2
aaauaaaauuguuau

SEQ ID NO: 1877700 - RNA, 12 nt, Salmonella typhimurium LT2
aaauaaaauuau

SEQ ID NO: 1877701 - RNA, 12 nt, Salmonella typhimurium LT2
aaauaaaauacg

SEQ ID NO: 1877702 - RNA, 22 nt, Salmonella typhimurium LT2
aaauaaaauacgcucaauauac

SEQ ID NO: 1877703 - RNA, 17 nt, Salmonella typhimurium LT2
aaauaaaaggggccugc

SEQ ID NO: 1877704 - RNA, 17 nt, Salmonella typhimurium LT2
aaagucgauaaaugccc

SEQ ID NO: 1877705 - RNA, 21 nt, Salmonella typhimurium LT2
aaauaacaagacgucucuuuc

SEQ ID NO: 1877706 - RNA, 17 nt, Salmonella typhimurium LT2
aaauaacccgccuggcg

SEQ ID NO: 1877707 - RNA, 17 nt, Salmonella typhimurium LT2
aaauaacgguagagaau

SEQ ID NO: 1877708 - RNA, 18 nt, Salmonella typhimurium LT2
aaauaacucuggaucagu

SEQ ID NO: 1877709 - RNA, 12 nt, Salmonella typhimurium LT2
aaauaagaaaau

SEQ ID NO: 1877710 - RNA, 12 nt, Salmonella typhimurium LT2
aaauaagaguca

SEQ ID NO: 1877711 - RNA, 19 nt, Salmonella typhimurium LT2
aaauucgcuaauccccccu

SEQ ID NO: 1877712 - RNA, 16 nt, Salmonella typhimurium LT2
aaauucgaaauaaaga

SEQ ID NO: 1877713 - RNA, 17 nt, Salmonella typhimurium LT2
aaauucgcgccaguccg

SEQ ID NO: 1877714 - RNA, 16 nt, Salmonella typhimurium LT2
aaauuccuggauuaaa

SEQ ID NO: 1877715 - RNA, 17 nt, Salmonella typhimurium LT2
aaauuccgcagagcuga

SEQ ID NO: 1877716 - RNA, 16 nt, Salmonella typhimurium LT2
aaauucacaccaaugu

SEQ ID NO: 1877717 - RNA, 20 nt, Salmonella typhimurium LT2
aaauuaucuguugauaaaac

SEQ ID NO: 1877718 - RNA, 13 nt, Salmonella typhimurium LT2
aaauuaccuuuac

SEQ ID NO: 1877719 - RNA, 23 nt, Salmonella typhimurium LT2
aaauuaccuuuacaugaaaaaua

SEQ ID NO: 1877720 - RNA, 14 nt, Salmonella typhimurium LT2
aaauuaucauguau

SEQ ID NO: 1877721 - RNA, 14 nt, Salmonella typhimurium LT2
aaauggauacuggu

SEQ ID NO: 1877722 - RNA, 19 nt, Salmonella typhimurium LT2
aaauguuguuugaaaagug

SEQ ID NO: 1877723 - RNA, 15 nt, Salmonella typhimurium LT2
aaauguugauaaggu

SEQ ID NO: 1877724 - RNA, 15 nt, Salmonella typhimurium LT2
aaauuaaaauucauu

SEQ ID NO: 1877725 - RNA, 13 nt, Salmonella typhimurium LT2
aaauuaauugcca

SEQ ID NO: 1877726 - RNA, 17 nt, Salmonella typhimurium LT2
aaaaagcguacaaaaaa

SEQ ID NO: 1877727 - RNA, 21 nt, Salmonella typhimurium LT2
aaaucaucgccaugaccacaa

SEQ ID NO: 1877728 - RNA, 14 nt, Salmonella typhimurium LT2
aaaucaugcucaua

SEQ ID NO: 1877729 - RNA, 21 nt, Salmonella typhimurium LT2
aaaucaugcucauaauggacc

SEQ ID NO: 1877730 - RNA, 13 nt, Salmonella typhimurium LT2
aaaucaucaaugg

SEQ ID NO: 1877731 - RNA, 16 nt, Salmonella typhimurium LT2
aaaucauccugcggga

SEQ ID NO: 1877732 - RNA, 21 nt, Salmonella typhimurium LT2
aaaucaugcccaacugccagc

SEQ ID NO: 1877733 - RNA, 21 nt, Salmonella typhimurium LT2
aaaucauucgaccacaaccca

SEQ ID NO: 1877734 - RNA, 18 nt, Salmonella typhimurium LT2
aaaucauuuguacaaaaa

SEQ ID NO: 1877735 - RNA, 19 nt, Salmonella typhimurium LT2
aaaucauuuguacaaaaaa

SEQ ID NO: 1877736 - RNA, 13 nt, Salmonella typhimurium LT2
aaaucgcgagccu

SEQ ID NO: 1877737 - RNA, 20 nt, Salmonella typhimurium LT2
aaaucuggugauaaagcaga

SEQ ID NO: 1877738 - RNA, 18 nt, Salmonella typhimurium LT2
aaaucugguguaaauaac

SEQ ID NO: 1877739 - RNA, 17 nt, Salmonella typhimurium LT2
aaaucgcggcgauuaau

SEQ ID NO: 1877740 - RNA, 21 nt, Salmonella typhimurium LT2
aaaucgcuauauugcugcgca

SEQ ID NO: 1877741 - RNA, 13 nt, Salmonella typhimurium LT2
aaaugauguguuu

SEQ ID NO: 1877742 - RNA, 18 nt, Salmonella typhimurium LT2
aaaugauguccacacuga

SEQ ID NO: 1877743 - RNA, 12 nt, Salmonella typhimurium LT2
aaaugaaaaauc

SEQ ID NO: 1877744 - RNA, 21 nt, Salmonella typhimurium LT2
aaaugaaaaacgguauuucca

SEQ ID NO: 1877745 - RNA, 13 nt, Salmonella typhimurium LT2
aaaucuuccaguu

SEQ ID NO: 1877746 - RNA, 13 nt, Salmonella typhimurium LT2
aaaucuucauuuc

SEQ ID NO: 1877747 - RNA, 18 nt, Salmonella typhimurium LT2
aaaugcgacaucucaggc

SEQ ID NO: 1877748 - RNA, 16 nt, Salmonella typhimurium LT2
aaaugcgaugaacauc

SEQ ID NO: 1877749 - RNA, 16 nt, Salmonella typhimurium LT2
aaaugcccgucccauu

SEQ ID NO: 1877750 - RNA, 23 nt, Salmonella typhimurium LT2
aaaugccccgugacuuuccaguu

SEQ ID NO: 1877751 - RNA, 13 nt, Salmonella typhimurium LT2
aaaugcugggcuu

SEQ ID NO: 1877752 - RNA, 15 nt, Salmonella typhimurium LT2
aaaugcuuaucugau

SEQ ID NO: 1877753 - RNA, 16 nt, Salmonella typhimurium LT2
aaaugcgcuuugauag

SEQ ID NO: 1877754 - RNA, 17 nt, Salmonella typhimurium LT2
aaaugcggguccugauc

SEQ ID NO: 1877755 - RNA, 14 nt, Salmonella typhimurium LT2
aaguuuuuuuaaaa

SEQ ID NO: 1877756 - RNA, 22 nt, Salmonella typhimurium LT2
aauaaaaaacaacucuauuaaa

SEQ ID NO: 1877757 - RNA, 15 nt, Salmonella typhimurium LT2
aauaaaaaacaagau

SEQ ID NO: 1877758 - RNA, 14 nt, Salmonella typhimurium LT2
aauaaaaaccauuu

SEQ ID NO: 1877759 - RNA, 22 nt, Salmonella typhimurium LT2
aauaaaaaccauuuauaaaaua

SEQ ID NO: 1877760 - RNA, 12 nt, Salmonella typhimurium LT2
aauaaaaaaacc

SEQ ID NO: 1877761 - RNA, 14 nt, Salmonella typhimurium LT2
aauaaacaucagcc

SEQ ID NO: 1877762 - RNA, 10 nt, Salmonella typhimurium LT2
aauaaacaca

SEQ ID NO: 1877763 - RNA, 15 nt, Salmonella typhimurium LT2
aauaaaauucagcgc

SEQ ID NO: 1877764 - RNA, 18 nt, Salmonella typhimurium LT2
aauaaaauuguuauuuaa

SEQ ID NO: 1877765 - RNA, 12 nt, Salmonella typhimurium LT2
aauaaaaggaau

SEQ ID NO: 1877766 - RNA, 17 nt, Salmonella typhimurium LT2
aauaaaacggcucauca

SEQ ID NO: 1877767 - RNA, 14 nt, Salmonella typhimurium LT2
aauaaaauagcgau

SEQ ID NO: 1877768 - RNA, 12 nt, Salmonella typhimurium LT2
aauaaaauaucc

SEQ ID NO: 1877769 - RNA, 17 nt, Salmonella typhimurium LT2
aauaaacugcauccccu

SEQ ID NO: 1877770 - RNA, 21 nt, Salmonella typhimurium LT2
aauaaagcggucuuucaacau

SEQ ID NO: 1877771 - RNA, 22 nt, Salmonella typhimurium LT2
aauaaagcguagccgcgccaga

SEQ ID NO: 1877772 - RNA, 13 nt, Salmonella typhimurium LT2
aauaaacauuuuu

SEQ ID NO: 1877773 - RNA, 15 nt, Salmonella typhimurium LT2
aauaaacaucagcca

SEQ ID NO: 1877774 - RNA, 22 nt, Salmonella typhimurium LT2
aauaaacggcgcguccagccag

SEQ ID NO: 1877775 - RNA, 20 nt, Salmonella typhimurium LT2
aauaaaggcuugacucaaaa

SEQ ID NO: 1877776 - RNA, 14 nt, Salmonella typhimurium LT2
aauaaauaccaaag

SEQ ID NO: 1877777 - RNA, 23 nt, Salmonella typhimurium LT2
aauaaauucuuuacgcagcaaga

SEQ ID NO: 1877778 - RNA, 18 nt, Salmonella typhimurium LT2
aauaaauuuucauuauaa

SEQ ID NO: 1877779 - RNA, 14 nt, Salmonella typhimurium LT2
aauaacaaaaugag

SEQ ID NO: 1877780 - RNA, 12 nt, Salmonella typhimurium LT2
aauaaccgccag

SEQ ID NO: 1877781 - RNA, 18 nt, Salmonella typhimurium LT2
aauaaccgccagcagcag

SEQ ID NO: 1877782 - RNA, 17 nt, Salmonella typhimurium LT2
aauaacacaggcggcgc

SEQ ID NO: 1877783 - RNA, 13 nt, Salmonella typhimurium LT2
aauaacaaaugaa

SEQ ID NO: 1877784 - RNA, 14 nt, Salmonella typhimurium LT2
aaguaauaaaaaac

SEQ ID NO: 1877785 - RNA, 18 nt, Salmonella typhimurium LT2
aaguaaggaggaaucgcu

SEQ ID NO: 1877786 - RNA, 15 nt, Salmonella typhimurium LT2
aaguaaauaagaaaa

SEQ ID NO: 1877787 - RNA, 14 nt, Salmonella typhimurium LT2
aagucugugaggaa

SEQ ID NO: 1877788 - RNA, 15 nt, Salmonella typhimurium LT2
aagucugugaggaaa

SEQ ID NO: 1877789 - RNA, 23 nt, Salmonella typhimurium LT2
aaguaauagguugcgccaacguc

SEQ ID NO: 1877790 - RNA, 20 nt, Salmonella typhimurium LT2
aaguuuaugguaaucacaca

SEQ ID NO: 1877791 - RNA, 21 nt, Salmonella typhimurium LT2
aaguuuauuugaauagucaac

SEQ ID NO: 1877792 - RNA, 18 nt, Salmonella typhimurium LT2
aagugguuaacagcgcag

SEQ ID NO: 1877793 - RNA, 15 nt, Salmonella typhimurium LT2
aagugugaacuaugc

SEQ ID NO: 1877794 - RNA, 20 nt, Salmonella typhimurium LT2
aaguuagccccuuaucaaag

SEQ ID NO: 1877795 - RNA, 18 nt, Salmonella typhimurium LT2
aaguuaucccugcugagu

SEQ ID NO: 1877796 - RNA, 23 nt, Salmonella typhimurium LT2
aauaaucccgcagaaaagaccgg

SEQ ID NO: 1877797 - RNA, 18 nt, Salmonella typhimurium LT2
aauaaucccgcauauuuu

SEQ ID NO: 1877798 - RNA, 17 nt, Salmonella typhimurium LT2
aauaaucccuucuuuua

SEQ ID NO: 1877799 - RNA, 18 nt, Salmonella typhimurium LT2
aauaaucgccgccgguaa

SEQ ID NO: 1877800 - RNA, 13 nt, Salmonella typhimurium LT2
aauaauucucaau

SEQ ID NO: 1877801 - RNA, 15 nt, Salmonella typhimurium LT2
aauaauugagcgcaa

SEQ ID NO: 1877802 - RNA, 13 nt, Salmonella typhimurium LT2
aauaauuuaaaau

SEQ ID NO: 1877803 - RNA, 14 nt, Salmonella typhimurium LT2
aauaauuuaaaauu

SEQ ID NO: 1877804 - RNA, 19 nt, Salmonella typhimurium LT2
aauacaggcguguggcaua

SEQ ID NO: 1877805 - RNA, 14 nt, Salmonella typhimurium LT2
aauacagccagcac

SEQ ID NO: 1877806 - RNA, 21 nt, Salmonella typhimurium LT2
aauaacgggcacggucugcug

SEQ ID NO: 1877807 - RNA, 16 nt, Salmonella typhimurium LT2
aauaaccucuacacau

SEQ ID NO: 1877808 - RNA, 20 nt, Salmonella typhimurium LT2
aauaaccucuacacauuuua

SEQ ID NO: 1877809 - RNA, 22 nt, Salmonella typhimurium LT2
aauaaccucuacacauuuuaaa

SEQ ID NO: 1877810 - RNA, 19 nt, Salmonella typhimurium LT2
aauaacgcacuaccagaaa

SEQ ID NO: 1877811 - RNA, 19 nt, Salmonella typhimurium LT2
aauaacgccagaucucaca

SEQ ID NO: 1877812 - RNA, 22 nt, Salmonella typhimurium LT2
aauaacgccagaucucacaaga

SEQ ID NO: 1877813 - RNA, 17 nt, Salmonella typhimurium LT2
aauaacgccgauaacca

SEQ ID NO: 1877814 - RNA, 20 nt, Salmonella typhimurium LT2
aaaaauacugauaaaaaaca

SEQ ID NO: 1877815 - RNA, 21 nt, Salmonella typhimurium LT2
aaaaauaauuacuaucuucaa

SEQ ID NO: 1877816 - RNA, 20 nt, Salmonella typhimurium LT2
aaaaauaauuacuaucuuca

SEQ ID NO: 1877817 - RNA, 21 nt, Salmonella typhimurium LT2
aauaacuauaauugcuuuuuu

SEQ ID NO: 1877818 - RNA, 17 nt, Salmonella typhimurium LT2
aauaacuauaauugcuu

SEQ ID NO: 1877819 - RNA, 16 nt, Salmonella typhimurium LT2
aauaacuauaauugcu

SEQ ID NO: 1877820 - RNA, 13 nt, Salmonella typhimurium LT2
aaaaauaucugaa

SEQ ID NO: 1877821 - RNA, 18 nt, Salmonella typhimurium LT2
aaaaauauguguuugaug

SEQ ID NO: 1877822 - RNA, 13 nt, Salmonella typhimurium LT2
aauaauauuauug

SEQ ID NO: 1877823 - RNA, 23 nt, Salmonella typhimurium LT2
aauaauaugccccgacaucagau

SEQ ID NO: 1877824 - RNA, 20 nt, Salmonella typhimurium LT2
aauaauaugccccgacauca

SEQ ID NO: 1877825 - RNA, 17 nt, Salmonella typhimurium LT2
aauaauauccugccgca

SEQ ID NO: 1877826 - RNA, 13 nt, Salmonella typhimurium LT2
aauacguaauacc

SEQ ID NO: 1877827 - RNA, 23 nt, Salmonella typhimurium LT2
aauacgggagagcguauccagca

SEQ ID NO: 1877828 - RNA, 18 nt, Salmonella typhimurium LT2
aauacgugagcgaaguuc

SEQ ID NO: 1877829 - RNA, 24 nt, Salmonella typhimurium LT2
aauacgguuagccagugggcguca

SEQ ID NO: 1877830 - RNA, 20 nt, Salmonella typhimurium LT2
aauacgcuuguacuugauac

SEQ ID NO: 1877831 - RNA, 18 nt, Salmonella typhimurium LT2
aauacgccgccagcaaua

SEQ ID NO: 1877832 - RNA, 20 nt, Salmonella typhimurium LT2
aauacgacucaauacauuca

SEQ ID NO: 1877833 - RNA, 13 nt, Salmonella typhimurium LT2
aauacaguuuucc

SEQ ID NO: 1877834 - RNA, 14 nt, Salmonella typhimurium LT2
aauacaguuuuccu

SEQ ID NO: 1877835 - RNA, 17 nt, Salmonella typhimurium LT2
aauaccggauacgcaua

SEQ ID NO: 1877836 - RNA, 16 nt, Salmonella typhimurium LT2
aauaccgaaauccgcu

SEQ ID NO: 1877837 - RNA, 14 nt, Salmonella typhimurium LT2
aauacccuccgcca

SEQ ID NO: 1877838 - RNA, 15 nt, Salmonella typhimurium LT2
aauagagaaaucaac

SEQ ID NO: 1877839 - RNA, 17 nt, Salmonella typhimurium LT2
aauagagaaaucaacga

SEQ ID NO: 1877840 - RNA, 15 nt, Salmonella typhimurium LT2
aauacuguaagccuc

SEQ ID NO: 1877841 - RNA, 15 nt, Salmonella typhimurium LT2
aauacuuaucaacuu

SEQ ID NO: 1877842 - RNA, 21 nt, Salmonella typhimurium LT2
aauacuuaucaacuucuucau

SEQ ID NO: 1877843 - RNA, 23 nt, Salmonella typhimurium LT2
aauacugaacgccgcguuuuagc

SEQ ID NO: 1877844 - RNA, 22 nt, Salmonella typhimurium LT2
aauacugagacgcgaaacgaaa

SEQ ID NO: 1877845 - RNA, 12 nt, Salmonella typhimurium LT2
aauacugauaaa

SEQ ID NO: 1877846 - RNA, 17 nt, Salmonella typhimurium LT2
aauacugaucaguuugc

SEQ ID NO: 1877847 - RNA, 18 nt, Salmonella typhimurium LT2
aauacugcuuuuccggca

SEQ ID NO: 1877848 - RNA, 14 nt, Salmonella typhimurium LT2
aagaaucccccaua

SEQ ID NO: 1877849 - RNA, 22 nt, Salmonella typhimurium LT2
aagaugguaauauuaaaaccau

SEQ ID NO: 1877850 - RNA, 20 nt, Salmonella typhimurium LT2
aagauuaauugauuacaaag

SEQ ID NO: 1877851 - RNA, 18 nt, Salmonella typhimurium LT2
aagauugauuuauucacu

SEQ ID NO: 1877852 - RNA, 18 nt, Salmonella typhimurium LT2
aagauucacucugaaaaa

SEQ ID NO: 1877853 - RNA, 12 nt, Salmonella typhimurium LT2
aagauuccagau

SEQ ID NO: 1877854 - RNA, 20 nt, Salmonella typhimurium LT2
aagcaacuguagaaugcuau

SEQ ID NO: 1877855 - RNA, 16 nt, Salmonella typhimurium LT2
aagcaauaccacgccc

SEQ ID NO: 1877856 - RNA, 15 nt, Salmonella typhimurium LT2
aagcaauaauccgcu

SEQ ID NO: 1877857 - RNA, 20 nt, Salmonella typhimurium LT2
aagcaauauggcugcgacaa

SEQ ID NO: 1877858 - RNA, 23 nt, Salmonella typhimurium LT2
aagcaauuacggacagaaaaaau

SEQ ID NO: 1877859 - RNA, 14 nt, Salmonella typhimurium LT2
aagcacaucaggaa

SEQ ID NO: 1877860 - RNA, 19 nt, Salmonella typhimurium LT2
aagcacaucaggaaaugaa

SEQ ID NO: 1877861 - RNA, 16 nt, Salmonella typhimurium LT2
aagcacauagcugaga

SEQ ID NO: 1877862 - RNA, 18 nt, Salmonella typhimurium LT2
aagcacauagcugagacu

SEQ ID NO: 1877863 - RNA, 22 nt, Salmonella typhimurium LT2
aagcacaggccauuaagcuucg

SEQ ID NO: 1877864 - RNA, 17 nt, Salmonella typhimurium LT2
aagcacagauaaaggau

SEQ ID NO: 1877865 - RNA, 22 nt, Salmonella typhimurium LT2
aagcaaagcgccauccggcaau

SEQ ID NO: 1877866 - RNA, 23 nt, Salmonella typhimurium LT2
aagcaacugggcuugcauugcuu

SEQ ID NO: 1877867 - RNA, 16 nt, Salmonella typhimurium LT2
aagcaacuguagaaug

SEQ ID NO: 1877868 - RNA, 23 nt, Salmonella typhimurium LT2
aagcaacugauuaaucugccgac

SEQ ID NO: 1877869 - RNA, 22 nt, Salmonella typhimurium LT2
aagcaaaaauuucgcucagaug

SEQ ID NO: 1877870 - RNA, 19 nt, Salmonella typhimurium LT2
aagcagaccggggcaggcg

SEQ ID NO: 1877871 - RNA, 22 nt, Salmonella typhimurium LT2
aagcagaccaccccacagcaau

SEQ ID NO: 1877872 - RNA, 15 nt, Salmonella typhimurium LT2
aagcagauaccagcc

SEQ ID NO: 1877873 - RNA, 12 nt, Salmonella typhimurium LT2
aagcagcugcug

SEQ ID NO: 1877874 - RNA, 19 nt, Salmonella typhimurium LT2
aagcagaacguagcccauu

SEQ ID NO: 1877875 - RNA, 14 nt, Salmonella typhimurium LT2
aagcacuucuccac

SEQ ID NO: 1877876 - RNA, 21 nt, Salmonella typhimurium LT2
aagcaccugcauuuaucuuua

SEQ ID NO: 1877877 - RNA, 18 nt, Salmonella typhimurium LT2
aagcacuauuauauuuua

SEQ ID NO: 1877878 - RNA, 19 nt, Salmonella typhimurium LT2
aagcaccaucgcaaauuca

SEQ ID NO: 1877879 - RNA, 15 nt, Salmonella typhimurium LT2
aagcauaccuucaca

SEQ ID NO: 1877880 - RNA, 23 nt, Salmonella typhimurium LT2
aagcauacccuuccccaucaaaa

SEQ ID NO: 1877881 - RNA, 14 nt, Salmonella typhimurium LT2
aagcauaccuucac

SEQ ID NO: 1877882 - RNA, 15 nt, Salmonella typhimurium LT2
aagcaucugauauau

SEQ ID NO: 1877883 - RNA, 18 nt, Salmonella typhimurium LT2
aagccccccgcacagcac

SEQ ID NO: 1877884 - RNA, 15 nt, Salmonella typhimurium LT2
aagccccccgcacag

SEQ ID NO: 1877885 - RNA, 18 nt, Salmonella typhimurium LT2
aagccgaaaccacagcgg

SEQ ID NO: 1877886 - RNA, 16 nt, Salmonella typhimurium LT2
aagcccggccacagcg

SEQ ID NO: 1877887 - RNA, 21 nt, Salmonella typhimurium LT2
aagcccaccgcgaacauugga

SEQ ID NO: 1877888 - RNA, 22 nt, Salmonella typhimurium LT2
aagccaugccgaagacuccccu

SEQ ID NO: 1877889 - RNA, 23 nt, Salmonella typhimurium LT2
aagccaucuucgguaauacaauc

SEQ ID NO: 1877890 - RNA, 21 nt, Salmonella typhimurium LT2
aagccauugccgauuucacga

SEQ ID NO: 1877891 - RNA, 22 nt, Salmonella typhimurium LT2
aagccauuggucaucaucagga

SEQ ID NO: 1877892 - RNA, 15 nt, Salmonella typhimurium LT2
aagccacaaucugau

SEQ ID NO: 1877893 - RNA, 20 nt, Salmonella typhimurium LT2
aagccagcacggcuucacgu

SEQ ID NO: 1877894 - RNA, 15 nt, Salmonella typhimurium LT2
aagccacugcccaga

SEQ ID NO: 1877895 - RNA, 22 nt, Salmonella typhimurium LT2
aagccagccaaauagcgccaga

SEQ ID NO: 1877896 - RNA, 16 nt, Salmonella typhimurium LT2
aagccaacguugaaaa

SEQ ID NO: 1877897 - RNA, 15 nt, Salmonella typhimurium LT2
aagccaaaauuuuca

SEQ ID NO: 1877898 - RNA, 19 nt, Salmonella typhimurium LT2
aagcauugccguuuucaau

SEQ ID NO: 1877899 - RNA, 15 nt, Salmonella typhimurium LT2
aagguucauggcuuc

SEQ ID NO: 1877900 - RNA, 16 nt, Salmonella typhimurium LT2
aagguucccugcgcca

SEQ ID NO: 1877901 - RNA, 17 nt, Salmonella typhimurium LT2
aaguaaauaagaaaaug

SEQ ID NO: 1877902 - RNA, 18 nt, Salmonella typhimurium LT2
aaguaaauaagaaaaugc

SEQ ID NO: 1877903 - RNA, 14 nt, Salmonella typhimurium LT2
aagguuaagagggu

SEQ ID NO: 1877904 - RNA, 14 nt, Salmonella typhimurium LT2
aaggugagcucuuu

SEQ ID NO: 1877905 - RNA, 23 nt, Salmonella typhimurium LT2
aaggucugacaacuauugcugcc

SEQ ID NO: 1877906 - RNA, 15 nt, Salmonella typhimurium LT2
aaggucaucacaucc

SEQ ID NO: 1877907 - RNA, 14 nt, Salmonella typhimurium LT2
aagguaauuuucac

SEQ ID NO: 1877908 - RNA, 19 nt, Salmonella typhimurium LT2
aaggcgcuauccugguagc

SEQ ID NO: 1877909 - RNA, 15 nt, Salmonella typhimurium LT2
aaggcggcaaagaua

SEQ ID NO: 1877910 - RNA, 16 nt, Salmonella typhimurium LT2
aaggcggcaaagauaa

SEQ ID NO: 1877911 - RNA, 23 nt, Salmonella typhimurium LT2
aaggccuggcugagaaaaauacg

SEQ ID NO: 1877912 - RNA, 18 nt, Salmonella typhimurium LT2
aagggaggugcucuccca

SEQ ID NO: 1877913 - RNA, 16 nt, Salmonella typhimurium LT2
aagggagcagacugua

SEQ ID NO: 1877914 - RNA, 22 nt, Salmonella typhimurium LT2
aaggcguaagucguaccggcgc

SEQ ID NO: 1877915 - RNA, 17 nt, Salmonella typhimurium LT2
aaggcggugucaucuuc

SEQ ID NO: 1877916 - RNA, 22 nt, Salmonella typhimurium LT2
aagguaaacgcgaccagcgcac

SEQ ID NO: 1877917 - RNA, 18 nt, Salmonella typhimurium LT2
aaggguuuucgccuggcg

SEQ ID NO: 1877918 - RNA, 12 nt, Salmonella typhimurium LT2
aagggcagagcc

SEQ ID NO: 1877919 - RNA, 21 nt, Salmonella typhimurium LT2
aagggccagagaaagucgcuc

SEQ ID NO: 1877920 - RNA, 17 nt, Salmonella typhimurium LT2
aaggguaugaauaaaaa

SEQ ID NO: 1877921 - RNA, 23 nt, Salmonella typhimurium LT2
aagcguaacagcgcuaucaggaa

SEQ ID NO: 1877922 - RNA, 19 nt, Salmonella typhimurium LT2
aagcgucauaaguguuuua

SEQ ID NO: 1877923 - RNA, 21 nt, Salmonella typhimurium LT2
aagcgucuuuaaagccuucau

SEQ ID NO: 1877924 - RNA, 14 nt, Salmonella typhimurium LT2
aagcgucgccagcg

SEQ ID NO: 1877925 - RNA, 21 nt, Salmonella typhimurium LT2
aagcgucgccagcguuucacu

SEQ ID NO: 1877926 - RNA, 17 nt, Salmonella typhimurium LT2
aagcgcugagucaggcg

SEQ ID NO: 1877927 - RNA, 13 nt, Salmonella typhimurium LT2
aagcgcugcugcu

SEQ ID NO: 1877928 - RNA, 23 nt, Salmonella typhimurium LT2
aagcggaaaggacguucuucucc

SEQ ID NO: 1877929 - RNA, 13 nt, Salmonella typhimurium LT2
aagcggaacugau

SEQ ID NO: 1877930 - RNA, 20 nt, Salmonella typhimurium LT2
aagcggaccaaugcuggcag

SEQ ID NO: 1877931 - RNA, 12 nt, Salmonella typhimurium LT2
aagcgcgggcug

SEQ ID NO: 1877932 - RNA, 20 nt, Salmonella typhimurium LT2
aagcgcgguaaauuucuuga

SEQ ID NO: 1877933 - RNA, 15 nt, Salmonella typhimurium LT2
aagcguuucucuugu

SEQ ID NO: 1877934 - RNA, 22 nt, Salmonella typhimurium LT2
aagcguuuccagaguacauucu

SEQ ID NO: 1877935 - RNA, 22 nt, Salmonella typhimurium LT2
aagcuaaaaaccgcaaucaguu

SEQ ID NO: 1877936 - RNA, 22 nt, Salmonella typhimurium LT2
aagcguuaaugcguuuacacag

SEQ ID NO: 1877937 - RNA, 15 nt, Salmonella typhimurium LT2
aagcguuaaugcguu

SEQ ID NO: 1877938 - RNA, 12 nt, Salmonella typhimurium LT2
aagcguuccagu

SEQ ID NO: 1877939 - RNA, 18 nt, Salmonella typhimurium LT2
aagcguuacggaaaaaau

SEQ ID NO: 1877940 - RNA, 14 nt, Salmonella typhimurium LT2
aagcguuuccagag

SEQ ID NO: 1877941 - RNA, 14 nt, Salmonella typhimurium LT2
aagcucuucaugca

SEQ ID NO: 1877942 - RNA, 11 nt, Salmonella typhimurium LT2
aagcuaauccc

SEQ ID NO: 1877943 - RNA, 19 nt, Salmonella typhimurium LT2
aagcuguaaccuacgccaa

SEQ ID NO: 1877944 - RNA, 16 nt, Salmonella typhimurium LT2
aagcugcgcagcacuu

SEQ ID NO: 1877945 - RNA, 21 nt, Salmonella typhimurium LT2
aagcuguuucuccguuguugc

SEQ ID NO: 1877946 - RNA, 17 nt, Salmonella typhimurium LT2
aagcugugccacauuua

SEQ ID NO: 1877947 - RNA, 17 nt, Salmonella typhimurium LT2
aagcugcggcagaauca

SEQ ID NO: 1877948 - RNA, 17 nt, Salmonella typhimurium LT2
aagcugcaccaggagca

SEQ ID NO: 1877949 - RNA, 21 nt, Salmonella typhimurium LT2
aagcuuugcguaaaaaaacau

SEQ ID NO: 1877950 - RNA, 22 nt, Salmonella typhimurium LT2
aagcuuugcguaaaaaaacauc

SEQ ID NO: 1877951 - RNA, 19 nt, Salmonella typhimurium LT2
aagcuuucugaauuucacg

SEQ ID NO: 1877952 - RNA, 12 nt, Salmonella typhimurium LT2
aagcuuuucacc

SEQ ID NO: 1877953 - RNA, 21 nt, Salmonella typhimurium LT2
aagcuuuucgcuugcggcugc

SEQ ID NO: 1877954 - RNA, 16 nt, Salmonella typhimurium LT2
aaggaaacgccaggca

SEQ ID NO: 1877955 - RNA, 13 nt, Salmonella typhimurium LT2
aacgccaucagcc

SEQ ID NO: 1877956 - RNA, 21 nt, Salmonella typhimurium LT2
aacgccaguuccgccacggcg

SEQ ID NO: 1877957 - RNA, 22 nt, Salmonella typhimurium LT2
aacgccaggccguugugucccu

SEQ ID NO: 1877958 - RNA, 18 nt, Salmonella typhimurium LT2
aacgcacccgcgcaggcg

SEQ ID NO: 1877959 - RNA, 15 nt, Salmonella typhimurium LT2
aacgcaccaccugca

SEQ ID NO: 1877960 - RNA, 15 nt, Salmonella typhimurium LT2
aacgcaacucaucgu

SEQ ID NO: 1877961 - RNA, 15 nt, Salmonella typhimurium LT2
aacgcccucucuccg

SEQ ID NO: 1877962 - RNA, 19 nt, Salmonella typhimurium LT2
aacgccgcaaccaaagccg

SEQ ID NO: 1877963 - RNA, 19 nt, Salmonella typhimurium LT2
aacgccccuucaucagcca

SEQ ID NO: 1877964 - RNA, 22 nt, Salmonella typhimurium LT2
aacgccccuucaucagccagca

SEQ ID NO: 1877965 - RNA, 12 nt, Salmonella typhimurium LT2
aacgcccaacug

SEQ ID NO: 1877966 - RNA, 22 nt, Salmonella typhimurium LT2
aacgcccgccgcgaccaacagc

SEQ ID NO: 1877967 - RNA, 21 nt, Salmonella typhimurium LT2
aacgcccggcgcgacaccuuc

SEQ ID NO: 1877968 - RNA, 19 nt, Salmonella typhimurium LT2
aaccggaccagcacaaaaa

SEQ ID NO: 1877969 - RNA, 15 nt, Salmonella typhimurium LT2
aacgauuucaucagc

SEQ ID NO: 1877970 - RNA, 16 nt, Salmonella typhimurium LT2
aacgauuucaucagcg

SEQ ID NO: 1877971 - RNA, 16 nt, Salmonella typhimurium LT2
aacgaucccuaauaaa

SEQ ID NO: 1877972 - RNA, 23 nt, Salmonella typhimurium LT2
aaccggcguccggcgccugaaua

SEQ ID NO: 1877973 - RNA, 13 nt, Salmonella typhimurium LT2
aacgccuccaccg

SEQ ID NO: 1877974 - RNA, 20 nt, Salmonella typhimurium LT2
aacgccgcuuuaccgccuuc

SEQ ID NO: 1877975 - RNA, 17 nt, Salmonella typhimurium LT2
aacgccggauuccagaa

SEQ ID NO: 1877976 - RNA, 17 nt, Salmonella typhimurium LT2
aacgccgccgcaaggcg

SEQ ID NO: 1877977 - RNA, 22 nt, Salmonella typhimurium LT2
aacgcuuuugcgcacugcucgu

SEQ ID NO: 1877978 - RNA, 15 nt, Salmonella typhimurium LT2
aacgcuuucgccagc

SEQ ID NO: 1877979 - RNA, 16 nt, Salmonella typhimurium LT2
aacgcuuucgccagcg

SEQ ID NO: 1877980 - RNA, 16 nt, Salmonella typhimurium LT2
aacggucuugccagcg

SEQ ID NO: 1877981 - RNA, 21 nt, Salmonella typhimurium LT2
aacgguaccgaacggcgucgg

SEQ ID NO: 1877982 - RNA, 18 nt, Salmonella typhimurium LT2
aacggugggguccgauuu

SEQ ID NO: 1877983 - RNA, 16 nt, Salmonella typhimurium LT2
aacgguaaguugaaag

SEQ ID NO: 1877984 - RNA, 17 nt, Salmonella typhimurium LT2
aacgcuuugccagcauc

SEQ ID NO: 1877985 - RNA, 21 nt, Salmonella typhimurium LT2
aacuaaacgacguggaguccg

SEQ ID NO: 1877986 - RNA, 23 nt, Salmonella typhimurium LT2
aacgugcauuauuuuagugaaaa

SEQ ID NO: 1877987 - RNA, 17 nt, Salmonella typhimurium LT2
aacgugauugcugacac

SEQ ID NO: 1877988 - RNA, 22 nt, Salmonella typhimurium LT2
aacgugauugcugacacaauau

SEQ ID NO: 1877989 - RNA, 13 nt, Salmonella typhimurium LT2
aacgugccacagu

SEQ ID NO: 1877990 - RNA, 22 nt, Salmonella typhimurium LT2
aacguguuuucgauuucauuca

SEQ ID NO: 1877991 - RNA, 12 nt, Salmonella typhimurium LT2
aacguguuaucg

SEQ ID NO: 1877992 - RNA, 18 nt, Salmonella typhimurium LT2
aacguguuaugcgccugg

SEQ ID NO: 1877993 - RNA, 13 nt, Salmonella typhimurium LT2
aacguuaccuuua

SEQ ID NO: 1877994 - RNA, 15 nt, Salmonella typhimurium LT2
aacguuacgccagcg

SEQ ID NO: 1877995 - RNA, 18 nt, Salmonella typhimurium LT2
aacguuacuuuaaaacau

SEQ ID NO: 1877996 - RNA, 18 nt, Salmonella typhimurium LT2
aacguugugcuccgccgg

SEQ ID NO: 1877997 - RNA, 22 nt, Salmonella typhimurium LT2
aacguuuccggaaugagaugca

SEQ ID NO: 1877998 - RNA, 20 nt, Salmonella typhimurium LT2
aacguuuguagaugaacucg

SEQ ID NO: 1877999 - RNA, 12 nt, Salmonella typhimurium LT2
aacguuuucacc

SEQ ID NO: 1878000 - RNA, 16 nt, Salmonella typhimurium LT2
aacguugaugauaaau

SEQ ID NO: 1878001 - RNA, 15 nt, Salmonella typhimurium LT2
aacguuguauaaaca

SEQ ID NO: 1878002 - RNA, 17 nt, Salmonella typhimurium LT2
aacguucgcaucccagg

SEQ ID NO: 1878003 - RNA, 16 nt, Salmonella typhimurium LT2
aacgucguaaaaccug

SEQ ID NO: 1878004 - RNA, 12 nt, Salmonella typhimurium LT2
aacgucaucauc

SEQ ID NO: 1878005 - RNA, 15 nt, Salmonella typhimurium LT2
aacgucaucauuacc

SEQ ID NO: 1878006 - RNA, 17 nt, Salmonella typhimurium LT2
aacguccuaggacgaaa

SEQ ID NO: 1878007 - RNA, 20 nt, Salmonella typhimurium LT2
aacgucagcgccacccauuu

SEQ ID NO: 1878008 - RNA, 21 nt, Salmonella typhimurium LT2
aacgucaguggaaaacagcau

SEQ ID NO: 1878009 - RNA, 23 nt, Salmonella typhimurium LT2
aacguaaagcuggccuucagguu

SEQ ID NO: 1878010 - RNA, 16 nt, Salmonella typhimurium LT2
aacguaaauacccagg

SEQ ID NO: 1878011 - RNA, 17 nt, Salmonella typhimurium LT2
aacgucacauuuugacu

SEQ ID NO: 1878012 - RNA, 20 nt, Salmonella typhimurium LT2
aacgucacauuuugacuggu

SEQ ID NO: 1878013 - RNA, 17 nt, Salmonella typhimurium LT2
aacugcgggaaguagca

SEQ ID NO: 1878014 - RNA, 14 nt, Salmonella typhimurium LT2
aacugcggccagac

SEQ ID NO: 1878015 - RNA, 20 nt, Salmonella typhimurium LT2
aacugcggaauuuuauccug

SEQ ID NO: 1878016 - RNA, 16 nt, Salmonella typhimurium LT2
aacugcgccugcauau

SEQ ID NO: 1878017 - RNA, 15 nt, Salmonella typhimurium LT2
aacugcgccugaaga

SEQ ID NO: 1878018 - RNA, 18 nt, Salmonella typhimurium LT2
aacugcacuuucugcacu

SEQ ID NO: 1878019 - RNA, 11 nt, Salmonella typhimurium LT2
aacugcugcuc

SEQ ID NO: 1878020 - RNA, 14 nt, Salmonella typhimurium LT2
aacugcuguagcac

SEQ ID NO: 1878021 - RNA, 13 nt, Salmonella typhimurium LT2
aacuggaaaaaga

SEQ ID NO: 1878022 - RNA, 16 nt, Salmonella typhimurium LT2
aacugaacccaucgcc

SEQ ID NO: 1878023 - RNA, 21 nt, Salmonella typhimurium LT2
aacucuuuugcagcaaauaca

SEQ ID NO: 1878024 - RNA, 23 nt, Salmonella typhimurium LT2
aacugauggcgcuaagccagcca

SEQ ID NO: 1878025 - RNA, 15 nt, Salmonella typhimurium LT2
aacugaugugacauu

SEQ ID NO: 1878026 - RNA, 23 nt, Salmonella typhimurium LT2
aacucuuguaggcccgauaagca

SEQ ID NO: 1878027 - RNA, 21 nt, Salmonella typhimurium LT2
aacucuuccgggcugacauaa

SEQ ID NO: 1878028 - RNA, 20 nt, Salmonella typhimurium LT2
aacuauuugccugaacgguu

SEQ ID NO: 1878029 - RNA, 22 nt, Salmonella typhimurium LT2
aacuuagcguccacucgcccau

SEQ ID NO: 1878030 - RNA, 13 nt, Salmonella typhimurium LT2
aacuuaaauaaaa

SEQ ID NO: 1878031 - RNA, 14 nt, Salmonella typhimurium LT2
aacuuaaauaaaaa

SEQ ID NO: 1878032 - RNA, 16 nt, Salmonella typhimurium LT2
aacuuaaauaaaaaug

SEQ ID NO: 1878033 - RNA, 17 nt, Salmonella typhimurium LT2
aacuuaaauaaaaauga

SEQ ID NO: 1878034 - RNA, 17 nt, Salmonella typhimurium LT2
aacuggugaaacagguu

SEQ ID NO: 1878035 - RNA, 13 nt, Salmonella typhimurium LT2
aacuggugaaaca

SEQ ID NO: 1878036 - RNA, 19 nt, Salmonella typhimurium LT2
aacugggugccaugaauau

SEQ ID NO: 1878037 - RNA, 15 nt, Salmonella typhimurium LT2
aacuggucaaacaaa

SEQ ID NO: 1878038 - RNA, 17 nt, Salmonella typhimurium LT2
aacuuauuuuauuuuua

SEQ ID NO: 1878039 - RNA, 18 nt, Salmonella typhimurium LT2
aacuuauuuuauuuuuau

SEQ ID NO: 1878040 - RNA, 22 nt, Salmonella typhimurium LT2
aagaaccgacugucgaaaccag

SEQ ID NO: 1878041 - RNA, 23 nt, Salmonella typhimurium LT2
aacuugccguuuuucucaucaag

SEQ ID NO: 1878042 - RNA, 22 nt, Salmonella typhimurium LT2
aacuuguaaaaaugccugugcc

SEQ ID NO: 1878043 - RNA, 15 nt, Salmonella typhimurium LT2
aagaaaaaauuaaaa

SEQ ID NO: 1878044 - RNA, 15 nt, Salmonella typhimurium LT2
aagaaacugugguua

SEQ ID NO: 1878045 - RNA, 15 nt, Salmonella typhimurium LT2
aagaaagauaaaaua

SEQ ID NO: 1878046 - RNA, 22 nt, Salmonella typhimurium LT2
aagaaaaaggagccuuacggcu

SEQ ID NO: 1878047 - RNA, 18 nt, Salmonella typhimurium LT2
aagaagcacgacacaaaa

SEQ ID NO: 1878048 - RNA, 19 nt, Salmonella typhimurium LT2
aagaacguucauggguuag

SEQ ID NO: 1878049 - RNA, 16 nt, Salmonella typhimurium LT2
aagaacgguuggaaua

SEQ ID NO: 1878050 - RNA, 19 nt, Salmonella typhimurium LT2
aagaagucgaaggcgcagc

SEQ ID NO: 1878051 - RNA, 16 nt, Salmonella typhimurium LT2
aagaauagccugggca

SEQ ID NO: 1878052 - RNA, 17 nt, Salmonella typhimurium LT2
aagaaucacgccgauga

SEQ ID NO: 1878053 - RNA, 13 nt, Salmonella typhimurium LT2
aagaauauauucu

SEQ ID NO: 1878054 - RNA, 16 nt, Salmonella typhimurium LT2
aaccaacgcccaacug

SEQ ID NO: 1878055 - RNA, 12 nt, Salmonella typhimurium LT2
aaccaacugagc

SEQ ID NO: 1878056 - RNA, 14 nt, Salmonella typhimurium LT2
aaccaacugagcua

SEQ ID NO: 1878057 - RNA, 12 nt, Salmonella typhimurium LT2
aacauugcgccg

SEQ ID NO: 1878058 - RNA, 18 nt, Salmonella typhimurium LT2
aacauugguuaucaaaaa

SEQ ID NO: 1878059 - RNA, 14 nt, Salmonella typhimurium LT2
aaccaaaugcccag

SEQ ID NO: 1878060 - RNA, 17 nt, Salmonella typhimurium LT2
aacauucaaaccuucaa

SEQ ID NO: 1878061 - RNA, 16 nt, Salmonella typhimurium LT2
aacaugaguaaacagg

SEQ ID NO: 1878062 - RNA, 20 nt, Salmonella typhimurium LT2
aacauuaaucgccauugcaa

SEQ ID NO: 1878063 - RNA, 18 nt, Salmonella typhimurium LT2
aacauguuuuguauuaau

SEQ ID NO: 1878064 - RNA, 23 nt, Salmonella typhimurium LT2
aacauacgggcaugaagaaaaua

SEQ ID NO: 1878065 - RNA, 15 nt, Salmonella typhimurium LT2
aacauauggcccauu

SEQ ID NO: 1878066 - RNA, 22 nt, Salmonella typhimurium LT2
aacagccauaaugcugccagca

SEQ ID NO: 1878067 - RNA, 20 nt, Salmonella typhimurium LT2
aacagcgaucacgccgucca

SEQ ID NO: 1878068 - RNA, 23 nt, Salmonella typhimurium LT2
aacagcgaucacgccguccagca

SEQ ID NO: 1878069 - RNA, 22 nt, Salmonella typhimurium LT2
aacagcgcaauaugcagaucga

SEQ ID NO: 1878070 - RNA, 18 nt, Salmonella typhimurium LT2
aacaucuuccaugccuuc

SEQ ID NO: 1878071 - RNA, 14 nt, Salmonella typhimurium LT2
aacaucauuucuac

SEQ ID NO: 1878072 - RNA, 15 nt, Salmonella typhimurium LT2
aacauauuuuucaca

SEQ ID NO: 1878073 - RNA, 19 nt, Salmonella typhimurium LT2
aacauauuuuucacacaua

SEQ ID NO: 1878074 - RNA, 23 nt, Salmonella typhimurium LT2
aacauauuuuucacacauaagca

SEQ ID NO: 1878075 - RNA, 19 nt, Salmonella typhimurium LT2
aacauauuuuuaugcacgc

SEQ ID NO: 1878076 - RNA, 22 nt, Salmonella typhimurium LT2
aacauauuuuuaugcacgcuau

SEQ ID NO: 1878077 - RNA, 16 nt, Salmonella typhimurium LT2
aaccgaauccuuugga

SEQ ID NO: 1878078 - RNA, 17 nt, Salmonella typhimurium LT2
aaccgaaauccaccagc

SEQ ID NO: 1878079 - RNA, 20 nt, Salmonella typhimurium LT2
aaccgacggugcucaugaca

SEQ ID NO: 1878080 - RNA, 18 nt, Salmonella typhimurium LT2
aaccgacuaucagaaaaa

SEQ ID NO: 1878081 - RNA, 19 nt, Salmonella typhimurium LT2
aaccgacgaacaaaauagu

SEQ ID NO: 1878082 - RNA, 19 nt, Salmonella typhimurium LT2
aaccgagguucaccagcgc

SEQ ID NO: 1878083 - RNA, 13 nt, Salmonella typhimurium LT2
aaccgagauacau

SEQ ID NO: 1878084 - RNA, 12 nt, Salmonella typhimurium LT2
aacccuccugcc

SEQ ID NO: 1878085 - RNA, 15 nt, Salmonella typhimurium LT2
aaccgcccccaacug

SEQ ID NO: 1878086 - RNA, 23 nt, Salmonella typhimurium LT2
aaccgccggauggcggcuaccuc

SEQ ID NO: 1878087 - RNA, 22 nt, Salmonella typhimurium LT2
aaccgcgcggcguucugcgcca

SEQ ID NO: 1878088 - RNA, 21 nt, Salmonella typhimurium LT2
aaccgcgcuggaaagcggcag

SEQ ID NO: 1878089 - RNA, 19 nt, Salmonella typhimurium LT2
aaccgcugaccaucaacaa

SEQ ID NO: 1878090 - RNA, 23 nt, Salmonella typhimurium LT2
aaccgcuaaugaggaaaaagccg

SEQ ID NO: 1878091 - RNA, 23 nt, Salmonella typhimurium LT2
aaccgcucacgguuucuacuucc

SEQ ID NO: 1878092 - RNA, 13 nt, Salmonella typhimurium LT2
aaccgcaaauaau

SEQ ID NO: 1878093 - RNA, 16 nt, Salmonella typhimurium LT2
aaccgauguaucaacc

SEQ ID NO: 1878094 - RNA, 14 nt, Salmonella typhimurium LT2
aacccacuuugcuu

SEQ ID NO: 1878095 - RNA, 16 nt, Salmonella typhimurium LT2
aaccauuucuuuugau

SEQ ID NO: 1878096 - RNA, 17 nt, Salmonella typhimurium LT2
aaccauugcuaaaaaua

SEQ ID NO: 1878097 - RNA, 11 nt, Salmonella typhimurium LT2
aacccauggcu

SEQ ID NO: 1878098 - RNA, 21 nt, Salmonella typhimurium LT2
aacccguuaaauaccagcacc

SEQ ID NO: 1878099 - RNA, 23 nt, Salmonella typhimurium LT2
aacccgucaccgccagugcauag

SEQ ID NO: 1878100 - RNA, 15 nt, Salmonella typhimurium LT2
aacccggcugagcgu

SEQ ID NO: 1878101 - RNA, 23 nt, Salmonella typhimurium LT2
aaccaugcccgggcgcugugcga

SEQ ID NO: 1878102 - RNA, 22 nt, Salmonella typhimurium LT2
aaccauguugaucguaaaauga

SEQ ID NO: 1878103 - RNA, 15 nt, Salmonella typhimurium LT2
aaccauucaaauuca

SEQ ID NO: 1878104 - RNA, 19 nt, Salmonella typhimurium LT2
aaccacgaaguaccacuaa

SEQ ID NO: 1878105 - RNA, 20 nt, Salmonella typhimurium LT2
aaccacaaguuuauccggca

SEQ ID NO: 1878106 - RNA, 19 nt, Salmonella typhimurium LT2
aaccacggauaagccagcc

SEQ ID NO: 1878107 - RNA, 17 nt, Salmonella typhimurium LT2
aaccacgccaaccaucg

SEQ ID NO: 1878108 - RNA, 10 nt, Salmonella typhimurium LT2
aaccacgcca

SEQ ID NO: 1878109 - RNA, 20 nt, Salmonella typhimurium LT2
aaccacgccauggccgcagc

SEQ ID NO: 1878110 - RNA, 23 nt, Salmonella typhimurium LT2
aacaauaucgauagcauuuuuac

SEQ ID NO: 1878111 - RNA, 17 nt, Salmonella typhimurium LT2
aacaaucgccugacuga

SEQ ID NO: 1878112 - RNA, 17 nt, Salmonella typhimurium LT2
aacaaucgggaacagcc

SEQ ID NO: 1878113 - RNA, 15 nt, Salmonella typhimurium LT2
aaaaagggaauaaua

SEQ ID NO: 1878114 - RNA, 16 nt, Salmonella typhimurium LT2
aacacauccagcguca

SEQ ID NO: 1878115 - RNA, 22 nt, Salmonella typhimurium LT2
aacacauaacgcccgacaaucg

SEQ ID NO: 1878116 - RNA, 16 nt, Salmonella typhimurium LT2
aacacaucagcaacuu

SEQ ID NO: 1878117 - RNA, 13 nt, Salmonella typhimurium LT2
aacacaaucacug

SEQ ID NO: 1878118 - RNA, 21 nt, Salmonella typhimurium LT2
aacaccagccgcaucuuauau

SEQ ID NO: 1878119 - RNA, 14 nt, Salmonella typhimurium LT2
aacaccaguuuauc

SEQ ID NO: 1878120 - RNA, 15 nt, Salmonella typhimurium LT2
aacaccaccgcccgc

SEQ ID NO: 1878121 - RNA, 14 nt, Salmonella typhimurium LT2
aacaccaacaaagu

SEQ ID NO: 1878122 - RNA, 11 nt, Salmonella typhimurium LT2
aacaccuccag

SEQ ID NO: 1878123 - RNA, 18 nt, Salmonella typhimurium LT2
aacacgaccagcgacagu

SEQ ID NO: 1878124 - RNA, 15 nt, Salmonella typhimurium LT2
aacacgucgauuuuc

SEQ ID NO: 1878125 - RNA, 20 nt, Salmonella typhimurium LT2
aacacguaauucauuacgaa

SEQ ID NO: 1878126 - RNA, 15 nt, Salmonella typhimurium LT2
aacacggcaugaagc

SEQ ID NO: 1878127 - RNA, 16 nt, Salmonella typhimurium LT2
aacacggcaugaagca

SEQ ID NO: 1878128 - RNA, 19 nt, Salmonella typhimurium LT2
aacacggcaugaagcagca

SEQ ID NO: 1878129 - RNA, 22 nt, Salmonella typhimurium LT2
aacacgauggcaaauaauacca

SEQ ID NO: 1878130 - RNA, 16 nt, Salmonella typhimurium LT2
aacacgccgcgcugga

SEQ ID NO: 1878131 - RNA, 13 nt, Salmonella typhimurium LT2
aacacucuccacc

SEQ ID NO: 1878132 - RNA, 14 nt, Salmonella typhimurium LT2
aacacucuccacca

SEQ ID NO: 1878133 - RNA, 15 nt, Salmonella typhimurium LT2
aacacuaaccagcgc

SEQ ID NO: 1878134 - RNA, 13 nt, Salmonella typhimurium LT2
aacagauaaaugu

SEQ ID NO: 1878135 - RNA, 22 nt, Salmonella typhimurium LT2
aacagagcgccggcaaagccau

SEQ ID NO: 1878136 - RNA, 21 nt, Salmonella typhimurium LT2
aacagaaaaaaugcaccgccu

SEQ ID NO: 1878137 - RNA, 17 nt, Salmonella typhimurium LT2
aacagaauuaccugggu

SEQ ID NO: 1878138 - RNA, 17 nt, Salmonella typhimurium LT2
aacagacaauaccaggg

SEQ ID NO: 1878139 - RNA, 23 nt, Salmonella typhimurium LT2
aacagccaaucauaaacgccuga

SEQ ID NO: 1878140 - RNA, 12 nt, Salmonella typhimurium LT2
aacagccaggcu

SEQ ID NO: 1878141 - RNA, 14 nt, Salmonella typhimurium LT2
aacagccagaagcc

SEQ ID NO: 1878142 - RNA, 13 nt, Salmonella typhimurium LT2
aacagccagaagc

SEQ ID NO: 1878143 - RNA, 18 nt, Salmonella typhimurium LT2
aacagcauaauaaagcag

SEQ ID NO: 1878144 - RNA, 19 nt, Salmonella typhimurium LT2
aacagcaggcaucgguucu

SEQ ID NO: 1878145 - RNA, 15 nt, Salmonella typhimurium LT2
aacagcaccagcagg

SEQ ID NO: 1878146 - RNA, 12 nt, Salmonella typhimurium LT2
aacagcaccagc

SEQ ID NO: 1878147 - RNA, 20 nt, Salmonella typhimurium LT2
aacagcaaaucgggaaaaug

SEQ ID NO: 1878148 - RNA, 22 nt, Salmonella typhimurium LT2
aauguauucucccgucagcaac

SEQ ID NO: 1878149 - RNA, 20 nt, Salmonella typhimurium LT2
aauguaauucaccaaauccu

SEQ ID NO: 1878150 - RNA, 12 nt, Salmonella typhimurium LT2
aaugguuuugcc

SEQ ID NO: 1878151 - RNA, 13 nt, Salmonella typhimurium LT2
aaugguuauuaau

SEQ ID NO: 1878152 - RNA, 19 nt, Salmonella typhimurium LT2
aauggcgcgaaaacagcug

SEQ ID NO: 1878153 - RNA, 14 nt, Salmonella typhimurium LT2
aauggcgcgaaaac

SEQ ID NO: 1878154 - RNA, 12 nt, Salmonella typhimurium LT2
aauggccgcccc

SEQ ID NO: 1878155 - RNA, 19 nt, Salmonella typhimurium LT2
aauggccccuggcugaaag

SEQ ID NO: 1878156 - RNA, 20 nt, Salmonella typhimurium LT2
aauggauagagucgauaaau

SEQ ID NO: 1878157 - RNA, 21 nt, Salmonella typhimurium LT2
aaugcgcaaaauucacaccaa

SEQ ID NO: 1878158 - RNA, 22 nt, Salmonella typhimurium LT2
aaugcgcgcggcugccggacug

SEQ ID NO: 1878159 - RNA, 22 nt, Salmonella typhimurium LT2
aaugcgcuccagcuucaucauc

SEQ ID NO: 1878160 - RNA, 19 nt, Salmonella typhimurium LT2
aaugcgcuuuuuuugcccu

SEQ ID NO: 1878161 - RNA, 17 nt, Salmonella typhimurium LT2
aaugcgcuuuuuuugcc

SEQ ID NO: 1878162 - RNA, 14 nt, Salmonella typhimurium LT2
aaugcuuuaaaugc

SEQ ID NO: 1878163 - RNA, 13 nt, Salmonella typhimurium LT2
aaugcuuuaaaug

SEQ ID NO: 1878164 - RNA, 15 nt, Salmonella typhimurium LT2
aaugcuuucaauacu

SEQ ID NO: 1878165 - RNA, 21 nt, Salmonella typhimurium LT2
aaugcagcggaauucccacau

SEQ ID NO: 1878166 - RNA, 19 nt, Salmonella typhimurium LT2
aaugccauaauuuauccuc

SEQ ID NO: 1878167 - RNA, 19 nt, Salmonella typhimurium LT2
aaugccauuuuugcaucau

SEQ ID NO: 1878168 - RNA, 19 nt, Salmonella typhimurium LT2
aaugcgcaaucccggagag

SEQ ID NO: 1878169 - RNA, 16 nt, Salmonella typhimurium LT2
aaugcgacagcggcaa

SEQ ID NO: 1878170 - RNA, 13 nt, Salmonella typhimurium LT2
aaugcgaaaaacg

SEQ ID NO: 1878171 - RNA, 19 nt, Salmonella typhimurium LT2
aaugcccaccgauuucagc

SEQ ID NO: 1878172 - RNA, 16 nt, Salmonella typhimurium LT2
aaugccuguuuauauu

SEQ ID NO: 1878173 - RNA, 24 nt, Salmonella typhimurium LT2
aaugccuuauccggccugcaggca

SEQ ID NO: 1878174 - RNA, 20 nt, Salmonella typhimurium LT2
aaugauuuuuauaaaauuua

SEQ ID NO: 1878175 - RNA, 11 nt, Salmonella typhimurium LT2
aaugcacugcu

SEQ ID NO: 1878176 - RNA, 12 nt, Salmonella typhimurium LT2
aaugcaaugucu

SEQ ID NO: 1878177 - RNA, 17 nt, Salmonella typhimurium LT2
aauguuaauaagcagaa

SEQ ID NO: 1878178 - RNA, 23 nt, Salmonella typhimurium LT2
aaugugcaaucacacuacacgaa

SEQ ID NO: 1878179 - RNA, 20 nt, Salmonella typhimurium LT2
aaugugcggcguacugcaac

SEQ ID NO: 1878180 - RNA, 20 nt, Salmonella typhimurium LT2
aauguccguuuucgacaugg

SEQ ID NO: 1878181 - RNA, 13 nt, Salmonella typhimurium LT2
aauguccugaauu

SEQ ID NO: 1878182 - RNA, 14 nt, Salmonella typhimurium LT2
aauguauuucagac

SEQ ID NO: 1878183 - RNA, 23 nt, Salmonella typhimurium LT2
aauguauucucccgucagcaaca

SEQ ID NO: 1878184 - RNA, 17 nt, Salmonella typhimurium LT2
aaugucgcgucagguuu

SEQ ID NO: 1878185 - RNA, 14 nt, Salmonella typhimurium LT2
aaugucgcgucagg

SEQ ID NO: 1878186 - RNA, 22 nt, Salmonella typhimurium LT2
aaugucguuaucgccccaggcg

SEQ ID NO: 1878187 - RNA, 14 nt, Salmonella typhimurium LT2
aauuaacaaauaaa

SEQ ID NO: 1878188 - RNA, 17 nt, Salmonella typhimurium LT2
aauuaaauguuugcuuu

SEQ ID NO: 1878189 - RNA, 14 nt, Salmonella typhimurium LT2
aauuaaauuauuua

SEQ ID NO: 1878190 - RNA, 16 nt, Salmonella typhimurium LT2
aauuaaauuauuuaag

SEQ ID NO: 1878191 - RNA, 22 nt, Salmonella typhimurium LT2
aauuaaaauucauuauaaaaca

SEQ ID NO: 1878192 - RNA, 18 nt, Salmonella typhimurium LT2
aauuaaauaacaaaugaa

SEQ ID NO: 1878193 - RNA, 12 nt, Salmonella typhimurium LT2
aauuaaaaagag

SEQ ID NO: 1878194 - RNA, 19 nt, Salmonella typhimurium LT2
aauuaaaaagagaaaaaau

SEQ ID NO: 1878195 - RNA, 12 nt, Salmonella typhimurium LT2
aauguuugcuuu

SEQ ID NO: 1878196 - RNA, 15 nt, Salmonella typhimurium LT2
aauguuguuccagag

SEQ ID NO: 1878197 - RNA, 21 nt, Salmonella typhimurium LT2
aauucucccaaauuuuuuuag

SEQ ID NO: 1878198 - RNA, 18 nt, Salmonella typhimurium LT2
aauucucccugccaggcc

SEQ ID NO: 1878199 - RNA, 15 nt, Salmonella typhimurium LT2
aauucuaugccaagc

SEQ ID NO: 1878200 - RNA, 21 nt, Salmonella typhimurium LT2
aauucgaaauaaagaaaguag

SEQ ID NO: 1878201 - RNA, 13 nt, Salmonella typhimurium LT2
aauucaugugaaa

SEQ ID NO: 1878202 - RNA, 17 nt, Salmonella typhimurium LT2
aauucaugugaaaguga

SEQ ID NO: 1878203 - RNA, 17 nt, Salmonella typhimurium LT2
aauucauuauaaaacau

SEQ ID NO: 1878204 - RNA, 18 nt, Salmonella typhimurium LT2
aauucauuauaaaacaua

SEQ ID NO: 1878205 - RNA, 14 nt, Salmonella typhimurium LT2
aauucauugagcau

SEQ ID NO: 1878206 - RNA, 22 nt, Salmonella typhimurium LT2
aauuccaggcccggugucagac

SEQ ID NO: 1878207 - RNA, 19 nt, Salmonella typhimurium LT2
aauuccauuagcauucccu

SEQ ID NO: 1878208 - RNA, 21 nt, Salmonella typhimurium LT2
aauuauauucguccuuuauca

SEQ ID NO: 1878209 - RNA, 22 nt, Salmonella typhimurium LT2
aauuaucuguugauaaaacacu

SEQ ID NO: 1878210 - RNA, 23 nt, Salmonella typhimurium LT2
aauuaucuguugauaaaacacuc

SEQ ID NO: 1878211 - RNA, 18 nt, Salmonella typhimurium LT2
aauuauaaacuacuggcu

SEQ ID NO: 1878212 - RNA, 21 nt, Salmonella typhimurium LT2
aauuaacgacaaaaauaccac

SEQ ID NO: 1878213 - RNA, 13 nt, Salmonella typhimurium LT2
aauuaacugcacu

SEQ ID NO: 1878214 - RNA, 12 nt, Salmonella typhimurium LT2
aauucagacuca

SEQ ID NO: 1878215 - RNA, 21 nt, Salmonella typhimurium LT2
aauuauuccauuuuaaccuua

SEQ ID NO: 1878216 - RNA, 19 nt, Salmonella typhimurium LT2
aauucaccaaauccucacu

SEQ ID NO: 1878217 - RNA, 22 nt, Salmonella typhimurium LT2
aauuauuggcuuuguaaauacu

SEQ ID NO: 1878218 - RNA, 18 nt, Salmonella typhimurium LT2
aauuguaggcaggaauuc

SEQ ID NO: 1878219 - RNA, 17 nt, Salmonella typhimurium LT2
aauuguaauaauuuaaa

SEQ ID NO: 1878220 - RNA, 17 nt, Salmonella typhimurium LT2
aauuguuccuguaaagc

SEQ ID NO: 1878221 - RNA, 16 nt, Salmonella typhimurium LT2
aauuguuucuucuuuu

SEQ ID NO: 1878222 - RNA, 19 nt, Salmonella typhimurium LT2
aauuuaauauaugaaccaa

SEQ ID NO: 1878223 - RNA, 20 nt, Salmonella typhimurium LT2
aauuuaauaauaaauuuuca

SEQ ID NO: 1878224 - RNA, 22 nt, Salmonella typhimurium LT2
aauuuaagccagacgcgcagca

SEQ ID NO: 1878225 - RNA, 17 nt, Salmonella typhimurium LT2
aauuuaaaccgcccauu

SEQ ID NO: 1878226 - RNA, 11 nt, Salmonella typhimurium LT2
aauuuacaucu

SEQ ID NO: 1878227 - RNA, 13 nt, Salmonella typhimurium LT2
aauugccgcccgu

SEQ ID NO: 1878228 - RNA, 20 nt, Salmonella typhimurium LT2
aauugccugacgaaaacccg

SEQ ID NO: 1878229 - RNA, 23 nt, Salmonella typhimurium LT2
aauugcugcccgccgccagccug

SEQ ID NO: 1878230 - RNA, 21 nt, Salmonella typhimurium LT2
aauugguagacgcgcuagcuu

SEQ ID NO: 1878231 - RNA, 13 nt, Salmonella typhimurium LT2
aauuggcccuuca

SEQ ID NO: 1878232 - RNA, 21 nt, Salmonella typhimurium LT2
aauucuggcgcagcuucugau

SEQ ID NO: 1878233 - RNA, 18 nt, Salmonella typhimurium LT2
aauugaagaguuugauca

SEQ ID NO: 1878234 - RNA, 21 nt, Salmonella typhimurium LT2
aaucaaaaggcaaugccuuuu

SEQ ID NO: 1878235 - RNA, 22 nt, Salmonella typhimurium LT2
aaucaacacgucgauuuucccu

SEQ ID NO: 1878236 - RNA, 18 nt, Salmonella typhimurium LT2
aaucaaauccaacucagu

SEQ ID NO: 1878237 - RNA, 16 nt, Salmonella typhimurium LT2
aaucaacgcauuauau

SEQ ID NO: 1878238 - RNA, 22 nt, Salmonella typhimurium LT2
aaucaacgccacaccgagacag

SEQ ID NO: 1878239 - RNA, 17 nt, Salmonella typhimurium LT2
aaucaagcccagcucag

SEQ ID NO: 1878240 - RNA, 23 nt, Salmonella typhimurium LT2
aaucaagcuuugcguaaaaaaac

SEQ ID NO: 1878241 - RNA, 20 nt, Salmonella typhimurium LT2
aaucaacugcgccacaucau

SEQ ID NO: 1878242 - RNA, 23 nt, Salmonella typhimurium LT2
aaucaacuuuuuuaccauugauu

SEQ ID NO: 1878243 - RNA, 18 nt, Salmonella typhimurium LT2
aaucaauuuuaauuuaau

SEQ ID NO: 1878244 - RNA, 22 nt, Salmonella typhimurium LT2
aaucaauuuuaauuuaauaaua

SEQ ID NO: 1878245 - RNA, 22 nt, Salmonella typhimurium LT2
aaucaaugcgacgcccaaccag

SEQ ID NO: 1878246 - RNA, 12 nt, Salmonella typhimurium LT2
aaucaccgccag

SEQ ID NO: 1878247 - RNA, 15 nt, Salmonella typhimurium LT2
aaucaccgccagcaa

SEQ ID NO: 1878248 - RNA, 17 nt, Salmonella typhimurium LT2
aaucaccgacagcaccg

SEQ ID NO: 1878249 - RNA, 20 nt, Salmonella typhimurium LT2
aaucaccacguaacucggca

SEQ ID NO: 1878250 - RNA, 12 nt, Salmonella typhimurium LT2
aaucacaucgcc

SEQ ID NO: 1878251 - RNA, 17 nt, Salmonella typhimurium LT2
aaucacaacguaaugau

SEQ ID NO: 1878252 - RNA, 16 nt, Salmonella typhimurium LT2
aaucacauacagcacu

SEQ ID NO: 1878253 - RNA, 19 nt, Salmonella typhimurium LT2
aaucagaagcgucauaagu

SEQ ID NO: 1878254 - RNA, 15 nt, Salmonella typhimurium LT2
aaucacuuauguaca

SEQ ID NO: 1878255 - RNA, 16 nt, Salmonella typhimurium LT2
aaucacuuaucaaacc

SEQ ID NO: 1878256 - RNA, 22 nt, Salmonella typhimurium LT2
aaucacuucauccggauaaagc

SEQ ID NO: 1878257 - RNA, 18 nt, Salmonella typhimurium LT2
aaucacuaacuagccaua

SEQ ID NO: 1878258 - RNA, 15 nt, Salmonella typhimurium LT2
aaucacgucauuaaa

SEQ ID NO: 1878259 - RNA, 14 nt, Salmonella typhimurium LT2
aaucacgcaucacu

SEQ ID NO: 1878260 - RNA, 18 nt, Salmonella typhimurium LT2
aaucacgcaucacuuuug

SEQ ID NO: 1878261 - RNA, 18 nt, Salmonella typhimurium LT2
aaucacgccagucaccag

SEQ ID NO: 1878262 - RNA, 13 nt, Salmonella typhimurium LT2
aauagccagcccc

SEQ ID NO: 1878263 - RNA, 12 nt, Salmonella typhimurium LT2
aauagccagaca

SEQ ID NO: 1878264 - RNA, 15 nt, Salmonella typhimurium LT2
aauagcaggcaaaaa

SEQ ID NO: 1878265 - RNA, 16 nt, Salmonella typhimurium LT2
aauagaggaaauaaca

SEQ ID NO: 1878266 - RNA, 20 nt, Salmonella typhimurium LT2
aauaugcucaacuuccagaa

SEQ ID NO: 1878267 - RNA, 18 nt, Salmonella typhimurium LT2
aauaugcaauuaauauau

SEQ ID NO: 1878268 - RNA, 19 nt, Salmonella typhimurium LT2
aauaugcaauuaauauauu

SEQ ID NO: 1878269 - RNA, 23 nt, Salmonella typhimurium LT2
aauaugauauguguaucuugcuu

SEQ ID NO: 1878270 - RNA, 20 nt, Salmonella typhimurium LT2
aauauuagcgguacucuuuu

SEQ ID NO: 1878271 - RNA, 13 nt, Salmonella typhimurium LT2
aauauggaauauc

SEQ ID NO: 1878272 - RNA, 14 nt, Salmonella typhimurium LT2
aauaugcuggcuua

SEQ ID NO: 1878273 - RNA, 15 nt, Salmonella typhimurium LT2
aauaugguuauccag

SEQ ID NO: 1878274 - RNA, 23 nt, Salmonella typhimurium LT2
aauauguccguuugcugcaccaa

SEQ ID NO: 1878275 - RNA, 16 nt, Salmonella typhimurium LT2
aauauguucuggcggu

SEQ ID NO: 1878276 - RNA, 14 nt, Salmonella typhimurium LT2
aauauuaaaaccau

SEQ ID NO: 1878277 - RNA, 15 nt, Salmonella typhimurium LT2
aauauuaaaaccauu

SEQ ID NO: 1878278 - RNA, 16 nt, Salmonella typhimurium LT2
aauauuaaaaccauug

SEQ ID NO: 1878279 - RNA, 19 nt, Salmonella typhimurium LT2
aauauuauucuguuuuuuc

SEQ ID NO: 1878280 - RNA, 18 nt, Salmonella typhimurium LT2
aauauucaauuucccuuu

SEQ ID NO: 1878281 - RNA, 15 nt, Salmonella typhimurium LT2
aauauugagaauaaa

SEQ ID NO: 1878282 - RNA, 14 nt, Salmonella typhimurium LT2
aauauucauuucca

SEQ ID NO: 1878283 - RNA, 18 nt, Salmonella typhimurium LT2
aauauuguuuaacguuuc

SEQ ID NO: 1878284 - RNA, 14 nt, Salmonella typhimurium LT2
aauauuuaacuuaa

SEQ ID NO: 1878285 - RNA, 23 nt, Salmonella typhimurium LT2
aauauuucuuuaugggcauuuca

SEQ ID NO: 1878286 - RNA, 12 nt, Salmonella typhimurium LT2
aauauuuuguag

SEQ ID NO: 1878287 - RNA, 18 nt, Salmonella typhimurium LT2
aaucuucggcaaaauacu

SEQ ID NO: 1878288 - RNA, 16 nt, Salmonella typhimurium LT2
aaucugacgaucaacc

SEQ ID NO: 1878289 - RNA, 19 nt, Salmonella typhimurium LT2
aaucugccaucagcaccuu

SEQ ID NO: 1878290 - RNA, 21 nt, Salmonella typhimurium LT2
aaucugcauguaguaagccau

SEQ ID NO: 1878291 - RNA, 21 nt, Salmonella typhimurium LT2
aaucuggucggugauauauuc

SEQ ID NO: 1878292 - RNA, 14 nt, Salmonella typhimurium LT2
aaucugguguaaau

SEQ ID NO: 1878293 - RNA, 20 nt, Salmonella typhimurium LT2
aaucgucgccaacaccgauc

SEQ ID NO: 1878294 - RNA, 18 nt, Salmonella typhimurium LT2
aaucgucgaggaagcugc

SEQ ID NO: 1878295 - RNA, 13 nt, Salmonella typhimurium LT2
aaucgucccuuuu

SEQ ID NO: 1878296 - RNA, 17 nt, Salmonella typhimurium LT2
aaucgucccuuuucccc

SEQ ID NO: 1878297 - RNA, 14 nt, Salmonella typhimurium LT2
aaucgucacagacc

SEQ ID NO: 1878298 - RNA, 13 nt, Salmonella typhimurium LT2
aaaaauuuaagcc

SEQ ID NO: 1878299 - RNA, 22 nt, Salmonella typhimurium LT2
aaaaauuuaagccagauguaau

SEQ ID NO: 1878300 - RNA, 13 nt, Salmonella typhimurium LT2
aaaaauucuuuua

SEQ ID NO: 1878301 - RNA, 18 nt, Salmonella typhimurium LT2
aaucgcgauccagcccca

SEQ ID NO: 1878302 - RNA, 17 nt, Salmonella typhimurium LT2
aaucgcaucauaaaugg

SEQ ID NO: 1878303 - RNA, 19 nt, Salmonella typhimurium LT2
aaucgcaucauaaauggcu

SEQ ID NO: 1878304 - RNA, 13 nt, Salmonella typhimurium LT2
aaucucagauaau

SEQ ID NO: 1878305 - RNA, 17 nt, Salmonella typhimurium LT2
aaucucacugcccauuc

SEQ ID NO: 1878306 - RNA, 16 nt, Salmonella typhimurium LT2
aaucucuggccaggca

SEQ ID NO: 1878307 - RNA, 20 nt, Salmonella typhimurium LT2
aaucccuucuuuuacugccc

SEQ ID NO: 1878308 - RNA, 19 nt, Salmonella typhimurium LT2
aaucccuggcgaauaaaau

SEQ ID NO: 1878309 - RNA, 13 nt, Salmonella typhimurium LT2
aaucccuucuuuu

SEQ ID NO: 1878310 - RNA, 17 nt, Salmonella typhimurium LT2
aauccgacgcuucaaau

SEQ ID NO: 1878311 - RNA, 22 nt, Salmonella typhimurium LT2
aaucccuuucgacgucaccauc

SEQ ID NO: 1878312 - RNA, 18 nt, Salmonella typhimurium LT2
aauccgugcgcagaauau

SEQ ID NO: 1878313 - RNA, 21 nt, Salmonella typhimurium LT2
aauccggcaacugccggggaa

SEQ ID NO: 1878314 - RNA, 13 nt, Salmonella typhimurium LT2
aauccuuccuuuc

SEQ ID NO: 1878315 - RNA, 16 nt, Salmonella typhimurium LT2
aauccuucuuccauuc

SEQ ID NO: 1878316 - RNA, 15 nt, Salmonella typhimurium LT2
aauccuuauuuaaua

SEQ ID NO: 1878317 - RNA, 18 nt, Salmonella typhimurium LT2
aauccuuaaucagcuugu

SEQ ID NO: 1878318 - RNA, 12 nt, Salmonella typhimurium LT2
aaucgacucacg

SEQ ID NO: 1878319 - RNA, 16 nt, Salmonella typhimurium LT2
aaucgaguucgcuuuu

SEQ ID NO: 1878320 - RNA, 15 nt, Salmonella typhimurium LT2
aaucgagccuuucac

SEQ ID NO: 1878321 - RNA, 11 nt, Salmonella typhimurium LT2
aaucagcagcg

SEQ ID NO: 1878322 - RNA, 21 nt, Salmonella typhimurium LT2
aaucagcagccgggccagacg

SEQ ID NO: 1878323 - RNA, 22 nt, Salmonella typhimurium LT2
aaucagauacggcuccagcaca

SEQ ID NO: 1878324 - RNA, 21 nt, Salmonella typhimurium LT2
aaucagauccgcgucauuaau

SEQ ID NO: 1878325 - RNA, 19 nt, Salmonella typhimurium LT2
aaucauuuguacaaaaaau

SEQ ID NO: 1878326 - RNA, 20 nt, Salmonella typhimurium LT2
aaucauuuguacaaaaaaug

SEQ ID NO: 1878327 - RNA, 22 nt, Salmonella typhimurium LT2
aaucaugcucauaauggaccag

SEQ ID NO: 1878328 - RNA, 22 nt, Salmonella typhimurium LT2
aaucaugaacgcuaucggcaua

SEQ ID NO: 1878329 - RNA, 21 nt, Salmonella typhimurium LT2
aauccacuggucgucugaaag

SEQ ID NO: 1878330 - RNA, 12 nt, Salmonella typhimurium LT2
aauccacugucc

SEQ ID NO: 1878331 - RNA, 16 nt, Salmonella typhimurium LT2
aauccacuguccagau

SEQ ID NO: 1878332 - RNA, 20 nt, Salmonella typhimurium LT2
aauccagaggguaauuucuu

SEQ ID NO: 1878333 - RNA, 17 nt, Salmonella typhimurium LT2
aaucccaccaauugcca

SEQ ID NO: 1878334 - RNA, 15 nt, Salmonella typhimurium LT2
aauccagcagaauaa

SEQ ID NO: 1878335 - RNA, 18 nt, Salmonella typhimurium LT2
acaaucgucacuucaauu

SEQ ID NO: 1878336 - RNA, 21 nt, Salmonella typhimurium LT2
acaaucgccgugaucccaaug

SEQ ID NO: 1878337 - RNA, 17 nt, Salmonella typhimurium LT2
acaaucgcguuuuccag

SEQ ID NO: 1878338 - RNA, 16 nt, Salmonella typhimurium LT2
acaaucccggcaacug

SEQ ID NO: 1878339 - RNA, 16 nt, Salmonella typhimurium LT2
acaauccccgaaagcc

SEQ ID NO: 1878340 - RNA, 18 nt, Salmonella typhimurium LT2
acaauccguuccaaucuc

SEQ ID NO: 1878341 - RNA, 15 nt, Salmonella typhimurium LT2
acaaucagcacacua

SEQ ID NO: 1878342 - RNA, 20 nt, Salmonella typhimurium LT2
acaaucaggcugcggaugau

SEQ ID NO: 1878343 - RNA, 17 nt, Salmonella typhimurium LT2
acaaugccuucugcgcc

SEQ ID NO: 1878344 - RNA, 15 nt, Salmonella typhimurium LT2
acaauugccagcagg

SEQ ID NO: 1878345 - RNA, 15 nt, Salmonella typhimurium LT2
acaaguucagcaggc

SEQ ID NO: 1878346 - RNA, 13 nt, Salmonella typhimurium LT2
acaauaccaauaa

SEQ ID NO: 1878347 - RNA, 22 nt, Salmonella typhimurium LT2
acaauauucgccgcgauaauaa

SEQ ID NO: 1878348 - RNA, 14 nt, Salmonella typhimurium LT2
acaauauugcgcua

SEQ ID NO: 1878349 - RNA, 13 nt, Salmonella typhimurium LT2
acaagcucauuuc

SEQ ID NO: 1878350 - RNA, 13 nt, Salmonella typhimurium LT2
acaacgcauugcc

SEQ ID NO: 1878351 - RNA, 19 nt, Salmonella typhimurium LT2
acaccggaauucuguucag

SEQ ID NO: 1878352 - RNA, 17 nt, Salmonella typhimurium LT2
acaccggcgccagcucu

SEQ ID NO: 1878353 - RNA, 21 nt, Salmonella typhimurium LT2
acaccguauccggccugcagg

SEQ ID NO: 1878354 - RNA, 20 nt, Salmonella typhimurium LT2
acaccuuuuccucuucuugc

SEQ ID NO: 1878355 - RNA, 20 nt, Salmonella typhimurium LT2
acaccuguaacgucacauuc

SEQ ID NO: 1878356 - RNA, 18 nt, Salmonella typhimurium LT2
acaccuccaguucaguua

SEQ ID NO: 1878357 - RNA, 20 nt, Salmonella typhimurium LT2
acacgcugguaaucauuuca

SEQ ID NO: 1878358 - RNA, 19 nt, Salmonella typhimurium LT2
acacgcuuuucagcgccag

SEQ ID NO: 1878359 - RNA, 17 nt, Salmonella typhimurium LT2
acacgcgaauagccaga

SEQ ID NO: 1878360 - RNA, 18 nt, Salmonella typhimurium LT2
acacgcgcaguacggcgc

SEQ ID NO: 1878361 - RNA, 17 nt, Salmonella typhimurium LT2
acacgcgcgcugcgccu

SEQ ID NO: 1878362 - RNA, 14 nt, Salmonella typhimurium LT2
acacggcgcucagg

SEQ ID NO: 1878363 - RNA, 12 nt, Salmonella typhimurium LT2
acacggcggcua

SEQ ID NO: 1878364 - RNA, 17 nt, Salmonella typhimurium LT2
acacggcugucggucag

SEQ ID NO: 1878365 - RNA, 14 nt, Salmonella typhimurium LT2
acacgauggcaaau

SEQ ID NO: 1878366 - RNA, 16 nt, Salmonella typhimurium LT2
acacgcaaaaaagccc

SEQ ID NO: 1878367 - RNA, 21 nt, Salmonella typhimurium LT2
acacaaacuccguuauauuuc

SEQ ID NO: 1878368 - RNA, 22 nt, Salmonella typhimurium LT2
acacaaaagcaucguaccuuca

SEQ ID NO: 1878369 - RNA, 22 nt, Salmonella typhimurium LT2
acacaaaaaacgguauaaaaaa

SEQ ID NO: 1878370 - RNA, 20 nt, Salmonella typhimurium LT2
acaauuuugauaagagaaaa

SEQ ID NO: 1878371 - RNA, 18 nt, Salmonella typhimurium LT2
acaauuuugauaagagaa

SEQ ID NO: 1878372 - RNA, 21 nt, Salmonella typhimurium LT2
acaauuuugauaagagaaaau

SEQ ID NO: 1878373 - RNA, 17 nt, Salmonella typhimurium LT2
acacauucaggcuggca

SEQ ID NO: 1878374 - RNA, 21 nt, Salmonella typhimurium LT2
acacauucaggcuggcaaagc

SEQ ID NO: 1878375 - RNA, 13 nt, Salmonella typhimurium LT2
acaccaacaaagu

SEQ ID NO: 1878376 - RNA, 15 nt, Salmonella typhimurium LT2
acacauuuuaaacca

SEQ ID NO: 1878377 - RNA, 13 nt, Salmonella typhimurium LT2
acacauuuccaac

SEQ ID NO: 1878378 - RNA, 15 nt, Salmonella typhimurium LT2
acacccgcagccgca

SEQ ID NO: 1878379 - RNA, 22 nt, Salmonella typhimurium LT2
acaccccgcgccgcugagaaaa

SEQ ID NO: 1878380 - RNA, 21 nt, Salmonella typhimurium LT2
acaccccgcgccgcugagaaa

SEQ ID NO: 1878381 - RNA, 13 nt, Salmonella typhimurium LT2
acacccagccccc

SEQ ID NO: 1878382 - RNA, 15 nt, Salmonella typhimurium LT2
acacccagccccccu

SEQ ID NO: 1878383 - RNA, 18 nt, Salmonella typhimurium LT2
acaccaacggcgacgccc

SEQ ID NO: 1878384 - RNA, 18 nt, Salmonella typhimurium LT2
acaccaaugucauauuug

SEQ ID NO: 1878385 - RNA, 23 nt, Salmonella typhimurium LT2
acaccaaugucauauuugugagc

SEQ ID NO: 1878386 - RNA, 12 nt, Salmonella typhimurium LT2
acaccacgcagg

SEQ ID NO: 1878387 - RNA, 19 nt, Salmonella typhimurium LT2
acaccacgaaggaaacgcc

SEQ ID NO: 1878388 - RNA, 21 nt, Salmonella typhimurium LT2
acaaaaccgcuaaugaggaaa

SEQ ID NO: 1878389 - RNA, 13 nt, Salmonella typhimurium LT2
acaaaaaucugaa

SEQ ID NO: 1878390 - RNA, 16 nt, Salmonella typhimurium LT2
acaaaaagugaaaaaa

SEQ ID NO: 1878391 - RNA, 16 nt, Salmonella typhimurium LT2
acaaaaaguaguucca

SEQ ID NO: 1878392 - RNA, 15 nt, Salmonella typhimurium LT2
aauuuauaacguauc

SEQ ID NO: 1878393 - RNA, 19 nt, Salmonella typhimurium LT2
acaaaauaaagugaaauaa

SEQ ID NO: 1878394 - RNA, 17 nt, Salmonella typhimurium LT2
acaaaagcgguuaagau

SEQ ID NO: 1878395 - RNA, 23 nt, Salmonella typhimurium LT2
acaaaaggcuggaacagauguuu

SEQ ID NO: 1878396 - RNA, 12 nt, Salmonella typhimurium LT2
acaaaauauuac

SEQ ID NO: 1878397 - RNA, 14 nt, Salmonella typhimurium LT2
acaaaaucauugcg

SEQ ID NO: 1878398 - RNA, 15 nt, Salmonella typhimurium LT2
acaaaccgauaauca

SEQ ID NO: 1878399 - RNA, 16 nt, Salmonella typhimurium LT2
acaaacgcuucuauuu

SEQ ID NO: 1878400 - RNA, 17 nt, Salmonella typhimurium LT2
acaaacgcuucuauuuc

SEQ ID NO: 1878401 - RNA, 16 nt, Salmonella typhimurium LT2
acaaacgcaccgccaa

SEQ ID NO: 1878402 - RNA, 15 nt, Salmonella typhimurium LT2
acaaacaaauaaauc

SEQ ID NO: 1878403 - RNA, 19 nt, Salmonella typhimurium LT2
acaaacauaagcaaauccu

SEQ ID NO: 1878404 - RNA, 11 nt, Salmonella typhimurium LT2
acaaagagcuc

SEQ ID NO: 1878405 - RNA, 15 nt, Salmonella typhimurium LT2
acaaagagcucccca

SEQ ID NO: 1878406 - RNA, 20 nt, Salmonella typhimurium LT2
acaaagagugccagaaacau

SEQ ID NO: 1878407 - RNA, 16 nt, Salmonella typhimurium LT2
acaaacuucaucgcca

SEQ ID NO: 1878408 - RNA, 17 nt, Salmonella typhimurium LT2
acaaacuuaauuauuaa

SEQ ID NO: 1878409 - RNA, 19 nt, Salmonella typhimurium LT2
acaaagcgguaaaucgcaa

SEQ ID NO: 1878410 - RNA, 22 nt, Salmonella typhimurium LT2
acaaagccugcuggaaaggccg

SEQ ID NO: 1878411 - RNA, 19 nt, Salmonella typhimurium LT2
acaaaggcaaaauggguuc

SEQ ID NO: 1878412 - RNA, 14 nt, Salmonella typhimurium LT2
acaaagcucaccug

SEQ ID NO: 1878413 - RNA, 20 nt, Salmonella typhimurium LT2
acaaagcucaccugcucgcc

SEQ ID NO: 1878414 - RNA, 19 nt, Salmonella typhimurium LT2
acaaauccaaucugacaca

SEQ ID NO: 1878415 - RNA, 13 nt, Salmonella typhimurium LT2
acaaaucaucagc

SEQ ID NO: 1878416 - RNA, 15 nt, Salmonella typhimurium LT2
acaaaucaucagcau

SEQ ID NO: 1878417 - RNA, 18 nt, Salmonella typhimurium LT2
acaaaugacgucagcaag

SEQ ID NO: 1878418 - RNA, 19 nt, Salmonella typhimurium LT2
acaaauguugauaagguga

SEQ ID NO: 1878419 - RNA, 15 nt, Salmonella typhimurium LT2
acaaauucugaagag

SEQ ID NO: 1878420 - RNA, 19 nt, Salmonella typhimurium LT2
acaaauuacacaauaucaa

SEQ ID NO: 1878421 - RNA, 14 nt, Salmonella typhimurium LT2
acaaauaaauccau

SEQ ID NO: 1878422 - RNA, 20 nt, Salmonella typhimurium LT2
acaaagguugcgccaaagca

SEQ ID NO: 1878423 - RNA, 14 nt, Salmonella typhimurium LT2
acaaagguaaacgc

SEQ ID NO: 1878424 - RNA, 23 nt, Salmonella typhimurium LT2
acaaagguugcgccaaagcaauc

SEQ ID NO: 1878425 - RNA, 17 nt, Salmonella typhimurium LT2
acaaagguuuguuuaau

SEQ ID NO: 1878426 - RNA, 13 nt, Salmonella typhimurium LT2
acaacaagaauau

SEQ ID NO: 1878427 - RNA, 18 nt, Salmonella typhimurium LT2
acaacaagaauauauucu

SEQ ID NO: 1878428 - RNA, 15 nt, Salmonella typhimurium LT2
acaacacgcuuuuca

SEQ ID NO: 1878429 - RNA, 15 nt, Salmonella typhimurium LT2
acaacauaaaggggu

SEQ ID NO: 1878430 - RNA, 13 nt, Salmonella typhimurium LT2
acaacaaaaagau

SEQ ID NO: 1878431 - RNA, 17 nt, Salmonella typhimurium LT2
acaaauuuugauaaaaa

SEQ ID NO: 1878432 - RNA, 20 nt, Salmonella typhimurium LT2
acaaauuguuuaaaaacagg

SEQ ID NO: 1878433 - RNA, 22 nt, Salmonella typhimurium LT2
acaacauuucgcacccugucaa

SEQ ID NO: 1878434 - RNA, 14 nt, Salmonella typhimurium LT2
acaaccagcagggc

SEQ ID NO: 1878435 - RNA, 15 nt, Salmonella typhimurium LT2
acaaccuccacgccc

SEQ ID NO: 1878436 - RNA, 19 nt, Salmonella typhimurium LT2
acaaccuccacgcccagcg

SEQ ID NO: 1878437 - RNA, 19 nt, Salmonella typhimurium LT2
acaaccguuggggaaaaua

SEQ ID NO: 1878438 - RNA, 20 nt, Salmonella typhimurium LT2
acaaccgcccccaacugagc

SEQ ID NO: 1878439 - RNA, 18 nt, Salmonella typhimurium LT2
accaacaagaagggaggu

SEQ ID NO: 1878440 - RNA, 12 nt, Salmonella typhimurium LT2
accaaagcccgc

SEQ ID NO: 1878441 - RNA, 19 nt, Salmonella typhimurium LT2
accaaagcccgcaaacaga

SEQ ID NO: 1878442 - RNA, 15 nt, Salmonella typhimurium LT2
accaaaucaauagaa

SEQ ID NO: 1878443 - RNA, 16 nt, Salmonella typhimurium LT2
accaaaucucaagagu

SEQ ID NO: 1878444 - RNA, 18 nt, Salmonella typhimurium LT2
accaaaucucaagaguga

SEQ ID NO: 1878445 - RNA, 21 nt, Salmonella typhimurium LT2
accaaaucucaagagugaaca

SEQ ID NO: 1878446 - RNA, 14 nt, Salmonella typhimurium LT2
accaaacacgaggc

SEQ ID NO: 1878447 - RNA, 18 nt, Salmonella typhimurium LT2
accaaacacgaggcugcc

SEQ ID NO: 1878448 - RNA, 11 nt, Salmonella typhimurium LT2
accaaagcaaa

SEQ ID NO: 1878449 - RNA, 21 nt, Salmonella typhimurium LT2
acauuuuuuuugcaugauagu

SEQ ID NO: 1878450 - RNA, 13 nt, Salmonella typhimurium LT2
acauuuuuguaau

SEQ ID NO: 1878451 - RNA, 15 nt, Salmonella typhimurium LT2
acauugaccagugca

SEQ ID NO: 1878452 - RNA, 21 nt, Salmonella typhimurium LT2
acauugaagguauccagccag

SEQ ID NO: 1878453 - RNA, 22 nt, Salmonella typhimurium LT2
acauugaagguauccagccagg

SEQ ID NO: 1878454 - RNA, 13 nt, Salmonella typhimurium LT2
acauuuucccaac

SEQ ID NO: 1878455 - RNA, 12 nt, Salmonella typhimurium LT2
acauuucuuuug

SEQ ID NO: 1878456 - RNA, 23 nt, Salmonella typhimurium LT2
acauuugauuccagccuugcuga

SEQ ID NO: 1878457 - RNA, 21 nt, Salmonella typhimurium LT2
acaugacacacggauuuuacu

SEQ ID NO: 1878458 - RNA, 14 nt, Salmonella typhimurium LT2
acaucuaccagguu

SEQ ID NO: 1878459 - RNA, 18 nt, Salmonella typhimurium LT2
acaucuaccgcauacuga

SEQ ID NO: 1878460 - RNA, 15 nt, Salmonella typhimurium LT2
acaucguaaaucaaa

SEQ ID NO: 1878461 - RNA, 22 nt, Salmonella typhimurium LT2
acaucguaaaucaaaugagaau

SEQ ID NO: 1878462 - RNA, 12 nt, Salmonella typhimurium LT2
acaucguaaauc

SEQ ID NO: 1878463 - RNA, 16 nt, Salmonella typhimurium LT2
acaugaccgcacagca

SEQ ID NO: 1878464 - RNA, 19 nt, Salmonella typhimurium LT2
acaugaccgcacagcagac

SEQ ID NO: 1878465 - RNA, 15 nt, Salmonella typhimurium LT2
acaugagauaaugcu

SEQ ID NO: 1878466 - RNA, 20 nt, Salmonella typhimurium LT2
acaugccggugcgagaaaaa

SEQ ID NO: 1878467 - RNA, 21 nt, Salmonella typhimurium LT2
acaugccggugcgagaaaaag

SEQ ID NO: 1878468 - RNA, 22 nt, Salmonella typhimurium LT2
acaugccggugcgagaaaaagc

SEQ ID NO: 1878469 - RNA, 21 nt, Salmonella typhimurium LT2
acauaacgcgauagauaccau

SEQ ID NO: 1878470 - RNA, 18 nt, Salmonella typhimurium LT2
acauaaggguaagcaaua

SEQ ID NO: 1878471 - RNA, 13 nt, Salmonella typhimurium LT2
acauaauaaagcc

SEQ ID NO: 1878472 - RNA, 16 nt, Salmonella typhimurium LT2
acaucaucuuuaucca

SEQ ID NO: 1878473 - RNA, 14 nt, Salmonella typhimurium LT2
acaucgcuuuccag

SEQ ID NO: 1878474 - RNA, 14 nt, Salmonella typhimurium LT2
acaucggcaggaac

SEQ ID NO: 1878475 - RNA, 18 nt, Salmonella typhimurium LT2
acaucggcguguuucauu

SEQ ID NO: 1878476 - RNA, 20 nt, Salmonella typhimurium LT2
acaucggagauuucauccuc

SEQ ID NO: 1878477 - RNA, 21 nt, Salmonella typhimurium LT2
acaucggagauuucauccucu

SEQ ID NO: 1878478 - RNA, 13 nt, Salmonella typhimurium LT2
acaucgcuuucca

SEQ ID NO: 1878479 - RNA, 24 nt, Salmonella typhimurium LT2
acaucgcuuaaugucacaaugccu

SEQ ID NO: 1878480 - RNA, 16 nt, Salmonella typhimurium LT2
acaucgcucaaaacac

SEQ ID NO: 1878481 - RNA, 17 nt, Salmonella typhimurium LT2
acaucgcucaaaacacu

SEQ ID NO: 1878482 - RNA, 17 nt, Salmonella typhimurium LT2
acaucgccggagccgcc

SEQ ID NO: 1878483 - RNA, 20 nt, Salmonella typhimurium LT2
acauccugugaaguaaaaaa

SEQ ID NO: 1878484 - RNA, 21 nt, Salmonella typhimurium LT2
acaucaugaugaucuucagcc

SEQ ID NO: 1878485 - RNA, 20 nt, Salmonella typhimurium LT2
acauccggcaggcauuuuac

SEQ ID NO: 1878486 - RNA, 20 nt, Salmonella typhimurium LT2
acauccgccaccuuaugcuc

SEQ ID NO: 1878487 - RNA, 21 nt, Salmonella typhimurium LT2
acauccgauuucauggucauc

SEQ ID NO: 1878488 - RNA, 20 nt, Salmonella typhimurium LT2
acagguugcguaacgccaca

SEQ ID NO: 1878489 - RNA, 12 nt, Salmonella typhimurium LT2
acaggugcaggg

SEQ ID NO: 1878490 - RNA, 15 nt, Salmonella typhimurium LT2
acagguuaaccaugc

SEQ ID NO: 1878491 - RNA, 19 nt, Salmonella typhimurium LT2
acaggucgaugauuuucaa

SEQ ID NO: 1878492 - RNA, 16 nt, Salmonella typhimurium LT2
acagguagcugcacaa

SEQ ID NO: 1878493 - RNA, 22 nt, Salmonella typhimurium LT2
acagguaaaacaaaaaaacggc

SEQ ID NO: 1878494 - RNA, 13 nt, Salmonella typhimurium LT2
acagguaaaacaa

SEQ ID NO: 1878495 - RNA, 23 nt, Salmonella typhimurium LT2
acaggguuugccagcaccagcag

SEQ ID NO: 1878496 - RNA, 15 nt, Salmonella typhimurium LT2
acagggcggccuccu

SEQ ID NO: 1878497 - RNA, 18 nt, Salmonella typhimurium LT2
acagggcggcgcgcugcc

SEQ ID NO: 1878498 - RNA, 19 nt, Salmonella typhimurium LT2
acagggcggcgcgcugccg

SEQ ID NO: 1878499 - RNA, 14 nt, Salmonella typhimurium LT2
acagggcuucuuua

SEQ ID NO: 1878500 - RNA, 22 nt, Salmonella typhimurium LT2
acagguugcguaacgccacaua

SEQ ID NO: 1878501 - RNA, 14 nt, Salmonella typhimurium LT2
acaguaaaacccaa

SEQ ID NO: 1878502 - RNA, 18 nt, Salmonella typhimurium LT2
acaguagcggcgaggcag

SEQ ID NO: 1878503 - RNA, 18 nt, Salmonella typhimurium LT2
acaguacgaucaugaauc

SEQ ID NO: 1878504 - RNA, 19 nt, Salmonella typhimurium LT2
acaguauuuguucagacac

SEQ ID NO: 1878505 - RNA, 16 nt, Salmonella typhimurium LT2
acaguccaggaaagag

SEQ ID NO: 1878506 - RNA, 22 nt, Salmonella typhimurium LT2
acagucgaucccaacguugguu

SEQ ID NO: 1878507 - RNA, 14 nt, Salmonella typhimurium LT2
acagucgcagagcc

SEQ ID NO: 1878508 - RNA, 22 nt, Salmonella typhimurium LT2
acaguccgaugguuaaauugaa

SEQ ID NO: 1878509 - RNA, 20 nt, Salmonella typhimurium LT2
acauaaccugaauauggcca

SEQ ID NO: 1878510 - RNA, 15 nt, Salmonella typhimurium LT2
acauaacaucucacu

SEQ ID NO: 1878511 - RNA, 15 nt, Salmonella typhimurium LT2
acauaaauaaacagc

SEQ ID NO: 1878512 - RNA, 14 nt, Salmonella typhimurium LT2
acauaaagauaaau

SEQ ID NO: 1878513 - RNA, 18 nt, Salmonella typhimurium LT2
acauaaagcccagaauag

SEQ ID NO: 1878514 - RNA, 21 nt, Salmonella typhimurium LT2
acauaaagcccagaauaguga

SEQ ID NO: 1878515 - RNA, 13 nt, Salmonella typhimurium LT2
acaguuuaucugc

SEQ ID NO: 1878516 - RNA, 19 nt, Salmonella typhimurium LT2
acagugcgcgaccgcauca

SEQ ID NO: 1878517 - RNA, 14 nt, Salmonella typhimurium LT2
acagcgccaucagc

SEQ ID NO: 1878518 - RNA, 23 nt, Salmonella typhimurium LT2
acagcgaacaguguaaacgccag

SEQ ID NO: 1878519 - RNA, 15 nt, Salmonella typhimurium LT2
acagcgaccacgcca

SEQ ID NO: 1878520 - RNA, 16 nt, Salmonella typhimurium LT2
acaggcuuuucaggcu

SEQ ID NO: 1878521 - RNA, 23 nt, Salmonella typhimurium LT2
acaggcuucgguugccugcguca

SEQ ID NO: 1878522 - RNA, 12 nt, Salmonella typhimurium LT2
acaggcggauga

SEQ ID NO: 1878523 - RNA, 23 nt, Salmonella typhimurium LT2
acaggcguguggcauaaauaaac

SEQ ID NO: 1878524 - RNA, 13 nt, Salmonella typhimurium LT2
acaggcugacaaa

SEQ ID NO: 1878525 - RNA, 17 nt, Salmonella typhimurium LT2
acaggcuauaacgcacc

SEQ ID NO: 1878526 - RNA, 23 nt, Salmonella typhimurium LT2
acaggcgcaggcauuaaaaaaac

SEQ ID NO: 1878527 - RNA, 15 nt, Salmonella typhimurium LT2
acaggccggacaggc

SEQ ID NO: 1878528 - RNA, 17 nt, Salmonella typhimurium LT2
acaggaagcagcuugcu

SEQ ID NO: 1878529 - RNA, 16 nt, Salmonella typhimurium LT2
acaggaaacagguacu

SEQ ID NO: 1878530 - RNA, 23 nt, Salmonella typhimurium LT2
acagccgcuguuuuucaucauca

SEQ ID NO: 1878531 - RNA, 21 nt, Salmonella typhimurium LT2
acagccgcuaucacagcggca

SEQ ID NO: 1878532 - RNA, 22 nt, Salmonella typhimurium LT2
acagccaggcuuucccuucaga

SEQ ID NO: 1878533 - RNA, 14 nt, Salmonella typhimurium LT2
acagccacacugcu

SEQ ID NO: 1878534 - RNA, 22 nt, Salmonella typhimurium LT2
acagcagugacauuuaucuucc

SEQ ID NO: 1878535 - RNA, 12 nt, Salmonella typhimurium LT2
acagccaaaaau

SEQ ID NO: 1878536 - RNA, 19 nt, Salmonella typhimurium LT2
acacgguuauaaccggaca

SEQ ID NO: 1878537 - RNA, 22 nt, Salmonella typhimurium LT2
acagcagcgcggcacacagcac

SEQ ID NO: 1878538 - RNA, 14 nt, Salmonella typhimurium LT2
acagcagcgcggca

SEQ ID NO: 1878539 - RNA, 13 nt, Salmonella typhimurium LT2
acagcacauagaa

SEQ ID NO: 1878540 - RNA, 16 nt, Salmonella typhimurium LT2
acagcaacgggacggc

SEQ ID NO: 1878541 - RNA, 19 nt, Salmonella typhimurium LT2
acagcaauggacaaguaaa

SEQ ID NO: 1878542 - RNA, 15 nt, Salmonella typhimurium LT2
acagcaaugagcagg

SEQ ID NO: 1878543 - RNA, 18 nt, Salmonella typhimurium LT2
agacgaagccgaagcuaa

SEQ ID NO: 1878544 - RNA, 18 nt, Salmonella typhimurium LT2
agaccuuuuacuucacgu

SEQ ID NO: 1878545 - RNA, 23 nt, Salmonella typhimurium LT2
agacgacguugugauaauacugg

SEQ ID NO: 1878546 - RNA, 22 nt, Salmonella typhimurium LT2
agaccuccgcccggugcucaau

SEQ ID NO: 1878547 - RNA, 15 nt, Salmonella typhimurium LT2
agaccguaugccagc

SEQ ID NO: 1878548 - RNA, 15 nt, Salmonella typhimurium LT2
aaaacaucgccccgg

SEQ ID NO: 1878549 - RNA, 19 nt, Salmonella typhimurium LT2
agacgcuccgcaguaauca

SEQ ID NO: 1878550 - RNA, 18 nt, Salmonella typhimurium LT2
agacgcucgacguccagc

SEQ ID NO: 1878551 - RNA, 19 nt, Salmonella typhimurium LT2
agacgcuaucguccuggcu

SEQ ID NO: 1878552 - RNA, 16 nt, Salmonella typhimurium LT2
agacgcguaaaucaga

SEQ ID NO: 1878553 - RNA, 18 nt, Salmonella typhimurium LT2
agacgcgcuagcuucagg

SEQ ID NO: 1878554 - RNA, 16 nt, Salmonella typhimurium LT2
agacgcgcuagcuuca

SEQ ID NO: 1878555 - RNA, 17 nt, Salmonella typhimurium LT2
agacgcgcuagcuucag

SEQ ID NO: 1878556 - RNA, 20 nt, Salmonella typhimurium LT2
agacgcgcucggcagcagcg

SEQ ID NO: 1878557 - RNA, 14 nt, Salmonella typhimurium LT2
agacgcgcagcacc

SEQ ID NO: 1878558 - RNA, 15 nt, Salmonella typhimurium LT2
agaccccgcaucgcc

SEQ ID NO: 1878559 - RNA, 21 nt, Salmonella typhimurium LT2
agacccgcaauaacgccgaua

SEQ ID NO: 1878560 - RNA, 15 nt, Salmonella typhimurium LT2
agacccgacaguaaa

SEQ ID NO: 1878561 - RNA, 17 nt, Salmonella typhimurium LT2
agaccggcaucucaucu

SEQ ID NO: 1878562 - RNA, 16 nt, Salmonella typhimurium LT2
agaccggcgaaaucgu

SEQ ID NO: 1878563 - RNA, 12 nt, Salmonella typhimurium LT2
agaccggcacaa

SEQ ID NO: 1878564 - RNA, 16 nt, Salmonella typhimurium LT2
agaauuugaacucuuu

SEQ ID NO: 1878565 - RNA, 19 nt, Salmonella typhimurium LT2
agaauuucuacacagcgcg

SEQ ID NO: 1878566 - RNA, 14 nt, Salmonella typhimurium LT2
agacccagacgcgu

SEQ ID NO: 1878567 - RNA, 21 nt, Salmonella typhimurium LT2
agacccacauauugcgcuuca

SEQ ID NO: 1878568 - RNA, 19 nt, Salmonella typhimurium LT2
agacucaguucgcgaccca

SEQ ID NO: 1878569 - RNA, 12 nt, Salmonella typhimurium LT2
agacucaggcgc

SEQ ID NO: 1878570 - RNA, 22 nt, Salmonella typhimurium LT2
agacucagccaggucugaacca

SEQ ID NO: 1878571 - RNA, 21 nt, Salmonella typhimurium LT2
agacucaaagaaaacaucagc

SEQ ID NO: 1878572 - RNA, 20 nt, Salmonella typhimurium LT2
agacuauccagccagggauc

SEQ ID NO: 1878573 - RNA, 14 nt, Salmonella typhimurium LT2
agacuauccagcca

SEQ ID NO: 1878574 - RNA, 19 nt, Salmonella typhimurium LT2
agacuacgcaaaaaaagcc

SEQ ID NO: 1878575 - RNA, 12 nt, Salmonella typhimurium LT2
agacggcugggc

SEQ ID NO: 1878576 - RNA, 16 nt, Salmonella typhimurium LT2
agacuggucgcccgga

SEQ ID NO: 1878577 - RNA, 18 nt, Salmonella typhimurium LT2
agacuggcgaccgccacc

SEQ ID NO: 1878578 - RNA, 22 nt, Salmonella typhimurium LT2
agacucgcuucacgcggauugc

SEQ ID NO: 1878579 - RNA, 14 nt, Salmonella typhimurium LT2
agacucucuuuaau

SEQ ID NO: 1878580 - RNA, 15 nt, Salmonella typhimurium LT2
agacugagcaaacuc

SEQ ID NO: 1878581 - RNA, 15 nt, Salmonella typhimurium LT2
agacugauauccauc

SEQ ID NO: 1878582 - RNA, 21 nt, Salmonella typhimurium LT2
agacugaucgccgcugcuggc

SEQ ID NO: 1878583 - RNA, 18 nt, Salmonella typhimurium LT2
agagcaacauaccgcaga

SEQ ID NO: 1878584 - RNA, 23 nt, Salmonella typhimurium LT2
agagccgcgcagcgcaacgccuu

SEQ ID NO: 1878585 - RNA, 15 nt, Salmonella typhimurium LT2
agagcccucuaucca

SEQ ID NO: 1878586 - RNA, 18 nt, Salmonella typhimurium LT2
agagcgggucaacgccaa

SEQ ID NO: 1878587 - RNA, 20 nt, Salmonella typhimurium LT2
agagcgcuucuaacaaaaca

SEQ ID NO: 1878588 - RNA, 21 nt, Salmonella typhimurium LT2
agagcaaaggaucgcaaccac

SEQ ID NO: 1878589 - RNA, 14 nt, Salmonella typhimurium LT2
agagcaaaccgccg

SEQ ID NO: 1878590 - RNA, 12 nt, Salmonella typhimurium LT2
agagauagaacg

SEQ ID NO: 1878591 - RNA, 16 nt, Salmonella typhimurium LT2
agagauaauuuuccca

SEQ ID NO: 1878592 - RNA, 21 nt, Salmonella typhimurium LT2
agagauaauuuucccaguuca

SEQ ID NO: 1878593 - RNA, 15 nt, Salmonella typhimurium LT2
agagauaucccaucg

SEQ ID NO: 1878594 - RNA, 12 nt, Salmonella typhimurium LT2
agagaguuccuc

SEQ ID NO: 1878595 - RNA, 16 nt, Salmonella typhimurium LT2
agagaguugagccaga

SEQ ID NO: 1878596 - RNA, 15 nt, Salmonella typhimurium LT2
agagagaaucggguc

SEQ ID NO: 1878597 - RNA, 12 nt, Salmonella typhimurium LT2
agagaaaaaauu

SEQ ID NO: 1878598 - RNA, 23 nt, Salmonella typhimurium LT2
agagaaaaagaagaaaaaauuaa

SEQ ID NO: 1878599 - RNA, 14 nt, Salmonella typhimurium LT2
agacuuuuuugccg

SEQ ID NO: 1878600 - RNA, 21 nt, Salmonella typhimurium LT2
agagaaaaccccguacaggac

SEQ ID NO: 1878601 - RNA, 15 nt, Salmonella typhimurium LT2
agagaaacaacaccg

SEQ ID NO: 1878602 - RNA, 23 nt, Salmonella typhimurium LT2
agagaacgacgcauaaaaaauga

SEQ ID NO: 1878603 - RNA, 16 nt, Salmonella typhimurium LT2
agagaaccugaacaau

SEQ ID NO: 1878604 - RNA, 12 nt, Salmonella typhimurium LT2
agagaaccguuc

SEQ ID NO: 1878605 - RNA, 15 nt, Salmonella typhimurium LT2
agagaaccaacguca

SEQ ID NO: 1878606 - RNA, 14 nt, Salmonella typhimurium LT2
agagaagucugagc

SEQ ID NO: 1878607 - RNA, 16 nt, Salmonella typhimurium LT2
agagaauuaacagcgc

SEQ ID NO: 1878608 - RNA, 17 nt, Salmonella typhimurium LT2
agagaauggccagcaca

SEQ ID NO: 1878609 - RNA, 22 nt, Salmonella typhimurium LT2
agagacggcgacaguugauauu

SEQ ID NO: 1878610 - RNA, 21 nt, Salmonella typhimurium LT2
agagacucucuuuaaucaccc

SEQ ID NO: 1878611 - RNA, 21 nt, Salmonella typhimurium LT2
agaugguauaaaucacgcuga

SEQ ID NO: 1878612 - RNA, 20 nt, Salmonella typhimurium LT2
agaugcugggcgugucccug

SEQ ID NO: 1878613 - RNA, 16 nt, Salmonella typhimurium LT2
agauguugauacagaa

SEQ ID NO: 1878614 - RNA, 22 nt, Salmonella typhimurium LT2
agauuaacgaccagguaaugga

SEQ ID NO: 1878615 - RNA, 13 nt, Salmonella typhimurium LT2
agauuaaacguga

SEQ ID NO: 1878616 - RNA, 17 nt, Salmonella typhimurium LT2
agaugaacguaacguga

SEQ ID NO: 1878617 - RNA, 22 nt, Salmonella typhimurium LT2
agaucuuuugcgccuuccaguu

SEQ ID NO: 1878618 - RNA, 21 nt, Salmonella typhimurium LT2
agaucuuuauccugcacgaag

SEQ ID NO: 1878619 - RNA, 16 nt, Salmonella typhimurium LT2
agaucuucuuuaaccg

SEQ ID NO: 1878620 - RNA, 22 nt, Salmonella typhimurium LT2
agaucuucuuuccgcuacuacc

SEQ ID NO: 1878621 - RNA, 19 nt, Salmonella typhimurium LT2
agaugaugauuuaugaaua

SEQ ID NO: 1878622 - RNA, 15 nt, Salmonella typhimurium LT2
agaugauuucuuguu

SEQ ID NO: 1878623 - RNA, 14 nt, Salmonella typhimurium LT2
agauccuucauuca

SEQ ID NO: 1878624 - RNA, 23 nt, Salmonella typhimurium LT2
agauccuucauucagaucaaaaa

SEQ ID NO: 1878625 - RNA, 17 nt, Salmonella typhimurium LT2
agaucgaacaauuaccg

SEQ ID NO: 1878626 - RNA, 20 nt, Salmonella typhimurium LT2
agaucgaacaauuaccgaug

SEQ ID NO: 1878627 - RNA, 16 nt, Salmonella typhimurium LT2
agaucgaccagcgcau

SEQ ID NO: 1878628 - RNA, 23 nt, Salmonella typhimurium LT2
agaucgcaggccaaaaaaacgaa

SEQ ID NO: 1878629 - RNA, 23 nt, Salmonella typhimurium LT2
agaucgcaggguaugaauuuuuu

SEQ ID NO: 1878630 - RNA, 17 nt, Salmonella typhimurium LT2
agaucgcgggcaaucaa

SEQ ID NO: 1878631 - RNA, 18 nt, Salmonella typhimurium LT2
agaucguaugcgccuguu

SEQ ID NO: 1878632 - RNA, 21 nt, Salmonella typhimurium LT2
agaucggagggggaggcaggc

SEQ ID NO: 1878633 - RNA, 15 nt, Salmonella typhimurium LT2
agaucugcgccgccg

SEQ ID NO: 1878634 - RNA, 15 nt, Salmonella typhimurium LT2
agaucuucccaguua

SEQ ID NO: 1878635 - RNA, 23 nt, Salmonella typhimurium LT2
agauaacuuccuuugccuuucuu

SEQ ID NO: 1878636 - RNA, 16 nt, Salmonella typhimurium LT2
agauaagaaguaaaca

SEQ ID NO: 1878637 - RNA, 15 nt, Salmonella typhimurium LT2
agagugccagaaaca

SEQ ID NO: 1878638 - RNA, 19 nt, Salmonella typhimurium LT2
agauaaaaagacagauaaa

SEQ ID NO: 1878639 - RNA, 16 nt, Salmonella typhimurium LT2
aaaaccagaccuccac

SEQ ID NO: 1878640 - RNA, 13 nt, Salmonella typhimurium LT2
agaguauugagac

SEQ ID NO: 1878641 - RNA, 18 nt, Salmonella typhimurium LT2
agaguccacagcccggcg

SEQ ID NO: 1878642 - RNA, 20 nt, Salmonella typhimurium LT2
agagugagcaacguuuuccu

SEQ ID NO: 1878643 - RNA, 10 nt, Salmonella typhimurium LT2
agagugaaca

SEQ ID NO: 1878644 - RNA, 17 nt, Salmonella typhimurium LT2
agaucaaacaggcgaaa

SEQ ID NO: 1878645 - RNA, 13 nt, Salmonella typhimurium LT2
agauauuuuguca

SEQ ID NO: 1878646 - RNA, 14 nt, Salmonella typhimurium LT2
agauauagaccagc

SEQ ID NO: 1878647 - RNA, 14 nt, Salmonella typhimurium LT2
agauauacaucuga

SEQ ID NO: 1878648 - RNA, 15 nt, Salmonella typhimurium LT2
agauaguugagcagc

SEQ ID NO: 1878649 - RNA, 11 nt, Salmonella typhimurium LT2
agauaguuuuu

SEQ ID NO: 1878650 - RNA, 18 nt, Salmonella typhimurium LT2
agauaguuuuuaauucca

SEQ ID NO: 1878651 - RNA, 20 nt, Salmonella typhimurium LT2
agauagucacgauaguuugc

SEQ ID NO: 1878652 - RNA, 17 nt, Salmonella typhimurium LT2
agauagugaucgggcug

SEQ ID NO: 1878653 - RNA, 22 nt, Salmonella typhimurium LT2
agauaguauuucccuucccagc

SEQ ID NO: 1878654 - RNA, 14 nt, Salmonella typhimurium LT2
agauagggccaggc

SEQ ID NO: 1878655 - RNA, 18 nt, Salmonella typhimurium LT2
agauagcuaaguguugga

SEQ ID NO: 1878656 - RNA, 17 nt, Salmonella typhimurium LT2
agauagcuuccaugccg

SEQ ID NO: 1878657 - RNA, 20 nt, Salmonella typhimurium LT2
agauaauccagccacagauu

SEQ ID NO: 1878658 - RNA, 16 nt, Salmonella typhimurium LT2
agauaaucaaacgcgc

SEQ ID NO: 1878659 - RNA, 14 nt, Salmonella typhimurium LT2
agauaauucucuuu

SEQ ID NO: 1878660 - RNA, 22 nt, Salmonella typhimurium LT2
agaaccaacgucaucaugaaaa

SEQ ID NO: 1878661 - RNA, 13 nt, Salmonella typhimurium LT2
agaacgaauuuac

SEQ ID NO: 1878662 - RNA, 22 nt, Salmonella typhimurium LT2
agaaccucacggagaaaagcga

SEQ ID NO: 1878663 - RNA, 23 nt, Salmonella typhimurium LT2
agaaccucacggagaaaagcgaa

SEQ ID NO: 1878664 - RNA, 21 nt, Salmonella typhimurium LT2
agaacggaaguugcauauaag

SEQ ID NO: 1878665 - RNA, 14 nt, Salmonella typhimurium LT2
agaacgagaggagg

SEQ ID NO: 1878666 - RNA, 17 nt, Salmonella typhimurium LT2
agaacuuguaaaaaugc

SEQ ID NO: 1878667 - RNA, 13 nt, Salmonella typhimurium LT2
agaagaaaaaauu

SEQ ID NO: 1878668 - RNA, 19 nt, Salmonella typhimurium LT2
agaagagaauggccagcac

SEQ ID NO: 1878669 - RNA, 14 nt, Salmonella typhimurium LT2
agaaaucccacauu

SEQ ID NO: 1878670 - RNA, 22 nt, Salmonella typhimurium LT2
agaaaucucaucugcaaaauau

SEQ ID NO: 1878671 - RNA, 23 nt, Salmonella typhimurium LT2
agaaauuuaggucaaaaaagcga

SEQ ID NO: 1878672 - RNA, 17 nt, Salmonella typhimurium LT2
agaaauuaaaucaucuu

SEQ ID NO: 1878673 - RNA, 17 nt, Salmonella typhimurium LT2
aaaacacgucuggaaac

SEQ ID NO: 1878674 - RNA, 18 nt, Salmonella typhimurium LT2
agaaaucaacgaaaucag

SEQ ID NO: 1878675 - RNA, 19 nt, Salmonella typhimurium LT2
agaaaucaacgaaaucaga

SEQ ID NO: 1878676 - RNA, 19 nt, Salmonella typhimurium LT2
agaaacaacaccguaaaag

SEQ ID NO: 1878677 - RNA, 13 nt, Salmonella typhimurium LT2
agaaacaacacga

SEQ ID NO: 1878678 - RNA, 14 nt, Salmonella typhimurium LT2
agaaacgcugaucu

SEQ ID NO: 1878679 - RNA, 21 nt, Salmonella typhimurium LT2
agaauaaaaagugcgcacuca

SEQ ID NO: 1878680 - RNA, 23 nt, Salmonella typhimurium LT2
agaauaaaaagugcgcacucaga

SEQ ID NO: 1878681 - RNA, 13 nt, Salmonella typhimurium LT2
agaauaacaaucu

SEQ ID NO: 1878682 - RNA, 15 nt, Salmonella typhimurium LT2
agaauaacaaucugc

SEQ ID NO: 1878683 - RNA, 15 nt, Salmonella typhimurium LT2
agaauaagccagguu

SEQ ID NO: 1878684 - RNA, 21 nt, Salmonella typhimurium LT2
agaauaaugcuggcggagcca

SEQ ID NO: 1878685 - RNA, 14 nt, Salmonella typhimurium LT2
agaauagacuggcg

SEQ ID NO: 1878686 - RNA, 13 nt, Salmonella typhimurium LT2
agaagccaucaaa

SEQ ID NO: 1878687 - RNA, 15 nt, Salmonella typhimurium LT2
agaagcccggccaca

SEQ ID NO: 1878688 - RNA, 17 nt, Salmonella typhimurium LT2
agaagccgucgauaaaa

SEQ ID NO: 1878689 - RNA, 15 nt, Salmonella typhimurium LT2
agaagcgcacuuucc

SEQ ID NO: 1878690 - RNA, 18 nt, Salmonella typhimurium LT2
agaagucugugaggaaag

SEQ ID NO: 1878691 - RNA, 19 nt, Salmonella typhimurium LT2
agaagucugugaggaaagc

SEQ ID NO: 1878692 - RNA, 15 nt, Salmonella typhimurium LT2
agaaguguacaaaca

SEQ ID NO: 1878693 - RNA, 18 nt, Salmonella typhimurium LT2
agaaguguacaaacacgu

SEQ ID NO: 1878694 - RNA, 22 nt, Salmonella typhimurium LT2
agaauggucgguauuaucaaug

SEQ ID NO: 1878695 - RNA, 24 nt, Salmonella typhimurium LT2
agaauggucgguauuaucaauggu

SEQ ID NO: 1878696 - RNA, 15 nt, Salmonella typhimurium LT2
agaauggccagcaca

SEQ ID NO: 1878697 - RNA, 22 nt, Salmonella typhimurium LT2
agaauggccagcacaauaacga

SEQ ID NO: 1878698 - RNA, 20 nt, Salmonella typhimurium LT2
agaauuacaucaauaaacau

SEQ ID NO: 1878699 - RNA, 16 nt, Salmonella typhimurium LT2
agaauuauuaccaaug

SEQ ID NO: 1878700 - RNA, 22 nt, Salmonella typhimurium LT2
agaauuauuaccaaugagcugc

SEQ ID NO: 1878701 - RNA, 18 nt, Salmonella typhimurium LT2
agaaucucgaaacaauag

SEQ ID NO: 1878702 - RNA, 18 nt, Salmonella typhimurium LT2
agaaugcgagcaaaaccc

SEQ ID NO: 1878703 - RNA, 14 nt, Salmonella typhimurium LT2
agaaugcccagcaa

SEQ ID NO: 1878704 - RNA, 15 nt, Salmonella typhimurium LT2
agaaugcccagcaag

SEQ ID NO: 1878705 - RNA, 19 nt, Salmonella typhimurium LT2
agaauauucacgacaugag

SEQ ID NO: 1878706 - RNA, 12 nt, Salmonella typhimurium LT2
agaauaugccag

SEQ ID NO: 1878707 - RNA, 16 nt, Salmonella typhimurium LT2
agaauauaggagagcg

SEQ ID NO: 1878708 - RNA, 21 nt, Salmonella typhimurium LT2
agaaucguggcgccaaaaagu

SEQ ID NO: 1878709 - RNA, 12 nt, Salmonella typhimurium LT2
agaaucagaugc

SEQ ID NO: 1878710 - RNA, 14 nt, Salmonella typhimurium LT2
acuuugcgaaaaag

SEQ ID NO: 1878711 - RNA, 19 nt, Salmonella typhimurium LT2
acuuugcccuuuuugcauu

SEQ ID NO: 1878712 - RNA, 16 nt, Salmonella typhimurium LT2
acuuugccaugaauaa

SEQ ID NO: 1878713 - RNA, 15 nt, Salmonella typhimurium LT2
acuuugauuuaauuc

SEQ ID NO: 1878714 - RNA, 20 nt, Salmonella typhimurium LT2
acuuugauuuaauucgauaa

SEQ ID NO: 1878715 - RNA, 20 nt, Salmonella typhimurium LT2
acuuugcgguuacguucggc

SEQ ID NO: 1878716 - RNA, 19 nt, Salmonella typhimurium LT2
acuuuggauaaagccaaug

SEQ ID NO: 1878717 - RNA, 22 nt, Salmonella typhimurium LT2
acuuuccagccccuucgcuguc

SEQ ID NO: 1878718 - RNA, 15 nt, Salmonella typhimurium LT2
acuuugaccagcauc

SEQ ID NO: 1878719 - RNA, 17 nt, Salmonella typhimurium LT2
acuuucuugccacuggc

SEQ ID NO: 1878720 - RNA, 21 nt, Salmonella typhimurium LT2
acuuucuuuugauacucugcu

SEQ ID NO: 1878721 - RNA, 18 nt, Salmonella typhimurium LT2
acuuuucuuuccugcaaa

SEQ ID NO: 1878722 - RNA, 19 nt, Salmonella typhimurium LT2
acuuuuugaucuaaaaauu

SEQ ID NO: 1878723 - RNA, 22 nt, Salmonella typhimurium LT2
acuuuuugcugaacguauggca

SEQ ID NO: 1878724 - RNA, 16 nt, Salmonella typhimurium LT2
acuuuuuuauggccaa

SEQ ID NO: 1878725 - RNA, 22 nt, Salmonella typhimurium LT2
acuuuuuuauggccaaccagau

SEQ ID NO: 1878726 - RNA, 15 nt, Salmonella typhimurium LT2
acuuuuccuuccgcc

SEQ ID NO: 1878727 - RNA, 21 nt, Salmonella typhimurium LT2
agaaaaugcucaguauggcca

SEQ ID NO: 1878728 - RNA, 17 nt, Salmonella typhimurium LT2
agaaaauuauuuuaaau

SEQ ID NO: 1878729 - RNA, 22 nt, Salmonella typhimurium LT2
agaaaauuacgcccaucagucc

SEQ ID NO: 1878730 - RNA, 20 nt, Salmonella typhimurium LT2
agaaaauuaacgacaaaaau

SEQ ID NO: 1878731 - RNA, 18 nt, Salmonella typhimurium LT2
agaaaaaacucaggaaau

SEQ ID NO: 1878732 - RNA, 18 nt, Salmonella typhimurium LT2
agaaaaaauuaaaauuca

SEQ ID NO: 1878733 - RNA, 14 nt, Salmonella typhimurium LT2
acuuuaagcggcag

SEQ ID NO: 1878734 - RNA, 16 nt, Salmonella typhimurium LT2
acuuguugcuggcagg

SEQ ID NO: 1878735 - RNA, 16 nt, Salmonella typhimurium LT2
acuuuaccgcucacaa

SEQ ID NO: 1878736 - RNA, 18 nt, Salmonella typhimurium LT2
acuuuaccgucagccacu

SEQ ID NO: 1878737 - RNA, 22 nt, Salmonella typhimurium LT2
acuuuaagcgagagcgucuuag

SEQ ID NO: 1878738 - RNA, 16 nt, Salmonella typhimurium LT2
acuuucaccugcauac

SEQ ID NO: 1878739 - RNA, 17 nt, Salmonella typhimurium LT2
acuuuccaaaauccagg

SEQ ID NO: 1878740 - RNA, 11 nt, Salmonella typhimurium LT2
acuuucaucag

SEQ ID NO: 1878741 - RNA, 13 nt, Salmonella typhimurium LT2
acuuuauuuuucg

SEQ ID NO: 1878742 - RNA, 12 nt, Salmonella typhimurium LT2
acuuuauucucu

SEQ ID NO: 1878743 - RNA, 19 nt, Salmonella typhimurium LT2
acuuaucaaaccaguuuuu

SEQ ID NO: 1878744 - RNA, 17 nt, Salmonella typhimurium LT2
acuuaguaucauauuuu

SEQ ID NO: 1878745 - RNA, 10 nt, Salmonella typhimurium LT2
acuuguauag

SEQ ID NO: 1878746 - RNA, 18 nt, Salmonella typhimurium LT2
acuuguauagacaaguau

SEQ ID NO: 1878747 - RNA, 17 nt, Salmonella typhimurium LT2
acuuggcgaucaccagc

SEQ ID NO: 1878748 - RNA, 13 nt, Salmonella typhimurium LT2
acuuggcuuccua

SEQ ID NO: 1878749 - RNA, 23 nt, Salmonella typhimurium LT2
acuugggaaacuuaucauuuuuu

SEQ ID NO: 1878750 - RNA, 14 nt, Salmonella typhimurium LT2
agccgaccaccauc

SEQ ID NO: 1878751 - RNA, 23 nt, Salmonella typhimurium LT2
agcccuuugagaaagcugcgccc

SEQ ID NO: 1878752 - RNA, 13 nt, Salmonella typhimurium LT2
agcccuuugcccu

SEQ ID NO: 1878753 - RNA, 14 nt, Salmonella typhimurium LT2
agcccuuugcccuc

SEQ ID NO: 1878754 - RNA, 16 nt, Salmonella typhimurium LT2
agcccucucacuggag

SEQ ID NO: 1878755 - RNA, 14 nt, Salmonella typhimurium LT2
agccaggcgaugaa

SEQ ID NO: 1878756 - RNA, 20 nt, Salmonella typhimurium LT2
agccagguccagauaccgga

SEQ ID NO: 1878757 - RNA, 21 nt, Salmonella typhimurium LT2
agcccggaaauaaacgccagu

SEQ ID NO: 1878758 - RNA, 18 nt, Salmonella typhimurium LT2
agcccuaucaccauaauc

SEQ ID NO: 1878759 - RNA, 22 nt, Salmonella typhimurium LT2
agcccuaucaccauaaucgcga

SEQ ID NO: 1878760 - RNA, 16 nt, Salmonella typhimurium LT2
agccggcgccauuucg

SEQ ID NO: 1878761 - RNA, 21 nt, Salmonella typhimurium LT2
agccggauguugggcgguucc

SEQ ID NO: 1878762 - RNA, 16 nt, Salmonella typhimurium LT2
agccggauuuuaaauu

SEQ ID NO: 1878763 - RNA, 18 nt, Salmonella typhimurium LT2
agccgcuguuuuucauca

SEQ ID NO: 1878764 - RNA, 11 nt, Salmonella typhimurium LT2
agccgcugccu

SEQ ID NO: 1878765 - RNA, 19 nt, Salmonella typhimurium LT2
agccggaaucauucuacaa

SEQ ID NO: 1878766 - RNA, 19 nt, Salmonella typhimurium LT2
agccgcugauauucgccug

SEQ ID NO: 1878767 - RNA, 14 nt, Salmonella typhimurium LT2
agccgcucgccaga

SEQ ID NO: 1878768 - RNA, 20 nt, Salmonella typhimurium LT2
agccgcguugcgcugaagua

SEQ ID NO: 1878769 - RNA, 16 nt, Salmonella typhimurium LT2
agccgcucaauaauau

SEQ ID NO: 1878770 - RNA, 19 nt, Salmonella typhimurium LT2
agccgcucaauaauauccu

SEQ ID NO: 1878771 - RNA, 21 nt, Salmonella typhimurium LT2
agccgcucaauaauauccugc

SEQ ID NO: 1878772 - RNA, 12 nt, Salmonella typhimurium LT2
agccgcccaucc

SEQ ID NO: 1878773 - RNA, 20 nt, Salmonella typhimurium LT2
agccgcggcgcuuucgccac

SEQ ID NO: 1878774 - RNA, 16 nt, Salmonella typhimurium LT2
agccgcggaccuuuug

SEQ ID NO: 1878775 - RNA, 18 nt, Salmonella typhimurium LT2
agccgcgcucaagcuggg

SEQ ID NO: 1878776 - RNA, 15 nt, Salmonella typhimurium LT2
agccucuaaauguug

SEQ ID NO: 1878777 - RNA, 15 nt, Salmonella typhimurium LT2
agccuucaccccuuc

SEQ ID NO: 1878778 - RNA, 22 nt, Salmonella typhimurium LT2
agccuuagcgggaggcgguucu

SEQ ID NO: 1878779 - RNA, 22 nt, Salmonella typhimurium LT2
agccuuaaucaacugcgccaca

SEQ ID NO: 1878780 - RNA, 16 nt, Salmonella typhimurium LT2
agccuuacuaucccau

SEQ ID NO: 1878781 - RNA, 19 nt, Salmonella typhimurium LT2
agccuugacgcaauagagu

SEQ ID NO: 1878782 - RNA, 19 nt, Salmonella typhimurium LT2
agcgaaaugcgaauccggc

SEQ ID NO: 1878783 - RNA, 15 nt, Salmonella typhimurium LT2
agcgaaaugcgaauc

SEQ ID NO: 1878784 - RNA, 21 nt, Salmonella typhimurium LT2
agcgaaaugacagccaccagc

SEQ ID NO: 1878785 - RNA, 17 nt, Salmonella typhimurium LT2
agcgaaccaucauuaau

SEQ ID NO: 1878786 - RNA, 17 nt, Salmonella typhimurium LT2
agcgacagccaguaaug

SEQ ID NO: 1878787 - RNA, 19 nt, Salmonella typhimurium LT2
agcgaacguccagcggcca

SEQ ID NO: 1878788 - RNA, 20 nt, Salmonella typhimurium LT2
agcgaagaucaggaguaaau

SEQ ID NO: 1878789 - RNA, 23 nt, Salmonella typhimurium LT2
agcgaagcgucauccggcaauca

SEQ ID NO: 1878790 - RNA, 13 nt, Salmonella typhimurium LT2
agccguaaauaau

SEQ ID NO: 1878791 - RNA, 19 nt, Salmonella typhimurium LT2
agccguaacgagugaggac

SEQ ID NO: 1878792 - RNA, 19 nt, Salmonella typhimurium LT2
agccgguacgggaaauggc

SEQ ID NO: 1878793 - RNA, 21 nt, Salmonella typhimurium LT2
agccggggauuuccccggcuu

SEQ ID NO: 1878794 - RNA, 18 nt, Salmonella typhimurium LT2
agccgggcgggaaccugu

SEQ ID NO: 1878795 - RNA, 16 nt, Salmonella typhimurium LT2
agccggcuaucuucuu

SEQ ID NO: 1878796 - RNA, 22 nt, Salmonella typhimurium LT2
agcggcagaucguuuacgaccu

SEQ ID NO: 1878797 - RNA, 21 nt, Salmonella typhimurium LT2
agcggcagaucguuuacgacc

SEQ ID NO: 1878798 - RNA, 20 nt, Salmonella typhimurium LT2
agcggcaaugagcggccagc

SEQ ID NO: 1878799 - RNA, 18 nt, Salmonella typhimurium LT2
agcggcacguacugcacc

SEQ ID NO: 1878800 - RNA, 20 nt, Salmonella typhimurium LT2
agcggcaccccgagcgacaa

SEQ ID NO: 1878801 - RNA, 17 nt, Salmonella typhimurium LT2
agcggaccguaauaucg

SEQ ID NO: 1878802 - RNA, 19 nt, Salmonella typhimurium LT2
agcggacugccuaacugga

SEQ ID NO: 1878803 - RNA, 16 nt, Salmonella typhimurium LT2
agcggauaauccgcca

SEQ ID NO: 1878804 - RNA, 20 nt, Salmonella typhimurium LT2
agcggaucgcguccauuacu

SEQ ID NO: 1878805 - RNA, 22 nt, Salmonella typhimurium LT2
agcggaucgcguccauuacucu

SEQ ID NO: 1878806 - RNA, 19 nt, Salmonella typhimurium LT2
agcggcaacugagcgaauc

SEQ ID NO: 1878807 - RNA, 14 nt, Salmonella typhimurium LT2
agcggaaagcaaca

SEQ ID NO: 1878808 - RNA, 17 nt, Salmonella typhimurium LT2
agcggaauagacggccu

SEQ ID NO: 1878809 - RNA, 18 nt, Salmonella typhimurium LT2
agcggaagggccuuuggc

SEQ ID NO: 1878810 - RNA, 16 nt, Salmonella typhimurium LT2
agcgcuuugccgcugc

SEQ ID NO: 1878811 - RNA, 14 nt, Salmonella typhimurium LT2
agcgcuuucuucuu

SEQ ID NO: 1878812 - RNA, 23 nt, Salmonella typhimurium LT2
agcgcuuuccagucccugaagaa

SEQ ID NO: 1878813 - RNA, 13 nt, Salmonella typhimurium LT2
agcgcuuuugccg

SEQ ID NO: 1878814 - RNA, 17 nt, Salmonella typhimurium LT2
agcgcuuuuuccagcgc

SEQ ID NO: 1878815 - RNA, 16 nt, Salmonella typhimurium LT2
agcgcuuuuuuuaugc

SEQ ID NO: 1878816 - RNA, 23 nt, Salmonella typhimurium LT2
agcgcuuaccacuuugcgcuccu

SEQ ID NO: 1878817 - RNA, 15 nt, Salmonella typhimurium LT2
agcgcuuaucccagu

SEQ ID NO: 1878818 - RNA, 15 nt, Salmonella typhimurium LT2
agcgcuugauccagu

SEQ ID NO: 1878819 - RNA, 15 nt, Salmonella typhimurium LT2
agcgcuucucuuucc

SEQ ID NO: 1878820 - RNA, 17 nt, Salmonella typhimurium LT2
agcgcugcgcaaauacg

SEQ ID NO: 1878821 - RNA, 14 nt, Salmonella typhimurium LT2
agcguauccagcac

SEQ ID NO: 1878822 - RNA, 14 nt, Salmonella typhimurium LT2
agcguacugcagcg

SEQ ID NO: 1878823 - RNA, 16 nt, Salmonella typhimurium LT2
agcguaccggccacaa

SEQ ID NO: 1878824 - RNA, 11 nt, Salmonella typhimurium LT2
agcggucagcg

SEQ ID NO: 1878825 - RNA, 15 nt, Salmonella typhimurium LT2
agcggucuuucaaca

SEQ ID NO: 1878826 - RNA, 23 nt, Salmonella typhimurium LT2
agcguaauuccggccucuuguag

SEQ ID NO: 1878827 - RNA, 18 nt, Salmonella typhimurium LT2
agcguacaggcggaugaa

SEQ ID NO: 1878828 - RNA, 16 nt, Salmonella typhimurium LT2
agcggcauauggccgu

SEQ ID NO: 1878829 - RNA, 13 nt, Salmonella typhimurium LT2
agcggguaaacag

SEQ ID NO: 1878830 - RNA, 16 nt, Salmonella typhimurium LT2
agcggguagagcuuuu

SEQ ID NO: 1878831 - RNA, 18 nt, Salmonella typhimurium LT2
agcggcgccaucaccauc

SEQ ID NO: 1878832 - RNA, 11 nt, Salmonella typhimurium LT2
agcgguaccac

SEQ ID NO: 1878833 - RNA, 16 nt, Salmonella typhimurium LT2
agcgacgccagauuau

SEQ ID NO: 1878834 - RNA, 18 nt, Salmonella typhimurium LT2
agcgacgaggcauggcga

SEQ ID NO: 1878835 - RNA, 23 nt, Salmonella typhimurium LT2
agcgaccacgacgccggagaccg

SEQ ID NO: 1878836 - RNA, 17 nt, Salmonella typhimurium LT2
agcgaccggcgucauca

SEQ ID NO: 1878837 - RNA, 22 nt, Salmonella typhimurium LT2
agcgcagcgccauugagcauuc

SEQ ID NO: 1878838 - RNA, 18 nt, Salmonella typhimurium LT2
agcgcagcgccaucaggc

SEQ ID NO: 1878839 - RNA, 17 nt, Salmonella typhimurium LT2
agcgcagcgccaucagg

SEQ ID NO: 1878840 - RNA, 15 nt, Salmonella typhimurium LT2
agcgcaggcaacgcc

SEQ ID NO: 1878841 - RNA, 13 nt, Salmonella typhimurium LT2
agcgcagcaaaac

SEQ ID NO: 1878842 - RNA, 19 nt, Salmonella typhimurium LT2
agcgcagacccgucagggu

SEQ ID NO: 1878843 - RNA, 15 nt, Salmonella typhimurium LT2
agcgcauggcggcca

SEQ ID NO: 1878844 - RNA, 23 nt, Salmonella typhimurium LT2
agcgcauuuuuaucagaccugcc

SEQ ID NO: 1878845 - RNA, 20 nt, Salmonella typhimurium LT2
agcgcauugcgucccagcac

SEQ ID NO: 1878846 - RNA, 21 nt, Salmonella typhimurium LT2
agcgcauugcgucccagcaca

SEQ ID NO: 1878847 - RNA, 18 nt, Salmonella typhimurium LT2
agcgcauuauguaauaac

SEQ ID NO: 1878848 - RNA, 18 nt, Salmonella typhimurium LT2
agcgcagugaccagcauc

SEQ ID NO: 1878849 - RNA, 15 nt, Salmonella typhimurium LT2
agcgcaguccagaug

SEQ ID NO: 1878850 - RNA, 14 nt, Salmonella typhimurium LT2
agcgccacgcccaa

SEQ ID NO: 1878851 - RNA, 12 nt, Salmonella typhimurium LT2
agcgccauugcg

SEQ ID NO: 1878852 - RNA, 13 nt, Salmonella typhimurium LT2
agcgcccagcagc

SEQ ID NO: 1878853 - RNA, 14 nt, Salmonella typhimurium LT2
agcgccccaguaac

SEQ ID NO: 1878854 - RNA, 14 nt, Salmonella typhimurium LT2
agcgcccccagcaa

SEQ ID NO: 1878855 - RNA, 17 nt, Salmonella typhimurium LT2
agcgcccccaguuccug

SEQ ID NO: 1878856 - RNA, 19 nt, Salmonella typhimurium LT2
agcgccccagccaaagccu

SEQ ID NO: 1878857 - RNA, 15 nt, Salmonella typhimurium LT2
agcgccccggcauaa

SEQ ID NO: 1878858 - RNA, 22 nt, Salmonella typhimurium LT2
agcgcgaucgccccgaccagga

SEQ ID NO: 1878859 - RNA, 17 nt, Salmonella typhimurium LT2
agcgcgcaaucgggccu

SEQ ID NO: 1878860 - RNA, 11 nt, Salmonella typhimurium LT2
agcgccgggaa

SEQ ID NO: 1878861 - RNA, 18 nt, Salmonella typhimurium LT2
agcgcgacgccaaacccg

SEQ ID NO: 1878862 - RNA, 18 nt, Salmonella typhimurium LT2
agcgccggauaauccaga

SEQ ID NO: 1878863 - RNA, 22 nt, Salmonella typhimurium LT2
agcgccgcguggcguuccaguu

SEQ ID NO: 1878864 - RNA, 16 nt, Salmonella typhimurium LT2
agcgccgcuuccaggc

SEQ ID NO: 1878865 - RNA, 17 nt, Salmonella typhimurium LT2
agcgccgcuuccaggcg

SEQ ID NO: 1878866 - RNA, 15 nt, Salmonella typhimurium LT2
agcgccgcgcaggcg

SEQ ID NO: 1878867 - RNA, 14 nt, Salmonella typhimurium LT2
agcgcggcagccgg

SEQ ID NO: 1878868 - RNA, 14 nt, Salmonella typhimurium LT2
agcgcggcaggccg

SEQ ID NO: 1878869 - RNA, 16 nt, Salmonella typhimurium LT2
agcgcgcucugccuuu

SEQ ID NO: 1878870 - RNA, 23 nt, Salmonella typhimurium LT2
agcgcggacagcagaauauugcu

SEQ ID NO: 1878871 - RNA, 16 nt, Salmonella typhimurium LT2
agcgcgcguagcagca

SEQ ID NO: 1878872 - RNA, 13 nt, Salmonella typhimurium LT2
agcgcgcggcugc

SEQ ID NO: 1878873 - RNA, 12 nt, Salmonella typhimurium LT2
agcgcgccagcg

SEQ ID NO: 1878874 - RNA, 18 nt, Salmonella typhimurium LT2
agcgcuccgggguucuuu

SEQ ID NO: 1878875 - RNA, 20 nt, Salmonella typhimurium LT2
agcgcgucagcgccuccgcg

SEQ ID NO: 1878876 - RNA, 19 nt, Salmonella typhimurium LT2
agcgcgguaucauugcugc

SEQ ID NO: 1878877 - RNA, 17 nt, Salmonella typhimurium LT2
agcgcgggcuggcuggc

SEQ ID NO: 1878878 - RNA, 18 nt, Salmonella typhimurium LT2
aaaaccuucauaaauacg

SEQ ID NO: 1878879 - RNA, 13 nt, Salmonella typhimurium LT2
agcagacgagaaa

SEQ ID NO: 1878880 - RNA, 16 nt, Salmonella typhimurium LT2
aaaaccuaaauaaaua

SEQ ID NO: 1878881 - RNA, 20 nt, Salmonella typhimurium LT2
aaaaccuaaauaaauaccaa

SEQ ID NO: 1878882 - RNA, 22 nt, Salmonella typhimurium LT2
agcagacguuuaagcaugguga

SEQ ID NO: 1878883 - RNA, 13 nt, Salmonella typhimurium LT2
agcagacguuggu

SEQ ID NO: 1878884 - RNA, 14 nt, Salmonella typhimurium LT2
agcagcgagauggc

SEQ ID NO: 1878885 - RNA, 17 nt, Salmonella typhimurium LT2
agcagcgcaucaugguc

SEQ ID NO: 1878886 - RNA, 13 nt, Salmonella typhimurium LT2
agcagcugcugua

SEQ ID NO: 1878887 - RNA, 15 nt, Salmonella typhimurium LT2
agcaggaacggcagg

SEQ ID NO: 1878888 - RNA, 14 nt, Salmonella typhimurium LT2
agcaggaaccacau

SEQ ID NO: 1878889 - RNA, 17 nt, Salmonella typhimurium LT2
agcagcuucgccagaug

SEQ ID NO: 1878890 - RNA, 20 nt, Salmonella typhimurium LT2
agcagggcaugauuacagau

SEQ ID NO: 1878891 - RNA, 16 nt, Salmonella typhimurium LT2
agcagggucaggaacu

SEQ ID NO: 1878892 - RNA, 17 nt, Salmonella typhimurium LT2
agcauaauaaagcagcg

SEQ ID NO: 1878893 - RNA, 16 nt, Salmonella typhimurium LT2
agcauaucguagaaag

SEQ ID NO: 1878894 - RNA, 19 nt, Salmonella typhimurium LT2
agcauaagcuaugcggaag

SEQ ID NO: 1878895 - RNA, 17 nt, Salmonella typhimurium LT2
agcaucaaacuuuuaaa

SEQ ID NO: 1878896 - RNA, 12 nt, Salmonella typhimurium LT2
agcaucccacga

SEQ ID NO: 1878897 - RNA, 14 nt, Salmonella typhimurium LT2
agcaucauuuuuua

SEQ ID NO: 1878898 - RNA, 21 nt, Salmonella typhimurium LT2
agcauccgggauauaaaauua

SEQ ID NO: 1878899 - RNA, 21 nt, Salmonella typhimurium LT2
agcauccgcaagacacgcuuc

SEQ ID NO: 1878900 - RNA, 16 nt, Salmonella typhimurium LT2
agcauccccacaggau

SEQ ID NO: 1878901 - RNA, 21 nt, Salmonella typhimurium LT2
agcaguuuuaucuaugugugg

SEQ ID NO: 1878902 - RNA, 16 nt, Salmonella typhimurium LT2
agcaguugcauucccu

SEQ ID NO: 1878903 - RNA, 13 nt, Salmonella typhimurium LT2
agcauaaaaagac

SEQ ID NO: 1878904 - RNA, 18 nt, Salmonella typhimurium LT2
agcauaaaaaagauugcu

SEQ ID NO: 1878905 - RNA, 15 nt, Salmonella typhimurium LT2
agcauaaaaaucauu

SEQ ID NO: 1878906 - RNA, 21 nt, Salmonella typhimurium LT2
agcauaaaaccgccgcccauc

SEQ ID NO: 1878907 - RNA, 15 nt, Salmonella typhimurium LT2
agcaguuccagcauc

SEQ ID NO: 1878908 - RNA, 16 nt, Salmonella typhimurium LT2
agcaguucagcagcac

SEQ ID NO: 1878909 - RNA, 19 nt, Salmonella typhimurium LT2
agccaaucagccccagcac

SEQ ID NO: 1878910 - RNA, 12 nt, Salmonella typhimurium LT2
agccaauauccg

SEQ ID NO: 1878911 - RNA, 18 nt, Salmonella typhimurium LT2
agccaauccagaauacca

SEQ ID NO: 1878912 - RNA, 23 nt, Salmonella typhimurium LT2
agccacaaugggggcauaauacg

SEQ ID NO: 1878913 - RNA, 21 nt, Salmonella typhimurium LT2
agccacacgacgguauuggua

SEQ ID NO: 1878914 - RNA, 20 nt, Salmonella typhimurium LT2
agccacagccugugucagau

SEQ ID NO: 1878915 - RNA, 19 nt, Salmonella typhimurium LT2
agccaaauagcgccagaca

SEQ ID NO: 1878916 - RNA, 15 nt, Salmonella typhimurium LT2
agccaaacucuucca

SEQ ID NO: 1878917 - RNA, 14 nt, Salmonella typhimurium LT2
agccaaacugcugu

SEQ ID NO: 1878918 - RNA, 18 nt, Salmonella typhimurium LT2
agccacuucaugcgcuuu

SEQ ID NO: 1878919 - RNA, 11 nt, Salmonella typhimurium LT2
agccacuggcu

SEQ ID NO: 1878920 - RNA, 21 nt, Salmonella typhimurium LT2
agccacuucuuccagcggcag

SEQ ID NO: 1878921 - RNA, 18 nt, Salmonella typhimurium LT2
agccagccaaacaguauc

SEQ ID NO: 1878922 - RNA, 15 nt, Salmonella typhimurium LT2
agccagccaaagcug

SEQ ID NO: 1878923 - RNA, 18 nt, Salmonella typhimurium LT2
agccagcaucaugggcuc

SEQ ID NO: 1878924 - RNA, 15 nt, Salmonella typhimurium LT2
agccagcagcucaac

SEQ ID NO: 1878925 - RNA, 19 nt, Salmonella typhimurium LT2
agccagccgccaaaaauau

SEQ ID NO: 1878926 - RNA, 15 nt, Salmonella typhimurium LT2
agccagcccagcgca

SEQ ID NO: 1878927 - RNA, 15 nt, Salmonella typhimurium LT2
agccagcccucaaca

SEQ ID NO: 1878928 - RNA, 17 nt, Salmonella typhimurium LT2
agccagcccugccacca

SEQ ID NO: 1878929 - RNA, 21 nt, Salmonella typhimurium LT2
agccagccaaauagcgccaga

SEQ ID NO: 1878930 - RNA, 19 nt, Salmonella typhimurium LT2
agccacucacguucagcgc

SEQ ID NO: 1878931 - RNA, 18 nt, Salmonella typhimurium LT2
agccacugcccagagaau

SEQ ID NO: 1878932 - RNA, 22 nt, Salmonella typhimurium LT2
agccacgguucucaccguggca

SEQ ID NO: 1878933 - RNA, 13 nt, Salmonella typhimurium LT2
agccacuauccag

SEQ ID NO: 1878934 - RNA, 16 nt, Salmonella typhimurium LT2
agccacaaucugauaa

SEQ ID NO: 1878935 - RNA, 22 nt, Salmonella typhimurium LT2
agcauguuugccgaauggcggc

SEQ ID NO: 1878936 - RNA, 19 nt, Salmonella typhimurium LT2
agcaugucggcaaucaccu

SEQ ID NO: 1878937 - RNA, 14 nt, Salmonella typhimurium LT2
agcauuauuuuuaa

SEQ ID NO: 1878938 - RNA, 22 nt, Salmonella typhimurium LT2
agcauuagccagaggcuaauca

SEQ ID NO: 1878939 - RNA, 16 nt, Salmonella typhimurium LT2
agcauuaccagcaaua

SEQ ID NO: 1878940 - RNA, 18 nt, Salmonella typhimurium LT2
agcauuaccagcaauaac

SEQ ID NO: 1878941 - RNA, 14 nt, Salmonella typhimurium LT2
agcaucugcggcuu

SEQ ID NO: 1878942 - RNA, 18 nt, Salmonella typhimurium LT2
agcaucugcggcuuucau

SEQ ID NO: 1878943 - RNA, 19 nt, Salmonella typhimurium LT2
agcauugggccgauaaagc

SEQ ID NO: 1878944 - RNA, 18 nt, Salmonella typhimurium LT2
agcauugugcagccaugu

SEQ ID NO: 1878945 - RNA, 19 nt, Salmonella typhimurium LT2
agcauugaggcuacccaga

SEQ ID NO: 1878946 - RNA, 17 nt, Salmonella typhimurium LT2
agcauuucgccaguucc

SEQ ID NO: 1878947 - RNA, 16 nt, Salmonella typhimurium LT2
agcauuucuucaagcg

SEQ ID NO: 1878948 - RNA, 18 nt, Salmonella typhimurium LT2
agccaaaagaaguggcaa

SEQ ID NO: 1878949 - RNA, 13 nt, Salmonella typhimurium LT2
agcaccagcagug

SEQ ID NO: 1878950 - RNA, 12 nt, Salmonella typhimurium LT2
agcaccagcagu

SEQ ID NO: 1878951 - RNA, 18 nt, Salmonella typhimurium LT2
agcaccagaccgacaagc

SEQ ID NO: 1878952 - RNA, 13 nt, Salmonella typhimurium LT2
agcacccaggcac

SEQ ID NO: 1878953 - RNA, 11 nt, Salmonella typhimurium LT2
agcacccauga

SEQ ID NO: 1878954 - RNA, 16 nt, Salmonella typhimurium LT2
agcaccauucuucaac

SEQ ID NO: 1878955 - RNA, 12 nt, Salmonella typhimurium LT2
agcacaggccau

SEQ ID NO: 1878956 - RNA, 18 nt, Salmonella typhimurium LT2
agcacagcgguagcaucu

SEQ ID NO: 1878957 - RNA, 20 nt, Salmonella typhimurium LT2
agcacagcgguagcaucuca

SEQ ID NO: 1878958 - RNA, 21 nt, Salmonella typhimurium LT2
agcacaucacucauaaugaug

SEQ ID NO: 1878959 - RNA, 16 nt, Salmonella typhimurium LT2
agcacagcccaguaau

SEQ ID NO: 1878960 - RNA, 19 nt, Salmonella typhimurium LT2
agcacaccauuucacaaau

SEQ ID NO: 1878961 - RNA, 15 nt, Salmonella typhimurium LT2
agcaccacgcccgga

SEQ ID NO: 1878962 - RNA, 15 nt, Salmonella typhimurium LT2
agcacaugcagauau

SEQ ID NO: 1878963 - RNA, 12 nt, Salmonella typhimurium LT2
agcacauccaug

SEQ ID NO: 1878964 - RNA, 14 nt, Salmonella typhimurium LT2
agcacauccucaau

SEQ ID NO: 1878965 - RNA, 21 nt, Salmonella typhimurium LT2
agcacaucgauuuugaccuga

SEQ ID NO: 1878966 - RNA, 17 nt, Salmonella typhimurium LT2
agcacgauauccagcac

SEQ ID NO: 1878967 - RNA, 15 nt, Salmonella typhimurium LT2
agcaccgccagcgcc

SEQ ID NO: 1878968 - RNA, 16 nt, Salmonella typhimurium LT2
agcaccgccgggaaga

SEQ ID NO: 1878969 - RNA, 21 nt, Salmonella typhimurium LT2
agcaccgccgggaagaaauua

SEQ ID NO: 1878970 - RNA, 21 nt, Salmonella typhimurium LT2
agcacgcuuuggcaggccucu

SEQ ID NO: 1878971 - RNA, 21 nt, Salmonella typhimurium LT2
agcacgccaccgggcuuuaau

SEQ ID NO: 1878972 - RNA, 17 nt, Salmonella typhimurium LT2
agcacgccuuccugguu

SEQ ID NO: 1878973 - RNA, 16 nt, Salmonella typhimurium LT2
agcacgcgcugcgccg

SEQ ID NO: 1878974 - RNA, 15 nt, Salmonella typhimurium LT2
agcacugcccaggac

SEQ ID NO: 1878975 - RNA, 14 nt, Salmonella typhimurium LT2
agcacuguggcggc

SEQ ID NO: 1878976 - RNA, 14 nt, Salmonella typhimurium LT2
agcagacaggugaa

SEQ ID NO: 1878977 - RNA, 13 nt, Salmonella typhimurium LT2
agcagacagguga

SEQ ID NO: 1878978 - RNA, 22 nt, Salmonella typhimurium LT2
agcagaccaccccacagcaaug

SEQ ID NO: 1878979 - RNA, 21 nt, Salmonella typhimurium LT2
agcagaacuggcgcgaugacu

SEQ ID NO: 1878980 - RNA, 15 nt, Salmonella typhimurium LT2
agcacaccauuucac

SEQ ID NO: 1878981 - RNA, 14 nt, Salmonella typhimurium LT2
agcacaaucagcgc

SEQ ID NO: 1878982 - RNA, 18 nt, Salmonella typhimurium LT2
agcacaauggucagcgcc

SEQ ID NO: 1878983 - RNA, 19 nt, Salmonella typhimurium LT2
agcaauuucucgcccgcca

SEQ ID NO: 1878984 - RNA, 12 nt, Salmonella typhimurium LT2
agcacaaaaagu

SEQ ID NO: 1878985 - RNA, 14 nt, Salmonella typhimurium LT2
agcacaaaaaucau

SEQ ID NO: 1878986 - RNA, 17 nt, Salmonella typhimurium LT2
agcacaaaaaucaugcu

SEQ ID NO: 1878987 - RNA, 13 nt, Salmonella typhimurium LT2
agcaaugggaagg

SEQ ID NO: 1878988 - RNA, 15 nt, Salmonella typhimurium LT2
agcaaugggaaggaa

SEQ ID NO: 1878989 - RNA, 15 nt, Salmonella typhimurium LT2
agcaauuaacaaaua

SEQ ID NO: 1878990 - RNA, 22 nt, Salmonella typhimurium LT2
agcaauuacggacagaaaaaau

SEQ ID NO: 1878991 - RNA, 20 nt, Salmonella typhimurium LT2
agcaaugcgaauaacaucau

SEQ ID NO: 1878992 - RNA, 15 nt, Salmonella typhimurium LT2
agcaaugcagaaguu

SEQ ID NO: 1878993 - RNA, 14 nt, Salmonella typhimurium LT2
agcaaugauuuuua

SEQ ID NO: 1878994 - RNA, 14 nt, Salmonella typhimurium LT2
agcaaucuggcagu

SEQ ID NO: 1878995 - RNA, 22 nt, Salmonella typhimurium LT2
agcaaucucuauaccauaaaug

SEQ ID NO: 1878996 - RNA, 22 nt, Salmonella typhimurium LT2
agcaauauuuuguaguuguuuu

SEQ ID NO: 1878997 - RNA, 13 nt, Salmonella typhimurium LT2
agcaaucaguuca

SEQ ID NO: 1878998 - RNA, 14 nt, Salmonella typhimurium LT2
agcaauaaaaggaa

SEQ ID NO: 1878999 - RNA, 17 nt, Salmonella typhimurium LT2
agcaauacagccagcac

SEQ ID NO: 1879000 - RNA, 15 nt, Salmonella typhimurium LT2
agcaacuguagaaug

SEQ ID NO: 1879001 - RNA, 18 nt, Salmonella typhimurium LT2
agcaacugaccaucuucg

SEQ ID NO: 1879002 - RNA, 22 nt, Salmonella typhimurium LT2
agcaacgggacggcggccagca

SEQ ID NO: 1879003 - RNA, 22 nt, Salmonella typhimurium LT2
agcaacgugaacugcgccugca

SEQ ID NO: 1879004 - RNA, 22 nt, Salmonella typhimurium LT2
agcaacguuuguaacagcagga

SEQ ID NO: 1879005 - RNA, 19 nt, Salmonella typhimurium LT2
agauuauuuuaucaucagc

SEQ ID NO: 1879006 - RNA, 19 nt, Salmonella typhimurium LT2
agauuaucggccagcgcca

SEQ ID NO: 1879007 - RNA, 16 nt, Salmonella typhimurium LT2
agauuauuucacuucg

SEQ ID NO: 1879008 - RNA, 14 nt, Salmonella typhimurium LT2
agcaagugcuggag

SEQ ID NO: 1879009 - RNA, 12 nt, Salmonella typhimurium LT2
agcaagaacaga

SEQ ID NO: 1879010 - RNA, 16 nt, Salmonella typhimurium LT2
agcaagaacagagcaa

SEQ ID NO: 1879011 - RNA, 21 nt, Salmonella typhimurium LT2
agcaagaagcagguguuauuu

SEQ ID NO: 1879012 - RNA, 11 nt, Salmonella typhimurium LT2
acucacauuca

SEQ ID NO: 1879013 - RNA, 21 nt, Salmonella typhimurium LT2
acucacauucauaaaagauca

SEQ ID NO: 1879014 - RNA, 15 nt, Salmonella typhimurium LT2
acucacgguuuuuau

SEQ ID NO: 1879015 - RNA, 18 nt, Salmonella typhimurium LT2
acucacgacuuucaccag

SEQ ID NO: 1879016 - RNA, 22 nt, Salmonella typhimurium LT2
acucaacgcccgcuuucaccau

SEQ ID NO: 1879017 - RNA, 17 nt, Salmonella typhimurium LT2
acucaacggucaaaaua

SEQ ID NO: 1879018 - RNA, 12 nt, Salmonella typhimurium LT2
acucaacaucau

SEQ ID NO: 1879019 - RNA, 15 nt, Salmonella typhimurium LT2
acucaacaucauuaa

SEQ ID NO: 1879020 - RNA, 22 nt, Salmonella typhimurium LT2
acucaaggcuauuagccaaagc

SEQ ID NO: 1879021 - RNA, 17 nt, Salmonella typhimurium LT2
acucaagcgaauccaga

SEQ ID NO: 1879022 - RNA, 23 nt, Salmonella typhimurium LT2
acucaauacauucaguacaauac

SEQ ID NO: 1879023 - RNA, 14 nt, Salmonella typhimurium LT2
acucaaucaggcua

SEQ ID NO: 1879024 - RNA, 19 nt, Salmonella typhimurium LT2
acuaucuuuaugucaguaa

SEQ ID NO: 1879025 - RNA, 12 nt, Salmonella typhimurium LT2
acucaaagaaaa

SEQ ID NO: 1879026 - RNA, 15 nt, Salmonella typhimurium LT2
acucaaaccugcgcc

SEQ ID NO: 1879027 - RNA, 21 nt, Salmonella typhimurium LT2
acguucggcguguagccaauc

SEQ ID NO: 1879028 - RNA, 15 nt, Salmonella typhimurium LT2
acguuccaacguuuc

SEQ ID NO: 1879029 - RNA, 15 nt, Salmonella typhimurium LT2
acguucaucauuuuc

SEQ ID NO: 1879030 - RNA, 18 nt, Salmonella typhimurium LT2
acguucaucauuuuccca

SEQ ID NO: 1879031 - RNA, 21 nt, Salmonella typhimurium LT2
acguucaucauuuucccacug

SEQ ID NO: 1879032 - RNA, 14 nt, Salmonella typhimurium LT2
acuacggcaaacac

SEQ ID NO: 1879033 - RNA, 16 nt, Salmonella typhimurium LT2
acuacgccuccugccg

SEQ ID NO: 1879034 - RNA, 17 nt, Salmonella typhimurium LT2
acuacguucaucaggca

SEQ ID NO: 1879035 - RNA, 15 nt, Salmonella typhimurium LT2
acuacgguaaaccag

SEQ ID NO: 1879036 - RNA, 19 nt, Salmonella typhimurium LT2
acuacuggcugguuucucc

SEQ ID NO: 1879037 - RNA, 13 nt, Salmonella typhimurium LT2
acuacuaaauccu

SEQ ID NO: 1879038 - RNA, 18 nt, Salmonella typhimurium LT2
acuacuaaauccuugagu

SEQ ID NO: 1879039 - RNA, 15 nt, Salmonella typhimurium LT2
acuacuuuuuuguag

SEQ ID NO: 1879040 - RNA, 14 nt, Salmonella typhimurium LT2
acuaguccugauau

SEQ ID NO: 1879041 - RNA, 23 nt, Salmonella typhimurium LT2
acuagcucagcuggauagagcau

SEQ ID NO: 1879042 - RNA, 16 nt, Salmonella typhimurium LT2
acuauccacagcgaau

SEQ ID NO: 1879043 - RNA, 16 nt, Salmonella typhimurium LT2
acuaucccauuuuuug

SEQ ID NO: 1879044 - RNA, 23 nt, Salmonella typhimurium LT2
acuauccuuacgguuacagcauc

SEQ ID NO: 1879045 - RNA, 17 nt, Salmonella typhimurium LT2
acuaucuucaaaaccgc

SEQ ID NO: 1879046 - RNA, 15 nt, Salmonella typhimurium LT2
acucagccagauacc

SEQ ID NO: 1879047 - RNA, 15 nt, Salmonella typhimurium LT2
acucagccaggucug

SEQ ID NO: 1879048 - RNA, 17 nt, Salmonella typhimurium LT2
acucagcgucaucacag

SEQ ID NO: 1879049 - RNA, 21 nt, Salmonella typhimurium LT2
acucagagagauccugagaaa

SEQ ID NO: 1879050 - RNA, 15 nt, Salmonella typhimurium LT2
acucacuugucuucu

SEQ ID NO: 1879051 - RNA, 21 nt, Salmonella typhimurium LT2
acucacgcaacaacaggccag

SEQ ID NO: 1879052 - RNA, 22 nt, Salmonella typhimurium LT2
acucagggugacagaagagaga

SEQ ID NO: 1879053 - RNA, 14 nt, Salmonella typhimurium LT2
acucaguuuccagc

SEQ ID NO: 1879054 - RNA, 17 nt, Salmonella typhimurium LT2
acucaguuuccagccag

SEQ ID NO: 1879055 - RNA, 21 nt, Salmonella typhimurium LT2
acucaucacagccacacugcu

SEQ ID NO: 1879056 - RNA, 20 nt, Salmonella typhimurium LT2
acucaucgucauccauccac

SEQ ID NO: 1879057 - RNA, 15 nt, Salmonella typhimurium LT2
acucauccauuuccg

SEQ ID NO: 1879058 - RNA, 21 nt, Salmonella typhimurium LT2
acucauccauuuccguuuuca

SEQ ID NO: 1879059 - RNA, 14 nt, Salmonella typhimurium LT2
acucaucggaacag

SEQ ID NO: 1879060 - RNA, 18 nt, Salmonella typhimurium LT2
acucaucgccgcaaugac

SEQ ID NO: 1879061 - RNA, 23 nt, Salmonella typhimurium LT2
acuccagacgaugauaauacauu

SEQ ID NO: 1879062 - RNA, 17 nt, Salmonella typhimurium LT2
acuccacccggagcaag

SEQ ID NO: 1879063 - RNA, 16 nt, Salmonella typhimurium LT2
acuccuucuaauucca

SEQ ID NO: 1879064 - RNA, 14 nt, Salmonella typhimurium LT2
acucgcgcuucagc

SEQ ID NO: 1879065 - RNA, 13 nt, Salmonella typhimurium LT2
acucgccugcgcu

SEQ ID NO: 1879066 - RNA, 21 nt, Salmonella typhimurium LT2
acuccauucccagcucuuuca

SEQ ID NO: 1879067 - RNA, 16 nt, Salmonella typhimurium LT2
acuccgcuauaaaaau

SEQ ID NO: 1879068 - RNA, 19 nt, Salmonella typhimurium LT2
acuccgcgauagagcgcgg

SEQ ID NO: 1879069 - RNA, 22 nt, Salmonella typhimurium LT2
acuccgccggcgcggaagggau

SEQ ID NO: 1879070 - RNA, 15 nt, Salmonella typhimurium LT2
acuccagcccaucag

SEQ ID NO: 1879071 - RNA, 21 nt, Salmonella typhimurium LT2
acuccagcccaucagucccca

SEQ ID NO: 1879072 - RNA, 20 nt, Salmonella typhimurium LT2
acuccagcaacgccgcaucc

SEQ ID NO: 1879073 - RNA, 17 nt, Salmonella typhimurium LT2
acuccagcacguccugg

SEQ ID NO: 1879074 - RNA, 20 nt, Salmonella typhimurium LT2
acugcuuagcucaucagccu

SEQ ID NO: 1879075 - RNA, 23 nt, Salmonella typhimurium LT2
acugcuuaaauuuuuugccgcuc

SEQ ID NO: 1879076 - RNA, 23 nt, Salmonella typhimurium LT2
acugcuguguccaggucaucacc

SEQ ID NO: 1879077 - RNA, 20 nt, Salmonella typhimurium LT2
acugcucauaacccuccugc

SEQ ID NO: 1879078 - RNA, 22 nt, Salmonella typhimurium LT2
acugcguuugaaauaccaggcg

SEQ ID NO: 1879079 - RNA, 13 nt, Salmonella typhimurium LT2
acugcuaguggau

SEQ ID NO: 1879080 - RNA, 15 nt, Salmonella typhimurium LT2
acugccguagcgcau

SEQ ID NO: 1879081 - RNA, 23 nt, Salmonella typhimurium LT2
acugccgcccaucgccacagcgg

SEQ ID NO: 1879082 - RNA, 18 nt, Salmonella typhimurium LT2
acugccgccgucaucugc

SEQ ID NO: 1879083 - RNA, 16 nt, Salmonella typhimurium LT2
acugccccgccacagc

SEQ ID NO: 1879084 - RNA, 15 nt, Salmonella typhimurium LT2
acugccgcccaucgc

SEQ ID NO: 1879085 - RNA, 15 nt, Salmonella typhimurium LT2
acugccagaccggcg

SEQ ID NO: 1879086 - RNA, 24 nt, Salmonella typhimurium LT2
acugcagugucaaauuguacuuuu

SEQ ID NO: 1879087 - RNA, 20 nt, Salmonella typhimurium LT2
acugccacgagccuucuggc

SEQ ID NO: 1879088 - RNA, 20 nt, Salmonella typhimurium LT2
acugcccagagaauauuggc

SEQ ID NO: 1879089 - RNA, 21 nt, Salmonella typhimurium LT2
acugccagggccaaucagaau

SEQ ID NO: 1879090 - RNA, 22 nt, Salmonella typhimurium LT2
acugcacgccaggguaauacug

SEQ ID NO: 1879091 - RNA, 15 nt, Salmonella typhimurium LT2
acugcaccaaauccu

SEQ ID NO: 1879092 - RNA, 18 nt, Salmonella typhimurium LT2
acugauuaauugcgacaa

SEQ ID NO: 1879093 - RNA, 22 nt, Salmonella typhimurium LT2
acugauggaguuucaucagcac

SEQ ID NO: 1879094 - RNA, 21 nt, Salmonella typhimurium LT2
acugauggcgcuaagccagcc

SEQ ID NO: 1879095 - RNA, 21 nt, Salmonella typhimurium LT2
acugauucaaaaggugagaaa

SEQ ID NO: 1879096 - RNA, 18 nt, Salmonella typhimurium LT2
acugauuccugccagacc

SEQ ID NO: 1879097 - RNA, 23 nt, Salmonella typhimurium LT2
acugacguugcgaaucagguaca

SEQ ID NO: 1879098 - RNA, 21 nt, Salmonella typhimurium LT2
acugacggcgcucuuuacaua

SEQ ID NO: 1879099 - RNA, 21 nt, Salmonella typhimurium LT2
acugacuauccacagcgaauu

SEQ ID NO: 1879100 - RNA, 20 nt, Salmonella typhimurium LT2
acugaauuacugcguaaacc

SEQ ID NO: 1879101 - RNA, 15 nt, Salmonella typhimurium LT2
acugaaugccauccc

SEQ ID NO: 1879102 - RNA, 17 nt, Salmonella typhimurium LT2
acugacagcagugacau

SEQ ID NO: 1879103 - RNA, 20 nt, Salmonella typhimurium LT2
acugacgacucucccaucaa

SEQ ID NO: 1879104 - RNA, 20 nt, Salmonella typhimurium LT2
acugaagauaaacagcagcg

SEQ ID NO: 1879105 - RNA, 12 nt, Salmonella typhimurium LT2
acugaauaccuu

SEQ ID NO: 1879106 - RNA, 17 nt, Salmonella typhimurium LT2
acucuauuaaaauaaau

SEQ ID NO: 1879107 - RNA, 15 nt, Salmonella typhimurium LT2
acucgugaagaucag

SEQ ID NO: 1879108 - RNA, 20 nt, Salmonella typhimurium LT2
acucuacgcgcugaccuuca

SEQ ID NO: 1879109 - RNA, 15 nt, Salmonella typhimurium LT2
acucguaagaggcgu

SEQ ID NO: 1879110 - RNA, 16 nt, Salmonella typhimurium LT2
acucgucaccgaauag

SEQ ID NO: 1879111 - RNA, 16 nt, Salmonella typhimurium LT2
acugggcgaagguggc

SEQ ID NO: 1879112 - RNA, 20 nt, Salmonella typhimurium LT2
acugggcgagggaggcaauc

SEQ ID NO: 1879113 - RNA, 15 nt, Salmonella typhimurium LT2
acuggucgcagccca

SEQ ID NO: 1879114 - RNA, 20 nt, Salmonella typhimurium LT2
acuggccguuuucccggcaa

SEQ ID NO: 1879115 - RNA, 17 nt, Salmonella typhimurium LT2
acuggcgacagccgcgu

SEQ ID NO: 1879116 - RNA, 16 nt, Salmonella typhimurium LT2
acuggccucccaguuc

SEQ ID NO: 1879117 - RNA, 16 nt, Salmonella typhimurium LT2
acuggcccccuguucc

SEQ ID NO: 1879118 - RNA, 20 nt, Salmonella typhimurium LT2
acugcuuccccaauugcugc

SEQ ID NO: 1879119 - RNA, 23 nt, Salmonella typhimurium LT2
acuggcggcucagggcaaagucu

SEQ ID NO: 1879120 - RNA, 18 nt, Salmonella typhimurium LT2
acuggcuuuccugaucaa

SEQ ID NO: 1879121 - RNA, 21 nt, Salmonella typhimurium LT2
acuggcuuuccugaucaauca

SEQ ID NO: 1879122 - RNA, 20 nt, Salmonella typhimurium LT2
acuguuuugucggucugaua

SEQ ID NO: 1879123 - RNA, 20 nt, Salmonella typhimurium LT2
acuguuuuaccaaaucaaua

SEQ ID NO: 1879124 - RNA, 14 nt, Salmonella typhimurium LT2
acuguuugcugaca

SEQ ID NO: 1879125 - RNA, 14 nt, Salmonella typhimurium LT2
acuguuuaaugcuu

SEQ ID NO: 1879126 - RNA, 17 nt, Salmonella typhimurium LT2
acuguuagcgaaacugc

SEQ ID NO: 1879127 - RNA, 16 nt, Salmonella typhimurium LT2
acugugggauuuuugg

SEQ ID NO: 1879128 - RNA, 18 nt, Salmonella typhimurium LT2
acugucgaaaccagcaua

SEQ ID NO: 1879129 - RNA, 15 nt, Salmonella typhimurium LT2
acuguccagaucuuc

SEQ ID NO: 1879130 - RNA, 15 nt, Salmonella typhimurium LT2
acugucagcaucagu

SEQ ID NO: 1879131 - RNA, 13 nt, Salmonella typhimurium LT2
acugucgcuggau

SEQ ID NO: 1879132 - RNA, 16 nt, Salmonella typhimurium LT2
acuguagcugagcggc

SEQ ID NO: 1879133 - RNA, 18 nt, Salmonella typhimurium LT2
acuguacgcgggaaauac

SEQ ID NO: 1879134 - RNA, 14 nt, Salmonella typhimurium LT2
acuguaaaucugcc

SEQ ID NO: 1879135 - RNA, 20 nt, Salmonella typhimurium LT2
acugucauggcuauuuugau

SEQ ID NO: 1879136 - RNA, 21 nt, Salmonella typhimurium LT2
acgccggggauaucaaugcgc

SEQ ID NO: 1879137 - RNA, 16 nt, Salmonella typhimurium LT2
acgccggugccugccg

SEQ ID NO: 1879138 - RNA, 15 nt, Salmonella typhimurium LT2
acgccggugccugcc

SEQ ID NO: 1879139 - RNA, 21 nt, Salmonella typhimurium LT2
acgccgucacaaagcccaccg

SEQ ID NO: 1879140 - RNA, 15 nt, Salmonella typhimurium LT2
acgccguccaggcuc

SEQ ID NO: 1879141 - RNA, 14 nt, Salmonella typhimurium LT2
acgccgucucuuuu

SEQ ID NO: 1879142 - RNA, 20 nt, Salmonella typhimurium LT2
acgccgcuggugcuguuuuu

SEQ ID NO: 1879143 - RNA, 16 nt, Salmonella typhimurium LT2
acgccggaugacacau

SEQ ID NO: 1879144 - RNA, 17 nt, Salmonella typhimurium LT2
acgccgccauccggcac

SEQ ID NO: 1879145 - RNA, 20 nt, Salmonella typhimurium LT2
acgccgccauccggcacagc

SEQ ID NO: 1879146 - RNA, 13 nt, Salmonella typhimurium LT2
acgccgccgccca

SEQ ID NO: 1879147 - RNA, 12 nt, Salmonella typhimurium LT2
acgccucugucu

SEQ ID NO: 1879148 - RNA, 22 nt, Salmonella typhimurium LT2
acgccuggcgcuuuaaaacgaa

SEQ ID NO: 1879149 - RNA, 14 nt, Salmonella typhimurium LT2
acgccugcccgguu

SEQ ID NO: 1879150 - RNA, 17 nt, Salmonella typhimurium LT2
acgccugaugcugcgag

SEQ ID NO: 1879151 - RNA, 15 nt, Salmonella typhimurium LT2
acgccugcaucaaca

SEQ ID NO: 1879152 - RNA, 20 nt, Salmonella typhimurium LT2
acgccucauccggccuggcg

SEQ ID NO: 1879153 - RNA, 19 nt, Salmonella typhimurium LT2
acgccuaccgcuucccaca

SEQ ID NO: 1879154 - RNA, 15 nt, Salmonella typhimurium LT2
acgccuuucuucacg

SEQ ID NO: 1879155 - RNA, 19 nt, Salmonella typhimurium LT2
acgccuuuacccuuacggc

SEQ ID NO: 1879156 - RNA, 17 nt, Salmonella typhimurium LT2
acgcgaaacgaaaccca

SEQ ID NO: 1879157 - RNA, 20 nt, Salmonella typhimurium LT2
acgcgaaacgaaacccaaau

SEQ ID NO: 1879158 - RNA, 19 nt, Salmonella typhimurium LT2
acgccuuccugccagcaca

SEQ ID NO: 1879159 - RNA, 20 nt, Salmonella typhimurium LT2
acgccuuauccggccugccc

SEQ ID NO: 1879160 - RNA, 16 nt, Salmonella typhimurium LT2
acgccuguaaugccgc

SEQ ID NO: 1879161 - RNA, 21 nt, Salmonella typhimurium LT2
acgccuguagcgcuuuuucca

SEQ ID NO: 1879162 - RNA, 15 nt, Salmonella typhimurium LT2
acgccauggccgcag

SEQ ID NO: 1879163 - RNA, 15 nt, Salmonella typhimurium LT2
acgauaugcugccga

SEQ ID NO: 1879164 - RNA, 11 nt, Salmonella typhimurium LT2
acgauauguuu

SEQ ID NO: 1879165 - RNA, 18 nt, Salmonella typhimurium LT2
acgcccagggcacgcucu

SEQ ID NO: 1879166 - RNA, 21 nt, Salmonella typhimurium LT2
acgcccaucagcaucccaccg

SEQ ID NO: 1879167 - RNA, 18 nt, Salmonella typhimurium LT2
acgccccaauaccacaac

SEQ ID NO: 1879168 - RNA, 15 nt, Salmonella typhimurium LT2
acgcccgcauucaua

SEQ ID NO: 1879169 - RNA, 22 nt, Salmonella typhimurium LT2
acgcccggcggguauggcaaug

SEQ ID NO: 1879170 - RNA, 16 nt, Salmonella typhimurium LT2
acgcccucaauaucuu

SEQ ID NO: 1879171 - RNA, 13 nt, Salmonella typhimurium LT2
acgccgcaaacgc

SEQ ID NO: 1879172 - RNA, 16 nt, Salmonella typhimurium LT2
acgccgaugacguggu

SEQ ID NO: 1879173 - RNA, 19 nt, Salmonella typhimurium LT2
acgccgaugguugccagac

SEQ ID NO: 1879174 - RNA, 22 nt, Salmonella typhimurium LT2
acgcucauuaacgacaacuucu

SEQ ID NO: 1879175 - RNA, 23 nt, Salmonella typhimurium LT2
acgcuaaucccgcucgccaggug

SEQ ID NO: 1879176 - RNA, 16 nt, Salmonella typhimurium LT2
acgcuaaaccacauga

SEQ ID NO: 1879177 - RNA, 21 nt, Salmonella typhimurium LT2
acgcuaaccucuauaguaaau

SEQ ID NO: 1879178 - RNA, 22 nt, Salmonella typhimurium LT2
acgcuaaccucuauaguaaauu

SEQ ID NO: 1879179 - RNA, 18 nt, Salmonella typhimurium LT2
acgcgugaacauggguuu

SEQ ID NO: 1879180 - RNA, 15 nt, Salmonella typhimurium LT2
acgcguucugaauaa

SEQ ID NO: 1879181 - RNA, 17 nt, Salmonella typhimurium LT2
acgcguucugaauaaau

SEQ ID NO: 1879182 - RNA, 19 nt, Salmonella typhimurium LT2
acgcgucagggcgauaaua

SEQ ID NO: 1879183 - RNA, 17 nt, Salmonella typhimurium LT2
acgcgucggcgcgggga

SEQ ID NO: 1879184 - RNA, 23 nt, Salmonella typhimurium LT2
acgcgucggcgcggggaacacaa

SEQ ID NO: 1879185 - RNA, 18 nt, Salmonella typhimurium LT2
acgcggugacuuuggccg

SEQ ID NO: 1879186 - RNA, 18 nt, Salmonella typhimurium LT2
acgcggucuuuuaaaaga

SEQ ID NO: 1879187 - RNA, 21 nt, Salmonella typhimurium LT2
acgcggucuuuuaaaagaccu

SEQ ID NO: 1879188 - RNA, 22 nt, Salmonella typhimurium LT2
acgcuguacauaacaucucacu

SEQ ID NO: 1879189 - RNA, 20 nt, Salmonella typhimurium LT2
acgcugcuccggcuuaaugc

SEQ ID NO: 1879190 - RNA, 20 nt, Salmonella typhimurium LT2
acgcuggcgcaaagaaggca

SEQ ID NO: 1879191 - RNA, 11 nt, Salmonella typhimurium LT2
acgcuccugga

SEQ ID NO: 1879192 - RNA, 14 nt, Salmonella typhimurium LT2
acgcucgcugaugg

SEQ ID NO: 1879193 - RNA, 18 nt, Salmonella typhimurium LT2
acgcuccuugagcgccug

SEQ ID NO: 1879194 - RNA, 20 nt, Salmonella typhimurium LT2
acgcugccauccucauuuug

SEQ ID NO: 1879195 - RNA, 20 nt, Salmonella typhimurium LT2
acgcugcuauuuugcgcuuu

SEQ ID NO: 1879196 - RNA, 15 nt, Salmonella typhimurium LT2
acgcugcgcaacagc

SEQ ID NO: 1879197 - RNA, 12 nt, Salmonella typhimurium LT2
acgcugcgccug

SEQ ID NO: 1879198 - RNA, 22 nt, Salmonella typhimurium LT2
acgcugcgccuggucuuccgca

SEQ ID NO: 1879199 - RNA, 14 nt, Salmonella typhimurium LT2
acgcgcuuguucgu

SEQ ID NO: 1879200 - RNA, 12 nt, Salmonella typhimurium LT2
acgcggaaguau

SEQ ID NO: 1879201 - RNA, 14 nt, Salmonella typhimurium LT2
acgcgcgcgaaaag

SEQ ID NO: 1879202 - RNA, 19 nt, Salmonella typhimurium LT2
acgcgcucaccuccgccac

SEQ ID NO: 1879203 - RNA, 16 nt, Salmonella typhimurium LT2
acgcggauugccgccc

SEQ ID NO: 1879204 - RNA, 17 nt, Salmonella typhimurium LT2
acgcggcgcuacggcgc

SEQ ID NO: 1879205 - RNA, 16 nt, Salmonella typhimurium LT2
acgcggguacgggacg

SEQ ID NO: 1879206 - RNA, 17 nt, Salmonella typhimurium LT2
acgcgccgagguuuuca

SEQ ID NO: 1879207 - RNA, 14 nt, Salmonella typhimurium LT2
acgcgccggaaggc

SEQ ID NO: 1879208 - RNA, 21 nt, Salmonella typhimurium LT2
acgcgccggaugagggcauaa

SEQ ID NO: 1879209 - RNA, 18 nt, Salmonella typhimurium LT2
acgcgccgccagcgacuu

SEQ ID NO: 1879210 - RNA, 21 nt, Salmonella typhimurium LT2
acgcgccagcagugggaaaau

SEQ ID NO: 1879211 - RNA, 20 nt, Salmonella typhimurium LT2
acgcgcaucaacgccaggca

SEQ ID NO: 1879212 - RNA, 16 nt, Salmonella typhimurium LT2
acgcgaaggccagcac

SEQ ID NO: 1879213 - RNA, 17 nt, Salmonella typhimurium LT2
acgcgaaggccagcacc

SEQ ID NO: 1879214 - RNA, 21 nt, Salmonella typhimurium LT2
acgcgacuuuccgccaccaga

SEQ ID NO: 1879215 - RNA, 22 nt, Salmonella typhimurium LT2
acgcgagcugccaguucauucc

SEQ ID NO: 1879216 - RNA, 17 nt, Salmonella typhimurium LT2
acgcgauauguuugcgc

SEQ ID NO: 1879217 - RNA, 16 nt, Salmonella typhimurium LT2
acgugauugcugacac

SEQ ID NO: 1879218 - RNA, 14 nt, Salmonella typhimurium LT2
acgugcauaaagcg

SEQ ID NO: 1879219 - RNA, 17 nt, Salmonella typhimurium LT2
acguggggguucaaguc

SEQ ID NO: 1879220 - RNA, 20 nt, Salmonella typhimurium LT2
acguggggguucaagucccc

SEQ ID NO: 1879221 - RNA, 21 nt, Salmonella typhimurium LT2
acgugggcuacggcucccucg

SEQ ID NO: 1879222 - RNA, 16 nt, Salmonella typhimurium LT2
acguguuaugcgccug

SEQ ID NO: 1879223 - RNA, 18 nt, Salmonella typhimurium LT2
acguguuuauccccgcug

SEQ ID NO: 1879224 - RNA, 16 nt, Salmonella typhimurium LT2
acgucgcucccggcac

SEQ ID NO: 1879225 - RNA, 13 nt, Salmonella typhimurium LT2
acgucgcccaccg

SEQ ID NO: 1879226 - RNA, 22 nt, Salmonella typhimurium LT2
acgucgacgccuuucuucacga

SEQ ID NO: 1879227 - RNA, 16 nt, Salmonella typhimurium LT2
acgucgaaaaucacug

SEQ ID NO: 1879228 - RNA, 15 nt, Salmonella typhimurium LT2
acguccauccgggua

SEQ ID NO: 1879229 - RNA, 21 nt, Salmonella typhimurium LT2
acguccauaccgguugcgcgc

SEQ ID NO: 1879230 - RNA, 19 nt, Salmonella typhimurium LT2
acguccauccggguaauuu

SEQ ID NO: 1879231 - RNA, 18 nt, Salmonella typhimurium LT2
acgucauuuuuucaauuu

SEQ ID NO: 1879232 - RNA, 16 nt, Salmonella typhimurium LT2
acgucauuuuuucaau

SEQ ID NO: 1879233 - RNA, 21 nt, Salmonella typhimurium LT2
acgucaguacguagccgcaaa

SEQ ID NO: 1879234 - RNA, 15 nt, Salmonella typhimurium LT2
acgucauaucaucca

SEQ ID NO: 1879235 - RNA, 14 nt, Salmonella typhimurium LT2
acgucaucaugaaa

SEQ ID NO: 1879236 - RNA, 23 nt, Salmonella typhimurium LT2
acgucaugccuuuuuuaccaauu

SEQ ID NO: 1879237 - RNA, 12 nt, Salmonella typhimurium LT2
acgucagcugga

SEQ ID NO: 1879238 - RNA, 19 nt, Salmonella typhimurium LT2
acgucagccgggauaauca

SEQ ID NO: 1879239 - RNA, 12 nt, Salmonella typhimurium LT2
acgucacuguca

SEQ ID NO: 1879240 - RNA, 16 nt, Salmonella typhimurium LT2
acgucacugucagcau

SEQ ID NO: 1879241 - RNA, 12 nt, Salmonella typhimurium LT2
acggugugccug

SEQ ID NO: 1879242 - RNA, 17 nt, Salmonella typhimurium LT2
acguauaauaauauccu

SEQ ID NO: 1879243 - RNA, 18 nt, Salmonella typhimurium LT2
acgucaccgcuuuuuuau

SEQ ID NO: 1879244 - RNA, 11 nt, Salmonella typhimurium LT2
acgucaccauc

SEQ ID NO: 1879245 - RNA, 22 nt, Salmonella typhimurium LT2
acgucaauguaauucaccaaau

SEQ ID NO: 1879246 - RNA, 15 nt, Salmonella typhimurium LT2
acgucaacaccucca

SEQ ID NO: 1879247 - RNA, 21 nt, Salmonella typhimurium LT2
acgucaacaccuccaguucag

SEQ ID NO: 1879248 - RNA, 18 nt, Salmonella typhimurium LT2
acgucaacucgcggccca

SEQ ID NO: 1879249 - RNA, 19 nt, Salmonella typhimurium LT2
acgggcauucccagaaagg

SEQ ID NO: 1879250 - RNA, 22 nt, Salmonella typhimurium LT2
acgggcauuguuaauccagagc

SEQ ID NO: 1879251 - RNA, 13 nt, Salmonella typhimurium LT2
acgggauuuucac

SEQ ID NO: 1879252 - RNA, 23 nt, Salmonella typhimurium LT2
acggcgucaccaccgcaggcagc

SEQ ID NO: 1879253 - RNA, 22 nt, Salmonella typhimurium LT2
acggcgcacacgaaauccaaac

SEQ ID NO: 1879254 - RNA, 19 nt, Salmonella typhimurium LT2
acgguaugaaacauauaua

SEQ ID NO: 1879255 - RNA, 21 nt, Salmonella typhimurium LT2
acgguaugaaacauauauauc

SEQ ID NO: 1879256 - RNA, 14 nt, Salmonella typhimurium LT2
acggucaaucauca

SEQ ID NO: 1879257 - RNA, 19 nt, Salmonella typhimurium LT2
acgcuguacgcuggcucuu

SEQ ID NO: 1879258 - RNA, 14 nt, Salmonella typhimurium LT2
acggcacacaggcc

SEQ ID NO: 1879259 - RNA, 14 nt, Salmonella typhimurium LT2
acggcaugaagcag

SEQ ID NO: 1879260 - RNA, 12 nt, Salmonella typhimurium LT2
acggcauaagcc

SEQ ID NO: 1879261 - RNA, 18 nt, Salmonella typhimurium LT2
acggcaguguuucccaac

SEQ ID NO: 1879262 - RNA, 20 nt, Salmonella typhimurium LT2
acggcagcgccauccggcac

SEQ ID NO: 1879263 - RNA, 17 nt, Salmonella typhimurium LT2
acggcagcucuuucaac

SEQ ID NO: 1879264 - RNA, 20 nt, Salmonella typhimurium LT2
acggcaggcccgauaaacgg

SEQ ID NO: 1879265 - RNA, 21 nt, Salmonella typhimurium LT2
acggcgaaauuaacgacauuu

SEQ ID NO: 1879266 - RNA, 14 nt, Salmonella typhimurium LT2
acggccugucuccg

SEQ ID NO: 1879267 - RNA, 15 nt, Salmonella typhimurium LT2
acggccugucuccgc

SEQ ID NO: 1879268 - RNA, 23 nt, Salmonella typhimurium LT2
acggccugcaaacgaaucaccuc

SEQ ID NO: 1879269 - RNA, 18 nt, Salmonella typhimurium LT2
acggcgauaccaguaaua

SEQ ID NO: 1879270 - RNA, 16 nt, Salmonella typhimurium LT2
acggcgauacugcucc

SEQ ID NO: 1879271 - RNA, 22 nt, Salmonella typhimurium LT2
acggcgacgcccgccaucugcu

SEQ ID NO: 1879272 - RNA, 14 nt, Salmonella typhimurium LT2
acggcgaccagcaa

SEQ ID NO: 1879273 - RNA, 17 nt, Salmonella typhimurium LT2
acggccagugaaauaaa

SEQ ID NO: 1879274 - RNA, 17 nt, Salmonella typhimurium LT2
acggcccauaucaauca

SEQ ID NO: 1879275 - RNA, 19 nt, Salmonella typhimurium LT2
accugcugguuauuaucca

SEQ ID NO: 1879276 - RNA, 23 nt, Salmonella typhimurium LT2
accugcuggcggcguaagcgggu

SEQ ID NO: 1879277 - RNA, 20 nt, Salmonella typhimurium LT2
accugcucgcccuguugcgc

SEQ ID NO: 1879278 - RNA, 21 nt, Salmonella typhimurium LT2
accugcucggcuaucgccacu

SEQ ID NO: 1879279 - RNA, 19 nt, Salmonella typhimurium LT2
accuggaugcugccugccu

SEQ ID NO: 1879280 - RNA, 20 nt, Salmonella typhimurium LT2
accuggaugcugccugccug

SEQ ID NO: 1879281 - RNA, 20 nt, Salmonella typhimurium LT2
accuggaaaggcuuuuuaau

SEQ ID NO: 1879282 - RNA, 19 nt, Salmonella typhimurium LT2
accugccguuuuccagccg

SEQ ID NO: 1879283 - RNA, 20 nt, Salmonella typhimurium LT2
accugcuccagauuacuaug

SEQ ID NO: 1879284 - RNA, 23 nt, Salmonella typhimurium LT2
accuccagcgaggccucuccucg

SEQ ID NO: 1879285 - RNA, 19 nt, Salmonella typhimurium LT2
accugauugccgguuguug

SEQ ID NO: 1879286 - RNA, 14 nt, Salmonella typhimurium LT2
accugccaggcuuc

SEQ ID NO: 1879287 - RNA, 20 nt, Salmonella typhimurium LT2
accugccaguccgcccgccu

SEQ ID NO: 1879288 - RNA, 22 nt, Salmonella typhimurium LT2
accugcacaucgccauuaaaag

SEQ ID NO: 1879289 - RNA, 13 nt, Salmonella typhimurium LT2
accugcagcagcu

SEQ ID NO: 1879290 - RNA, 21 nt, Salmonella typhimurium LT2
accugcaucccuuucuuuaca

SEQ ID NO: 1879291 - RNA, 14 nt, Salmonella typhimurium LT2
accugcauggggaa

SEQ ID NO: 1879292 - RNA, 17 nt, Salmonella typhimurium LT2
accuguaaccuuaaaag

SEQ ID NO: 1879293 - RNA, 14 nt, Salmonella typhimurium LT2
accuguacccggua

SEQ ID NO: 1879294 - RNA, 22 nt, Salmonella typhimurium LT2
accuguacccgguacuuucucc

SEQ ID NO: 1879295 - RNA, 19 nt, Salmonella typhimurium LT2
accuggccguugauaaagu

SEQ ID NO: 1879296 - RNA, 15 nt, Salmonella typhimurium LT2
accuggcggagcugc

SEQ ID NO: 1879297 - RNA, 11 nt, Salmonella typhimurium LT2
accuggcuggc

SEQ ID NO: 1879298 - RNA, 18 nt, Salmonella typhimurium LT2
accuucacacagugcgcg

SEQ ID NO: 1879299 - RNA, 21 nt, Salmonella typhimurium LT2
accuucaucucuuugcccguc

SEQ ID NO: 1879300 - RNA, 18 nt, Salmonella typhimurium LT2
accuucacgccgccaaag

SEQ ID NO: 1879301 - RNA, 17 nt, Salmonella typhimurium LT2
accuucaccugaauauc

SEQ ID NO: 1879302 - RNA, 15 nt, Salmonella typhimurium LT2
accuuguucuuccau

SEQ ID NO: 1879303 - RNA, 14 nt, Salmonella typhimurium LT2
accuuguucuucca

SEQ ID NO: 1879304 - RNA, 13 nt, Salmonella typhimurium LT2
accuuucuucucu

SEQ ID NO: 1879305 - RNA, 15 nt, Salmonella typhimurium LT2
accuucucuuuaugc

SEQ ID NO: 1879306 - RNA, 14 nt, Salmonella typhimurium LT2
accuucuucacuaa

SEQ ID NO: 1879307 - RNA, 13 nt, Salmonella typhimurium LT2
accuucuucgcuc

SEQ ID NO: 1879308 - RNA, 18 nt, Salmonella typhimurium LT2
acgagcauccagaucggc

SEQ ID NO: 1879309 - RNA, 20 nt, Salmonella typhimurium LT2
acgagcgcgucagcgccucc

SEQ ID NO: 1879310 - RNA, 22 nt, Salmonella typhimurium LT2
acgagcgggucaggaaacuggc

SEQ ID NO: 1879311 - RNA, 23 nt, Salmonella typhimurium LT2
acgaguggcggacgggugaguaa

SEQ ID NO: 1879312 - RNA, 17 nt, Salmonella typhimurium LT2
acgauaaagacacagau

SEQ ID NO: 1879313 - RNA, 23 nt, Salmonella typhimurium LT2
acgauaucgccuggugugaacau

SEQ ID NO: 1879314 - RNA, 20 nt, Salmonella typhimurium LT2
acgaccgccgacaaucguca

SEQ ID NO: 1879315 - RNA, 19 nt, Salmonella typhimurium LT2
acgaccaggaucagaccga

SEQ ID NO: 1879316 - RNA, 12 nt, Salmonella typhimurium LT2
acgaccagccaa

SEQ ID NO: 1879317 - RNA, 23 nt, Salmonella typhimurium LT2
acgaccaugguucccgccacuga

SEQ ID NO: 1879318 - RNA, 18 nt, Salmonella typhimurium LT2
acgaccccgccgagaauu

SEQ ID NO: 1879319 - RNA, 22 nt, Salmonella typhimurium LT2
acgacccccaccaugucaaggu

SEQ ID NO: 1879320 - RNA, 22 nt, Salmonella typhimurium LT2
acgaccggcacgguuaaugaaa

SEQ ID NO: 1879321 - RNA, 15 nt, Salmonella typhimurium LT2
acgacgcuccagaau

SEQ ID NO: 1879322 - RNA, 18 nt, Salmonella typhimurium LT2
acgacgaauaagcugaau

SEQ ID NO: 1879323 - RNA, 13 nt, Salmonella typhimurium LT2
acgacucaauaca

SEQ ID NO: 1879324 - RNA, 16 nt, Salmonella typhimurium LT2
acgacuagucaauaaa

SEQ ID NO: 1879325 - RNA, 22 nt, Salmonella typhimurium LT2
acgacguggaguccgaggcaug

SEQ ID NO: 1879326 - RNA, 22 nt, Salmonella typhimurium LT2
acgacgugggcuacggcucccu

SEQ ID NO: 1879327 - RNA, 14 nt, Salmonella typhimurium LT2
acgacguccacacc

SEQ ID NO: 1879328 - RNA, 21 nt, Salmonella typhimurium LT2
acgacggugcuauacaguaaa

SEQ ID NO: 1879329 - RNA, 16 nt, Salmonella typhimurium LT2
acgaaaaucauccgcu

SEQ ID NO: 1879330 - RNA, 21 nt, Salmonella typhimurium LT2
accuuuggaggagagcgucau

SEQ ID NO: 1879331 - RNA, 21 nt, Salmonella typhimurium LT2
accuuugggaaaauaaaugcu

SEQ ID NO: 1879332 - RNA, 15 nt, Salmonella typhimurium LT2
accuuuuacuucacg

SEQ ID NO: 1879333 - RNA, 15 nt, Salmonella typhimurium LT2
acgaauaacaaaaug

SEQ ID NO: 1879334 - RNA, 16 nt, Salmonella typhimurium LT2
acgaauaacaaaauga

SEQ ID NO: 1879335 - RNA, 12 nt, Salmonella typhimurium LT2
acgacagaauau

SEQ ID NO: 1879336 - RNA, 13 nt, Salmonella typhimurium LT2
acgacagaauaug

SEQ ID NO: 1879337 - RNA, 14 nt, Salmonella typhimurium LT2
acgacagaauaugc

SEQ ID NO: 1879338 - RNA, 20 nt, Salmonella typhimurium LT2
acgaaugucuuaaugcgguu

SEQ ID NO: 1879339 - RNA, 19 nt, Salmonella typhimurium LT2
acgaauggcggcguuuucc

SEQ ID NO: 1879340 - RNA, 22 nt, Salmonella typhimurium LT2
acgaaugccgauagucuccgcc

SEQ ID NO: 1879341 - RNA, 18 nt, Salmonella typhimurium LT2
acgaaucucgcugccgga

SEQ ID NO: 1879342 - RNA, 18 nt, Salmonella typhimurium LT2
acgacaacuucuaauuuu

SEQ ID NO: 1879343 - RNA, 15 nt, Salmonella typhimurium LT2
acgacaaaaauacca

SEQ ID NO: 1879344 - RNA, 16 nt, Salmonella typhimurium LT2
accguggucuccgccu

SEQ ID NO: 1879345 - RNA, 16 nt, Salmonella typhimurium LT2
accgugugcagugaca

SEQ ID NO: 1879346 - RNA, 22 nt, Salmonella typhimurium LT2
accgugugcagugacagaggaa

SEQ ID NO: 1879347 - RNA, 21 nt, Salmonella typhimurium LT2
accguuaacguuuuacgcugc

SEQ ID NO: 1879348 - RNA, 17 nt, Salmonella typhimurium LT2
accgugguuaccgccag

SEQ ID NO: 1879349 - RNA, 17 nt, Salmonella typhimurium LT2
accguucagaucgccaa

SEQ ID NO: 1879350 - RNA, 14 nt, Salmonella typhimurium LT2
accguuauccggca

SEQ ID NO: 1879351 - RNA, 22 nt, Salmonella typhimurium LT2
accguuaacguuuuacgcugcc

SEQ ID NO: 1879352 - RNA, 18 nt, Salmonella typhimurium LT2
accguuuaaaaacaucau

SEQ ID NO: 1879353 - RNA, 20 nt, Salmonella typhimurium LT2
accguuuaaucgcccugcgg

SEQ ID NO: 1879354 - RNA, 23 nt, Salmonella typhimurium LT2
accguugucggggcuuuaaugcu

SEQ ID NO: 1879355 - RNA, 15 nt, Salmonella typhimurium LT2
accguugcgcccauc

SEQ ID NO: 1879356 - RNA, 19 nt, Salmonella typhimurium LT2
accguugcgcccaucauca

SEQ ID NO: 1879357 - RNA, 14 nt, Salmonella typhimurium LT2
accgucagcagcac

SEQ ID NO: 1879358 - RNA, 16 nt, Salmonella typhimurium LT2
accgucagcuccggua

SEQ ID NO: 1879359 - RNA, 23 nt, Salmonella typhimurium LT2
accgucgaccagcguaccgucuc

SEQ ID NO: 1879360 - RNA, 18 nt, Salmonella typhimurium LT2
accgucgacgucuuucuu

SEQ ID NO: 1879361 - RNA, 17 nt, Salmonella typhimurium LT2
accguccgccaggccca

SEQ ID NO: 1879362 - RNA, 14 nt, Salmonella typhimurium LT2
accgucuugcugcg

SEQ ID NO: 1879363 - RNA, 15 nt, Salmonella typhimurium LT2
accgugcacgcugcg

SEQ ID NO: 1879364 - RNA, 18 nt, Salmonella typhimurium LT2
accgucuggcgaggcgcc

SEQ ID NO: 1879365 - RNA, 15 nt, Salmonella typhimurium LT2
accuccaaagcgcua

SEQ ID NO: 1879366 - RNA, 23 nt, Salmonella typhimurium LT2
accucauuucucaaaaacaccau

SEQ ID NO: 1879367 - RNA, 16 nt, Salmonella typhimurium LT2
accucaucccccagcc

SEQ ID NO: 1879368 - RNA, 17 nt, Salmonella typhimurium LT2
accucaucaccuacccu

SEQ ID NO: 1879369 - RNA, 13 nt, Salmonella typhimurium LT2
accuauuuuaaau

SEQ ID NO: 1879370 - RNA, 18 nt, Salmonella typhimurium LT2
accuaccuuauacccaua

SEQ ID NO: 1879371 - RNA, 13 nt, Salmonella typhimurium LT2
accuaccggcaua

SEQ ID NO: 1879372 - RNA, 17 nt, Salmonella typhimurium LT2
accuaccguaauacuuc

SEQ ID NO: 1879373 - RNA, 18 nt, Salmonella typhimurium LT2
accuacgcucauaaaaaa

SEQ ID NO: 1879374 - RNA, 17 nt, Salmonella typhimurium LT2
accuacgccaagcaccu

SEQ ID NO: 1879375 - RNA, 17 nt, Salmonella typhimurium LT2
accuaaaaaccagaacu

SEQ ID NO: 1879376 - RNA, 23 nt, Salmonella typhimurium LT2
accuaaaaaccagaacuuccaga

SEQ ID NO: 1879377 - RNA, 18 nt, Salmonella typhimurium LT2
accuacaagauuugcaau

SEQ ID NO: 1879378 - RNA, 21 nt, Salmonella typhimurium LT2
accuacaauuugaauuacccc

SEQ ID NO: 1879379 - RNA, 16 nt, Salmonella typhimurium LT2
accgggaucgggacau

SEQ ID NO: 1879380 - RNA, 14 nt, Salmonella typhimurium LT2
accgggcaggauac

SEQ ID NO: 1879381 - RNA, 18 nt, Salmonella typhimurium LT2
accgggcaggauacggcg

SEQ ID NO: 1879382 - RNA, 15 nt, Salmonella typhimurium LT2
accgguaaggcaggc

SEQ ID NO: 1879383 - RNA, 22 nt, Salmonella typhimurium LT2
accgggugcacgaacugcugcc

SEQ ID NO: 1879384 - RNA, 18 nt, Salmonella typhimurium LT2
accgguagccaggcgcga

SEQ ID NO: 1879385 - RNA, 20 nt, Salmonella typhimurium LT2
accgguauuaccaauauuaa

SEQ ID NO: 1879386 - RNA, 20 nt, Salmonella typhimurium LT2
accgggagaaaacgcggccu

SEQ ID NO: 1879387 - RNA, 22 nt, Salmonella typhimurium LT2
accggcagcgucguccagcccg

SEQ ID NO: 1879388 - RNA, 20 nt, Salmonella typhimurium LT2
accggcaggugauggcggcu

SEQ ID NO: 1879389 - RNA, 13 nt, Salmonella typhimurium LT2
accggcauuucac

SEQ ID NO: 1879390 - RNA, 17 nt, Salmonella typhimurium LT2
accguaaacgccugcac

SEQ ID NO: 1879391 - RNA, 13 nt, Salmonella typhimurium LT2
accgguuuuuccg

SEQ ID NO: 1879392 - RNA, 14 nt, Salmonella typhimurium LT2
accgguuuuuuccu

SEQ ID NO: 1879393 - RNA, 18 nt, Salmonella typhimurium LT2
accgucagccacuucuuc

SEQ ID NO: 1879394 - RNA, 22 nt, Salmonella typhimurium LT2
accguaguagguauccagcaga

SEQ ID NO: 1879395 - RNA, 19 nt, Salmonella typhimurium LT2
accguauccuuccagcccg

SEQ ID NO: 1879396 - RNA, 18 nt, Salmonella typhimurium LT2
accguauccuuccagccc

SEQ ID NO: 1879397 - RNA, 20 nt, Salmonella typhimurium LT2
accguauagcccauaauaac

SEQ ID NO: 1879398 - RNA, 18 nt, Salmonella typhimurium LT2
accgcuucccgcgucgcc

SEQ ID NO: 1879399 - RNA, 16 nt, Salmonella typhimurium LT2
accgcuuucccggcau

SEQ ID NO: 1879400 - RNA, 22 nt, Salmonella typhimurium LT2
accgcuuugccgcgcucuuuaa

SEQ ID NO: 1879401 - RNA, 17 nt, Salmonella typhimurium LT2
accgcuuucccggcaug

SEQ ID NO: 1879402 - RNA, 16 nt, Salmonella typhimurium LT2
accgcuucgcauugcg

SEQ ID NO: 1879403 - RNA, 18 nt, Salmonella typhimurium LT2
accggcacucaccucuuc

SEQ ID NO: 1879404 - RNA, 21 nt, Salmonella typhimurium LT2
accggaccuaauaaccagccc

SEQ ID NO: 1879405 - RNA, 14 nt, Salmonella typhimurium LT2
accggacaaacauu

SEQ ID NO: 1879406 - RNA, 21 nt, Salmonella typhimurium LT2
accggaacaguccaggaaaga

SEQ ID NO: 1879407 - RNA, 15 nt, Salmonella typhimurium LT2
accgcucgccgccuc

SEQ ID NO: 1879408 - RNA, 21 nt, Salmonella typhimurium LT2
accgcucgccgccucccccuc

SEQ ID NO: 1879409 - RNA, 15 nt, Salmonella typhimurium LT2
accgcuccgcgcauc

SEQ ID NO: 1879410 - RNA, 20 nt, Salmonella typhimurium LT2
accgcuccgcgcauccugca

SEQ ID NO: 1879411 - RNA, 19 nt, Salmonella typhimurium LT2
accgcucuccgcaauuaau

SEQ ID NO: 1879412 - RNA, 23 nt, Salmonella typhimurium LT2
accgcucacgguuucuacuucca

SEQ ID NO: 1879413 - RNA, 19 nt, Salmonella typhimurium LT2
accgcguuugcgcaacaga

SEQ ID NO: 1879414 - RNA, 23 nt, Salmonella typhimurium LT2
accgcguuuugcugaugaagcga

SEQ ID NO: 1879415 - RNA, 12 nt, Salmonella typhimurium LT2
accgcguuucca

SEQ ID NO: 1879416 - RNA, 17 nt, Salmonella typhimurium LT2
accgauuucaucgcuga

SEQ ID NO: 1879417 - RNA, 21 nt, Salmonella typhimurium LT2
accgcaaaccgaauucgucca

SEQ ID NO: 1879418 - RNA, 15 nt, Salmonella typhimurium LT2
accagcgccugcgcu

SEQ ID NO: 1879419 - RNA, 22 nt, Salmonella typhimurium LT2
accagcggaauccccgccgcca

SEQ ID NO: 1879420 - RNA, 17 nt, Salmonella typhimurium LT2
accagcggcaccagcac

SEQ ID NO: 1879421 - RNA, 17 nt, Salmonella typhimurium LT2
accagcgcuucgccugc

SEQ ID NO: 1879422 - RNA, 22 nt, Salmonella typhimurium LT2
accagcgcuucuguuaaaaaau

SEQ ID NO: 1879423 - RNA, 16 nt, Salmonella typhimurium LT2
accagcgcgccagcgc

SEQ ID NO: 1879424 - RNA, 18 nt, Salmonella typhimurium LT2
accagcgcgccagcgcca

SEQ ID NO: 1879425 - RNA, 18 nt, Salmonella typhimurium LT2
accagcgguuucaggcca

SEQ ID NO: 1879426 - RNA, 18 nt, Salmonella typhimurium LT2
accagcgucagcgggcca

SEQ ID NO: 1879427 - RNA, 19 nt, Salmonella typhimurium LT2
accagcguggcuauccaua

SEQ ID NO: 1879428 - RNA, 17 nt, Salmonella typhimurium LT2
accagcgugcgcucagg

SEQ ID NO: 1879429 - RNA, 19 nt, Salmonella typhimurium LT2
accagcgcaguaaacuccu

SEQ ID NO: 1879430 - RNA, 15 nt, Salmonella typhimurium LT2
accagcgccauaauc

SEQ ID NO: 1879431 - RNA, 18 nt, Salmonella typhimurium LT2
accagcgauaaacgccag

SEQ ID NO: 1879432 - RNA, 21 nt, Salmonella typhimurium LT2
accagcgauaaacgccagccc

SEQ ID NO: 1879433 - RNA, 23 nt, Salmonella typhimurium LT2
accagcgauaaacgccagcccuu

SEQ ID NO: 1879434 - RNA, 14 nt, Salmonella typhimurium LT2
accagccugccguc

SEQ ID NO: 1879435 - RNA, 21 nt, Salmonella typhimurium LT2
accagccggugcucgccguuc

SEQ ID NO: 1879436 - RNA, 15 nt, Salmonella typhimurium LT2
accagccuaaaaaca

SEQ ID NO: 1879437 - RNA, 17 nt, Salmonella typhimurium LT2
accagccuaaaaacaga

SEQ ID NO: 1879438 - RNA, 20 nt, Salmonella typhimurium LT2
accagcgaaaugacagccac

SEQ ID NO: 1879439 - RNA, 15 nt, Salmonella typhimurium LT2
accagcgacggccag

SEQ ID NO: 1879440 - RNA, 22 nt, Salmonella typhimurium LT2
accagcaucaauagcagcuuca

SEQ ID NO: 1879441 - RNA, 22 nt, Salmonella typhimurium LT2
accagcauaaugagccccggac

SEQ ID NO: 1879442 - RNA, 21 nt, Salmonella typhimurium LT2
accagcaggugguacaucaaa

SEQ ID NO: 1879443 - RNA, 22 nt, Salmonella typhimurium LT2
accagcaguguaucguugucgc

SEQ ID NO: 1879444 - RNA, 16 nt, Salmonella typhimurium LT2
accagccacugcgcca

SEQ ID NO: 1879445 - RNA, 18 nt, Salmonella typhimurium LT2
accagccgauaacucuuc

SEQ ID NO: 1879446 - RNA, 18 nt, Salmonella typhimurium LT2
accagccgaucaucacga

SEQ ID NO: 1879447 - RNA, 18 nt, Salmonella typhimurium LT2
accagcccaugaaugagc

SEQ ID NO: 1879448 - RNA, 12 nt, Salmonella typhimurium LT2
accagcccauga

SEQ ID NO: 1879449 - RNA, 14 nt, Salmonella typhimurium LT2
accagccccacggu

SEQ ID NO: 1879450 - RNA, 15 nt, Salmonella typhimurium LT2
accagccccaaaauu

SEQ ID NO: 1879451 - RNA, 14 nt, Salmonella typhimurium LT2
accagccccagccc

SEQ ID NO: 1879452 - RNA, 18 nt, Salmonella typhimurium LT2
accagccaggaaccgccg

SEQ ID NO: 1879453 - RNA, 20 nt, Salmonella typhimurium LT2
accaaccaggcaaaccagca

SEQ ID NO: 1879454 - RNA, 13 nt, Salmonella typhimurium LT2
accaacugccaaa

SEQ ID NO: 1879455 - RNA, 13 nt, Salmonella typhimurium LT2
accaacugcugcg

SEQ ID NO: 1879456 - RNA, 18 nt, Salmonella typhimurium LT2
accagacucaccccuucu

SEQ ID NO: 1879457 - RNA, 15 nt, Salmonella typhimurium LT2
accagacgaauaauc

SEQ ID NO: 1879458 - RNA, 16 nt, Salmonella typhimurium LT2
accagacgaauaaucu

SEQ ID NO: 1879459 - RNA, 17 nt, Salmonella typhimurium LT2
accagaauacacuucuc

SEQ ID NO: 1879460 - RNA, 18 nt, Salmonella typhimurium LT2
accagaaugcccaggccc

SEQ ID NO: 1879461 - RNA, 12 nt, Salmonella typhimurium LT2
accagcagcaga

SEQ ID NO: 1879462 - RNA, 17 nt, Salmonella typhimurium LT2
accagcagcacaaaaau

SEQ ID NO: 1879463 - RNA, 15 nt, Salmonella typhimurium LT2
accagcagcgggcug

SEQ ID NO: 1879464 - RNA, 17 nt, Salmonella typhimurium LT2
accagcaccgccagcgc

SEQ ID NO: 1879465 - RNA, 20 nt, Salmonella typhimurium LT2
accagcaaugauaacggcgc

SEQ ID NO: 1879466 - RNA, 22 nt, Salmonella typhimurium LT2
accagcaaugauaacggcgcca

SEQ ID NO: 1879467 - RNA, 14 nt, Salmonella typhimurium LT2
accagcacaaaaaa

SEQ ID NO: 1879468 - RNA, 16 nt, Salmonella typhimurium LT2
accagcaaugagacaa

SEQ ID NO: 1879469 - RNA, 14 nt, Salmonella typhimurium LT2
accagcacagccca

SEQ ID NO: 1879470 - RNA, 14 nt, Salmonella typhimurium LT2
accagcaccgccag

SEQ ID NO: 1879471 - RNA, 18 nt, Salmonella typhimurium LT2
accagaucaacauggugu

SEQ ID NO: 1879472 - RNA, 20 nt, Salmonella typhimurium LT2
accagauuccccaaucccac

SEQ ID NO: 1879473 - RNA, 16 nt, Salmonella typhimurium LT2
accagauaccccgcca

SEQ ID NO: 1879474 - RNA, 16 nt, Salmonella typhimurium LT2
accauccgcgccgaga

SEQ ID NO: 1879475 - RNA, 18 nt, Salmonella typhimurium LT2
accauauuuaucuaagaa

SEQ ID NO: 1879476 - RNA, 21 nt, Salmonella typhimurium LT2
accauccgguuuuaaauuccu

SEQ ID NO: 1879477 - RNA, 14 nt, Salmonella typhimurium LT2
accaucgccggaga

SEQ ID NO: 1879478 - RNA, 15 nt, Salmonella typhimurium LT2
accaucgcgcagcca

SEQ ID NO: 1879479 - RNA, 23 nt, Salmonella typhimurium LT2
accaucgcguugcaaucgccuga

SEQ ID NO: 1879480 - RNA, 17 nt, Salmonella typhimurium LT2
accauagcggcucagga

SEQ ID NO: 1879481 - RNA, 12 nt, Salmonella typhimurium LT2
accauagcagcc

SEQ ID NO: 1879482 - RNA, 18 nt, Salmonella typhimurium LT2
accaguugaccaaacagc

SEQ ID NO: 1879483 - RNA, 20 nt, Salmonella typhimurium LT2
accaguuuuuccguuuuaau

SEQ ID NO: 1879484 - RNA, 21 nt, Salmonella typhimurium LT2
accaguucacuccuaagagaa

SEQ ID NO: 1879485 - RNA, 16 nt, Salmonella typhimurium LT2
accaguuccccauacu

SEQ ID NO: 1879486 - RNA, 16 nt, Salmonella typhimurium LT2
accaguuaauuucuuu

SEQ ID NO: 1879487 - RNA, 14 nt, Salmonella typhimurium LT2
accaguucacuccu

SEQ ID NO: 1879488 - RNA, 22 nt, Salmonella typhimurium LT2
accagugcggcaaccaccagca

SEQ ID NO: 1879489 - RNA, 20 nt, Salmonella typhimurium LT2
accaggauagcgccuuguuu

SEQ ID NO: 1879490 - RNA, 15 nt, Salmonella typhimurium LT2
accaggcaaaccagc

SEQ ID NO: 1879491 - RNA, 17 nt, Salmonella typhimurium LT2
accaggcaaaccagcac

SEQ ID NO: 1879492 - RNA, 14 nt, Salmonella typhimurium LT2
accaggacaugcca

SEQ ID NO: 1879493 - RNA, 17 nt, Salmonella typhimurium LT2
accaggacaugccacuc

SEQ ID NO: 1879494 - RNA, 13 nt, Salmonella typhimurium LT2
accaggccccugc

SEQ ID NO: 1879495 - RNA, 18 nt, Salmonella typhimurium LT2
accagcuucucaguauga

SEQ ID NO: 1879496 - RNA, 17 nt, Salmonella typhimurium LT2
accagcucucccgccuc

SEQ ID NO: 1879497 - RNA, 23 nt, Salmonella typhimurium LT2
accagcucucccgccucgucaug

SEQ ID NO: 1879498 - RNA, 22 nt, Salmonella typhimurium LT2
accaggucuuaccuauuuuaaa

SEQ ID NO: 1879499 - RNA, 19 nt, Salmonella typhimurium LT2
accaggucuggcagggcag

SEQ ID NO: 1879500 - RNA, 21 nt, Salmonella typhimurium LT2
accaguacaauuuccugccac

SEQ ID NO: 1879501 - RNA, 18 nt, Salmonella typhimurium LT2
accagguccgacuucaug

SEQ ID NO: 1879502 - RNA, 23 nt, Salmonella typhimurium LT2
accagggcgucccgucccaccac

SEQ ID NO: 1879503 - RNA, 19 nt, Salmonella typhimurium LT2
accagggauuuugcuuuuu

SEQ ID NO: 1879504 - RNA, 15 nt, Salmonella typhimurium LT2
accaucuaaaucaau

SEQ ID NO: 1879505 - RNA, 22 nt, Salmonella typhimurium LT2
acccagcaauacagccagcaca

SEQ ID NO: 1879506 - RNA, 22 nt, Salmonella typhimurium LT2
acccagaaucagcaacacaauc

SEQ ID NO: 1879507 - RNA, 15 nt, Salmonella typhimurium LT2
acccacuucuuccag

SEQ ID NO: 1879508 - RNA, 14 nt, Salmonella typhimurium LT2
acccagugccacca

SEQ ID NO: 1879509 - RNA, 19 nt, Salmonella typhimurium LT2
acccauacucuuucccggc

SEQ ID NO: 1879510 - RNA, 20 nt, Salmonella typhimurium LT2
acccauacccuguuugauca

SEQ ID NO: 1879511 - RNA, 14 nt, Salmonella typhimurium LT2
acccagccccccua

SEQ ID NO: 1879512 - RNA, 22 nt, Salmonella typhimurium LT2
acccagcccaauacgccagccu

SEQ ID NO: 1879513 - RNA, 18 nt, Salmonella typhimurium LT2
acccagcuuucucacuug

SEQ ID NO: 1879514 - RNA, 16 nt, Salmonella typhimurium LT2
acccagcgaauuauga

SEQ ID NO: 1879515 - RNA, 17 nt, Salmonella typhimurium LT2
acccccucagcaaugau

SEQ ID NO: 1879516 - RNA, 14 nt, Salmonella typhimurium LT2
accccggccucgcc

SEQ ID NO: 1879517 - RNA, 13 nt, Salmonella typhimurium LT2
acccccuggccgg

SEQ ID NO: 1879518 - RNA, 20 nt, Salmonella typhimurium LT2
acccgauucugccaguucac

SEQ ID NO: 1879519 - RNA, 20 nt, Salmonella typhimurium LT2
acccgaucgccauccugcac

SEQ ID NO: 1879520 - RNA, 16 nt, Salmonella typhimurium LT2
acccgaccgucuuugu

SEQ ID NO: 1879521 - RNA, 15 nt, Salmonella typhimurium LT2
acccgacugccacca

SEQ ID NO: 1879522 - RNA, 20 nt, Salmonella typhimurium LT2
acccgauaccgccagcccca

SEQ ID NO: 1879523 - RNA, 17 nt, Salmonella typhimurium LT2
acccgacaguaaaaccc

SEQ ID NO: 1879524 - RNA, 19 nt, Salmonella typhimurium LT2
accccgucgaggaucaucu

SEQ ID NO: 1879525 - RNA, 18 nt, Salmonella typhimurium LT2
accccgugauucacccgc

SEQ ID NO: 1879526 - RNA, 17 nt, Salmonella typhimurium LT2
acccgaaagucaaaaua

SEQ ID NO: 1879527 - RNA, 17 nt, Salmonella typhimurium LT2
acccgguacuuucucca

SEQ ID NO: 1879528 - RNA, 19 nt, Salmonella typhimurium LT2
acccgcaguagcuaaugau

SEQ ID NO: 1879529 - RNA, 18 nt, Salmonella typhimurium LT2
acccuauugccacaauau

SEQ ID NO: 1879530 - RNA, 18 nt, Salmonella typhimurium LT2
acccuauuuugcgccugg

SEQ ID NO: 1879531 - RNA, 19 nt, Salmonella typhimurium LT2
acccuauuuugcgccuggg

SEQ ID NO: 1879532 - RNA, 16 nt, Salmonella typhimurium LT2
acccuacaucuccuua

SEQ ID NO: 1879533 - RNA, 16 nt, Salmonella typhimurium LT2
acccguauucuuugcg

SEQ ID NO: 1879534 - RNA, 20 nt, Salmonella typhimurium LT2
acccggugcggcaagcgcgc

SEQ ID NO: 1879535 - RNA, 22 nt, Salmonella typhimurium LT2
acccggugaaaaacaucggcaa

SEQ ID NO: 1879536 - RNA, 14 nt, Salmonella typhimurium LT2
acccuguauuuuuu

SEQ ID NO: 1879537 - RNA, 15 nt, Salmonella typhimurium LT2
acccuguucagcacc

SEQ ID NO: 1879538 - RNA, 18 nt, Salmonella typhimurium LT2
acccuguuugaucauggg

SEQ ID NO: 1879539 - RNA, 22 nt, Salmonella typhimurium LT2
acccugcgugaacgaccgccac

SEQ ID NO: 1879540 - RNA, 18 nt, Salmonella typhimurium LT2
acccucacugacauuacg

SEQ ID NO: 1879541 - RNA, 12 nt, Salmonella typhimurium LT2
accgaaccugcg

SEQ ID NO: 1879542 - RNA, 21 nt, Salmonella typhimurium LT2
accgaaaggguauacaaaaaa

SEQ ID NO: 1879543 - RNA, 16 nt, Salmonella typhimurium LT2
accgaaauccaccagc

SEQ ID NO: 1879544 - RNA, 18 nt, Salmonella typhimurium LT2
accgaaauccaccagcgg

SEQ ID NO: 1879545 - RNA, 14 nt, Salmonella typhimurium LT2
acccuuuggccacc

SEQ ID NO: 1879546 - RNA, 17 nt, Salmonella typhimurium LT2
accgaaacagucacgcu

SEQ ID NO: 1879547 - RNA, 16 nt, Salmonella typhimurium LT2
accgaaaaucuucuuc

SEQ ID NO: 1879548 - RNA, 18 nt, Salmonella typhimurium LT2
accgaaacgcauacgcag

SEQ ID NO: 1879549 - RNA, 14 nt, Salmonella typhimurium LT2
accgacaaaacagu

SEQ ID NO: 1879550 - RNA, 18 nt, Salmonella typhimurium LT2
accgauaaucaccagccc

SEQ ID NO: 1879551 - RNA, 13 nt, Salmonella typhimurium LT2
accgauaaauacc

SEQ ID NO: 1879552 - RNA, 22 nt, Salmonella typhimurium LT2
accgacagccauaccggcgcgc

SEQ ID NO: 1879553 - RNA, 17 nt, Salmonella typhimurium LT2
accgacagauagcccug

SEQ ID NO: 1879554 - RNA, 15 nt, Salmonella typhimurium LT2
accgacuaucagaaa

SEQ ID NO: 1879555 - RNA, 21 nt, Salmonella typhimurium LT2
accgacucccccagauucuga

SEQ ID NO: 1879556 - RNA, 17 nt, Salmonella typhimurium LT2
accgacgcguggugaag

SEQ ID NO: 1879557 - RNA, 15 nt, Salmonella typhimurium LT2
agcgucugcggcugg

SEQ ID NO: 1879558 - RNA, 14 nt, Salmonella typhimurium LT2
agcgucugcggcug

SEQ ID NO: 1879559 - RNA, 22 nt, Salmonella typhimurium LT2
agcgucuuagcuaucugcccug

SEQ ID NO: 1879560 - RNA, 22 nt, Salmonella typhimurium LT2
agcuccgcguauucucaaccag

SEQ ID NO: 1879561 - RNA, 18 nt, Salmonella typhimurium LT2
agcuccuccgauuugcuu

SEQ ID NO: 1879562 - RNA, 17 nt, Salmonella typhimurium LT2
agcuccugcgggagcug

SEQ ID NO: 1879563 - RNA, 13 nt, Salmonella typhimurium LT2
agcuccugcgggc

SEQ ID NO: 1879564 - RNA, 13 nt, Salmonella typhimurium LT2
agcgucacaggcu

SEQ ID NO: 1879565 - RNA, 18 nt, Salmonella typhimurium LT2
agcgucagcaccaguaca

SEQ ID NO: 1879566 - RNA, 17 nt, Salmonella typhimurium LT2
agcgucagcgggccaaa

SEQ ID NO: 1879567 - RNA, 12 nt, Salmonella typhimurium LT2
agcgucgccagu

SEQ ID NO: 1879568 - RNA, 16 nt, Salmonella typhimurium LT2
agcgucgccaguaaca

SEQ ID NO: 1879569 - RNA, 12 nt, Salmonella typhimurium LT2
agcgucgccugg

SEQ ID NO: 1879570 - RNA, 20 nt, Salmonella typhimurium LT2
agcucggcaaagcccaucac

SEQ ID NO: 1879571 - RNA, 21 nt, Salmonella typhimurium LT2
agcucggcaaagcccaucacc

SEQ ID NO: 1879572 - RNA, 20 nt, Salmonella typhimurium LT2
agcucgcaggccauaaaacg

SEQ ID NO: 1879573 - RNA, 13 nt, Salmonella typhimurium LT2
agcucgcccggua

SEQ ID NO: 1879574 - RNA, 23 nt, Salmonella typhimurium LT2
agcucuguggggggaacggcaga

SEQ ID NO: 1879575 - RNA, 19 nt, Salmonella typhimurium LT2
agcucuggaaaaauuguuu

SEQ ID NO: 1879576 - RNA, 15 nt, Salmonella typhimurium LT2
agcucuccuggaugc

SEQ ID NO: 1879577 - RNA, 20 nt, Salmonella typhimurium LT2
agcucgguucuucggcauaa

SEQ ID NO: 1879578 - RNA, 20 nt, Salmonella typhimurium LT2
agcucggcuucgacauagcc

SEQ ID NO: 1879579 - RNA, 14 nt, Salmonella typhimurium LT2
agcucguuauuucc

SEQ ID NO: 1879580 - RNA, 15 nt, Salmonella typhimurium LT2
agcucguuauuuccg

SEQ ID NO: 1879581 - RNA, 15 nt, Salmonella typhimurium LT2
agcucuucgaugacc

SEQ ID NO: 1879582 - RNA, 20 nt, Salmonella typhimurium LT2
agcucuucgcuuugaaucuc

SEQ ID NO: 1879583 - RNA, 16 nt, Salmonella typhimurium LT2
agcucuucaugcagcg

SEQ ID NO: 1879584 - RNA, 18 nt, Salmonella typhimurium LT2
agcugaauaaaaaaucuc

SEQ ID NO: 1879585 - RNA, 18 nt, Salmonella typhimurium LT2
agcugacaaugugccgga

SEQ ID NO: 1879586 - RNA, 18 nt, Salmonella typhimurium LT2
agcugaaugcuucgccac

SEQ ID NO: 1879587 - RNA, 16 nt, Salmonella typhimurium LT2
agcugacgcagcagcu

SEQ ID NO: 1879588 - RNA, 17 nt, Salmonella typhimurium LT2
agcugagcggcaaugag

SEQ ID NO: 1879589 - RNA, 15 nt, Salmonella typhimurium LT2
agcugagaguaaauu

SEQ ID NO: 1879590 - RNA, 20 nt, Salmonella typhimurium LT2
agcuguucguucgcaacauu

SEQ ID NO: 1879591 - RNA, 13 nt, Salmonella typhimurium LT2
agcuggcugacag

SEQ ID NO: 1879592 - RNA, 23 nt, Salmonella typhimurium LT2
agcuggcugacagaagccccgcu

SEQ ID NO: 1879593 - RNA, 20 nt, Salmonella typhimurium LT2
agcuggcgagaaaguggugg

SEQ ID NO: 1879594 - RNA, 21 nt, Salmonella typhimurium LT2
agcuggcaagaccgauagaga

SEQ ID NO: 1879595 - RNA, 15 nt, Salmonella typhimurium LT2
agcugcaccaggagc

SEQ ID NO: 1879596 - RNA, 15 nt, Salmonella typhimurium LT2
agcugauugaugcuu

SEQ ID NO: 1879597 - RNA, 16 nt, Salmonella typhimurium LT2
agcugcggcagaauca

SEQ ID NO: 1879598 - RNA, 20 nt, Salmonella typhimurium LT2
agcugcggcuauauaaaauc

SEQ ID NO: 1879599 - RNA, 19 nt, Salmonella typhimurium LT2
agcugcgcuuuuucaucau

SEQ ID NO: 1879600 - RNA, 20 nt, Salmonella typhimurium LT2
agcugcgcuuuuucaucauc

SEQ ID NO: 1879601 - RNA, 21 nt, Salmonella typhimurium LT2
agcugcgcuuuuucaucaucu

SEQ ID NO: 1879602 - RNA, 17 nt, Salmonella typhimurium LT2
agcuggauagagcauca

SEQ ID NO: 1879603 - RNA, 14 nt, Salmonella typhimurium LT2
agcugcgcgccgca

SEQ ID NO: 1879604 - RNA, 16 nt, Salmonella typhimurium LT2
agcugcgcagcacuuc

SEQ ID NO: 1879605 - RNA, 16 nt, Salmonella typhimurium LT2
agcugcgaucaaguuu

SEQ ID NO: 1879606 - RNA, 17 nt, Salmonella typhimurium LT2
agcugcgaucaaguuuu

SEQ ID NO: 1879607 - RNA, 22 nt, Salmonella typhimurium LT2
agcuuggccaguggggcugcug

SEQ ID NO: 1879608 - RNA, 18 nt, Salmonella typhimurium LT2
agcuuucugaauuucacg

SEQ ID NO: 1879609 - RNA, 12 nt, Salmonella typhimurium LT2
agcuuuuucuuu

SEQ ID NO: 1879610 - RNA, 15 nt, Salmonella typhimurium LT2
agcuuuuuauuacuu

SEQ ID NO: 1879611 - RNA, 11 nt, Salmonella typhimurium LT2
agcuuuuucuu

SEQ ID NO: 1879612 - RNA, 16 nt, Salmonella typhimurium LT2
agcuuuccaccagcca

SEQ ID NO: 1879613 - RNA, 18 nt, Salmonella typhimurium LT2
agcuuaaaaaauccugca

SEQ ID NO: 1879614 - RNA, 14 nt, Salmonella typhimurium LT2
agcuuauccugccc

SEQ ID NO: 1879615 - RNA, 23 nt, Salmonella typhimurium LT2
agcuuaucgaacugugagccuaa

SEQ ID NO: 1879616 - RNA, 20 nt, Salmonella typhimurium LT2
agcuuaucgccaaagauaua

SEQ ID NO: 1879617 - RNA, 23 nt, Salmonella typhimurium LT2
agcuuaucugaccaugccagcaa

SEQ ID NO: 1879618 - RNA, 14 nt, Salmonella typhimurium LT2
aggaccugauuaau

SEQ ID NO: 1879619 - RNA, 19 nt, Salmonella typhimurium LT2
aggaaugaaaacgaaucga

SEQ ID NO: 1879620 - RNA, 14 nt, Salmonella typhimurium LT2
aggaaugaaaacga

SEQ ID NO: 1879621 - RNA, 15 nt, Salmonella typhimurium LT2
aggaauccagcgcgc

SEQ ID NO: 1879622 - RNA, 16 nt, Salmonella typhimurium LT2
aggaauccagcgcgcc

SEQ ID NO: 1879623 - RNA, 17 nt, Salmonella typhimurium LT2
aggaauacccagcucag

SEQ ID NO: 1879624 - RNA, 20 nt, Salmonella typhimurium LT2
aggaauacccagcucagcuu

SEQ ID NO: 1879625 - RNA, 13 nt, Salmonella typhimurium LT2
aggaauaacgcgc

SEQ ID NO: 1879626 - RNA, 22 nt, Salmonella typhimurium LT2
aggaauaacaucguaaaucaaa

SEQ ID NO: 1879627 - RNA, 19 nt, Salmonella typhimurium LT2
aggaaguugcugauuaaaa

SEQ ID NO: 1879628 - RNA, 20 nt, Salmonella typhimurium LT2
aggaaacucgugaagaucag

SEQ ID NO: 1879629 - RNA, 13 nt, Salmonella typhimurium LT2
aggaauaacaucg

SEQ ID NO: 1879630 - RNA, 23 nt, Salmonella typhimurium LT2
aggaaacauaaggguaagcaaua

SEQ ID NO: 1879631 - RNA, 15 nt, Salmonella typhimurium LT2
aggaaaauaaugccu

SEQ ID NO: 1879632 - RNA, 13 nt, Salmonella typhimurium LT2
aggaaaacgcuuc

SEQ ID NO: 1879633 - RNA, 13 nt, Salmonella typhimurium LT2
aggaaaaacauau

SEQ ID NO: 1879634 - RNA, 16 nt, Salmonella typhimurium LT2
aggacucaaucacuua

SEQ ID NO: 1879635 - RNA, 16 nt, Salmonella typhimurium LT2
aggauacagccgacua

SEQ ID NO: 1879636 - RNA, 21 nt, Salmonella typhimurium LT2
aggauacggucgacaccagcg

SEQ ID NO: 1879637 - RNA, 21 nt, Salmonella typhimurium LT2
aggaguucgguuacaugcuga

SEQ ID NO: 1879638 - RNA, 15 nt, Salmonella typhimurium LT2
aggauauaagcgcca

SEQ ID NO: 1879639 - RNA, 13 nt, Salmonella typhimurium LT2
aggauauccugcg

SEQ ID NO: 1879640 - RNA, 16 nt, Salmonella typhimurium LT2
aggaucaucuccgacg

SEQ ID NO: 1879641 - RNA, 14 nt, Salmonella typhimurium LT2
aggaucaccgccac

SEQ ID NO: 1879642 - RNA, 20 nt, Salmonella typhimurium LT2
aggaucaaaaucgcgcccca

SEQ ID NO: 1879643 - RNA, 21 nt, Salmonella typhimurium LT2
aggauauucguccaccuaaag

SEQ ID NO: 1879644 - RNA, 16 nt, Salmonella typhimurium LT2
aggauauuuauuuuau

SEQ ID NO: 1879645 - RNA, 19 nt, Salmonella typhimurium LT2
aggaucauuggccagauaa

SEQ ID NO: 1879646 - RNA, 15 nt, Salmonella typhimurium LT2
aggaugaaugacugu

SEQ ID NO: 1879647 - RNA, 19 nt, Salmonella typhimurium LT2
aggaugaaugacuguccac

SEQ ID NO: 1879648 - RNA, 16 nt, Salmonella typhimurium LT2
aggccggacaaggcgg

SEQ ID NO: 1879649 - RNA, 20 nt, Salmonella typhimurium LT2
aggccggaacgacguucaga

SEQ ID NO: 1879650 - RNA, 23 nt, Salmonella typhimurium LT2
aggccggauaagcgaauccgaca

SEQ ID NO: 1879651 - RNA, 14 nt, Salmonella typhimurium LT2
aggccggauaagca

SEQ ID NO: 1879652 - RNA, 19 nt, Salmonella typhimurium LT2
aggccgccgggucagaaaa

SEQ ID NO: 1879653 - RNA, 20 nt, Salmonella typhimurium LT2
aggccauuaauauuuuauca

SEQ ID NO: 1879654 - RNA, 22 nt, Salmonella typhimurium LT2
aggcccguucacguuuuuacuc

SEQ ID NO: 1879655 - RNA, 22 nt, Salmonella typhimurium LT2
aggcccgguggcgccgcgccac

SEQ ID NO: 1879656 - RNA, 18 nt, Salmonella typhimurium LT2
aggccgccgcacaggcga

SEQ ID NO: 1879657 - RNA, 10 nt, Salmonella typhimurium LT2
aggccgccgc

SEQ ID NO: 1879658 - RNA, 23 nt, Salmonella typhimurium LT2
aggccgaauaagcgacagcgcca

SEQ ID NO: 1879659 - RNA, 23 nt, Salmonella typhimurium LT2
aggccgacaaaugacgucagcaa

SEQ ID NO: 1879660 - RNA, 23 nt, Salmonella typhimurium LT2
aggccagugccaaguaacacggc

SEQ ID NO: 1879661 - RNA, 14 nt, Salmonella typhimurium LT2
aggccagucugucg

SEQ ID NO: 1879662 - RNA, 15 nt, Salmonella typhimurium LT2
aggccaucacuggca

SEQ ID NO: 1879663 - RNA, 20 nt, Salmonella typhimurium LT2
aggcaucgcgccgccgggcu

SEQ ID NO: 1879664 - RNA, 19 nt, Salmonella typhimurium LT2
aggcauaauggaacugccu

SEQ ID NO: 1879665 - RNA, 14 nt, Salmonella typhimurium LT2
aggcauagaaaaag

SEQ ID NO: 1879666 - RNA, 11 nt, Salmonella typhimurium LT2
aggcaguuugc

SEQ ID NO: 1879667 - RNA, 13 nt, Salmonella typhimurium LT2
aggcauaaaaaaa

SEQ ID NO: 1879668 - RNA, 17 nt, Salmonella typhimurium LT2
aggcaucaacucgauac

SEQ ID NO: 1879669 - RNA, 19 nt, Salmonella typhimurium LT2
aggcauccgugaccugcug

SEQ ID NO: 1879670 - RNA, 19 nt, Salmonella typhimurium LT2
aggcagcaccucaauauga

SEQ ID NO: 1879671 - RNA, 20 nt, Salmonella typhimurium LT2
aggcagcguaauacaggcga

SEQ ID NO: 1879672 - RNA, 15 nt, Salmonella typhimurium LT2
aggcaggaaauccag

SEQ ID NO: 1879673 - RNA, 17 nt, Salmonella typhimurium LT2
aggcaggaaauccagca

SEQ ID NO: 1879674 - RNA, 17 nt, Salmonella typhimurium LT2
aggcaguaacucuauau

SEQ ID NO: 1879675 - RNA, 16 nt, Salmonella typhimurium LT2
aggcaggucugauaaa

SEQ ID NO: 1879676 - RNA, 15 nt, Salmonella typhimurium LT2
aggcagauucuucug

SEQ ID NO: 1879677 - RNA, 19 nt, Salmonella typhimurium LT2
aggcagcaggauauccugc

SEQ ID NO: 1879678 - RNA, 17 nt, Salmonella typhimurium LT2
aggcagagcgcgcucug

SEQ ID NO: 1879679 - RNA, 13 nt, Salmonella typhimurium LT2
aggcacaacaaua

SEQ ID NO: 1879680 - RNA, 23 nt, Salmonella typhimurium LT2
aggcaauauaccgucagcaccag

SEQ ID NO: 1879681 - RNA, 23 nt, Salmonella typhimurium LT2
aggcaauccuggcgcacauugcu

SEQ ID NO: 1879682 - RNA, 13 nt, Salmonella typhimurium LT2
aggcaaucggcca

SEQ ID NO: 1879683 - RNA, 20 nt, Salmonella typhimurium LT2
aggcaaacgcggugaaggca

SEQ ID NO: 1879684 - RNA, 14 nt, Salmonella typhimurium LT2
aggcaaaccagcac

SEQ ID NO: 1879685 - RNA, 16 nt, Salmonella typhimurium LT2
aggcaauaaacaucag

SEQ ID NO: 1879686 - RNA, 20 nt, Salmonella typhimurium LT2
aggauguuuugcggcuucag

SEQ ID NO: 1879687 - RNA, 21 nt, Salmonella typhimurium LT2
aggcugcggcacgcuaaacca

SEQ ID NO: 1879688 - RNA, 13 nt, Salmonella typhimurium LT2
aggcugcggauga

SEQ ID NO: 1879689 - RNA, 11 nt, Salmonella typhimurium LT2
aggcuggaaca

SEQ ID NO: 1879690 - RNA, 19 nt, Salmonella typhimurium LT2
aggcuggcgacaaucaauc

SEQ ID NO: 1879691 - RNA, 17 nt, Salmonella typhimurium LT2
aggcugugacugucguu

SEQ ID NO: 1879692 - RNA, 22 nt, Salmonella typhimurium LT2
aggcuccagguauugauaccuu

SEQ ID NO: 1879693 - RNA, 23 nt, Salmonella typhimurium LT2
aggcuacgaacgcgaaggccagc

SEQ ID NO: 1879694 - RNA, 22 nt, Salmonella typhimurium LT2
aggcuacgguacugcccaccuu

SEQ ID NO: 1879695 - RNA, 13 nt, Salmonella typhimurium LT2
aggcucaaauuug

SEQ ID NO: 1879696 - RNA, 21 nt, Salmonella typhimurium LT2
aggcucgcauucgcgagccuu

SEQ ID NO: 1879697 - RNA, 21 nt, Salmonella typhimurium LT2
aggcuccggcaccaaaccaua

SEQ ID NO: 1879698 - RNA, 13 nt, Salmonella typhimurium LT2
aggcggcgccgcg

SEQ ID NO: 1879699 - RNA, 18 nt, Salmonella typhimurium LT2
aggcggucuggauuuggc

SEQ ID NO: 1879700 - RNA, 16 nt, Salmonella typhimurium LT2
aggcguaaccgccauc

SEQ ID NO: 1879701 - RNA, 14 nt, Salmonella typhimurium LT2
aggcguaaccgcca

SEQ ID NO: 1879702 - RNA, 15 nt, Salmonella typhimurium LT2
aggcggguaauuugc

SEQ ID NO: 1879703 - RNA, 22 nt, Salmonella typhimurium LT2
aggcguuuuagccguucauagu

SEQ ID NO: 1879704 - RNA, 14 nt, Salmonella typhimurium LT2
aggcuacccagaca

SEQ ID NO: 1879705 - RNA, 19 nt, Salmonella typhimurium LT2
aggcuacccgcaauaccaa

SEQ ID NO: 1879706 - RNA, 13 nt, Salmonella typhimurium LT2
aggcuacccagac

SEQ ID NO: 1879707 - RNA, 20 nt, Salmonella typhimurium LT2
aggcguugugcugcggcaug

SEQ ID NO: 1879708 - RNA, 21 nt, Salmonella typhimurium LT2
aggcgugguggauauccagca

SEQ ID NO: 1879709 - RNA, 21 nt, Salmonella typhimurium LT2
aggcguuaccgggcaaacagc

SEQ ID NO: 1879710 - RNA, 17 nt, Salmonella typhimurium LT2
aggggauggcguauucc

SEQ ID NO: 1879711 - RNA, 15 nt, Salmonella typhimurium LT2
aggguguucaccauu

SEQ ID NO: 1879712 - RNA, 17 nt, Salmonella typhimurium LT2
aggguuuucaggaagga

SEQ ID NO: 1879713 - RNA, 18 nt, Salmonella typhimurium LT2
aggguuuucaggaaggag

SEQ ID NO: 1879714 - RNA, 12 nt, Salmonella typhimurium LT2
aggguuuugccg

SEQ ID NO: 1879715 - RNA, 20 nt, Salmonella typhimurium LT2
agggucgccgcgcccagcag

SEQ ID NO: 1879716 - RNA, 16 nt, Salmonella typhimurium LT2
aggcuucaaccguuuc

SEQ ID NO: 1879717 - RNA, 15 nt, Salmonella typhimurium LT2
aggcuuaccaaacag

SEQ ID NO: 1879718 - RNA, 16 nt, Salmonella typhimurium LT2
agggaucaucuucacu

SEQ ID NO: 1879719 - RNA, 20 nt, Salmonella typhimurium LT2
agggauaagaaagauaaaau

SEQ ID NO: 1879720 - RNA, 14 nt, Salmonella typhimurium LT2
agggcgacgucaga

SEQ ID NO: 1879721 - RNA, 18 nt, Salmonella typhimurium LT2
agggcgauauccagcgcc

SEQ ID NO: 1879722 - RNA, 21 nt, Salmonella typhimurium LT2
agggccgcguuaacgccguug

SEQ ID NO: 1879723 - RNA, 12 nt, Salmonella typhimurium LT2
agggcauuaaau

SEQ ID NO: 1879724 - RNA, 23 nt, Salmonella typhimurium LT2
agggcaugauuacagauauccac

SEQ ID NO: 1879725 - RNA, 13 nt, Salmonella typhimurium LT2
agguucccgcccu

SEQ ID NO: 1879726 - RNA, 19 nt, Salmonella typhimurium LT2
agguuauuguguuacaugu

SEQ ID NO: 1879727 - RNA, 17 nt, Salmonella typhimurium LT2
agguucgaauccuuccc

SEQ ID NO: 1879728 - RNA, 13 nt, Salmonella typhimurium LT2
aguaaaaagaaag

SEQ ID NO: 1879729 - RNA, 21 nt, Salmonella typhimurium LT2
aguaacggcaguguuucccaa

SEQ ID NO: 1879730 - RNA, 22 nt, Salmonella typhimurium LT2
aguaacgcguccaacuggcuuu

SEQ ID NO: 1879731 - RNA, 22 nt, Salmonella typhimurium LT2
aguaacucuauaucgacaggcg

SEQ ID NO: 1879732 - RNA, 18 nt, Salmonella typhimurium LT2
aguaacugcaaaucuucg

SEQ ID NO: 1879733 - RNA, 13 nt, Salmonella typhimurium LT2
aguaagacaaaaa

SEQ ID NO: 1879734 - RNA, 17 nt, Salmonella typhimurium LT2
aguaaccuauuuuaaaa

SEQ ID NO: 1879735 - RNA, 13 nt, Salmonella typhimurium LT2
aguaaauaacaaa

SEQ ID NO: 1879736 - RNA, 14 nt, Salmonella typhimurium LT2
aguaaauaacaaaa

SEQ ID NO: 1879737 - RNA, 13 nt, Salmonella typhimurium LT2
aguaaauaaaaac

SEQ ID NO: 1879738 - RNA, 16 nt, Salmonella typhimurium LT2
aguaaauaaaaaccau

SEQ ID NO: 1879739 - RNA, 17 nt, Salmonella typhimurium LT2
aguaaauaaaaaccauu

SEQ ID NO: 1879740 - RNA, 15 nt, Salmonella typhimurium LT2
aguaaaucaacuuuu

SEQ ID NO: 1879741 - RNA, 15 nt, Salmonella typhimurium LT2
aguaaauaagaaaau

SEQ ID NO: 1879742 - RNA, 16 nt, Salmonella typhimurium LT2
aguaagcgccagccgu

SEQ ID NO: 1879743 - RNA, 17 nt, Salmonella typhimurium LT2
aguaagcucaggccaau

SEQ ID NO: 1879744 - RNA, 17 nt, Salmonella typhimurium LT2
aguaaugccuucugaaa

SEQ ID NO: 1879745 - RNA, 19 nt, Salmonella typhimurium LT2
aguaaugauguuggggaga

SEQ ID NO: 1879746 - RNA, 15 nt, Salmonella typhimurium LT2
aguaaugacaaaaau

SEQ ID NO: 1879747 - RNA, 20 nt, Salmonella typhimurium LT2
aguacaaugcaaagaaaaac

SEQ ID NO: 1879748 - RNA, 23 nt, Salmonella typhimurium LT2
aguacaggguuugucagcauaaa

SEQ ID NO: 1879749 - RNA, 19 nt, Salmonella typhimurium LT2
aguacauaguucuggcuuu

SEQ ID NO: 1879750 - RNA, 11 nt, Salmonella typhimurium LT2
aguacaauacc

SEQ ID NO: 1879751 - RNA, 22 nt, Salmonella typhimurium LT2
aguacgcccgugacgccaggca

SEQ ID NO: 1879752 - RNA, 20 nt, Salmonella typhimurium LT2
aguacgggucugaauagcgc

SEQ ID NO: 1879753 - RNA, 15 nt, Salmonella typhimurium LT2
aguacggugaauauu

SEQ ID NO: 1879754 - RNA, 17 nt, Salmonella typhimurium LT2
aguaccugacuuuucca

SEQ ID NO: 1879755 - RNA, 20 nt, Salmonella typhimurium LT2
aguaccgaacagccaggcuu

SEQ ID NO: 1879756 - RNA, 17 nt, Salmonella typhimurium LT2
aguaccgccgccgggcc

SEQ ID NO: 1879757 - RNA, 20 nt, Salmonella typhimurium LT2
aguaccgccuuguccggccu

SEQ ID NO: 1879758 - RNA, 14 nt, Salmonella typhimurium LT2
agguguauguaacu

SEQ ID NO: 1879759 - RNA, 13 nt, Salmonella typhimurium LT2
agguggugcaggc

SEQ ID NO: 1879760 - RNA, 13 nt, Salmonella typhimurium LT2
aggugagcucuuu

SEQ ID NO: 1879761 - RNA, 12 nt, Salmonella typhimurium LT2
aggugaguaaau

SEQ ID NO: 1879762 - RNA, 14 nt, Salmonella typhimurium LT2
aggugauaccuguu

SEQ ID NO: 1879763 - RNA, 12 nt, Salmonella typhimurium LT2
aggugauaagca

SEQ ID NO: 1879764 - RNA, 19 nt, Salmonella typhimurium LT2
agguucagcgugcguucau

SEQ ID NO: 1879765 - RNA, 16 nt, Salmonella typhimurium LT2
agguuauucaggugga

SEQ ID NO: 1879766 - RNA, 14 nt, Salmonella typhimurium LT2
agguuaaccaugcc

SEQ ID NO: 1879767 - RNA, 14 nt, Salmonella typhimurium LT2
agguuaguaaugcc

SEQ ID NO: 1879768 - RNA, 16 nt, Salmonella typhimurium LT2
agguuacguucaucag

SEQ ID NO: 1879769 - RNA, 21 nt, Salmonella typhimurium LT2
aggucagguaagcgcuagcgc

SEQ ID NO: 1879770 - RNA, 21 nt, Salmonella typhimurium LT2
aggucaaccacgagagcaccg

SEQ ID NO: 1879771 - RNA, 23 nt, Salmonella typhimurium LT2
aggucaacccuauugccacaaua

SEQ ID NO: 1879772 - RNA, 15 nt, Salmonella typhimurium LT2
aggucacaucaucgc

SEQ ID NO: 1879773 - RNA, 14 nt, Salmonella typhimurium LT2
agguaaauccgcca

SEQ ID NO: 1879774 - RNA, 23 nt, Salmonella typhimurium LT2
agguaaagccgccauccggcauu

SEQ ID NO: 1879775 - RNA, 22 nt, Salmonella typhimurium LT2
agguaaaggcggaaaucagcac

SEQ ID NO: 1879776 - RNA, 15 nt, Salmonella typhimurium LT2
aggucugacaacuau

SEQ ID NO: 1879777 - RNA, 20 nt, Salmonella typhimurium LT2
aggucuugccaacaaagguu

SEQ ID NO: 1879778 - RNA, 18 nt, Salmonella typhimurium LT2
aggucuugauagcgauca

SEQ ID NO: 1879779 - RNA, 16 nt, Salmonella typhimurium LT2
agucagcauaaaaaag

SEQ ID NO: 1879780 - RNA, 13 nt, Salmonella typhimurium LT2
agucagcguuacu

SEQ ID NO: 1879781 - RNA, 17 nt, Salmonella typhimurium LT2
agucacuucaaccuuua

SEQ ID NO: 1879782 - RNA, 14 nt, Salmonella typhimurium LT2
agucaccagcagca

SEQ ID NO: 1879783 - RNA, 16 nt, Salmonella typhimurium LT2
agucaccagcagcaca

SEQ ID NO: 1879784 - RNA, 21 nt, Salmonella typhimurium LT2
agucacagaauacccuccgcc

SEQ ID NO: 1879785 - RNA, 17 nt, Salmonella typhimurium LT2
agucaaguuagcccccg

SEQ ID NO: 1879786 - RNA, 21 nt, Salmonella typhimurium LT2
agucaaccagcccuuccgccg

SEQ ID NO: 1879787 - RNA, 18 nt, Salmonella typhimurium LT2
aguagacagagaagcugc

SEQ ID NO: 1879788 - RNA, 20 nt, Salmonella typhimurium LT2
aguacuuucaccugcauacc

SEQ ID NO: 1879789 - RNA, 18 nt, Salmonella typhimurium LT2
aguacuuucuccugggau

SEQ ID NO: 1879790 - RNA, 14 nt, Salmonella typhimurium LT2
aguccauuuuccua

SEQ ID NO: 1879791 - RNA, 17 nt, Salmonella typhimurium LT2
aguccauuuccucaacc

SEQ ID NO: 1879792 - RNA, 19 nt, Salmonella typhimurium LT2
aguccacguuuuacuuccu

SEQ ID NO: 1879793 - RNA, 15 nt, Salmonella typhimurium LT2
aguccacuuucugua

SEQ ID NO: 1879794 - RNA, 20 nt, Salmonella typhimurium LT2
aguccacccucgucagugaa

SEQ ID NO: 1879795 - RNA, 15 nt, Salmonella typhimurium LT2
aguccagccauaauc

SEQ ID NO: 1879796 - RNA, 18 nt, Salmonella typhimurium LT2
agucauucuguagauacu

SEQ ID NO: 1879797 - RNA, 19 nt, Salmonella typhimurium LT2
agucauucuguagauacug

SEQ ID NO: 1879798 - RNA, 18 nt, Salmonella typhimurium LT2
agucauugcuaugccuga

SEQ ID NO: 1879799 - RNA, 14 nt, Salmonella typhimurium LT2
agucauggcuuuua

SEQ ID NO: 1879800 - RNA, 13 nt, Salmonella typhimurium LT2
agucaucugccag

SEQ ID NO: 1879801 - RNA, 21 nt, Salmonella typhimurium LT2
agucaucgucugcgucuucuu

SEQ ID NO: 1879802 - RNA, 15 nt, Salmonella typhimurium LT2
agucaggcgccagag

SEQ ID NO: 1879803 - RNA, 18 nt, Salmonella typhimurium LT2
agucaggcacaaaaaaca

SEQ ID NO: 1879804 - RNA, 15 nt, Salmonella typhimurium LT2
agucaguuuaugacu

SEQ ID NO: 1879805 - RNA, 17 nt, Salmonella typhimurium LT2
agucaguuuucaauauu

SEQ ID NO: 1879806 - RNA, 16 nt, Salmonella typhimurium LT2
agucuucauggucgga

SEQ ID NO: 1879807 - RNA, 17 nt, Salmonella typhimurium LT2
agucugugaggaaagcg

SEQ ID NO: 1879808 - RNA, 16 nt, Salmonella typhimurium LT2
agugacagaggaauga

SEQ ID NO: 1879809 - RNA, 19 nt, Salmonella typhimurium LT2
agugaauuaugaccaaugu

SEQ ID NO: 1879810 - RNA, 15 nt, Salmonella typhimurium LT2
agugaacacccugcc

SEQ ID NO: 1879811 - RNA, 12 nt, Salmonella typhimurium LT2
agugaaauaaau

SEQ ID NO: 1879812 - RNA, 16 nt, Salmonella typhimurium LT2
agucguuauccagauc

SEQ ID NO: 1879813 - RNA, 23 nt, Salmonella typhimurium LT2
agucuaaccgaugcccggcaauc

SEQ ID NO: 1879814 - RNA, 14 nt, Salmonella typhimurium LT2
agucuaaaaauaau

SEQ ID NO: 1879815 - RNA, 20 nt, Salmonella typhimurium LT2
agucuauguucaguaagaca

SEQ ID NO: 1879816 - RNA, 24 nt, Salmonella typhimurium LT2
agucgucauugaguuaguggucau

SEQ ID NO: 1879817 - RNA, 15 nt, Salmonella typhimurium LT2
agucgcagcggcugc

SEQ ID NO: 1879818 - RNA, 14 nt, Salmonella typhimurium LT2
agucgccagaaggc

SEQ ID NO: 1879819 - RNA, 14 nt, Salmonella typhimurium LT2
agucgccaggcaag

SEQ ID NO: 1879820 - RNA, 21 nt, Salmonella typhimurium LT2
agucgccaugaguucaauaug

SEQ ID NO: 1879821 - RNA, 14 nt, Salmonella typhimurium LT2
agucgccgcggcgc

SEQ ID NO: 1879822 - RNA, 18 nt, Salmonella typhimurium LT2
aguccccuuuucacccaa

SEQ ID NO: 1879823 - RNA, 19 nt, Salmonella typhimurium LT2
aguccccccccucgcacca

SEQ ID NO: 1879824 - RNA, 15 nt, Salmonella typhimurium LT2
agucccuaauagcgc

SEQ ID NO: 1879825 - RNA, 19 nt, Salmonella typhimurium LT2
agucccuguucgccacccg

SEQ ID NO: 1879826 - RNA, 21 nt, Salmonella typhimurium LT2
agucgaacuuugcgaaaaagu

SEQ ID NO: 1879827 - RNA, 20 nt, Salmonella typhimurium LT2
aguccugcgucgcuucgcca

SEQ ID NO: 1879828 - RNA, 22 nt, Salmonella typhimurium LT2
agugagauugacagaauaaugc

SEQ ID NO: 1879829 - RNA, 14 nt, Salmonella typhimurium LT2
agugauacauaguc

SEQ ID NO: 1879830 - RNA, 16 nt, Salmonella typhimurium LT2
aguggcggcacgcagg

SEQ ID NO: 1879831 - RNA, 15 nt, Salmonella typhimurium LT2
aguggcggaaaauag

SEQ ID NO: 1879832 - RNA, 23 nt, Salmonella typhimurium LT2
aguggaaaacagcauaauaaagc

SEQ ID NO: 1879833 - RNA, 16 nt, Salmonella typhimurium LT2
agugguuuuaagcuuc

SEQ ID NO: 1879834 - RNA, 16 nt, Salmonella typhimurium LT2
aguguaaaaauuuuug

SEQ ID NO: 1879835 - RNA, 16 nt, Salmonella typhimurium LT2
aguguaaguucauuua

SEQ ID NO: 1879836 - RNA, 19 nt, Salmonella typhimurium LT2
agugugauaagccccuuua

SEQ ID NO: 1879837 - RNA, 13 nt, Salmonella typhimurium LT2
agugucgccauaa

SEQ ID NO: 1879838 - RNA, 17 nt, Salmonella typhimurium LT2
agugucgccauaaauca

SEQ ID NO: 1879839 - RNA, 17 nt, Salmonella typhimurium LT2
aguguuaaacauauggc

SEQ ID NO: 1879840 - RNA, 23 nt, Salmonella typhimurium LT2
aguguucuuacggacgugggggu

SEQ ID NO: 1879841 - RNA, 20 nt, Salmonella typhimurium LT2
agugugccgccggguuuaag

SEQ ID NO: 1879842 - RNA, 19 nt, Salmonella typhimurium LT2
agugugccgucauccagca

SEQ ID NO: 1879843 - RNA, 18 nt, Salmonella typhimurium LT2
aguguuucccaacaaugc

SEQ ID NO: 1879844 - RNA, 21 nt, Salmonella typhimurium LT2
aguguuggaugaaccauauca

SEQ ID NO: 1879845 - RNA, 22 nt, Salmonella typhimurium LT2
aguguuggauuacgugcccggc

SEQ ID NO: 1879846 - RNA, 23 nt, Salmonella typhimurium LT2
aguuaacagaaugcugaacagcc

SEQ ID NO: 1879847 - RNA, 21 nt, Salmonella typhimurium LT2
aguuaacgcguuaaucacuac

SEQ ID NO: 1879848 - RNA, 19 nt, Salmonella typhimurium LT2
aguuaagcaacugauuaau

SEQ ID NO: 1879849 - RNA, 19 nt, Salmonella typhimurium LT2
aguuaagcggggguaacaa

SEQ ID NO: 1879850 - RNA, 15 nt, Salmonella typhimurium LT2
aguuaacuucuccuc

SEQ ID NO: 1879851 - RNA, 22 nt, Salmonella typhimurium LT2
aguugcuuaccuuguucuucca

SEQ ID NO: 1879852 - RNA, 13 nt, Salmonella typhimurium LT2
aguugcugauuaa

SEQ ID NO: 1879853 - RNA, 19 nt, Salmonella typhimurium LT2
aguugcguucccaguuccg

SEQ ID NO: 1879854 - RNA, 23 nt, Salmonella typhimurium LT2
aguugcugucgcucacgauaacg

SEQ ID NO: 1879855 - RNA, 17 nt, Salmonella typhimurium LT2
aguugcggcaacgugaa

SEQ ID NO: 1879856 - RNA, 18 nt, Salmonella typhimurium LT2
aguugaaaggaaaggucg

SEQ ID NO: 1879857 - RNA, 19 nt, Salmonella typhimurium LT2
aguucgccuucuucaucuu

SEQ ID NO: 1879858 - RNA, 22 nt, Salmonella typhimurium LT2
aguuauacagcaccugcucagg

SEQ ID NO: 1879859 - RNA, 19 nt, Salmonella typhimurium LT2
aguuagcgcccauaaugca

SEQ ID NO: 1879860 - RNA, 18 nt, Salmonella typhimurium LT2
aguuccgcaauccuggcu

SEQ ID NO: 1879861 - RNA, 13 nt, Salmonella typhimurium LT2
aguuccgccagac

SEQ ID NO: 1879862 - RNA, 19 nt, Salmonella typhimurium LT2
aguuccgccagacucagcc

SEQ ID NO: 1879863 - RNA, 19 nt, Salmonella typhimurium LT2
aguuccgcaaagcccauca

SEQ ID NO: 1879864 - RNA, 20 nt, Salmonella typhimurium LT2
aguuccgcaaagcccaucag

SEQ ID NO: 1879865 - RNA, 22 nt, Salmonella typhimurium LT2
aguucccuacucucgcaugggg

SEQ ID NO: 1879866 - RNA, 15 nt, Salmonella typhimurium LT2
aguucccgacaggcu

SEQ ID NO: 1879867 - RNA, 12 nt, Salmonella typhimurium LT2
aguuccggauac

SEQ ID NO: 1879868 - RNA, 11 nt, Salmonella typhimurium LT2
aguuccuccug

SEQ ID NO: 1879869 - RNA, 12 nt, Salmonella typhimurium LT2
aguuccuccugg

SEQ ID NO: 1879870 - RNA, 20 nt, Salmonella typhimurium LT2
aguuccuggagaacgagaaa

SEQ ID NO: 1879871 - RNA, 24 nt, Salmonella typhimurium LT2
aguuccugugcggcauagccuauc

SEQ ID NO: 1879872 - RNA, 16 nt, Salmonella typhimurium LT2
aguucagcagcaccac

SEQ ID NO: 1879873 - RNA, 14 nt, Salmonella typhimurium LT2
aguucauaaaugua

SEQ ID NO: 1879874 - RNA, 23 nt, Salmonella typhimurium LT2
aguucaguaugaucaugcccggc

SEQ ID NO: 1879875 - RNA, 20 nt, Salmonella typhimurium LT2
aguucaucauccugcagggu

SEQ ID NO: 1879876 - RNA, 17 nt, Salmonella typhimurium LT2
aguucaucacaaaauca

SEQ ID NO: 1879877 - RNA, 19 nt, Salmonella typhimurium LT2
aguucaucacaaaaucauu

SEQ ID NO: 1879878 - RNA, 16 nt, Salmonella typhimurium LT2
aguucauccagcagca

SEQ ID NO: 1879879 - RNA, 17 nt, Salmonella typhimurium LT2
aguucaguuaagcgggg

SEQ ID NO: 1879880 - RNA, 17 nt, Salmonella typhimurium LT2
aguucccagcgguggau

SEQ ID NO: 1879881 - RNA, 20 nt, Salmonella typhimurium LT2
auaacuuccuuugccuuucu

SEQ ID NO: 1879882 - RNA, 19 nt, Salmonella typhimurium LT2
auaaauugcggcaugaucu

SEQ ID NO: 1879883 - RNA, 20 nt, Salmonella typhimurium LT2
auaacgaccaaacaagaucg

SEQ ID NO: 1879884 - RNA, 19 nt, Salmonella typhimurium LT2
auaaauuucauccaugcca

SEQ ID NO: 1879885 - RNA, 20 nt, Salmonella typhimurium LT2
auaaauuucauccaugccaa

SEQ ID NO: 1879886 - RNA, 14 nt, Salmonella typhimurium LT2
auaacgauaaauuu

SEQ ID NO: 1879887 - RNA, 22 nt, Salmonella typhimurium LT2
auaacgcaggcgauagccccag

SEQ ID NO: 1879888 - RNA, 21 nt, Salmonella typhimurium LT2
auaacgccgcccccaugccgc

SEQ ID NO: 1879889 - RNA, 22 nt, Salmonella typhimurium LT2
auaacgccgaugccgccgacaa

SEQ ID NO: 1879890 - RNA, 15 nt, Salmonella typhimurium LT2
auaacguuguggaau

SEQ ID NO: 1879891 - RNA, 22 nt, Salmonella typhimurium LT2
auaacuauaauugcuuuuuucc

SEQ ID NO: 1879892 - RNA, 13 nt, Salmonella typhimurium LT2
auaagcgcagcgc

SEQ ID NO: 1879893 - RNA, 15 nt, Salmonella typhimurium LT2
auaagccugcgcgcc

SEQ ID NO: 1879894 - RNA, 18 nt, Salmonella typhimurium LT2
auaagccgcguucugucg

SEQ ID NO: 1879895 - RNA, 22 nt, Salmonella typhimurium LT2
auaagcagaacaaacagaccgc

SEQ ID NO: 1879896 - RNA, 21 nt, Salmonella typhimurium LT2
auaagcacaccauuucacaaa

SEQ ID NO: 1879897 - RNA, 18 nt, Salmonella typhimurium LT2
auaagcacaccauuucac

SEQ ID NO: 1879898 - RNA, 19 nt, Salmonella typhimurium LT2
auaagcaacugggcuugca

SEQ ID NO: 1879899 - RNA, 21 nt, Salmonella typhimurium LT2
auaagauaggagacgccgccc

SEQ ID NO: 1879900 - RNA, 20 nt, Salmonella typhimurium LT2
auaaggcgccguuuacagcc

SEQ ID NO: 1879901 - RNA, 20 nt, Salmonella typhimurium LT2
auaaggccugagcuuuccug

SEQ ID NO: 1879902 - RNA, 21 nt, Salmonella typhimurium LT2
auaaggccugagcuuuccuga

SEQ ID NO: 1879903 - RNA, 18 nt, Salmonella typhimurium LT2
auaaggugaaugcguuug

SEQ ID NO: 1879904 - RNA, 22 nt, Salmonella typhimurium LT2
auaagguacggcccguacugaa

SEQ ID NO: 1879905 - RNA, 18 nt, Salmonella typhimurium LT2
auaagguugccugccaga

SEQ ID NO: 1879906 - RNA, 22 nt, Salmonella typhimurium LT2
auaagcugggcgucaacgugaa

SEQ ID NO: 1879907 - RNA, 13 nt, Salmonella typhimurium LT2
auaagcugaaugg

SEQ ID NO: 1879908 - RNA, 23 nt, Salmonella typhimurium LT2
auaaugccucauuaaaaaaacau

SEQ ID NO: 1879909 - RNA, 21 nt, Salmonella typhimurium LT2
auaaugcccaccgauuucagc

SEQ ID NO: 1879910 - RNA, 16 nt, Salmonella typhimurium LT2
auaaugcgccaccacu

SEQ ID NO: 1879911 - RNA, 21 nt, Salmonella typhimurium LT2
auaaugcgccuugaguaucaa

SEQ ID NO: 1879912 - RNA, 16 nt, Salmonella typhimurium LT2
auaaucgcguuuuccu

SEQ ID NO: 1879913 - RNA, 17 nt, Salmonella typhimurium LT2
auaaucgguagcacuuu

SEQ ID NO: 1879914 - RNA, 20 nt, Salmonella typhimurium LT2
auaaucgguagcacuuuaaa

SEQ ID NO: 1879915 - RNA, 14 nt, Salmonella typhimurium LT2
auaaucgccgccgg

SEQ ID NO: 1879916 - RNA, 20 nt, Salmonella typhimurium LT2
auaauccgccuuuuccccca

SEQ ID NO: 1879917 - RNA, 21 nt, Salmonella typhimurium LT2
auaauuaaaucaauacugcca

SEQ ID NO: 1879918 - RNA, 19 nt, Salmonella typhimurium LT2
auaaguaccauugcccauu

SEQ ID NO: 1879919 - RNA, 14 nt, Salmonella typhimurium LT2
auaauauccagcac

SEQ ID NO: 1879920 - RNA, 16 nt, Salmonella typhimurium LT2
auaauauccagcacgc

SEQ ID NO: 1879921 - RNA, 16 nt, Salmonella typhimurium LT2
auaauaugcucaacuu

SEQ ID NO: 1879922 - RNA, 17 nt, Salmonella typhimurium LT2
auaauauuaucagcaau

SEQ ID NO: 1879923 - RNA, 18 nt, Salmonella typhimurium LT2
auaauauuaucagcaaua

SEQ ID NO: 1879924 - RNA, 19 nt, Salmonella typhimurium LT2
auaaucaacggucuugcca

SEQ ID NO: 1879925 - RNA, 20 nt, Salmonella typhimurium LT2
auaaucaacggucuugccag

SEQ ID NO: 1879926 - RNA, 20 nt, Salmonella typhimurium LT2
auaaaacucccggcggaaau

SEQ ID NO: 1879927 - RNA, 22 nt, Salmonella typhimurium LT2
auaaaagccgccauguuuuuua

SEQ ID NO: 1879928 - RNA, 12 nt, Salmonella typhimurium LT2
auaaaagaucau

SEQ ID NO: 1879929 - RNA, 21 nt, Salmonella typhimurium LT2
auaaaaagugcgcacucagaa

SEQ ID NO: 1879930 - RNA, 17 nt, Salmonella typhimurium LT2
auaaaaauagcuggcug

SEQ ID NO: 1879931 - RNA, 18 nt, Salmonella typhimurium LT2
auaaaaauagcuggcugu

SEQ ID NO: 1879932 - RNA, 12 nt, Salmonella typhimurium LT2
auaaaaaauuau

SEQ ID NO: 1879933 - RNA, 14 nt, Salmonella typhimurium LT2
auaaaaccauucaa

SEQ ID NO: 1879934 - RNA, 14 nt, Salmonella typhimurium LT2
auaaaaccggcaua

SEQ ID NO: 1879935 - RNA, 15 nt, Salmonella typhimurium LT2
aguuuuucaagaauu

SEQ ID NO: 1879936 - RNA, 14 nt, Salmonella typhimurium LT2
aguuuuuuucugcc

SEQ ID NO: 1879937 - RNA, 14 nt, Salmonella typhimurium LT2
auaaaaaacaucau

SEQ ID NO: 1879938 - RNA, 19 nt, Salmonella typhimurium LT2
aguuuugcuucaugcacaa

SEQ ID NO: 1879939 - RNA, 22 nt, Salmonella typhimurium LT2
aguuuucgggcagcguuccuga

SEQ ID NO: 1879940 - RNA, 12 nt, Salmonella typhimurium LT2
aguuuucuucuu

SEQ ID NO: 1879941 - RNA, 22 nt, Salmonella typhimurium LT2
auaaacgucccgacgaauaaca

SEQ ID NO: 1879942 - RNA, 14 nt, Salmonella typhimurium LT2
auaaacucagcaau

SEQ ID NO: 1879943 - RNA, 14 nt, Salmonella typhimurium LT2
auaaacgggaagua

SEQ ID NO: 1879944 - RNA, 22 nt, Salmonella typhimurium LT2
auaaacgcggccaucacgcugc

SEQ ID NO: 1879945 - RNA, 15 nt, Salmonella typhimurium LT2
auaaacgccugacga

SEQ ID NO: 1879946 - RNA, 15 nt, Salmonella typhimurium LT2
auaaacauuacguuu

SEQ ID NO: 1879947 - RNA, 22 nt, Salmonella typhimurium LT2
auaaacauuuuuuuugcaugau

SEQ ID NO: 1879948 - RNA, 12 nt, Salmonella typhimurium LT2
auaaacaccuua

SEQ ID NO: 1879949 - RNA, 16 nt, Salmonella typhimurium LT2
auaaacagguaaaaca

SEQ ID NO: 1879950 - RNA, 20 nt, Salmonella typhimurium LT2
auaaagaccggcacaaccgu

SEQ ID NO: 1879951 - RNA, 22 nt, Salmonella typhimurium LT2
auaaauuaacucucucuguaau

SEQ ID NO: 1879952 - RNA, 15 nt, Salmonella typhimurium LT2
auaaaucaaacgcac

SEQ ID NO: 1879953 - RNA, 23 nt, Salmonella typhimurium LT2
auaaauauugcaacgaucccuaa

SEQ ID NO: 1879954 - RNA, 16 nt, Salmonella typhimurium LT2
auaaaucaggaaaaag

SEQ ID NO: 1879955 - RNA, 13 nt, Salmonella typhimurium LT2
auaaaucagcaca

SEQ ID NO: 1879956 - RNA, 13 nt, Salmonella typhimurium LT2
auaaaucaucauc

SEQ ID NO: 1879957 - RNA, 13 nt, Salmonella typhimurium LT2
auaaaguuuauuu

SEQ ID NO: 1879958 - RNA, 13 nt, Salmonella typhimurium LT2
auaaauaaaaaau

SEQ ID NO: 1879959 - RNA, 12 nt, Salmonella typhimurium LT2
auaaauaaaauu

SEQ ID NO: 1879960 - RNA, 24 nt, Salmonella typhimurium LT2
aucauacugccgccgugggauugc

SEQ ID NO: 1879961 - RNA, 15 nt, Salmonella typhimurium LT2
aaaacgugguaaaaa

SEQ ID NO: 1879962 - RNA, 14 nt, Salmonella typhimurium LT2
aucauacugaacuc

SEQ ID NO: 1879963 - RNA, 16 nt, Salmonella typhimurium LT2
aucaucuucacuucac

SEQ ID NO: 1879964 - RNA, 19 nt, Salmonella typhimurium LT2
aucaucuucacuucacaaa

SEQ ID NO: 1879965 - RNA, 21 nt, Salmonella typhimurium LT2
aucaucuucacuucacaaaca

SEQ ID NO: 1879966 - RNA, 15 nt, Salmonella typhimurium LT2
aucaugccagccgac

SEQ ID NO: 1879967 - RNA, 11 nt, Salmonella typhimurium LT2
aucaugcccac

SEQ ID NO: 1879968 - RNA, 17 nt, Salmonella typhimurium LT2
aucaugacagauuuaau

SEQ ID NO: 1879969 - RNA, 14 nt, Salmonella typhimurium LT2
aaaacucugagcau

SEQ ID NO: 1879970 - RNA, 20 nt, Salmonella typhimurium LT2
aaaacucugagcauacacau

SEQ ID NO: 1879971 - RNA, 15 nt, Salmonella typhimurium LT2
aaaacugccaucaau

SEQ ID NO: 1879972 - RNA, 15 nt, Salmonella typhimurium LT2
aucaugguugaaaaa

SEQ ID NO: 1879973 - RNA, 14 nt, Salmonella typhimurium LT2
aucauggcucagau

SEQ ID NO: 1879974 - RNA, 13 nt, Salmonella typhimurium LT2
aucaugcuugcaa

SEQ ID NO: 1879975 - RNA, 17 nt, Salmonella typhimurium LT2
aucaugcuaaaagcgac

SEQ ID NO: 1879976 - RNA, 15 nt, Salmonella typhimurium LT2
aaaagaagaaaaaau

SEQ ID NO: 1879977 - RNA, 16 nt, Salmonella typhimurium LT2
aaaagaaucgccaggc

SEQ ID NO: 1879978 - RNA, 17 nt, Salmonella typhimurium LT2
aaaagaaucgccaggcg

SEQ ID NO: 1879979 - RNA, 16 nt, Salmonella typhimurium LT2
aucauucucuacgccc

SEQ ID NO: 1879980 - RNA, 19 nt, Salmonella typhimurium LT2
aucauucucuacgcccagu

SEQ ID NO: 1879981 - RNA, 14 nt, Salmonella typhimurium LT2
aucauugacuucaa

SEQ ID NO: 1879982 - RNA, 21 nt, Salmonella typhimurium LT2
auccaacacggcgcucaggau

SEQ ID NO: 1879983 - RNA, 15 nt, Salmonella typhimurium LT2
auccaacgaaacgca

SEQ ID NO: 1879984 - RNA, 17 nt, Salmonella typhimurium LT2
auccaaccgcugaccau

SEQ ID NO: 1879985 - RNA, 23 nt, Salmonella typhimurium LT2
auccaaccgcugaccaucaacaa

SEQ ID NO: 1879986 - RNA, 22 nt, Salmonella typhimurium LT2
auccaacgcgguuuucccuuuu

SEQ ID NO: 1879987 - RNA, 21 nt, Salmonella typhimurium LT2
auccaacgcuuugaucagcac

SEQ ID NO: 1879988 - RNA, 17 nt, Salmonella typhimurium LT2
auccaacucaguuucca

SEQ ID NO: 1879989 - RNA, 21 nt, Salmonella typhimurium LT2
auccacauuauucacgcuaug

SEQ ID NO: 1879990 - RNA, 15 nt, Salmonella typhimurium LT2
auccacauacugcaa

SEQ ID NO: 1879991 - RNA, 16 nt, Salmonella typhimurium LT2
auccacauacugcaau

SEQ ID NO: 1879992 - RNA, 23 nt, Salmonella typhimurium LT2
auccacgccgcuaucgaccagca

SEQ ID NO: 1879993 - RNA, 14 nt, Salmonella typhimurium LT2
auccacaaucgucg

SEQ ID NO: 1879994 - RNA, 20 nt, Salmonella typhimurium LT2
auccacugagcgcgccauga

SEQ ID NO: 1879995 - RNA, 22 nt, Salmonella typhimurium LT2
auccagagcggauaaauaguga

SEQ ID NO: 1879996 - RNA, 22 nt, Salmonella typhimurium LT2
auccagaggguaauuucuucca

SEQ ID NO: 1879997 - RNA, 19 nt, Salmonella typhimurium LT2
auccacggguuacaacugc

SEQ ID NO: 1879998 - RNA, 22 nt, Salmonella typhimurium LT2
auccacgucauaacgcgcauuc

SEQ ID NO: 1879999 - RNA, 23 nt, Salmonella typhimurium LT2
auccacucggcgcugucguucca

SEQ ID NO: 1880000 - RNA, 21 nt, Salmonella typhimurium LT2
auccagcucuuucaauccuuc

SEQ ID NO: 1880001 - RNA, 23 nt, Salmonella typhimurium LT2
auccagcggugcgcgguuaugcg

SEQ ID NO: 1880002 - RNA, 18 nt, Salmonella typhimurium LT2
auccagcgguagcggcac

SEQ ID NO: 1880003 - RNA, 18 nt, Salmonella typhimurium LT2
auccagcacgagugccag

SEQ ID NO: 1880004 - RNA, 22 nt, Salmonella typhimurium LT2
auccagcggaacucaucaucaa

SEQ ID NO: 1880005 - RNA, 15 nt, Salmonella typhimurium LT2
auccagcagcaggca

SEQ ID NO: 1880006 - RNA, 11 nt, Salmonella typhimurium LT2
auccagcagcc

SEQ ID NO: 1880007 - RNA, 10 nt, Salmonella typhimurium LT2
auccagcagc

SEQ ID NO: 1880008 - RNA, 17 nt, Salmonella typhimurium LT2
auccaucagccaggguu

SEQ ID NO: 1880009 - RNA, 14 nt, Salmonella typhimurium LT2
auccauauucuucg

SEQ ID NO: 1880010 - RNA, 22 nt, Salmonella typhimurium LT2
auccaguuuuuuacuuucaaaa

SEQ ID NO: 1880011 - RNA, 23 nt, Salmonella typhimurium LT2
auccauaccgcuuuguaaaacau

SEQ ID NO: 1880012 - RNA, 21 nt, Salmonella typhimurium LT2
auccaguaacgcguccaacug

SEQ ID NO: 1880013 - RNA, 17 nt, Salmonella typhimurium LT2
auccaguaauuuuuccg

SEQ ID NO: 1880014 - RNA, 16 nt, Salmonella typhimurium LT2
auccaguacaagcagg

SEQ ID NO: 1880015 - RNA, 15 nt, Salmonella typhimurium LT2
auccaguugaugaug

SEQ ID NO: 1880016 - RNA, 15 nt, Salmonella typhimurium LT2
auccaguuuuuucca

SEQ ID NO: 1880017 - RNA, 20 nt, Salmonella typhimurium LT2
auccaguuuuuuccagcgcg

SEQ ID NO: 1880018 - RNA, 18 nt, Salmonella typhimurium LT2
auccccaacaucaugucc

SEQ ID NO: 1880019 - RNA, 17 nt, Salmonella typhimurium LT2
aucccaugcaccagccc

SEQ ID NO: 1880020 - RNA, 19 nt, Salmonella typhimurium LT2
aucccaugcaccagcccca

SEQ ID NO: 1880021 - RNA, 18 nt, Salmonella typhimurium LT2
aucccacgggauugaacc

SEQ ID NO: 1880022 - RNA, 20 nt, Salmonella typhimurium LT2
aucccaccaauugccacaua

SEQ ID NO: 1880023 - RNA, 18 nt, Salmonella typhimurium LT2
aucccaccauaaagcgaa

SEQ ID NO: 1880024 - RNA, 11 nt, Salmonella typhimurium LT2
aucccacagcg

SEQ ID NO: 1880025 - RNA, 20 nt, Salmonella typhimurium LT2
auccaucgguucucugccau

SEQ ID NO: 1880026 - RNA, 12 nt, Salmonella typhimurium LT2
auccccagcgcu

SEQ ID NO: 1880027 - RNA, 14 nt, Salmonella typhimurium LT2
auccccugcuccug

SEQ ID NO: 1880028 - RNA, 22 nt, Salmonella typhimurium LT2
aucccgacccauacucuuuccc

SEQ ID NO: 1880029 - RNA, 22 nt, Salmonella typhimurium LT2
aucccgauuucgcuccacuggc

SEQ ID NO: 1880030 - RNA, 19 nt, Salmonella typhimurium LT2
auccggcaaaagaggcuaa

SEQ ID NO: 1880031 - RNA, 21 nt, Salmonella typhimurium LT2
auccggcaaaaugcccggcug

SEQ ID NO: 1880032 - RNA, 19 nt, Salmonella typhimurium LT2
auccggccugcaggcaacg

SEQ ID NO: 1880033 - RNA, 14 nt, Salmonella typhimurium LT2
auccggccuggcgc

SEQ ID NO: 1880034 - RNA, 17 nt, Salmonella typhimurium LT2
auccggcgaggcgauaa

SEQ ID NO: 1880035 - RNA, 20 nt, Salmonella typhimurium LT2
auccggcgucagcauggugu

SEQ ID NO: 1880036 - RNA, 13 nt, Salmonella typhimurium LT2
auccggcauuuuu

SEQ ID NO: 1880037 - RNA, 23 nt, Salmonella typhimurium LT2
auccggccuacucuugagccaga

SEQ ID NO: 1880038 - RNA, 16 nt, Salmonella typhimurium LT2
auccggcaagcgcugg

SEQ ID NO: 1880039 - RNA, 13 nt, Salmonella typhimurium LT2
auccggcaauaau

SEQ ID NO: 1880040 - RNA, 16 nt, Salmonella typhimurium LT2
auccggcaauuccgca

SEQ ID NO: 1880041 - RNA, 18 nt, Salmonella typhimurium LT2
auccggcaauuuauaccg

SEQ ID NO: 1880042 - RNA, 21 nt, Salmonella typhimurium LT2
auccguucaucgguaauauua

SEQ ID NO: 1880043 - RNA, 12 nt, Salmonella typhimurium LT2
auccguuuucag

SEQ ID NO: 1880044 - RNA, 16 nt, Salmonella typhimurium LT2
auccuaaaucugccau

SEQ ID NO: 1880045 - RNA, 15 nt, Salmonella typhimurium LT2
auccguccucuuucc

SEQ ID NO: 1880046 - RNA, 14 nt, Salmonella typhimurium LT2
auccguccucuuuc

SEQ ID NO: 1880047 - RNA, 14 nt, Salmonella typhimurium LT2
auccgugaccugcu

SEQ ID NO: 1880048 - RNA, 20 nt, Salmonella typhimurium LT2
auccguagccaacacaucag

SEQ ID NO: 1880049 - RNA, 22 nt, Salmonella typhimurium LT2
auccguagccaacacaucagca

SEQ ID NO: 1880050 - RNA, 16 nt, Salmonella typhimurium LT2
auccuuucucugguuu

SEQ ID NO: 1880051 - RNA, 20 nt, Salmonella typhimurium LT2
auccuuuacuauagauauua

SEQ ID NO: 1880052 - RNA, 13 nt, Salmonella typhimurium LT2
auccuuccagccc

SEQ ID NO: 1880053 - RNA, 14 nt, Salmonella typhimurium LT2
auccuuccagcccg

SEQ ID NO: 1880054 - RNA, 14 nt, Salmonella typhimurium LT2
auccuuccagcgcc

SEQ ID NO: 1880055 - RNA, 22 nt, Salmonella typhimurium LT2
auccuuccagcgccauaagacu

SEQ ID NO: 1880056 - RNA, 15 nt, Salmonella typhimurium LT2
auccugaugcgccuc

SEQ ID NO: 1880057 - RNA, 15 nt, Salmonella typhimurium LT2
auccugauuaaguuu

SEQ ID NO: 1880058 - RNA, 16 nt, Salmonella typhimurium LT2
auccugacucaccagc

SEQ ID NO: 1880059 - RNA, 18 nt, Salmonella typhimurium LT2
auccugacucaccagcac

SEQ ID NO: 1880060 - RNA, 19 nt, Salmonella typhimurium LT2
auccuguucauccacagaa

SEQ ID NO: 1880061 - RNA, 13 nt, Salmonella typhimurium LT2
auccuguucaaac

SEQ ID NO: 1880062 - RNA, 23 nt, Salmonella typhimurium LT2
auccucauuuuguugcuccagca

SEQ ID NO: 1880063 - RNA, 22 nt, Salmonella typhimurium LT2
auccucauaaauagccagcauc

SEQ ID NO: 1880064 - RNA, 15 nt, Salmonella typhimurium LT2
auccucaauguuaac

SEQ ID NO: 1880065 - RNA, 22 nt, Salmonella typhimurium LT2
auccugaaccagcggcaccagc

SEQ ID NO: 1880066 - RNA, 20 nt, Salmonella typhimurium LT2
auccucuuggguuauuucga

SEQ ID NO: 1880067 - RNA, 18 nt, Salmonella typhimurium LT2
auccucuuggguuauuuc

SEQ ID NO: 1880068 - RNA, 16 nt, Salmonella typhimurium LT2
auccucgcauccucca

SEQ ID NO: 1880069 - RNA, 15 nt, Salmonella typhimurium LT2
aucgcgaggcaacag

SEQ ID NO: 1880070 - RNA, 13 nt, Salmonella typhimurium LT2
aucgcgagaaaau

SEQ ID NO: 1880071 - RNA, 19 nt, Salmonella typhimurium LT2
aucgcgauacugccgccca

SEQ ID NO: 1880072 - RNA, 22 nt, Salmonella typhimurium LT2
aucgccuggugugaacaucacg

SEQ ID NO: 1880073 - RNA, 22 nt, Salmonella typhimurium LT2
aucgccuuugccaagaaacgca

SEQ ID NO: 1880074 - RNA, 19 nt, Salmonella typhimurium LT2
aucgcgcaguguaaagcgu

SEQ ID NO: 1880075 - RNA, 16 nt, Salmonella typhimurium LT2
aucgcgcagacagugg

SEQ ID NO: 1880076 - RNA, 20 nt, Salmonella typhimurium LT2
aucgcgcacaugcugugcgc

SEQ ID NO: 1880077 - RNA, 19 nt, Salmonella typhimurium LT2
aucgcguugcaaucgccug

SEQ ID NO: 1880078 - RNA, 15 nt, Salmonella typhimurium LT2
aucgcgugcaacagu

SEQ ID NO: 1880079 - RNA, 19 nt, Salmonella typhimurium LT2
aucgcgucucccagaugaa

SEQ ID NO: 1880080 - RNA, 19 nt, Salmonella typhimurium LT2
aucgcgucugacagcgcgc

SEQ ID NO: 1880081 - RNA, 17 nt, Salmonella typhimurium LT2
aucgcugccuugaguga

SEQ ID NO: 1880082 - RNA, 18 nt, Salmonella typhimurium LT2
aucgcugccuugagugac

SEQ ID NO: 1880083 - RNA, 16 nt, Salmonella typhimurium LT2
aucgccugaugaccgc

SEQ ID NO: 1880084 - RNA, 18 nt, Salmonella typhimurium LT2
aucgccugcgcgccugac

SEQ ID NO: 1880085 - RNA, 22 nt, Salmonella typhimurium LT2
aucgccggagccgccuggccug

SEQ ID NO: 1880086 - RNA, 22 nt, Salmonella typhimurium LT2
aucgcccccaucgugauaaagg

SEQ ID NO: 1880087 - RNA, 15 nt, Salmonella typhimurium LT2
aucgcccaucacaug

SEQ ID NO: 1880088 - RNA, 14 nt, Salmonella typhimurium LT2
aucgccccagccga

SEQ ID NO: 1880089 - RNA, 19 nt, Salmonella typhimurium LT2
aucgcccaugacauuccca

SEQ ID NO: 1880090 - RNA, 20 nt, Salmonella typhimurium LT2
aucgagccuuucacccaaaa

SEQ ID NO: 1880091 - RNA, 11 nt, Salmonella typhimurium LT2
aucgagauaag

SEQ ID NO: 1880092 - RNA, 16 nt, Salmonella typhimurium LT2
aucgauucucuucuuc

SEQ ID NO: 1880093 - RNA, 15 nt, Salmonella typhimurium LT2
aucgauucugaauaa

SEQ ID NO: 1880094 - RNA, 22 nt, Salmonella typhimurium LT2
aucgauucugaauaauauguaa

SEQ ID NO: 1880095 - RNA, 16 nt, Salmonella typhimurium LT2
aucgaugcccugugca

SEQ ID NO: 1880096 - RNA, 21 nt, Salmonella typhimurium LT2
aucgcaacgccggugccugcc

SEQ ID NO: 1880097 - RNA, 14 nt, Salmonella typhimurium LT2
aucgcaacgugcag

SEQ ID NO: 1880098 - RNA, 18 nt, Salmonella typhimurium LT2
aucgcaaauugcgcgccc

SEQ ID NO: 1880099 - RNA, 23 nt, Salmonella typhimurium LT2
aucgcaaauugcgcgcccgcuuc

SEQ ID NO: 1880100 - RNA, 17 nt, Salmonella typhimurium LT2
aucgauuuugaccugaa

SEQ ID NO: 1880101 - RNA, 19 nt, Salmonella typhimurium LT2
aucgcaacacgauccccau

SEQ ID NO: 1880102 - RNA, 19 nt, Salmonella typhimurium LT2
aucgccauccugcaccgua

SEQ ID NO: 1880103 - RNA, 15 nt, Salmonella typhimurium LT2
aucgccaugaccaca

SEQ ID NO: 1880104 - RNA, 22 nt, Salmonella typhimurium LT2
aucgccauucggauaauccaga

SEQ ID NO: 1880105 - RNA, 13 nt, Salmonella typhimurium LT2
aucgcauauugcg

SEQ ID NO: 1880106 - RNA, 17 nt, Salmonella typhimurium LT2
aucgcaguugauacauu

SEQ ID NO: 1880107 - RNA, 14 nt, Salmonella typhimurium LT2
aucgcaucagauaa

SEQ ID NO: 1880108 - RNA, 15 nt, Salmonella typhimurium LT2
aucguuuccagcauc

SEQ ID NO: 1880109 - RNA, 16 nt, Salmonella typhimurium LT2
aucguugauauuauua

SEQ ID NO: 1880110 - RNA, 18 nt, Salmonella typhimurium LT2
aucguugcggcgcagggc

SEQ ID NO: 1880111 - RNA, 17 nt, Salmonella typhimurium LT2
aucuacgacaaaggcaa

SEQ ID NO: 1880112 - RNA, 22 nt, Salmonella typhimurium LT2
aucuaauuaaaaagagaaaaaa

SEQ ID NO: 1880113 - RNA, 18 nt, Salmonella typhimurium LT2
aucuacgguaucugcaua

SEQ ID NO: 1880114 - RNA, 20 nt, Salmonella typhimurium LT2
aucuaccagccgauuuuucg

SEQ ID NO: 1880115 - RNA, 15 nt, Salmonella typhimurium LT2
aucuauuauuuuucu

SEQ ID NO: 1880116 - RNA, 13 nt, Salmonella typhimurium LT2
aucguccagccau

SEQ ID NO: 1880117 - RNA, 21 nt, Salmonella typhimurium LT2
aucgucccuuuucccccgcug

SEQ ID NO: 1880118 - RNA, 21 nt, Salmonella typhimurium LT2
aucgucggcgauugucaucau

SEQ ID NO: 1880119 - RNA, 15 nt, Salmonella typhimurium LT2
aucgucgucauaucg

SEQ ID NO: 1880120 - RNA, 17 nt, Salmonella typhimurium LT2
aucggcaaacgccgccu

SEQ ID NO: 1880121 - RNA, 17 nt, Salmonella typhimurium LT2
aucggcaauaucccgcc

SEQ ID NO: 1880122 - RNA, 21 nt, Salmonella typhimurium LT2
aucgcuuaacggcccaggcau

SEQ ID NO: 1880123 - RNA, 13 nt, Salmonella typhimurium LT2
aucgcuuaacaac

SEQ ID NO: 1880124 - RNA, 16 nt, Salmonella typhimurium LT2
aucguuauccagcagc

SEQ ID NO: 1880125 - RNA, 21 nt, Salmonella typhimurium LT2
aucguucaaaagugccagcac

SEQ ID NO: 1880126 - RNA, 20 nt, Salmonella typhimurium LT2
aucgugcgggcgaggggaga

SEQ ID NO: 1880127 - RNA, 16 nt, Salmonella typhimurium LT2
aucgugccaugaccau

SEQ ID NO: 1880128 - RNA, 21 nt, Salmonella typhimurium LT2
aucucgucaaacucuuccggg

SEQ ID NO: 1880129 - RNA, 12 nt, Salmonella typhimurium LT2
aucucgucgcca

SEQ ID NO: 1880130 - RNA, 20 nt, Salmonella typhimurium LT2
aucucgguacgccaaaucug

SEQ ID NO: 1880131 - RNA, 23 nt, Salmonella typhimurium LT2
aucucgguacgccaaaucuguuc

SEQ ID NO: 1880132 - RNA, 15 nt, Salmonella typhimurium LT2
aucucguaaaucaau

SEQ ID NO: 1880133 - RNA, 14 nt, Salmonella typhimurium LT2
aucucuacgccggc

SEQ ID NO: 1880134 - RNA, 18 nt, Salmonella typhimurium LT2
aucucuaucggcaaacca

SEQ ID NO: 1880135 - RNA, 19 nt, Salmonella typhimurium LT2
aucucuuccaggauacaca

SEQ ID NO: 1880136 - RNA, 15 nt, Salmonella typhimurium LT2
aucucaaugccacgc

SEQ ID NO: 1880137 - RNA, 17 nt, Salmonella typhimurium LT2
aucucaaugccacgccg

SEQ ID NO: 1880138 - RNA, 16 nt, Salmonella typhimurium LT2
aucuccaguuguucac

SEQ ID NO: 1880139 - RNA, 13 nt, Salmonella typhimurium LT2
aucuccaucucca

SEQ ID NO: 1880140 - RNA, 23 nt, Salmonella typhimurium LT2
aucucccacccgcgcgcuuucca

SEQ ID NO: 1880141 - RNA, 14 nt, Salmonella typhimurium LT2
aucugcuucuggcu

SEQ ID NO: 1880142 - RNA, 17 nt, Salmonella typhimurium LT2
aucuggugauaaagcag

SEQ ID NO: 1880143 - RNA, 19 nt, Salmonella typhimurium LT2
aucugguggaaaagaaaac

SEQ ID NO: 1880144 - RNA, 14 nt, Salmonella typhimurium LT2
aucuggugauaaag

SEQ ID NO: 1880145 - RNA, 14 nt, Salmonella typhimurium LT2
aucugcccuuucuu

SEQ ID NO: 1880146 - RNA, 16 nt, Salmonella typhimurium LT2
aucugccgggagcaga

SEQ ID NO: 1880147 - RNA, 18 nt, Salmonella typhimurium LT2
aucugccgggagcagauu

SEQ ID NO: 1880148 - RNA, 23 nt, Salmonella typhimurium LT2
aucugauuaccgguuguuguguc

SEQ ID NO: 1880149 - RNA, 13 nt, Salmonella typhimurium LT2
aucugauaaaaug

SEQ ID NO: 1880150 - RNA, 22 nt, Salmonella typhimurium LT2
aucugauagcccauccagcaca

SEQ ID NO: 1880151 - RNA, 16 nt, Salmonella typhimurium LT2
aucuuguccucaucau

SEQ ID NO: 1880152 - RNA, 13 nt, Salmonella typhimurium LT2
aucuuguccucau

SEQ ID NO: 1880153 - RNA, 22 nt, Salmonella typhimurium LT2
aucuuguccucaucauucgguu

SEQ ID NO: 1880154 - RNA, 14 nt, Salmonella typhimurium LT2
aucuuugccgcaaa

SEQ ID NO: 1880155 - RNA, 22 nt, Salmonella typhimurium LT2
aucuuuggcuuuaugaauauca

SEQ ID NO: 1880156 - RNA, 18 nt, Salmonella typhimurium LT2
aucuuuugcgccuuccag

SEQ ID NO: 1880157 - RNA, 11 nt, Salmonella typhimurium LT2
aucuuuuuccc

SEQ ID NO: 1880158 - RNA, 15 nt, Salmonella typhimurium LT2
aucuuuuugcuccug

SEQ ID NO: 1880159 - RNA, 17 nt, Salmonella typhimurium LT2
aucuugcuuuauuuuua

SEQ ID NO: 1880160 - RNA, 17 nt, Salmonella typhimurium LT2
aucuucugcugcucccu

SEQ ID NO: 1880161 - RNA, 15 nt, Salmonella typhimurium LT2
aucuucuacaaugcg

SEQ ID NO: 1880162 - RNA, 16 nt, Salmonella typhimurium LT2
aucuguugcgcaagca

SEQ ID NO: 1880163 - RNA, 21 nt, Salmonella typhimurium LT2
augaccugggcgccagagagc

SEQ ID NO: 1880164 - RNA, 20 nt, Salmonella typhimurium LT2
augaccguuaguaaucggau

SEQ ID NO: 1880165 - RNA, 16 nt, Salmonella typhimurium LT2
augaccggacgugcca

SEQ ID NO: 1880166 - RNA, 15 nt, Salmonella typhimurium LT2
augaccgcaauuaaa

SEQ ID NO: 1880167 - RNA, 13 nt, Salmonella typhimurium LT2
augacccauuuau

SEQ ID NO: 1880168 - RNA, 21 nt, Salmonella typhimurium LT2
augacacaucaccuccagcga

SEQ ID NO: 1880169 - RNA, 13 nt, Salmonella typhimurium LT2
augaccagaacau

SEQ ID NO: 1880170 - RNA, 14 nt, Salmonella typhimurium LT2
augacagacaggcc

SEQ ID NO: 1880171 - RNA, 21 nt, Salmonella typhimurium LT2
augacagaguccacagcccgg

SEQ ID NO: 1880172 - RNA, 23 nt, Salmonella typhimurium LT2
augacggcagucgcuacaaccag

SEQ ID NO: 1880173 - RNA, 16 nt, Salmonella typhimurium LT2
augacgcuggaaguac

SEQ ID NO: 1880174 - RNA, 17 nt, Salmonella typhimurium LT2
augacgcuauuguugau

SEQ ID NO: 1880175 - RNA, 19 nt, Salmonella typhimurium LT2
augacgcccugcgccagca

SEQ ID NO: 1880176 - RNA, 13 nt, Salmonella typhimurium LT2
augacgccgcagc

SEQ ID NO: 1880177 - RNA, 13 nt, Salmonella typhimurium LT2
augacgaacagga

SEQ ID NO: 1880178 - RNA, 14 nt, Salmonella typhimurium LT2
augacgaccucauc

SEQ ID NO: 1880179 - RNA, 21 nt, Salmonella typhimurium LT2
augacgacagccaggagucua

SEQ ID NO: 1880180 - RNA, 16 nt, Salmonella typhimurium LT2
augacgacaucugcac

SEQ ID NO: 1880181 - RNA, 22 nt, Salmonella typhimurium LT2
augagauacgucaucaugcugc

SEQ ID NO: 1880182 - RNA, 14 nt, Salmonella typhimurium LT2
augagauaauaaau

SEQ ID NO: 1880183 - RNA, 13 nt, Salmonella typhimurium LT2
augagaaaaggaa

SEQ ID NO: 1880184 - RNA, 12 nt, Salmonella typhimurium LT2
augagaagaaaa

SEQ ID NO: 1880185 - RNA, 13 nt, Salmonella typhimurium LT2
augagaagaaaaa

SEQ ID NO: 1880186 - RNA, 15 nt, Salmonella typhimurium LT2
augaagcauaaaaag

SEQ ID NO: 1880187 - RNA, 15 nt, Salmonella typhimurium LT2
augaauaaccucccg

SEQ ID NO: 1880188 - RNA, 23 nt, Salmonella typhimurium LT2
augaauaccaagucucaagagug

SEQ ID NO: 1880189 - RNA, 23 nt, Salmonella typhimurium LT2
augaauacgcuccagcuggcugg

SEQ ID NO: 1880190 - RNA, 14 nt, Salmonella typhimurium LT2
augaauaucaaacc

SEQ ID NO: 1880191 - RNA, 14 nt, Salmonella typhimurium LT2
augaaacgacacag

SEQ ID NO: 1880192 - RNA, 16 nt, Salmonella typhimurium LT2
augaaacgugaaauau

SEQ ID NO: 1880193 - RNA, 12 nt, Salmonella typhimurium LT2
augaaaaaaacg

SEQ ID NO: 1880194 - RNA, 11 nt, Salmonella typhimurium LT2
augaaaaaaac

SEQ ID NO: 1880195 - RNA, 12 nt, Salmonella typhimurium LT2
augaaagagaaa

SEQ ID NO: 1880196 - RNA, 12 nt, Salmonella typhimurium LT2
augaagacgaag

SEQ ID NO: 1880197 - RNA, 22 nt, Salmonella typhimurium LT2
augaagacgaaggggacaaaau

SEQ ID NO: 1880198 - RNA, 14 nt, Salmonella typhimurium LT2
augaagaaaauacu

SEQ ID NO: 1880199 - RNA, 13 nt, Salmonella typhimurium LT2
augaagaaggccu

SEQ ID NO: 1880200 - RNA, 18 nt, Salmonella typhimurium LT2
auaccguagaucgccagc

SEQ ID NO: 1880201 - RNA, 20 nt, Salmonella typhimurium LT2
auaccguccagacuccuuuu

SEQ ID NO: 1880202 - RNA, 20 nt, Salmonella typhimurium LT2
auacgucauaucauccagcc

SEQ ID NO: 1880203 - RNA, 13 nt, Salmonella typhimurium LT2
auacgucccugcu

SEQ ID NO: 1880204 - RNA, 23 nt, Salmonella typhimurium LT2
auacgggagagcguauccagcac

SEQ ID NO: 1880205 - RNA, 21 nt, Salmonella typhimurium LT2
auacggcggcaaugccgccgu

SEQ ID NO: 1880206 - RNA, 22 nt, Salmonella typhimurium LT2
auacggagaacggcacaauagc

SEQ ID NO: 1880207 - RNA, 20 nt, Salmonella typhimurium LT2
auacggauuaggcaagcugg

SEQ ID NO: 1880208 - RNA, 19 nt, Salmonella typhimurium LT2
auacguuugaaaugaauac

SEQ ID NO: 1880209 - RNA, 14 nt, Salmonella typhimurium LT2
auacguuccagcag

SEQ ID NO: 1880210 - RNA, 18 nt, Salmonella typhimurium LT2
auacgucuuacgccaugc

SEQ ID NO: 1880211 - RNA, 19 nt, Salmonella typhimurium LT2
auacguuauaaauuuuuua

SEQ ID NO: 1880212 - RNA, 12 nt, Salmonella typhimurium LT2
auacguuaugca

SEQ ID NO: 1880213 - RNA, 11 nt, Salmonella typhimurium LT2
auacucuuucc

SEQ ID NO: 1880214 - RNA, 19 nt, Salmonella typhimurium LT2
auacucuuugaacagccag

SEQ ID NO: 1880215 - RNA, 20 nt, Salmonella typhimurium LT2
auacugacacgccaguucau

SEQ ID NO: 1880216 - RNA, 13 nt, Salmonella typhimurium LT2
auagaccacgcca

SEQ ID NO: 1880217 - RNA, 15 nt, Salmonella typhimurium LT2
auagacgacaucuuu

SEQ ID NO: 1880218 - RNA, 18 nt, Salmonella typhimurium LT2
auagacgacaucuuuucc

SEQ ID NO: 1880219 - RNA, 13 nt, Salmonella typhimurium LT2
auagacgauauag

SEQ ID NO: 1880220 - RNA, 21 nt, Salmonella typhimurium LT2
auagacgacaucgcucaaaac

SEQ ID NO: 1880221 - RNA, 23 nt, Salmonella typhimurium LT2
auagaacgguuuugcgcugguac

SEQ ID NO: 1880222 - RNA, 17 nt, Salmonella typhimurium LT2
auagaaagucuuuuguu

SEQ ID NO: 1880223 - RNA, 17 nt, Salmonella typhimurium LT2
auacuguuccaggcgaa

SEQ ID NO: 1880224 - RNA, 15 nt, Salmonella typhimurium LT2
auaccaccugccaaa

SEQ ID NO: 1880225 - RNA, 21 nt, Salmonella typhimurium LT2
auaccaggcacuugagaaauu

SEQ ID NO: 1880226 - RNA, 15 nt, Salmonella typhimurium LT2
auaccagccaacagu

SEQ ID NO: 1880227 - RNA, 20 nt, Salmonella typhimurium LT2
auaccagccaacaguauaga

SEQ ID NO: 1880228 - RNA, 22 nt, Salmonella typhimurium LT2
auaccacaacaagaauauauuc

SEQ ID NO: 1880229 - RNA, 21 nt, Salmonella typhimurium LT2
auaccaaagcccgcaaacaga

SEQ ID NO: 1880230 - RNA, 21 nt, Salmonella typhimurium LT2
auaccaaaucucaagagugaa

SEQ ID NO: 1880231 - RNA, 19 nt, Salmonella typhimurium LT2
auaccaaauuacgcacacu

SEQ ID NO: 1880232 - RNA, 14 nt, Salmonella typhimurium LT2
auacccaacagcag

SEQ ID NO: 1880233 - RNA, 15 nt, Salmonella typhimurium LT2
auacccaacagcaga

SEQ ID NO: 1880234 - RNA, 18 nt, Salmonella typhimurium LT2
auacccaacagcagacag

SEQ ID NO: 1880235 - RNA, 14 nt, Salmonella typhimurium LT2
auacccuguuugau

SEQ ID NO: 1880236 - RNA, 16 nt, Salmonella typhimurium LT2
auaccaugauucauac

SEQ ID NO: 1880237 - RNA, 15 nt, Salmonella typhimurium LT2
auaccaguacaacaa

SEQ ID NO: 1880238 - RNA, 22 nt, Salmonella typhimurium LT2
auaccauaaaugaaaccucaau

SEQ ID NO: 1880239 - RNA, 21 nt, Salmonella typhimurium LT2
auaccagcggcaaacagcgac

SEQ ID NO: 1880240 - RNA, 18 nt, Salmonella typhimurium LT2
auacauucaguacaauac

SEQ ID NO: 1880241 - RNA, 20 nt, Salmonella typhimurium LT2
auacauuuuuguaauaaaaa

SEQ ID NO: 1880242 - RNA, 23 nt, Salmonella typhimurium LT2
auacauuuuguauucgcagggcu

SEQ ID NO: 1880243 - RNA, 18 nt, Salmonella typhimurium LT2
auacaugccugcgccaug

SEQ ID NO: 1880244 - RNA, 16 nt, Salmonella typhimurium LT2
auacaucuuccuccug

SEQ ID NO: 1880245 - RNA, 23 nt, Salmonella typhimurium LT2
auacauccggcaggcauuuuaca

SEQ ID NO: 1880246 - RNA, 13 nt, Salmonella typhimurium LT2
auacauaaauccg

SEQ ID NO: 1880247 - RNA, 16 nt, Salmonella typhimurium LT2
auacauaaauccggau

SEQ ID NO: 1880248 - RNA, 21 nt, Salmonella typhimurium LT2
auacauaccacgcagcggcau

SEQ ID NO: 1880249 - RNA, 14 nt, Salmonella typhimurium LT2
auacauagucuaug

SEQ ID NO: 1880250 - RNA, 15 nt, Salmonella typhimurium LT2
auacauaaaauguuc

SEQ ID NO: 1880251 - RNA, 14 nt, Salmonella typhimurium LT2
auagccccaguaaa

SEQ ID NO: 1880252 - RNA, 18 nt, Salmonella typhimurium LT2
auagcccagucgcacaaa

SEQ ID NO: 1880253 - RNA, 14 nt, Salmonella typhimurium LT2
auagagaguuccuc

SEQ ID NO: 1880254 - RNA, 22 nt, Salmonella typhimurium LT2
auagagcaaaggaucgcaacca

SEQ ID NO: 1880255 - RNA, 23 nt, Salmonella typhimurium LT2
auagcgcgccauauuaacaaugc

SEQ ID NO: 1880256 - RNA, 20 nt, Salmonella typhimurium LT2
auagcgcgucguugucuuug

SEQ ID NO: 1880257 - RNA, 23 nt, Salmonella typhimurium LT2
auagcgcuaugcgcuccaggaug

SEQ ID NO: 1880258 - RNA, 11 nt, Salmonella typhimurium LT2
auagcgcccca

SEQ ID NO: 1880259 - RNA, 16 nt, Salmonella typhimurium LT2
auagcgccccaaagcg

SEQ ID NO: 1880260 - RNA, 18 nt, Salmonella typhimurium LT2
auagcgccacgaguggcg

SEQ ID NO: 1880261 - RNA, 15 nt, Salmonella typhimurium LT2
auagcgccaucagac

SEQ ID NO: 1880262 - RNA, 18 nt, Salmonella typhimurium LT2
auagcgccaucagacauu

SEQ ID NO: 1880263 - RNA, 19 nt, Salmonella typhimurium LT2
auagcuggcugucuuccgu

SEQ ID NO: 1880264 - RNA, 23 nt, Salmonella typhimurium LT2
auagcggcguuuauauaaaaaua

SEQ ID NO: 1880265 - RNA, 13 nt, Salmonella typhimurium LT2
auagcgcugcgca

SEQ ID NO: 1880266 - RNA, 13 nt, Salmonella typhimurium LT2
auagguuuuaugc

SEQ ID NO: 1880267 - RNA, 15 nt, Salmonella typhimurium LT2
auaggucguuccuca

SEQ ID NO: 1880268 - RNA, 19 nt, Salmonella typhimurium LT2
auaggugacuuuccuggcu

SEQ ID NO: 1880269 - RNA, 23 nt, Salmonella typhimurium LT2
auaggccucgaccaguuuuuccg

SEQ ID NO: 1880270 - RNA, 12 nt, Salmonella typhimurium LT2
auagggccaggc

SEQ ID NO: 1880271 - RNA, 20 nt, Salmonella typhimurium LT2
auaggggauaucgcuggccu

SEQ ID NO: 1880272 - RNA, 14 nt, Salmonella typhimurium LT2
auaguauuucccuu

SEQ ID NO: 1880273 - RNA, 18 nt, Salmonella typhimurium LT2
auaguagcugagaguaaa

SEQ ID NO: 1880274 - RNA, 20 nt, Salmonella typhimurium LT2
auagucauaauacucaauau

SEQ ID NO: 1880275 - RNA, 20 nt, Salmonella typhimurium LT2
auagucaucgccuucauccg

SEQ ID NO: 1880276 - RNA, 15 nt, Salmonella typhimurium LT2
auagucauugacagc

SEQ ID NO: 1880277 - RNA, 13 nt, Salmonella typhimurium LT2
auagucagcuuaa

SEQ ID NO: 1880278 - RNA, 20 nt, Salmonella typhimurium LT2
auagucaaugcccccgccaa

SEQ ID NO: 1880279 - RNA, 14 nt, Salmonella typhimurium LT2
auauccuaacuuau

SEQ ID NO: 1880280 - RNA, 14 nt, Salmonella typhimurium LT2
auauccuccaccuc

SEQ ID NO: 1880281 - RNA, 21 nt, Salmonella typhimurium LT2
auauccaccagcccaucuuuc

SEQ ID NO: 1880282 - RNA, 15 nt, Salmonella typhimurium LT2
auaucacgcgcgcga

SEQ ID NO: 1880283 - RNA, 17 nt, Salmonella typhimurium LT2
auaucaaaccacgcuga

SEQ ID NO: 1880284 - RNA, 18 nt, Salmonella typhimurium LT2
auaucaacggucaggcug

SEQ ID NO: 1880285 - RNA, 13 nt, Salmonella typhimurium LT2
auaucaaucaccu

SEQ ID NO: 1880286 - RNA, 14 nt, Salmonella typhimurium LT2
auaucaauucaaca

SEQ ID NO: 1880287 - RNA, 20 nt, Salmonella typhimurium LT2
auauaugcaaaacuguagca

SEQ ID NO: 1880288 - RNA, 18 nt, Salmonella typhimurium LT2
auauaguuuuuaccauau

SEQ ID NO: 1880289 - RNA, 13 nt, Salmonella typhimurium LT2
auauauuauugcc

SEQ ID NO: 1880290 - RNA, 15 nt, Salmonella typhimurium LT2
auauagccauuuaau

SEQ ID NO: 1880291 - RNA, 14 nt, Salmonella typhimurium LT2
auauagccguggcu

SEQ ID NO: 1880292 - RNA, 23 nt, Salmonella typhimurium LT2
auauacagccuuuugagcagcau

SEQ ID NO: 1880293 - RNA, 16 nt, Salmonella typhimurium LT2
auauaauuuauagcca

SEQ ID NO: 1880294 - RNA, 15 nt, Salmonella typhimurium LT2
auauaacagaauaag

SEQ ID NO: 1880295 - RNA, 15 nt, Salmonella typhimurium LT2
auaguuaauaauggu

SEQ ID NO: 1880296 - RNA, 15 nt, Salmonella typhimurium LT2
auagugucuaauuua

SEQ ID NO: 1880297 - RNA, 14 nt, Salmonella typhimurium LT2
auagucuccaugac

SEQ ID NO: 1880298 - RNA, 19 nt, Salmonella typhimurium LT2
auagucgcuuuucauacug

SEQ ID NO: 1880299 - RNA, 16 nt, Salmonella typhimurium LT2
auauuuuuuccccgcu

SEQ ID NO: 1880300 - RNA, 22 nt, Salmonella typhimurium LT2
auauuucuuuaugggcauuuca

SEQ ID NO: 1880301 - RNA, 16 nt, Salmonella typhimurium LT2
auauuuuucacacaua

SEQ ID NO: 1880302 - RNA, 12 nt, Salmonella typhimurium LT2
auauuuuucccu

SEQ ID NO: 1880303 - RNA, 22 nt, Salmonella typhimurium LT2
auauucuuuguuuaaaaauuuu

SEQ ID NO: 1880304 - RNA, 21 nt, Salmonella typhimurium LT2
auauucugggcuuacuuucca

SEQ ID NO: 1880305 - RNA, 16 nt, Salmonella typhimurium LT2
auauuuaccgccgcuu

SEQ ID NO: 1880306 - RNA, 14 nt, Salmonella typhimurium LT2
auauuuaccgccgc

SEQ ID NO: 1880307 - RNA, 16 nt, Salmonella typhimurium LT2
aucaaccaccuucacc

SEQ ID NO: 1880308 - RNA, 20 nt, Salmonella typhimurium LT2
aucaacuucguucaguucca

SEQ ID NO: 1880309 - RNA, 14 nt, Salmonella typhimurium LT2
aucaacuccuccgg

SEQ ID NO: 1880310 - RNA, 20 nt, Salmonella typhimurium LT2
aucaaauacgcuauuuaaaa

SEQ ID NO: 1880311 - RNA, 17 nt, Salmonella typhimurium LT2
aucaaauaccuuuucau

SEQ ID NO: 1880312 - RNA, 17 nt, Salmonella typhimurium LT2
aucaaauaagguggcua

SEQ ID NO: 1880313 - RNA, 22 nt, Salmonella typhimurium LT2
aucaaaggcgucgccgaauaaa

SEQ ID NO: 1880314 - RNA, 17 nt, Salmonella typhimurium LT2
auauggaugagucuugc

SEQ ID NO: 1880315 - RNA, 18 nt, Salmonella typhimurium LT2
auaugcgcaaucacccca

SEQ ID NO: 1880316 - RNA, 21 nt, Salmonella typhimurium LT2
auaugcaggcauaaaaaagag

SEQ ID NO: 1880317 - RNA, 19 nt, Salmonella typhimurium LT2
auaugcaggcauaaaaaag

SEQ ID NO: 1880318 - RNA, 13 nt, Salmonella typhimurium LT2
auaugccaggcau

SEQ ID NO: 1880319 - RNA, 21 nt, Salmonella typhimurium LT2
auaugccggccgcaguuuucc

SEQ ID NO: 1880320 - RNA, 19 nt, Salmonella typhimurium LT2
auaugccaaguaauaaaga

SEQ ID NO: 1880321 - RNA, 19 nt, Salmonella typhimurium LT2
auauguaaauuauccguuu

SEQ ID NO: 1880322 - RNA, 15 nt, Salmonella typhimurium LT2
auauggccguuugcu

SEQ ID NO: 1880323 - RNA, 23 nt, Salmonella typhimurium LT2
auauggcacuuucagauaccaaa

SEQ ID NO: 1880324 - RNA, 17 nt, Salmonella typhimurium LT2
auaugggcaauuauauu

SEQ ID NO: 1880325 - RNA, 17 nt, Salmonella typhimurium LT2
auaugucugauucuuau

SEQ ID NO: 1880326 - RNA, 12 nt, Salmonella typhimurium LT2
auauuacugacu

SEQ ID NO: 1880327 - RNA, 15 nt, Salmonella typhimurium LT2
auauuaaauuuauac

SEQ ID NO: 1880328 - RNA, 14 nt, Salmonella typhimurium LT2
auauuauaaaauaa

SEQ ID NO: 1880329 - RNA, 12 nt, Salmonella typhimurium LT2
auauuauaaaau

SEQ ID NO: 1880330 - RNA, 17 nt, Salmonella typhimurium LT2
aucacauccgccagcgc

SEQ ID NO: 1880331 - RNA, 13 nt, Salmonella typhimurium LT2
aucacaucccagc

SEQ ID NO: 1880332 - RNA, 21 nt, Salmonella typhimurium LT2
aucacaugcggaagcaaaaua

SEQ ID NO: 1880333 - RNA, 17 nt, Salmonella typhimurium LT2
aucacaucgccguucca

SEQ ID NO: 1880334 - RNA, 18 nt, Salmonella typhimurium LT2
aucacaucgcgcagcagg

SEQ ID NO: 1880335 - RNA, 19 nt, Salmonella typhimurium LT2
aucacaagcuguuucuccg

SEQ ID NO: 1880336 - RNA, 18 nt, Salmonella typhimurium LT2
aucaauucuuuaauuugu

SEQ ID NO: 1880337 - RNA, 17 nt, Salmonella typhimurium LT2
aucaauuuuaauuuaau

SEQ ID NO: 1880338 - RNA, 22 nt, Salmonella typhimurium LT2
aucaauuuuaauuuaauaauaa

SEQ ID NO: 1880339 - RNA, 24 nt, Salmonella typhimurium LT2
aucaauuuuaauuuaauaauaaau

SEQ ID NO: 1880340 - RNA, 15 nt, Salmonella typhimurium LT2
aucacccugaauuuc

SEQ ID NO: 1880341 - RNA, 12 nt, Salmonella typhimurium LT2
aucacccgcuuc

SEQ ID NO: 1880342 - RNA, 17 nt, Salmonella typhimurium LT2
aucacccaacguucaug

SEQ ID NO: 1880343 - RNA, 14 nt, Salmonella typhimurium LT2
aucaccaggcaaug

SEQ ID NO: 1880344 - RNA, 13 nt, Salmonella typhimurium LT2
aucaccaccucaa

SEQ ID NO: 1880345 - RNA, 20 nt, Salmonella typhimurium LT2
aucaccagcccgaauccacu

SEQ ID NO: 1880346 - RNA, 16 nt, Salmonella typhimurium LT2
aucaccaaguagacag

SEQ ID NO: 1880347 - RNA, 22 nt, Salmonella typhimurium LT2
aucaccugauugauacgcgccc

SEQ ID NO: 1880348 - RNA, 13 nt, Salmonella typhimurium LT2
aucacugauauaa

SEQ ID NO: 1880349 - RNA, 18 nt, Salmonella typhimurium LT2
aucagcagccgggccaga

SEQ ID NO: 1880350 - RNA, 13 nt, Salmonella typhimurium LT2
aucagcagaucca

SEQ ID NO: 1880351 - RNA, 15 nt, Salmonella typhimurium LT2
aucagaaaacagcau

SEQ ID NO: 1880352 - RNA, 21 nt, Salmonella typhimurium LT2
aucacuggagcgcauuuuacu

SEQ ID NO: 1880353 - RNA, 23 nt, Salmonella typhimurium LT2
aucacuggagcgcauuuuacugc

SEQ ID NO: 1880354 - RNA, 17 nt, Salmonella typhimurium LT2
aucacugucagaaauua

SEQ ID NO: 1880355 - RNA, 19 nt, Salmonella typhimurium LT2
aucagaagcuaagggaugc

SEQ ID NO: 1880356 - RNA, 23 nt, Salmonella typhimurium LT2
aucagcguguacggccugauaac

SEQ ID NO: 1880357 - RNA, 21 nt, Salmonella typhimurium LT2
aucagcgucagcaccaguaca

SEQ ID NO: 1880358 - RNA, 23 nt, Salmonella typhimurium LT2
aucaggcaagacccgaaccugcg

SEQ ID NO: 1880359 - RNA, 15 nt, Salmonella typhimurium LT2
aucaggauuauuaca

SEQ ID NO: 1880360 - RNA, 16 nt, Salmonella typhimurium LT2
aucaggauaauuucac

SEQ ID NO: 1880361 - RNA, 16 nt, Salmonella typhimurium LT2
aucagccugagcgcca

SEQ ID NO: 1880362 - RNA, 22 nt, Salmonella typhimurium LT2
aucagcggcacauaagcgauuc

SEQ ID NO: 1880363 - RNA, 14 nt, Salmonella typhimurium LT2
aucagccccagcac

SEQ ID NO: 1880364 - RNA, 22 nt, Salmonella typhimurium LT2
aucagcccaugccguauuuaug

SEQ ID NO: 1880365 - RNA, 18 nt, Salmonella typhimurium LT2
aaaacgggagauuguuau

SEQ ID NO: 1880366 - RNA, 18 nt, Salmonella typhimurium LT2
aaaacggauaauaucuuu

SEQ ID NO: 1880367 - RNA, 22 nt, Salmonella typhimurium LT2
aaaacguaacguacgggugucc

SEQ ID NO: 1880368 - RNA, 17 nt, Salmonella typhimurium LT2
aaaacgguauaaaaaac

SEQ ID NO: 1880369 - RNA, 18 nt, Salmonella typhimurium LT2
aucaguccgcaaagaacc

SEQ ID NO: 1880370 - RNA, 15 nt, Salmonella typhimurium LT2
aucaguugcaggaag

SEQ ID NO: 1880371 - RNA, 13 nt, Salmonella typhimurium LT2
aucaguucaggaa

SEQ ID NO: 1880372 - RNA, 16 nt, Salmonella typhimurium LT2
aucaguucaggaacau

SEQ ID NO: 1880373 - RNA, 19 nt, Salmonella typhimurium LT2
aucaggugcgagagcuguc

SEQ ID NO: 1880374 - RNA, 20 nt, Salmonella typhimurium LT2
aucaggugaauaccaaagcc

SEQ ID NO: 1880375 - RNA, 21 nt, Salmonella typhimurium LT2
aucaggugaguaaauaaaaac

SEQ ID NO: 1880376 - RNA, 14 nt, Salmonella typhimurium LT2
aucagggaaaaaug

SEQ ID NO: 1880377 - RNA, 16 nt, Salmonella typhimurium LT2
aucagggaaaaaugug

SEQ ID NO: 1880378 - RNA, 22 nt, Salmonella typhimurium LT2
aucaggcugguauaaaaacugc

SEQ ID NO: 1880379 - RNA, 17 nt, Salmonella typhimurium LT2
aucaggcacaacccaaa

SEQ ID NO: 1880380 - RNA, 15 nt, Salmonella typhimurium LT2
aucaggcauaaaccu

SEQ ID NO: 1880381 - RNA, 16 nt, Salmonella typhimurium LT2
aucaggcauaaaccua

SEQ ID NO: 1880382 - RNA, 21 nt, Salmonella typhimurium LT2
caagucaccguuuuucaucaa

SEQ ID NO: 1880383 - RNA, 22 nt, Salmonella typhimurium LT2
caaggcauuggacgggaucucg

SEQ ID NO: 1880384 - RNA, 14 nt, Salmonella typhimurium LT2
caaguaguuguuau

SEQ ID NO: 1880385 - RNA, 16 nt, Salmonella typhimurium LT2
caaguagaacuuccaa

SEQ ID NO: 1880386 - RNA, 19 nt, Salmonella typhimurium LT2
caaguauaugucugauucu

SEQ ID NO: 1880387 - RNA, 18 nt, Salmonella typhimurium LT2
caagcugguuaaugaccu

SEQ ID NO: 1880388 - RNA, 22 nt, Salmonella typhimurium LT2
caagcugugccauauucucugg

SEQ ID NO: 1880389 - RNA, 14 nt, Salmonella typhimurium LT2
caagcuggaauacc

SEQ ID NO: 1880390 - RNA, 15 nt, Salmonella typhimurium LT2
caagcugguaaaugc

SEQ ID NO: 1880391 - RNA, 14 nt, Salmonella typhimurium LT2
caagugcuggaggu

SEQ ID NO: 1880392 - RNA, 15 nt, Salmonella typhimurium LT2
caauaaaagcaacau

SEQ ID NO: 1880393 - RNA, 13 nt, Salmonella typhimurium LT2
caauaaagcaggg

SEQ ID NO: 1880394 - RNA, 14 nt, Salmonella typhimurium LT2
caauaaagccgcau

SEQ ID NO: 1880395 - RNA, 20 nt, Salmonella typhimurium LT2
caauaaacuaaguaaggagg

SEQ ID NO: 1880396 - RNA, 16 nt, Salmonella typhimurium LT2
caauaaaauuauccag

SEQ ID NO: 1880397 - RNA, 18 nt, Salmonella typhimurium LT2
caauaaaauauccuccac

SEQ ID NO: 1880398 - RNA, 21 nt, Salmonella typhimurium LT2
caaguuuggcaaucaaaucca

SEQ ID NO: 1880399 - RNA, 12 nt, Salmonella typhimurium LT2
caaguucagcag

SEQ ID NO: 1880400 - RNA, 13 nt, Salmonella typhimurium LT2
caaguucagcagg

SEQ ID NO: 1880401 - RNA, 14 nt, Salmonella typhimurium LT2
caaguucagcaggc

SEQ ID NO: 1880402 - RNA, 23 nt, Salmonella typhimurium LT2
caauaagggucgcgcuguauaau

SEQ ID NO: 1880403 - RNA, 20 nt, Salmonella typhimurium LT2
caauaagcuugcuuuccaua

SEQ ID NO: 1880404 - RNA, 17 nt, Salmonella typhimurium LT2
caauaagcgguaauaau

SEQ ID NO: 1880405 - RNA, 22 nt, Salmonella typhimurium LT2
caauacagcccgccagcaccag

SEQ ID NO: 1880406 - RNA, 18 nt, Salmonella typhimurium LT2
caauacagccagcacaag

SEQ ID NO: 1880407 - RNA, 23 nt, Salmonella typhimurium LT2
caauacaggcgaccgggcagaca

SEQ ID NO: 1880408 - RNA, 18 nt, Salmonella typhimurium LT2
caauacguccauuugaug

SEQ ID NO: 1880409 - RNA, 16 nt, Salmonella typhimurium LT2
caauauagccguggcu

SEQ ID NO: 1880410 - RNA, 12 nt, Salmonella typhimurium LT2
caauauacuuau

SEQ ID NO: 1880411 - RNA, 18 nt, Salmonella typhimurium LT2
caauauaccgucagcacc

SEQ ID NO: 1880412 - RNA, 21 nt, Salmonella typhimurium LT2
caauauauugcuccaucaucg

SEQ ID NO: 1880413 - RNA, 16 nt, Salmonella typhimurium LT2
caauaucguugccgcc

SEQ ID NO: 1880414 - RNA, 16 nt, Salmonella typhimurium LT2
caauaucggcggaaau

SEQ ID NO: 1880415 - RNA, 21 nt, Salmonella typhimurium LT2
caauaucgauagcauuuuuac

SEQ ID NO: 1880416 - RNA, 16 nt, Salmonella typhimurium LT2
caaucacacccagcgc

SEQ ID NO: 1880417 - RNA, 22 nt, Salmonella typhimurium LT2
caaucaacaccagcagcgcggc

SEQ ID NO: 1880418 - RNA, 19 nt, Salmonella typhimurium LT2
caaucagccccagcaccag

SEQ ID NO: 1880419 - RNA, 12 nt, Salmonella typhimurium LT2
caaucagcagcc

SEQ ID NO: 1880420 - RNA, 18 nt, Salmonella typhimurium LT2
caaucacuuauguacaac

SEQ ID NO: 1880421 - RNA, 21 nt, Salmonella typhimurium LT2
caaucacuuauguacaaccuc

SEQ ID NO: 1880422 - RNA, 15 nt, Salmonella typhimurium LT2
caaucacgcagagua

SEQ ID NO: 1880423 - RNA, 15 nt, Salmonella typhimurium LT2
caauccauuaaugcc

SEQ ID NO: 1880424 - RNA, 20 nt, Salmonella typhimurium LT2
caaucaguacgcgcgcggcg

SEQ ID NO: 1880425 - RNA, 21 nt, Salmonella typhimurium LT2
caaucauaaacgccugacgau

SEQ ID NO: 1880426 - RNA, 14 nt, Salmonella typhimurium LT2
caaucgccagcccc

SEQ ID NO: 1880427 - RNA, 20 nt, Salmonella typhimurium LT2
caaucgcauaaccggcgcca

SEQ ID NO: 1880428 - RNA, 19 nt, Salmonella typhimurium LT2
caaucgccaaauccggcuu

SEQ ID NO: 1880429 - RNA, 19 nt, Salmonella typhimurium LT2
caaucguuaauucauggcc

SEQ ID NO: 1880430 - RNA, 21 nt, Salmonella typhimurium LT2
caaucgucacuucaauuugcc

SEQ ID NO: 1880431 - RNA, 15 nt, Salmonella typhimurium LT2
caaucucacugccca

SEQ ID NO: 1880432 - RNA, 19 nt, Salmonella typhimurium LT2
caagauaagaaguaaacag

SEQ ID NO: 1880433 - RNA, 16 nt, Salmonella typhimurium LT2
caagauccguccaugu

SEQ ID NO: 1880434 - RNA, 17 nt, Salmonella typhimurium LT2
caagaucgguugaacca

SEQ ID NO: 1880435 - RNA, 20 nt, Salmonella typhimurium LT2
caagaucgguugaaccaucu

SEQ ID NO: 1880436 - RNA, 17 nt, Salmonella typhimurium LT2
caagauccaacacggcg

SEQ ID NO: 1880437 - RNA, 17 nt, Salmonella typhimurium LT2
caagacccgacaguaaa

SEQ ID NO: 1880438 - RNA, 21 nt, Salmonella typhimurium LT2
caagaccgauagagacugccg

SEQ ID NO: 1880439 - RNA, 21 nt, Salmonella typhimurium LT2
caagagagcaacauaccgcag

SEQ ID NO: 1880440 - RNA, 15 nt, Salmonella typhimurium LT2
caagagcagcaaccc

SEQ ID NO: 1880441 - RNA, 15 nt, Salmonella typhimurium LT2
caagagauaucccau

SEQ ID NO: 1880442 - RNA, 22 nt, Salmonella typhimurium LT2
caagacacgcuuccagaugaag

SEQ ID NO: 1880443 - RNA, 10 nt, Salmonella typhimurium LT2
caacuucaug

SEQ ID NO: 1880444 - RNA, 12 nt, Salmonella typhimurium LT2
caagaaucaaua

SEQ ID NO: 1880445 - RNA, 22 nt, Salmonella typhimurium LT2
caagcuaauccccagcgcucca

SEQ ID NO: 1880446 - RNA, 18 nt, Salmonella typhimurium LT2
caagcugacggauacgcu

SEQ ID NO: 1880447 - RNA, 14 nt, Salmonella typhimurium LT2
caagcgaagcgccc

SEQ ID NO: 1880448 - RNA, 17 nt, Salmonella typhimurium LT2
caagcgccuguucaaca

SEQ ID NO: 1880449 - RNA, 18 nt, Salmonella typhimurium LT2
caagcgccuguucaacau

SEQ ID NO: 1880450 - RNA, 16 nt, Salmonella typhimurium LT2
caagcgcgccauaaca

SEQ ID NO: 1880451 - RNA, 20 nt, Salmonella typhimurium LT2
caagcgcgccauaacaucac

SEQ ID NO: 1880452 - RNA, 17 nt, Salmonella typhimurium LT2
caagcguugaauuccau

SEQ ID NO: 1880453 - RNA, 21 nt, Salmonella typhimurium LT2
caagcgccucgcugacgccag

SEQ ID NO: 1880454 - RNA, 15 nt, Salmonella typhimurium LT2
caagcaguuccagca

SEQ ID NO: 1880455 - RNA, 14 nt, Salmonella typhimurium LT2
caagcaguaugccc

SEQ ID NO: 1880456 - RNA, 20 nt, Salmonella typhimurium LT2
caacguuucuuucaucagau

SEQ ID NO: 1880457 - RNA, 18 nt, Salmonella typhimurium LT2
caacggucggucuuuuug

SEQ ID NO: 1880458 - RNA, 19 nt, Salmonella typhimurium LT2
caacguauaaaauggcaaa

SEQ ID NO: 1880459 - RNA, 21 nt, Salmonella typhimurium LT2
caacgucgacagacgcaucuu

SEQ ID NO: 1880460 - RNA, 17 nt, Salmonella typhimurium LT2
caacgucgcgcccugca

SEQ ID NO: 1880461 - RNA, 17 nt, Salmonella typhimurium LT2
caacgucaucaugaaaa

SEQ ID NO: 1880462 - RNA, 17 nt, Salmonella typhimurium LT2
caacucuauuaaaauaa

SEQ ID NO: 1880463 - RNA, 21 nt, Salmonella typhimurium LT2
caacucuauuaaaauaaauua

SEQ ID NO: 1880464 - RNA, 21 nt, Salmonella typhimurium LT2
caacucuccuuucggccaugg

SEQ ID NO: 1880465 - RNA, 16 nt, Salmonella typhimurium LT2
caacugcgccugaaga

SEQ ID NO: 1880466 - RNA, 15 nt, Salmonella typhimurium LT2
caacuggcaauagcc

SEQ ID NO: 1880467 - RNA, 19 nt, Salmonella typhimurium LT2
caaccgugucugcugaucg

SEQ ID NO: 1880468 - RNA, 19 nt, Salmonella typhimurium LT2
caaccguuggggaaaauau

SEQ ID NO: 1880469 - RNA, 15 nt, Salmonella typhimurium LT2
caaccguuucuuuuu

SEQ ID NO: 1880470 - RNA, 17 nt, Salmonella typhimurium LT2
caaccguuuugcaaugc

SEQ ID NO: 1880471 - RNA, 15 nt, Salmonella typhimurium LT2
caaccucuuuuuccg

SEQ ID NO: 1880472 - RNA, 17 nt, Salmonella typhimurium LT2
caaccucggcuugcuuc

SEQ ID NO: 1880473 - RNA, 18 nt, Salmonella typhimurium LT2
caaccucggcuugcuuca

SEQ ID NO: 1880474 - RNA, 14 nt, Salmonella typhimurium LT2
caacgcgcaucaac

SEQ ID NO: 1880475 - RNA, 23 nt, Salmonella typhimurium LT2
caacgcugagucagaaacggcca

SEQ ID NO: 1880476 - RNA, 21 nt, Salmonella typhimurium LT2
caacgcugaauaucgucagua

SEQ ID NO: 1880477 - RNA, 20 nt, Salmonella typhimurium LT2
caacgcuuuagugccgccau

SEQ ID NO: 1880478 - RNA, 20 nt, Salmonella typhimurium LT2
caacgggcaguccggcggca

SEQ ID NO: 1880479 - RNA, 16 nt, Salmonella typhimurium LT2
caacggcgccauguug

SEQ ID NO: 1880480 - RNA, 13 nt, Salmonella typhimurium LT2
caacggcgcggcg

SEQ ID NO: 1880481 - RNA, 13 nt, Salmonella typhimurium LT2
caacggcggauga

SEQ ID NO: 1880482 - RNA, 19 nt, Salmonella typhimurium LT2
caaaucuguucuguccaug

SEQ ID NO: 1880483 - RNA, 22 nt, Salmonella typhimurium LT2
caaaucuggugauaaagcagac

SEQ ID NO: 1880484 - RNA, 15 nt, Salmonella typhimurium LT2
caaaugaacacaaaa

SEQ ID NO: 1880485 - RNA, 18 nt, Salmonella typhimurium LT2
caaaugaacacaaaaaac

SEQ ID NO: 1880486 - RNA, 15 nt, Salmonella typhimurium LT2
caaaugagaauagac

SEQ ID NO: 1880487 - RNA, 16 nt, Salmonella typhimurium LT2
caaaugagaauagacu

SEQ ID NO: 1880488 - RNA, 15 nt, Salmonella typhimurium LT2
caaauugcuguucca

SEQ ID NO: 1880489 - RNA, 17 nt, Salmonella typhimurium LT2
caaauucagaccccugu

SEQ ID NO: 1880490 - RNA, 20 nt, Salmonella typhimurium LT2
caaauguuguuugaaaagug

SEQ ID NO: 1880491 - RNA, 14 nt, Salmonella typhimurium LT2
caaagucgucaaua

SEQ ID NO: 1880492 - RNA, 16 nt, Salmonella typhimurium LT2
caaagucuucaugguc

SEQ ID NO: 1880493 - RNA, 10 nt, Salmonella typhimurium LT2
caaagggagc

SEQ ID NO: 1880494 - RNA, 17 nt, Salmonella typhimurium LT2
caaagucaccuuagcga

SEQ ID NO: 1880495 - RNA, 16 nt, Salmonella typhimurium LT2
caaauaguccagcagc

SEQ ID NO: 1880496 - RNA, 16 nt, Salmonella typhimurium LT2
caaaucgcccaucaca

SEQ ID NO: 1880497 - RNA, 15 nt, Salmonella typhimurium LT2
caaaucgccaucagc

SEQ ID NO: 1880498 - RNA, 18 nt, Salmonella typhimurium LT2
caaaucgcccaucacaug

SEQ ID NO: 1880499 - RNA, 20 nt, Salmonella typhimurium LT2
caaaucgcccaucacaugua

SEQ ID NO: 1880500 - RNA, 17 nt, Salmonella typhimurium LT2
caaaucccgguaaaggu

SEQ ID NO: 1880501 - RNA, 18 nt, Salmonella typhimurium LT2
caaaucaucgccaugacc

SEQ ID NO: 1880502 - RNA, 13 nt, Salmonella typhimurium LT2
caaaucaucagca

SEQ ID NO: 1880503 - RNA, 13 nt, Salmonella typhimurium LT2
caaaucagcagga

SEQ ID NO: 1880504 - RNA, 11 nt, Salmonella typhimurium LT2
caaaucacugg

SEQ ID NO: 1880505 - RNA, 17 nt, Salmonella typhimurium LT2
caaccagcgaaaugaca

SEQ ID NO: 1880506 - RNA, 20 nt, Salmonella typhimurium LT2
caaccagcgaaaugacagcc

SEQ ID NO: 1880507 - RNA, 18 nt, Salmonella typhimurium LT2
caaccagugcaacgccuu

SEQ ID NO: 1880508 - RNA, 12 nt, Salmonella typhimurium LT2
caaccaggcaaa

SEQ ID NO: 1880509 - RNA, 13 nt, Salmonella typhimurium LT2
caaccaggcaaac

SEQ ID NO: 1880510 - RNA, 16 nt, Salmonella typhimurium LT2
caaccagcccaugaau

SEQ ID NO: 1880511 - RNA, 18 nt, Salmonella typhimurium LT2
caaccagcccaugaauga

SEQ ID NO: 1880512 - RNA, 17 nt, Salmonella typhimurium LT2
caacauuucgcacccug

SEQ ID NO: 1880513 - RNA, 18 nt, Salmonella typhimurium LT2
caacauuucgcacccugu

SEQ ID NO: 1880514 - RNA, 14 nt, Salmonella typhimurium LT2
caacauugccggca

SEQ ID NO: 1880515 - RNA, 15 nt, Salmonella typhimurium LT2
caacaugaccagcgc

SEQ ID NO: 1880516 - RNA, 21 nt, Salmonella typhimurium LT2
caacaugacauuaauucaguc

SEQ ID NO: 1880517 - RNA, 15 nt, Salmonella typhimurium LT2
caacaugaaagggaa

SEQ ID NO: 1880518 - RNA, 18 nt, Salmonella typhimurium LT2
caaccauauuuaugcagc

SEQ ID NO: 1880519 - RNA, 22 nt, Salmonella typhimurium LT2
caacccuaaaagcgcggcgccc

SEQ ID NO: 1880520 - RNA, 19 nt, Salmonella typhimurium LT2
caacccguaccuccagcga

SEQ ID NO: 1880521 - RNA, 12 nt, Salmonella typhimurium LT2
caaccggcuggc

SEQ ID NO: 1880522 - RNA, 19 nt, Salmonella typhimurium LT2
caaccgacgaacaaaauag

SEQ ID NO: 1880523 - RNA, 20 nt, Salmonella typhimurium LT2
caacagugugccgucaucca

SEQ ID NO: 1880524 - RNA, 19 nt, Salmonella typhimurium LT2
caacaucauguccccaggu

SEQ ID NO: 1880525 - RNA, 17 nt, Salmonella typhimurium LT2
caacaucaucggaucca

SEQ ID NO: 1880526 - RNA, 21 nt, Salmonella typhimurium LT2
caacaucugugaaaacgccuu

SEQ ID NO: 1880527 - RNA, 22 nt, Salmonella typhimurium LT2
caacaaauguugauaaggugaa

SEQ ID NO: 1880528 - RNA, 20 nt, Salmonella typhimurium LT2
caacaacaggccagaauaac

SEQ ID NO: 1880529 - RNA, 14 nt, Salmonella typhimurium LT2
caacaaacauaagc

SEQ ID NO: 1880530 - RNA, 19 nt, Salmonella typhimurium LT2
caacaccgauccgaagaac

SEQ ID NO: 1880531 - RNA, 12 nt, Salmonella typhimurium LT2
caacaccauccc

SEQ ID NO: 1880532 - RNA, 20 nt, Salmonella typhimurium LT2
caaaaucccggcuggguuca

SEQ ID NO: 1880533 - RNA, 14 nt, Salmonella typhimurium LT2
caaaauucacacca

SEQ ID NO: 1880534 - RNA, 14 nt, Salmonella typhimurium LT2
caaaauuaccuuua

SEQ ID NO: 1880535 - RNA, 21 nt, Salmonella typhimurium LT2
caaaaggcuggaacagauguu

SEQ ID NO: 1880536 - RNA, 17 nt, Salmonella typhimurium LT2
caaaagccuguuuacca

SEQ ID NO: 1880537 - RNA, 14 nt, Salmonella typhimurium LT2
caaaagcguuuuau

SEQ ID NO: 1880538 - RNA, 23 nt, Salmonella typhimurium LT2
caaaaggucgauuaaacgccugg

SEQ ID NO: 1880539 - RNA, 14 nt, Salmonella typhimurium LT2
caaaauacuggccg

SEQ ID NO: 1880540 - RNA, 15 nt, Salmonella typhimurium LT2
caaaacgcucaacgc

SEQ ID NO: 1880541 - RNA, 19 nt, Salmonella typhimurium LT2
caaaaccuucauaaauacg

SEQ ID NO: 1880542 - RNA, 17 nt, Salmonella typhimurium LT2
caaaacgcugcuauuuu

SEQ ID NO: 1880543 - RNA, 16 nt, Salmonella typhimurium LT2
caaaacggcaauaagc

SEQ ID NO: 1880544 - RNA, 18 nt, Salmonella typhimurium LT2
caaaacguagagugcuuc

SEQ ID NO: 1880545 - RNA, 22 nt, Salmonella typhimurium LT2
caaaacguagagugcuucuuca

SEQ ID NO: 1880546 - RNA, 21 nt, Salmonella typhimurium LT2
caaaacgucgugaguggcggc

SEQ ID NO: 1880547 - RNA, 19 nt, Salmonella typhimurium LT2
caaaacgugguaaaaagcu

SEQ ID NO: 1880548 - RNA, 20 nt, Salmonella typhimurium LT2
caaaaagauauuauaaaaua

SEQ ID NO: 1880549 - RNA, 16 nt, Salmonella typhimurium LT2
caaaaagaggaaagcg

SEQ ID NO: 1880550 - RNA, 18 nt, Salmonella typhimurium LT2
caaaaagccuugcugaau

SEQ ID NO: 1880551 - RNA, 20 nt, Salmonella typhimurium LT2
caaaacuacgcguauuuauu

SEQ ID NO: 1880552 - RNA, 21 nt, Salmonella typhimurium LT2
caaaacugagucguaggcuca

SEQ ID NO: 1880553 - RNA, 21 nt, Salmonella typhimurium LT2
caaaacuuauuuuauuuuuau

SEQ ID NO: 1880554 - RNA, 23 nt, Salmonella typhimurium LT2
caaaagaggaaguugcucccgca

SEQ ID NO: 1880555 - RNA, 14 nt, Salmonella typhimurium LT2
caaaagauugauuu

SEQ ID NO: 1880556 - RNA, 17 nt, Salmonella typhimurium LT2
caaaagaggcuaauuau

SEQ ID NO: 1880557 - RNA, 13 nt, Salmonella typhimurium LT2
caaacaaauaaau

SEQ ID NO: 1880558 - RNA, 15 nt, Salmonella typhimurium LT2
caaacaaaucaucag

SEQ ID NO: 1880559 - RNA, 21 nt, Salmonella typhimurium LT2
caaaccacgcgcgagaacauc

SEQ ID NO: 1880560 - RNA, 15 nt, Salmonella typhimurium LT2
caaaccacagugacg

SEQ ID NO: 1880561 - RNA, 16 nt, Salmonella typhimurium LT2
caaacaaggcaucuau

SEQ ID NO: 1880562 - RNA, 15 nt, Salmonella typhimurium LT2
caaaccaggaaauaa

SEQ ID NO: 1880563 - RNA, 16 nt, Salmonella typhimurium LT2
caaaccaguuuuucau

SEQ ID NO: 1880564 - RNA, 14 nt, Salmonella typhimurium LT2
caaaccacugcugu

SEQ ID NO: 1880565 - RNA, 23 nt, Salmonella typhimurium LT2
caaaccagacgcguaaccccugc

SEQ ID NO: 1880566 - RNA, 21 nt, Salmonella typhimurium LT2
caaaccgguaaucccuucacg

SEQ ID NO: 1880567 - RNA, 19 nt, Salmonella typhimurium LT2
caaaccugagcauauaaau

SEQ ID NO: 1880568 - RNA, 21 nt, Salmonella typhimurium LT2
caaaccugagcauauaaauaa

SEQ ID NO: 1880569 - RNA, 13 nt, Salmonella typhimurium LT2
caaacuuuuaaau

SEQ ID NO: 1880570 - RNA, 13 nt, Salmonella typhimurium LT2
caaacuuccacac

SEQ ID NO: 1880571 - RNA, 19 nt, Salmonella typhimurium LT2
caaacggcagcucuuucaa

SEQ ID NO: 1880572 - RNA, 14 nt, Salmonella typhimurium LT2
caaacuuuccguug

SEQ ID NO: 1880573 - RNA, 10 nt, Salmonella typhimurium LT2
caaagauuau

SEQ ID NO: 1880574 - RNA, 23 nt, Salmonella typhimurium LT2
caaagacgguuucagugauaaag

SEQ ID NO: 1880575 - RNA, 20 nt, Salmonella typhimurium LT2
caaagcccugacgauacaua

SEQ ID NO: 1880576 - RNA, 19 nt, Salmonella typhimurium LT2
caaagccgccauccggccu

SEQ ID NO: 1880577 - RNA, 14 nt, Salmonella typhimurium LT2
caaagccggcgcca

SEQ ID NO: 1880578 - RNA, 13 nt, Salmonella typhimurium LT2
caaagccugcugg

SEQ ID NO: 1880579 - RNA, 16 nt, Salmonella typhimurium LT2
caaaggcguaaaaagg

SEQ ID NO: 1880580 - RNA, 20 nt, Salmonella typhimurium LT2
caaaggcguaaaaaggcgca

SEQ ID NO: 1880581 - RNA, 16 nt, Salmonella typhimurium LT2
caaaggaucgcaacca

SEQ ID NO: 1880582 - RNA, 19 nt, Salmonella typhimurium LT2
caaaggaucgcaaccacga

SEQ ID NO: 1880583 - RNA, 23 nt, Salmonella typhimurium LT2
caaagcgggcgacgauggggaaa

SEQ ID NO: 1880584 - RNA, 14 nt, Salmonella typhimurium LT2
caccgacagcaccg

SEQ ID NO: 1880585 - RNA, 12 nt, Salmonella typhimurium LT2
caccgacuccuc

SEQ ID NO: 1880586 - RNA, 22 nt, Salmonella typhimurium LT2
caccgacguuggcgauuacuau

SEQ ID NO: 1880587 - RNA, 16 nt, Salmonella typhimurium LT2
cacccgggaagcccuu

SEQ ID NO: 1880588 - RNA, 12 nt, Salmonella typhimurium LT2
cacccgccggca

SEQ ID NO: 1880589 - RNA, 22 nt, Salmonella typhimurium LT2
cacccguauucuuugcgccuua

SEQ ID NO: 1880590 - RNA, 14 nt, Salmonella typhimurium LT2
caccccggccacgu

SEQ ID NO: 1880591 - RNA, 21 nt, Salmonella typhimurium LT2
caccccgcgccgcugagaaaa

SEQ ID NO: 1880592 - RNA, 17 nt, Salmonella typhimurium LT2
cacccagaucgcgaucc

SEQ ID NO: 1880593 - RNA, 14 nt, Salmonella typhimurium LT2
cacccagccccccu

SEQ ID NO: 1880594 - RNA, 19 nt, Salmonella typhimurium LT2
cacccaggauggcggccaa

SEQ ID NO: 1880595 - RNA, 17 nt, Salmonella typhimurium LT2
cacccacgucaguaaga

SEQ ID NO: 1880596 - RNA, 22 nt, Salmonella typhimurium LT2
caccccagguaaauccgccagu

SEQ ID NO: 1880597 - RNA, 14 nt, Salmonella typhimurium LT2
cacccccaucgccc

SEQ ID NO: 1880598 - RNA, 18 nt, Salmonella typhimurium LT2
cacccccagcugacuggc

SEQ ID NO: 1880599 - RNA, 20 nt, Salmonella typhimurium LT2
cacccaguuuuuuucugcca

SEQ ID NO: 1880600 - RNA, 18 nt, Salmonella typhimurium LT2
cacccauagauaccuucu

SEQ ID NO: 1880601 - RNA, 22 nt, Salmonella typhimurium LT2
cacccauugaacccgaccgucu

SEQ ID NO: 1880602 - RNA, 16 nt, Salmonella typhimurium LT2
caccucacuccagacc

SEQ ID NO: 1880603 - RNA, 19 nt, Salmonella typhimurium LT2
caccguuuaaucgcccugc

SEQ ID NO: 1880604 - RNA, 18 nt, Salmonella typhimurium LT2
caccguuugcagccagau

SEQ ID NO: 1880605 - RNA, 20 nt, Salmonella typhimurium LT2
caccguuuaaucgcccugcg

SEQ ID NO: 1880606 - RNA, 16 nt, Salmonella typhimurium LT2
caccguuuuucaucaa

SEQ ID NO: 1880607 - RNA, 20 nt, Salmonella typhimurium LT2
caccguuuuucaucaagaga

SEQ ID NO: 1880608 - RNA, 12 nt, Salmonella typhimurium LT2
caccggcggcca

SEQ ID NO: 1880609 - RNA, 21 nt, Salmonella typhimurium LT2
caccgggagaaaacgcggccu

SEQ ID NO: 1880610 - RNA, 22 nt, Salmonella typhimurium LT2
caccggcagcgucguccagccc

SEQ ID NO: 1880611 - RNA, 13 nt, Salmonella typhimurium LT2
aaaauaaaggugc

SEQ ID NO: 1880612 - RNA, 15 nt, Salmonella typhimurium LT2
caccgcauccgcauc

SEQ ID NO: 1880613 - RNA, 21 nt, Salmonella typhimurium LT2
caccgcaucaaacucgcccag

SEQ ID NO: 1880614 - RNA, 15 nt, Salmonella typhimurium LT2
caccgcaucgcgccc

SEQ ID NO: 1880615 - RNA, 22 nt, Salmonella typhimurium LT2
caccgcgaauauacgcaccuga

SEQ ID NO: 1880616 - RNA, 17 nt, Salmonella typhimurium LT2
caccgcgcggcugguaa

SEQ ID NO: 1880617 - RNA, 13 nt, Salmonella typhimurium LT2
caccgccucgacc

SEQ ID NO: 1880618 - RNA, 17 nt, Salmonella typhimurium LT2
caccgccuugacaggaa

SEQ ID NO: 1880619 - RNA, 18 nt, Salmonella typhimurium LT2
caccgcggcaaccagccc

SEQ ID NO: 1880620 - RNA, 22 nt, Salmonella typhimurium LT2
caccgcggagaucgcucccgcg

SEQ ID NO: 1880621 - RNA, 20 nt, Salmonella typhimurium LT2
caccgcggagaucgcucccg

SEQ ID NO: 1880622 - RNA, 21 nt, Salmonella typhimurium LT2
caccgcggcgcucgccagccc

SEQ ID NO: 1880623 - RNA, 21 nt, Salmonella typhimurium LT2
caccgcuucacauacccgcuu

SEQ ID NO: 1880624 - RNA, 20 nt, Salmonella typhimurium LT2
caccgcugcgcucacgcggc

SEQ ID NO: 1880625 - RNA, 19 nt, Salmonella typhimurium LT2
caccgcugcgugcgcgcca

SEQ ID NO: 1880626 - RNA, 18 nt, Salmonella typhimurium LT2
caccgcuaccugcccuuu

SEQ ID NO: 1880627 - RNA, 20 nt, Salmonella typhimurium LT2
caccgcuaaaaaacaggcgc

SEQ ID NO: 1880628 - RNA, 19 nt, Salmonella typhimurium LT2
cacggcgauguaacgccuu

SEQ ID NO: 1880629 - RNA, 20 nt, Salmonella typhimurium LT2
cacggcgccaugauccagcg

SEQ ID NO: 1880630 - RNA, 19 nt, Salmonella typhimurium LT2
aaaauaggcguaaagauua

SEQ ID NO: 1880631 - RNA, 20 nt, Salmonella typhimurium LT2
aaaauaggcguaaagauuag

SEQ ID NO: 1880632 - RNA, 21 nt, Salmonella typhimurium LT2
cacggcaacgccguacuccag

SEQ ID NO: 1880633 - RNA, 22 nt, Salmonella typhimurium LT2
cacggcaacgccuuccugccag

SEQ ID NO: 1880634 - RNA, 23 nt, Salmonella typhimurium LT2
cacggcaacgccuuccugccagc

SEQ ID NO: 1880635 - RNA, 21 nt, Salmonella typhimurium LT2
cacgcuccuucuucgccguca

SEQ ID NO: 1880636 - RNA, 20 nt, Salmonella typhimurium LT2
cacggagagacaguucagau

SEQ ID NO: 1880637 - RNA, 15 nt, Salmonella typhimurium LT2
cacggauggccucug

SEQ ID NO: 1880638 - RNA, 19 nt, Salmonella typhimurium LT2
cacggauuuaauccaccac

SEQ ID NO: 1880639 - RNA, 19 nt, Salmonella typhimurium LT2
cacgcucaauggcgcgcca

SEQ ID NO: 1880640 - RNA, 18 nt, Salmonella typhimurium LT2
cacgcuaaaaaaggcaga

SEQ ID NO: 1880641 - RNA, 16 nt, Salmonella typhimurium LT2
cacgcuaaagcccagc

SEQ ID NO: 1880642 - RNA, 20 nt, Salmonella typhimurium LT2
cacgcuaaagucagcauaaa

SEQ ID NO: 1880643 - RNA, 15 nt, Salmonella typhimurium LT2
cacgcguucacaacg

SEQ ID NO: 1880644 - RNA, 13 nt, Salmonella typhimurium LT2
cacgcuccagcgg

SEQ ID NO: 1880645 - RNA, 17 nt, Salmonella typhimurium LT2
cacgcgcuggcgcgccu

SEQ ID NO: 1880646 - RNA, 15 nt, Salmonella typhimurium LT2
cacgcggccuccggc

SEQ ID NO: 1880647 - RNA, 21 nt, Salmonella typhimurium LT2
cacgcggccuccggcgcgaac

SEQ ID NO: 1880648 - RNA, 12 nt, Salmonella typhimurium LT2
cacgcgccgccu

SEQ ID NO: 1880649 - RNA, 14 nt, Salmonella typhimurium LT2
cacgcgccagccgu

SEQ ID NO: 1880650 - RNA, 19 nt, Salmonella typhimurium LT2
cacgcgcaguacggcgcac

SEQ ID NO: 1880651 - RNA, 15 nt, Salmonella typhimurium LT2
cacgcgcgcgcguca

SEQ ID NO: 1880652 - RNA, 22 nt, Salmonella typhimurium LT2
cacgccucuggcguacgcagau

SEQ ID NO: 1880653 - RNA, 16 nt, Salmonella typhimurium LT2
cacgccuguucaucag

SEQ ID NO: 1880654 - RNA, 14 nt, Salmonella typhimurium LT2
cacgcgacgccagc

SEQ ID NO: 1880655 - RNA, 16 nt, Salmonella typhimurium LT2
cacgcgaagcgccgau

SEQ ID NO: 1880656 - RNA, 13 nt, Salmonella typhimurium LT2
cacgcgacgccag

SEQ ID NO: 1880657 - RNA, 17 nt, Salmonella typhimurium LT2
cacgccgacgacaggca

SEQ ID NO: 1880658 - RNA, 19 nt, Salmonella typhimurium LT2
cacgccgacgcauccgcca

SEQ ID NO: 1880659 - RNA, 22 nt, Salmonella typhimurium LT2
cacgccgacucacgcagcgcuc

SEQ ID NO: 1880660 - RNA, 16 nt, Salmonella typhimurium LT2
cacgccgcacacagcg

SEQ ID NO: 1880661 - RNA, 21 nt, Salmonella typhimurium LT2
cacgccguagcugcgcgccgc

SEQ ID NO: 1880662 - RNA, 15 nt, Salmonella typhimurium LT2
cacgcccugaagggc

SEQ ID NO: 1880663 - RNA, 13 nt, Salmonella typhimurium LT2
cacgcaacaacag

SEQ ID NO: 1880664 - RNA, 19 nt, Salmonella typhimurium LT2
cacgauguucaacgucagc

SEQ ID NO: 1880665 - RNA, 13 nt, Salmonella typhimurium LT2
cacgauuaacccc

SEQ ID NO: 1880666 - RNA, 22 nt, Salmonella typhimurium LT2
cacgcaaaaaagcccguccguc

SEQ ID NO: 1880667 - RNA, 17 nt, Salmonella typhimurium LT2
caccuuaaacuugccgu

SEQ ID NO: 1880668 - RNA, 23 nt, Salmonella typhimurium LT2
caccucaucgcuaccuucuuccc

SEQ ID NO: 1880669 - RNA, 13 nt, Salmonella typhimurium LT2
caccugcucgccc

SEQ ID NO: 1880670 - RNA, 14 nt, Salmonella typhimurium LT2
caccuccgccacca

SEQ ID NO: 1880671 - RNA, 14 nt, Salmonella typhimurium LT2
caccugcucaggcu

SEQ ID NO: 1880672 - RNA, 17 nt, Salmonella typhimurium LT2
caccucaucccccagcc

SEQ ID NO: 1880673 - RNA, 20 nt, Salmonella typhimurium LT2
caccugcuguugcggaauac

SEQ ID NO: 1880674 - RNA, 18 nt, Salmonella typhimurium LT2
caccuggaugcugccugc

SEQ ID NO: 1880675 - RNA, 22 nt, Salmonella typhimurium LT2
caccuggaugcugccugccuga

SEQ ID NO: 1880676 - RNA, 12 nt, Salmonella typhimurium LT2
aaaauagccuga

SEQ ID NO: 1880677 - RNA, 18 nt, Salmonella typhimurium LT2
cacgaaugucgcgucagg

SEQ ID NO: 1880678 - RNA, 21 nt, Salmonella typhimurium LT2
cacgaaauaacgcacuaccag

SEQ ID NO: 1880679 - RNA, 17 nt, Salmonella typhimurium LT2
aaaauacuuccauuccc

SEQ ID NO: 1880680 - RNA, 15 nt, Salmonella typhimurium LT2
cacgacuuucaccag

SEQ ID NO: 1880681 - RNA, 13 nt, Salmonella typhimurium LT2
cacgacuuuuccu

SEQ ID NO: 1880682 - RNA, 14 nt, Salmonella typhimurium LT2
cacgacuuuuccuu

SEQ ID NO: 1880683 - RNA, 14 nt, Salmonella typhimurium LT2
cacgagccuucugg

SEQ ID NO: 1880684 - RNA, 21 nt, Salmonella typhimurium LT2
cacgagccuucuggccaaagc

SEQ ID NO: 1880685 - RNA, 22 nt, Salmonella typhimurium LT2
cacgacuaucguuacccuauuu

SEQ ID NO: 1880686 - RNA, 15 nt, Salmonella typhimurium LT2
cacgacugauaggcu

SEQ ID NO: 1880687 - RNA, 21 nt, Salmonella typhimurium LT2
cacgaauuugucccuguucca

SEQ ID NO: 1880688 - RNA, 15 nt, Salmonella typhimurium LT2
cacgacaaucucuac

SEQ ID NO: 1880689 - RNA, 20 nt, Salmonella typhimurium LT2
cacgaucuugucacaauaac

SEQ ID NO: 1880690 - RNA, 15 nt, Salmonella typhimurium LT2
cacgaugcauaugca

SEQ ID NO: 1880691 - RNA, 15 nt, Salmonella typhimurium LT2
caccaaaucccccaa

SEQ ID NO: 1880692 - RNA, 15 nt, Salmonella typhimurium LT2
caccaaauccuccag

SEQ ID NO: 1880693 - RNA, 12 nt, Salmonella typhimurium LT2
caccaaaucauc

SEQ ID NO: 1880694 - RNA, 14 nt, Salmonella typhimurium LT2
caccaacgaggcga

SEQ ID NO: 1880695 - RNA, 14 nt, Salmonella typhimurium LT2
caccacaaaggcgc

SEQ ID NO: 1880696 - RNA, 22 nt, Salmonella typhimurium LT2
caccacaaacgccgucacaaag

SEQ ID NO: 1880697 - RNA, 23 nt, Salmonella typhimurium LT2
caccacacgcuuauccagccacu

SEQ ID NO: 1880698 - RNA, 20 nt, Salmonella typhimurium LT2
cacaucgccauuaaaagcca

SEQ ID NO: 1880699 - RNA, 22 nt, Salmonella typhimurium LT2
cacauucagagcgucuacgcca

SEQ ID NO: 1880700 - RNA, 22 nt, Salmonella typhimurium LT2
cacauucaggcuggcaaagcag

SEQ ID NO: 1880701 - RNA, 17 nt, Salmonella typhimurium LT2
caccaaaaauucuuuua

SEQ ID NO: 1880702 - RNA, 22 nt, Salmonella typhimurium LT2
cacagcuugccguagcgcgcuu

SEQ ID NO: 1880703 - RNA, 21 nt, Salmonella typhimurium LT2
cacagcuugccguagcgcgcu

SEQ ID NO: 1880704 - RNA, 13 nt, Salmonella typhimurium LT2
cacauacuucugu

SEQ ID NO: 1880705 - RNA, 20 nt, Salmonella typhimurium LT2
cacauaccgcauucacucgc

SEQ ID NO: 1880706 - RNA, 18 nt, Salmonella typhimurium LT2
cacauagcauccagaccc

SEQ ID NO: 1880707 - RNA, 16 nt, Salmonella typhimurium LT2
cacauagcugagacuc

SEQ ID NO: 1880708 - RNA, 21 nt, Salmonella typhimurium LT2
cacauauaacaaacgccgcuc

SEQ ID NO: 1880709 - RNA, 23 nt, Salmonella typhimurium LT2
cacauaucgcaguugauacauuu

SEQ ID NO: 1880710 - RNA, 17 nt, Salmonella typhimurium LT2
cacagccccagcaccaa

SEQ ID NO: 1880711 - RNA, 17 nt, Salmonella typhimurium LT2
cacagccaggccgcgcc

SEQ ID NO: 1880712 - RNA, 21 nt, Salmonella typhimurium LT2
cacagcccauaccagcgcggc

SEQ ID NO: 1880713 - RNA, 21 nt, Salmonella typhimurium LT2
cacagcguacaauggcaggca

SEQ ID NO: 1880714 - RNA, 18 nt, Salmonella typhimurium LT2
cacagcucaauaucauag

SEQ ID NO: 1880715 - RNA, 14 nt, Salmonella typhimurium LT2
cacauauugcgcuu

SEQ ID NO: 1880716 - RNA, 18 nt, Salmonella typhimurium LT2
cacaucagcaacuugaag

SEQ ID NO: 1880717 - RNA, 20 nt, Salmonella typhimurium LT2
cacaucagccaacuuuuucu

SEQ ID NO: 1880718 - RNA, 15 nt, Salmonella typhimurium LT2
cacaucaccuccagc

SEQ ID NO: 1880719 - RNA, 12 nt, Salmonella typhimurium LT2
cacaucaugaug

SEQ ID NO: 1880720 - RNA, 20 nt, Salmonella typhimurium LT2
cacaucaugaugaucuucag

SEQ ID NO: 1880721 - RNA, 23 nt, Salmonella typhimurium LT2
cacaucaugaugaucuucagccc

SEQ ID NO: 1880722 - RNA, 20 nt, Salmonella typhimurium LT2
cacaucaugccagccgacag

SEQ ID NO: 1880723 - RNA, 13 nt, Salmonella typhimurium LT2
cacauccaaccgc

SEQ ID NO: 1880724 - RNA, 13 nt, Salmonella typhimurium LT2
cacauccagcccc

SEQ ID NO: 1880725 - RNA, 17 nt, Salmonella typhimurium LT2
cacauccgccagcgccu

SEQ ID NO: 1880726 - RNA, 22 nt, Salmonella typhimurium LT2
cacauccggcguguaaaccgcc

SEQ ID NO: 1880727 - RNA, 18 nt, Salmonella typhimurium LT2
cacauccggcugaaaaau

SEQ ID NO: 1880728 - RNA, 16 nt, Salmonella typhimurium LT2
cacaucccagcagaga

SEQ ID NO: 1880729 - RNA, 13 nt, Salmonella typhimurium LT2
cacauccauguac

SEQ ID NO: 1880730 - RNA, 19 nt, Salmonella typhimurium LT2
caccagcagggcaugauua

SEQ ID NO: 1880731 - RNA, 16 nt, Salmonella typhimurium LT2
caccagcgccugcgcu

SEQ ID NO: 1880732 - RNA, 13 nt, Salmonella typhimurium LT2
caccagcgcgccg

SEQ ID NO: 1880733 - RNA, 15 nt, Salmonella typhimurium LT2
caccagcgccagcga

SEQ ID NO: 1880734 - RNA, 20 nt, Salmonella typhimurium LT2
caccaggcguaagaucccag

SEQ ID NO: 1880735 - RNA, 24 nt, Salmonella typhimurium LT2
caccaggcguuauuggcgcagcca

SEQ ID NO: 1880736 - RNA, 22 nt, Salmonella typhimurium LT2
aaaauaaacgcuugacucugaa

SEQ ID NO: 1880737 - RNA, 18 nt, Salmonella typhimurium LT2
caccagcggaauccccgc

SEQ ID NO: 1880738 - RNA, 21 nt, Salmonella typhimurium LT2
caccaacggcgacgcccgcca

SEQ ID NO: 1880739 - RNA, 12 nt, Salmonella typhimurium LT2
caccaccagccc

SEQ ID NO: 1880740 - RNA, 13 nt, Salmonella typhimurium LT2
caccaccagcccg

SEQ ID NO: 1880741 - RNA, 19 nt, Salmonella typhimurium LT2
caccaccagcccggcgcac

SEQ ID NO: 1880742 - RNA, 15 nt, Salmonella typhimurium LT2
caccacgccgagaaa

SEQ ID NO: 1880743 - RNA, 19 nt, Salmonella typhimurium LT2
caccacgccuaaugaagcg

SEQ ID NO: 1880744 - RNA, 19 nt, Salmonella typhimurium LT2
caccacgccuuucacgccg

SEQ ID NO: 1880745 - RNA, 21 nt, Salmonella typhimurium LT2
caccacgaucuugucacaaua

SEQ ID NO: 1880746 - RNA, 19 nt, Salmonella typhimurium LT2
caccacguaaugcgccccg

SEQ ID NO: 1880747 - RNA, 23 nt, Salmonella typhimurium LT2
caccacugaaaaauaauuacuau

SEQ ID NO: 1880748 - RNA, 17 nt, Salmonella typhimurium LT2
caccacuugauucugca

SEQ ID NO: 1880749 - RNA, 19 nt, Salmonella typhimurium LT2
caccacuggcagcgccuga

SEQ ID NO: 1880750 - RNA, 14 nt, Salmonella typhimurium LT2
caccagcaccgcca

SEQ ID NO: 1880751 - RNA, 10 nt, Salmonella typhimurium LT2
caccagcagc

SEQ ID NO: 1880752 - RNA, 12 nt, Salmonella typhimurium LT2
cacacggcgcca

SEQ ID NO: 1880753 - RNA, 15 nt, Salmonella typhimurium LT2
cacacggcgccauga

SEQ ID NO: 1880754 - RNA, 23 nt, Salmonella typhimurium LT2
cacacggcgccaugauccagcgg

SEQ ID NO: 1880755 - RNA, 21 nt, Salmonella typhimurium LT2
cacacgcuuauccagccacug

SEQ ID NO: 1880756 - RNA, 21 nt, Salmonella typhimurium LT2
cacacgcuucugguugucacg

SEQ ID NO: 1880757 - RNA, 20 nt, Salmonella typhimurium LT2
cacacguauaaacgccgccg

SEQ ID NO: 1880758 - RNA, 20 nt, Salmonella typhimurium LT2
cacacgccuggccaggcuuu

SEQ ID NO: 1880759 - RNA, 13 nt, Salmonella typhimurium LT2
cacacacuguuua

SEQ ID NO: 1880760 - RNA, 20 nt, Salmonella typhimurium LT2
cacacagcggaaagcaacag

SEQ ID NO: 1880761 - RNA, 18 nt, Salmonella typhimurium LT2
cacacauaagcacaccau

SEQ ID NO: 1880762 - RNA, 18 nt, Salmonella typhimurium LT2
cacaaugccgcccaggau

SEQ ID NO: 1880763 - RNA, 20 nt, Salmonella typhimurium LT2
cacaaucgcgccugccagga

SEQ ID NO: 1880764 - RNA, 20 nt, Salmonella typhimurium LT2
cacaaucgccgugaucccaa

SEQ ID NO: 1880765 - RNA, 16 nt, Salmonella typhimurium LT2
cacagauuacaaggaa

SEQ ID NO: 1880766 - RNA, 14 nt, Salmonella typhimurium LT2
cacagauuccagau

SEQ ID NO: 1880767 - RNA, 19 nt, Salmonella typhimurium LT2
cacagcaccauguugacca

SEQ ID NO: 1880768 - RNA, 15 nt, Salmonella typhimurium LT2
cacagcacauagaag

SEQ ID NO: 1880769 - RNA, 22 nt, Salmonella typhimurium LT2
cacagcacauagaagcucaugu

SEQ ID NO: 1880770 - RNA, 20 nt, Salmonella typhimurium LT2
cacagcacuaacgaggccac

SEQ ID NO: 1880771 - RNA, 14 nt, Salmonella typhimurium LT2
cacagcaugaauaa

SEQ ID NO: 1880772 - RNA, 22 nt, Salmonella typhimurium LT2
cacagcaugaauaaccucccgc

SEQ ID NO: 1880773 - RNA, 15 nt, Salmonella typhimurium LT2
cacagccacacugcu

SEQ ID NO: 1880774 - RNA, 13 nt, Salmonella typhimurium LT2
cacagaugacaga

SEQ ID NO: 1880775 - RNA, 24 nt, Salmonella typhimurium LT2
cacacuuucgcccggcgccagcuc

SEQ ID NO: 1880776 - RNA, 19 nt, Salmonella typhimurium LT2
cacaagagcagcaacccug

SEQ ID NO: 1880777 - RNA, 16 nt, Salmonella typhimurium LT2
cacaagagcagcaacc

SEQ ID NO: 1880778 - RNA, 21 nt, Salmonella typhimurium LT2
cacaagauucacucugaaaaa

SEQ ID NO: 1880779 - RNA, 17 nt, Salmonella typhimurium LT2
cacaagcuguuucuccg

SEQ ID NO: 1880780 - RNA, 13 nt, Salmonella typhimurium LT2
cacaaguuuaucc

SEQ ID NO: 1880781 - RNA, 21 nt, Salmonella typhimurium LT2
cacaaucccgccagacccgca

SEQ ID NO: 1880782 - RNA, 12 nt, Salmonella typhimurium LT2
cacaacguaaua

SEQ ID NO: 1880783 - RNA, 21 nt, Salmonella typhimurium LT2
cacaacgucaguggaaaacag

SEQ ID NO: 1880784 - RNA, 14 nt, Salmonella typhimurium LT2
cacaacgucauccc

SEQ ID NO: 1880785 - RNA, 22 nt, Salmonella typhimurium LT2
cacaacgugccagaaacaagaa

SEQ ID NO: 1880786 - RNA, 13 nt, Salmonella typhimurium LT2
cacaacuguucuu

SEQ ID NO: 1880787 - RNA, 17 nt, Salmonella typhimurium LT2
cacaaccuccacgccca

SEQ ID NO: 1880788 - RNA, 12 nt, Salmonella typhimurium LT2
cacaacccaaag

SEQ ID NO: 1880789 - RNA, 14 nt, Salmonella typhimurium LT2
caauuugcugcugu

SEQ ID NO: 1880790 - RNA, 16 nt, Salmonella typhimurium LT2
caauggccgcagcgcc

SEQ ID NO: 1880791 - RNA, 19 nt, Salmonella typhimurium LT2
caauggcgacgaucagcgc

SEQ ID NO: 1880792 - RNA, 20 nt, Salmonella typhimurium LT2
caauggccccuggcugaaag

SEQ ID NO: 1880793 - RNA, 14 nt, Salmonella typhimurium LT2
caaugucauauuug

SEQ ID NO: 1880794 - RNA, 16 nt, Salmonella typhimurium LT2
caaugucaucaagauu

SEQ ID NO: 1880795 - RNA, 17 nt, Salmonella typhimurium LT2
caauguauuuuacgcag

SEQ ID NO: 1880796 - RNA, 22 nt, Salmonella typhimurium LT2
caauguaacaccuguaacguca

SEQ ID NO: 1880797 - RNA, 23 nt, Salmonella typhimurium LT2
caauguaaaacgguaugaaacau

SEQ ID NO: 1880798 - RNA, 13 nt, Salmonella typhimurium LT2
caauggucagcgc

SEQ ID NO: 1880799 - RNA, 19 nt, Salmonella typhimurium LT2
caauggcuucaaugaucca

SEQ ID NO: 1880800 - RNA, 18 nt, Salmonella typhimurium LT2
caaugaccgcaauuaaau

SEQ ID NO: 1880801 - RNA, 23 nt, Salmonella typhimurium LT2
caaugaccgcaauuaaaugaaug

SEQ ID NO: 1880802 - RNA, 21 nt, Salmonella typhimurium LT2
caaucuggugacgaugauaac

SEQ ID NO: 1880803 - RNA, 22 nt, Salmonella typhimurium LT2
caaucuggccguuugcugcucu

SEQ ID NO: 1880804 - RNA, 15 nt, Salmonella typhimurium LT2
caaugcuuucaccag

SEQ ID NO: 1880805 - RNA, 17 nt, Salmonella typhimurium LT2
caaugcugcuuugaugc

SEQ ID NO: 1880806 - RNA, 15 nt, Salmonella typhimurium LT2
caauuucccccacuu

SEQ ID NO: 1880807 - RNA, 20 nt, Salmonella typhimurium LT2
caauuuccccugcgaacagc

SEQ ID NO: 1880808 - RNA, 16 nt, Salmonella typhimurium LT2
caauuucauucaccac

SEQ ID NO: 1880809 - RNA, 15 nt, Salmonella typhimurium LT2
caauuccgcgccgcc

SEQ ID NO: 1880810 - RNA, 14 nt, Salmonella typhimurium LT2
caauucccagaccc

SEQ ID NO: 1880811 - RNA, 20 nt, Salmonella typhimurium LT2
caaugugguuaucguauaau

SEQ ID NO: 1880812 - RNA, 19 nt, Salmonella typhimurium LT2
caauguuaacuacuuuaca

SEQ ID NO: 1880813 - RNA, 20 nt, Salmonella typhimurium LT2
caauucggaucgauaaaagc

SEQ ID NO: 1880814 - RNA, 23 nt, Salmonella typhimurium LT2
caauucgagauuuuucugcgcca

SEQ ID NO: 1880815 - RNA, 14 nt, Salmonella typhimurium LT2
caauuccugccaga

SEQ ID NO: 1880816 - RNA, 21 nt, Salmonella typhimurium LT2
augcaaugucuuuauccgcca

SEQ ID NO: 1880817 - RNA, 14 nt, Salmonella typhimurium LT2
augcaaagaaaaac

SEQ ID NO: 1880818 - RNA, 17 nt, Salmonella typhimurium LT2
augcaaagucaguuuuc

SEQ ID NO: 1880819 - RNA, 21 nt, Salmonella typhimurium LT2
augauuugcaaccgcucuuuu

SEQ ID NO: 1880820 - RNA, 16 nt, Salmonella typhimurium LT2
augauuuucaaaccaa

SEQ ID NO: 1880821 - RNA, 17 nt, Salmonella typhimurium LT2
augauucaaucggcgau

SEQ ID NO: 1880822 - RNA, 16 nt, Salmonella typhimurium LT2
augauuuaaaaguaca

SEQ ID NO: 1880823 - RNA, 19 nt, Salmonella typhimurium LT2
augauggcgaacagcccca

SEQ ID NO: 1880824 - RNA, 21 nt, Salmonella typhimurium LT2
augaugagaugcaggccaagc

SEQ ID NO: 1880825 - RNA, 17 nt, Salmonella typhimurium LT2
augaugaccgaagcagg

SEQ ID NO: 1880826 - RNA, 17 nt, Salmonella typhimurium LT2
augaugcgcuguaaaug

SEQ ID NO: 1880827 - RNA, 19 nt, Salmonella typhimurium LT2
augaugagauacgucauca

SEQ ID NO: 1880828 - RNA, 12 nt, Salmonella typhimurium LT2
augagccagccc

SEQ ID NO: 1880829 - RNA, 12 nt, Salmonella typhimurium LT2
augagcaggccc

SEQ ID NO: 1880830 - RNA, 22 nt, Salmonella typhimurium LT2
augagcaggcccgguaagcaca

SEQ ID NO: 1880831 - RNA, 23 nt, Salmonella typhimurium LT2
augagauugauaaucagcaagau

SEQ ID NO: 1880832 - RNA, 14 nt, Salmonella typhimurium LT2
augagcaaaaugcu

SEQ ID NO: 1880833 - RNA, 18 nt, Salmonella typhimurium LT2
augagcaaaaugcucauu

SEQ ID NO: 1880834 - RNA, 22 nt, Salmonella typhimurium LT2
augagcaaaguaaaacaagccg

SEQ ID NO: 1880835 - RNA, 19 nt, Salmonella typhimurium LT2
augccucauuaaaaaaaca

SEQ ID NO: 1880836 - RNA, 18 nt, Salmonella typhimurium LT2
augccgccuuuaucgaca

SEQ ID NO: 1880837 - RNA, 16 nt, Salmonella typhimurium LT2
augccgccguuuuauu

SEQ ID NO: 1880838 - RNA, 21 nt, Salmonella typhimurium LT2
augccuucauaaugaauacgc

SEQ ID NO: 1880839 - RNA, 17 nt, Salmonella typhimurium LT2
augccuggggucgucag

SEQ ID NO: 1880840 - RNA, 22 nt, Salmonella typhimurium LT2
augccugcgccauguucauaaa

SEQ ID NO: 1880841 - RNA, 17 nt, Salmonella typhimurium LT2
augcgacuccaggaaca

SEQ ID NO: 1880842 - RNA, 18 nt, Salmonella typhimurium LT2
augcgacuccaggaacag

SEQ ID NO: 1880843 - RNA, 15 nt, Salmonella typhimurium LT2
augcgaauaaucgcc

SEQ ID NO: 1880844 - RNA, 16 nt, Salmonella typhimurium LT2
augcgaauaacaucau

SEQ ID NO: 1880845 - RNA, 19 nt, Salmonella typhimurium LT2
augccuuuuucaacagcac

SEQ ID NO: 1880846 - RNA, 18 nt, Salmonella typhimurium LT2
augccuuugguuuccccg

SEQ ID NO: 1880847 - RNA, 17 nt, Salmonella typhimurium LT2
augcgccccugcaggcg

SEQ ID NO: 1880848 - RNA, 17 nt, Salmonella typhimurium LT2
augcgcccggagcggug

SEQ ID NO: 1880849 - RNA, 13 nt, Salmonella typhimurium LT2
augcgccauccca

SEQ ID NO: 1880850 - RNA, 18 nt, Salmonella typhimurium LT2
augcgccaggcagcaccu

SEQ ID NO: 1880851 - RNA, 17 nt, Salmonella typhimurium LT2
augcgccagcggccagc

SEQ ID NO: 1880852 - RNA, 15 nt, Salmonella typhimurium LT2
augccauccagcacc

SEQ ID NO: 1880853 - RNA, 13 nt, Salmonella typhimurium LT2
augccaucccuuc

SEQ ID NO: 1880854 - RNA, 16 nt, Salmonella typhimurium LT2
augccaucggccagca

SEQ ID NO: 1880855 - RNA, 17 nt, Salmonella typhimurium LT2
augccgaagacuccccu

SEQ ID NO: 1880856 - RNA, 16 nt, Salmonella typhimurium LT2
augccgaguuccggau

SEQ ID NO: 1880857 - RNA, 22 nt, Salmonella typhimurium LT2
augccgcaauaaacacgauggc

SEQ ID NO: 1880858 - RNA, 12 nt, Salmonella typhimurium LT2
augccgaccaau

SEQ ID NO: 1880859 - RNA, 10 nt, Salmonella typhimurium LT2
augccgccgc

SEQ ID NO: 1880860 - RNA, 21 nt, Salmonella typhimurium LT2
augccgcacuccccagaauga

SEQ ID NO: 1880861 - RNA, 14 nt, Salmonella typhimurium LT2
augcagaccucugc

SEQ ID NO: 1880862 - RNA, 21 nt, Salmonella typhimurium LT2
augcagcaggucgaccaccug

SEQ ID NO: 1880863 - RNA, 14 nt, Salmonella typhimurium LT2
augccaagcggcau

SEQ ID NO: 1880864 - RNA, 21 nt, Salmonella typhimurium LT2
augcagcgcaaacucagagag

SEQ ID NO: 1880865 - RNA, 14 nt, Salmonella typhimurium LT2
augccaacuuuacu

SEQ ID NO: 1880866 - RNA, 14 nt, Salmonella typhimurium LT2
augccaccagcgcc

SEQ ID NO: 1880867 - RNA, 20 nt, Salmonella typhimurium LT2
augccaaguaauaaagagaa

SEQ ID NO: 1880868 - RNA, 13 nt, Salmonella typhimurium LT2
augcugccagcau

SEQ ID NO: 1880869 - RNA, 20 nt, Salmonella typhimurium LT2
augcucugcugugccaguac

SEQ ID NO: 1880870 - RNA, 17 nt, Salmonella typhimurium LT2
augcugauuugccagau

SEQ ID NO: 1880871 - RNA, 14 nt, Salmonella typhimurium LT2
augcuccuuccguc

SEQ ID NO: 1880872 - RNA, 18 nt, Salmonella typhimurium LT2
augcgcgucaggccaggg

SEQ ID NO: 1880873 - RNA, 21 nt, Salmonella typhimurium LT2
augcuccaguuguuccagcag

SEQ ID NO: 1880874 - RNA, 20 nt, Salmonella typhimurium LT2
augcucccccccuuccccca

SEQ ID NO: 1880875 - RNA, 20 nt, Salmonella typhimurium LT2
augcgcguuuagcgccagca

SEQ ID NO: 1880876 - RNA, 21 nt, Salmonella typhimurium LT2
augcgcgucccggcagugcau

SEQ ID NO: 1880877 - RNA, 14 nt, Salmonella typhimurium LT2
augcuuaucgccaa

SEQ ID NO: 1880878 - RNA, 16 nt, Salmonella typhimurium LT2
augcuuccggcagguu

SEQ ID NO: 1880879 - RNA, 14 nt, Salmonella typhimurium LT2
augcuuacagagca

SEQ ID NO: 1880880 - RNA, 15 nt, Salmonella typhimurium LT2
augcuuucagcaugu

SEQ ID NO: 1880881 - RNA, 18 nt, Salmonella typhimurium LT2
augcuuucgcgauaauca

SEQ ID NO: 1880882 - RNA, 17 nt, Salmonella typhimurium LT2
augcuuuaaaugccugu

SEQ ID NO: 1880883 - RNA, 14 nt, Salmonella typhimurium LT2
augcuuuaaaugcc

SEQ ID NO: 1880884 - RNA, 17 nt, Salmonella typhimurium LT2
auggacgggauacggcg

SEQ ID NO: 1880885 - RNA, 23 nt, Salmonella typhimurium LT2
auggacgggauacggcgagacca

SEQ ID NO: 1880886 - RNA, 22 nt, Salmonella typhimurium LT2
auggagccuucaaccauugucu

SEQ ID NO: 1880887 - RNA, 20 nt, Salmonella typhimurium LT2
auggaacugccuggcucauu

SEQ ID NO: 1880888 - RNA, 22 nt, Salmonella typhimurium LT2
auggacagggucgauucccaga

SEQ ID NO: 1880889 - RNA, 14 nt, Salmonella typhimurium LT2
augcuuuuuacauu

SEQ ID NO: 1880890 - RNA, 14 nt, Salmonella typhimurium LT2
auggaaaugcacgu

SEQ ID NO: 1880891 - RNA, 15 nt, Salmonella typhimurium LT2
auggcgucgugcagc

SEQ ID NO: 1880892 - RNA, 23 nt, Salmonella typhimurium LT2
auggccccggucaacgcgccgcc

SEQ ID NO: 1880893 - RNA, 19 nt, Salmonella typhimurium LT2
auggcccagcguacugcca

SEQ ID NO: 1880894 - RNA, 22 nt, Salmonella typhimurium LT2
auggccgacauugaccagugca

SEQ ID NO: 1880895 - RNA, 19 nt, Salmonella typhimurium LT2
auggcaggcagcacaauca

SEQ ID NO: 1880896 - RNA, 15 nt, Salmonella typhimurium LT2
auggcauacagcucg

SEQ ID NO: 1880897 - RNA, 22 nt, Salmonella typhimurium LT2
auggcauaugacgguauugcuu

SEQ ID NO: 1880898 - RNA, 16 nt, Salmonella typhimurium LT2
auggcaucaaucccgc

SEQ ID NO: 1880899 - RNA, 20 nt, Salmonella typhimurium LT2
auggguuauggauguuuuca

SEQ ID NO: 1880900 - RNA, 16 nt, Salmonella typhimurium LT2
augggcgggauccugc

SEQ ID NO: 1880901 - RNA, 18 nt, Salmonella typhimurium LT2
auggcugauggcgaaaau

SEQ ID NO: 1880902 - RNA, 16 nt, Salmonella typhimurium LT2
auggcucagauugaac

SEQ ID NO: 1880903 - RNA, 23 nt, Salmonella typhimurium LT2
auggcugcgacaaugaagcauaa

SEQ ID NO: 1880904 - RNA, 23 nt, Salmonella typhimurium LT2
auggugauagcgcgccagcacca

SEQ ID NO: 1880905 - RNA, 13 nt, Salmonella typhimurium LT2
auggugccgccga

SEQ ID NO: 1880906 - RNA, 16 nt, Salmonella typhimurium LT2
augguacucaacauca

SEQ ID NO: 1880907 - RNA, 16 nt, Salmonella typhimurium LT2
augguagcugcggcua

SEQ ID NO: 1880908 - RNA, 16 nt, Salmonella typhimurium LT2
augguguauaaauaac

SEQ ID NO: 1880909 - RNA, 13 nt, Salmonella typhimurium LT2
auggugcucagcc

SEQ ID NO: 1880910 - RNA, 22 nt, Salmonella typhimurium LT2
augguugcaugauuaggcuggg

SEQ ID NO: 1880911 - RNA, 18 nt, Salmonella typhimurium LT2
augguuauaguccacuuu

SEQ ID NO: 1880912 - RNA, 22 nt, Salmonella typhimurium LT2
augguguuggcgaucagcggca

SEQ ID NO: 1880913 - RNA, 18 nt, Salmonella typhimurium LT2
augguuacgcgacgugcu

SEQ ID NO: 1880914 - RNA, 22 nt, Salmonella typhimurium LT2
augguuacgcgacgugcugugg

SEQ ID NO: 1880915 - RNA, 23 nt, Salmonella typhimurium LT2
auguaaacuccauuaaauuacuu

SEQ ID NO: 1880916 - RNA, 22 nt, Salmonella typhimurium LT2
auguaaagucggccauuuuuuu

SEQ ID NO: 1880917 - RNA, 17 nt, Salmonella typhimurium LT2
auguaaauuaauucaug

SEQ ID NO: 1880918 - RNA, 12 nt, Salmonella typhimurium LT2
augucuaugauu

SEQ ID NO: 1880919 - RNA, 16 nt, Salmonella typhimurium LT2
augucgacauaauuuc

SEQ ID NO: 1880920 - RNA, 18 nt, Salmonella typhimurium LT2
auguacgcaggcggcugg

SEQ ID NO: 1880921 - RNA, 18 nt, Salmonella typhimurium LT2
auguaccgcuacgcaggc

SEQ ID NO: 1880922 - RNA, 18 nt, Salmonella typhimurium LT2
auguacaucguaaagcac

SEQ ID NO: 1880923 - RNA, 21 nt, Salmonella typhimurium LT2
augugcaaucacacuacacga

SEQ ID NO: 1880924 - RNA, 16 nt, Salmonella typhimurium LT2
augugaauccaggcca

SEQ ID NO: 1880925 - RNA, 16 nt, Salmonella typhimurium LT2
augucugcgucgggug

SEQ ID NO: 1880926 - RNA, 20 nt, Salmonella typhimurium LT2
auguggguauccacgccugg

SEQ ID NO: 1880927 - RNA, 14 nt, Salmonella typhimurium LT2
augugcgccagccu

SEQ ID NO: 1880928 - RNA, 23 nt, Salmonella typhimurium LT2
augugcggagaagacgccgccgc

SEQ ID NO: 1880929 - RNA, 17 nt, Salmonella typhimurium LT2
augugcucguuggccug

SEQ ID NO: 1880930 - RNA, 19 nt, Salmonella typhimurium LT2
augugcuauuuucucuugc

SEQ ID NO: 1880931 - RNA, 22 nt, Salmonella typhimurium LT2
auguggacgccauaaaccagaa

SEQ ID NO: 1880932 - RNA, 17 nt, Salmonella typhimurium LT2
auguuaacuacuuuaca

SEQ ID NO: 1880933 - RNA, 14 nt, Salmonella typhimurium LT2
auguguuugagcag

SEQ ID NO: 1880934 - RNA, 15 nt, Salmonella typhimurium LT2
auguuaccuguuaaa

SEQ ID NO: 1880935 - RNA, 16 nt, Salmonella typhimurium LT2
auguuagaaucuauua

SEQ ID NO: 1880936 - RNA, 23 nt, Salmonella typhimurium LT2
auguuccuggacguggguuucaa

SEQ ID NO: 1880937 - RNA, 14 nt, Salmonella typhimurium LT2
auguucgaacaugc

SEQ ID NO: 1880938 - RNA, 14 nt, Salmonella typhimurium LT2
auguucuaacagau

SEQ ID NO: 1880939 - RNA, 15 nt, Salmonella typhimurium LT2
auguuugccacgcca

SEQ ID NO: 1880940 - RNA, 21 nt, Salmonella typhimurium LT2
auguugaucguaaaaugaaaa

SEQ ID NO: 1880941 - RNA, 17 nt, Salmonella typhimurium LT2
auguuuucagcauuaau

SEQ ID NO: 1880942 - RNA, 20 nt, Salmonella typhimurium LT2
auuaaaaagcagccagaccc

SEQ ID NO: 1880943 - RNA, 19 nt, Salmonella typhimurium LT2
auuaaaacaagucagcguu

SEQ ID NO: 1880944 - RNA, 19 nt, Salmonella typhimurium LT2
auuaaaacucuccaugcca

SEQ ID NO: 1880945 - RNA, 20 nt, Salmonella typhimurium LT2
auuaaaaccauugcuaaaaa

SEQ ID NO: 1880946 - RNA, 22 nt, Salmonella typhimurium LT2
auuaaaaccauugcuaaaaaua

SEQ ID NO: 1880947 - RNA, 16 nt, Salmonella typhimurium LT2
auuaaacuuucaugaa

SEQ ID NO: 1880948 - RNA, 11 nt, Salmonella typhimurium LT2
auuaaaucauc

SEQ ID NO: 1880949 - RNA, 13 nt, Salmonella typhimurium LT2
auuaagcagacug

SEQ ID NO: 1880950 - RNA, 14 nt, Salmonella typhimurium LT2
auuaagcagacugc

SEQ ID NO: 1880951 - RNA, 13 nt, Salmonella typhimurium LT2
auuaagcaggccg

SEQ ID NO: 1880952 - RNA, 17 nt, Salmonella typhimurium LT2
auuaaguuuuuuuaaaa

SEQ ID NO: 1880953 - RNA, 18 nt, Salmonella typhimurium LT2
auuaaguuuuuuuaaaaa

SEQ ID NO: 1880954 - RNA, 22 nt, Salmonella typhimurium LT2
auuaaggccggcauuuuauuca

SEQ ID NO: 1880955 - RNA, 22 nt, Salmonella typhimurium LT2
auuaagcggauuuuuucgcuuu

SEQ ID NO: 1880956 - RNA, 17 nt, Salmonella typhimurium LT2
auuaagccuuuuuaaau

SEQ ID NO: 1880957 - RNA, 18 nt, Salmonella typhimurium LT2
auuaagccuuuuuaaaua

SEQ ID NO: 1880958 - RNA, 23 nt, Salmonella typhimurium LT2
auuaagccuuuuuaaauauuaag

SEQ ID NO: 1880959 - RNA, 22 nt, Salmonella typhimurium LT2
auuaauacaggccagcauugau

SEQ ID NO: 1880960 - RNA, 16 nt, Salmonella typhimurium LT2
auuaaauguuugcuuu

SEQ ID NO: 1880961 - RNA, 17 nt, Salmonella typhimurium LT2
auuaacgacauuuuugc

SEQ ID NO: 1880962 - RNA, 12 nt, Salmonella typhimurium LT2
auuaacugcacu

SEQ ID NO: 1880963 - RNA, 18 nt, Salmonella typhimurium LT2
auuaacugcacuuucugc

SEQ ID NO: 1880964 - RNA, 21 nt, Salmonella typhimurium LT2
auuaacugcacuuucugcacu

SEQ ID NO: 1880965 - RNA, 19 nt, Salmonella typhimurium LT2
aaaagcgauuuauucuuug

SEQ ID NO: 1880966 - RNA, 14 nt, Salmonella typhimurium LT2
auuagucugccauu

SEQ ID NO: 1880967 - RNA, 20 nt, Salmonella typhimurium LT2
auuaugccgcacuccccaga

SEQ ID NO: 1880968 - RNA, 18 nt, Salmonella typhimurium LT2
auuaugccugucaucauc

SEQ ID NO: 1880969 - RNA, 23 nt, Salmonella typhimurium LT2
auuaucuaccagccgauuuuucg

SEQ ID NO: 1880970 - RNA, 14 nt, Salmonella typhimurium LT2
auuauguugagagc

SEQ ID NO: 1880971 - RNA, 15 nt, Salmonella typhimurium LT2
auuauguagcaacag

SEQ ID NO: 1880972 - RNA, 14 nt, Salmonella typhimurium LT2
auuaugguagcugc

SEQ ID NO: 1880973 - RNA, 15 nt, Salmonella typhimurium LT2
auucaaaauccgcca

SEQ ID NO: 1880974 - RNA, 21 nt, Salmonella typhimurium LT2
auucaaaccuucaagaaucaa

SEQ ID NO: 1880975 - RNA, 16 nt, Salmonella typhimurium LT2
auuauuuuugucauaa

SEQ ID NO: 1880976 - RNA, 14 nt, Salmonella typhimurium LT2
auuauuuuuucuuu

SEQ ID NO: 1880977 - RNA, 17 nt, Salmonella typhimurium LT2
auuauuuuuucuuuaau

SEQ ID NO: 1880978 - RNA, 22 nt, Salmonella typhimurium LT2
auuauuuuuucuuuaauuaaau

SEQ ID NO: 1880979 - RNA, 18 nt, Salmonella typhimurium LT2
auucaauaauauugucau

SEQ ID NO: 1880980 - RNA, 16 nt, Salmonella typhimurium LT2
auucaagcuguuggau

SEQ ID NO: 1880981 - RNA, 20 nt, Salmonella typhimurium LT2
auucaagaacgguuuauccc

SEQ ID NO: 1880982 - RNA, 18 nt, Salmonella typhimurium LT2
auuauuuuagugaaaaaa

SEQ ID NO: 1880983 - RNA, 19 nt, Salmonella typhimurium LT2
auuauuuuagugaaaaaau

SEQ ID NO: 1880984 - RNA, 21 nt, Salmonella typhimurium LT2
auuauuuuucuauuccgcuca

SEQ ID NO: 1880985 - RNA, 14 nt, Salmonella typhimurium LT2
auuauuuacaguau

SEQ ID NO: 1880986 - RNA, 22 nt, Salmonella typhimurium LT2
auuauugcguugcuuuauaaaa

SEQ ID NO: 1880987 - RNA, 21 nt, Salmonella typhimurium LT2
auuacguuggggauaaccaga

SEQ ID NO: 1880988 - RNA, 13 nt, Salmonella typhimurium LT2
auuacuauacccg

SEQ ID NO: 1880989 - RNA, 22 nt, Salmonella typhimurium LT2
auuaccgggauuuccauauuaa

SEQ ID NO: 1880990 - RNA, 23 nt, Salmonella typhimurium LT2
auuaccgggauuuccauauuaac

SEQ ID NO: 1880991 - RNA, 22 nt, Salmonella typhimurium LT2
auuacguucaacgggaaaaaau

SEQ ID NO: 1880992 - RNA, 16 nt, Salmonella typhimurium LT2
auuacaggaguaugcg

SEQ ID NO: 1880993 - RNA, 19 nt, Salmonella typhimurium LT2
auuacaucaaaugaacaca

SEQ ID NO: 1880994 - RNA, 21 nt, Salmonella typhimurium LT2
auuaccgaugguuaaagguug

SEQ ID NO: 1880995 - RNA, 17 nt, Salmonella typhimurium LT2
aaaagccagauaaagca

SEQ ID NO: 1880996 - RNA, 22 nt, Salmonella typhimurium LT2
aaaagccagcacggcuucacgu

SEQ ID NO: 1880997 - RNA, 15 nt, Salmonella typhimurium LT2
aaaagccaugccgaa

SEQ ID NO: 1880998 - RNA, 16 nt, Salmonella typhimurium LT2
auuaauacguacugaa

SEQ ID NO: 1880999 - RNA, 14 nt, Salmonella typhimurium LT2
aaaagcccucucac

SEQ ID NO: 1881000 - RNA, 15 nt, Salmonella typhimurium LT2
auuacuuaugauaua

SEQ ID NO: 1881001 - RNA, 15 nt, Salmonella typhimurium LT2
auuacugaauaccuu

SEQ ID NO: 1881002 - RNA, 16 nt, Salmonella typhimurium LT2
auuagccagaggcuaa

SEQ ID NO: 1881003 - RNA, 18 nt, Salmonella typhimurium LT2
aaaagcgguaauaacuga

SEQ ID NO: 1881004 - RNA, 14 nt, Salmonella typhimurium LT2
aaaagcgaaaauaa

SEQ ID NO: 1881005 - RNA, 19 nt, Salmonella typhimurium LT2
aaaagcgccacgcgucagg

SEQ ID NO: 1881006 - RNA, 14 nt, Salmonella typhimurium LT2
auuccaucaaaagc

SEQ ID NO: 1881007 - RNA, 22 nt, Salmonella typhimurium LT2
auuccaucaauaauccggcaau

SEQ ID NO: 1881008 - RNA, 18 nt, Salmonella typhimurium LT2
auuccgugucugaaugag

SEQ ID NO: 1881009 - RNA, 22 nt, Salmonella typhimurium LT2
auucccugcgcauacgucaugc

SEQ ID NO: 1881010 - RNA, 18 nt, Salmonella typhimurium LT2
auucccguaaaagaagaa

SEQ ID NO: 1881011 - RNA, 16 nt, Salmonella typhimurium LT2
auucccgucccugcau

SEQ ID NO: 1881012 - RNA, 15 nt, Salmonella typhimurium LT2
auucccgucccugca

SEQ ID NO: 1881013 - RNA, 21 nt, Salmonella typhimurium LT2
auucccgacacuuguaaguua

SEQ ID NO: 1881014 - RNA, 20 nt, Salmonella typhimurium LT2
auucaucgauacgcggaugu

SEQ ID NO: 1881015 - RNA, 15 nt, Salmonella typhimurium LT2
auucaucgacaaaua

SEQ ID NO: 1881016 - RNA, 15 nt, Salmonella typhimurium LT2
auucaucaucuuguc

SEQ ID NO: 1881017 - RNA, 16 nt, Salmonella typhimurium LT2
aaaaggauacagcgcc

SEQ ID NO: 1881018 - RNA, 15 nt, Salmonella typhimurium LT2
aaaaggcaauaaagu

SEQ ID NO: 1881019 - RNA, 15 nt, Salmonella typhimurium LT2
auucauauuuauaca

SEQ ID NO: 1881020 - RNA, 23 nt, Salmonella typhimurium LT2
auucaagcaacuguagaaugcua

SEQ ID NO: 1881021 - RNA, 21 nt, Salmonella typhimurium LT2
auucaugguacucaacaucau

SEQ ID NO: 1881022 - RNA, 19 nt, Salmonella typhimurium LT2
auucaugcaacuucaccuc

SEQ ID NO: 1881023 - RNA, 15 nt, Salmonella typhimurium LT2
auucaugaucuuucc

SEQ ID NO: 1881024 - RNA, 21 nt, Salmonella typhimurium LT2
auucaugaucuuuccuuuuuc

SEQ ID NO: 1881025 - RNA, 15 nt, Salmonella typhimurium LT2
auucauuauaaaaca

SEQ ID NO: 1881026 - RNA, 20 nt, Salmonella typhimurium LT2
auucauuauaaaacauaaag

SEQ ID NO: 1881027 - RNA, 18 nt, Salmonella typhimurium LT2
auucauggcgcgcgccgc

SEQ ID NO: 1881028 - RNA, 16 nt, Salmonella typhimurium LT2
auucaugugaaaguga

SEQ ID NO: 1881029 - RNA, 19 nt, Salmonella typhimurium LT2
auucauugucuuuuucuca

SEQ ID NO: 1881030 - RNA, 20 nt, Salmonella typhimurium LT2
auucauugagcaucaaacuu

SEQ ID NO: 1881031 - RNA, 15 nt, Salmonella typhimurium LT2
auucauucccauacu

SEQ ID NO: 1881032 - RNA, 15 nt, Salmonella typhimurium LT2
auucauuucaaugua

SEQ ID NO: 1881033 - RNA, 14 nt, Salmonella typhimurium LT2
auucauuuccagca

SEQ ID NO: 1881034 - RNA, 14 nt, Salmonella typhimurium LT2
auucauuucaaugu

SEQ ID NO: 1881035 - RNA, 20 nt, Salmonella typhimurium LT2
auucgcgaauagugcagaaa

SEQ ID NO: 1881036 - RNA, 20 nt, Salmonella typhimurium LT2
auucgcgcuaaaugacaaau

SEQ ID NO: 1881037 - RNA, 23 nt, Salmonella typhimurium LT2
auucgcgcuaaaugacaaauaga

SEQ ID NO: 1881038 - RNA, 13 nt, Salmonella typhimurium LT2
auucgcguucaga

SEQ ID NO: 1881039 - RNA, 15 nt, Salmonella typhimurium LT2
auuccuuuaaauauc

SEQ ID NO: 1881040 - RNA, 20 nt, Salmonella typhimurium LT2
auuccuuuuaauuuucugua

SEQ ID NO: 1881041 - RNA, 20 nt, Salmonella typhimurium LT2
auuccuuuuuccgccaccug

SEQ ID NO: 1881042 - RNA, 17 nt, Salmonella typhimurium LT2
auucgucagcggcugcu

SEQ ID NO: 1881043 - RNA, 23 nt, Salmonella typhimurium LT2
auucucacagaaucaucaggcua

SEQ ID NO: 1881044 - RNA, 17 nt, Salmonella typhimurium LT2
auucguauugacaacaa

SEQ ID NO: 1881045 - RNA, 18 nt, Salmonella typhimurium LT2
auucucuaccccuucugc

SEQ ID NO: 1881046 - RNA, 19 nt, Salmonella typhimurium LT2
auucucuaccccuucugcc

SEQ ID NO: 1881047 - RNA, 17 nt, Salmonella typhimurium LT2
auucucuguugccgccc

SEQ ID NO: 1881048 - RNA, 15 nt, Salmonella typhimurium LT2
auucuucuuagaaua

SEQ ID NO: 1881049 - RNA, 18 nt, Salmonella typhimurium LT2
auucuucgaaugucucaa

SEQ ID NO: 1881050 - RNA, 19 nt, Salmonella typhimurium LT2
auucuugcgccgcaaacuc

SEQ ID NO: 1881051 - RNA, 17 nt, Salmonella typhimurium LT2
auucuggccguuuucaa

SEQ ID NO: 1881052 - RNA, 18 nt, Salmonella typhimurium LT2
auucuggcgcagcuucug

SEQ ID NO: 1881053 - RNA, 20 nt, Salmonella typhimurium LT2
auucuggcgcagcuucugau

SEQ ID NO: 1881054 - RNA, 18 nt, Salmonella typhimurium LT2
auucugcuuaccagaccg

SEQ ID NO: 1881055 - RNA, 13 nt, Salmonella typhimurium LT2
auucugcgguaau

SEQ ID NO: 1881056 - RNA, 15 nt, Salmonella typhimurium LT2
auucugcgccagcca

SEQ ID NO: 1881057 - RNA, 22 nt, Salmonella typhimurium LT2
auugcaacgaucccuaauaaaa

SEQ ID NO: 1881058 - RNA, 20 nt, Salmonella typhimurium LT2
auugcaccugggagucgugc

SEQ ID NO: 1881059 - RNA, 21 nt, Salmonella typhimurium LT2
auugcagcauuacacuauguu

SEQ ID NO: 1881060 - RNA, 14 nt, Salmonella typhimurium LT2
auugcauaggggca

SEQ ID NO: 1881061 - RNA, 19 nt, Salmonella typhimurium LT2
auugcauaggggcaauaaa

SEQ ID NO: 1881062 - RNA, 20 nt, Salmonella typhimurium LT2
auugcgacaagcucauuucc

SEQ ID NO: 1881063 - RNA, 17 nt, Salmonella typhimurium LT2
auugccuuucaauacuu

SEQ ID NO: 1881064 - RNA, 18 nt, Salmonella typhimurium LT2
auugccgucagcuccugc

SEQ ID NO: 1881065 - RNA, 13 nt, Salmonella typhimurium LT2
auugccgucucaa

SEQ ID NO: 1881066 - RNA, 14 nt, Salmonella typhimurium LT2
auugcugagcugac

SEQ ID NO: 1881067 - RNA, 20 nt, Salmonella typhimurium LT2
auugcugcuauauaacauau

SEQ ID NO: 1881068 - RNA, 16 nt, Salmonella typhimurium LT2
auugcguaaugagcgu

SEQ ID NO: 1881069 - RNA, 17 nt, Salmonella typhimurium LT2
auugcccaucgcgccau

SEQ ID NO: 1881070 - RNA, 15 nt, Salmonella typhimurium LT2
auugcccaauguuuu

SEQ ID NO: 1881071 - RNA, 23 nt, Salmonella typhimurium LT2
auugcccuuuuguuuuugccccc

SEQ ID NO: 1881072 - RNA, 13 nt, Salmonella typhimurium LT2
auugccgaccauu

SEQ ID NO: 1881073 - RNA, 19 nt, Salmonella typhimurium LT2
auugccgaccauuacccac

SEQ ID NO: 1881074 - RNA, 16 nt, Salmonella typhimurium LT2
auuguguuacauguac

SEQ ID NO: 1881075 - RNA, 22 nt, Salmonella typhimurium LT2
auuguugcguuggaaauacguu

SEQ ID NO: 1881076 - RNA, 20 nt, Salmonella typhimurium LT2
auuguuuaacguuucaugga

SEQ ID NO: 1881077 - RNA, 12 nt, Salmonella typhimurium LT2
auuguuuacuuu

SEQ ID NO: 1881078 - RNA, 16 nt, Salmonella typhimurium LT2
auuguuugaaaaggaa

SEQ ID NO: 1881079 - RNA, 23 nt, Salmonella typhimurium LT2
auuguccccaucuuuaaaucccu

SEQ ID NO: 1881080 - RNA, 12 nt, Salmonella typhimurium LT2
auuguccacccu

SEQ ID NO: 1881081 - RNA, 15 nt, Salmonella typhimurium LT2
auuguacugcgccag

SEQ ID NO: 1881082 - RNA, 16 nt, Salmonella typhimurium LT2
auuguaauaauuuaaa

SEQ ID NO: 1881083 - RNA, 17 nt, Salmonella typhimurium LT2
auuguaauaauuuaaaa

SEQ ID NO: 1881084 - RNA, 15 nt, Salmonella typhimurium LT2
auuguaaaaccgacu

SEQ ID NO: 1881085 - RNA, 11 nt, Salmonella typhimurium LT2
auugguugcuu

SEQ ID NO: 1881086 - RNA, 23 nt, Salmonella typhimurium LT2
auugguugcuucguccagaucca

SEQ ID NO: 1881087 - RNA, 22 nt, Salmonella typhimurium LT2
auugcuggccuagaugaaugac

SEQ ID NO: 1881088 - RNA, 15 nt, Salmonella typhimurium LT2
auugcuguauuuuau

SEQ ID NO: 1881089 - RNA, 22 nt, Salmonella typhimurium LT2
auugcuguguuuucagccaggc

SEQ ID NO: 1881090 - RNA, 23 nt, Salmonella typhimurium LT2
auugcuguguuuucagccaggcg

SEQ ID NO: 1881091 - RNA, 22 nt, Salmonella typhimurium LT2
auugcuguccgggcguuucagc

SEQ ID NO: 1881092 - RNA, 15 nt, Salmonella typhimurium LT2
auuggcuggccugcu

SEQ ID NO: 1881093 - RNA, 15 nt, Salmonella typhimurium LT2
auuggcguuuuauga

SEQ ID NO: 1881094 - RNA, 20 nt, Salmonella typhimurium LT2
auuggcgcgucaucaauauc

SEQ ID NO: 1881095 - RNA, 15 nt, Salmonella typhimurium LT2
auuggugauauaaac

SEQ ID NO: 1881096 - RNA, 14 nt, Salmonella typhimurium LT2
aaaagggaguauua

SEQ ID NO: 1881097 - RNA, 18 nt, Salmonella typhimurium LT2
auugguuaucaaaaaccu

SEQ ID NO: 1881098 - RNA, 16 nt, Salmonella typhimurium LT2
caaaaaaucagcaauc

SEQ ID NO: 1881099 - RNA, 16 nt, Salmonella typhimurium LT2
caaaaaaugugagcca

SEQ ID NO: 1881100 - RNA, 14 nt, Salmonella typhimurium LT2
caaaaaaugacacc

SEQ ID NO: 1881101 - RNA, 12 nt, Salmonella typhimurium LT2
caaaaaaaaccg

SEQ ID NO: 1881102 - RNA, 15 nt, Salmonella typhimurium LT2
auuuuuuuugcauga

SEQ ID NO: 1881103 - RNA, 16 nt, Salmonella typhimurium LT2
caaaaaaagaaaaaua

SEQ ID NO: 1881104 - RNA, 22 nt, Salmonella typhimurium LT2
auuuuucuauuccgcucagaua

SEQ ID NO: 1881105 - RNA, 16 nt, Salmonella typhimurium LT2
auuuuucgguuuucca

SEQ ID NO: 1881106 - RNA, 18 nt, Salmonella typhimurium LT2
auuuuucgcccgguucau

SEQ ID NO: 1881107 - RNA, 17 nt, Salmonella typhimurium LT2
auuuuucgaucuucucc

SEQ ID NO: 1881108 - RNA, 16 nt, Salmonella typhimurium LT2
auuuuucgaucuucuc

SEQ ID NO: 1881109 - RNA, 20 nt, Salmonella typhimurium LT2
auuuuuccggcgucaaaaau

SEQ ID NO: 1881110 - RNA, 15 nt, Salmonella typhimurium LT2
auuuucauuauaaaa

SEQ ID NO: 1881111 - RNA, 22 nt, Salmonella typhimurium LT2
auuuucgcuuuaauggcuuuca

SEQ ID NO: 1881112 - RNA, 21 nt, Salmonella typhimurium LT2
auuuucgucguuucuacaaua

SEQ ID NO: 1881113 - RNA, 19 nt, Salmonella typhimurium LT2
auuuuggacggcgucacca

SEQ ID NO: 1881114 - RNA, 13 nt, Salmonella typhimurium LT2
auuuugcuuuuuc

SEQ ID NO: 1881115 - RNA, 17 nt, Salmonella typhimurium LT2
auuuuggggaaaauacc

SEQ ID NO: 1881116 - RNA, 16 nt, Salmonella typhimurium LT2
auuuuggggaaaauac

SEQ ID NO: 1881117 - RNA, 13 nt, Salmonella typhimurium LT2
auuuuuaaaccaa

SEQ ID NO: 1881118 - RNA, 17 nt, Salmonella typhimurium LT2
auuuuguugaaauuucu

SEQ ID NO: 1881119 - RNA, 19 nt, Salmonella typhimurium LT2
auuuuguugcuccagcauc

SEQ ID NO: 1881120 - RNA, 12 nt, Salmonella typhimurium LT2
auuuuucagggu

SEQ ID NO: 1881121 - RNA, 16 nt, Salmonella typhimurium LT2
auuuuuccagccauuu

SEQ ID NO: 1881122 - RNA, 22 nt, Salmonella typhimurium LT2
auuuuuaaugauguagucauca

SEQ ID NO: 1881123 - RNA, 13 nt, Salmonella typhimurium LT2
auuuuaacaucac

SEQ ID NO: 1881124 - RNA, 13 nt, Salmonella typhimurium LT2
auuuuacuccaca

SEQ ID NO: 1881125 - RNA, 20 nt, Salmonella typhimurium LT2
auuuuacuccacauauugag

SEQ ID NO: 1881126 - RNA, 22 nt, Salmonella typhimurium LT2
auuuuacugcguaaucuuuuca

SEQ ID NO: 1881127 - RNA, 14 nt, Salmonella typhimurium LT2
auuuuacuuucauu

SEQ ID NO: 1881128 - RNA, 16 nt, Salmonella typhimurium LT2
auuuuaucuccauauc

SEQ ID NO: 1881129 - RNA, 11 nt, Salmonella typhimurium LT2
auuuuaucacu

SEQ ID NO: 1881130 - RNA, 17 nt, Salmonella typhimurium LT2
auuuuagcuucuucaua

SEQ ID NO: 1881131 - RNA, 19 nt, Salmonella typhimurium LT2
auuuucaacggcaucaaua

SEQ ID NO: 1881132 - RNA, 12 nt, Salmonella typhimurium LT2
auuuuauuuuua

SEQ ID NO: 1881133 - RNA, 18 nt, Salmonella typhimurium LT2
auuuucauacuauuuccu

SEQ ID NO: 1881134 - RNA, 12 nt, Salmonella typhimurium LT2
auuucuugcauc

SEQ ID NO: 1881135 - RNA, 17 nt, Salmonella typhimurium LT2
auuucuuaauuccucag

SEQ ID NO: 1881136 - RNA, 18 nt, Salmonella typhimurium LT2
auuucuguauaauuauuu

SEQ ID NO: 1881137 - RNA, 20 nt, Salmonella typhimurium LT2
auuucuguauaauuauuugu

SEQ ID NO: 1881138 - RNA, 12 nt, Salmonella typhimurium LT2
auuucuucaucc

SEQ ID NO: 1881139 - RNA, 20 nt, Salmonella typhimurium LT2
auuucgucgauauuacgacc

SEQ ID NO: 1881140 - RNA, 15 nt, Salmonella typhimurium LT2
auuucguagccgcgc

SEQ ID NO: 1881141 - RNA, 23 nt, Salmonella typhimurium LT2
auuucguagccgcgcgccgccuc

SEQ ID NO: 1881142 - RNA, 21 nt, Salmonella typhimurium LT2
auuucgucagcacuucccacu

SEQ ID NO: 1881143 - RNA, 21 nt, Salmonella typhimurium LT2
auuucucgcucgcccaucacu

SEQ ID NO: 1881144 - RNA, 13 nt, Salmonella typhimurium LT2
auuucucgcccgc

SEQ ID NO: 1881145 - RNA, 15 nt, Salmonella typhimurium LT2
auuucucgccgccgg

SEQ ID NO: 1881146 - RNA, 21 nt, Salmonella typhimurium LT2
auuucucgcguccccagccga

SEQ ID NO: 1881147 - RNA, 17 nt, Salmonella typhimurium LT2
auuucaguacagccaaa

SEQ ID NO: 1881148 - RNA, 14 nt, Salmonella typhimurium LT2
auuuccauauuaac

SEQ ID NO: 1881149 - RNA, 16 nt, Salmonella typhimurium LT2
auuucaguggucaggc

SEQ ID NO: 1881150 - RNA, 20 nt, Salmonella typhimurium LT2
auuucaguacagccaaaaau

SEQ ID NO: 1881151 - RNA, 17 nt, Salmonella typhimurium LT2
auuucagggcuuauuca

SEQ ID NO: 1881152 - RNA, 18 nt, Salmonella typhimurium LT2
auuucaccgccaauaacg

SEQ ID NO: 1881153 - RNA, 16 nt, Salmonella typhimurium LT2
auuucacccagaguuu

SEQ ID NO: 1881154 - RNA, 23 nt, Salmonella typhimurium LT2
auuucacgucacguucauccugg

SEQ ID NO: 1881155 - RNA, 15 nt, Salmonella typhimurium LT2
auuucacgaauaucg

SEQ ID NO: 1881156 - RNA, 21 nt, Salmonella typhimurium LT2
auuucacgaacgaguacguaa

SEQ ID NO: 1881157 - RNA, 17 nt, Salmonella typhimurium LT2
auuucacgcugcaguuu

SEQ ID NO: 1881158 - RNA, 22 nt, Salmonella typhimurium LT2
auuucgcuggcggccccucuuc

SEQ ID NO: 1881159 - RNA, 13 nt, Salmonella typhimurium LT2
auuucgcucagau

SEQ ID NO: 1881160 - RNA, 17 nt, Salmonella typhimurium LT2
auuucgcuccacuggcc

SEQ ID NO: 1881161 - RNA, 20 nt, Salmonella typhimurium LT2
auuucgcuggcggccccucu

SEQ ID NO: 1881162 - RNA, 19 nt, Salmonella typhimurium LT2
auuucgccuauuuucucuu

SEQ ID NO: 1881163 - RNA, 22 nt, Salmonella typhimurium LT2
auuucgcuacucagcgucauca

SEQ ID NO: 1881164 - RNA, 15 nt, Salmonella typhimurium LT2
auuuccguggcgaua

SEQ ID NO: 1881165 - RNA, 23 nt, Salmonella typhimurium LT2
auuuccgcuuacucguuuugccg

SEQ ID NO: 1881166 - RNA, 15 nt, Salmonella typhimurium LT2
auuucccccacuucu

SEQ ID NO: 1881167 - RNA, 13 nt, Salmonella typhimurium LT2
auuuccccaguua

SEQ ID NO: 1881168 - RNA, 13 nt, Salmonella typhimurium LT2
auuuccauuuuuc

SEQ ID NO: 1881169 - RNA, 14 nt, Salmonella typhimurium LT2
auuuccauuuuuca

SEQ ID NO: 1881170 - RNA, 13 nt, Salmonella typhimurium LT2
auuucccuuccca

SEQ ID NO: 1881171 - RNA, 16 nt, Salmonella typhimurium LT2
auuucccuucccagcc

SEQ ID NO: 1881172 - RNA, 21 nt, Salmonella typhimurium LT2
aaaagugcgcacucagaaaau

SEQ ID NO: 1881173 - RNA, 19 nt, Salmonella typhimurium LT2
auuuaugauuuuaacauca

SEQ ID NO: 1881174 - RNA, 16 nt, Salmonella typhimurium LT2
auuuauugauuauuuu

SEQ ID NO: 1881175 - RNA, 22 nt, Salmonella typhimurium LT2
auuucaaacguuucaagaugcc

SEQ ID NO: 1881176 - RNA, 14 nt, Salmonella typhimurium LT2
auuucacaaauuaa

SEQ ID NO: 1881177 - RNA, 17 nt, Salmonella typhimurium LT2
auuucaaucaucauauc

SEQ ID NO: 1881178 - RNA, 17 nt, Salmonella typhimurium LT2
auuucaaucgcacccgc

SEQ ID NO: 1881179 - RNA, 20 nt, Salmonella typhimurium LT2
auuuauuuuauaaauuaacu

SEQ ID NO: 1881180 - RNA, 21 nt, Salmonella typhimurium LT2
auuuaucggcgguugaggcug

SEQ ID NO: 1881181 - RNA, 19 nt, Salmonella typhimurium LT2
auuuaucuaagaauuuaau

SEQ ID NO: 1881182 - RNA, 16 nt, Salmonella typhimurium LT2
auuuaucaauuuuuaa

SEQ ID NO: 1881183 - RNA, 14 nt, Salmonella typhimurium LT2
auuuaucaauaacc

SEQ ID NO: 1881184 - RNA, 22 nt, Salmonella typhimurium LT2
auuuaucuuccggcaucacauc

SEQ ID NO: 1881185 - RNA, 17 nt, Salmonella typhimurium LT2
auuuauagcaaauauga

SEQ ID NO: 1881186 - RNA, 20 nt, Salmonella typhimurium LT2
auuuauagcaaauaugaaga

SEQ ID NO: 1881187 - RNA, 18 nt, Salmonella typhimurium LT2
auuuauaccgcagugugc

SEQ ID NO: 1881188 - RNA, 21 nt, Salmonella typhimurium LT2
auuuaauauacuagccaguaa

SEQ ID NO: 1881189 - RNA, 14 nt, Salmonella typhimurium LT2
auuuaauaauaaau

SEQ ID NO: 1881190 - RNA, 17 nt, Salmonella typhimurium LT2
auuuaauauaugaacca

SEQ ID NO: 1881191 - RNA, 19 nt, Salmonella typhimurium LT2
cagcuaaaaacgccaauca

SEQ ID NO: 1881192 - RNA, 15 nt, Salmonella typhimurium LT2
cagcguuuugcgcuc

SEQ ID NO: 1881193 - RNA, 17 nt, Salmonella typhimurium LT2
aaaauugacaauaagau

SEQ ID NO: 1881194 - RNA, 20 nt, Salmonella typhimurium LT2
cagcucuuucaauccuucuu

SEQ ID NO: 1881195 - RNA, 18 nt, Salmonella typhimurium LT2
cagcugaaacagaauaaa

SEQ ID NO: 1881196 - RNA, 14 nt, Salmonella typhimurium LT2
cagcucgucggcca

SEQ ID NO: 1881197 - RNA, 17 nt, Salmonella typhimurium LT2
cagcugacgcagcagcu

SEQ ID NO: 1881198 - RNA, 19 nt, Salmonella typhimurium LT2
cagcugacgcagcagcucc

SEQ ID NO: 1881199 - RNA, 21 nt, Salmonella typhimurium LT2
cagcugagcuaaucacccacu

SEQ ID NO: 1881200 - RNA, 19 nt, Salmonella typhimurium LT2
cagcugcugcgcuuuccag

SEQ ID NO: 1881201 - RNA, 20 nt, Salmonella typhimurium LT2
cagcugcuggcgaugauaau

SEQ ID NO: 1881202 - RNA, 19 nt, Salmonella typhimurium LT2
cagcuggauagagcaucaa

SEQ ID NO: 1881203 - RNA, 18 nt, Salmonella typhimurium LT2
caggaagcggcuggguuc

SEQ ID NO: 1881204 - RNA, 22 nt, Salmonella typhimurium LT2
caggaaucgaaccugcaacuag

SEQ ID NO: 1881205 - RNA, 14 nt, Salmonella typhimurium LT2
caggaaaucuucca

SEQ ID NO: 1881206 - RNA, 14 nt, Salmonella typhimurium LT2
caggaacugcucca

SEQ ID NO: 1881207 - RNA, 14 nt, Salmonella typhimurium LT2
caggaacuggcuga

SEQ ID NO: 1881208 - RNA, 20 nt, Salmonella typhimurium LT2
caggaagaacacgccgccua

SEQ ID NO: 1881209 - RNA, 17 nt, Salmonella typhimurium LT2
caggaaaucuuccaguu

SEQ ID NO: 1881210 - RNA, 17 nt, Salmonella typhimurium LT2
caggaaagagccgcgca

SEQ ID NO: 1881211 - RNA, 16 nt, Salmonella typhimurium LT2
caggaaagagccgcgc

SEQ ID NO: 1881212 - RNA, 19 nt, Salmonella typhimurium LT2
cagcuuuaaugcuuuccag

SEQ ID NO: 1881213 - RNA, 17 nt, Salmonella typhimurium LT2
cagcuucgguccggcgc

SEQ ID NO: 1881214 - RNA, 14 nt, Salmonella typhimurium LT2
cagcuuguuuacgc

SEQ ID NO: 1881215 - RNA, 16 nt, Salmonella typhimurium LT2
cagcugguauaggcca

SEQ ID NO: 1881216 - RNA, 19 nt, Salmonella typhimurium LT2
cagcuuccuguacgccugc

SEQ ID NO: 1881217 - RNA, 22 nt, Salmonella typhimurium LT2
cagcuggcgauauccgugccgc

SEQ ID NO: 1881218 - RNA, 22 nt, Salmonella typhimurium LT2
caggaugggaggcuauucaaua

SEQ ID NO: 1881219 - RNA, 16 nt, Salmonella typhimurium LT2
caggauguaagacagc

SEQ ID NO: 1881220 - RNA, 19 nt, Salmonella typhimurium LT2
caggauggauauaacauuu

SEQ ID NO: 1881221 - RNA, 23 nt, Salmonella typhimurium LT2
caggaucgguaaacgccccuucg

SEQ ID NO: 1881222 - RNA, 20 nt, Salmonella typhimurium LT2
caggaguugccuugccucac

SEQ ID NO: 1881223 - RNA, 13 nt, Salmonella typhimurium LT2
caggaucgguaaa

SEQ ID NO: 1881224 - RNA, 19 nt, Salmonella typhimurium LT2
caggacauggucaccauga

SEQ ID NO: 1881225 - RNA, 23 nt, Salmonella typhimurium LT2
caggacaaaguuaucccugcuga

SEQ ID NO: 1881226 - RNA, 18 nt, Salmonella typhimurium LT2
caggaguaaauaacaaaa

SEQ ID NO: 1881227 - RNA, 15 nt, Salmonella typhimurium LT2
caggaguaaauaaca

SEQ ID NO: 1881228 - RNA, 12 nt, Salmonella typhimurium LT2
caggaggcaaaa

SEQ ID NO: 1881229 - RNA, 14 nt, Salmonella typhimurium LT2
caggcaauacuucg

SEQ ID NO: 1881230 - RNA, 19 nt, Salmonella typhimurium LT2
caggcaaucagcagccggg

SEQ ID NO: 1881231 - RNA, 17 nt, Salmonella typhimurium LT2
caggcacaaaaaacaaa

SEQ ID NO: 1881232 - RNA, 16 nt, Salmonella typhimurium LT2
caggcaaggcaucagg

SEQ ID NO: 1881233 - RNA, 13 nt, Salmonella typhimurium LT2
caggcaacaugac

SEQ ID NO: 1881234 - RNA, 20 nt, Salmonella typhimurium LT2
caggcaaccugucaguaccu

SEQ ID NO: 1881235 - RNA, 15 nt, Salmonella typhimurium LT2
caggcaaaccagcac

SEQ ID NO: 1881236 - RNA, 14 nt, Salmonella typhimurium LT2
caggcaaaaauaac

SEQ ID NO: 1881237 - RNA, 15 nt, Salmonella typhimurium LT2
caggcaaaaauaacu

SEQ ID NO: 1881238 - RNA, 14 nt, Salmonella typhimurium LT2
caggcauaaaaaaa

SEQ ID NO: 1881239 - RNA, 17 nt, Salmonella typhimurium LT2
caggcauaaaaaagagg

SEQ ID NO: 1881240 - RNA, 18 nt, Salmonella typhimurium LT2
caggcauaaaaaagagga

SEQ ID NO: 1881241 - RNA, 17 nt, Salmonella typhimurium LT2
caggcaguuugcgaaaa

SEQ ID NO: 1881242 - RNA, 22 nt, Salmonella typhimurium LT2
caggcauuuuacaccccuggcu

SEQ ID NO: 1881243 - RNA, 20 nt, Salmonella typhimurium LT2
caggcagccggauuuuaaau

SEQ ID NO: 1881244 - RNA, 14 nt, Salmonella typhimurium LT2
caggcaggucucca

SEQ ID NO: 1881245 - RNA, 15 nt, Salmonella typhimurium LT2
caggcacucaaccug

SEQ ID NO: 1881246 - RNA, 14 nt, Salmonella typhimurium LT2
caggcacuugagaa

SEQ ID NO: 1881247 - RNA, 16 nt, Salmonella typhimurium LT2
caggcacuugagaaau

SEQ ID NO: 1881248 - RNA, 16 nt, Salmonella typhimurium LT2
caggcacgccugugcu

SEQ ID NO: 1881249 - RNA, 20 nt, Salmonella typhimurium LT2
caggcacgggugccuguucu

SEQ ID NO: 1881250 - RNA, 23 nt, Salmonella typhimurium LT2
caggcacuacggugugccugcgc

SEQ ID NO: 1881251 - RNA, 15 nt, Salmonella typhimurium LT2
caggcacgugcauaa

SEQ ID NO: 1881252 - RNA, 15 nt, Salmonella typhimurium LT2
caggcagccacaaug

SEQ ID NO: 1881253 - RNA, 18 nt, Salmonella typhimurium LT2
caggcagcagaccgguac

SEQ ID NO: 1881254 - RNA, 13 nt, Salmonella typhimurium LT2
caggcagccacaa

SEQ ID NO: 1881255 - RNA, 20 nt, Salmonella typhimurium LT2
caggcgacucacgaugagau

SEQ ID NO: 1881256 - RNA, 22 nt, Salmonella typhimurium LT2
caggcgcgaaucgacaauccgc

SEQ ID NO: 1881257 - RNA, 18 nt, Salmonella typhimurium LT2
caggcgcccgagcgccgc

SEQ ID NO: 1881258 - RNA, 22 nt, Salmonella typhimurium LT2
caggcgcuaucuucaauacgaa

SEQ ID NO: 1881259 - RNA, 19 nt, Salmonella typhimurium LT2
caggcgcuauucccaggca

SEQ ID NO: 1881260 - RNA, 22 nt, Salmonella typhimurium LT2
caggcgcgaccucaucaaacag

SEQ ID NO: 1881261 - RNA, 13 nt, Salmonella typhimurium LT2
caggccaaaaaag

SEQ ID NO: 1881262 - RNA, 13 nt, Salmonella typhimurium LT2
caggccaaaagag

SEQ ID NO: 1881263 - RNA, 20 nt, Salmonella typhimurium LT2
caggccaacguaguuauugu

SEQ ID NO: 1881264 - RNA, 16 nt, Salmonella typhimurium LT2
caggccuaacacaugc

SEQ ID NO: 1881265 - RNA, 16 nt, Salmonella typhimurium LT2
caggccuuucggcagc

SEQ ID NO: 1881266 - RNA, 20 nt, Salmonella typhimurium LT2
caggccuacacguucgcuua

SEQ ID NO: 1881267 - RNA, 17 nt, Salmonella typhimurium LT2
caggccuaccagccgag

SEQ ID NO: 1881268 - RNA, 16 nt, Salmonella typhimurium LT2
caggccuaccagccga

SEQ ID NO: 1881269 - RNA, 17 nt, Salmonella typhimurium LT2
caggcgaccagaugcag

SEQ ID NO: 1881270 - RNA, 17 nt, Salmonella typhimurium LT2
caggcgaccauccacca

SEQ ID NO: 1881271 - RNA, 17 nt, Salmonella typhimurium LT2
caggcgaacuucaucca

SEQ ID NO: 1881272 - RNA, 14 nt, Salmonella typhimurium LT2
cagggaaagccagu

SEQ ID NO: 1881273 - RNA, 16 nt, Salmonella typhimurium LT2
cagggaaaccauguug

SEQ ID NO: 1881274 - RNA, 15 nt, Salmonella typhimurium LT2
caggcuuuucaggcu

SEQ ID NO: 1881275 - RNA, 21 nt, Salmonella typhimurium LT2
caggcuugccgcgccagacgc

SEQ ID NO: 1881276 - RNA, 19 nt, Salmonella typhimurium LT2
caggcuuuaaauucagcac

SEQ ID NO: 1881277 - RNA, 14 nt, Salmonella typhimurium LT2
caggcuugcccauu

SEQ ID NO: 1881278 - RNA, 15 nt, Salmonella typhimurium LT2
caggcuugccgcgcc

SEQ ID NO: 1881279 - RNA, 20 nt, Salmonella typhimurium LT2
caggcugaugugcuccauca

SEQ ID NO: 1881280 - RNA, 23 nt, Salmonella typhimurium LT2
caggcuauaacgcaccaccugca

SEQ ID NO: 1881281 - RNA, 22 nt, Salmonella typhimurium LT2
caggcuacgguacugcccaccu

SEQ ID NO: 1881282 - RNA, 18 nt, Salmonella typhimurium LT2
caggcggggucaaaaaag

SEQ ID NO: 1881283 - RNA, 18 nt, Salmonella typhimurium LT2
caggcggcuucgcauccc

SEQ ID NO: 1881284 - RNA, 19 nt, Salmonella typhimurium LT2
caggcgggugcgcagcccc

SEQ ID NO: 1881285 - RNA, 22 nt, Salmonella typhimurium LT2
caggcgggugcgcagccccagc

SEQ ID NO: 1881286 - RNA, 18 nt, Salmonella typhimurium LT2
caggcggguauggcgcca

SEQ ID NO: 1881287 - RNA, 22 nt, Salmonella typhimurium LT2
caggcgugaugacuuugacgga

SEQ ID NO: 1881288 - RNA, 21 nt, Salmonella typhimurium LT2
caggcguuauuggcgcagcca

SEQ ID NO: 1881289 - RNA, 17 nt, Salmonella typhimurium LT2
caggcggcauggguaaa

SEQ ID NO: 1881290 - RNA, 16 nt, Salmonella typhimurium LT2
caggcggcaaaaaacg

SEQ ID NO: 1881291 - RNA, 22 nt, Salmonella typhimurium LT2
caggcgcugcuggcagcgcuga

SEQ ID NO: 1881292 - RNA, 18 nt, Salmonella typhimurium LT2
caggcgcuugcgccgcca

SEQ ID NO: 1881293 - RNA, 19 nt, Salmonella typhimurium LT2
caggcgcuugcgccgccau

SEQ ID NO: 1881294 - RNA, 20 nt, Salmonella typhimurium LT2
caggggaugauuuucaggca

SEQ ID NO: 1881295 - RNA, 13 nt, Salmonella typhimurium LT2
cagggcugcuggc

SEQ ID NO: 1881296 - RNA, 17 nt, Salmonella typhimurium LT2
cagggcuuauucaagca

SEQ ID NO: 1881297 - RNA, 21 nt, Salmonella typhimurium LT2
cagggucgcggcauuaaaugc

SEQ ID NO: 1881298 - RNA, 14 nt, Salmonella typhimurium LT2
cagggucaggaacu

SEQ ID NO: 1881299 - RNA, 17 nt, Salmonella typhimurium LT2
caggguaaucaccauua

SEQ ID NO: 1881300 - RNA, 17 nt, Salmonella typhimurium LT2
caggguaugaauuuuuu

SEQ ID NO: 1881301 - RNA, 16 nt, Salmonella typhimurium LT2
cagggcaacggccagc

SEQ ID NO: 1881302 - RNA, 17 nt, Salmonella typhimurium LT2
cagggauauacaaauau

SEQ ID NO: 1881303 - RNA, 14 nt, Salmonella typhimurium LT2
cagggcgauuuccg

SEQ ID NO: 1881304 - RNA, 17 nt, Salmonella typhimurium LT2
cagguagaaucccacca

SEQ ID NO: 1881305 - RNA, 19 nt, Salmonella typhimurium LT2
cagguagcgccuuuacugg

SEQ ID NO: 1881306 - RNA, 15 nt, Salmonella typhimurium LT2
cagguaccccgccac

SEQ ID NO: 1881307 - RNA, 16 nt, Salmonella typhimurium LT2
cagguacaggccgccg

SEQ ID NO: 1881308 - RNA, 21 nt, Salmonella typhimurium LT2
caggguuugccagcaccagca

SEQ ID NO: 1881309 - RNA, 13 nt, Salmonella typhimurium LT2
caggguuugccag

SEQ ID NO: 1881310 - RNA, 23 nt, Salmonella typhimurium LT2
caggguuugcgcagacugcgcca

SEQ ID NO: 1881311 - RNA, 16 nt, Salmonella typhimurium LT2
caggguuuucaggaag

SEQ ID NO: 1881312 - RNA, 22 nt, Salmonella typhimurium LT2
caggguuagcgauccuguccug

SEQ ID NO: 1881313 - RNA, 23 nt, Salmonella typhimurium LT2
cagguaaaauugccgccaaccgu

SEQ ID NO: 1881314 - RNA, 14 nt, Salmonella typhimurium LT2
caggguuuaaucac

SEQ ID NO: 1881315 - RNA, 13 nt, Salmonella typhimurium LT2
caggguuuacugc

SEQ ID NO: 1881316 - RNA, 16 nt, Salmonella typhimurium LT2
caggguuuacugccag

SEQ ID NO: 1881317 - RNA, 16 nt, Salmonella typhimurium LT2
cagccuaccugccgcc

SEQ ID NO: 1881318 - RNA, 13 nt, Salmonella typhimurium LT2
cagccuaucgcca

SEQ ID NO: 1881319 - RNA, 12 nt, Salmonella typhimurium LT2
cagccuaaaaac

SEQ ID NO: 1881320 - RNA, 18 nt, Salmonella typhimurium LT2
cagccguuucuucugucc

SEQ ID NO: 1881321 - RNA, 15 nt, Salmonella typhimurium LT2
cagccgucuuucccg

SEQ ID NO: 1881322 - RNA, 14 nt, Salmonella typhimurium LT2
cagccgugagcaga

SEQ ID NO: 1881323 - RNA, 23 nt, Salmonella typhimurium LT2
cagccgucaaacaucgcgcucca

SEQ ID NO: 1881324 - RNA, 17 nt, Salmonella typhimurium LT2
cagccggugcucgccgu

SEQ ID NO: 1881325 - RNA, 14 nt, Salmonella typhimurium LT2
cagccguaccugca

SEQ ID NO: 1881326 - RNA, 16 nt, Salmonella typhimurium LT2
cagccgguauccagcg

SEQ ID NO: 1881327 - RNA, 15 nt, Salmonella typhimurium LT2
cagccgggcaggaaa

SEQ ID NO: 1881328 - RNA, 15 nt, Salmonella typhimurium LT2
cagcccggcgcacac

SEQ ID NO: 1881329 - RNA, 19 nt, Salmonella typhimurium LT2
cagcccggcgcacacccug

SEQ ID NO: 1881330 - RNA, 17 nt, Salmonella typhimurium LT2
cagccgcguugcgcuga

SEQ ID NO: 1881331 - RNA, 18 nt, Salmonella typhimurium LT2
cagccuucggacugcugg

SEQ ID NO: 1881332 - RNA, 20 nt, Salmonella typhimurium LT2
cagccuuaaucaacugcgcc

SEQ ID NO: 1881333 - RNA, 17 nt, Salmonella typhimurium LT2
cagcgacauccucuuca

SEQ ID NO: 1881334 - RNA, 13 nt, Salmonella typhimurium LT2
cagcgacagccag

SEQ ID NO: 1881335 - RNA, 23 nt, Salmonella typhimurium LT2
cagcgacgaugaaauaaacgacc

SEQ ID NO: 1881336 - RNA, 23 nt, Salmonella typhimurium LT2
cagcgacgccagauuaucggcca

SEQ ID NO: 1881337 - RNA, 22 nt, Salmonella typhimurium LT2
cagcgcaaacgacgcugacuca

SEQ ID NO: 1881338 - RNA, 22 nt, Salmonella typhimurium LT2
cagcgcaaacaacccggcugcc

SEQ ID NO: 1881339 - RNA, 18 nt, Salmonella typhimurium LT2
cagcgauguaguuaacuc

SEQ ID NO: 1881340 - RNA, 14 nt, Salmonella typhimurium LT2
cagcgauugcgcca

SEQ ID NO: 1881341 - RNA, 16 nt, Salmonella typhimurium LT2
cagcgauugcgccaga

SEQ ID NO: 1881342 - RNA, 15 nt, Salmonella typhimurium LT2
cagcgauccagccgc

SEQ ID NO: 1881343 - RNA, 23 nt, Salmonella typhimurium LT2
cagcgaucccaauugaucggcca

SEQ ID NO: 1881344 - RNA, 15 nt, Salmonella typhimurium LT2
cagcgaucacgccgu

SEQ ID NO: 1881345 - RNA, 16 nt, Salmonella typhimurium LT2
cagcgauauuucuccg

SEQ ID NO: 1881346 - RNA, 21 nt, Salmonella typhimurium LT2
cagcgaguuacguugcggcgu

SEQ ID NO: 1881347 - RNA, 19 nt, Salmonella typhimurium LT2
cagcgaggccucuccucga

SEQ ID NO: 1881348 - RNA, 12 nt, Salmonella typhimurium LT2
cagccagcagcu

SEQ ID NO: 1881349 - RNA, 15 nt, Salmonella typhimurium LT2
cagccauaccggcgc

SEQ ID NO: 1881350 - RNA, 24 nt, Salmonella typhimurium LT2
cagccauaccggcgcgcgccagcu

SEQ ID NO: 1881351 - RNA, 18 nt, Salmonella typhimurium LT2
cagccauaaucaguacug

SEQ ID NO: 1881352 - RNA, 16 nt, Salmonella typhimurium LT2
cagccauaaaugcuga

SEQ ID NO: 1881353 - RNA, 23 nt, Salmonella typhimurium LT2
cagccaguccuccggcugaagcc

SEQ ID NO: 1881354 - RNA, 23 nt, Salmonella typhimurium LT2
cagccagucgccaggcaagguua

SEQ ID NO: 1881355 - RNA, 20 nt, Salmonella typhimurium LT2
cagccacuucuuccagcggc

SEQ ID NO: 1881356 - RNA, 13 nt, Salmonella typhimurium LT2
cagccagaaaaag

SEQ ID NO: 1881357 - RNA, 16 nt, Salmonella typhimurium LT2
cagccagaagcccggg

SEQ ID NO: 1881358 - RNA, 20 nt, Salmonella typhimurium LT2
cagccagaacguaauggcau

SEQ ID NO: 1881359 - RNA, 15 nt, Salmonella typhimurium LT2
cagccacuucuucca

SEQ ID NO: 1881360 - RNA, 16 nt, Salmonella typhimurium LT2
cagccagacggcgccc

SEQ ID NO: 1881361 - RNA, 22 nt, Salmonella typhimurium LT2
cagccagagauccacauuggcu

SEQ ID NO: 1881362 - RNA, 17 nt, Salmonella typhimurium LT2
cagccaaaauaugcugg

SEQ ID NO: 1881363 - RNA, 17 nt, Salmonella typhimurium LT2
cagcagccacagaaugc

SEQ ID NO: 1881364 - RNA, 12 nt, Salmonella typhimurium LT2
cagcagccaggu

SEQ ID NO: 1881365 - RNA, 14 nt, Salmonella typhimurium LT2
cagccaaagcugac

SEQ ID NO: 1881366 - RNA, 18 nt, Salmonella typhimurium LT2
cagccaaauagcgccaga

SEQ ID NO: 1881367 - RNA, 19 nt, Salmonella typhimurium LT2
cagccaaauagcgccagac

SEQ ID NO: 1881368 - RNA, 16 nt, Salmonella typhimurium LT2
cagccaacaguauaga

SEQ ID NO: 1881369 - RNA, 21 nt, Salmonella typhimurium LT2
cagccaacaguauagaaauag

SEQ ID NO: 1881370 - RNA, 23 nt, Salmonella typhimurium LT2
cagccacguugucggcucaucca

SEQ ID NO: 1881371 - RNA, 14 nt, Salmonella typhimurium LT2
cagccacucccgau

SEQ ID NO: 1881372 - RNA, 16 nt, Salmonella typhimurium LT2
cagcccgaucaucucc

SEQ ID NO: 1881373 - RNA, 20 nt, Salmonella typhimurium LT2
cagcccgccagcaccaggcu

SEQ ID NO: 1881374 - RNA, 14 nt, Salmonella typhimurium LT2
cagcccgccagcac

SEQ ID NO: 1881375 - RNA, 13 nt, Salmonella typhimurium LT2
cagcccgccagca

SEQ ID NO: 1881376 - RNA, 14 nt, Salmonella typhimurium LT2
cagccccagcacca

SEQ ID NO: 1881377 - RNA, 16 nt, Salmonella typhimurium LT2
cagccccuucgcuguc

SEQ ID NO: 1881378 - RNA, 17 nt, Salmonella typhimurium LT2
cagccccuucgcugucc

SEQ ID NO: 1881379 - RNA, 21 nt, Salmonella typhimurium LT2
cagcccauaccagcgcggcac

SEQ ID NO: 1881380 - RNA, 20 nt, Salmonella typhimurium LT2
cagcccaucggucgcgcgca

SEQ ID NO: 1881381 - RNA, 12 nt, Salmonella typhimurium LT2
cagcccaugaau

SEQ ID NO: 1881382 - RNA, 16 nt, Salmonella typhimurium LT2
cagccccacauuggaa

SEQ ID NO: 1881383 - RNA, 16 nt, Salmonella typhimurium LT2
cagcccagguuaccaa

SEQ ID NO: 1881384 - RNA, 23 nt, Salmonella typhimurium LT2
aaaauuaagcgacccgauaaaca

SEQ ID NO: 1881385 - RNA, 22 nt, Salmonella typhimurium LT2
aaaauuaacgacaaaaauacca

SEQ ID NO: 1881386 - RNA, 13 nt, Salmonella typhimurium LT2
cagcggcgcaggg

SEQ ID NO: 1881387 - RNA, 18 nt, Salmonella typhimurium LT2
cagcggcgccaucaccau

SEQ ID NO: 1881388 - RNA, 17 nt, Salmonella typhimurium LT2
cagcggccauugaaguc

SEQ ID NO: 1881389 - RNA, 13 nt, Salmonella typhimurium LT2
aaaauuaccaggc

SEQ ID NO: 1881390 - RNA, 12 nt, Salmonella typhimurium LT2
cagcgggaacau

SEQ ID NO: 1881391 - RNA, 15 nt, Salmonella typhimurium LT2
cagcggcgcgccgcu

SEQ ID NO: 1881392 - RNA, 14 nt, Salmonella typhimurium LT2
cagcggcggcagua

SEQ ID NO: 1881393 - RNA, 12 nt, Salmonella typhimurium LT2
cagcgcguccuu

SEQ ID NO: 1881394 - RNA, 16 nt, Salmonella typhimurium LT2
cagcgcguccuccagc

SEQ ID NO: 1881395 - RNA, 15 nt, Salmonella typhimurium LT2
cagcgcgucggccgg

SEQ ID NO: 1881396 - RNA, 18 nt, Salmonella typhimurium LT2
cagcgcguccagcccgcu

SEQ ID NO: 1881397 - RNA, 20 nt, Salmonella typhimurium LT2
cagcgcguccaauagccccu

SEQ ID NO: 1881398 - RNA, 19 nt, Salmonella typhimurium LT2
cagcggaauuaacugcacu

SEQ ID NO: 1881399 - RNA, 18 nt, Salmonella typhimurium LT2
cagcggagagacauuggu

SEQ ID NO: 1881400 - RNA, 15 nt, Salmonella typhimurium LT2
cagcggaauucccac

SEQ ID NO: 1881401 - RNA, 22 nt, Salmonella typhimurium LT2
cagcgcuuugccgcugcugccu

SEQ ID NO: 1881402 - RNA, 15 nt, Salmonella typhimurium LT2
cagcgcuuugccgcu

SEQ ID NO: 1881403 - RNA, 20 nt, Salmonella typhimurium LT2
cagcgcuuucaccgcgucgu

SEQ ID NO: 1881404 - RNA, 15 nt, Salmonella typhimurium LT2
cagcgcgcugucuuu

SEQ ID NO: 1881405 - RNA, 14 nt, Salmonella typhimurium LT2
cagcgcggcaagga

SEQ ID NO: 1881406 - RNA, 13 nt, Salmonella typhimurium LT2
cagcgcggcagcc

SEQ ID NO: 1881407 - RNA, 15 nt, Salmonella typhimurium LT2
cagcgcauucguaau

SEQ ID NO: 1881408 - RNA, 13 nt, Salmonella typhimurium LT2
cagcgccugcgcu

SEQ ID NO: 1881409 - RNA, 14 nt, Salmonella typhimurium LT2
cagcgcauggaaga

SEQ ID NO: 1881410 - RNA, 12 nt, Salmonella typhimurium LT2
cagcgcauccac

SEQ ID NO: 1881411 - RNA, 17 nt, Salmonella typhimurium LT2
cagcgcauagcugcccu

SEQ ID NO: 1881412 - RNA, 17 nt, Salmonella typhimurium LT2
cagcgcagucagugaaa

SEQ ID NO: 1881413 - RNA, 21 nt, Salmonella typhimurium LT2
cagcgggcuaugcugaagcag

SEQ ID NO: 1881414 - RNA, 14 nt, Salmonella typhimurium LT2
cagcgggguucgga

SEQ ID NO: 1881415 - RNA, 14 nt, Salmonella typhimurium LT2
cagcgggccaaaaa

SEQ ID NO: 1881416 - RNA, 23 nt, Salmonella typhimurium LT2
aaaauuacuucguagacucaggc

SEQ ID NO: 1881417 - RNA, 18 nt, Salmonella typhimurium LT2
aaaauuacuucguagacu

SEQ ID NO: 1881418 - RNA, 16 nt, Salmonella typhimurium LT2
cagcguaauggccacc

SEQ ID NO: 1881419 - RNA, 21 nt, Salmonella typhimurium LT2
cagcguacaauggcaggcaua

SEQ ID NO: 1881420 - RNA, 18 nt, Salmonella typhimurium LT2
cagcguacaauggcaggc

SEQ ID NO: 1881421 - RNA, 21 nt, Salmonella typhimurium LT2
cagcguaccugcggcaauggc

SEQ ID NO: 1881422 - RNA, 18 nt, Salmonella typhimurium LT2
cagcguaaaacuuuucug

SEQ ID NO: 1881423 - RNA, 18 nt, Salmonella typhimurium LT2
cagcgguccaaagauaaa

SEQ ID NO: 1881424 - RNA, 21 nt, Salmonella typhimurium LT2
cagcgggugaucgcuugccac

SEQ ID NO: 1881425 - RNA, 23 nt, Salmonella typhimurium LT2
cagcgguuacuuuugaacauaaa

SEQ ID NO: 1881426 - RNA, 17 nt, Salmonella typhimurium LT2
cagcgguuucauauggg

SEQ ID NO: 1881427 - RNA, 15 nt, Salmonella typhimurium LT2
cagcgguugcaugaa

SEQ ID NO: 1881428 - RNA, 22 nt, Salmonella typhimurium LT2
cagcgguuggaucucaccacug

SEQ ID NO: 1881429 - RNA, 16 nt, Salmonella typhimurium LT2
aaaauucauuauaaaa

SEQ ID NO: 1881430 - RNA, 13 nt, Salmonella typhimurium LT2
cagcguuuccagc

SEQ ID NO: 1881431 - RNA, 15 nt, Salmonella typhimurium LT2
cagcgugcguaugac

SEQ ID NO: 1881432 - RNA, 18 nt, Salmonella typhimurium LT2
cagcguggccuuauccag

SEQ ID NO: 1881433 - RNA, 13 nt, Salmonella typhimurium LT2
cagcgugggaagc

SEQ ID NO: 1881434 - RNA, 14 nt, Salmonella typhimurium LT2
cagcguugaccagc

SEQ ID NO: 1881435 - RNA, 17 nt, Salmonella typhimurium LT2
cagcguuacuguagcug

SEQ ID NO: 1881436 - RNA, 16 nt, Salmonella typhimurium LT2
cagcguguuucaucuc

SEQ ID NO: 1881437 - RNA, 22 nt, Salmonella typhimurium LT2
cagcgucugccccaaacgcuca

SEQ ID NO: 1881438 - RNA, 20 nt, Salmonella typhimurium LT2
cagcgucaggaacgcggcgc

SEQ ID NO: 1881439 - RNA, 20 nt, Salmonella typhimurium LT2
cagcgucaacugcgccugcu

SEQ ID NO: 1881440 - RNA, 13 nt, Salmonella typhimurium LT2
cagcgucauuaaa

SEQ ID NO: 1881441 - RNA, 15 nt, Salmonella typhimurium LT2
cagcgucgccaugcg

SEQ ID NO: 1881442 - RNA, 16 nt, Salmonella typhimurium LT2
cagcgucccggcgucu

SEQ ID NO: 1881443 - RNA, 15 nt, Salmonella typhimurium LT2
cacugcccgccgcca

SEQ ID NO: 1881444 - RNA, 18 nt, Salmonella typhimurium LT2
cacugcccucaaguuaug

SEQ ID NO: 1881445 - RNA, 20 nt, Salmonella typhimurium LT2
cacugccguagcgcauuauu

SEQ ID NO: 1881446 - RNA, 22 nt, Salmonella typhimurium LT2
cacugcuguagcgucucaucaa

SEQ ID NO: 1881447 - RNA, 17 nt, Salmonella typhimurium LT2
cacuggaaacagccaau

SEQ ID NO: 1881448 - RNA, 23 nt, Salmonella typhimurium LT2
cacugcucguuaaauccucccau

SEQ ID NO: 1881449 - RNA, 12 nt, Salmonella typhimurium LT2
cacugcgccgcc

SEQ ID NO: 1881450 - RNA, 21 nt, Salmonella typhimurium LT2
cacugcggagguuucuuuuuc

SEQ ID NO: 1881451 - RNA, 18 nt, Salmonella typhimurium LT2
cacugccacgagccuucu

SEQ ID NO: 1881452 - RNA, 16 nt, Salmonella typhimurium LT2
cacugcagugucaaau

SEQ ID NO: 1881453 - RNA, 16 nt, Salmonella typhimurium LT2
cacugcaucucuucca

SEQ ID NO: 1881454 - RNA, 17 nt, Salmonella typhimurium LT2
cacugcauuacucgccu

SEQ ID NO: 1881455 - RNA, 21 nt, Salmonella typhimurium LT2
cacugauggaguuucaucagc

SEQ ID NO: 1881456 - RNA, 15 nt, Salmonella typhimurium LT2
cacugacuauccaca

SEQ ID NO: 1881457 - RNA, 16 nt, Salmonella typhimurium LT2
cacugacgcgccagcu

SEQ ID NO: 1881458 - RNA, 14 nt, Salmonella typhimurium LT2
cacugaccugcugg

SEQ ID NO: 1881459 - RNA, 20 nt, Salmonella typhimurium LT2
cacugauaacggaaagaggu

SEQ ID NO: 1881460 - RNA, 14 nt, Salmonella typhimurium LT2
cacugauaccccag

SEQ ID NO: 1881461 - RNA, 19 nt, Salmonella typhimurium LT2
cacugaguuucaccgccag

SEQ ID NO: 1881462 - RNA, 19 nt, Salmonella typhimurium LT2
cacugaauuacugcguaaa

SEQ ID NO: 1881463 - RNA, 14 nt, Salmonella typhimurium LT2
cacugacauuacga

SEQ ID NO: 1881464 - RNA, 14 nt, Salmonella typhimurium LT2
cacugaagaggaga

SEQ ID NO: 1881465 - RNA, 17 nt, Salmonella typhimurium LT2
cacucuuuaaccggcaa

SEQ ID NO: 1881466 - RNA, 22 nt, Salmonella typhimurium LT2
cacucuuuggacggcaucagga

SEQ ID NO: 1881467 - RNA, 16 nt, Salmonella typhimurium LT2
cacucuccagcauccu

SEQ ID NO: 1881468 - RNA, 20 nt, Salmonella typhimurium LT2
cacucggugcauuugucgcu

SEQ ID NO: 1881469 - RNA, 14 nt, Salmonella typhimurium LT2
cacucgauggcuuu

SEQ ID NO: 1881470 - RNA, 17 nt, Salmonella typhimurium LT2
cacuccuaagagaaaac

SEQ ID NO: 1881471 - RNA, 16 nt, Salmonella typhimurium LT2
cacuccggcugcacca

SEQ ID NO: 1881472 - RNA, 23 nt, Salmonella typhimurium LT2
cacucccgauucaacguuucgcu

SEQ ID NO: 1881473 - RNA, 22 nt, Salmonella typhimurium LT2
cacucccccacccuuugcagcg

SEQ ID NO: 1881474 - RNA, 15 nt, Salmonella typhimurium LT2
cacuccccagaauga

SEQ ID NO: 1881475 - RNA, 14 nt, Salmonella typhimurium LT2
cacuccaucgccug

SEQ ID NO: 1881476 - RNA, 18 nt, Salmonella typhimurium LT2
cacuaauccccauuuuuu

SEQ ID NO: 1881477 - RNA, 14 nt, Salmonella typhimurium LT2
cacuaacucaauga

SEQ ID NO: 1881478 - RNA, 19 nt, Salmonella typhimurium LT2
cacuaacuggcaaucaugc

SEQ ID NO: 1881479 - RNA, 19 nt, Salmonella typhimurium LT2
cacuaaacuaaugccuggc

SEQ ID NO: 1881480 - RNA, 21 nt, Salmonella typhimurium LT2
cacuaaacuaaugccuggcag

SEQ ID NO: 1881481 - RNA, 15 nt, Salmonella typhimurium LT2
cacuaccgggcagca

SEQ ID NO: 1881482 - RNA, 21 nt, Salmonella typhimurium LT2
cacuaccgggcagcaucucga

SEQ ID NO: 1881483 - RNA, 22 nt, Salmonella typhimurium LT2
cacuaccugauuggcuccccgc

SEQ ID NO: 1881484 - RNA, 16 nt, Salmonella typhimurium LT2
cacuaccgccgcggau

SEQ ID NO: 1881485 - RNA, 12 nt, Salmonella typhimurium LT2
cacuaauuugcg

SEQ ID NO: 1881486 - RNA, 12 nt, Salmonella typhimurium LT2
cacuaauuuaag

SEQ ID NO: 1881487 - RNA, 23 nt, Salmonella typhimurium LT2
cacguugucccaggccagaugcg

SEQ ID NO: 1881488 - RNA, 18 nt, Salmonella typhimurium LT2
cacguuacccgccagucg

SEQ ID NO: 1881489 - RNA, 18 nt, Salmonella typhimurium LT2
aaaauauaacuucuuaau

SEQ ID NO: 1881490 - RNA, 15 nt, Salmonella typhimurium LT2
cacuacuucuucagu

SEQ ID NO: 1881491 - RNA, 19 nt, Salmonella typhimurium LT2
cacuagucaggcacaaaaa

SEQ ID NO: 1881492 - RNA, 16 nt, Salmonella typhimurium LT2
cacuacggugugccug

SEQ ID NO: 1881493 - RNA, 20 nt, Salmonella typhimurium LT2
cacuauugucgucuggugau

SEQ ID NO: 1881494 - RNA, 14 nt, Salmonella typhimurium LT2
cacucaaccugugu

SEQ ID NO: 1881495 - RNA, 22 nt, Salmonella typhimurium LT2
cacucagaaaauuauuuuaaau

SEQ ID NO: 1881496 - RNA, 14 nt, Salmonella typhimurium LT2
cacucagaaaauua

SEQ ID NO: 1881497 - RNA, 21 nt, Salmonella typhimurium LT2
cacucagaaaauuauuuuaaa

SEQ ID NO: 1881498 - RNA, 12 nt, Salmonella typhimurium LT2
cacucauccagc

SEQ ID NO: 1881499 - RNA, 14 nt, Salmonella typhimurium LT2
cacucauccagcaa

SEQ ID NO: 1881500 - RNA, 21 nt, Salmonella typhimurium LT2
cacuguggcggcugcggcgca

SEQ ID NO: 1881501 - RNA, 14 nt, Salmonella typhimurium LT2
cacuguugcaucuu

SEQ ID NO: 1881502 - RNA, 20 nt, Salmonella typhimurium LT2
cacuuacuuauguaagcucc

SEQ ID NO: 1881503 - RNA, 21 nt, Salmonella typhimurium LT2
cacuggcgaguugccggagac

SEQ ID NO: 1881504 - RNA, 21 nt, Salmonella typhimurium LT2
cacuggagcgcauuuuacugc

SEQ ID NO: 1881505 - RNA, 16 nt, Salmonella typhimurium LT2
cacuggagggcauuaa

SEQ ID NO: 1881506 - RNA, 19 nt, Salmonella typhimurium LT2
cacugguaggcauccagau

SEQ ID NO: 1881507 - RNA, 19 nt, Salmonella typhimurium LT2
cacugguugcccauggcau

SEQ ID NO: 1881508 - RNA, 22 nt, Salmonella typhimurium LT2
cacuugagaaauuauuuuaaau

SEQ ID NO: 1881509 - RNA, 17 nt, Salmonella typhimurium LT2
cacuugcucccagaaac

SEQ ID NO: 1881510 - RNA, 20 nt, Salmonella typhimurium LT2
cacuuggcgaucaccagcac

SEQ ID NO: 1881511 - RNA, 21 nt, Salmonella typhimurium LT2
cacuuggcgaucaccagcacc

SEQ ID NO: 1881512 - RNA, 16 nt, Salmonella typhimurium LT2
cacuuguaccaacugc

SEQ ID NO: 1881513 - RNA, 21 nt, Salmonella typhimurium LT2
cacuugagaaauuauuuuaaa

SEQ ID NO: 1881514 - RNA, 21 nt, Salmonella typhimurium LT2
cacuucuuugaaguucaucac

SEQ ID NO: 1881515 - RNA, 23 nt, Salmonella typhimurium LT2
cacuucuucgcgaucgugauaaa

SEQ ID NO: 1881516 - RNA, 14 nt, Salmonella typhimurium LT2
cacuucuucauaaa

SEQ ID NO: 1881517 - RNA, 22 nt, Salmonella typhimurium LT2
cacuucugaguucggcaugggg

SEQ ID NO: 1881518 - RNA, 13 nt, Salmonella typhimurium LT2
cacuucugcggua

SEQ ID NO: 1881519 - RNA, 23 nt, Salmonella typhimurium LT2
cacuucucgcgcaucaggaucuu

SEQ ID NO: 1881520 - RNA, 19 nt, Salmonella typhimurium LT2
cacuucacacgaacuuuau

SEQ ID NO: 1881521 - RNA, 21 nt, Salmonella typhimurium LT2
cacuucaauguuagcauuauu

SEQ ID NO: 1881522 - RNA, 20 nt, Salmonella typhimurium LT2
cacuucauccggauaaagcc

SEQ ID NO: 1881523 - RNA, 14 nt, Salmonella typhimurium LT2
cacuucgauaacau

SEQ ID NO: 1881524 - RNA, 17 nt, Salmonella typhimurium LT2
cacuucgcgcauugcga

SEQ ID NO: 1881525 - RNA, 21 nt, Salmonella typhimurium LT2
cacuucgcugauaccgcccuc

SEQ ID NO: 1881526 - RNA, 21 nt, Salmonella typhimurium LT2
cacuucaugccgaacagguua

SEQ ID NO: 1881527 - RNA, 15 nt, Salmonella typhimurium LT2
cacuuccgccaccac

SEQ ID NO: 1881528 - RNA, 20 nt, Salmonella typhimurium LT2
aaaauaucgaugcuuauuau

SEQ ID NO: 1881529 - RNA, 11 nt, Salmonella typhimurium LT2
aaaauauccuc

SEQ ID NO: 1881530 - RNA, 13 nt, Salmonella typhimurium LT2
aaaauauccucca

SEQ ID NO: 1881531 - RNA, 19 nt, Salmonella typhimurium LT2
aaaauauccgccaucgaca

SEQ ID NO: 1881532 - RNA, 21 nt, Salmonella typhimurium LT2
aaaauauuuaacuuaaauaaa

SEQ ID NO: 1881533 - RNA, 23 nt, Salmonella typhimurium LT2
aaaauauuuaacuuaaauaaaaa

SEQ ID NO: 1881534 - RNA, 16 nt, Salmonella typhimurium LT2
cacuuugcagaccuuu

SEQ ID NO: 1881535 - RNA, 20 nt, Salmonella typhimurium LT2
aaaauaugcaauuaauauau

SEQ ID NO: 1881536 - RNA, 18 nt, Salmonella typhimurium LT2
cagaaacgguccuggucc

SEQ ID NO: 1881537 - RNA, 12 nt, Salmonella typhimurium LT2
cagaaacuguga

SEQ ID NO: 1881538 - RNA, 19 nt, Salmonella typhimurium LT2
cagaaaauccuucagcguu

SEQ ID NO: 1881539 - RNA, 19 nt, Salmonella typhimurium LT2
cacuuuuggcgacaggaac

SEQ ID NO: 1881540 - RNA, 15 nt, Salmonella typhimurium LT2
cagaaaaagccccca

SEQ ID NO: 1881541 - RNA, 20 nt, Salmonella typhimurium LT2
cacuuuucccgccagcugcg

SEQ ID NO: 1881542 - RNA, 16 nt, Salmonella typhimurium LT2
cagaacguagcccauu

SEQ ID NO: 1881543 - RNA, 21 nt, Salmonella typhimurium LT2
cagaacucacauauucaauaa

SEQ ID NO: 1881544 - RNA, 14 nt, Salmonella typhimurium LT2
cagaacucaucuuc

SEQ ID NO: 1881545 - RNA, 18 nt, Salmonella typhimurium LT2
cagaaccccaucgccuga

SEQ ID NO: 1881546 - RNA, 17 nt, Salmonella typhimurium LT2
cagaacugcgaaaucac

SEQ ID NO: 1881547 - RNA, 23 nt, Salmonella typhimurium LT2
cagaagaaaaucaacacgucgau

SEQ ID NO: 1881548 - RNA, 14 nt, Salmonella typhimurium LT2
cagaaggcgaacau

SEQ ID NO: 1881549 - RNA, 22 nt, Salmonella typhimurium LT2
cagaaggccgucgacagacggc

SEQ ID NO: 1881550 - RNA, 12 nt, Salmonella typhimurium LT2
cagaauaaaaca

SEQ ID NO: 1881551 - RNA, 21 nt, Salmonella typhimurium LT2
cagaccggcaucucaucuugc

SEQ ID NO: 1881552 - RNA, 20 nt, Salmonella typhimurium LT2
cagaccggcaucucaucuug

SEQ ID NO: 1881553 - RNA, 20 nt, Salmonella typhimurium LT2
cagaccgcuuaacuccggcg

SEQ ID NO: 1881554 - RNA, 21 nt, Salmonella typhimurium LT2
cagaccucguucggcgcaccu

SEQ ID NO: 1881555 - RNA, 16 nt, Salmonella typhimurium LT2
cagaccguaugccagc

SEQ ID NO: 1881556 - RNA, 14 nt, Salmonella typhimurium LT2
cagaccgaucucau

SEQ ID NO: 1881557 - RNA, 19 nt, Salmonella typhimurium LT2
cagacccgcguacaggaag

SEQ ID NO: 1881558 - RNA, 21 nt, Salmonella typhimurium LT2
cagacgauacucaaaccugcg

SEQ ID NO: 1881559 - RNA, 21 nt, Salmonella typhimurium LT2
cagacggcuccagcgccagcu

SEQ ID NO: 1881560 - RNA, 20 nt, Salmonella typhimurium LT2
cagacgaacaaacuccagca

SEQ ID NO: 1881561 - RNA, 17 nt, Salmonella typhimurium LT2
cagacucgacgcgacgu

SEQ ID NO: 1881562 - RNA, 13 nt, Salmonella typhimurium LT2
cagacgucaacac

SEQ ID NO: 1881563 - RNA, 15 nt, Salmonella typhimurium LT2
cagacgucaacaccu

SEQ ID NO: 1881564 - RNA, 20 nt, Salmonella typhimurium LT2
cagacgguuuauccccgcug

SEQ ID NO: 1881565 - RNA, 13 nt, Salmonella typhimurium LT2
cagacggcugggc

SEQ ID NO: 1881566 - RNA, 15 nt, Salmonella typhimurium LT2
cagacugcgccacgu

SEQ ID NO: 1881567 - RNA, 19 nt, Salmonella typhimurium LT2
cagacugcguaauguugau

SEQ ID NO: 1881568 - RNA, 9 nt, Salmonella typhimurium LT2
cagacugcg

SEQ ID NO: 1881569 - RNA, 14 nt, Salmonella typhimurium LT2
cagaaucagccgac

SEQ ID NO: 1881570 - RNA, 23 nt, Salmonella typhimurium LT2
cagaaucagcaacacaaucaggc

SEQ ID NO: 1881571 - RNA, 23 nt, Salmonella typhimurium LT2
cagaaucacgucguucgggccga

SEQ ID NO: 1881572 - RNA, 19 nt, Salmonella typhimurium LT2
cagaaucaucaugucguca

SEQ ID NO: 1881573 - RNA, 16 nt, Salmonella typhimurium LT2
cagaauagacgccaug

SEQ ID NO: 1881574 - RNA, 12 nt, Salmonella typhimurium LT2
cagaauauguuu

SEQ ID NO: 1881575 - RNA, 18 nt, Salmonella typhimurium LT2
cagaauaaugcuggcgga

SEQ ID NO: 1881576 - RNA, 18 nt, Salmonella typhimurium LT2
cagaauacaaccucaaau

SEQ ID NO: 1881577 - RNA, 16 nt, Salmonella typhimurium LT2
cagaauacacuucuca

SEQ ID NO: 1881578 - RNA, 21 nt, Salmonella typhimurium LT2
cagaauacgccgccgcccaga

SEQ ID NO: 1881579 - RNA, 17 nt, Salmonella typhimurium LT2
cagaauacgaauauuca

SEQ ID NO: 1881580 - RNA, 23 nt, Salmonella typhimurium LT2
cagaauaccgcguccuucuuccg

SEQ ID NO: 1881581 - RNA, 15 nt, Salmonella typhimurium LT2
cagaauuuuuaaccg

SEQ ID NO: 1881582 - RNA, 14 nt, Salmonella typhimurium LT2
cagacaaacaccgc

SEQ ID NO: 1881583 - RNA, 20 nt, Salmonella typhimurium LT2
cagacaaccauauuuaugca

SEQ ID NO: 1881584 - RNA, 16 nt, Salmonella typhimurium LT2
cagacauggcaauggc

SEQ ID NO: 1881585 - RNA, 15 nt, Salmonella typhimurium LT2
cagacaugcgccgga

SEQ ID NO: 1881586 - RNA, 23 nt, Salmonella typhimurium LT2
cagacaucggagauuucauccuc

SEQ ID NO: 1881587 - RNA, 15 nt, Salmonella typhimurium LT2
cagaaugagcggaac

SEQ ID NO: 1881588 - RNA, 24 nt, Salmonella typhimurium LT2
cagaaugauaaugccgcugauaau

SEQ ID NO: 1881589 - RNA, 23 nt, Salmonella typhimurium LT2
cagaaugauaaugccgcugauaa

SEQ ID NO: 1881590 - RNA, 14 nt, Salmonella typhimurium LT2
cagaaugcccaggc

SEQ ID NO: 1881591 - RNA, 14 nt, Salmonella typhimurium LT2
cagaaugcguaaaa

SEQ ID NO: 1881592 - RNA, 22 nt, Salmonella typhimurium LT2
cagaaugcguaaaaagcacgcu

SEQ ID NO: 1881593 - RNA, 12 nt, Salmonella typhimurium LT2
cagagcaacgag

SEQ ID NO: 1881594 - RNA, 22 nt, Salmonella typhimurium LT2
cagagaucuuucacccccagcu

SEQ ID NO: 1881595 - RNA, 15 nt, Salmonella typhimurium LT2
cagacuguaaaucug

SEQ ID NO: 1881596 - RNA, 14 nt, Salmonella typhimurium LT2
cagacugguuguuc

SEQ ID NO: 1881597 - RNA, 13 nt, Salmonella typhimurium LT2
cagacuguaaauc

SEQ ID NO: 1881598 - RNA, 20 nt, Salmonella typhimurium LT2
cagagcgcgcuggcaagcgc

SEQ ID NO: 1881599 - RNA, 15 nt, Salmonella typhimurium LT2
cagagcggauaaaua

SEQ ID NO: 1881600 - RNA, 14 nt, Salmonella typhimurium LT2
cagagcgcaucaaa

SEQ ID NO: 1881601 - RNA, 17 nt, Salmonella typhimurium LT2
cagagcgcgcuggcaag

SEQ ID NO: 1881602 - RNA, 16 nt, Salmonella typhimurium LT2
cagagguaaucagauc

SEQ ID NO: 1881603 - RNA, 16 nt, Salmonella typhimurium LT2
cagaggccugaaugca

SEQ ID NO: 1881604 - RNA, 14 nt, Salmonella typhimurium LT2
cagaggcggcgcca

SEQ ID NO: 1881605 - RNA, 12 nt, Salmonella typhimurium LT2
cagaguacauuc

SEQ ID NO: 1881606 - RNA, 18 nt, Salmonella typhimurium LT2
cagaguaaccacgauaaa

SEQ ID NO: 1881607 - RNA, 22 nt, Salmonella typhimurium LT2
cagaguaacccgauacccugag

SEQ ID NO: 1881608 - RNA, 14 nt, Salmonella typhimurium LT2
cagauaaaacaaaa

SEQ ID NO: 1881609 - RNA, 18 nt, Salmonella typhimurium LT2
cagauaaaacaaaaggcc

SEQ ID NO: 1881610 - RNA, 17 nt, Salmonella typhimurium LT2
cagauagcgcugcgcca

SEQ ID NO: 1881611 - RNA, 16 nt, Salmonella typhimurium LT2
cagauagcguauuaua

SEQ ID NO: 1881612 - RNA, 24 nt, Salmonella typhimurium LT2
cagauaggcggcaaauaaagccag

SEQ ID NO: 1881613 - RNA, 20 nt, Salmonella typhimurium LT2
cagauaggcggcaaauaaag

SEQ ID NO: 1881614 - RNA, 20 nt, Salmonella typhimurium LT2
cagauacugcgcguggcaaa

SEQ ID NO: 1881615 - RNA, 15 nt, Salmonella typhimurium LT2
cagauaacaccagcg

SEQ ID NO: 1881616 - RNA, 21 nt, Salmonella typhimurium LT2
cagauaacauaugaguuaugu

SEQ ID NO: 1881617 - RNA, 15 nt, Salmonella typhimurium LT2
cagauaaccaaucac

SEQ ID NO: 1881618 - RNA, 15 nt, Salmonella typhimurium LT2
cagauacauggcuau

SEQ ID NO: 1881619 - RNA, 15 nt, Salmonella typhimurium LT2
cagauacgcgggcuc

SEQ ID NO: 1881620 - RNA, 22 nt, Salmonella typhimurium LT2
cagauaccggcgcagcaucugc

SEQ ID NO: 1881621 - RNA, 18 nt, Salmonella typhimurium LT2
cagauaggcgaggaagac

SEQ ID NO: 1881622 - RNA, 23 nt, Salmonella typhimurium LT2
aaaauccguagcuguaacagucc

SEQ ID NO: 1881623 - RNA, 15 nt, Salmonella typhimurium LT2
cagaucaaaaaucug

SEQ ID NO: 1881624 - RNA, 21 nt, Salmonella typhimurium LT2
cagauauugcggaucagcaaa

SEQ ID NO: 1881625 - RNA, 20 nt, Salmonella typhimurium LT2
cagauaucuguauaaauaaa

SEQ ID NO: 1881626 - RNA, 13 nt, Salmonella typhimurium LT2
cagauaucgcgua

SEQ ID NO: 1881627 - RNA, 17 nt, Salmonella typhimurium LT2
cagauaguuaauaaugg

SEQ ID NO: 1881628 - RNA, 19 nt, Salmonella typhimurium LT2
cagcaccucaucccccagc

SEQ ID NO: 1881629 - RNA, 16 nt, Salmonella typhimurium LT2
cagcaccugaauaaug

SEQ ID NO: 1881630 - RNA, 14 nt, Salmonella typhimurium LT2
cagcaccgccggga

SEQ ID NO: 1881631 - RNA, 14 nt, Salmonella typhimurium LT2
cagcaccgccagcg

SEQ ID NO: 1881632 - RNA, 19 nt, Salmonella typhimurium LT2
cagcacgcuuacccagcau

SEQ ID NO: 1881633 - RNA, 17 nt, Salmonella typhimurium LT2
cagcacgcuuacccagc

SEQ ID NO: 1881634 - RNA, 13 nt, Salmonella typhimurium LT2
cagcaccuugccg

SEQ ID NO: 1881635 - RNA, 16 nt, Salmonella typhimurium LT2
cagcaccaacgccgcu

SEQ ID NO: 1881636 - RNA, 13 nt, Salmonella typhimurium LT2
cagcaauacccag

SEQ ID NO: 1881637 - RNA, 17 nt, Salmonella typhimurium LT2
cagcaauaucagccauu

SEQ ID NO: 1881638 - RNA, 23 nt, Salmonella typhimurium LT2
cagcaccagcgaguagccugcga

SEQ ID NO: 1881639 - RNA, 14 nt, Salmonella typhimurium LT2
cagcaccauggcua

SEQ ID NO: 1881640 - RNA, 17 nt, Salmonella typhimurium LT2
cagcaccauggcuaucc

SEQ ID NO: 1881641 - RNA, 23 nt, Salmonella typhimurium LT2
cagcaccauuaucgcgccggaac

SEQ ID NO: 1881642 - RNA, 22 nt, Salmonella typhimurium LT2
cagcaccaggauacguucaucu

SEQ ID NO: 1881643 - RNA, 19 nt, Salmonella typhimurium LT2
cagcacuaacgaggccacc

SEQ ID NO: 1881644 - RNA, 12 nt, Salmonella typhimurium LT2
cagcacuacagc

SEQ ID NO: 1881645 - RNA, 22 nt, Salmonella typhimurium LT2
cagcacuacggauggcccugcc

SEQ ID NO: 1881646 - RNA, 13 nt, Salmonella typhimurium LT2
cagcacuaacagc

SEQ ID NO: 1881647 - RNA, 14 nt, Salmonella typhimurium LT2
cagcacuaacagca

SEQ ID NO: 1881648 - RNA, 19 nt, Salmonella typhimurium LT2
cagcacuaacagcagcaac

SEQ ID NO: 1881649 - RNA, 13 nt, Salmonella typhimurium LT2
cagcagcagcagc

SEQ ID NO: 1881650 - RNA, 15 nt, Salmonella typhimurium LT2
cagcagcaugaugga

SEQ ID NO: 1881651 - RNA, 22 nt, Salmonella typhimurium LT2
cagauuuuuaauguccagcagu

SEQ ID NO: 1881652 - RNA, 23 nt, Salmonella typhimurium LT2
cagauuuuuaauguccagcagug

SEQ ID NO: 1881653 - RNA, 21 nt, Salmonella typhimurium LT2
cagauugcgaaagaauuacug

SEQ ID NO: 1881654 - RNA, 20 nt, Salmonella typhimurium LT2
cagauuccccaaucccacca

SEQ ID NO: 1881655 - RNA, 15 nt, Salmonella typhimurium LT2
cagcaaaauggcaau

SEQ ID NO: 1881656 - RNA, 22 nt, Salmonella typhimurium LT2
cagcaaaauggcaauugcgccg

SEQ ID NO: 1881657 - RNA, 18 nt, Salmonella typhimurium LT2
aaaaucugguguaaauaa

SEQ ID NO: 1881658 - RNA, 16 nt, Salmonella typhimurium LT2
aaaaucgucaucagau

SEQ ID NO: 1881659 - RNA, 12 nt, Salmonella typhimurium LT2
cagauccuggcg

SEQ ID NO: 1881660 - RNA, 15 nt, Salmonella typhimurium LT2
cagauccagcgccgu

SEQ ID NO: 1881661 - RNA, 18 nt, Salmonella typhimurium LT2
cagaucagcacgcgccgu

SEQ ID NO: 1881662 - RNA, 18 nt, Salmonella typhimurium LT2
cagaucaucaaucaucuc

SEQ ID NO: 1881663 - RNA, 16 nt, Salmonella typhimurium LT2
aaaaugaugcaacaug

SEQ ID NO: 1881664 - RNA, 21 nt, Salmonella typhimurium LT2
aaaaugagauugauaaucagc

SEQ ID NO: 1881665 - RNA, 15 nt, Salmonella typhimurium LT2
cagcaaauacagaug

SEQ ID NO: 1881666 - RNA, 16 nt, Salmonella typhimurium LT2
cagcaacagcgcgucc

SEQ ID NO: 1881667 - RNA, 20 nt, Salmonella typhimurium LT2
cagcaaaucgggaaaaugau

SEQ ID NO: 1881668 - RNA, 22 nt, Salmonella typhimurium LT2
cagcaaaucgcccaucacaugu

SEQ ID NO: 1881669 - RNA, 21 nt, Salmonella typhimurium LT2
aaaaugccauauacauaugga

SEQ ID NO: 1881670 - RNA, 18 nt, Salmonella typhimurium LT2
aaaaugcgcuaacgucgc

SEQ ID NO: 1881671 - RNA, 23 nt, Salmonella typhimurium LT2
cagcaagucgcgggcgcuaaacc

SEQ ID NO: 1881672 - RNA, 18 nt, Salmonella typhimurium LT2
cagcaagucgcgggcgcu

SEQ ID NO: 1881673 - RNA, 14 nt, Salmonella typhimurium LT2
cagcaauaaaagga

SEQ ID NO: 1881674 - RNA, 19 nt, Salmonella typhimurium LT2
cagcaauaacaggcacagu

SEQ ID NO: 1881675 - RNA, 21 nt, Salmonella typhimurium LT2
cagcaacugaccaucuucguu

SEQ ID NO: 1881676 - RNA, 14 nt, Salmonella typhimurium LT2
cagcaagaagagaa

SEQ ID NO: 1881677 - RNA, 19 nt, Salmonella typhimurium LT2
cagcaagaagagaaugucc

SEQ ID NO: 1881678 - RNA, 21 nt, Salmonella typhimurium LT2
cagugccggaaagacggcagc

SEQ ID NO: 1881679 - RNA, 13 nt, Salmonella typhimurium LT2
cagguaucauaug

SEQ ID NO: 1881680 - RNA, 16 nt, Salmonella typhimurium LT2
cagguauuaauccugc

SEQ ID NO: 1881681 - RNA, 18 nt, Salmonella typhimurium LT2
cagguauuaaauacagag

SEQ ID NO: 1881682 - RNA, 22 nt, Salmonella typhimurium LT2
cagugccaguuaagcaacugau

SEQ ID NO: 1881683 - RNA, 17 nt, Salmonella typhimurium LT2
caguggaacaaacgcaa

SEQ ID NO: 1881684 - RNA, 17 nt, Salmonella typhimurium LT2
caguggacgauaagcac

SEQ ID NO: 1881685 - RNA, 14 nt, Salmonella typhimurium LT2
cagugcuuuuaacg

SEQ ID NO: 1881686 - RNA, 24 nt, Salmonella typhimurium LT2
caguguacauagcuuugccacugg

SEQ ID NO: 1881687 - RNA, 20 nt, Salmonella typhimurium LT2
cagugggcgucaaaaucccg

SEQ ID NO: 1881688 - RNA, 22 nt, Salmonella typhimurium LT2
caguggucguuagccagauggc

SEQ ID NO: 1881689 - RNA, 22 nt, Salmonella typhimurium LT2
caguuaccgcacacgcaaaaaa

SEQ ID NO: 1881690 - RNA, 12 nt, Salmonella typhimurium LT2
caguuagcuuca

SEQ ID NO: 1881691 - RNA, 14 nt, Salmonella typhimurium LT2
caguuaagcggggg

SEQ ID NO: 1881692 - RNA, 15 nt, Salmonella typhimurium LT2
caguguuuauuaaaa

SEQ ID NO: 1881693 - RNA, 16 nt, Salmonella typhimurium LT2
caguucacgccgccgc

SEQ ID NO: 1881694 - RNA, 19 nt, Salmonella typhimurium LT2
caguucacuccuaagagaa

SEQ ID NO: 1881695 - RNA, 20 nt, Salmonella typhimurium LT2
caguucacuccuaagagaaa

SEQ ID NO: 1881696 - RNA, 21 nt, Salmonella typhimurium LT2
caguucacuccuaagagaaaa

SEQ ID NO: 1881697 - RNA, 24 nt, Salmonella typhimurium LT2
caguuauuaaucaagcccagcuca

SEQ ID NO: 1881698 - RNA, 18 nt, Salmonella typhimurium LT2
caguuauuuuacgggcgu

SEQ ID NO: 1881699 - RNA, 13 nt, Salmonella typhimurium LT2
caguucauuccgc

SEQ ID NO: 1881700 - RNA, 16 nt, Salmonella typhimurium LT2
caguucauuucaggca

SEQ ID NO: 1881701 - RNA, 12 nt, Salmonella typhimurium LT2
caguucaggaac

SEQ ID NO: 1881702 - RNA, 16 nt, Salmonella typhimurium LT2
caguucaccggcggcc

SEQ ID NO: 1881703 - RNA, 12 nt, Salmonella typhimurium LT2
caguucauuaac

SEQ ID NO: 1881704 - RNA, 18 nt, Salmonella typhimurium LT2
caguucauaagucaucca

SEQ ID NO: 1881705 - RNA, 19 nt, Salmonella typhimurium LT2
caguucauccacgucauaa

SEQ ID NO: 1881706 - RNA, 16 nt, Salmonella typhimurium LT2
caguucauccagcagc

SEQ ID NO: 1881707 - RNA, 15 nt, Salmonella typhimurium LT2
caguuggcgaccgcu

SEQ ID NO: 1881708 - RNA, 13 nt, Salmonella typhimurium LT2
caguugcgcgucu

SEQ ID NO: 1881709 - RNA, 18 nt, Salmonella typhimurium LT2
caguugccccuuguugaa

SEQ ID NO: 1881710 - RNA, 16 nt, Salmonella typhimurium LT2
caguugaccaaacagc

SEQ ID NO: 1881711 - RNA, 16 nt, Salmonella typhimurium LT2
caguugauacauuuuu

SEQ ID NO: 1881712 - RNA, 18 nt, Salmonella typhimurium LT2
caguugauacauuuuuug

SEQ ID NO: 1881713 - RNA, 14 nt, Salmonella typhimurium LT2
caguucguucugcg

SEQ ID NO: 1881714 - RNA, 17 nt, Salmonella typhimurium LT2
caguucguagagcucca

SEQ ID NO: 1881715 - RNA, 21 nt, Salmonella typhimurium LT2
caguucgccuucuucaucuuc

SEQ ID NO: 1881716 - RNA, 22 nt, Salmonella typhimurium LT2
caguucgccguugauuuucagg

SEQ ID NO: 1881717 - RNA, 19 nt, Salmonella typhimurium LT2
caguuccgcaaagcccauc

SEQ ID NO: 1881718 - RNA, 19 nt, Salmonella typhimurium LT2
caguuccgccacggcgucc

SEQ ID NO: 1881719 - RNA, 15 nt, Salmonella typhimurium LT2
caguuguccauuuuc

SEQ ID NO: 1881720 - RNA, 16 nt, Salmonella typhimurium LT2
caguuguuccagcagc

SEQ ID NO: 1881721 - RNA, 15 nt, Salmonella typhimurium LT2
caguuucgccagcgc

SEQ ID NO: 1881722 - RNA, 17 nt, Salmonella typhimurium LT2
caguuuagggaucaucu

SEQ ID NO: 1881723 - RNA, 23 nt, Salmonella typhimurium LT2
caguuuagagguuccccagccgc

SEQ ID NO: 1881724 - RNA, 23 nt, Salmonella typhimurium LT2
caguuuacgagugcguucuucca

SEQ ID NO: 1881725 - RNA, 12 nt, Salmonella typhimurium LT2
caguuuacgcag

SEQ ID NO: 1881726 - RNA, 12 nt, Salmonella typhimurium LT2
caguuuaucugc

SEQ ID NO: 1881727 - RNA, 15 nt, Salmonella typhimurium LT2
caguuuaucugcgug

SEQ ID NO: 1881728 - RNA, 15 nt, Salmonella typhimurium LT2
caguuuuugaacaua

SEQ ID NO: 1881729 - RNA, 19 nt, Salmonella typhimurium LT2
caguuuugaucgaaucucc

SEQ ID NO: 1881730 - RNA, 19 nt, Salmonella typhimurium LT2
caguuuuucauuuguuccu

SEQ ID NO: 1881731 - RNA, 16 nt, Salmonella typhimurium LT2
caguuuugcauucugc

SEQ ID NO: 1881732 - RNA, 21 nt, Salmonella typhimurium LT2
caguuuuggcaaucacaagcu

SEQ ID NO: 1881733 - RNA, 23 nt, Salmonella typhimurium LT2
caguuuuuuacuuucaaaauacu

SEQ ID NO: 1881734 - RNA, 18 nt, Salmonella typhimurium LT2
cauaaaaaacaucaugcc

SEQ ID NO: 1881735 - RNA, 13 nt, Salmonella typhimurium LT2
caguuuuuugucu

SEQ ID NO: 1881736 - RNA, 23 nt, Salmonella typhimurium LT2
caguuugucaugcgugcgccgcg

SEQ ID NO: 1881737 - RNA, 17 nt, Salmonella typhimurium LT2
caguuuuccuucagcag

SEQ ID NO: 1881738 - RNA, 19 nt, Salmonella typhimurium LT2
caguuucucgucauaguga

SEQ ID NO: 1881739 - RNA, 15 nt, Salmonella typhimurium LT2
caguuugcgaaaagc

SEQ ID NO: 1881740 - RNA, 14 nt, Salmonella typhimurium LT2
caguuugcgaaaag

SEQ ID NO: 1881741 - RNA, 22 nt, Salmonella typhimurium LT2
caguuugcaaccgcuuugucag

SEQ ID NO: 1881742 - RNA, 19 nt, Salmonella typhimurium LT2
cauaccgcuuuacccggcg

SEQ ID NO: 1881743 - RNA, 19 nt, Salmonella typhimurium LT2
cauaccgguguagcuggca

SEQ ID NO: 1881744 - RNA, 15 nt, Salmonella typhimurium LT2
cauaccggagccugg

SEQ ID NO: 1881745 - RNA, 18 nt, Salmonella typhimurium LT2
cauaccggacuccaggca

SEQ ID NO: 1881746 - RNA, 12 nt, Salmonella typhimurium LT2
cauacccgcuua

SEQ ID NO: 1881747 - RNA, 15 nt, Salmonella typhimurium LT2
cauaccgaacagaaa

SEQ ID NO: 1881748 - RNA, 20 nt, Salmonella typhimurium LT2
cauacccuuccaguugcguc

SEQ ID NO: 1881749 - RNA, 23 nt, Salmonella typhimurium LT2
cauacccuuccaguugcgucagc

SEQ ID NO: 1881750 - RNA, 22 nt, Salmonella typhimurium LT2
cauacccuuccccaucaaaacu

SEQ ID NO: 1881751 - RNA, 19 nt, Salmonella typhimurium LT2
cauacccuauuuacagagc

SEQ ID NO: 1881752 - RNA, 14 nt, Salmonella typhimurium LT2
cauacccagguuug

SEQ ID NO: 1881753 - RNA, 19 nt, Salmonella typhimurium LT2
cauaccugcggccaugauc

SEQ ID NO: 1881754 - RNA, 12 nt, Salmonella typhimurium LT2
cauaccuccucu

SEQ ID NO: 1881755 - RNA, 14 nt, Salmonella typhimurium LT2
cauaccuccucucu

SEQ ID NO: 1881756 - RNA, 14 nt, Salmonella typhimurium LT2
cauacgcagcacuu

SEQ ID NO: 1881757 - RNA, 15 nt, Salmonella typhimurium LT2
cauacagcacuuccc

SEQ ID NO: 1881758 - RNA, 19 nt, Salmonella typhimurium LT2
cauacagcgauaaccgccg

SEQ ID NO: 1881759 - RNA, 14 nt, Salmonella typhimurium LT2
cauacacugcauaa

SEQ ID NO: 1881760 - RNA, 15 nt, Salmonella typhimurium LT2
cauacaccgccagcg

SEQ ID NO: 1881761 - RNA, 18 nt, Salmonella typhimurium LT2
cauaccacgcagcggcau

SEQ ID NO: 1881762 - RNA, 14 nt, Salmonella typhimurium LT2
cauacauaaauccg

SEQ ID NO: 1881763 - RNA, 23 nt, Salmonella typhimurium LT2
cauacaggccgccgggucagaaa

SEQ ID NO: 1881764 - RNA, 19 nt, Salmonella typhimurium LT2
cauacauccaucacuccuu

SEQ ID NO: 1881765 - RNA, 15 nt, Salmonella typhimurium LT2
cauacauacauacca

SEQ ID NO: 1881766 - RNA, 17 nt, Salmonella typhimurium LT2
cauaaucgcguuuuccu

SEQ ID NO: 1881767 - RNA, 14 nt, Salmonella typhimurium LT2
cauaauggcccagc

SEQ ID NO: 1881768 - RNA, 14 nt, Salmonella typhimurium LT2
cauaauggaacugc

SEQ ID NO: 1881769 - RNA, 22 nt, Salmonella typhimurium LT2
cauaaugcugccagcaugauaa

SEQ ID NO: 1881770 - RNA, 23 nt, Salmonella typhimurium LT2
cauaauggcgacgccuucaguca

SEQ ID NO: 1881771 - RNA, 21 nt, Salmonella typhimurium LT2
cauaaugauggggucacaggu

SEQ ID NO: 1881772 - RNA, 16 nt, Salmonella typhimurium LT2
cauacaaagagaaaau

SEQ ID NO: 1881773 - RNA, 14 nt, Salmonella typhimurium LT2
cauaaugucccugc

SEQ ID NO: 1881774 - RNA, 23 nt, Salmonella typhimurium LT2
cauaaugucucccgauuguauaa

SEQ ID NO: 1881775 - RNA, 13 nt, Salmonella typhimurium LT2
cauaaguguuuua

SEQ ID NO: 1881776 - RNA, 15 nt, Salmonella typhimurium LT2
cauaaguguuuuaag

SEQ ID NO: 1881777 - RNA, 20 nt, Salmonella typhimurium LT2
cauaauaaacugcauccccu

SEQ ID NO: 1881778 - RNA, 17 nt, Salmonella typhimurium LT2
cauaauaaccccaagca

SEQ ID NO: 1881779 - RNA, 19 nt, Salmonella typhimurium LT2
cauaaacgguuucagcagc

SEQ ID NO: 1881780 - RNA, 23 nt, Salmonella typhimurium LT2
cauaaacgucccgacgaauaaca

SEQ ID NO: 1881781 - RNA, 17 nt, Salmonella typhimurium LT2
cauaaacggcaccugga

SEQ ID NO: 1881782 - RNA, 14 nt, Salmonella typhimurium LT2
cauaaaaaagaaua

SEQ ID NO: 1881783 - RNA, 15 nt, Salmonella typhimurium LT2
cauaaaacccgcuuc

SEQ ID NO: 1881784 - RNA, 21 nt, Salmonella typhimurium LT2
cauaaaugcgaugaacaucga

SEQ ID NO: 1881785 - RNA, 15 nt, Salmonella typhimurium LT2
cauaaaugaucuucg

SEQ ID NO: 1881786 - RNA, 14 nt, Salmonella typhimurium LT2
cauaaauuggcuca

SEQ ID NO: 1881787 - RNA, 22 nt, Salmonella typhimurium LT2
cauaaauaaugccguuuuagcg

SEQ ID NO: 1881788 - RNA, 18 nt, Salmonella typhimurium LT2
cauaaagucagacaagua

SEQ ID NO: 1881789 - RNA, 20 nt, Salmonella typhimurium LT2
cauaaauaaaccgaaagggu

SEQ ID NO: 1881790 - RNA, 21 nt, Salmonella typhimurium LT2
cauaaaggcuuuaaagcaggc

SEQ ID NO: 1881791 - RNA, 15 nt, Salmonella typhimurium LT2
cauaaagccucucuu

SEQ ID NO: 1881792 - RNA, 14 nt, Salmonella typhimurium LT2
cauaagccagcccu

SEQ ID NO: 1881793 - RNA, 15 nt, Salmonella typhimurium LT2
cauaagccagcccug

SEQ ID NO: 1881794 - RNA, 21 nt, Salmonella typhimurium LT2
cauaagcacaccauuucacaa

SEQ ID NO: 1881795 - RNA, 16 nt, Salmonella typhimurium LT2
cauaagcacagauaaa

SEQ ID NO: 1881796 - RNA, 22 nt, Salmonella typhimurium LT2
cauaagcaaacagggggaagca

SEQ ID NO: 1881797 - RNA, 19 nt, Salmonella typhimurium LT2
cauaaggguaagcaauaug

SEQ ID NO: 1881798 - RNA, 22 nt, Salmonella typhimurium LT2
cauaagccgcguucugucgaua

SEQ ID NO: 1881799 - RNA, 15 nt, Salmonella typhimurium LT2
cauaagcgcggcgga

SEQ ID NO: 1881800 - RNA, 21 nt, Salmonella typhimurium LT2
cauaagagauggaaugagcau

SEQ ID NO: 1881801 - RNA, 20 nt, Salmonella typhimurium LT2
cauaagagauggaaugagca

SEQ ID NO: 1881802 - RNA, 14 nt, Salmonella typhimurium LT2
cauaacuugccgcc

SEQ ID NO: 1881803 - RNA, 18 nt, Salmonella typhimurium LT2
cauaacguuuccuuauau

SEQ ID NO: 1881804 - RNA, 18 nt, Salmonella typhimurium LT2
cauaacgugccaucuuug

SEQ ID NO: 1881805 - RNA, 18 nt, Salmonella typhimurium LT2
cauaacggcuacgcagcg

SEQ ID NO: 1881806 - RNA, 23 nt, Salmonella typhimurium LT2
cauaacgggguauaacucagcgg

SEQ ID NO: 1881807 - RNA, 22 nt, Salmonella typhimurium LT2
cauaacauugguuaucaaaaac

SEQ ID NO: 1881808 - RNA, 23 nt, Salmonella typhimurium LT2
cauaacauugguuaucaaaaacc

SEQ ID NO: 1881809 - RNA, 15 nt, Salmonella typhimurium LT2
cauaacgccgaugcc

SEQ ID NO: 1881810 - RNA, 17 nt, Salmonella typhimurium LT2
cauaacccuccugccuu

SEQ ID NO: 1881811 - RNA, 18 nt, Salmonella typhimurium LT2
cauaacccuucagcaacg

SEQ ID NO: 1881812 - RNA, 19 nt, Salmonella typhimurium LT2
cauaaccggcaaccaacgc

SEQ ID NO: 1881813 - RNA, 22 nt, Salmonella typhimurium LT2
cauaaccggugccgaaaucauc

SEQ ID NO: 1881814 - RNA, 16 nt, Salmonella typhimurium LT2
caucaaacuuuuaaau

SEQ ID NO: 1881815 - RNA, 22 nt, Salmonella typhimurium LT2
caucaagcaugaggguuguuuu

SEQ ID NO: 1881816 - RNA, 14 nt, Salmonella typhimurium LT2
caucaaaauuaccu

SEQ ID NO: 1881817 - RNA, 17 nt, Salmonella typhimurium LT2
caucaaaauuaccuuua

SEQ ID NO: 1881818 - RNA, 18 nt, Salmonella typhimurium LT2
caucaaaauuaccuuuac

SEQ ID NO: 1881819 - RNA, 21 nt, Salmonella typhimurium LT2
caucaaaacuggaaacgcauc

SEQ ID NO: 1881820 - RNA, 14 nt, Salmonella typhimurium LT2
caucaaacuuuuaa

SEQ ID NO: 1881821 - RNA, 22 nt, Salmonella typhimurium LT2
cauauuuaucuaagaauuuaau

SEQ ID NO: 1881822 - RNA, 17 nt, Salmonella typhimurium LT2
cauauuucaagccgcag

SEQ ID NO: 1881823 - RNA, 21 nt, Salmonella typhimurium LT2
cauauucaccagagcaucaau

SEQ ID NO: 1881824 - RNA, 20 nt, Salmonella typhimurium LT2
cauauugguccgguaacagc

SEQ ID NO: 1881825 - RNA, 14 nt, Salmonella typhimurium LT2
cauaugcgcggcga

SEQ ID NO: 1881826 - RNA, 17 nt, Salmonella typhimurium LT2
cauauggcguuccgguu

SEQ ID NO: 1881827 - RNA, 15 nt, Salmonella typhimurium LT2
cauaguuauuaacau

SEQ ID NO: 1881828 - RNA, 15 nt, Salmonella typhimurium LT2
cauauccaagccccu

SEQ ID NO: 1881829 - RNA, 11 nt, Salmonella typhimurium LT2
cauauccagcc

SEQ ID NO: 1881830 - RNA, 18 nt, Salmonella typhimurium LT2
cauaucaaucaacgguuc

SEQ ID NO: 1881831 - RNA, 15 nt, Salmonella typhimurium LT2
cauaucugcgccgcc

SEQ ID NO: 1881832 - RNA, 19 nt, Salmonella typhimurium LT2
cauaucuguuuggcaaggg

SEQ ID NO: 1881833 - RNA, 20 nt, Salmonella typhimurium LT2
cauaugaguuauguauuuaa

SEQ ID NO: 1881834 - RNA, 21 nt, Salmonella typhimurium LT2
cauaugaguuauguauuuaau

SEQ ID NO: 1881835 - RNA, 22 nt, Salmonella typhimurium LT2
cauaugaguuauguauuuaauu

SEQ ID NO: 1881836 - RNA, 17 nt, Salmonella typhimurium LT2
cauagugacgcuguaca

SEQ ID NO: 1881837 - RNA, 15 nt, Salmonella typhimurium LT2
cauagucgcuuuuca

SEQ ID NO: 1881838 - RNA, 21 nt, Salmonella typhimurium LT2
cauagucgugcggguucaucc

SEQ ID NO: 1881839 - RNA, 19 nt, Salmonella typhimurium LT2
cauauaccgcaccugggua

SEQ ID NO: 1881840 - RNA, 17 nt, Salmonella typhimurium LT2
cauacguuuaaagcgcu

SEQ ID NO: 1881841 - RNA, 12 nt, Salmonella typhimurium LT2
cauacucacauu

SEQ ID NO: 1881842 - RNA, 23 nt, Salmonella typhimurium LT2
cauacucacauucauaaaagauc

SEQ ID NO: 1881843 - RNA, 16 nt, Salmonella typhimurium LT2
cauacucacgaauaag

SEQ ID NO: 1881844 - RNA, 21 nt, Salmonella typhimurium LT2
caucagccugcaguuuugcau

SEQ ID NO: 1881845 - RNA, 18 nt, Salmonella typhimurium LT2
caucagcgccagcccugc

SEQ ID NO: 1881846 - RNA, 16 nt, Salmonella typhimurium LT2
caucagauucaacagg

SEQ ID NO: 1881847 - RNA, 17 nt, Salmonella typhimurium LT2
caucagccagccgccaa

SEQ ID NO: 1881848 - RNA, 22 nt, Salmonella typhimurium LT2
caucagcccuaucgcugcgcug

SEQ ID NO: 1881849 - RNA, 12 nt, Salmonella typhimurium LT2
caucagccaggc

SEQ ID NO: 1881850 - RNA, 23 nt, Salmonella typhimurium LT2
caucagccagccgccaaaaauau

SEQ ID NO: 1881851 - RNA, 18 nt, Salmonella typhimurium LT2
caucagcgcuaccagcgc

SEQ ID NO: 1881852 - RNA, 18 nt, Salmonella typhimurium LT2
caucagcgucagcaccag

SEQ ID NO: 1881853 - RNA, 17 nt, Salmonella typhimurium LT2
caucaggaucuucaucc

SEQ ID NO: 1881854 - RNA, 15 nt, Salmonella typhimurium LT2
caucaggaaaugaac

SEQ ID NO: 1881855 - RNA, 13 nt, Salmonella typhimurium LT2
caucaaucaccuu

SEQ ID NO: 1881856 - RNA, 20 nt, Salmonella typhimurium LT2
caucaaucgcuaucugacag

SEQ ID NO: 1881857 - RNA, 13 nt, Salmonella typhimurium LT2
caucaaugcccag

SEQ ID NO: 1881858 - RNA, 19 nt, Salmonella typhimurium LT2
caucaauggcgauuuuuag

SEQ ID NO: 1881859 - RNA, 22 nt, Salmonella typhimurium LT2
caucacgcaaaugcagcggaau

SEQ ID NO: 1881860 - RNA, 20 nt, Salmonella typhimurium LT2
caucacggagcgguaguuca

SEQ ID NO: 1881861 - RNA, 19 nt, Salmonella typhimurium LT2
caucagacccgcguacagg

SEQ ID NO: 1881862 - RNA, 17 nt, Salmonella typhimurium LT2
caucagaccgauaaaua

SEQ ID NO: 1881863 - RNA, 17 nt, Salmonella typhimurium LT2
caucagaccgccaagcg

SEQ ID NO: 1881864 - RNA, 21 nt, Salmonella typhimurium LT2
caucaucgccagcuuaucgac

SEQ ID NO: 1881865 - RNA, 19 nt, Salmonella typhimurium LT2
caucaucggcacagccagu

SEQ ID NO: 1881866 - RNA, 16 nt, Salmonella typhimurium LT2
caucaucgucgcgccc

SEQ ID NO: 1881867 - RNA, 14 nt, Salmonella typhimurium LT2
caucaucucauaaa

SEQ ID NO: 1881868 - RNA, 21 nt, Salmonella typhimurium LT2
caucaucuuguccucaucauu

SEQ ID NO: 1881869 - RNA, 14 nt, Salmonella typhimurium LT2
caucauuaauauaa

SEQ ID NO: 1881870 - RNA, 22 nt, Salmonella typhimurium LT2
caucauuaccuacgcgauaaaa

SEQ ID NO: 1881871 - RNA, 20 nt, Salmonella typhimurium LT2
caucauuacugcuuagcugu

SEQ ID NO: 1881872 - RNA, 20 nt, Salmonella typhimurium LT2
caucaugaaaaacaguaccg

SEQ ID NO: 1881873 - RNA, 12 nt, Salmonella typhimurium LT2
caucaucgccaa

SEQ ID NO: 1881874 - RNA, 18 nt, Salmonella typhimurium LT2
caucaucaggacucaauc

SEQ ID NO: 1881875 - RNA, 14 nt, Salmonella typhimurium LT2
caucaucagcagca

SEQ ID NO: 1881876 - RNA, 19 nt, Salmonella typhimurium LT2
caucaucaucggcacagcc

SEQ ID NO: 1881877 - RNA, 17 nt, Salmonella typhimurium LT2
caucaggcuuugcgcca

SEQ ID NO: 1881878 - RNA, 15 nt, Salmonella typhimurium LT2
caucaggccugcaaa

SEQ ID NO: 1881879 - RNA, 20 nt, Salmonella typhimurium LT2
caucaggugaguaaauaaaa

SEQ ID NO: 1881880 - RNA, 17 nt, Salmonella typhimurium LT2
caucaguagugucuuca

SEQ ID NO: 1881881 - RNA, 16 nt, Salmonella typhimurium LT2
caucauaaauggcuga

SEQ ID NO: 1881882 - RNA, 14 nt, Salmonella typhimurium LT2
caucauaauaauug

SEQ ID NO: 1881883 - RNA, 19 nt, Salmonella typhimurium LT2
caucgccgccuccgccgcu

SEQ ID NO: 1881884 - RNA, 14 nt, Salmonella typhimurium LT2
caucgccgccgagu

SEQ ID NO: 1881885 - RNA, 19 nt, Salmonella typhimurium LT2
caucgccugaucgcgcaga

SEQ ID NO: 1881886 - RNA, 22 nt, Salmonella typhimurium LT2
caucgcgccaaacgggcaagcc

SEQ ID NO: 1881887 - RNA, 13 nt, Salmonella typhimurium LT2
caucgcgcagcag

SEQ ID NO: 1881888 - RNA, 21 nt, Salmonella typhimurium LT2
caucgcgaucaucagcacgcc

SEQ ID NO: 1881889 - RNA, 16 nt, Salmonella typhimurium LT2
caucgcgccgcuggcg

SEQ ID NO: 1881890 - RNA, 21 nt, Salmonella typhimurium LT2
caucgcgccgccgggcuucac

SEQ ID NO: 1881891 - RNA, 16 nt, Salmonella typhimurium LT2
cauccuguaccaccac

SEQ ID NO: 1881892 - RNA, 17 nt, Salmonella typhimurium LT2
cauccuguagcagugga

SEQ ID NO: 1881893 - RNA, 21 nt, Salmonella typhimurium LT2
cauccuguggguucaucgcca

SEQ ID NO: 1881894 - RNA, 19 nt, Salmonella typhimurium LT2
cauccuguucauccacaga

SEQ ID NO: 1881895 - RNA, 15 nt, Salmonella typhimurium LT2
caucgacagacuuca

SEQ ID NO: 1881896 - RNA, 19 nt, Salmonella typhimurium LT2
caucgacgaaauggugugc

SEQ ID NO: 1881897 - RNA, 15 nt, Salmonella typhimurium LT2
caucgacccccacca

SEQ ID NO: 1881898 - RNA, 17 nt, Salmonella typhimurium LT2
caucauuggcugucuua

SEQ ID NO: 1881899 - RNA, 20 nt, Salmonella typhimurium LT2
caucauugucacuauucuua

SEQ ID NO: 1881900 - RNA, 22 nt, Salmonella typhimurium LT2
caucauucgguuaggaauagca

SEQ ID NO: 1881901 - RNA, 15 nt, Salmonella typhimurium LT2
caucauugauacugu

SEQ ID NO: 1881902 - RNA, 13 nt, Salmonella typhimurium LT2
caucauugcgcca

SEQ ID NO: 1881903 - RNA, 16 nt, Salmonella typhimurium LT2
caucaugacacuuuau

SEQ ID NO: 1881904 - RNA, 15 nt, Salmonella typhimurium LT2
cauccgcgcuuucug

SEQ ID NO: 1881905 - RNA, 15 nt, Salmonella typhimurium LT2
cauccgcucccgcuu

SEQ ID NO: 1881906 - RNA, 18 nt, Salmonella typhimurium LT2
cauccggguuaaaccagc

SEQ ID NO: 1881907 - RNA, 13 nt, Salmonella typhimurium LT2
cauccggcaaucc

SEQ ID NO: 1881908 - RNA, 15 nt, Salmonella typhimurium LT2
cauccggcaauuuau

SEQ ID NO: 1881909 - RNA, 18 nt, Salmonella typhimurium LT2
cauccucaauguuaacua

SEQ ID NO: 1881910 - RNA, 22 nt, Salmonella typhimurium LT2
cauccucauuuuguugcuccag

SEQ ID NO: 1881911 - RNA, 15 nt, Salmonella typhimurium LT2
cauccucaaugguuu

SEQ ID NO: 1881912 - RNA, 22 nt, Salmonella typhimurium LT2
cauccuccauccagguaacaua

SEQ ID NO: 1881913 - RNA, 13 nt, Salmonella typhimurium LT2
cauccucauuuug

SEQ ID NO: 1881914 - RNA, 23 nt, Salmonella typhimurium LT2
cauccugaagcggcgcaauuuuc

SEQ ID NO: 1881915 - RNA, 21 nt, Salmonella typhimurium LT2
cauccucuuggguuauuucga

SEQ ID NO: 1881916 - RNA, 19 nt, Salmonella typhimurium LT2
cauccucuuggguuauuuc

SEQ ID NO: 1881917 - RNA, 13 nt, Salmonella typhimurium LT2
cauccugcaaaag

SEQ ID NO: 1881918 - RNA, 20 nt, Salmonella typhimurium LT2
cauccugcaaaaggaacagu

SEQ ID NO: 1881919 - RNA, 19 nt, Salmonella typhimurium LT2
cauccugcaacucaaaaua

SEQ ID NO: 1881920 - RNA, 22 nt, Salmonella typhimurium LT2
caucucaauaucguugccgccg

SEQ ID NO: 1881921 - RNA, 18 nt, Salmonella typhimurium LT2
caucucccaggccgccac

SEQ ID NO: 1881922 - RNA, 21 nt, Salmonella typhimurium LT2
caucuccagcgcauugcccuu

SEQ ID NO: 1881923 - RNA, 20 nt, Salmonella typhimurium LT2
caucucccaggccgccaccg

SEQ ID NO: 1881924 - RNA, 21 nt, Salmonella typhimurium LT2
caucucccaggccgccaccgc

SEQ ID NO: 1881925 - RNA, 19 nt, Salmonella typhimurium LT2
caucuccggcgaccaauua

SEQ ID NO: 1881926 - RNA, 19 nt, Salmonella typhimurium LT2
caucuaucugcuucuggcu

SEQ ID NO: 1881927 - RNA, 14 nt, Salmonella typhimurium LT2
caucuaauuaaaaa

SEQ ID NO: 1881928 - RNA, 16 nt, Salmonella typhimurium LT2
caucuaauuaaaaaga

SEQ ID NO: 1881929 - RNA, 16 nt, Salmonella typhimurium LT2
caucuacuaucaucug

SEQ ID NO: 1881930 - RNA, 13 nt, Salmonella typhimurium LT2
caucuacgccgga

SEQ ID NO: 1881931 - RNA, 15 nt, Salmonella typhimurium LT2
caucuaacacaaauu

SEQ ID NO: 1881932 - RNA, 22 nt, Salmonella typhimurium LT2
caucguuuugguggcgaucaua

SEQ ID NO: 1881933 - RNA, 21 nt, Salmonella typhimurium LT2
caucgucgccagacccagcgc

SEQ ID NO: 1881934 - RNA, 23 nt, Salmonella typhimurium LT2
caucgcugaauuuggcggcgcgc

SEQ ID NO: 1881935 - RNA, 14 nt, Salmonella typhimurium LT2
caucgguucucugc

SEQ ID NO: 1881936 - RNA, 17 nt, Salmonella typhimurium LT2
caucguaccaauaccca

SEQ ID NO: 1881937 - RNA, 22 nt, Salmonella typhimurium LT2
caucgcuaaguugaacgguaaa

SEQ ID NO: 1881938 - RNA, 13 nt, Salmonella typhimurium LT2
caucgcucaaaac

SEQ ID NO: 1881939 - RNA, 14 nt, Salmonella typhimurium LT2
caucgcucaaaaca

SEQ ID NO: 1881940 - RNA, 18 nt, Salmonella typhimurium LT2
caucgcuaaccggcggcg

SEQ ID NO: 1881941 - RNA, 16 nt, Salmonella typhimurium LT2
caucugcgcauauucc

SEQ ID NO: 1881942 - RNA, 14 nt, Salmonella typhimurium LT2
caucugaccgugag

SEQ ID NO: 1881943 - RNA, 17 nt, Salmonella typhimurium LT2
caucuccuggucuggcu

SEQ ID NO: 1881944 - RNA, 21 nt, Salmonella typhimurium LT2
caucuccugacugccgccggc

SEQ ID NO: 1881945 - RNA, 15 nt, Salmonella typhimurium LT2
caucucuggcggcgu

SEQ ID NO: 1881946 - RNA, 16 nt, Salmonella typhimurium LT2
caucucguuaaaacgg

SEQ ID NO: 1881947 - RNA, 22 nt, Salmonella typhimurium LT2
caucuuauauuuuggugugaca

SEQ ID NO: 1881948 - RNA, 19 nt, Salmonella typhimurium LT2
caucugcggcuuucaucau

SEQ ID NO: 1881949 - RNA, 22 nt, Salmonella typhimurium LT2
caucugcggcaugaauugccgu

SEQ ID NO: 1881950 - RNA, 16 nt, Salmonella typhimurium LT2
caucuggcguugccug

SEQ ID NO: 1881951 - RNA, 20 nt, Salmonella typhimurium LT2
ccaaaucucccccggcacca

SEQ ID NO: 1881952 - RNA, 15 nt, Salmonella typhimurium LT2
ccaaaucgucagccg

SEQ ID NO: 1881953 - RNA, 13 nt, Salmonella typhimurium LT2
ccaacaacccauu

SEQ ID NO: 1881954 - RNA, 22 nt, Salmonella typhimurium LT2
ccaacaggaacaucguguccug

SEQ ID NO: 1881955 - RNA, 19 nt, Salmonella typhimurium LT2
ccaacagccgccuguuuga

SEQ ID NO: 1881956 - RNA, 15 nt, Salmonella typhimurium LT2
ccaacaaugccacgc

SEQ ID NO: 1881957 - RNA, 15 nt, Salmonella typhimurium LT2
ccaacauacaugccu

SEQ ID NO: 1881958 - RNA, 15 nt, Salmonella typhimurium LT2
ccaaaucaauagaau

SEQ ID NO: 1881959 - RNA, 16 nt, Salmonella typhimurium LT2
ccaaagggagcagacu

SEQ ID NO: 1881960 - RNA, 20 nt, Salmonella typhimurium LT2
cauuuuccgcugucuaucca

SEQ ID NO: 1881961 - RNA, 17 nt, Salmonella typhimurium LT2
cauuuuccgcugucuau

SEQ ID NO: 1881962 - RNA, 22 nt, Salmonella typhimurium LT2
cauuuuccgcugucuauccacu

SEQ ID NO: 1881963 - RNA, 15 nt, Salmonella typhimurium LT2
cauuuuaucuuuugu

SEQ ID NO: 1881964 - RNA, 18 nt, Salmonella typhimurium LT2
ccaacgcaaugcgauaag

SEQ ID NO: 1881965 - RNA, 18 nt, Salmonella typhimurium LT2
ccaacgacccccaccaug

SEQ ID NO: 1881966 - RNA, 15 nt, Salmonella typhimurium LT2
ccaacugccaaacca

SEQ ID NO: 1881967 - RNA, 16 nt, Salmonella typhimurium LT2
ccaacugcgccugaag

SEQ ID NO: 1881968 - RNA, 14 nt, Salmonella typhimurium LT2
ccaacguauaaaau

SEQ ID NO: 1881969 - RNA, 17 nt, Salmonella typhimurium LT2
ccaacugucgccauccu

SEQ ID NO: 1881970 - RNA, 13 nt, Salmonella typhimurium LT2
ccaagcagcgcca

SEQ ID NO: 1881971 - RNA, 21 nt, Salmonella typhimurium LT2
ccaagcaccuagguuccagcu

SEQ ID NO: 1881972 - RNA, 17 nt, Salmonella typhimurium LT2
ccaauauagccgauggc

SEQ ID NO: 1881973 - RNA, 23 nt, Salmonella typhimurium LT2
ccaauaccggcguaauugcgccu

SEQ ID NO: 1881974 - RNA, 13 nt, Salmonella typhimurium LT2
ccaaucagcccca

SEQ ID NO: 1881975 - RNA, 16 nt, Salmonella typhimurium LT2
ccaaucacgcagagua

SEQ ID NO: 1881976 - RNA, 21 nt, Salmonella typhimurium LT2
ccaauauuaauguauuauuau

SEQ ID NO: 1881977 - RNA, 14 nt, Salmonella typhimurium LT2
ccaauauccccagc

SEQ ID NO: 1881978 - RNA, 17 nt, Salmonella typhimurium LT2
ccaauaugaugcuugcu

SEQ ID NO: 1881979 - RNA, 20 nt, Salmonella typhimurium LT2
ccaaucgccgccgccagguu

SEQ ID NO: 1881980 - RNA, 22 nt, Salmonella typhimurium LT2
ccaaucaugucaaauucaagcc

SEQ ID NO: 1881981 - RNA, 14 nt, Salmonella typhimurium LT2
ccaaucccaccacu

SEQ ID NO: 1881982 - RNA, 15 nt, Salmonella typhimurium LT2
ccaauguuaauaagc

SEQ ID NO: 1881983 - RNA, 15 nt, Salmonella typhimurium LT2
ccaauugcugcaucg

SEQ ID NO: 1881984 - RNA, 12 nt, Salmonella typhimurium LT2
ccaauuuuucac

SEQ ID NO: 1881985 - RNA, 18 nt, Salmonella typhimurium LT2
ccaauguacguaaaacca

SEQ ID NO: 1881986 - RNA, 18 nt, Salmonella typhimurium LT2
ccaaugucauauuuguga

SEQ ID NO: 1881987 - RNA, 14 nt, Salmonella typhimurium LT2
ccaauguaaauuaa

SEQ ID NO: 1881988 - RNA, 18 nt, Salmonella typhimurium LT2
ccaaugcguuguuccuga

SEQ ID NO: 1881989 - RNA, 15 nt, Salmonella typhimurium LT2
ccaaucuccagcauc

SEQ ID NO: 1881990 - RNA, 20 nt, Salmonella typhimurium LT2
ccacagcgaauuccggccau

SEQ ID NO: 1881991 - RNA, 16 nt, Salmonella typhimurium LT2
ccacagauaaaacaaa

SEQ ID NO: 1881992 - RNA, 18 nt, Salmonella typhimurium LT2
ccacagccaccgccagca

SEQ ID NO: 1881993 - RNA, 23 nt, Salmonella typhimurium LT2
ccacagcggaugguauuucaggc

SEQ ID NO: 1881994 - RNA, 24 nt, Salmonella typhimurium LT2
ccaccgggcaacccggcuaaauga

SEQ ID NO: 1881995 - RNA, 17 nt, Salmonella typhimurium LT2
ccaccgguuuuuuccug

SEQ ID NO: 1881996 - RNA, 22 nt, Salmonella typhimurium LT2
ccaccguaugugcgccgugcag

SEQ ID NO: 1881997 - RNA, 14 nt, Salmonella typhimurium LT2
ccaccguauuuuuu

SEQ ID NO: 1881998 - RNA, 18 nt, Salmonella typhimurium LT2
ccaccgccgccaccaaaa

SEQ ID NO: 1881999 - RNA, 18 nt, Salmonella typhimurium LT2
ccaccgcauuuucagcuu

SEQ ID NO: 1882000 - RNA, 16 nt, Salmonella typhimurium LT2
ccaccgccagacgccc

SEQ ID NO: 1882001 - RNA, 13 nt, Salmonella typhimurium LT2
ccacccuggcgca

SEQ ID NO: 1882002 - RNA, 16 nt, Salmonella typhimurium LT2
ccaccugaucgccgac

SEQ ID NO: 1882003 - RNA, 23 nt, Salmonella typhimurium LT2
ccaccucuuuuaacgaacgcgcg

SEQ ID NO: 1882004 - RNA, 18 nt, Salmonella typhimurium LT2
ccacgaccuacaccguau

SEQ ID NO: 1882005 - RNA, 22 nt, Salmonella typhimurium LT2
ccaccugcauggggaaauacug

SEQ ID NO: 1882006 - RNA, 17 nt, Salmonella typhimurium LT2
ccacgcaaucucuuccg

SEQ ID NO: 1882007 - RNA, 20 nt, Salmonella typhimurium LT2
ccacgcacaguacgcccggc

SEQ ID NO: 1882008 - RNA, 17 nt, Salmonella typhimurium LT2
ccacgauaaucccggcu

SEQ ID NO: 1882009 - RNA, 20 nt, Salmonella typhimurium LT2
ccacgaguggcgcggaaagc

SEQ ID NO: 1882010 - RNA, 16 nt, Salmonella typhimurium LT2
ccacgagaaauccaca

SEQ ID NO: 1882011 - RNA, 18 nt, Salmonella typhimurium LT2
ccaccaucgucgccagac

SEQ ID NO: 1882012 - RNA, 19 nt, Salmonella typhimurium LT2
ccaccaucuccugacugcc

SEQ ID NO: 1882013 - RNA, 19 nt, Salmonella typhimurium LT2
ccaccaucuucaagcuuua

SEQ ID NO: 1882014 - RNA, 16 nt, Salmonella typhimurium LT2
ccaccauaggccagcg

SEQ ID NO: 1882015 - RNA, 21 nt, Salmonella typhimurium LT2
ccaccauauucgccaccgcgc

SEQ ID NO: 1882016 - RNA, 19 nt, Salmonella typhimurium LT2
ccaccauauucgccaccgc

SEQ ID NO: 1882017 - RNA, 13 nt, Salmonella typhimurium LT2
ccaccagucccug

SEQ ID NO: 1882018 - RNA, 20 nt, Salmonella typhimurium LT2
ccaccaguaaccgccacagc

SEQ ID NO: 1882019 - RNA, 20 nt, Salmonella typhimurium LT2
ccaccacugauuccagagcg

SEQ ID NO: 1882020 - RNA, 21 nt, Salmonella typhimurium LT2
ccaccacugauuccagagcga

SEQ ID NO: 1882021 - RNA, 13 nt, Salmonella typhimurium LT2
ccaccacgcccaa

SEQ ID NO: 1882022 - RNA, 12 nt, Salmonella typhimurium LT2
ccaccagcacag

SEQ ID NO: 1882023 - RNA, 13 nt, Salmonella typhimurium LT2
ccaccagcacagg

SEQ ID NO: 1882024 - RNA, 13 nt, Salmonella typhimurium LT2
ccaccacgcagcc

SEQ ID NO: 1882025 - RNA, 21 nt, Salmonella typhimurium LT2
ccacggcguguugaaguccuc

SEQ ID NO: 1882026 - RNA, 23 nt, Salmonella typhimurium LT2
ccacggcguagcgagaaggcuuu

SEQ ID NO: 1882027 - RNA, 18 nt, Salmonella typhimurium LT2
ccacggcuucagcggcgc

SEQ ID NO: 1882028 - RNA, 15 nt, Salmonella typhimurium LT2
ccacggcuucagcgg

SEQ ID NO: 1882029 - RNA, 18 nt, Salmonella typhimurium LT2
ccacgguuaucuggcgca

SEQ ID NO: 1882030 - RNA, 16 nt, Salmonella typhimurium LT2
ccacgguucucaccgu

SEQ ID NO: 1882031 - RNA, 13 nt, Salmonella typhimurium LT2
ccacuacgcagcu

SEQ ID NO: 1882032 - RNA, 18 nt, Salmonella typhimurium LT2
ccacuacgcagcuccagc

SEQ ID NO: 1882033 - RNA, 13 nt, Salmonella typhimurium LT2
ccacuaccgccac

SEQ ID NO: 1882034 - RNA, 14 nt, Salmonella typhimurium LT2
ccacuaacagugcg

SEQ ID NO: 1882035 - RNA, 15 nt, Salmonella typhimurium LT2
ccacuaacuggcaau

SEQ ID NO: 1882036 - RNA, 21 nt, Salmonella typhimurium LT2
ccacuaacuggcaaucaugcg

SEQ ID NO: 1882037 - RNA, 16 nt, Salmonella typhimurium LT2
ccacucauccagcaaa

SEQ ID NO: 1882038 - RNA, 21 nt, Salmonella typhimurium LT2
ccacucagcgcuguuuuuccg

SEQ ID NO: 1882039 - RNA, 23 nt, Salmonella typhimurium LT2
ccacguugucggcucauccagca

SEQ ID NO: 1882040 - RNA, 21 nt, Salmonella typhimurium LT2
ccacguucggcguguagccaa

SEQ ID NO: 1882041 - RNA, 13 nt, Salmonella typhimurium LT2
ccacgcccagcua

SEQ ID NO: 1882042 - RNA, 18 nt, Salmonella typhimurium LT2
ccacgcccgccgccagca

SEQ ID NO: 1882043 - RNA, 15 nt, Salmonella typhimurium LT2
ccacgccaucgcggc

SEQ ID NO: 1882044 - RNA, 17 nt, Salmonella typhimurium LT2
ccacgccaucgcggcgc

SEQ ID NO: 1882045 - RNA, 17 nt, Salmonella typhimurium LT2
ccacgccauggccgcag

SEQ ID NO: 1882046 - RNA, 18 nt, Salmonella typhimurium LT2
ccacgccauggccgcagc

SEQ ID NO: 1882047 - RNA, 18 nt, Salmonella typhimurium LT2
ccacgccccuaaggcagc

SEQ ID NO: 1882048 - RNA, 15 nt, Salmonella typhimurium LT2
ccacgcccagcgccg

SEQ ID NO: 1882049 - RNA, 18 nt, Salmonella typhimurium LT2
ccacgcgcucgugcaaau

SEQ ID NO: 1882050 - RNA, 16 nt, Salmonella typhimurium LT2
ccacgcgagcugccag

SEQ ID NO: 1882051 - RNA, 20 nt, Salmonella typhimurium LT2
ccacgcgaugcaaccccuga

SEQ ID NO: 1882052 - RNA, 20 nt, Salmonella typhimurium LT2
ccacgccgcacacagcggaa

SEQ ID NO: 1882053 - RNA, 14 nt, Salmonella typhimurium LT2
ccacgccguagcug

SEQ ID NO: 1882054 - RNA, 14 nt, Salmonella typhimurium LT2
ccacgcucacuuuu

SEQ ID NO: 1882055 - RNA, 15 nt, Salmonella typhimurium LT2
ccacgcuccaucaua

SEQ ID NO: 1882056 - RNA, 15 nt, Salmonella typhimurium LT2
ccacgcuccagcgga

SEQ ID NO: 1882057 - RNA, 17 nt, Salmonella typhimurium LT2
ccacgcucgcuggugcc

SEQ ID NO: 1882058 - RNA, 22 nt, Salmonella typhimurium LT2
ccacggacaucggcuucgcugg

SEQ ID NO: 1882059 - RNA, 15 nt, Salmonella typhimurium LT2
ccacggccagcagcc

SEQ ID NO: 1882060 - RNA, 16 nt, Salmonella typhimurium LT2
ccacggccagcagcca

SEQ ID NO: 1882061 - RNA, 12 nt, Salmonella typhimurium LT2
ccacggccagca

SEQ ID NO: 1882062 - RNA, 18 nt, Salmonella typhimurium LT2
ccacggcgcacacgccca

SEQ ID NO: 1882063 - RNA, 20 nt, Salmonella typhimurium LT2
ccacggauauuuaccgccgc

SEQ ID NO: 1882064 - RNA, 19 nt, Salmonella typhimurium LT2
ccacggauaagccagcccu

SEQ ID NO: 1882065 - RNA, 19 nt, Salmonella typhimurium LT2
ccacggauauuuaccgccg

SEQ ID NO: 1882066 - RNA, 12 nt, Salmonella typhimurium LT2
ccacggagagcg

SEQ ID NO: 1882067 - RNA, 21 nt, Salmonella typhimurium LT2
ccacggauuuaauccaccaca

SEQ ID NO: 1882068 - RNA, 12 nt, Salmonella typhimurium LT2
cauguccaucag

SEQ ID NO: 1882069 - RNA, 14 nt, Salmonella typhimurium LT2
cauguaaccaaagc

SEQ ID NO: 1882070 - RNA, 17 nt, Salmonella typhimurium LT2
cauggcguuauggcaaa

SEQ ID NO: 1882071 - RNA, 15 nt, Salmonella typhimurium LT2
cauggguuugaccca

SEQ ID NO: 1882072 - RNA, 15 nt, Salmonella typhimurium LT2
cauggguuagauaua

SEQ ID NO: 1882073 - RNA, 16 nt, Salmonella typhimurium LT2
cauggguaaagcccau

SEQ ID NO: 1882074 - RNA, 12 nt, Salmonella typhimurium LT2
caugcuggauga

SEQ ID NO: 1882075 - RNA, 13 nt, Salmonella typhimurium LT2
caugcuggcuaaa

SEQ ID NO: 1882076 - RNA, 13 nt, Salmonella typhimurium LT2
cauggaaauaaag

SEQ ID NO: 1882077 - RNA, 18 nt, Salmonella typhimurium LT2
cauggaagaaaauauaau

SEQ ID NO: 1882078 - RNA, 20 nt, Salmonella typhimurium LT2
cauggaguuccaguucaucu

SEQ ID NO: 1882079 - RNA, 19 nt, Salmonella typhimurium LT2
cauggagauuggcucuuug

SEQ ID NO: 1882080 - RNA, 23 nt, Salmonella typhimurium LT2
cauggcaaaacuaaacccggccu

SEQ ID NO: 1882081 - RNA, 14 nt, Salmonella typhimurium LT2
cauggcauacagcu

SEQ ID NO: 1882082 - RNA, 20 nt, Salmonella typhimurium LT2
cauggcagauaaaccacgcc

SEQ ID NO: 1882083 - RNA, 14 nt, Salmonella typhimurium LT2
caucuuccaugccu

SEQ ID NO: 1882084 - RNA, 16 nt, Salmonella typhimurium LT2
caucuucaccuuucca

SEQ ID NO: 1882085 - RNA, 16 nt, Salmonella typhimurium LT2
caucuucacgcagcgu

SEQ ID NO: 1882086 - RNA, 20 nt, Salmonella typhimurium LT2
caugcucauuuugauaaauc

SEQ ID NO: 1882087 - RNA, 15 nt, Salmonella typhimurium LT2
caucuucuaccugaa

SEQ ID NO: 1882088 - RNA, 21 nt, Salmonella typhimurium LT2
caugcugaccgaaccgcugua

SEQ ID NO: 1882089 - RNA, 18 nt, Salmonella typhimurium LT2
caugcucgcuuuccauua

SEQ ID NO: 1882090 - RNA, 14 nt, Salmonella typhimurium LT2
cauuacgauaaaug

SEQ ID NO: 1882091 - RNA, 14 nt, Salmonella typhimurium LT2
cauuacgaucugac

SEQ ID NO: 1882092 - RNA, 21 nt, Salmonella typhimurium LT2
cauuaccgcccuguccuccau

SEQ ID NO: 1882093 - RNA, 16 nt, Salmonella typhimurium LT2
cauuacgcuuccugcc

SEQ ID NO: 1882094 - RNA, 13 nt, Salmonella typhimurium LT2
cauuacauccuca

SEQ ID NO: 1882095 - RNA, 16 nt, Salmonella typhimurium LT2
cauuaccagcaauaac

SEQ ID NO: 1882096 - RNA, 13 nt, Salmonella typhimurium LT2
cauuacccccgcc

SEQ ID NO: 1882097 - RNA, 14 nt, Salmonella typhimurium LT2
cauuaccccagcau

SEQ ID NO: 1882098 - RNA, 17 nt, Salmonella typhimurium LT2
cauuaccccagcaucuc

SEQ ID NO: 1882099 - RNA, 19 nt, Salmonella typhimurium LT2
cauuagcauucccuuaucu

SEQ ID NO: 1882100 - RNA, 21 nt, Salmonella typhimurium LT2
cauuacuccgcuauaaaaauu

SEQ ID NO: 1882101 - RNA, 13 nt, Salmonella typhimurium LT2
caugucguuagaa

SEQ ID NO: 1882102 - RNA, 21 nt, Salmonella typhimurium LT2
caugucuucgcgcguggugcu

SEQ ID NO: 1882103 - RNA, 14 nt, Salmonella typhimurium LT2
caugugcagcaucc

SEQ ID NO: 1882104 - RNA, 23 nt, Salmonella typhimurium LT2
cauuaauccccggcgaaagaaaa

SEQ ID NO: 1882105 - RNA, 17 nt, Salmonella typhimurium LT2
cauuacaggcaucuucc

SEQ ID NO: 1882106 - RNA, 22 nt, Salmonella typhimurium LT2
cauuacaggcaucuuccagcgu

SEQ ID NO: 1882107 - RNA, 21 nt, Salmonella typhimurium LT2
cauuaaucaguucaggaacau

SEQ ID NO: 1882108 - RNA, 22 nt, Salmonella typhimurium LT2
cauuaaucaguucaggaacauc

SEQ ID NO: 1882109 - RNA, 20 nt, Salmonella typhimurium LT2
cauucagcggcugcgccugc

SEQ ID NO: 1882110 - RNA, 22 nt, Salmonella typhimurium LT2
cauucagcacgcuuuggcaggc

SEQ ID NO: 1882111 - RNA, 20 nt, Salmonella typhimurium LT2
cauuauuuuagugaaaaaau

SEQ ID NO: 1882112 - RNA, 21 nt, Salmonella typhimurium LT2
cauuauugucuuuguugccuu

SEQ ID NO: 1882113 - RNA, 20 nt, Salmonella typhimurium LT2
cauuagcggcauugaagagu

SEQ ID NO: 1882114 - RNA, 21 nt, Salmonella typhimurium LT2
cauuaggccggacguugaaaa

SEQ ID NO: 1882115 - RNA, 18 nt, Salmonella typhimurium LT2
cauucaggcuggcaaagc

SEQ ID NO: 1882116 - RNA, 19 nt, Salmonella typhimurium LT2
cauucaggcuggcaaagca

SEQ ID NO: 1882117 - RNA, 14 nt, Salmonella typhimurium LT2
cauucaggcuuucc

SEQ ID NO: 1882118 - RNA, 19 nt, Salmonella typhimurium LT2
cauucagugaauuaugacc

SEQ ID NO: 1882119 - RNA, 17 nt, Salmonella typhimurium LT2
cauucaguacaauaccu

SEQ ID NO: 1882120 - RNA, 12 nt, Salmonella typhimurium LT2
cauuccgccugc

SEQ ID NO: 1882121 - RNA, 14 nt, Salmonella typhimurium LT2
cauuccgcccagga

SEQ ID NO: 1882122 - RNA, 24 nt, Salmonella typhimurium LT2
cauucgaccacaacccacuggccu

SEQ ID NO: 1882123 - RNA, 17 nt, Salmonella typhimurium LT2
cauucgaauccuccugu

SEQ ID NO: 1882124 - RNA, 16 nt, Salmonella typhimurium LT2
cauucgaauucugaua

SEQ ID NO: 1882125 - RNA, 18 nt, Salmonella typhimurium LT2
cauuccuuuagcuuccag

SEQ ID NO: 1882126 - RNA, 16 nt, Salmonella typhimurium LT2
cauuccugccgccgca

SEQ ID NO: 1882127 - RNA, 13 nt, Salmonella typhimurium LT2
cauuccuauuuuc

SEQ ID NO: 1882128 - RNA, 21 nt, Salmonella typhimurium LT2
cauugcucauaccgccgccca

SEQ ID NO: 1882129 - RNA, 22 nt, Salmonella typhimurium LT2
cauugcucauaccgccgcccag

SEQ ID NO: 1882130 - RNA, 20 nt, Salmonella typhimurium LT2
cauuggaagagacacgcuga

SEQ ID NO: 1882131 - RNA, 14 nt, Salmonella typhimurium LT2
cauugcuuucuuga

SEQ ID NO: 1882132 - RNA, 13 nt, Salmonella typhimurium LT2
cauugcguauuuc

SEQ ID NO: 1882133 - RNA, 16 nt, Salmonella typhimurium LT2
cauugcgucccagcac

SEQ ID NO: 1882134 - RNA, 14 nt, Salmonella typhimurium LT2
cauugccguaaauu

SEQ ID NO: 1882135 - RNA, 19 nt, Salmonella typhimurium LT2
cauugccguuaacugcugc

SEQ ID NO: 1882136 - RNA, 16 nt, Salmonella typhimurium LT2
cauugccgauuucacg

SEQ ID NO: 1882137 - RNA, 20 nt, Salmonella typhimurium LT2
cauugccauguuaauaccag

SEQ ID NO: 1882138 - RNA, 19 nt, Salmonella typhimurium LT2
cauugccauguuaauacca

SEQ ID NO: 1882139 - RNA, 12 nt, Salmonella typhimurium LT2
cauugcccggcg

SEQ ID NO: 1882140 - RNA, 12 nt, Salmonella typhimurium LT2
cauugcagcgcg

SEQ ID NO: 1882141 - RNA, 11 nt, Salmonella typhimurium LT2
cauugcagcau

SEQ ID NO: 1882142 - RNA, 14 nt, Salmonella typhimurium LT2
cauugauuuuucau

SEQ ID NO: 1882143 - RNA, 20 nt, Salmonella typhimurium LT2
cauucuacaaguucagcagg

SEQ ID NO: 1882144 - RNA, 20 nt, Salmonella typhimurium LT2
cauucguuuugcugauauga

SEQ ID NO: 1882145 - RNA, 14 nt, Salmonella typhimurium LT2
cauucgcuccucag

SEQ ID NO: 1882146 - RNA, 19 nt, Salmonella typhimurium LT2
cauucggauaauccagacg

SEQ ID NO: 1882147 - RNA, 19 nt, Salmonella typhimurium LT2
cauucgcuguuguugacac

SEQ ID NO: 1882148 - RNA, 15 nt, Salmonella typhimurium LT2
cauucgguaguucca

SEQ ID NO: 1882149 - RNA, 13 nt, Salmonella typhimurium LT2
cauugucuuuuuc

SEQ ID NO: 1882150 - RNA, 19 nt, Salmonella typhimurium LT2
cauuguccuuuaucugccc

SEQ ID NO: 1882151 - RNA, 22 nt, Salmonella typhimurium LT2
cauuguuccugcuggcaaaacg

SEQ ID NO: 1882152 - RNA, 19 nt, Salmonella typhimurium LT2
cauuguuccugcuggcaaa

SEQ ID NO: 1882153 - RNA, 17 nt, Salmonella typhimurium LT2
cauuuaaucgccugcgc

SEQ ID NO: 1882154 - RNA, 17 nt, Salmonella typhimurium LT2
cauuuaaugaugcguuc

SEQ ID NO: 1882155 - RNA, 16 nt, Salmonella typhimurium LT2
cauugguuaucaaaaa

SEQ ID NO: 1882156 - RNA, 17 nt, Salmonella typhimurium LT2
cauuggucuggauugca

SEQ ID NO: 1882157 - RNA, 14 nt, Salmonella typhimurium LT2
cauuguaaaaccga

SEQ ID NO: 1882158 - RNA, 16 nt, Salmonella typhimurium LT2
cauuggcgucugcuga

SEQ ID NO: 1882159 - RNA, 13 nt, Salmonella typhimurium LT2
cauuggcuaauga

SEQ ID NO: 1882160 - RNA, 14 nt, Salmonella typhimurium LT2
cauuggcuaaugaa

SEQ ID NO: 1882161 - RNA, 18 nt, Salmonella typhimurium LT2
cauuggcaaugaaaccgc

SEQ ID NO: 1882162 - RNA, 20 nt, Salmonella typhimurium LT2
cauuucuccugcaucugcgc

SEQ ID NO: 1882163 - RNA, 20 nt, Salmonella typhimurium LT2
cauuucucgcacaccagauu

SEQ ID NO: 1882164 - RNA, 16 nt, Salmonella typhimurium LT2
cauuucucaaaaacac

SEQ ID NO: 1882165 - RNA, 18 nt, Salmonella typhimurium LT2
cauuucucaaaaacacca

SEQ ID NO: 1882166 - RNA, 13 nt, Salmonella typhimurium LT2
cauuucuugcauc

SEQ ID NO: 1882167 - RNA, 20 nt, Salmonella typhimurium LT2
cauuucuugcaucaggcagu

SEQ ID NO: 1882168 - RNA, 15 nt, Salmonella typhimurium LT2
cauuugcaauggccc

SEQ ID NO: 1882169 - RNA, 23 nt, Salmonella typhimurium LT2
cauuugcgacaucagccagccgc

SEQ ID NO: 1882170 - RNA, 14 nt, Salmonella typhimurium LT2
cauuugccugccgc

SEQ ID NO: 1882171 - RNA, 21 nt, Salmonella typhimurium LT2
cauuugaugaaccgagauaca

SEQ ID NO: 1882172 - RNA, 19 nt, Salmonella typhimurium LT2
cauuugaacucuuccagau

SEQ ID NO: 1882173 - RNA, 21 nt, Salmonella typhimurium LT2
cauuuggguucacgggcauca

SEQ ID NO: 1882174 - RNA, 22 nt, Salmonella typhimurium LT2
cauuuggguucacgggcaucau

SEQ ID NO: 1882175 - RNA, 19 nt, Salmonella typhimurium LT2
cauuuguagcggcaacagc

SEQ ID NO: 1882176 - RNA, 16 nt, Salmonella typhimurium LT2
cauuuguacaaaaaau

SEQ ID NO: 1882177 - RNA, 16 nt, Salmonella typhimurium LT2
cauuuuauccaacagc

SEQ ID NO: 1882178 - RNA, 21 nt, Salmonella typhimurium LT2
cauuuuaucgacacuauuuuu

SEQ ID NO: 1882179 - RNA, 14 nt, Salmonella typhimurium LT2
cauuuguacaaaaa

SEQ ID NO: 1882180 - RNA, 15 nt, Salmonella typhimurium LT2
cauuucaaugcguaa

SEQ ID NO: 1882181 - RNA, 16 nt, Salmonella typhimurium LT2
cauuucacuauaaaaa

SEQ ID NO: 1882182 - RNA, 15 nt, Salmonella typhimurium LT2
cauuucaaucgccac

SEQ ID NO: 1882183 - RNA, 12 nt, Salmonella typhimurium LT2
cauuucaagcag

SEQ ID NO: 1882184 - RNA, 18 nt, Salmonella typhimurium LT2
cauuucaaagcguucuga

SEQ ID NO: 1882185 - RNA, 21 nt, Salmonella typhimurium LT2
cauuuauggguuccaguugca

SEQ ID NO: 1882186 - RNA, 18 nt, Salmonella typhimurium LT2
cauuucccuuccccuuuc

SEQ ID NO: 1882187 - RNA, 17 nt, Salmonella typhimurium LT2
cauuuccggcggcaacc

SEQ ID NO: 1882188 - RNA, 15 nt, Salmonella typhimurium LT2
cauuuccguuaaucu

SEQ ID NO: 1882189 - RNA, 16 nt, Salmonella typhimurium LT2
cauuuccguuaaucug

SEQ ID NO: 1882190 - RNA, 14 nt, Salmonella typhimurium LT2
cauuuccggcgcgc

SEQ ID NO: 1882191 - RNA, 15 nt, Salmonella typhimurium LT2
cauuuccugauuuuu

SEQ ID NO: 1882192 - RNA, 14 nt, Salmonella typhimurium LT2
ccagcuucaggccg

SEQ ID NO: 1882193 - RNA, 19 nt, Salmonella typhimurium LT2
ccagcuuguuauccaucag

SEQ ID NO: 1882194 - RNA, 11 nt, Salmonella typhimurium LT2
ccagcuugaau

SEQ ID NO: 1882195 - RNA, 17 nt, Salmonella typhimurium LT2
ccaggaaauaaucgagu

SEQ ID NO: 1882196 - RNA, 16 nt, Salmonella typhimurium LT2
ccagcucgucuugugu

SEQ ID NO: 1882197 - RNA, 17 nt, Salmonella typhimurium LT2
ccagcucgucggccagc

SEQ ID NO: 1882198 - RNA, 19 nt, Salmonella typhimurium LT2
ccagcugaaacagaauaaa

SEQ ID NO: 1882199 - RNA, 15 nt, Salmonella typhimurium LT2
ccagcucuucuucgc

SEQ ID NO: 1882200 - RNA, 12 nt, Salmonella typhimurium LT2
ccagcucuucuu

SEQ ID NO: 1882201 - RNA, 13 nt, Salmonella typhimurium LT2
ccagcucugccgg

SEQ ID NO: 1882202 - RNA, 23 nt, Salmonella typhimurium LT2
ccagcucugccgguuggccggcc

SEQ ID NO: 1882203 - RNA, 18 nt, Salmonella typhimurium LT2
ccagcuguuuaagcgccu

SEQ ID NO: 1882204 - RNA, 13 nt, Salmonella typhimurium LT2
ccaggauggcggc

SEQ ID NO: 1882205 - RNA, 22 nt, Salmonella typhimurium LT2
ccaggcaaaugauuaucuccau

SEQ ID NO: 1882206 - RNA, 14 nt, Salmonella typhimurium LT2
ccaggcaaaccagc

SEQ ID NO: 1882207 - RNA, 17 nt, Salmonella typhimurium LT2
ccaggcaaucagcagcc

SEQ ID NO: 1882208 - RNA, 20 nt, Salmonella typhimurium LT2
ccaggcagcaccucaauaug

SEQ ID NO: 1882209 - RNA, 13 nt, Salmonella typhimurium LT2
ccaggccaucaga

SEQ ID NO: 1882210 - RNA, 11 nt, Salmonella typhimurium LT2
ccaggccagcg

SEQ ID NO: 1882211 - RNA, 19 nt, Salmonella typhimurium LT2
ccaggcagcguggcgagcu

SEQ ID NO: 1882212 - RNA, 16 nt, Salmonella typhimurium LT2
ccaggcauaaaaaaag

SEQ ID NO: 1882213 - RNA, 12 nt, Salmonella typhimurium LT2
ccaggccaaaag

SEQ ID NO: 1882214 - RNA, 21 nt, Salmonella typhimurium LT2
ccaggagauaucaaaaguauc

SEQ ID NO: 1882215 - RNA, 22 nt, Salmonella typhimurium LT2
ccaggagacaauaucucccggu

SEQ ID NO: 1882216 - RNA, 15 nt, Salmonella typhimurium LT2
ccaggauaauaauga

SEQ ID NO: 1882217 - RNA, 15 nt, Salmonella typhimurium LT2
ccaggaucgccgcug

SEQ ID NO: 1882218 - RNA, 15 nt, Salmonella typhimurium LT2
ccaggaugccaacca

SEQ ID NO: 1882219 - RNA, 20 nt, Salmonella typhimurium LT2
ccaggaugauguucaucgcu

SEQ ID NO: 1882220 - RNA, 22 nt, Salmonella typhimurium LT2
ccaggcggcuuuuucaucaucg

SEQ ID NO: 1882221 - RNA, 20 nt, Salmonella typhimurium LT2
ccaggcguaagaucccaggg

SEQ ID NO: 1882222 - RNA, 20 nt, Salmonella typhimurium LT2
ccaggcgcuauucccaggca

SEQ ID NO: 1882223 - RNA, 18 nt, Salmonella typhimurium LT2
ccaggcggauaaaacaga

SEQ ID NO: 1882224 - RNA, 20 nt, Salmonella typhimurium LT2
ccaggcggauaaaacagaaa

SEQ ID NO: 1882225 - RNA, 14 nt, Salmonella typhimurium LT2
ccaggcgcucgccg

SEQ ID NO: 1882226 - RNA, 17 nt, Salmonella typhimurium LT2
ccaggcgcgcagcugcc

SEQ ID NO: 1882227 - RNA, 18 nt, Salmonella typhimurium LT2
ccaggcgcagcaaacggc

SEQ ID NO: 1882228 - RNA, 21 nt, Salmonella typhimurium LT2
ccaggcgcaaggcgucgcugg

SEQ ID NO: 1882229 - RNA, 18 nt, Salmonella typhimurium LT2
ccaggcgaugaauuccug

SEQ ID NO: 1882230 - RNA, 16 nt, Salmonella typhimurium LT2
ccaggcgauaccgcgc

SEQ ID NO: 1882231 - RNA, 13 nt, Salmonella typhimurium LT2
ccaggccugagcc

SEQ ID NO: 1882232 - RNA, 14 nt, Salmonella typhimurium LT2
ccaggccccugcca

SEQ ID NO: 1882233 - RNA, 18 nt, Salmonella typhimurium LT2
ccaggccgccaccgccuc

SEQ ID NO: 1882234 - RNA, 20 nt, Salmonella typhimurium LT2
ccaggccgccaccgccucgc

SEQ ID NO: 1882235 - RNA, 15 nt, Salmonella typhimurium LT2
ccaggccgguaaagu

SEQ ID NO: 1882236 - RNA, 19 nt, Salmonella typhimurium LT2
ccagggcgggauccccugc

SEQ ID NO: 1882237 - RNA, 20 nt, Salmonella typhimurium LT2
ccagggcgggauccccugcu

SEQ ID NO: 1882238 - RNA, 21 nt, Salmonella typhimurium LT2
ccaggggaugauuuucaggca

SEQ ID NO: 1882239 - RNA, 17 nt, Salmonella typhimurium LT2
ccaggucaucaccucca

SEQ ID NO: 1882240 - RNA, 18 nt, Salmonella typhimurium LT2
ccagguccgacuucaugc

SEQ ID NO: 1882241 - RNA, 18 nt, Salmonella typhimurium LT2
ccaggcuauccagcucac

SEQ ID NO: 1882242 - RNA, 14 nt, Salmonella typhimurium LT2
ccaggcuauccagc

SEQ ID NO: 1882243 - RNA, 22 nt, Salmonella typhimurium LT2
ccaggcuauaguggauggccca

SEQ ID NO: 1882244 - RNA, 12 nt, Salmonella typhimurium LT2
ccaggcuaucca

SEQ ID NO: 1882245 - RNA, 14 nt, Salmonella typhimurium LT2
ccaggcuggcgcag

SEQ ID NO: 1882246 - RNA, 19 nt, Salmonella typhimurium LT2
ccaggcuggcgcagccgcu

SEQ ID NO: 1882247 - RNA, 16 nt, Salmonella typhimurium LT2
ccaggcuuagccgccg

SEQ ID NO: 1882248 - RNA, 21 nt, Salmonella typhimurium LT2
ccagggauuuugcuuuuucgg

SEQ ID NO: 1882249 - RNA, 18 nt, Salmonella typhimurium LT2
ccagggaugcgccacagc

SEQ ID NO: 1882250 - RNA, 21 nt, Salmonella typhimurium LT2
ccaggcuuuaaauucagcacc

SEQ ID NO: 1882251 - RNA, 21 nt, Salmonella typhimurium LT2
ccaggcuuuaguuuccgguaa

SEQ ID NO: 1882252 - RNA, 22 nt, Salmonella typhimurium LT2
ccaggcuuccugcgcugucacc

SEQ ID NO: 1882253 - RNA, 19 nt, Salmonella typhimurium LT2
ccagcgcagucagugaaaa

SEQ ID NO: 1882254 - RNA, 22 nt, Salmonella typhimurium LT2
ccagcgcaaagggacacucaag

SEQ ID NO: 1882255 - RNA, 23 nt, Salmonella typhimurium LT2
ccagcgauuuuuacgccauucau

SEQ ID NO: 1882256 - RNA, 20 nt, Salmonella typhimurium LT2
ccagcgcaaccugcgcccgc

SEQ ID NO: 1882257 - RNA, 18 nt, Salmonella typhimurium LT2
ccagcgcauuaccgccgc

SEQ ID NO: 1882258 - RNA, 17 nt, Salmonella typhimurium LT2
ccagcgccagccgcgcc

SEQ ID NO: 1882259 - RNA, 17 nt, Salmonella typhimurium LT2
ccagcgaugagcgccag

SEQ ID NO: 1882260 - RNA, 16 nt, Salmonella typhimurium LT2
ccagcgauaaacgcca

SEQ ID NO: 1882261 - RNA, 17 nt, Salmonella typhimurium LT2
ccagcgauaaacgccag

SEQ ID NO: 1882262 - RNA, 19 nt, Salmonella typhimurium LT2
ccagcgauaaacgccagcc

SEQ ID NO: 1882263 - RNA, 12 nt, Salmonella typhimurium LT2
ccagcgauccag

SEQ ID NO: 1882264 - RNA, 17 nt, Salmonella typhimurium LT2
ccagcgaggccucuccu

SEQ ID NO: 1882265 - RNA, 20 nt, Salmonella typhimurium LT2
ccagcgacuccggauagaga

SEQ ID NO: 1882266 - RNA, 21 nt, Salmonella typhimurium LT2
ccagcgccggcgaaucaccga

SEQ ID NO: 1882267 - RNA, 21 nt, Salmonella typhimurium LT2
ccagcgccgggaaaaucagug

SEQ ID NO: 1882268 - RNA, 19 nt, Salmonella typhimurium LT2
ccagcgccgggauauccuc

SEQ ID NO: 1882269 - RNA, 12 nt, Salmonella typhimurium LT2
ccagcgccgcga

SEQ ID NO: 1882270 - RNA, 20 nt, Salmonella typhimurium LT2
ccagcgccugcgcugcaaua

SEQ ID NO: 1882271 - RNA, 21 nt, Salmonella typhimurium LT2
ccagcgcgaauuugccccaga

SEQ ID NO: 1882272 - RNA, 20 nt, Salmonella typhimurium LT2
ccagcgcgaccugcaucccu

SEQ ID NO: 1882273 - RNA, 24 nt, Salmonella typhimurium LT2
ccagcgcgaauuugccccagauac

SEQ ID NO: 1882274 - RNA, 13 nt, Salmonella typhimurium LT2
ccagcgccccugc

SEQ ID NO: 1882275 - RNA, 17 nt, Salmonella typhimurium LT2
ccagccgggcaggaaaa

SEQ ID NO: 1882276 - RNA, 14 nt, Salmonella typhimurium LT2
ccacucuuccagca

SEQ ID NO: 1882277 - RNA, 15 nt, Salmonella typhimurium LT2
ccacugaccugcugg

SEQ ID NO: 1882278 - RNA, 22 nt, Salmonella typhimurium LT2
ccacugauaguccaucaccucu

SEQ ID NO: 1882279 - RNA, 20 nt, Salmonella typhimurium LT2
ccacugauaguccaucaccu

SEQ ID NO: 1882280 - RNA, 22 nt, Salmonella typhimurium LT2
ccacugauggaguuucaucagc

SEQ ID NO: 1882281 - RNA, 17 nt, Salmonella typhimurium LT2
ccacucuuuuaaggccc

SEQ ID NO: 1882282 - RNA, 13 nt, Salmonella typhimurium LT2
ccacucuccagca

SEQ ID NO: 1882283 - RNA, 15 nt, Salmonella typhimurium LT2
ccacucuccagcauc

SEQ ID NO: 1882284 - RNA, 22 nt, Salmonella typhimurium LT2
ccacucggcgagcaguacgccu

SEQ ID NO: 1882285 - RNA, 18 nt, Salmonella typhimurium LT2
ccacuccgccaguacaua

SEQ ID NO: 1882286 - RNA, 16 nt, Salmonella typhimurium LT2
ccacuccaucgccuga

SEQ ID NO: 1882287 - RNA, 16 nt, Salmonella typhimurium LT2
ccacuccggugcccau

SEQ ID NO: 1882288 - RNA, 15 nt, Salmonella typhimurium LT2
ccacucgauucccau

SEQ ID NO: 1882289 - RNA, 23 nt, Salmonella typhimurium LT2
ccacucggagguuuucucaucca

SEQ ID NO: 1882290 - RNA, 19 nt, Salmonella typhimurium LT2
ccagccugaacaucuucca

SEQ ID NO: 1882291 - RNA, 15 nt, Salmonella typhimurium LT2
ccagccuaaaaacag

SEQ ID NO: 1882292 - RNA, 19 nt, Salmonella typhimurium LT2
ccagccuaccugccgccau

SEQ ID NO: 1882293 - RNA, 18 nt, Salmonella typhimurium LT2
ccagccguucaccagcca

SEQ ID NO: 1882294 - RNA, 14 nt, Salmonella typhimurium LT2
ccagcgaaccgcag

SEQ ID NO: 1882295 - RNA, 13 nt, Salmonella typhimurium LT2
ccagcgaauaaug

SEQ ID NO: 1882296 - RNA, 14 nt, Salmonella typhimurium LT2
ccagcgaauaauga

SEQ ID NO: 1882297 - RNA, 20 nt, Salmonella typhimurium LT2
ccagcgaccaccgucccagu

SEQ ID NO: 1882298 - RNA, 14 nt, Salmonella typhimurium LT2
ccagcgacggccag

SEQ ID NO: 1882299 - RNA, 18 nt, Salmonella typhimurium LT2
ccagcgucucagcaggcg

SEQ ID NO: 1882300 - RNA, 16 nt, Salmonella typhimurium LT2
ccagcgugacccagac

SEQ ID NO: 1882301 - RNA, 16 nt, Salmonella typhimurium LT2
ccagcgucacuggcca

SEQ ID NO: 1882302 - RNA, 18 nt, Salmonella typhimurium LT2
ccagcguacaucuuccau

SEQ ID NO: 1882303 - RNA, 21 nt, Salmonella typhimurium LT2
ccagcguauaauuaagcugcg

SEQ ID NO: 1882304 - RNA, 20 nt, Salmonella typhimurium LT2
ccagcguaugauagcgagca

SEQ ID NO: 1882305 - RNA, 19 nt, Salmonella typhimurium LT2
ccagcguaguuucacugug

SEQ ID NO: 1882306 - RNA, 15 nt, Salmonella typhimurium LT2
ccagcguaagcgccc

SEQ ID NO: 1882307 - RNA, 20 nt, Salmonella typhimurium LT2
ccagcgguuucaggccagac

SEQ ID NO: 1882308 - RNA, 22 nt, Salmonella typhimurium LT2
ccagcgguuucaggccagacug

SEQ ID NO: 1882309 - RNA, 15 nt, Salmonella typhimurium LT2
ccagcucauguaguc

SEQ ID NO: 1882310 - RNA, 14 nt, Salmonella typhimurium LT2
ccagcucauuuuua

SEQ ID NO: 1882311 - RNA, 15 nt, Salmonella typhimurium LT2
ccagcuccauagaaa

SEQ ID NO: 1882312 - RNA, 16 nt, Salmonella typhimurium LT2
ccagcuccauccacca

SEQ ID NO: 1882313 - RNA, 18 nt, Salmonella typhimurium LT2
ccagcuccauccaccagc

SEQ ID NO: 1882314 - RNA, 15 nt, Salmonella typhimurium LT2
ccagcucaaccgcgc

SEQ ID NO: 1882315 - RNA, 15 nt, Salmonella typhimurium LT2
ccagcuauagcgcaa

SEQ ID NO: 1882316 - RNA, 15 nt, Salmonella typhimurium LT2
ccagcuauccagcuu

SEQ ID NO: 1882317 - RNA, 14 nt, Salmonella typhimurium LT2
ccagcucaacgccu

SEQ ID NO: 1882318 - RNA, 13 nt, Salmonella typhimurium LT2
ccagcucauagga

SEQ ID NO: 1882319 - RNA, 13 nt, Salmonella typhimurium LT2
ccagcguuucucu

SEQ ID NO: 1882320 - RNA, 19 nt, Salmonella typhimurium LT2
ccagcguuucuggaaguag

SEQ ID NO: 1882321 - RNA, 13 nt, Salmonella typhimurium LT2
ccagcuaaaaacg

SEQ ID NO: 1882322 - RNA, 18 nt, Salmonella typhimurium LT2
ccagcgcguaaauaccuu

SEQ ID NO: 1882323 - RNA, 13 nt, Salmonella typhimurium LT2
ccagcgcgcggca

SEQ ID NO: 1882324 - RNA, 20 nt, Salmonella typhimurium LT2
ccagcgcgcgugggaacagc

SEQ ID NO: 1882325 - RNA, 11 nt, Salmonella typhimurium LT2
ccagcgcgccc

SEQ ID NO: 1882326 - RNA, 11 nt, Salmonella typhimurium LT2
ccagcgcgcca

SEQ ID NO: 1882327 - RNA, 19 nt, Salmonella typhimurium LT2
ccagcgcgccgcagcgccg

SEQ ID NO: 1882328 - RNA, 16 nt, Salmonella typhimurium LT2
ccagcgcgugaaccgu

SEQ ID NO: 1882329 - RNA, 18 nt, Salmonella typhimurium LT2
ccagcgcugacaucaucc

SEQ ID NO: 1882330 - RNA, 22 nt, Salmonella typhimurium LT2
ccagcgcuucuguuaaaaaauu

SEQ ID NO: 1882331 - RNA, 17 nt, Salmonella typhimurium LT2
ccagcgcuucuguuaaa

SEQ ID NO: 1882332 - RNA, 19 nt, Salmonella typhimurium LT2
ccagcggaauccccgccgc

SEQ ID NO: 1882333 - RNA, 19 nt, Salmonella typhimurium LT2
ccagcggcgacaguaacug

SEQ ID NO: 1882334 - RNA, 14 nt, Salmonella typhimurium LT2
ccagcggcccgcgc

SEQ ID NO: 1882335 - RNA, 18 nt, Salmonella typhimurium LT2
ccagcggcgcaaugccgc

SEQ ID NO: 1882336 - RNA, 16 nt, Salmonella typhimurium LT2
ccagcggcaccagcac

SEQ ID NO: 1882337 - RNA, 14 nt, Salmonella typhimurium LT2
ccagcggccacagc

SEQ ID NO: 1882338 - RNA, 23 nt, Salmonella typhimurium LT2
ccagcggcguuuuuuccugcugg

SEQ ID NO: 1882339 - RNA, 22 nt, Salmonella typhimurium LT2
ccagcgggcuauaggccaucac

SEQ ID NO: 1882340 - RNA, 19 nt, Salmonella typhimurium LT2
ccagcgggcugcaagggaa

SEQ ID NO: 1882341 - RNA, 17 nt, Salmonella typhimurium LT2
ccaucaauuuugcgccu

SEQ ID NO: 1882342 - RNA, 19 nt, Salmonella typhimurium LT2
ccaucaacuucucgcaggc

SEQ ID NO: 1882343 - RNA, 15 nt, Salmonella typhimurium LT2
ccaucaaucaccuua

SEQ ID NO: 1882344 - RNA, 13 nt, Salmonella typhimurium LT2
ccaucaauaccag

SEQ ID NO: 1882345 - RNA, 14 nt, Salmonella typhimurium LT2
ccaucaaauaauac

SEQ ID NO: 1882346 - RNA, 16 nt, Salmonella typhimurium LT2
ccauaucgaccuuuuu

SEQ ID NO: 1882347 - RNA, 17 nt, Salmonella typhimurium LT2
ccauaucgaccuuuuuc

SEQ ID NO: 1882348 - RNA, 21 nt, Salmonella typhimurium LT2
ccauaucagacgcgcaaaacu

SEQ ID NO: 1882349 - RNA, 21 nt, Salmonella typhimurium LT2
ccauaucaguuaugacagaca

SEQ ID NO: 1882350 - RNA, 14 nt, Salmonella typhimurium LT2
ccauauaugaaauc

SEQ ID NO: 1882351 - RNA, 14 nt, Salmonella typhimurium LT2
ccauaauaaugcca

SEQ ID NO: 1882352 - RNA, 19 nt, Salmonella typhimurium LT2
ccauauaacagaauaagcc

SEQ ID NO: 1882353 - RNA, 14 nt, Salmonella typhimurium LT2
ccauauaacagaau

SEQ ID NO: 1882354 - RNA, 16 nt, Salmonella typhimurium LT2
ccauacuuacugcugu

SEQ ID NO: 1882355 - RNA, 17 nt, Salmonella typhimurium LT2
ccauacugacuuaauaa

SEQ ID NO: 1882356 - RNA, 18 nt, Salmonella typhimurium LT2
ccaguuucaaugcccagg

SEQ ID NO: 1882357 - RNA, 17 nt, Salmonella typhimurium LT2
ccaguuuauccgccguc

SEQ ID NO: 1882358 - RNA, 16 nt, Salmonella typhimurium LT2
ccaguuguucuuucac

SEQ ID NO: 1882359 - RNA, 14 nt, Salmonella typhimurium LT2
ccaguuguuuauuc

SEQ ID NO: 1882360 - RNA, 22 nt, Salmonella typhimurium LT2
ccaguuguuuauuccauucauc

SEQ ID NO: 1882361 - RNA, 19 nt, Salmonella typhimurium LT2
ccaguucgccuucuucauc

SEQ ID NO: 1882362 - RNA, 17 nt, Salmonella typhimurium LT2
ccaguucuggcugcgcu

SEQ ID NO: 1882363 - RNA, 19 nt, Salmonella typhimurium LT2
ccaguuuccugacccgcuc

SEQ ID NO: 1882364 - RNA, 23 nt, Salmonella typhimurium LT2
ccaguuucgccagcggcagcgcg

SEQ ID NO: 1882365 - RNA, 14 nt, Salmonella typhimurium LT2
ccaguuuccugacc

SEQ ID NO: 1882366 - RNA, 14 nt, Salmonella typhimurium LT2
ccaguuucuucagg

SEQ ID NO: 1882367 - RNA, 19 nt, Salmonella typhimurium LT2
ccaguuugcguucacagca

SEQ ID NO: 1882368 - RNA, 21 nt, Salmonella typhimurium LT2
ccaguuugcguucacagcacc

SEQ ID NO: 1882369 - RNA, 17 nt, Salmonella typhimurium LT2
ccauaaagcgaauaauu

SEQ ID NO: 1882370 - RNA, 14 nt, Salmonella typhimurium LT2
ccagugcggcgaga

SEQ ID NO: 1882371 - RNA, 15 nt, Salmonella typhimurium LT2
ccagugcggcgagau

SEQ ID NO: 1882372 - RNA, 19 nt, Salmonella typhimurium LT2
ccaguggagacacuucagc

SEQ ID NO: 1882373 - RNA, 20 nt, Salmonella typhimurium LT2
ccagugguuccauuccagaa

SEQ ID NO: 1882374 - RNA, 16 nt, Salmonella typhimurium LT2
ccaggucgcccagcca

SEQ ID NO: 1882375 - RNA, 24 nt, Salmonella typhimurium LT2
ccaggucugaugagcgcagcgacu

SEQ ID NO: 1882376 - RNA, 23 nt, Salmonella typhimurium LT2
ccaucgacgaaauggugugcaug

SEQ ID NO: 1882377 - RNA, 20 nt, Salmonella typhimurium LT2
ccaucgcacucgcuguaaau

SEQ ID NO: 1882378 - RNA, 15 nt, Salmonella typhimurium LT2
ccaucucaauaaucu

SEQ ID NO: 1882379 - RNA, 13 nt, Salmonella typhimurium LT2
ccaucuaacacaa

SEQ ID NO: 1882380 - RNA, 16 nt, Salmonella typhimurium LT2
ccaucuaacacaaauu

SEQ ID NO: 1882381 - RNA, 19 nt, Salmonella typhimurium LT2
ccaugauucaucccgcugu

SEQ ID NO: 1882382 - RNA, 22 nt, Salmonella typhimurium LT2
ccaugaucgauagcgacggcgc

SEQ ID NO: 1882383 - RNA, 15 nt, Salmonella typhimurium LT2
ccaugaucgccgcca

SEQ ID NO: 1882384 - RNA, 19 nt, Salmonella typhimurium LT2
ccaugccugauggcgcagc

SEQ ID NO: 1882385 - RNA, 16 nt, Salmonella typhimurium LT2
ccaucucuuccgcggu

SEQ ID NO: 1882386 - RNA, 14 nt, Salmonella typhimurium LT2
ccaucugacccggg

SEQ ID NO: 1882387 - RNA, 23 nt, Salmonella typhimurium LT2
ccaucacgcugcggucuucaaca

SEQ ID NO: 1882388 - RNA, 15 nt, Salmonella typhimurium LT2
ccaucagauucaaca

SEQ ID NO: 1882389 - RNA, 21 nt, Salmonella typhimurium LT2
ccaucagaaugcuggucacgg

SEQ ID NO: 1882390 - RNA, 14 nt, Salmonella typhimurium LT2
ccaucaccucuucg

SEQ ID NO: 1882391 - RNA, 19 nt, Salmonella typhimurium LT2
ccaucaccuggcaacauag

SEQ ID NO: 1882392 - RNA, 15 nt, Salmonella typhimurium LT2
ccaucaccgccaguc

SEQ ID NO: 1882393 - RNA, 16 nt, Salmonella typhimurium LT2
ccaucaggcaauaugu

SEQ ID NO: 1882394 - RNA, 12 nt, Salmonella typhimurium LT2
ccaucaggcaau

SEQ ID NO: 1882395 - RNA, 14 nt, Salmonella typhimurium LT2
ccaucaggcaauau

SEQ ID NO: 1882396 - RNA, 16 nt, Salmonella typhimurium LT2
ccaucaggcacaaugc

SEQ ID NO: 1882397 - RNA, 20 nt, Salmonella typhimurium LT2
ccaucagcaucaucaccgcc

SEQ ID NO: 1882398 - RNA, 16 nt, Salmonella typhimurium LT2
ccaucauggcuuucag

SEQ ID NO: 1882399 - RNA, 15 nt, Salmonella typhimurium LT2
ccaucauuaauauaa

SEQ ID NO: 1882400 - RNA, 13 nt, Salmonella typhimurium LT2
ccaucauuaauau

SEQ ID NO: 1882401 - RNA, 22 nt, Salmonella typhimurium LT2
ccaucauggcuuucagauuagc

SEQ ID NO: 1882402 - RNA, 15 nt, Salmonella typhimurium LT2
ccaucauagcccaua

SEQ ID NO: 1882403 - RNA, 21 nt, Salmonella typhimurium LT2
ccaucaucaggacucaaucac

SEQ ID NO: 1882404 - RNA, 19 nt, Salmonella typhimurium LT2
aaacaagauuaauuuaauu

SEQ ID NO: 1882405 - RNA, 20 nt, Salmonella typhimurium LT2
cccaccauaaagcgaauaau

SEQ ID NO: 1882406 - RNA, 21 nt, Salmonella typhimurium LT2
cccaccauaaagcgaauaauu

SEQ ID NO: 1882407 - RNA, 21 nt, Salmonella typhimurium LT2
cccacgauacgucccugcugg

SEQ ID NO: 1882408 - RNA, 15 nt, Salmonella typhimurium LT2
cccaccgauuucagc

SEQ ID NO: 1882409 - RNA, 18 nt, Salmonella typhimurium LT2
cccaccggaccgccgagc

SEQ ID NO: 1882410 - RNA, 14 nt, Salmonella typhimurium LT2
cccacaccacagcc

SEQ ID NO: 1882411 - RNA, 12 nt, Salmonella typhimurium LT2
cccacagguagg

SEQ ID NO: 1882412 - RNA, 19 nt, Salmonella typhimurium LT2
cccacagcuugccguagcg

SEQ ID NO: 1882413 - RNA, 13 nt, Salmonella typhimurium LT2
cccaccagccgca

SEQ ID NO: 1882414 - RNA, 15 nt, Salmonella typhimurium LT2
cccaccacgcagcca

SEQ ID NO: 1882415 - RNA, 16 nt, Salmonella typhimurium LT2
cccagcaucccgcugg

SEQ ID NO: 1882416 - RNA, 17 nt, Salmonella typhimurium LT2
cccagacugugauggcg

SEQ ID NO: 1882417 - RNA, 21 nt, Salmonella typhimurium LT2
cccagacggcgauacugcucc

SEQ ID NO: 1882418 - RNA, 13 nt, Salmonella typhimurium LT2
cccacugaccugc

SEQ ID NO: 1882419 - RNA, 16 nt, Salmonella typhimurium LT2
cccacugaccugcugg

SEQ ID NO: 1882420 - RNA, 20 nt, Salmonella typhimurium LT2
cccacuuauggucguauuuu

SEQ ID NO: 1882421 - RNA, 20 nt, Salmonella typhimurium LT2
cccacuuggcgaucaccagc

SEQ ID NO: 1882422 - RNA, 23 nt, Salmonella typhimurium LT2
cccacuuggcgaucaccagcacc

SEQ ID NO: 1882423 - RNA, 17 nt, Salmonella typhimurium LT2
cccacgcauaguccugc

SEQ ID NO: 1882424 - RNA, 18 nt, Salmonella typhimurium LT2
cccacgcauaguccugcc

SEQ ID NO: 1882425 - RNA, 19 nt, Salmonella typhimurium LT2
cccacgcccgccaucgccg

SEQ ID NO: 1882426 - RNA, 21 nt, Salmonella typhimurium LT2
cccacgcggaaucgucacaga

SEQ ID NO: 1882427 - RNA, 13 nt, Salmonella typhimurium LT2
cccacuaacugcc

SEQ ID NO: 1882428 - RNA, 14 nt, Salmonella typhimurium LT2
cccacgucauccga

SEQ ID NO: 1882429 - RNA, 18 nt, Salmonella typhimurium LT2
cccacgguacgacgcggc

SEQ ID NO: 1882430 - RNA, 23 nt, Salmonella typhimurium LT2
cccacguaagugggaucagguaa

SEQ ID NO: 1882431 - RNA, 15 nt, Salmonella typhimurium LT2
cccacgggccgccau

SEQ ID NO: 1882432 - RNA, 18 nt, Salmonella typhimurium LT2
ccauuuccggcgcgccua

SEQ ID NO: 1882433 - RNA, 20 nt, Salmonella typhimurium LT2
ccauuuccguuuucagguua

SEQ ID NO: 1882434 - RNA, 13 nt, Salmonella typhimurium LT2
cccaaaauaauuc

SEQ ID NO: 1882435 - RNA, 20 nt, Salmonella typhimurium LT2
ccauuuccgcugucgccccu

SEQ ID NO: 1882436 - RNA, 13 nt, Salmonella typhimurium LT2
ccauuuauaaaau

SEQ ID NO: 1882437 - RNA, 19 nt, Salmonella typhimurium LT2
cccaacagcgaccacgcca

SEQ ID NO: 1882438 - RNA, 20 nt, Salmonella typhimurium LT2
cccaaaucaauuaacugaca

SEQ ID NO: 1882439 - RNA, 13 nt, Salmonella typhimurium LT2
cccaaacaccaac

SEQ ID NO: 1882440 - RNA, 11 nt, Salmonella typhimurium LT2
cccaaaaugcc

SEQ ID NO: 1882441 - RNA, 18 nt, Salmonella typhimurium LT2
cccacaaucccgccagac

SEQ ID NO: 1882442 - RNA, 12 nt, Salmonella typhimurium LT2
cccaaccagccc

SEQ ID NO: 1882443 - RNA, 13 nt, Salmonella typhimurium LT2
cccaauaccggcg

SEQ ID NO: 1882444 - RNA, 21 nt, Salmonella typhimurium LT2
ccauuggcuauuuuuugcugg

SEQ ID NO: 1882445 - RNA, 18 nt, Salmonella typhimurium LT2
ccauuggcucggcgucau

SEQ ID NO: 1882446 - RNA, 23 nt, Salmonella typhimurium LT2
ccauuguugucauuguaaaaccg

SEQ ID NO: 1882447 - RNA, 23 nt, Salmonella typhimurium LT2
ccauucuuucgucacuaacucca

SEQ ID NO: 1882448 - RNA, 14 nt, Salmonella typhimurium LT2
ccauucccaccaua

SEQ ID NO: 1882449 - RNA, 22 nt, Salmonella typhimurium LT2
ccauugauuguugccgucgcug

SEQ ID NO: 1882450 - RNA, 16 nt, Salmonella typhimurium LT2
ccauugcuuuuuugau

SEQ ID NO: 1882451 - RNA, 13 nt, Salmonella typhimurium LT2
ccauugagcagcc

SEQ ID NO: 1882452 - RNA, 14 nt, Salmonella typhimurium LT2
ccauucaaccagcc

SEQ ID NO: 1882453 - RNA, 13 nt, Salmonella typhimurium LT2
ccauucaccugcc

SEQ ID NO: 1882454 - RNA, 23 nt, Salmonella typhimurium LT2
ccaugcuuuccgggccuacaagu

SEQ ID NO: 1882455 - RNA, 22 nt, Salmonella typhimurium LT2
ccaugcuauccgccgccagcca

SEQ ID NO: 1882456 - RNA, 15 nt, Salmonella typhimurium LT2
ccaugcuauucagca

SEQ ID NO: 1882457 - RNA, 21 nt, Salmonella typhimurium LT2
ccaugcggcugaguucaggca

SEQ ID NO: 1882458 - RNA, 19 nt, Salmonella typhimurium LT2
cccgaaagucaucugccag

SEQ ID NO: 1882459 - RNA, 19 nt, Salmonella typhimurium LT2
cccgacuaccggcaccagc

SEQ ID NO: 1882460 - RNA, 16 nt, Salmonella typhimurium LT2
cccgaucaucuccugu

SEQ ID NO: 1882461 - RNA, 13 nt, Salmonella typhimurium LT2
cccgauagcgccg

SEQ ID NO: 1882462 - RNA, 14 nt, Salmonella typhimurium LT2
cccgauacccgccc

SEQ ID NO: 1882463 - RNA, 15 nt, Salmonella typhimurium LT2
cccgauaaaccaggc

SEQ ID NO: 1882464 - RNA, 18 nt, Salmonella typhimurium LT2
cccgauaaccgcguucau

SEQ ID NO: 1882465 - RNA, 14 nt, Salmonella typhimurium LT2
cccgauaagcgcug

SEQ ID NO: 1882466 - RNA, 13 nt, Salmonella typhimurium LT2
cccgacugccacc

SEQ ID NO: 1882467 - RNA, 16 nt, Salmonella typhimurium LT2
ccccuaccgaggcagg

SEQ ID NO: 1882468 - RNA, 16 nt, Salmonella typhimurium LT2
ccccguuugcaguccg

SEQ ID NO: 1882469 - RNA, 14 nt, Salmonella typhimurium LT2
ccccguucgacaac

SEQ ID NO: 1882470 - RNA, 22 nt, Salmonella typhimurium LT2
ccccggucaacgcgccgccaac

SEQ ID NO: 1882471 - RNA, 11 nt, Salmonella typhimurium LT2
ccccuuccccc

SEQ ID NO: 1882472 - RNA, 23 nt, Salmonella typhimurium LT2
ccccuucccccaaaaugccgccc

SEQ ID NO: 1882473 - RNA, 14 nt, Salmonella typhimurium LT2
cccgaaaugguucc

SEQ ID NO: 1882474 - RNA, 14 nt, Salmonella typhimurium LT2
cccgaacaacaaua

SEQ ID NO: 1882475 - RNA, 15 nt, Salmonella typhimurium LT2
ccccugcuccugcca

SEQ ID NO: 1882476 - RNA, 21 nt, Salmonella typhimurium LT2
ccccuggacgcgagccacagg

SEQ ID NO: 1882477 - RNA, 20 nt, Salmonella typhimurium LT2
cccgccucggucaguauuuc

SEQ ID NO: 1882478 - RNA, 15 nt, Salmonella typhimurium LT2
cccgccgcuggcggg

SEQ ID NO: 1882479 - RNA, 15 nt, Salmonella typhimurium LT2
cccgccguuaaauca

SEQ ID NO: 1882480 - RNA, 23 nt, Salmonella typhimurium LT2
cccgccgcggcgguuauccuccg

SEQ ID NO: 1882481 - RNA, 15 nt, Salmonella typhimurium LT2
cccgcccugcccgcc

SEQ ID NO: 1882482 - RNA, 13 nt, Salmonella typhimurium LT2
cccgauucugcca

SEQ ID NO: 1882483 - RNA, 15 nt, Salmonella typhimurium LT2
cccgauucgcaugaa

SEQ ID NO: 1882484 - RNA, 18 nt, Salmonella typhimurium LT2
cccgauggcguaagcuua

SEQ ID NO: 1882485 - RNA, 12 nt, Salmonella typhimurium LT2
ccccagaaaauu

SEQ ID NO: 1882486 - RNA, 14 nt, Salmonella typhimurium LT2
ccccacuaccgcca

SEQ ID NO: 1882487 - RNA, 19 nt, Salmonella typhimurium LT2
ccccaggccacccaccgac

SEQ ID NO: 1882488 - RNA, 13 nt, Salmonella typhimurium LT2
ccccagcugcggc

SEQ ID NO: 1882489 - RNA, 20 nt, Salmonella typhimurium LT2
ccccagguuauucaggugga

SEQ ID NO: 1882490 - RNA, 19 nt, Salmonella typhimurium LT2
ccccagguaaauccgccag

SEQ ID NO: 1882491 - RNA, 20 nt, Salmonella typhimurium LT2
cccagccagagauccacauu

SEQ ID NO: 1882492 - RNA, 17 nt, Salmonella typhimurium LT2
cccagcaugagccagcc

SEQ ID NO: 1882493 - RNA, 21 nt, Salmonella typhimurium LT2
cccagcaucccgcuggcgcca

SEQ ID NO: 1882494 - RNA, 15 nt, Salmonella typhimurium LT2
ccccaauuugcuguu

SEQ ID NO: 1882495 - RNA, 22 nt, Salmonella typhimurium LT2
ccccaaucccaccacuucgcca

SEQ ID NO: 1882496 - RNA, 17 nt, Salmonella typhimurium LT2
ccccaaucuugcguacc

SEQ ID NO: 1882497 - RNA, 15 nt, Salmonella typhimurium LT2
cccauugucaucagu

SEQ ID NO: 1882498 - RNA, 21 nt, Salmonella typhimurium LT2
cccauugucaucaguaugagc

SEQ ID NO: 1882499 - RNA, 19 nt, Salmonella typhimurium LT2
ccccccgcacagcacauag

SEQ ID NO: 1882500 - RNA, 13 nt, Salmonella typhimurium LT2
ccccccuaccgga

SEQ ID NO: 1882501 - RNA, 12 nt, Salmonella typhimurium LT2
ccccccagccau

SEQ ID NO: 1882502 - RNA, 16 nt, Salmonella typhimurium LT2
cccccauggagagcga

SEQ ID NO: 1882503 - RNA, 15 nt, Salmonella typhimurium LT2
ccccaugugccuugc

SEQ ID NO: 1882504 - RNA, 20 nt, Salmonella typhimurium LT2
cccccaaaaugccgcccauc

SEQ ID NO: 1882505 - RNA, 18 nt, Salmonella typhimurium LT2
cccccaacgucaccauca

SEQ ID NO: 1882506 - RNA, 12 nt, Salmonella typhimurium LT2
ccccauuugaac

SEQ ID NO: 1882507 - RNA, 21 nt, Salmonella typhimurium LT2
cccccgcacagcacauagaag

SEQ ID NO: 1882508 - RNA, 11 nt, Salmonella typhimurium LT2
ccccggccucg

SEQ ID NO: 1882509 - RNA, 15 nt, Salmonella typhimurium LT2
ccccggccucgcccg

SEQ ID NO: 1882510 - RNA, 13 nt, Salmonella typhimurium LT2
ccccggcaccacg

SEQ ID NO: 1882511 - RNA, 12 nt, Salmonella typhimurium LT2
ccccgccgccau

SEQ ID NO: 1882512 - RNA, 12 nt, Salmonella typhimurium LT2
ccccgccccagc

SEQ ID NO: 1882513 - RNA, 20 nt, Salmonella typhimurium LT2
ccccgccauaauacacaaua

SEQ ID NO: 1882514 - RNA, 15 nt, Salmonella typhimurium LT2
ccccgccaccgccgc

SEQ ID NO: 1882515 - RNA, 16 nt, Salmonella typhimurium LT2
ccccgccaccgccgcu

SEQ ID NO: 1882516 - RNA, 14 nt, Salmonella typhimurium LT2
cccgcuuuaccgaa

SEQ ID NO: 1882517 - RNA, 20 nt, Salmonella typhimurium LT2
cccgcugucgggagccucuu

SEQ ID NO: 1882518 - RNA, 15 nt, Salmonella typhimurium LT2
cccgcugcgccgcuc

SEQ ID NO: 1882519 - RNA, 14 nt, Salmonella typhimurium LT2
cccggcaacugcgc

SEQ ID NO: 1882520 - RNA, 15 nt, Salmonella typhimurium LT2
cccggcaacugcgcc

SEQ ID NO: 1882521 - RNA, 13 nt, Salmonella typhimurium LT2
cccggcaaucgcg

SEQ ID NO: 1882522 - RNA, 21 nt, Salmonella typhimurium LT2
cccggagagaaacaacaccgu

SEQ ID NO: 1882523 - RNA, 15 nt, Salmonella typhimurium LT2
cccgcgcagcgccag

SEQ ID NO: 1882524 - RNA, 14 nt, Salmonella typhimurium LT2
cccgcgccagcagg

SEQ ID NO: 1882525 - RNA, 19 nt, Salmonella typhimurium LT2
cccgcgccguucggaguug

SEQ ID NO: 1882526 - RNA, 13 nt, Salmonella typhimurium LT2
cccgcgcgccagc

SEQ ID NO: 1882527 - RNA, 15 nt, Salmonella typhimurium LT2
cccgcgcgccagcgg

SEQ ID NO: 1882528 - RNA, 20 nt, Salmonella typhimurium LT2
cccgcggcgaucaccacgcc

SEQ ID NO: 1882529 - RNA, 14 nt, Salmonella typhimurium LT2
cccgcguuggcggc

SEQ ID NO: 1882530 - RNA, 21 nt, Salmonella typhimurium LT2
cccgcguugcgccaagcgccu

SEQ ID NO: 1882531 - RNA, 22 nt, Salmonella typhimurium LT2
cccgcguugcgccaagcgccuc

SEQ ID NO: 1882532 - RNA, 19 nt, Salmonella typhimurium LT2
cccgcguaauaugggcaca

SEQ ID NO: 1882533 - RNA, 10 nt, Salmonella typhimurium LT2
cccggccgcg

SEQ ID NO: 1882534 - RNA, 19 nt, Salmonella typhimurium LT2
cccggcaggcaucgcgccg

SEQ ID NO: 1882535 - RNA, 23 nt, Salmonella typhimurium LT2
cccggcaggcaucgcgccgccgg

SEQ ID NO: 1882536 - RNA, 17 nt, Salmonella typhimurium LT2
cccggccacagcgccag

SEQ ID NO: 1882537 - RNA, 17 nt, Salmonella typhimurium LT2
cccggccaaucacgcag

SEQ ID NO: 1882538 - RNA, 12 nt, Salmonella typhimurium LT2
cccggccacagc

SEQ ID NO: 1882539 - RNA, 12 nt, Salmonella typhimurium LT2
cccggcgcagcg

SEQ ID NO: 1882540 - RNA, 15 nt, Salmonella typhimurium LT2
cccggcgcacacccu

SEQ ID NO: 1882541 - RNA, 16 nt, Salmonella typhimurium LT2
cccggcgccagcucaa

SEQ ID NO: 1882542 - RNA, 22 nt, Salmonella typhimurium LT2
cccggcgauccguagcccugga

SEQ ID NO: 1882543 - RNA, 23 nt, Salmonella typhimurium LT2
cccggcgauccguagcccuggaa

SEQ ID NO: 1882544 - RNA, 15 nt, Salmonella typhimurium LT2
cccggccuacacauc

SEQ ID NO: 1882545 - RNA, 22 nt, Salmonella typhimurium LT2
cccgguucgccgcuucaaaaac

SEQ ID NO: 1882546 - RNA, 17 nt, Salmonella typhimurium LT2
cccgguucauuaccgac

SEQ ID NO: 1882547 - RNA, 14 nt, Salmonella typhimurium LT2
cccggucgcgccag

SEQ ID NO: 1882548 - RNA, 23 nt, Salmonella typhimurium LT2
cccgguuugggcgcgaaacugcu

SEQ ID NO: 1882549 - RNA, 14 nt, Salmonella typhimurium LT2
cccguacugaaccc

SEQ ID NO: 1882550 - RNA, 16 nt, Salmonella typhimurium LT2
cccguagccugauaaa

SEQ ID NO: 1882551 - RNA, 16 nt, Salmonella typhimurium LT2
aaacacgccgcgcugg

SEQ ID NO: 1882552 - RNA, 13 nt, Salmonella typhimurium LT2
aaacacgaggcug

SEQ ID NO: 1882553 - RNA, 20 nt, Salmonella typhimurium LT2
cccggcguauccaguaacca

SEQ ID NO: 1882554 - RNA, 13 nt, Salmonella typhimurium LT2
cccggcgucggaa

SEQ ID NO: 1882555 - RNA, 19 nt, Salmonella typhimurium LT2
cccggcgggcaaccuucaa

SEQ ID NO: 1882556 - RNA, 13 nt, Salmonella typhimurium LT2
ccgauagcauuau

SEQ ID NO: 1882557 - RNA, 18 nt, Salmonella typhimurium LT2
ccgauaaucaccagcccg

SEQ ID NO: 1882558 - RNA, 23 nt, Salmonella typhimurium LT2
ccgauacaggacugacugcuguc

SEQ ID NO: 1882559 - RNA, 17 nt, Salmonella typhimurium LT2
ccgauacaggacugacu

SEQ ID NO: 1882560 - RNA, 13 nt, Salmonella typhimurium LT2
ccgauaccaaaau

SEQ ID NO: 1882561 - RNA, 16 nt, Salmonella typhimurium LT2
ccgauagcgccgcgcu

SEQ ID NO: 1882562 - RNA, 16 nt, Salmonella typhimurium LT2
ccgauagcggcggcgc

SEQ ID NO: 1882563 - RNA, 23 nt, Salmonella typhimurium LT2
ccgaucagcaccacgcccggauc

SEQ ID NO: 1882564 - RNA, 23 nt, Salmonella typhimurium LT2
ccgauccgaagaacagauucauu

SEQ ID NO: 1882565 - RNA, 18 nt, Salmonella typhimurium LT2
ccgaugacgcuccugaau

SEQ ID NO: 1882566 - RNA, 12 nt, Salmonella typhimurium LT2
ccgaucucccag

SEQ ID NO: 1882567 - RNA, 19 nt, Salmonella typhimurium LT2
ccgaucucaugcaacuggc

SEQ ID NO: 1882568 - RNA, 21 nt, Salmonella typhimurium LT2
ccgaucugguuguccaccagc

SEQ ID NO: 1882569 - RNA, 20 nt, Salmonella typhimurium LT2
ccgcacgaacggucaggacg

SEQ ID NO: 1882570 - RNA, 14 nt, Salmonella typhimurium LT2
ccgcaccuggucua

SEQ ID NO: 1882571 - RNA, 20 nt, Salmonella typhimurium LT2
ccgcacgguggauggucucu

SEQ ID NO: 1882572 - RNA, 21 nt, Salmonella typhimurium LT2
ccgcaaauucgucgccgccaa

SEQ ID NO: 1882573 - RNA, 18 nt, Salmonella typhimurium LT2
ccgcaacggcuugugagc

SEQ ID NO: 1882574 - RNA, 15 nt, Salmonella typhimurium LT2
ccgcaacggucgguc

SEQ ID NO: 1882575 - RNA, 15 nt, Salmonella typhimurium LT2
ccgcaaacgccgaag

SEQ ID NO: 1882576 - RNA, 21 nt, Salmonella typhimurium LT2
ccgaugguuaaagguuguuuc

SEQ ID NO: 1882577 - RNA, 21 nt, Salmonella typhimurium LT2
ccgcaaacuggccacagcaaa

SEQ ID NO: 1882578 - RNA, 20 nt, Salmonella typhimurium LT2
ccgcaaagaaccaacaccag

SEQ ID NO: 1882579 - RNA, 21 nt, Salmonella typhimurium LT2
ccgcaaacggaauagcgccuu

SEQ ID NO: 1882580 - RNA, 22 nt, Salmonella typhimurium LT2
ccgcaaacgccgugaacgccaa

SEQ ID NO: 1882581 - RNA, 11 nt, Salmonella typhimurium LT2
ccgauggcgcu

SEQ ID NO: 1882582 - RNA, 22 nt, Salmonella typhimurium LT2
ccgauaaagcgaccgaucauca

SEQ ID NO: 1882583 - RNA, 22 nt, Salmonella typhimurium LT2
ccgauaaaucaaacgcaccacc

SEQ ID NO: 1882584 - RNA, 21 nt, Salmonella typhimurium LT2
ccgagguucaccagcgcgccg

SEQ ID NO: 1882585 - RNA, 19 nt, Salmonella typhimurium LT2
ccgaguaacaccgcggcgc

SEQ ID NO: 1882586 - RNA, 19 nt, Salmonella typhimurium LT2
ccgagucuacaucaagaga

SEQ ID NO: 1882587 - RNA, 13 nt, Salmonella typhimurium LT2
ccgagacugcccg

SEQ ID NO: 1882588 - RNA, 18 nt, Salmonella typhimurium LT2
ccgagagcuacaguguua

SEQ ID NO: 1882589 - RNA, 17 nt, Salmonella typhimurium LT2
ccgagcggccaaaggga

SEQ ID NO: 1882590 - RNA, 18 nt, Salmonella typhimurium LT2
ccgacgguuauugcgcug

SEQ ID NO: 1882591 - RNA, 16 nt, Salmonella typhimurium LT2
ccgacguuaacugccg

SEQ ID NO: 1882592 - RNA, 16 nt, Salmonella typhimurium LT2
cccgucgccuguuucu

SEQ ID NO: 1882593 - RNA, 23 nt, Salmonella typhimurium LT2
cccugcgaacagcgcuccacgcg

SEQ ID NO: 1882594 - RNA, 20 nt, Salmonella typhimurium LT2
cccugccgucucaaccagca

SEQ ID NO: 1882595 - RNA, 15 nt, Salmonella typhimurium LT2
cccugcagaugcugc

SEQ ID NO: 1882596 - RNA, 21 nt, Salmonella typhimurium LT2
cccuggcucaauccaggugga

SEQ ID NO: 1882597 - RNA, 19 nt, Salmonella typhimurium LT2
cccuggcucaauccaggug

SEQ ID NO: 1882598 - RNA, 14 nt, Salmonella typhimurium LT2
cccuggcgcgccag

SEQ ID NO: 1882599 - RNA, 19 nt, Salmonella typhimurium LT2
cccuggcgcaguggcggcu

SEQ ID NO: 1882600 - RNA, 16 nt, Salmonella typhimurium LT2
cccugcuguuccagug

SEQ ID NO: 1882601 - RNA, 18 nt, Salmonella typhimurium LT2
cccugcgcuuucaaccac

SEQ ID NO: 1882602 - RNA, 17 nt, Salmonella typhimurium LT2
cccugcgcuuucaacca

SEQ ID NO: 1882603 - RNA, 15 nt, Salmonella typhimurium LT2
cccuucuuuuacugc

SEQ ID NO: 1882604 - RNA, 20 nt, Salmonella typhimurium LT2
cccuucuuuaugcgccuucu

SEQ ID NO: 1882605 - RNA, 17 nt, Salmonella typhimurium LT2
cccuucucgcuaauauc

SEQ ID NO: 1882606 - RNA, 20 nt, Salmonella typhimurium LT2
cccuuuaggcggcgccgcgc

SEQ ID NO: 1882607 - RNA, 17 nt, Salmonella typhimurium LT2
cccuuucauuucugccu

SEQ ID NO: 1882608 - RNA, 23 nt, Salmonella typhimurium LT2
cccuuucauuucugccugcuuca

SEQ ID NO: 1882609 - RNA, 19 nt, Salmonella typhimurium LT2
cccuuucgguucgccgcgc

SEQ ID NO: 1882610 - RNA, 19 nt, Salmonella typhimurium LT2
cccuuucaaaaaagagaag

SEQ ID NO: 1882611 - RNA, 15 nt, Salmonella typhimurium LT2
cccuuucacccgcgc

SEQ ID NO: 1882612 - RNA, 13 nt, Salmonella typhimurium LT2
cccuuucaguuca

SEQ ID NO: 1882613 - RNA, 19 nt, Salmonella typhimurium LT2
cccuuguuauccuaaaucu

SEQ ID NO: 1882614 - RNA, 20 nt, Salmonella typhimurium LT2
cccugucaaagcauugugca

SEQ ID NO: 1882615 - RNA, 20 nt, Salmonella typhimurium LT2
cccuguaggguggcuuuauu

SEQ ID NO: 1882616 - RNA, 15 nt, Salmonella typhimurium LT2
cccuggcugcccuuu

SEQ ID NO: 1882617 - RNA, 20 nt, Salmonella typhimurium LT2
cccuguggaaacuccagcgg

SEQ ID NO: 1882618 - RNA, 18 nt, Salmonella typhimurium LT2
cccuguucgccacccgcc

SEQ ID NO: 1882619 - RNA, 16 nt, Salmonella typhimurium LT2
cccuucgcuguccauu

SEQ ID NO: 1882620 - RNA, 19 nt, Salmonella typhimurium LT2
cccuucgggcagucuccuc

SEQ ID NO: 1882621 - RNA, 16 nt, Salmonella typhimurium LT2
cccuuccagacagcuu

SEQ ID NO: 1882622 - RNA, 18 nt, Salmonella typhimurium LT2
cccuuccgccacggcuuu

SEQ ID NO: 1882623 - RNA, 21 nt, Salmonella typhimurium LT2
cccuuccgccggggagggaug

SEQ ID NO: 1882624 - RNA, 16 nt, Salmonella typhimurium LT2
cccuuccaguugcguc

SEQ ID NO: 1882625 - RNA, 20 nt, Salmonella typhimurium LT2
cccuuccguauugagcagcg

SEQ ID NO: 1882626 - RNA, 13 nt, Salmonella typhimurium LT2
cccuuucuuaugc

SEQ ID NO: 1882627 - RNA, 21 nt, Salmonella typhimurium LT2
cccuuucuucucaacgccgga

SEQ ID NO: 1882628 - RNA, 13 nt, Salmonella typhimurium LT2
ccgaaagugguuu

SEQ ID NO: 1882629 - RNA, 14 nt, Salmonella typhimurium LT2
aaacagacaauuag

SEQ ID NO: 1882630 - RNA, 11 nt, Salmonella typhimurium LT2
aaacagaauuu

SEQ ID NO: 1882631 - RNA, 15 nt, Salmonella typhimurium LT2
ccgaacaacgccagg

SEQ ID NO: 1882632 - RNA, 16 nt, Salmonella typhimurium LT2
ccgaaauccaccagcg

SEQ ID NO: 1882633 - RNA, 19 nt, Salmonella typhimurium LT2
aaacaguccggcgaaaaaa

SEQ ID NO: 1882634 - RNA, 16 nt, Salmonella typhimurium LT2
aaacagugauuacaaa

SEQ ID NO: 1882635 - RNA, 22 nt, Salmonella typhimurium LT2
aaacaguuccgcaaagcccauc

SEQ ID NO: 1882636 - RNA, 21 nt, Salmonella typhimurium LT2
aaaccaccauacccaacagca

SEQ ID NO: 1882637 - RNA, 13 nt, Salmonella typhimurium LT2
aaaccaacagccg

SEQ ID NO: 1882638 - RNA, 14 nt, Salmonella typhimurium LT2
aaaccaaacaccag

SEQ ID NO: 1882639 - RNA, 14 nt, Salmonella typhimurium LT2
aaaccaaacagcga

SEQ ID NO: 1882640 - RNA, 12 nt, Salmonella typhimurium LT2
ccgacaaaacag

SEQ ID NO: 1882641 - RNA, 21 nt, Salmonella typhimurium LT2
ccgacaaccccaaacaccaac

SEQ ID NO: 1882642 - RNA, 23 nt, Salmonella typhimurium LT2
ccgacaauagagucuaccgccgu

SEQ ID NO: 1882643 - RNA, 22 nt, Salmonella typhimurium LT2
ccgacaauuuugauaagagaaa

SEQ ID NO: 1882644 - RNA, 17 nt, Salmonella typhimurium LT2
ccugucgcccaggcgau

SEQ ID NO: 1882645 - RNA, 18 nt, Salmonella typhimurium LT2
ccugucgcugcucccggc

SEQ ID NO: 1882646 - RNA, 16 nt, Salmonella typhimurium LT2
ccuguaacaacuguuu

SEQ ID NO: 1882647 - RNA, 18 nt, Salmonella typhimurium LT2
ccuguaaccuuaaaaggc

SEQ ID NO: 1882648 - RNA, 15 nt, Salmonella typhimurium LT2
ccuguaaacagaugc

SEQ ID NO: 1882649 - RNA, 14 nt, Salmonella typhimurium LT2
ccuguaaaccgccu

SEQ ID NO: 1882650 - RNA, 12 nt, Salmonella typhimurium LT2
ccuguaaagcuu

SEQ ID NO: 1882651 - RNA, 19 nt, Salmonella typhimurium LT2
ccugcugcagacugccggc

SEQ ID NO: 1882652 - RNA, 18 nt, Salmonella typhimurium LT2
ccugguaagcgcagcgcc

SEQ ID NO: 1882653 - RNA, 22 nt, Salmonella typhimurium LT2
ccugguccggaauagagauaga

SEQ ID NO: 1882654 - RNA, 21 nt, Salmonella typhimurium LT2
ccugucuauuguuuagacaga

SEQ ID NO: 1882655 - RNA, 23 nt, Salmonella typhimurium LT2
ccugucugucaaaacccagccca

SEQ ID NO: 1882656 - RNA, 22 nt, Salmonella typhimurium LT2
ccugucugucauaacugauaug

SEQ ID NO: 1882657 - RNA, 14 nt, Salmonella typhimurium LT2
ccugucguacucca

SEQ ID NO: 1882658 - RNA, 18 nt, Salmonella typhimurium LT2
ccugugccguugagcaca

SEQ ID NO: 1882659 - RNA, 13 nt, Salmonella typhimurium LT2
ccugugcucccgc

SEQ ID NO: 1882660 - RNA, 23 nt, Salmonella typhimurium LT2
ccuguuaacgcggguuuuuacuu

SEQ ID NO: 1882661 - RNA, 14 nt, Salmonella typhimurium LT2
ccuguuaucaggau

SEQ ID NO: 1882662 - RNA, 14 nt, Salmonella typhimurium LT2
ccuguuaaucaucg

SEQ ID NO: 1882663 - RNA, 12 nt, Salmonella typhimurium LT2
ccuguucaagug

SEQ ID NO: 1882664 - RNA, 13 nt, Salmonella typhimurium LT2
ccuguucaacaug

SEQ ID NO: 1882665 - RNA, 19 nt, Salmonella typhimurium LT2
ccuguucaagcaauaaugc

SEQ ID NO: 1882666 - RNA, 19 nt, Salmonella typhimurium LT2
ccuguguauucugcgccag

SEQ ID NO: 1882667 - RNA, 19 nt, Salmonella typhimurium LT2
ccugugcuuucgccaccag

SEQ ID NO: 1882668 - RNA, 13 nt, Salmonella typhimurium LT2
ccuguuuaucuga

SEQ ID NO: 1882669 - RNA, 13 nt, Salmonella typhimurium LT2
ccuguuuauauuc

SEQ ID NO: 1882670 - RNA, 18 nt, Salmonella typhimurium LT2
ccuguuucugcgccgcuu

SEQ ID NO: 1882671 - RNA, 20 nt, Salmonella typhimurium LT2
ccuguuuuuucagcgcgccg

SEQ ID NO: 1882672 - RNA, 22 nt, Salmonella typhimurium LT2
ccuguucuggccgcgaugguua

SEQ ID NO: 1882673 - RNA, 15 nt, Salmonella typhimurium LT2
ccuguucaugccaga

SEQ ID NO: 1882674 - RNA, 16 nt, Salmonella typhimurium LT2
ccuguucagcacccag

SEQ ID NO: 1882675 - RNA, 17 nt, Salmonella typhimurium LT2
ccuguuccaugauggcg

SEQ ID NO: 1882676 - RNA, 12 nt, Salmonella typhimurium LT2
ccuguucccggc

SEQ ID NO: 1882677 - RNA, 14 nt, Salmonella typhimurium LT2
ccuguucgcuuauu

SEQ ID NO: 1882678 - RNA, 14 nt, Salmonella typhimurium LT2
ccuugaguaucaau

SEQ ID NO: 1882679 - RNA, 18 nt, Salmonella typhimurium LT2
ccuucugguagccagaca

SEQ ID NO: 1882680 - RNA, 21 nt, Salmonella typhimurium LT2
ccuucugcgcccgccugcugu

SEQ ID NO: 1882681 - RNA, 16 nt, Salmonella typhimurium LT2
ccuucugcaccccguc

SEQ ID NO: 1882682 - RNA, 17 nt, Salmonella typhimurium LT2
ccuucucugucgagcau

SEQ ID NO: 1882683 - RNA, 18 nt, Salmonella typhimurium LT2
ccuugccagugaaaaaaa

SEQ ID NO: 1882684 - RNA, 13 nt, Salmonella typhimurium LT2
ccuugcgaagacc

SEQ ID NO: 1882685 - RNA, 15 nt, Salmonella typhimurium LT2
ccuuccagaaauaaa

SEQ ID NO: 1882686 - RNA, 19 nt, Salmonella typhimurium LT2
ccuuccaccgucuugcugc

SEQ ID NO: 1882687 - RNA, 19 nt, Salmonella typhimurium LT2
ccuucccgcgauaaaaaca

SEQ ID NO: 1882688 - RNA, 13 nt, Salmonella typhimurium LT2
ccuuccccuuuca

SEQ ID NO: 1882689 - RNA, 12 nt, Salmonella typhimurium LT2
ccuucgggcgau

SEQ ID NO: 1882690 - RNA, 19 nt, Salmonella typhimurium LT2
ccuucguuuuauuugaugc

SEQ ID NO: 1882691 - RNA, 17 nt, Salmonella typhimurium LT2
ccuucuaccgucagcag

SEQ ID NO: 1882692 - RNA, 18 nt, Salmonella typhimurium LT2
ccuucgguguaaacaggc

SEQ ID NO: 1882693 - RNA, 20 nt, Salmonella typhimurium LT2
ccuucgucacgcgcaaagcu

SEQ ID NO: 1882694 - RNA, 13 nt, Salmonella typhimurium LT2
ccuucaucguuua

SEQ ID NO: 1882695 - RNA, 12 nt, Salmonella typhimurium LT2
ccuuauaaugcu

SEQ ID NO: 1882696 - RNA, 21 nt, Salmonella typhimurium LT2
ccuuauauauguucaauauuc

SEQ ID NO: 1882697 - RNA, 13 nt, Salmonella typhimurium LT2
ccuuaucaagccu

SEQ ID NO: 1882698 - RNA, 23 nt, Salmonella typhimurium LT2
ccuucaucaucauaguggcgcac

SEQ ID NO: 1882699 - RNA, 14 nt, Salmonella typhimurium LT2
ccuucauauuucaa

SEQ ID NO: 1882700 - RNA, 13 nt, Salmonella typhimurium LT2
ccuuacggcuccu

SEQ ID NO: 1882701 - RNA, 13 nt, Salmonella typhimurium LT2
ccuuacuauccca

SEQ ID NO: 1882702 - RNA, 15 nt, Salmonella typhimurium LT2
ccuuaguaaaaccga

SEQ ID NO: 1882703 - RNA, 23 nt, Salmonella typhimurium LT2
ccuuacuguagcgccgcuuccag

SEQ ID NO: 1882704 - RNA, 15 nt, Salmonella typhimurium LT2
ccuuucuguucuuug

SEQ ID NO: 1882705 - RNA, 22 nt, Salmonella typhimurium LT2
ccuuugucgaaauugccgcccg

SEQ ID NO: 1882706 - RNA, 16 nt, Salmonella typhimurium LT2
ccuuuuagcacuuuaa

SEQ ID NO: 1882707 - RNA, 13 nt, Salmonella typhimurium LT2
ccuuuuaauuuuc

SEQ ID NO: 1882708 - RNA, 16 nt, Salmonella typhimurium LT2
ccuuuuaauuuucugu

SEQ ID NO: 1882709 - RNA, 16 nt, Salmonella typhimurium LT2
ccuuuucguacauguc

SEQ ID NO: 1882710 - RNA, 16 nt, Salmonella typhimurium LT2
ccuuuuccucuucuug

SEQ ID NO: 1882711 - RNA, 18 nt, Salmonella typhimurium LT2
ccuuuuuugugaauauca

SEQ ID NO: 1882712 - RNA, 22 nt, Salmonella typhimurium LT2
ccuuuuuugguuauccagcagc

SEQ ID NO: 1882713 - RNA, 23 nt, Salmonella typhimurium LT2
ccuuuuuugguuauccagcagcc

SEQ ID NO: 1882714 - RNA, 17 nt, Salmonella typhimurium LT2
ccuuuuuuauugccuga

SEQ ID NO: 1882715 - RNA, 23 nt, Salmonella typhimurium LT2
ccuuuucgcagcaauucugcugg

SEQ ID NO: 1882716 - RNA, 22 nt, Salmonella typhimurium LT2
cgaaaacguugacuuaaaaagc

SEQ ID NO: 1882717 - RNA, 12 nt, Salmonella typhimurium LT2
cgaaaaucaucc

SEQ ID NO: 1882718 - RNA, 15 nt, Salmonella typhimurium LT2
cgaaaauagccugaa

SEQ ID NO: 1882719 - RNA, 16 nt, Salmonella typhimurium LT2
cgaaacaggcggcaga

SEQ ID NO: 1882720 - RNA, 17 nt, Salmonella typhimurium LT2
cgaaacagggcaaggau

SEQ ID NO: 1882721 - RNA, 13 nt, Salmonella typhimurium LT2
cgaaacccaaaua

SEQ ID NO: 1882722 - RNA, 16 nt, Salmonella typhimurium LT2
cgaaacccaaauaacc

SEQ ID NO: 1882723 - RNA, 17 nt, Salmonella typhimurium LT2
cgaaagaaacgccgacc

SEQ ID NO: 1882724 - RNA, 18 nt, Salmonella typhimurium LT2
cgaaacguugcuuauuca

SEQ ID NO: 1882725 - RNA, 13 nt, Salmonella typhimurium LT2
cgaaacgcagcau

SEQ ID NO: 1882726 - RNA, 19 nt, Salmonella typhimurium LT2
cgaaacgcauacgcagcac

SEQ ID NO: 1882727 - RNA, 22 nt, Salmonella typhimurium LT2
cgaaaugaccaccgcaucggca

SEQ ID NO: 1882728 - RNA, 15 nt, Salmonella typhimurium LT2
cgaaaugaccaccgc

SEQ ID NO: 1882729 - RNA, 16 nt, Salmonella typhimurium LT2
cgaaaugguuccaggc

SEQ ID NO: 1882730 - RNA, 23 nt, Salmonella typhimurium LT2
cgaaaugguuccaggcgcgcacc

SEQ ID NO: 1882731 - RNA, 16 nt, Salmonella typhimurium LT2
cgaaaucaucaauggc

SEQ ID NO: 1882732 - RNA, 22 nt, Salmonella typhimurium LT2
cgaaagcguaucacccugccaa

SEQ ID NO: 1882733 - RNA, 17 nt, Salmonella typhimurium LT2
cgaaaggguauacaaaa

SEQ ID NO: 1882734 - RNA, 20 nt, Salmonella typhimurium LT2
cgaaaucaaagaccuccgcc

SEQ ID NO: 1882735 - RNA, 16 nt, Salmonella typhimurium LT2
cgaaccauuucuuuug

SEQ ID NO: 1882736 - RNA, 20 nt, Salmonella typhimurium LT2
cgaacgccgacaucacgcaa

SEQ ID NO: 1882737 - RNA, 20 nt, Salmonella typhimurium LT2
cgaaccaucauuaauauaau

SEQ ID NO: 1882738 - RNA, 17 nt, Salmonella typhimurium LT2
cgaacauuucagcgcca

SEQ ID NO: 1882739 - RNA, 22 nt, Salmonella typhimurium LT2
cgaaccaacgacccccaccaug

SEQ ID NO: 1882740 - RNA, 20 nt, Salmonella typhimurium LT2
cgaacaucugcguugcgcgc

SEQ ID NO: 1882741 - RNA, 19 nt, Salmonella typhimurium LT2
cgaacaguguaaacgccag

SEQ ID NO: 1882742 - RNA, 18 nt, Salmonella typhimurium LT2
cgaacaaacuccagcacg

SEQ ID NO: 1882743 - RNA, 19 nt, Salmonella typhimurium LT2
cgaacaaguaguuguuaua

SEQ ID NO: 1882744 - RNA, 21 nt, Salmonella typhimurium LT2
cgaacagaaaaaaugcaccgc

SEQ ID NO: 1882745 - RNA, 13 nt, Salmonella typhimurium LT2
cgaacagcgcucc

SEQ ID NO: 1882746 - RNA, 16 nt, Salmonella typhimurium LT2
cgaagggccagagaaa

SEQ ID NO: 1882747 - RNA, 14 nt, Salmonella typhimurium LT2
cgaagucgccaccc

SEQ ID NO: 1882748 - RNA, 22 nt, Salmonella typhimurium LT2
cgaaguaauaaaaaacaacucu

SEQ ID NO: 1882749 - RNA, 22 nt, Salmonella typhimurium LT2
cgaagaucguuauccagcagcc

SEQ ID NO: 1882750 - RNA, 23 nt, Salmonella typhimurium LT2
cgaacggcuuuccagcagccaga

SEQ ID NO: 1882751 - RNA, 14 nt, Salmonella typhimurium LT2
cgaagacuccccug

SEQ ID NO: 1882752 - RNA, 16 nt, Salmonella typhimurium LT2
cgaacggcuuuccagc

SEQ ID NO: 1882753 - RNA, 15 nt, Salmonella typhimurium LT2
cgaacgcgaaggcca

SEQ ID NO: 1882754 - RNA, 22 nt, Salmonella typhimurium LT2
cgaacgcgaaggccagcaccag

SEQ ID NO: 1882755 - RNA, 15 nt, Salmonella typhimurium LT2
cgaacgcguccauga

SEQ ID NO: 1882756 - RNA, 21 nt, Salmonella typhimurium LT2
cgaacgcggcuuauccggcuu

SEQ ID NO: 1882757 - RNA, 23 nt, Salmonella typhimurium LT2
cgaacgcggcuuauccggcuuac

SEQ ID NO: 1882758 - RNA, 22 nt, Salmonella typhimurium LT2
ccugacagagcucgucaaaaau

SEQ ID NO: 1882759 - RNA, 20 nt, Salmonella typhimurium LT2
ccugaccacgacgaccgcca

SEQ ID NO: 1882760 - RNA, 13 nt, Salmonella typhimurium LT2
ccugaccagcgac

SEQ ID NO: 1882761 - RNA, 23 nt, Salmonella typhimurium LT2
ccugacauuacccggccaggcgu

SEQ ID NO: 1882762 - RNA, 15 nt, Salmonella typhimurium LT2
ccugacauagcucac

SEQ ID NO: 1882763 - RNA, 19 nt, Salmonella typhimurium LT2
ccugaaucgccucaacgcu

SEQ ID NO: 1882764 - RNA, 14 nt, Salmonella typhimurium LT2
ccugacgcugagag

SEQ ID NO: 1882765 - RNA, 13 nt, Salmonella typhimurium LT2
ccugacggcagcc

SEQ ID NO: 1882766 - RNA, 14 nt, Salmonella typhimurium LT2
ccugacucaccagc

SEQ ID NO: 1882767 - RNA, 19 nt, Salmonella typhimurium LT2
ccugaccgauauagccacu

SEQ ID NO: 1882768 - RNA, 23 nt, Salmonella typhimurium LT2
ccugaccguugaucuccgcgcaa

SEQ ID NO: 1882769 - RNA, 16 nt, Salmonella typhimurium LT2
ccugacgaccauugcc

SEQ ID NO: 1882770 - RNA, 18 nt, Salmonella typhimurium LT2
ccugauaagcgaagcgcc

SEQ ID NO: 1882771 - RNA, 13 nt, Salmonella typhimurium LT2
ccugauaauccag

SEQ ID NO: 1882772 - RNA, 18 nt, Salmonella typhimurium LT2
ccugaggaagaagcgcac

SEQ ID NO: 1882773 - RNA, 12 nt, Salmonella typhimurium LT2
ccugagcuuucc

SEQ ID NO: 1882774 - RNA, 19 nt, Salmonella typhimurium LT2
ccugagcccaaucgguuga

SEQ ID NO: 1882775 - RNA, 14 nt, Salmonella typhimurium LT2
ccugacugaagacg

SEQ ID NO: 1882776 - RNA, 19 nt, Salmonella typhimurium LT2
ccugagaagaguaaagauc

SEQ ID NO: 1882777 - RNA, 16 nt, Salmonella typhimurium LT2
ccucuucgcaauaggg

SEQ ID NO: 1882778 - RNA, 21 nt, Salmonella typhimurium LT2
ccucuugucaggcaaaaauaa

SEQ ID NO: 1882779 - RNA, 12 nt, Salmonella typhimurium LT2
ccucuuuccguu

SEQ ID NO: 1882780 - RNA, 21 nt, Salmonella typhimurium LT2
ccucuuuuuagcagcaauaau

SEQ ID NO: 1882781 - RNA, 17 nt, Salmonella typhimurium LT2
ccucuggccaguuucaa

SEQ ID NO: 1882782 - RNA, 11 nt, Salmonella typhimurium LT2
ccucugcugcg

SEQ ID NO: 1882783 - RNA, 23 nt, Salmonella typhimurium LT2
ccucuucauagcguuuuuucauc

SEQ ID NO: 1882784 - RNA, 13 nt, Salmonella typhimurium LT2
ccucuuaucaggc

SEQ ID NO: 1882785 - RNA, 18 nt, Salmonella typhimurium LT2
ccucuuccgccaggucgc

SEQ ID NO: 1882786 - RNA, 16 nt, Salmonella typhimurium LT2
ccugaaccucuucacc

SEQ ID NO: 1882787 - RNA, 16 nt, Salmonella typhimurium LT2
ccugaaacaggugugc

SEQ ID NO: 1882788 - RNA, 12 nt, Salmonella typhimurium LT2
ccucuuuuucau

SEQ ID NO: 1882789 - RNA, 15 nt, Salmonella typhimurium LT2
ccugaauauggccag

SEQ ID NO: 1882790 - RNA, 19 nt, Salmonella typhimurium LT2
ccugaauccagacuuuuuu

SEQ ID NO: 1882791 - RNA, 22 nt, Salmonella typhimurium LT2
ccugaauaacccgcagcccugc

SEQ ID NO: 1882792 - RNA, 19 nt, Salmonella typhimurium LT2
ccugaauaacccgcagccc

SEQ ID NO: 1882793 - RNA, 23 nt, Salmonella typhimurium LT2
ccugaagauagucgauccccaac

SEQ ID NO: 1882794 - RNA, 15 nt, Salmonella typhimurium LT2
ccugaagccauccuc

SEQ ID NO: 1882795 - RNA, 18 nt, Salmonella typhimurium LT2
ccugaagcggcgcaauuu

SEQ ID NO: 1882796 - RNA, 16 nt, Salmonella typhimurium LT2
ccugaaggacaagcug

SEQ ID NO: 1882797 - RNA, 12 nt, Salmonella typhimurium LT2
ccugauggcgcu

SEQ ID NO: 1882798 - RNA, 12 nt, Salmonella typhimurium LT2
ccugauggcgcg

SEQ ID NO: 1882799 - RNA, 23 nt, Salmonella typhimurium LT2
ccugaugcugcgaggccaacggc

SEQ ID NO: 1882800 - RNA, 22 nt, Salmonella typhimurium LT2
ccugauuaaguuuuuuuaaaaa

SEQ ID NO: 1882801 - RNA, 21 nt, Salmonella typhimurium LT2
ccugauuaccuaccagcgcgc

SEQ ID NO: 1882802 - RNA, 19 nt, Salmonella typhimurium LT2
ccugauuuaacgaguugaa

SEQ ID NO: 1882803 - RNA, 21 nt, Salmonella typhimurium LT2
ccugaucgugccaugaccauu

SEQ ID NO: 1882804 - RNA, 21 nt, Salmonella typhimurium LT2
ccugaucggcguuuagcccga

SEQ ID NO: 1882805 - RNA, 18 nt, Salmonella typhimurium LT2
ccugauccggcuguucca

SEQ ID NO: 1882806 - RNA, 20 nt, Salmonella typhimurium LT2
ccugaucgauucucuucuuc

SEQ ID NO: 1882807 - RNA, 21 nt, Salmonella typhimurium LT2
ccugaucgauucucuucuucu

SEQ ID NO: 1882808 - RNA, 23 nt, Salmonella typhimurium LT2
ccugaucgauucucuucuucuuu

SEQ ID NO: 1882809 - RNA, 14 nt, Salmonella typhimurium LT2
ccugauauccacgc

SEQ ID NO: 1882810 - RNA, 18 nt, Salmonella typhimurium LT2
ccugauauacaaaaccca

SEQ ID NO: 1882811 - RNA, 23 nt, Salmonella typhimurium LT2
ccugauauugcguaagcagcugc

SEQ ID NO: 1882812 - RNA, 13 nt, Salmonella typhimurium LT2
ccugaucaaacac

SEQ ID NO: 1882813 - RNA, 15 nt, Salmonella typhimurium LT2
ccugaucaaucaacu

SEQ ID NO: 1882814 - RNA, 14 nt, Salmonella typhimurium LT2
ccugaucccacagc

SEQ ID NO: 1882815 - RNA, 12 nt, Salmonella typhimurium LT2
ccugcaauuccg

SEQ ID NO: 1882816 - RNA, 17 nt, Salmonella typhimurium LT2
ccugcagaauaagcucc

SEQ ID NO: 1882817 - RNA, 13 nt, Salmonella typhimurium LT2
ccugcacuuccag

SEQ ID NO: 1882818 - RNA, 17 nt, Salmonella typhimurium LT2
ccugcaacagcaccagc

SEQ ID NO: 1882819 - RNA, 20 nt, Salmonella typhimurium LT2
ccugcaacgcgaaauucuug

SEQ ID NO: 1882820 - RNA, 22 nt, Salmonella typhimurium LT2
ccugcaaaaggaacaguugcag

SEQ ID NO: 1882821 - RNA, 14 nt, Salmonella typhimurium LT2
ccugauuuaucacg

SEQ ID NO: 1882822 - RNA, 13 nt, Salmonella typhimurium LT2
ccugauuuaucac

SEQ ID NO: 1882823 - RNA, 22 nt, Salmonella typhimurium LT2
ccugauuuuuuaauucauauau

SEQ ID NO: 1882824 - RNA, 17 nt, Salmonella typhimurium LT2
ccugcgcugauuuucuc

SEQ ID NO: 1882825 - RNA, 17 nt, Salmonella typhimurium LT2
ccugcgcgacgcccacc

SEQ ID NO: 1882826 - RNA, 20 nt, Salmonella typhimurium LT2
ccugcgguaaucgccgcgac

SEQ ID NO: 1882827 - RNA, 18 nt, Salmonella typhimurium LT2
ccugcgguacggccagcg

SEQ ID NO: 1882828 - RNA, 19 nt, Salmonella typhimurium LT2
ccugcggacgcagcucaua

SEQ ID NO: 1882829 - RNA, 17 nt, Salmonella typhimurium LT2
ccugcgcugucaccagc

SEQ ID NO: 1882830 - RNA, 14 nt, Salmonella typhimurium LT2
ccugcgucacagac

SEQ ID NO: 1882831 - RNA, 22 nt, Salmonella typhimurium LT2
ccugcgucacgauaguuuuaau

SEQ ID NO: 1882832 - RNA, 20 nt, Salmonella typhimurium LT2
ccugcgucauccccaggcug

SEQ ID NO: 1882833 - RNA, 18 nt, Salmonella typhimurium LT2
ccugcguuaaacgcugug

SEQ ID NO: 1882834 - RNA, 15 nt, Salmonella typhimurium LT2
ccugcgccagccgga

SEQ ID NO: 1882835 - RNA, 21 nt, Salmonella typhimurium LT2
ccugcgccagcaccauggcua

SEQ ID NO: 1882836 - RNA, 13 nt, Salmonella typhimurium LT2
ccugcgccagcgg

SEQ ID NO: 1882837 - RNA, 16 nt, Salmonella typhimurium LT2
ccugcauauuuuucau

SEQ ID NO: 1882838 - RNA, 14 nt, Salmonella typhimurium LT2
ccugcaucaacagg

SEQ ID NO: 1882839 - RNA, 17 nt, Salmonella typhimurium LT2
ccugcaucgacauccga

SEQ ID NO: 1882840 - RNA, 18 nt, Salmonella typhimurium LT2
ccugcaugaucaugcugc

SEQ ID NO: 1882841 - RNA, 15 nt, Salmonella typhimurium LT2
ccugccggguuuaau

SEQ ID NO: 1882842 - RNA, 21 nt, Salmonella typhimurium LT2
ccugccguaccguugccgccg

SEQ ID NO: 1882843 - RNA, 23 nt, Salmonella typhimurium LT2
ccugccgucaaacuuaaugccug

SEQ ID NO: 1882844 - RNA, 17 nt, Salmonella typhimurium LT2
ccugccggauuuuucau

SEQ ID NO: 1882845 - RNA, 17 nt, Salmonella typhimurium LT2
ccugccggaaaaugcgc

SEQ ID NO: 1882846 - RNA, 16 nt, Salmonella typhimurium LT2
ccucaacgcccugcuc

SEQ ID NO: 1882847 - RNA, 22 nt, Salmonella typhimurium LT2
ccucaacgcccugcucccacag

SEQ ID NO: 1882848 - RNA, 18 nt, Salmonella typhimurium LT2
ccucaacauugccggcau

SEQ ID NO: 1882849 - RNA, 17 nt, Salmonella typhimurium LT2
ccucaacaucucuucgu

SEQ ID NO: 1882850 - RNA, 23 nt, Salmonella typhimurium LT2
ccucaacgcccugcucccacagc

SEQ ID NO: 1882851 - RNA, 16 nt, Salmonella typhimurium LT2
ccucaccguagcucca

SEQ ID NO: 1882852 - RNA, 11 nt, Salmonella typhimurium LT2
ccucacuccag

SEQ ID NO: 1882853 - RNA, 14 nt, Salmonella typhimurium LT2
ccucacggagaaaa

SEQ ID NO: 1882854 - RNA, 18 nt, Salmonella typhimurium LT2
ccucacgcaaccagguca

SEQ ID NO: 1882855 - RNA, 18 nt, Salmonella typhimurium LT2
ccucagucgcuuguaccg

SEQ ID NO: 1882856 - RNA, 13 nt, Salmonella typhimurium LT2
ccuaucgccauau

SEQ ID NO: 1882857 - RNA, 20 nt, Salmonella typhimurium LT2
ccuauuaucggcaccaucua

SEQ ID NO: 1882858 - RNA, 21 nt, Salmonella typhimurium LT2
ccgugcaaaaucacgcggcgc

SEQ ID NO: 1882859 - RNA, 14 nt, Salmonella typhimurium LT2
ccgugaguuuuaac

SEQ ID NO: 1882860 - RNA, 16 nt, Salmonella typhimurium LT2
ccgugaucgaggcgcu

SEQ ID NO: 1882861 - RNA, 15 nt, Salmonella typhimurium LT2
ccgugcgcagaauau

SEQ ID NO: 1882862 - RNA, 15 nt, Salmonella typhimurium LT2
ccuccgaagagaccu

SEQ ID NO: 1882863 - RNA, 11 nt, Salmonella typhimurium LT2
ccuccgcccgg

SEQ ID NO: 1882864 - RNA, 20 nt, Salmonella typhimurium LT2
ccucauuuuguugcuccagc

SEQ ID NO: 1882865 - RNA, 16 nt, Salmonella typhimurium LT2
ccucauuuuguugcuc

SEQ ID NO: 1882866 - RNA, 16 nt, Salmonella typhimurium LT2
ccuccagccagcgcca

SEQ ID NO: 1882867 - RNA, 17 nt, Salmonella typhimurium LT2
ccuccagccagcgccag

SEQ ID NO: 1882868 - RNA, 13 nt, Salmonella typhimurium LT2
ccuccccaggcgc

SEQ ID NO: 1882869 - RNA, 17 nt, Salmonella typhimurium LT2
ccucccccucaaucggc

SEQ ID NO: 1882870 - RNA, 22 nt, Salmonella typhimurium LT2
ccuccagcgaggccucuccucg

SEQ ID NO: 1882871 - RNA, 14 nt, Salmonella typhimurium LT2
ccucauucagcggc

SEQ ID NO: 1882872 - RNA, 14 nt, Salmonella typhimurium LT2
ccucauuaaaaaaa

SEQ ID NO: 1882873 - RNA, 17 nt, Salmonella typhimurium LT2
ccucauuaaaaaaacau

SEQ ID NO: 1882874 - RNA, 22 nt, Salmonella typhimurium LT2
ccucaugcuuaucgccaaacca

SEQ ID NO: 1882875 - RNA, 16 nt, Salmonella typhimurium LT2
ccucaucugcuucaac

SEQ ID NO: 1882876 - RNA, 17 nt, Salmonella typhimurium LT2
aaacgccugcaucaaca

SEQ ID NO: 1882877 - RNA, 18 nt, Salmonella typhimurium LT2
aaacgccugcaucaacag

SEQ ID NO: 1882878 - RNA, 17 nt, Salmonella typhimurium LT2
aaacgccugaauaaucg

SEQ ID NO: 1882879 - RNA, 16 nt, Salmonella typhimurium LT2
aaacgccgcagaaaau

SEQ ID NO: 1882880 - RNA, 23 nt, Salmonella typhimurium LT2
aaacgccccuucaucagccagca

SEQ ID NO: 1882881 - RNA, 17 nt, Salmonella typhimurium LT2
aaacgcccgcaaaagcg

SEQ ID NO: 1882882 - RNA, 19 nt, Salmonella typhimurium LT2
aaacgcccccagauagaac

SEQ ID NO: 1882883 - RNA, 18 nt, Salmonella typhimurium LT2
aaacgccaggcgcugcgu

SEQ ID NO: 1882884 - RNA, 22 nt, Salmonella typhimurium LT2
aaacgcauccaggcgaaauaga

SEQ ID NO: 1882885 - RNA, 15 nt, Salmonella typhimurium LT2
aaacgccaagaauga

SEQ ID NO: 1882886 - RNA, 19 nt, Salmonella typhimurium LT2
ccucauacagcccgcgcag

SEQ ID NO: 1882887 - RNA, 13 nt, Salmonella typhimurium LT2
ccucauauuugua

SEQ ID NO: 1882888 - RNA, 19 nt, Salmonella typhimurium LT2
ccucauauuuguaucuggu

SEQ ID NO: 1882889 - RNA, 18 nt, Salmonella typhimurium LT2
ccuccugaauagcuuuca

SEQ ID NO: 1882890 - RNA, 15 nt, Salmonella typhimurium LT2
ccuccugcagacucc

SEQ ID NO: 1882891 - RNA, 18 nt, Salmonella typhimurium LT2
ccucgccaaagcgcugcu

SEQ ID NO: 1882892 - RNA, 13 nt, Salmonella typhimurium LT2
ccucgcauccucc

SEQ ID NO: 1882893 - RNA, 19 nt, Salmonella typhimurium LT2
ccucgcauccuccauccag

SEQ ID NO: 1882894 - RNA, 13 nt, Salmonella typhimurium LT2
ccucgcccgcgau

SEQ ID NO: 1882895 - RNA, 13 nt, Salmonella typhimurium LT2
ccucgccauugau

SEQ ID NO: 1882896 - RNA, 23 nt, Salmonella typhimurium LT2
ccuccgcguagcccagcgccgca

SEQ ID NO: 1882897 - RNA, 17 nt, Salmonella typhimurium LT2
ccucgcguagcgccaac

SEQ ID NO: 1882898 - RNA, 15 nt, Salmonella typhimurium LT2
ccucgcugacgccag

SEQ ID NO: 1882899 - RNA, 19 nt, Salmonella typhimurium LT2
ccucgcugacgccagccag

SEQ ID NO: 1882900 - RNA, 15 nt, Salmonella typhimurium LT2
ccucgcuaaugcccg

SEQ ID NO: 1882901 - RNA, 17 nt, Salmonella typhimurium LT2
ccucggucgagcuuuug

SEQ ID NO: 1882902 - RNA, 20 nt, Salmonella typhimurium LT2
ccucggucgagcuuuugcug

SEQ ID NO: 1882903 - RNA, 14 nt, Salmonella typhimurium LT2
ccucgguuuauccc

SEQ ID NO: 1882904 - RNA, 21 nt, Salmonella typhimurium LT2
ccucgguggccuuguagcgcu

SEQ ID NO: 1882905 - RNA, 17 nt, Salmonella typhimurium LT2
ccucgguggcgguccaa

SEQ ID NO: 1882906 - RNA, 21 nt, Salmonella typhimurium LT2
ccucugagaacuauuugccug

SEQ ID NO: 1882907 - RNA, 15 nt, Salmonella typhimurium LT2
ccucucuuccuccug

SEQ ID NO: 1882908 - RNA, 16 nt, Salmonella typhimurium LT2
ccucucuuccuccuga

SEQ ID NO: 1882909 - RNA, 22 nt, Salmonella typhimurium LT2
ccucucccgaacugucugaauc

SEQ ID NO: 1882910 - RNA, 22 nt, Salmonella typhimurium LT2
ccucuauaguaaauugacgcuu

SEQ ID NO: 1882911 - RNA, 16 nt, Salmonella typhimurium LT2
ccucguccagaugggc

SEQ ID NO: 1882912 - RNA, 19 nt, Salmonella typhimurium LT2
ccucguucggcgcaccugu

SEQ ID NO: 1882913 - RNA, 21 nt, Salmonella typhimurium LT2
ccucguuugcugagcagccag

SEQ ID NO: 1882914 - RNA, 22 nt, Salmonella typhimurium LT2
ccucuaaauguuggauugcauc

SEQ ID NO: 1882915 - RNA, 12 nt, Salmonella typhimurium LT2
ccgcgccagcca

SEQ ID NO: 1882916 - RNA, 11 nt, Salmonella typhimurium LT2
ccgcgccaccg

SEQ ID NO: 1882917 - RNA, 15 nt, Salmonella typhimurium LT2
ccgcgcauagcuggc

SEQ ID NO: 1882918 - RNA, 12 nt, Salmonella typhimurium LT2
ccgcgcagcgcc

SEQ ID NO: 1882919 - RNA, 21 nt, Salmonella typhimurium LT2
ccgcgcagaaucacuucaucc

SEQ ID NO: 1882920 - RNA, 13 nt, Salmonella typhimurium LT2
ccgcgcacgccgc

SEQ ID NO: 1882921 - RNA, 23 nt, Salmonella typhimurium LT2
ccgcgcaaagcaauaccacgccc

SEQ ID NO: 1882922 - RNA, 15 nt, Salmonella typhimurium LT2
ccgcgacuuuggcuu

SEQ ID NO: 1882923 - RNA, 13 nt, Salmonella typhimurium LT2
ccgcgaucgcugg

SEQ ID NO: 1882924 - RNA, 16 nt, Salmonella typhimurium LT2
ccgcgaucgcggcaac

SEQ ID NO: 1882925 - RNA, 23 nt, Salmonella typhimurium LT2
ccgcgauagaccacgccaucaac

SEQ ID NO: 1882926 - RNA, 16 nt, Salmonella typhimurium LT2
ccgcgauacggauagc

SEQ ID NO: 1882927 - RNA, 21 nt, Salmonella typhimurium LT2
ccgcgauagaccacgccauca

SEQ ID NO: 1882928 - RNA, 23 nt, Salmonella typhimurium LT2
ccgcgacaaaaagcgcgccgaaa

SEQ ID NO: 1882929 - RNA, 10 nt, Salmonella typhimurium LT2
ccgcagccgg

SEQ ID NO: 1882930 - RNA, 22 nt, Salmonella typhimurium LT2
ccgcagccuaguucugcgccag

SEQ ID NO: 1882931 - RNA, 15 nt, Salmonella typhimurium LT2
ccgcagccugauggc

SEQ ID NO: 1882932 - RNA, 16 nt, Salmonella typhimurium LT2
ccgcagccaccccggc

SEQ ID NO: 1882933 - RNA, 12 nt, Salmonella typhimurium LT2
ccgcagccagaa

SEQ ID NO: 1882934 - RNA, 18 nt, Salmonella typhimurium LT2
ccgcagcauuuccgccgc

SEQ ID NO: 1882935 - RNA, 18 nt, Salmonella typhimurium LT2
ccgcagcggauugccgcg

SEQ ID NO: 1882936 - RNA, 14 nt, Salmonella typhimurium LT2
ccgccugccgcgcc

SEQ ID NO: 1882937 - RNA, 18 nt, Salmonella typhimurium LT2
ccgccugccgcgccgccg

SEQ ID NO: 1882938 - RNA, 18 nt, Salmonella typhimurium LT2
ccgccugcgccagcgccg

SEQ ID NO: 1882939 - RNA, 16 nt, Salmonella typhimurium LT2
ccgccugcgccuugac

SEQ ID NO: 1882940 - RNA, 23 nt, Salmonella typhimurium LT2
ccgccuuuucccccagcaucuua

SEQ ID NO: 1882941 - RNA, 16 nt, Salmonella typhimurium LT2
ccgccuuguccggccu

SEQ ID NO: 1882942 - RNA, 11 nt, Salmonella typhimurium LT2
ccgccuugucu

SEQ ID NO: 1882943 - RNA, 15 nt, Salmonella typhimurium LT2
ccgccugcuccgggc

SEQ ID NO: 1882944 - RNA, 17 nt, Salmonella typhimurium LT2
ccgccuucagcgcgccc

SEQ ID NO: 1882945 - RNA, 15 nt, Salmonella typhimurium LT2
ccgccuuaccgcggu

SEQ ID NO: 1882946 - RNA, 13 nt, Salmonella typhimurium LT2
ccgccuucugcac

SEQ ID NO: 1882947 - RNA, 13 nt, Salmonella typhimurium LT2
ccgcgccgcccca

SEQ ID NO: 1882948 - RNA, 11 nt, Salmonella typhimurium LT2
ccgcgccgccg

SEQ ID NO: 1882949 - RNA, 17 nt, Salmonella typhimurium LT2
ccgcgccuaccagcgcu

SEQ ID NO: 1882950 - RNA, 16 nt, Salmonella typhimurium LT2
ccgcgccggucgccag

SEQ ID NO: 1882951 - RNA, 12 nt, Salmonella typhimurium LT2
ccgcgccgucgg

SEQ ID NO: 1882952 - RNA, 13 nt, Salmonella typhimurium LT2
ccgcgccaggcgg

SEQ ID NO: 1882953 - RNA, 15 nt, Salmonella typhimurium LT2
aaacccggugcggca

SEQ ID NO: 1882954 - RNA, 23 nt, Salmonella typhimurium LT2
aaaccgaaaggguauacaaaaaa

SEQ ID NO: 1882955 - RNA, 13 nt, Salmonella typhimurium LT2
aaacccugcgcca

SEQ ID NO: 1882956 - RNA, 15 nt, Salmonella typhimurium LT2
ccgcgcgcuuuccac

SEQ ID NO: 1882957 - RNA, 16 nt, Salmonella typhimurium LT2
ccgcgcgacagagcca

SEQ ID NO: 1882958 - RNA, 20 nt, Salmonella typhimurium LT2
aaaccgcccccagucugcug

SEQ ID NO: 1882959 - RNA, 16 nt, Salmonella typhimurium LT2
aaaccgaucucccagc

SEQ ID NO: 1882960 - RNA, 16 nt, Salmonella typhimurium LT2
aaaccgacagcaauau

SEQ ID NO: 1882961 - RNA, 13 nt, Salmonella typhimurium LT2
ccgcgcucaguca

SEQ ID NO: 1882962 - RNA, 14 nt, Salmonella typhimurium LT2
ccgcgcucaacaca

SEQ ID NO: 1882963 - RNA, 22 nt, Salmonella typhimurium LT2
ccgcgcuagugccgccaggcaa

SEQ ID NO: 1882964 - RNA, 15 nt, Salmonella typhimurium LT2
ccgcgcgucagcgug

SEQ ID NO: 1882965 - RNA, 16 nt, Salmonella typhimurium LT2
ccgcgcugcgccgcaa

SEQ ID NO: 1882966 - RNA, 19 nt, Salmonella typhimurium LT2
ccgcgcuggcugaaccccu

SEQ ID NO: 1882967 - RNA, 19 nt, Salmonella typhimurium LT2
ccgcgcuuucuggcgcaga

SEQ ID NO: 1882968 - RNA, 19 nt, Salmonella typhimurium LT2
ccgcguaucauugcgcucu

SEQ ID NO: 1882969 - RNA, 23 nt, Salmonella typhimurium LT2
ccgcguaauaugggcacaacccu

SEQ ID NO: 1882970 - RNA, 19 nt, Salmonella typhimurium LT2
ccgcguagcccagcgccgc

SEQ ID NO: 1882971 - RNA, 20 nt, Salmonella typhimurium LT2
ccgcgugaacaccacugaaa

SEQ ID NO: 1882972 - RNA, 20 nt, Salmonella typhimurium LT2
ccgcgucugaccgccgcgau

SEQ ID NO: 1882973 - RNA, 20 nt, Salmonella typhimurium LT2
ccgcggcggacagcggcagc

SEQ ID NO: 1882974 - RNA, 15 nt, Salmonella typhimurium LT2
ccgcggcggacagcg

SEQ ID NO: 1882975 - RNA, 14 nt, Salmonella typhimurium LT2
ccgcuacaauccag

SEQ ID NO: 1882976 - RNA, 14 nt, Salmonella typhimurium LT2
ccgcguuggcggcu

SEQ ID NO: 1882977 - RNA, 18 nt, Salmonella typhimurium LT2
ccgcguuuaagccccugg

SEQ ID NO: 1882978 - RNA, 13 nt, Salmonella typhimurium LT2
ccgcguucugcug

SEQ ID NO: 1882979 - RNA, 17 nt, Salmonella typhimurium LT2
ccgcguucugcugugcc

SEQ ID NO: 1882980 - RNA, 20 nt, Salmonella typhimurium LT2
ccgcguugcgccaagcgccu

SEQ ID NO: 1882981 - RNA, 15 nt, Salmonella typhimurium LT2
ccgcuaucgaccagc

SEQ ID NO: 1882982 - RNA, 14 nt, Salmonella typhimurium LT2
ccgcuacuccgccc

SEQ ID NO: 1882983 - RNA, 18 nt, Salmonella typhimurium LT2
ccgcucaauaauauccug

SEQ ID NO: 1882984 - RNA, 14 nt, Salmonella typhimurium LT2
ccgcucagcucgac

SEQ ID NO: 1882985 - RNA, 18 nt, Salmonella typhimurium LT2
ccgcucgcccgcagcaaa

SEQ ID NO: 1882986 - RNA, 12 nt, Salmonella typhimurium LT2
ccgcucgccgcc

SEQ ID NO: 1882987 - RNA, 14 nt, Salmonella typhimurium LT2
ccgcucgaaucgcc

SEQ ID NO: 1882988 - RNA, 17 nt, Salmonella typhimurium LT2
ccgcuccgcgcauccug

SEQ ID NO: 1882989 - RNA, 18 nt, Salmonella typhimurium LT2
ccgcucccgcauggacaa

SEQ ID NO: 1882990 - RNA, 20 nt, Salmonella typhimurium LT2
ccgcugguugccuuccugau

SEQ ID NO: 1882991 - RNA, 20 nt, Salmonella typhimurium LT2
ccggaaauagagagggccgc

SEQ ID NO: 1882992 - RNA, 22 nt, Salmonella typhimurium LT2
ccggaaauggucgcuccggaac

SEQ ID NO: 1882993 - RNA, 14 nt, Salmonella typhimurium LT2
ccggaacagggccg

SEQ ID NO: 1882994 - RNA, 20 nt, Salmonella typhimurium LT2
ccggaacagggccgcauccc

SEQ ID NO: 1882995 - RNA, 20 nt, Salmonella typhimurium LT2
ccggaacaggcuuuucaggc

SEQ ID NO: 1882996 - RNA, 15 nt, Salmonella typhimurium LT2
ccgcuuuaccgccuu

SEQ ID NO: 1882997 - RNA, 22 nt, Salmonella typhimurium LT2
ccggaaagaauaaucgccgccg

SEQ ID NO: 1882998 - RNA, 23 nt, Salmonella typhimurium LT2
ccggaaagaauaaucgccgccgg

SEQ ID NO: 1882999 - RNA, 21 nt, Salmonella typhimurium LT2
ccggaaaggauauaagcgcca

SEQ ID NO: 1883000 - RNA, 19 nt, Salmonella typhimurium LT2
ccggagaggcguucaugcc

SEQ ID NO: 1883001 - RNA, 17 nt, Salmonella typhimurium LT2
ccggagaccuuuuucau

SEQ ID NO: 1883002 - RNA, 15 nt, Salmonella typhimurium LT2
ccggaauccaccaua

SEQ ID NO: 1883003 - RNA, 15 nt, Salmonella typhimurium LT2
ccggacguacccagg

SEQ ID NO: 1883004 - RNA, 13 nt, Salmonella typhimurium LT2
ccggaacgggcau

SEQ ID NO: 1883005 - RNA, 14 nt, Salmonella typhimurium LT2
ccggaagucauuau

SEQ ID NO: 1883006 - RNA, 19 nt, Salmonella typhimurium LT2
ccgcugacgaccccaggca

SEQ ID NO: 1883007 - RNA, 16 nt, Salmonella typhimurium LT2
ccgcucuucagcgucc

SEQ ID NO: 1883008 - RNA, 22 nt, Salmonella typhimurium LT2
ccgcucgcuuacgcggcgcgcu

SEQ ID NO: 1883009 - RNA, 19 nt, Salmonella typhimurium LT2
ccgcucgcuuacgcggcgc

SEQ ID NO: 1883010 - RNA, 16 nt, Salmonella typhimurium LT2
ccgcugcaacucccgc

SEQ ID NO: 1883011 - RNA, 14 nt, Salmonella typhimurium LT2
ccgcucugcgccag

SEQ ID NO: 1883012 - RNA, 19 nt, Salmonella typhimurium LT2
ccgcugacguuggccgccg

SEQ ID NO: 1883013 - RNA, 24 nt, Salmonella typhimurium LT2
ccgcugacguuggccgccggacag

SEQ ID NO: 1883014 - RNA, 19 nt, Salmonella typhimurium LT2
ccgcugacacgcgcaguac

SEQ ID NO: 1883015 - RNA, 12 nt, Salmonella typhimurium LT2
ccgcuggaauaa

SEQ ID NO: 1883016 - RNA, 13 nt, Salmonella typhimurium LT2
ccgcuggccgguu

SEQ ID NO: 1883017 - RNA, 23 nt, Salmonella typhimurium LT2
ccgcugggauucggcaacaccca

SEQ ID NO: 1883018 - RNA, 15 nt, Salmonella typhimurium LT2
ccgcugcgcacggca

SEQ ID NO: 1883019 - RNA, 17 nt, Salmonella typhimurium LT2
ccgggccugagcgcgca

SEQ ID NO: 1883020 - RNA, 13 nt, Salmonella typhimurium LT2
ccgggccgucagg

SEQ ID NO: 1883021 - RNA, 13 nt, Salmonella typhimurium LT2
ccgggauauaaaa

SEQ ID NO: 1883022 - RNA, 16 nt, Salmonella typhimurium LT2
aaaccugagcauauaa

SEQ ID NO: 1883023 - RNA, 19 nt, Salmonella typhimurium LT2
ccggggaucaagcccccgc

SEQ ID NO: 1883024 - RNA, 18 nt, Salmonella typhimurium LT2
ccgggcggcugucccaga

SEQ ID NO: 1883025 - RNA, 23 nt, Salmonella typhimurium LT2
aaaccggcgcgccuuccagcaau

SEQ ID NO: 1883026 - RNA, 19 nt, Salmonella typhimurium LT2
ccggcggcaaggucugcgc

SEQ ID NO: 1883027 - RNA, 11 nt, Salmonella typhimurium LT2
ccggcggcagu

SEQ ID NO: 1883028 - RNA, 11 nt, Salmonella typhimurium LT2
ccggcucgccu

SEQ ID NO: 1883029 - RNA, 14 nt, Salmonella typhimurium LT2
aaaccggcugccag

SEQ ID NO: 1883030 - RNA, 20 nt, Salmonella typhimurium LT2
aaaccgggcggguguucccu

SEQ ID NO: 1883031 - RNA, 11 nt, Salmonella typhimurium LT2
ccggcucgccc

SEQ ID NO: 1883032 - RNA, 17 nt, Salmonella typhimurium LT2
ccgggagaacgccgggc

SEQ ID NO: 1883033 - RNA, 16 nt, Salmonella typhimurium LT2
ccgggaagaaggcucc

SEQ ID NO: 1883034 - RNA, 20 nt, Salmonella typhimurium LT2
ccggcuguuuugcuucuuca

SEQ ID NO: 1883035 - RNA, 14 nt, Salmonella typhimurium LT2
ccggcgccuccagc

SEQ ID NO: 1883036 - RNA, 17 nt, Salmonella typhimurium LT2
ccggcgcgccuuccagc

SEQ ID NO: 1883037 - RNA, 13 nt, Salmonella typhimurium LT2
ccggcgcggcauc

SEQ ID NO: 1883038 - RNA, 20 nt, Salmonella typhimurium LT2
ccggcgcguuuuggcagaca

SEQ ID NO: 1883039 - RNA, 16 nt, Salmonella typhimurium LT2
ccggcgcgggcgagau

SEQ ID NO: 1883040 - RNA, 14 nt, Salmonella typhimurium LT2
ccggcggaauagcu

SEQ ID NO: 1883041 - RNA, 22 nt, Salmonella typhimurium LT2
ccggcgcuggacaaaccacagu

SEQ ID NO: 1883042 - RNA, 18 nt, Salmonella typhimurium LT2
ccggcgcuaaccagcgcu

SEQ ID NO: 1883043 - RNA, 18 nt, Salmonella typhimurium LT2
ccggcgacgcuuucaccu

SEQ ID NO: 1883044 - RNA, 21 nt, Salmonella typhimurium LT2
ccggcgacguauucccccuga

SEQ ID NO: 1883045 - RNA, 15 nt, Salmonella typhimurium LT2
ccggccuggcgcagc

SEQ ID NO: 1883046 - RNA, 18 nt, Salmonella typhimurium LT2
ccggcgaauagucgccgc

SEQ ID NO: 1883047 - RNA, 13 nt, Salmonella typhimurium LT2
ccggccuggcgca

SEQ ID NO: 1883048 - RNA, 19 nt, Salmonella typhimurium LT2
ccggcgaccacuagcgccg

SEQ ID NO: 1883049 - RNA, 14 nt, Salmonella typhimurium LT2
ccggcgcauccagu

SEQ ID NO: 1883050 - RNA, 21 nt, Salmonella typhimurium LT2
ccggccuacagcugauugaug

SEQ ID NO: 1883051 - RNA, 15 nt, Salmonella typhimurium LT2
ccggccugacgcagc

SEQ ID NO: 1883052 - RNA, 22 nt, Salmonella typhimurium LT2
ccggccucagugaaucgcauca

SEQ ID NO: 1883053 - RNA, 18 nt, Salmonella typhimurium LT2
ccggauaauccagacaaa

SEQ ID NO: 1883054 - RNA, 14 nt, Salmonella typhimurium LT2
ccggauaaggcgcc

SEQ ID NO: 1883055 - RNA, 21 nt, Salmonella typhimurium LT2
ccggauaaggcgcuugugaua

SEQ ID NO: 1883056 - RNA, 23 nt, Salmonella typhimurium LT2
ccggauaaggcggagccgccauc

SEQ ID NO: 1883057 - RNA, 22 nt, Salmonella typhimurium LT2
ccggauaaggcguucacgccgc

SEQ ID NO: 1883058 - RNA, 16 nt, Salmonella typhimurium LT2
ccggauaacggcgcga

SEQ ID NO: 1883059 - RNA, 19 nt, Salmonella typhimurium LT2
ccggauaagcgcagcgcca

SEQ ID NO: 1883060 - RNA, 21 nt, Salmonella typhimurium LT2
ccggaguuuuuccgggccgac

SEQ ID NO: 1883061 - RNA, 17 nt, Salmonella typhimurium LT2
ccgguggcgcugcgcuu

SEQ ID NO: 1883062 - RNA, 13 nt, Salmonella typhimurium LT2
ccggugcgcccca

SEQ ID NO: 1883063 - RNA, 20 nt, Salmonella typhimurium LT2
ccggucauguuccaacaaug

SEQ ID NO: 1883064 - RNA, 20 nt, Salmonella typhimurium LT2
ccgucaaugccgggcagacg

SEQ ID NO: 1883065 - RNA, 16 nt, Salmonella typhimurium LT2
ccgucaacacgcagac

SEQ ID NO: 1883066 - RNA, 19 nt, Salmonella typhimurium LT2
ccguaugacguggccagca

SEQ ID NO: 1883067 - RNA, 21 nt, Salmonella typhimurium LT2
ccguaucguugaccgugaccu

SEQ ID NO: 1883068 - RNA, 18 nt, Salmonella typhimurium LT2
ccguauggucggcgugcc

SEQ ID NO: 1883069 - RNA, 16 nt, Salmonella typhimurium LT2
ccguagcuccagaccu

SEQ ID NO: 1883070 - RNA, 16 nt, Salmonella typhimurium LT2
ccguagcccuggaauc

SEQ ID NO: 1883071 - RNA, 14 nt, Salmonella typhimurium LT2
ccguauccagacca

SEQ ID NO: 1883072 - RNA, 15 nt, Salmonella typhimurium LT2
ccguauccgccacca

SEQ ID NO: 1883073 - RNA, 11 nt, Salmonella typhimurium LT2
ccguaucacug

SEQ ID NO: 1883074 - RNA, 14 nt, Salmonella typhimurium LT2
ccguaaauuccuug

SEQ ID NO: 1883075 - RNA, 16 nt, Salmonella typhimurium LT2
ccguaacgcuccugga

SEQ ID NO: 1883076 - RNA, 20 nt, Salmonella typhimurium LT2
ccgguuugggcgcgaaacug

SEQ ID NO: 1883077 - RNA, 17 nt, Salmonella typhimurium LT2
ccgguuucaauccaugu

SEQ ID NO: 1883078 - RNA, 14 nt, Salmonella typhimurium LT2
ccgguuuuuuccug

SEQ ID NO: 1883079 - RNA, 16 nt, Salmonella typhimurium LT2
ccguaauccaauguuu

SEQ ID NO: 1883080 - RNA, 23 nt, Salmonella typhimurium LT2
ccguaauacuuccggcugcggua

SEQ ID NO: 1883081 - RNA, 21 nt, Salmonella typhimurium LT2
ccguagauaagcgccacgucg

SEQ ID NO: 1883082 - RNA, 22 nt, Salmonella typhimurium LT2
ccguacgcgucacaaucgcgcc

SEQ ID NO: 1883083 - RNA, 14 nt, Salmonella typhimurium LT2
ccguaccgcggcgc

SEQ ID NO: 1883084 - RNA, 19 nt, Salmonella typhimurium LT2
ccguccccagcccaucggu

SEQ ID NO: 1883085 - RNA, 13 nt, Salmonella typhimurium LT2
ccgucccagcgga

SEQ ID NO: 1883086 - RNA, 20 nt, Salmonella typhimurium LT2
ccgucccuuccgccaccagg

SEQ ID NO: 1883087 - RNA, 17 nt, Salmonella typhimurium LT2
ccguccggcaaacccuu

SEQ ID NO: 1883088 - RNA, 14 nt, Salmonella typhimurium LT2
ccgucgcccguccg

SEQ ID NO: 1883089 - RNA, 16 nt, Salmonella typhimurium LT2
ccgucgcccguccgcu

SEQ ID NO: 1883090 - RNA, 15 nt, Salmonella typhimurium LT2
ccgucgaugauggcg

SEQ ID NO: 1883091 - RNA, 19 nt, Salmonella typhimurium LT2
aaacgauuaauaaccaaua

SEQ ID NO: 1883092 - RNA, 16 nt, Salmonella typhimurium LT2
ccgugaagcccggcgg

SEQ ID NO: 1883093 - RNA, 22 nt, Salmonella typhimurium LT2
ccgugaagcccggcggcgcgau

SEQ ID NO: 1883094 - RNA, 14 nt, Salmonella typhimurium LT2
ccgugaccugcuga

SEQ ID NO: 1883095 - RNA, 14 nt, Salmonella typhimurium LT2
ccgucuucauccau

SEQ ID NO: 1883096 - RNA, 18 nt, Salmonella typhimurium LT2
ccgucuuacgaucccacg

SEQ ID NO: 1883097 - RNA, 18 nt, Salmonella typhimurium LT2
ccgucggcgccagccaca

SEQ ID NO: 1883098 - RNA, 16 nt, Salmonella typhimurium LT2
ccgucggcgccagcca

SEQ ID NO: 1883099 - RNA, 13 nt, Salmonella typhimurium LT2
ccguccaggccug

SEQ ID NO: 1883100 - RNA, 15 nt, Salmonella typhimurium LT2
aaaccuuucuucucu

SEQ ID NO: 1883101 - RNA, 13 nt, Salmonella typhimurium LT2
aaacgaaacccaa

SEQ ID NO: 1883102 - RNA, 16 nt, Salmonella typhimurium LT2
aaacgaaaacugggca

SEQ ID NO: 1883103 - RNA, 18 nt, Salmonella typhimurium LT2
ccguccagaccgucauga

SEQ ID NO: 1883104 - RNA, 19 nt, Salmonella typhimurium LT2
ccgucaccacgcgcacgcc

SEQ ID NO: 1883105 - RNA, 18 nt, Salmonella typhimurium LT2
ccgucagagcgaggccca

SEQ ID NO: 1883106 - RNA, 23 nt, Salmonella typhimurium LT2
ccgucagcaacaccaccgcccgc

SEQ ID NO: 1883107 - RNA, 21 nt, Salmonella typhimurium LT2
ccgucagacgauauucaagcu

SEQ ID NO: 1883108 - RNA, 13 nt, Salmonella typhimurium LT2
ccgucagcgcaug

SEQ ID NO: 1883109 - RNA, 16 nt, Salmonella typhimurium LT2
ccgucauccagcagca

SEQ ID NO: 1883110 - RNA, 18 nt, Salmonella typhimurium LT2
ccgucagugagcccuccu

SEQ ID NO: 1883111 - RNA, 16 nt, Salmonella typhimurium LT2
ccgucagucgccagaa

SEQ ID NO: 1883112 - RNA, 15 nt, Salmonella typhimurium LT2
ccgucaucgcccagg

SEQ ID NO: 1883113 - RNA, 18 nt, Salmonella typhimurium LT2
cgcgacuuuuuucaccca

SEQ ID NO: 1883114 - RNA, 19 nt, Salmonella typhimurium LT2
cgcgacuuuggcuuuaucc

SEQ ID NO: 1883115 - RNA, 14 nt, Salmonella typhimurium LT2
cgcgagaacugcug

SEQ ID NO: 1883116 - RNA, 15 nt, Salmonella typhimurium LT2
cgcgauauccaccug

SEQ ID NO: 1883117 - RNA, 16 nt, Salmonella typhimurium LT2
cgcgauacugccgccc

SEQ ID NO: 1883118 - RNA, 23 nt, Salmonella typhimurium LT2
cgcgauaauaauuaccacgcagc

SEQ ID NO: 1883119 - RNA, 19 nt, Salmonella typhimurium LT2
cgcgaucacagacagaugc

SEQ ID NO: 1883120 - RNA, 22 nt, Salmonella typhimurium LT2
cgcgaucaguucuugcaggcag

SEQ ID NO: 1883121 - RNA, 17 nt, Salmonella typhimurium LT2
cgcgaucaucagcacgc

SEQ ID NO: 1883122 - RNA, 14 nt, Salmonella typhimurium LT2
cgcgauccgccagc

SEQ ID NO: 1883123 - RNA, 22 nt, Salmonella typhimurium LT2
cgcgauccucauacagcccgcg

SEQ ID NO: 1883124 - RNA, 23 nt, Salmonella typhimurium LT2
cgccuuuuuuaaauuugaccucg

SEQ ID NO: 1883125 - RNA, 16 nt, Salmonella typhimurium LT2
cgcgaaauagugggga

SEQ ID NO: 1883126 - RNA, 14 nt, Salmonella typhimurium LT2
cgcgaagcggcgcc

SEQ ID NO: 1883127 - RNA, 19 nt, Salmonella typhimurium LT2
cgcgaaggccagcaccagc

SEQ ID NO: 1883128 - RNA, 21 nt, Salmonella typhimurium LT2
cgcgaccggaucaauaaacag

SEQ ID NO: 1883129 - RNA, 12 nt, Salmonella typhimurium LT2
cgccugcuccgu

SEQ ID NO: 1883130 - RNA, 16 nt, Salmonella typhimurium LT2
cgccugcuccaccagc

SEQ ID NO: 1883131 - RNA, 17 nt, Salmonella typhimurium LT2
cgccugcuccgggcggu

SEQ ID NO: 1883132 - RNA, 14 nt, Salmonella typhimurium LT2
cgccugcgcgccug

SEQ ID NO: 1883133 - RNA, 22 nt, Salmonella typhimurium LT2
cgccgucuucuucuucgcgcau

SEQ ID NO: 1883134 - RNA, 22 nt, Salmonella typhimurium LT2
cgccugcgcucauauacccugc

SEQ ID NO: 1883135 - RNA, 21 nt, Salmonella typhimurium LT2
cgccugcggauuuuucgccag

SEQ ID NO: 1883136 - RNA, 14 nt, Salmonella typhimurium LT2
cgccuguuaauggu

SEQ ID NO: 1883137 - RNA, 21 nt, Salmonella typhimurium LT2
cgccugugguuuaaaacggug

SEQ ID NO: 1883138 - RNA, 15 nt, Salmonella typhimurium LT2
cgccugcugccagcc

SEQ ID NO: 1883139 - RNA, 20 nt, Salmonella typhimurium LT2
cgccugcugccagccgccgc

SEQ ID NO: 1883140 - RNA, 22 nt, Salmonella typhimurium LT2
cgccugcugcaacgucgcgccc

SEQ ID NO: 1883141 - RNA, 23 nt, Salmonella typhimurium LT2
cgccugcugcaacgucgcgcccu

SEQ ID NO: 1883142 - RNA, 20 nt, Salmonella typhimurium LT2
cgccuuugccaagaaacgca

SEQ ID NO: 1883143 - RNA, 15 nt, Salmonella typhimurium LT2
cgccuuguccggccu

SEQ ID NO: 1883144 - RNA, 15 nt, Salmonella typhimurium LT2
cgccuuguuuaucag

SEQ ID NO: 1883145 - RNA, 14 nt, Salmonella typhimurium LT2
cgccuugcggcggc

SEQ ID NO: 1883146 - RNA, 23 nt, Salmonella typhimurium LT2
cgccuugacaggaaacagguacu

SEQ ID NO: 1883147 - RNA, 15 nt, Salmonella typhimurium LT2
cgccuguuucugcgc

SEQ ID NO: 1883148 - RNA, 14 nt, Salmonella typhimurium LT2
cgccuucuucaucu

SEQ ID NO: 1883149 - RNA, 16 nt, Salmonella typhimurium LT2
cgcgccuccccugccg

SEQ ID NO: 1883150 - RNA, 11 nt, Salmonella typhimurium LT2
cgcgccguucg

SEQ ID NO: 1883151 - RNA, 15 nt, Salmonella typhimurium LT2
cgcgccgugcccagc

SEQ ID NO: 1883152 - RNA, 15 nt, Salmonella typhimurium LT2
cgcgccuccggccug

SEQ ID NO: 1883153 - RNA, 16 nt, Salmonella typhimurium LT2
cgcgccugacgcggac

SEQ ID NO: 1883154 - RNA, 13 nt, Salmonella typhimurium LT2
cgcgcgccgccug

SEQ ID NO: 1883155 - RNA, 12 nt, Salmonella typhimurium LT2
cgcgcgccgccu

SEQ ID NO: 1883156 - RNA, 21 nt, Salmonella typhimurium LT2
cgcgcgccgcuuccggcaggu

SEQ ID NO: 1883157 - RNA, 12 nt, Salmonella typhimurium LT2
cgcgccgcgcag

SEQ ID NO: 1883158 - RNA, 13 nt, Salmonella typhimurium LT2
cgcgccgcgcgca

SEQ ID NO: 1883159 - RNA, 18 nt, Salmonella typhimurium LT2
cgcgccgccucgaucucc

SEQ ID NO: 1883160 - RNA, 14 nt, Salmonella typhimurium LT2
cgcgcccgacgcgc

SEQ ID NO: 1883161 - RNA, 20 nt, Salmonella typhimurium LT2
cgcgcccgccaccagcacag

SEQ ID NO: 1883162 - RNA, 13 nt, Salmonella typhimurium LT2
cgcgcccgcuucc

SEQ ID NO: 1883163 - RNA, 21 nt, Salmonella typhimurium LT2
cgcgccaauccaugccggcuu

SEQ ID NO: 1883164 - RNA, 19 nt, Salmonella typhimurium LT2
cgcgccaauggccgccccc

SEQ ID NO: 1883165 - RNA, 17 nt, Salmonella typhimurium LT2
cgcgccauuugccagau

SEQ ID NO: 1883166 - RNA, 14 nt, Salmonella typhimurium LT2
cgcgcccagcagca

SEQ ID NO: 1883167 - RNA, 14 nt, Salmonella typhimurium LT2
cgcgcccagcgccg

SEQ ID NO: 1883168 - RNA, 20 nt, Salmonella typhimurium LT2
cgcgccaaaagaggcagcaa

SEQ ID NO: 1883169 - RNA, 16 nt, Salmonella typhimurium LT2
cgcgcacgccgcucga

SEQ ID NO: 1883170 - RNA, 13 nt, Salmonella typhimurium LT2
cgcgcacgcgcgc

SEQ ID NO: 1883171 - RNA, 18 nt, Salmonella typhimurium LT2
cgcgcaaccgcaucacgc

SEQ ID NO: 1883172 - RNA, 23 nt, Salmonella typhimurium LT2
cgcgcaaccgcaucacgcgaagc

SEQ ID NO: 1883173 - RNA, 18 nt, Salmonella typhimurium LT2
cgcgcaaagggugaaauc

SEQ ID NO: 1883174 - RNA, 22 nt, Salmonella typhimurium LT2
cgcgcaaagggugaaaucacgc

SEQ ID NO: 1883175 - RNA, 13 nt, Salmonella typhimurium LT2
cgcgaucgcgcca

SEQ ID NO: 1883176 - RNA, 19 nt, Salmonella typhimurium LT2
cgcgaucgaugugauaaau

SEQ ID NO: 1883177 - RNA, 17 nt, Salmonella typhimurium LT2
cgcgaucgcgccagccu

SEQ ID NO: 1883178 - RNA, 14 nt, Salmonella typhimurium LT2
cgcgaugcaucuug

SEQ ID NO: 1883179 - RNA, 21 nt, Salmonella typhimurium LT2
cgcgguucuguuccgcuaucu

SEQ ID NO: 1883180 - RNA, 22 nt, Salmonella typhimurium LT2
cgcggucgggauauaugcaaaa

SEQ ID NO: 1883181 - RNA, 18 nt, Salmonella typhimurium LT2
cgcggugauccuccugca

SEQ ID NO: 1883182 - RNA, 23 nt, Salmonella typhimurium LT2
cgcggugaaugcgcggcugcgga

SEQ ID NO: 1883183 - RNA, 23 nt, Salmonella typhimurium LT2
cgcggugacuuuggccggcuucu

SEQ ID NO: 1883184 - RNA, 20 nt, Salmonella typhimurium LT2
cgcggguuuuuacuuuccau

SEQ ID NO: 1883185 - RNA, 18 nt, Salmonella typhimurium LT2
cgcgguauucauaccuuu

SEQ ID NO: 1883186 - RNA, 19 nt, Salmonella typhimurium LT2
cgcgguauuucgccgccgc

SEQ ID NO: 1883187 - RNA, 12 nt, Salmonella typhimurium LT2
cgcggucagcgg

SEQ ID NO: 1883188 - RNA, 23 nt, Salmonella typhimurium LT2
cgcggucagggugaaucccgcca

SEQ ID NO: 1883189 - RNA, 19 nt, Salmonella typhimurium LT2
cgcgucaacggcgcggcgu

SEQ ID NO: 1883190 - RNA, 19 nt, Salmonella typhimurium LT2
cgcguauucucaaccagcc

SEQ ID NO: 1883191 - RNA, 17 nt, Salmonella typhimurium LT2
cgcguauucucaaccag

SEQ ID NO: 1883192 - RNA, 15 nt, Salmonella typhimurium LT2
cgcguauaacgccgc

SEQ ID NO: 1883193 - RNA, 19 nt, Salmonella typhimurium LT2
cgcguagguuggcugaggc

SEQ ID NO: 1883194 - RNA, 14 nt, Salmonella typhimurium LT2
cgcgucccucucca

SEQ ID NO: 1883195 - RNA, 15 nt, Salmonella typhimurium LT2
cgcgucccucuccag

SEQ ID NO: 1883196 - RNA, 16 nt, Salmonella typhimurium LT2
cgcgucccucuccagg

SEQ ID NO: 1883197 - RNA, 12 nt, Salmonella typhimurium LT2
cgcguccggggc

SEQ ID NO: 1883198 - RNA, 13 nt, Salmonella typhimurium LT2
cgcguccggggcc

SEQ ID NO: 1883199 - RNA, 14 nt, Salmonella typhimurium LT2
cgcguccggggcca

SEQ ID NO: 1883200 - RNA, 19 nt, Salmonella typhimurium LT2
cgcguccggggccagcgcc

SEQ ID NO: 1883201 - RNA, 13 nt, Salmonella typhimurium LT2
cgcguaccagcgc

SEQ ID NO: 1883202 - RNA, 18 nt, Salmonella typhimurium LT2
cgcguagcccagcgccgc

SEQ ID NO: 1883203 - RNA, 17 nt, Salmonella typhimurium LT2
cgcguagccucgcuucu

SEQ ID NO: 1883204 - RNA, 18 nt, Salmonella typhimurium LT2
cgcguagcccacagguag

SEQ ID NO: 1883205 - RNA, 14 nt, Salmonella typhimurium LT2
cgcguagcccagcg

SEQ ID NO: 1883206 - RNA, 16 nt, Salmonella typhimurium LT2
cgcguagcccagcgcc

SEQ ID NO: 1883207 - RNA, 15 nt, Salmonella typhimurium LT2
cgcgguuuccacacc

SEQ ID NO: 1883208 - RNA, 19 nt, Salmonella typhimurium LT2
cgcguaaucucccacccgc

SEQ ID NO: 1883209 - RNA, 16 nt, Salmonella typhimurium LT2
cgcguaacgccuccac

SEQ ID NO: 1883210 - RNA, 17 nt, Salmonella typhimurium LT2
cgcguaaccccugcccg

SEQ ID NO: 1883211 - RNA, 15 nt, Salmonella typhimurium LT2
cgcguggguucacag

SEQ ID NO: 1883212 - RNA, 16 nt, Salmonella typhimurium LT2
cgcguuuuccauuuua

SEQ ID NO: 1883213 - RNA, 23 nt, Salmonella typhimurium LT2
cgcguuuuccucgucgcgcgccg

SEQ ID NO: 1883214 - RNA, 13 nt, Salmonella typhimurium LT2
cgcguuuuccauu

SEQ ID NO: 1883215 - RNA, 23 nt, Salmonella typhimurium LT2
cgcguucauccagcgcgcggcau

SEQ ID NO: 1883216 - RNA, 13 nt, Salmonella typhimurium LT2
cgcguuagccggg

SEQ ID NO: 1883217 - RNA, 17 nt, Salmonella typhimurium LT2
cgcguuccaucgcuuua

SEQ ID NO: 1883218 - RNA, 22 nt, Salmonella typhimurium LT2
cgcgucguucacgucgcgaagc

SEQ ID NO: 1883219 - RNA, 21 nt, Salmonella typhimurium LT2
cgcgucugaaugacgccgucu

SEQ ID NO: 1883220 - RNA, 16 nt, Salmonella typhimurium LT2
cgcgucggcgcgggga

SEQ ID NO: 1883221 - RNA, 15 nt, Salmonella typhimurium LT2
cgcggcgguucaucc

SEQ ID NO: 1883222 - RNA, 18 nt, Salmonella typhimurium LT2
cgcggcguaccgcgcgcc

SEQ ID NO: 1883223 - RNA, 19 nt, Salmonella typhimurium LT2
cgcggcuucaucaccaucg

SEQ ID NO: 1883224 - RNA, 12 nt, Salmonella typhimurium LT2
cgcggggaacac

SEQ ID NO: 1883225 - RNA, 15 nt, Salmonella typhimurium LT2
cgcggcaggccggca

SEQ ID NO: 1883226 - RNA, 14 nt, Salmonella typhimurium LT2
cgcggcagcgcgca

SEQ ID NO: 1883227 - RNA, 20 nt, Salmonella typhimurium LT2
cgcggcaucguagucaggca

SEQ ID NO: 1883228 - RNA, 23 nt, Salmonella typhimurium LT2
cgcggcauauuuuuuccccgcuu

SEQ ID NO: 1883229 - RNA, 22 nt, Salmonella typhimurium LT2
cgcggcacacuuucaucagccg

SEQ ID NO: 1883230 - RNA, 15 nt, Salmonella typhimurium LT2
cgcggcaaccagccc

SEQ ID NO: 1883231 - RNA, 19 nt, Salmonella typhimurium LT2
cgcggcaaccagcccauga

SEQ ID NO: 1883232 - RNA, 22 nt, Salmonella typhimurium LT2
cgcggauaccuaacagccgcgg

SEQ ID NO: 1883233 - RNA, 22 nt, Salmonella typhimurium LT2
cgcggccaaaacccaccagcag

SEQ ID NO: 1883234 - RNA, 18 nt, Salmonella typhimurium LT2
cgcggcauuucccuuccc

SEQ ID NO: 1883235 - RNA, 13 nt, Salmonella typhimurium LT2
cgcggccaaaacc

SEQ ID NO: 1883236 - RNA, 16 nt, Salmonella typhimurium LT2
cgcggccaaaacccac

SEQ ID NO: 1883237 - RNA, 20 nt, Salmonella typhimurium LT2
cgcggccaaaacccaccagc

SEQ ID NO: 1883238 - RNA, 15 nt, Salmonella typhimurium LT2
cgcgcuuccugccag

SEQ ID NO: 1883239 - RNA, 19 nt, Salmonella typhimurium LT2
cgcgcgcuuucaccgccuc

SEQ ID NO: 1883240 - RNA, 14 nt, Salmonella typhimurium LT2
cgcccgccaccagc

SEQ ID NO: 1883241 - RNA, 14 nt, Salmonella typhimurium LT2
cgcccgcagcaaaa

SEQ ID NO: 1883242 - RNA, 11 nt, Salmonella typhimurium LT2
cgcccgccaga

SEQ ID NO: 1883243 - RNA, 19 nt, Salmonella typhimurium LT2
cgcccgauaauaucacucc

SEQ ID NO: 1883244 - RNA, 15 nt, Salmonella typhimurium LT2
cgcccgaccacgccc

SEQ ID NO: 1883245 - RNA, 13 nt, Salmonella typhimurium LT2
cgccccgaccagg

SEQ ID NO: 1883246 - RNA, 20 nt, Salmonella typhimurium LT2
cgccccagaagagcgagucu

SEQ ID NO: 1883247 - RNA, 21 nt, Salmonella typhimurium LT2
cgcccauuccgccugccgcgc

SEQ ID NO: 1883248 - RNA, 16 nt, Salmonella typhimurium LT2
cgcccauuccgccugc

SEQ ID NO: 1883249 - RNA, 12 nt, Salmonella typhimurium LT2
cgccccaaagcg

SEQ ID NO: 1883250 - RNA, 21 nt, Salmonella typhimurium LT2
cgccccaaaucucccccggca

SEQ ID NO: 1883251 - RNA, 17 nt, Salmonella typhimurium LT2
cgcccaguccuuccggc

SEQ ID NO: 1883252 - RNA, 20 nt, Salmonella typhimurium LT2
cgcccaguuucuucaggcca

SEQ ID NO: 1883253 - RNA, 16 nt, Salmonella typhimurium LT2
cgccacggccagcagc

SEQ ID NO: 1883254 - RNA, 14 nt, Salmonella typhimurium LT2
cgccacgcuccagc

SEQ ID NO: 1883255 - RNA, 20 nt, Salmonella typhimurium LT2
cgccacgcgacgccagccga

SEQ ID NO: 1883256 - RNA, 17 nt, Salmonella typhimurium LT2
cgccacgcgacgccagc

SEQ ID NO: 1883257 - RNA, 15 nt, Salmonella typhimurium LT2
cgccaugccgcgccu

SEQ ID NO: 1883258 - RNA, 21 nt, Salmonella typhimurium LT2
cgccaugaccugggcgccaga

SEQ ID NO: 1883259 - RNA, 20 nt, Salmonella typhimurium LT2
cgccaugacgccaagcugca

SEQ ID NO: 1883260 - RNA, 14 nt, Salmonella typhimurium LT2
cgccaugauccagc

SEQ ID NO: 1883261 - RNA, 17 nt, Salmonella typhimurium LT2
cgccaucuccuccucau

SEQ ID NO: 1883262 - RNA, 16 nt, Salmonella typhimurium LT2
cgccaucuucacgcag

SEQ ID NO: 1883263 - RNA, 22 nt, Salmonella typhimurium LT2
cgccaucuaaauuucaguauua

SEQ ID NO: 1883264 - RNA, 18 nt, Salmonella typhimurium LT2
cgccaucucauucgccag

SEQ ID NO: 1883265 - RNA, 16 nt, Salmonella typhimurium LT2
cgccaucuccggcagc

SEQ ID NO: 1883266 - RNA, 17 nt, Salmonella typhimurium LT2
cgccaucuccggcagcg

SEQ ID NO: 1883267 - RNA, 19 nt, Salmonella typhimurium LT2
cgccaugcggaaucacgca

SEQ ID NO: 1883268 - RNA, 19 nt, Salmonella typhimurium LT2
cgccaugcuuuccgggccu

SEQ ID NO: 1883269 - RNA, 15 nt, Salmonella typhimurium LT2
cgccauggccgcagc

SEQ ID NO: 1883270 - RNA, 18 nt, Salmonella typhimurium LT2
cgccaugucuucgcgcgu

SEQ ID NO: 1883271 - RNA, 13 nt, Salmonella typhimurium LT2
cgcccaccagucc

SEQ ID NO: 1883272 - RNA, 20 nt, Salmonella typhimurium LT2
cgcccagccugcccgccuga

SEQ ID NO: 1883273 - RNA, 15 nt, Salmonella typhimurium LT2
cgcccagcagggcca

SEQ ID NO: 1883274 - RNA, 23 nt, Salmonella typhimurium LT2
cgccgcccaucgggccgcucagc

SEQ ID NO: 1883275 - RNA, 14 nt, Salmonella typhimurium LT2
cgccgccaucaacg

SEQ ID NO: 1883276 - RNA, 13 nt, Salmonella typhimurium LT2
cgccgccaccaug

SEQ ID NO: 1883277 - RNA, 21 nt, Salmonella typhimurium LT2
cgccgccaccauguugcgcag

SEQ ID NO: 1883278 - RNA, 22 nt, Salmonella typhimurium LT2
cgccgccaccauguugcgcagc

SEQ ID NO: 1883279 - RNA, 13 nt, Salmonella typhimurium LT2
cgccgccaccaaa

SEQ ID NO: 1883280 - RNA, 18 nt, Salmonella typhimurium LT2
cgccgcaggccaucauac

SEQ ID NO: 1883281 - RNA, 16 nt, Salmonella typhimurium LT2
cgccgcagcuccaugu

SEQ ID NO: 1883282 - RNA, 18 nt, Salmonella typhimurium LT2
cgccgcagcgccugcgcc

SEQ ID NO: 1883283 - RNA, 17 nt, Salmonella typhimurium LT2
cgccgcauugguaaauc

SEQ ID NO: 1883284 - RNA, 19 nt, Salmonella typhimurium LT2
cgccgcauccuguaccacc

SEQ ID NO: 1883285 - RNA, 16 nt, Salmonella typhimurium LT2
cgccgacgacaggcag

SEQ ID NO: 1883286 - RNA, 21 nt, Salmonella typhimurium LT2
cgccgauaaccagcgcgccgc

SEQ ID NO: 1883287 - RNA, 17 nt, Salmonella typhimurium LT2
cgccgauagcggcggcg

SEQ ID NO: 1883288 - RNA, 22 nt, Salmonella typhimurium LT2
cgcccggugauggugcagcccc

SEQ ID NO: 1883289 - RNA, 16 nt, Salmonella typhimurium LT2
cgcccuccuguugaac

SEQ ID NO: 1883290 - RNA, 23 nt, Salmonella typhimurium LT2
cgcccggagggguuuucgccagc

SEQ ID NO: 1883291 - RNA, 11 nt, Salmonella typhimurium LT2
cgcccgcuuca

SEQ ID NO: 1883292 - RNA, 16 nt, Salmonella typhimurium LT2
cgcccgccucgcugau

SEQ ID NO: 1883293 - RNA, 18 nt, Salmonella typhimurium LT2
cgcccugcucccacagcu

SEQ ID NO: 1883294 - RNA, 21 nt, Salmonella typhimurium LT2
cgcccuggaggaacagcgccg

SEQ ID NO: 1883295 - RNA, 16 nt, Salmonella typhimurium LT2
cgcccugcucccacag

SEQ ID NO: 1883296 - RNA, 17 nt, Salmonella typhimurium LT2
cgcccucucuccgccug

SEQ ID NO: 1883297 - RNA, 23 nt, Salmonella typhimurium LT2
cgcccuguggaaacuccagcggc

SEQ ID NO: 1883298 - RNA, 20 nt, Salmonella typhimurium LT2
cgccgacaaucgucacuuca

SEQ ID NO: 1883299 - RNA, 13 nt, Salmonella typhimurium LT2
cgccgacaaaucc

SEQ ID NO: 1883300 - RNA, 22 nt, Salmonella typhimurium LT2
cgccgacaaauccuccggcgcg

SEQ ID NO: 1883301 - RNA, 22 nt, Salmonella typhimurium LT2
cgccggcaacagguaccccgcc

SEQ ID NO: 1883302 - RNA, 13 nt, Salmonella typhimurium LT2
cgccggcaaagcc

SEQ ID NO: 1883303 - RNA, 14 nt, Salmonella typhimurium LT2
cgccggacggcgca

SEQ ID NO: 1883304 - RNA, 19 nt, Salmonella typhimurium LT2
cgccggaaucgcgauccag

SEQ ID NO: 1883305 - RNA, 19 nt, Salmonella typhimurium LT2
cgccggaugcgccgugcuu

SEQ ID NO: 1883306 - RNA, 14 nt, Salmonella typhimurium LT2
cgccggccccgcuu

SEQ ID NO: 1883307 - RNA, 23 nt, Salmonella typhimurium LT2
cgccgggcgucacccgccggcag

SEQ ID NO: 1883308 - RNA, 23 nt, Salmonella typhimurium LT2
cgccgggauaaaacaccacaaag

SEQ ID NO: 1883309 - RNA, 15 nt, Salmonella typhimurium LT2
cgccggucaugccau

SEQ ID NO: 1883310 - RNA, 12 nt, Salmonella typhimurium LT2
cgccgucggcag

SEQ ID NO: 1883311 - RNA, 19 nt, Salmonella typhimurium LT2
cgccguagcugcgcgccgc

SEQ ID NO: 1883312 - RNA, 17 nt, Salmonella typhimurium LT2
cgccguacuccagccca

SEQ ID NO: 1883313 - RNA, 15 nt, Salmonella typhimurium LT2
cgccguaaccgccug

SEQ ID NO: 1883314 - RNA, 14 nt, Salmonella typhimurium LT2
cgccguaaaacaac

SEQ ID NO: 1883315 - RNA, 21 nt, Salmonella typhimurium LT2
cgccguaacgugcuccagcgc

SEQ ID NO: 1883316 - RNA, 22 nt, Salmonella typhimurium LT2
aaacguugcuggacauauucca

SEQ ID NO: 1883317 - RNA, 16 nt, Salmonella typhimurium LT2
aaacguugaugauaaa

SEQ ID NO: 1883318 - RNA, 20 nt, Salmonella typhimurium LT2
aaacguguuuauccccgcug

SEQ ID NO: 1883319 - RNA, 13 nt, Salmonella typhimurium LT2
aaacgucaugcug

SEQ ID NO: 1883320 - RNA, 23 nt, Salmonella typhimurium LT2
aaacgucccgacgaauaacaaaa

SEQ ID NO: 1883321 - RNA, 16 nt, Salmonella typhimurium LT2
aaacgucguaaaaccu

SEQ ID NO: 1883322 - RNA, 17 nt, Salmonella typhimurium LT2
aaacgucguaaaaccug

SEQ ID NO: 1883323 - RNA, 13 nt, Salmonella typhimurium LT2
aaacgugaaauau

SEQ ID NO: 1883324 - RNA, 16 nt, Salmonella typhimurium LT2
cgccgcgggcagcagc

SEQ ID NO: 1883325 - RNA, 17 nt, Salmonella typhimurium LT2
cgccgcgggcagcagca

SEQ ID NO: 1883326 - RNA, 16 nt, Salmonella typhimurium LT2
cgccgcugcgagcagc

SEQ ID NO: 1883327 - RNA, 15 nt, Salmonella typhimurium LT2
cgccgcuuccaggcg

SEQ ID NO: 1883328 - RNA, 13 nt, Salmonella typhimurium LT2
cgccgcuggcggg

SEQ ID NO: 1883329 - RNA, 19 nt, Salmonella typhimurium LT2
cgccgcuucgucgucgucc

SEQ ID NO: 1883330 - RNA, 17 nt, Salmonella typhimurium LT2
cgccgcuuuuuccgccg

SEQ ID NO: 1883331 - RNA, 18 nt, Salmonella typhimurium LT2
cgccgcuuuuuccgccgc

SEQ ID NO: 1883332 - RNA, 17 nt, Salmonella typhimurium LT2
cgccgcuuuaaucacca

SEQ ID NO: 1883333 - RNA, 20 nt, Salmonella typhimurium LT2
cgccggaaaaccggucauau

SEQ ID NO: 1883334 - RNA, 22 nt, Salmonella typhimurium LT2
cgccggaaagaauaaucgccgc

SEQ ID NO: 1883335 - RNA, 19 nt, Salmonella typhimurium LT2
cgccgcuaucgaccagcac

SEQ ID NO: 1883336 - RNA, 21 nt, Salmonella typhimurium LT2
cgccgcuaucgccgacccggc

SEQ ID NO: 1883337 - RNA, 16 nt, Salmonella typhimurium LT2
cgccgcuacucagccc

SEQ ID NO: 1883338 - RNA, 16 nt, Salmonella typhimurium LT2
cgccgccuaucgccag

SEQ ID NO: 1883339 - RNA, 13 nt, Salmonella typhimurium LT2
cgccgccuccccc

SEQ ID NO: 1883340 - RNA, 15 nt, Salmonella typhimurium LT2
cgccgccucccccuc

SEQ ID NO: 1883341 - RNA, 18 nt, Salmonella typhimurium LT2
cgccgccguccaggccug

SEQ ID NO: 1883342 - RNA, 13 nt, Salmonella typhimurium LT2
cgccgccgggccg

SEQ ID NO: 1883343 - RNA, 12 nt, Salmonella typhimurium LT2
cgccgccugcuc

SEQ ID NO: 1883344 - RNA, 13 nt, Salmonella typhimurium LT2
cgccgccucuuca

SEQ ID NO: 1883345 - RNA, 21 nt, Salmonella typhimurium LT2
cgccgccucgcgauccgccag

SEQ ID NO: 1883346 - RNA, 16 nt, Salmonella typhimurium LT2
cgccgccuuagcgacc

SEQ ID NO: 1883347 - RNA, 16 nt, Salmonella typhimurium LT2
cgccgccuucugcacc

SEQ ID NO: 1883348 - RNA, 15 nt, Salmonella typhimurium LT2
cgccgcgccgcccca

SEQ ID NO: 1883349 - RNA, 20 nt, Salmonella typhimurium LT2
cgccgcgauguuugcucgcc

SEQ ID NO: 1883350 - RNA, 21 nt, Salmonella typhimurium LT2
cgccgcgauguuugcucgcca

SEQ ID NO: 1883351 - RNA, 17 nt, Salmonella typhimurium LT2
cgccgcgaugcaucuug

SEQ ID NO: 1883352 - RNA, 13 nt, Salmonella typhimurium LT2
cgauugucaucau

SEQ ID NO: 1883353 - RNA, 17 nt, Salmonella typhimurium LT2
cgaugucguccugcgcg

SEQ ID NO: 1883354 - RNA, 14 nt, Salmonella typhimurium LT2
cgaugugcugggga

SEQ ID NO: 1883355 - RNA, 20 nt, Salmonella typhimurium LT2
cgcaaaacucugagcauaca

SEQ ID NO: 1883356 - RNA, 18 nt, Salmonella typhimurium LT2
cgcaaacgccgaagccaa

SEQ ID NO: 1883357 - RNA, 12 nt, Salmonella typhimurium LT2
cgcaaaccgcuu

SEQ ID NO: 1883358 - RNA, 22 nt, Salmonella typhimurium LT2
cgcaaacuuugcgccauuucaa

SEQ ID NO: 1883359 - RNA, 17 nt, Salmonella typhimurium LT2
cgcaaacuggccacagc

SEQ ID NO: 1883360 - RNA, 15 nt, Salmonella typhimurium LT2
cgcaaaagcgcgccc

SEQ ID NO: 1883361 - RNA, 12 nt, Salmonella typhimurium LT2
cgcaaaaaauau

SEQ ID NO: 1883362 - RNA, 19 nt, Salmonella typhimurium LT2
cgauuuuugaucucuuuag

SEQ ID NO: 1883363 - RNA, 16 nt, Salmonella typhimurium LT2
cgauuuuaugcauggu

SEQ ID NO: 1883364 - RNA, 18 nt, Salmonella typhimurium LT2
cgaugccuuaugcccggc

SEQ ID NO: 1883365 - RNA, 23 nt, Salmonella typhimurium LT2
cgaugaugauuaaugcugcacca

SEQ ID NO: 1883366 - RNA, 21 nt, Salmonella typhimurium LT2
cgaugaucuugcucaauaaua

SEQ ID NO: 1883367 - RNA, 15 nt, Salmonella typhimurium LT2
cgaugauagugucca

SEQ ID NO: 1883368 - RNA, 14 nt, Salmonella typhimurium LT2
cgauauuuuucuug

SEQ ID NO: 1883369 - RNA, 21 nt, Salmonella typhimurium LT2
cgaugcggaaauagcggugcc

SEQ ID NO: 1883370 - RNA, 14 nt, Salmonella typhimurium LT2
cgaugcggauccgg

SEQ ID NO: 1883371 - RNA, 22 nt, Salmonella typhimurium LT2
cgaugcucagggcauccgccgc

SEQ ID NO: 1883372 - RNA, 15 nt, Salmonella typhimurium LT2
cgaugcguucaaaaa

SEQ ID NO: 1883373 - RNA, 21 nt, Salmonella typhimurium LT2
cgaugcugaauagccagcccc

SEQ ID NO: 1883374 - RNA, 14 nt, Salmonella typhimurium LT2
cgaugcugcuucag

SEQ ID NO: 1883375 - RNA, 18 nt, Salmonella typhimurium LT2
cgaugcugcuucaguaaa

SEQ ID NO: 1883376 - RNA, 23 nt, Salmonella typhimurium LT2
cgaugguaugcgaagguggcgga

SEQ ID NO: 1883377 - RNA, 22 nt, Salmonella typhimurium LT2
cgauggaaagaacacaggcagc

SEQ ID NO: 1883378 - RNA, 14 nt, Salmonella typhimurium LT2
cgcaccacugcugu

SEQ ID NO: 1883379 - RNA, 15 nt, Salmonella typhimurium LT2
cgcaccacgccgaag

SEQ ID NO: 1883380 - RNA, 14 nt, Salmonella typhimurium LT2
cgcacuacaucauu

SEQ ID NO: 1883381 - RNA, 14 nt, Salmonella typhimurium LT2
cgcacucgccgcca

SEQ ID NO: 1883382 - RNA, 11 nt, Salmonella typhimurium LT2
cgcacguucag

SEQ ID NO: 1883383 - RNA, 16 nt, Salmonella typhimurium LT2
cgcacguucagcucag

SEQ ID NO: 1883384 - RNA, 19 nt, Salmonella typhimurium LT2
cgcacgccagauaaaucag

SEQ ID NO: 1883385 - RNA, 15 nt, Salmonella typhimurium LT2
cgcacacgccgugca

SEQ ID NO: 1883386 - RNA, 13 nt, Salmonella typhimurium LT2
cgcacacccugca

SEQ ID NO: 1883387 - RNA, 22 nt, Salmonella typhimurium LT2
cgcacaaucgccgugaucccaa

SEQ ID NO: 1883388 - RNA, 23 nt, Salmonella typhimurium LT2
cgcacaaagcguucggccugcug

SEQ ID NO: 1883389 - RNA, 23 nt, Salmonella typhimurium LT2
cgcacagcagacaaccgacgcau

SEQ ID NO: 1883390 - RNA, 14 nt, Salmonella typhimurium LT2
cgcacagaaucacc

SEQ ID NO: 1883391 - RNA, 16 nt, Salmonella typhimurium LT2
cgcaacguuucuuuca

SEQ ID NO: 1883392 - RNA, 19 nt, Salmonella typhimurium LT2
cgcaacuuagcguccacuc

SEQ ID NO: 1883393 - RNA, 23 nt, Salmonella typhimurium LT2
cgcaauugguaauuaaaggcagc

SEQ ID NO: 1883394 - RNA, 16 nt, Salmonella typhimurium LT2
cgcaaagcccaucagc

SEQ ID NO: 1883395 - RNA, 18 nt, Salmonella typhimurium LT2
cgcaaagggugaaaucac

SEQ ID NO: 1883396 - RNA, 19 nt, Salmonella typhimurium LT2
cgcaaauucaucgccgccg

SEQ ID NO: 1883397 - RNA, 16 nt, Salmonella typhimurium LT2
cgcaaauugcgcgccc

SEQ ID NO: 1883398 - RNA, 23 nt, Salmonella typhimurium LT2
cgcaacaauggucgcgccgucgc

SEQ ID NO: 1883399 - RNA, 15 nt, Salmonella typhimurium LT2
cgcaaccuuaaggcc

SEQ ID NO: 1883400 - RNA, 21 nt, Salmonella typhimurium LT2
cgcaacauuuuuguuaauauu

SEQ ID NO: 1883401 - RNA, 15 nt, Salmonella typhimurium LT2
cgcaggcuugcccau

SEQ ID NO: 1883402 - RNA, 13 nt, Salmonella typhimurium LT2
cgcaggcucgucg

SEQ ID NO: 1883403 - RNA, 16 nt, Salmonella typhimurium LT2
cgcaggcggcuggcgu

SEQ ID NO: 1883404 - RNA, 16 nt, Salmonella typhimurium LT2
cgcaggccguuggcuu

SEQ ID NO: 1883405 - RNA, 12 nt, Salmonella typhimurium LT2
cgcaggcggcca

SEQ ID NO: 1883406 - RNA, 22 nt, Salmonella typhimurium LT2
cgcaggcauuaaaaaaacguag

SEQ ID NO: 1883407 - RNA, 22 nt, Salmonella typhimurium LT2
cgcaggcccgauaagcgccgcg

SEQ ID NO: 1883408 - RNA, 14 nt, Salmonella typhimurium LT2
cgcaggccaggcgu

SEQ ID NO: 1883409 - RNA, 22 nt, Salmonella typhimurium LT2
cgcaggauaaagaccggcacaa

SEQ ID NO: 1883410 - RNA, 14 nt, Salmonella typhimurium LT2
cgcagaucgccugg

SEQ ID NO: 1883411 - RNA, 14 nt, Salmonella typhimurium LT2
cgcagaaccgccgc

SEQ ID NO: 1883412 - RNA, 13 nt, Salmonella typhimurium LT2
cgcagcggcugcg

SEQ ID NO: 1883413 - RNA, 12 nt, Salmonella typhimurium LT2
cgcagcggcggu

SEQ ID NO: 1883414 - RNA, 20 nt, Salmonella typhimurium LT2
cgcagcguugauccgugccc

SEQ ID NO: 1883415 - RNA, 15 nt, Salmonella typhimurium LT2
cgcaugacccaggca

SEQ ID NO: 1883416 - RNA, 18 nt, Salmonella typhimurium LT2
cgcaucaggaucuucauc

SEQ ID NO: 1883417 - RNA, 22 nt, Salmonella typhimurium LT2
cgcaucaggaucuucaucccau

SEQ ID NO: 1883418 - RNA, 18 nt, Salmonella typhimurium LT2
aaacggccagugaaauaa

SEQ ID NO: 1883419 - RNA, 23 nt, Salmonella typhimurium LT2
aaacggcagccgccaccacaaag

SEQ ID NO: 1883420 - RNA, 17 nt, Salmonella typhimurium LT2
aaacggccugcgcugga

SEQ ID NO: 1883421 - RNA, 23 nt, Salmonella typhimurium LT2
aaacggcgguuuuuuuauccauu

SEQ ID NO: 1883422 - RNA, 16 nt, Salmonella typhimurium LT2
cgcaucacggcagcac

SEQ ID NO: 1883423 - RNA, 15 nt, Salmonella typhimurium LT2
cgcaucaccgcgcac

SEQ ID NO: 1883424 - RNA, 23 nt, Salmonella typhimurium LT2
cgcauauuuuuuaccgcccgcuu

SEQ ID NO: 1883425 - RNA, 21 nt, Salmonella typhimurium LT2
cgcauagauauaaacgcccga

SEQ ID NO: 1883426 - RNA, 21 nt, Salmonella typhimurium LT2
cgcauaggcuuugcugagcgc

SEQ ID NO: 1883427 - RNA, 12 nt, Salmonella typhimurium LT2
cgcauucauaag

SEQ ID NO: 1883428 - RNA, 20 nt, Salmonella typhimurium LT2
cgcauucuucagcgcguccu

SEQ ID NO: 1883429 - RNA, 16 nt, Salmonella typhimurium LT2
cgcauuccccaccaca

SEQ ID NO: 1883430 - RNA, 23 nt, Salmonella typhimurium LT2
cgcauuuaaucgccugcgcgccu

SEQ ID NO: 1883431 - RNA, 15 nt, Salmonella typhimurium LT2
cgcauuugcuuucau

SEQ ID NO: 1883432 - RNA, 23 nt, Salmonella typhimurium LT2
cgcauugucauaauauucauauc

SEQ ID NO: 1883433 - RNA, 16 nt, Salmonella typhimurium LT2
cgcauugguaaauccg

SEQ ID NO: 1883434 - RNA, 22 nt, Salmonella typhimurium LT2
cgccaaaccagacccgcugcgu

SEQ ID NO: 1883435 - RNA, 14 nt, Salmonella typhimurium LT2
cgccaaacgggcaa

SEQ ID NO: 1883436 - RNA, 19 nt, Salmonella typhimurium LT2
cgccaaaucuguucugucc

SEQ ID NO: 1883437 - RNA, 19 nt, Salmonella typhimurium LT2
cgcauuuuuucuucaguuc

SEQ ID NO: 1883438 - RNA, 17 nt, Salmonella typhimurium LT2
cgcauuuuuaagcuggc

SEQ ID NO: 1883439 - RNA, 21 nt, Salmonella typhimurium LT2
cgccaaaagaggcagcaaagc

SEQ ID NO: 1883440 - RNA, 21 nt, Salmonella typhimurium LT2
cgccaaaaaaggcagccagga

SEQ ID NO: 1883441 - RNA, 14 nt, Salmonella typhimurium LT2
cgccaaaccacacc

SEQ ID NO: 1883442 - RNA, 12 nt, Salmonella typhimurium LT2
cgccaacgcccg

SEQ ID NO: 1883443 - RNA, 21 nt, Salmonella typhimurium LT2
cgccaacuuuuugcgcaauac

SEQ ID NO: 1883444 - RNA, 15 nt, Salmonella typhimurium LT2
cgccaaccaucggca

SEQ ID NO: 1883445 - RNA, 13 nt, Salmonella typhimurium LT2
cgccaagcgcggc

SEQ ID NO: 1883446 - RNA, 20 nt, Salmonella typhimurium LT2
cgccaagcgcggcagcagcu

SEQ ID NO: 1883447 - RNA, 17 nt, Salmonella typhimurium LT2
cgccaauggccgccccc

SEQ ID NO: 1883448 - RNA, 14 nt, Salmonella typhimurium LT2
cgccaauauccauu

SEQ ID NO: 1883449 - RNA, 12 nt, Salmonella typhimurium LT2
cgccaauaucca

SEQ ID NO: 1883450 - RNA, 15 nt, Salmonella typhimurium LT2
cgccaauugaugaac

SEQ ID NO: 1883451 - RNA, 15 nt, Salmonella typhimurium LT2
cgccaauuccugcca

SEQ ID NO: 1883452 - RNA, 23 nt, Salmonella typhimurium LT2
cgccacaccgagacagagaaccu

SEQ ID NO: 1883453 - RNA, 14 nt, Salmonella typhimurium LT2
cgccacauucaauu

SEQ ID NO: 1883454 - RNA, 15 nt, Salmonella typhimurium LT2
cgccaccgccgccac

SEQ ID NO: 1883455 - RNA, 13 nt, Salmonella typhimurium LT2
cgccaccgccgcu

SEQ ID NO: 1883456 - RNA, 15 nt, Salmonella typhimurium LT2
cgccaccgcgcgcuu

SEQ ID NO: 1883457 - RNA, 14 nt, Salmonella typhimurium LT2
cgccaccgcgcgca

SEQ ID NO: 1883458 - RNA, 14 nt, Salmonella typhimurium LT2
cgccaccgcgcgcu

SEQ ID NO: 1883459 - RNA, 22 nt, Salmonella typhimurium LT2
cgccaccacagucaucgcgcca

SEQ ID NO: 1883460 - RNA, 14 nt, Salmonella typhimurium LT2
cgccacccgccugc

SEQ ID NO: 1883461 - RNA, 19 nt, Salmonella typhimurium LT2
aaacgcgcucgccagcgca

SEQ ID NO: 1883462 - RNA, 21 nt, Salmonella typhimurium LT2
aaacgcguagcggguucuuuc

SEQ ID NO: 1883463 - RNA, 17 nt, Salmonella typhimurium LT2
aaacgcucaaauauccc

SEQ ID NO: 1883464 - RNA, 18 nt, Salmonella typhimurium LT2
aaacgcucgcuuaaugag

SEQ ID NO: 1883465 - RNA, 20 nt, Salmonella typhimurium LT2
aaacgccuggagugacuaaa

SEQ ID NO: 1883466 - RNA, 23 nt, Salmonella typhimurium LT2
cgagcgauagagaguuccuccug

SEQ ID NO: 1883467 - RNA, 20 nt, Salmonella typhimurium LT2
cgagcgacgcccugcccaug

SEQ ID NO: 1883468 - RNA, 14 nt, Salmonella typhimurium LT2
cgagccuucuggcc

SEQ ID NO: 1883469 - RNA, 20 nt, Salmonella typhimurium LT2
cgagccauuaaugcaggcag

SEQ ID NO: 1883470 - RNA, 14 nt, Salmonella typhimurium LT2
cgagccagaaaugu

SEQ ID NO: 1883471 - RNA, 22 nt, Salmonella typhimurium LT2
cgagcaguucagcagcaccacu

SEQ ID NO: 1883472 - RNA, 15 nt, Salmonella typhimurium LT2
cgagcccuaucacca

SEQ ID NO: 1883473 - RNA, 17 nt, Salmonella typhimurium LT2
cgagauaauccagccac

SEQ ID NO: 1883474 - RNA, 14 nt, Salmonella typhimurium LT2
cgagcaguucagca

SEQ ID NO: 1883475 - RNA, 17 nt, Salmonella typhimurium LT2
cgagcaguucagcagca

SEQ ID NO: 1883476 - RNA, 14 nt, Salmonella typhimurium LT2
cgagcaggacgcgc

SEQ ID NO: 1883477 - RNA, 14 nt, Salmonella typhimurium LT2
cgagcagccuggcg

SEQ ID NO: 1883478 - RNA, 15 nt, Salmonella typhimurium LT2
cgagacggcggaaag

SEQ ID NO: 1883479 - RNA, 15 nt, Salmonella typhimurium LT2
cgagaguuugugaug

SEQ ID NO: 1883480 - RNA, 17 nt, Salmonella typhimurium LT2
cgagagugacgacgcca

SEQ ID NO: 1883481 - RNA, 17 nt, Salmonella typhimurium LT2
cgagacucaaagaaaac

SEQ ID NO: 1883482 - RNA, 15 nt, Salmonella typhimurium LT2
cgagagaaaaaaauc

SEQ ID NO: 1883483 - RNA, 22 nt, Salmonella typhimurium LT2
cgagagaaauagaaaaauccgg

SEQ ID NO: 1883484 - RNA, 22 nt, Salmonella typhimurium LT2
cgagagaauuaacagcgcgacc

SEQ ID NO: 1883485 - RNA, 14 nt, Salmonella typhimurium LT2
cgagagaaaaaaau

SEQ ID NO: 1883486 - RNA, 20 nt, Salmonella typhimurium LT2
cgacuucaaucgccaaaucc

SEQ ID NO: 1883487 - RNA, 22 nt, Salmonella typhimurium LT2
cgacuucacgcugcauaaaacu

SEQ ID NO: 1883488 - RNA, 18 nt, Salmonella typhimurium LT2
cgacuuaaaagaaucccc

SEQ ID NO: 1883489 - RNA, 14 nt, Salmonella typhimurium LT2
cgagaaaaaacuca

SEQ ID NO: 1883490 - RNA, 20 nt, Salmonella typhimurium LT2
cgacuuuuuucaaauccagc

SEQ ID NO: 1883491 - RNA, 18 nt, Salmonella typhimurium LT2
cgacuuuucacuuauaaa

SEQ ID NO: 1883492 - RNA, 22 nt, Salmonella typhimurium LT2
cgacuuuucacuuauaaauaaa

SEQ ID NO: 1883493 - RNA, 21 nt, Salmonella typhimurium LT2
cgagaaccaacugccaaacca

SEQ ID NO: 1883494 - RNA, 14 nt, Salmonella typhimurium LT2
cgacugaccagacc

SEQ ID NO: 1883495 - RNA, 13 nt, Salmonella typhimurium LT2
cgacugccaccac

SEQ ID NO: 1883496 - RNA, 14 nt, Salmonella typhimurium LT2
cgacugccaccacg

SEQ ID NO: 1883497 - RNA, 21 nt, Salmonella typhimurium LT2
cgacugguaaugucauccagc

SEQ ID NO: 1883498 - RNA, 15 nt, Salmonella typhimurium LT2
cgacugguaacggcg

SEQ ID NO: 1883499 - RNA, 13 nt, Salmonella typhimurium LT2
cgacuccagaaua

SEQ ID NO: 1883500 - RNA, 19 nt, Salmonella typhimurium LT2
cgacucccaggcgcgcagc

SEQ ID NO: 1883501 - RNA, 17 nt, Salmonella typhimurium LT2
cgacucccccagauucu

SEQ ID NO: 1883502 - RNA, 17 nt, Salmonella typhimurium LT2
cgacucacgguuuuuau

SEQ ID NO: 1883503 - RNA, 16 nt, Salmonella typhimurium LT2
cgacucauaaugucuc

SEQ ID NO: 1883504 - RNA, 13 nt, Salmonella typhimurium LT2
cgacucucccggc

SEQ ID NO: 1883505 - RNA, 17 nt, Salmonella typhimurium LT2
cgacucucccggcgccc

SEQ ID NO: 1883506 - RNA, 15 nt, Salmonella typhimurium LT2
cgacuccggauagag

SEQ ID NO: 1883507 - RNA, 13 nt, Salmonella typhimurium LT2
cgacucgagcgaa

SEQ ID NO: 1883508 - RNA, 22 nt, Salmonella typhimurium LT2
cgacgugacucagcggccauug

SEQ ID NO: 1883509 - RNA, 20 nt, Salmonella typhimurium LT2
cgacguuguucgcuucuucu

SEQ ID NO: 1883510 - RNA, 15 nt, Salmonella typhimurium LT2
cgacuaucgccgccc

SEQ ID NO: 1883511 - RNA, 17 nt, Salmonella typhimurium LT2
cgacuaucgccgcccca

SEQ ID NO: 1883512 - RNA, 21 nt, Salmonella typhimurium LT2
cgaauagaguaauacauccau

SEQ ID NO: 1883513 - RNA, 19 nt, Salmonella typhimurium LT2
cgaauagcgacaaaugaag

SEQ ID NO: 1883514 - RNA, 15 nt, Salmonella typhimurium LT2
cgaggcgcccaacgc

SEQ ID NO: 1883515 - RNA, 20 nt, Salmonella typhimurium LT2
cgagggaaggggauuuuccg

SEQ ID NO: 1883516 - RNA, 17 nt, Salmonella typhimurium LT2
cgaggcuuaauacagca

SEQ ID NO: 1883517 - RNA, 20 nt, Salmonella typhimurium LT2
cgaggcuuaauacagcaacg

SEQ ID NO: 1883518 - RNA, 23 nt, Salmonella typhimurium LT2
cgaggaacaucagccagcagcuc

SEQ ID NO: 1883519 - RNA, 21 nt, Salmonella typhimurium LT2
cgaggaacaucagccagcagc

SEQ ID NO: 1883520 - RNA, 20 nt, Salmonella typhimurium LT2
cgaggauacggucgacacca

SEQ ID NO: 1883521 - RNA, 22 nt, Salmonella typhimurium LT2
cgaggauacggucgacaccagc

SEQ ID NO: 1883522 - RNA, 13 nt, Salmonella typhimurium LT2
cgagcgccugaug

SEQ ID NO: 1883523 - RNA, 16 nt, Salmonella typhimurium LT2
cgagcgccgucacucc

SEQ ID NO: 1883524 - RNA, 23 nt, Salmonella typhimurium LT2
cgagcgccgcuuugcccggccac

SEQ ID NO: 1883525 - RNA, 13 nt, Salmonella typhimurium LT2
aaacgcugcgcaa

SEQ ID NO: 1883526 - RNA, 19 nt, Salmonella typhimurium LT2
aaacgcuuauggauaagcg

SEQ ID NO: 1883527 - RNA, 23 nt, Salmonella typhimurium LT2
aaacgcuucuauuucuuuauucu

SEQ ID NO: 1883528 - RNA, 22 nt, Salmonella typhimurium LT2
cgagcggccaaagggagcagac

SEQ ID NO: 1883529 - RNA, 17 nt, Salmonella typhimurium LT2
cgagcggucaggccagc

SEQ ID NO: 1883530 - RNA, 14 nt, Salmonella typhimurium LT2
cgagcggccaaagg

SEQ ID NO: 1883531 - RNA, 15 nt, Salmonella typhimurium LT2
cgagcugguuucaau

SEQ ID NO: 1883532 - RNA, 14 nt, Salmonella typhimurium LT2
cgagcuacaggugc

SEQ ID NO: 1883533 - RNA, 22 nt, Salmonella typhimurium LT2
cgagcgugauacucugcgcugc

SEQ ID NO: 1883534 - RNA, 20 nt, Salmonella typhimurium LT2
cgauaaucauacagcgcagc

SEQ ID NO: 1883535 - RNA, 14 nt, Salmonella typhimurium LT2
cgauaaccaccagc

SEQ ID NO: 1883536 - RNA, 14 nt, Salmonella typhimurium LT2
cgauaaccaggucg

SEQ ID NO: 1883537 - RNA, 15 nt, Salmonella typhimurium LT2
cgauaacccgcgcau

SEQ ID NO: 1883538 - RNA, 17 nt, Salmonella typhimurium LT2
cgauaaccucucaccgc

SEQ ID NO: 1883539 - RNA, 13 nt, Salmonella typhimurium LT2
cgauacaccuuca

SEQ ID NO: 1883540 - RNA, 18 nt, Salmonella typhimurium LT2
cgauacacgccgacgcau

SEQ ID NO: 1883541 - RNA, 14 nt, Salmonella typhimurium LT2
cgauagcauuuuua

SEQ ID NO: 1883542 - RNA, 15 nt, Salmonella typhimurium LT2
cgauagcgccccaaa

SEQ ID NO: 1883543 - RNA, 16 nt, Salmonella typhimurium LT2
cgauaucgccuggugu

SEQ ID NO: 1883544 - RNA, 13 nt, Salmonella typhimurium LT2
cgauagaccacgc

SEQ ID NO: 1883545 - RNA, 17 nt, Salmonella typhimurium LT2
cgauagaccuucguaau

SEQ ID NO: 1883546 - RNA, 19 nt, Salmonella typhimurium LT2
cgauaccaauucccagacc

SEQ ID NO: 1883547 - RNA, 20 nt, Salmonella typhimurium LT2
cgauagagaguuccuccugg

SEQ ID NO: 1883548 - RNA, 19 nt, Salmonella typhimurium LT2
cgauagagaccgcuuuagc

SEQ ID NO: 1883549 - RNA, 18 nt, Salmonella typhimurium LT2
cgauagacguugagcuca

SEQ ID NO: 1883550 - RNA, 18 nt, Salmonella typhimurium LT2
cgauagagaguuccuccu

SEQ ID NO: 1883551 - RNA, 14 nt, Salmonella typhimurium LT2
cgauaaaaaagccu

SEQ ID NO: 1883552 - RNA, 15 nt, Salmonella typhimurium LT2
cgauaaagaacucga

SEQ ID NO: 1883553 - RNA, 11 nt, Salmonella typhimurium LT2
cgauaaaucaa

SEQ ID NO: 1883554 - RNA, 13 nt, Salmonella typhimurium LT2
cgauaaagacagg

SEQ ID NO: 1883555 - RNA, 16 nt, Salmonella typhimurium LT2
cgagugcguucuucca

SEQ ID NO: 1883556 - RNA, 16 nt, Salmonella typhimurium LT2
cgagucgucaguucca

SEQ ID NO: 1883557 - RNA, 16 nt, Salmonella typhimurium LT2
cgagucuuaccagguc

SEQ ID NO: 1883558 - RNA, 20 nt, Salmonella typhimurium LT2
cgaguaauccguagccaaca

SEQ ID NO: 1883559 - RNA, 23 nt, Salmonella typhimurium LT2
cgaguaacaccgcggcgcucgcc

SEQ ID NO: 1883560 - RNA, 15 nt, Salmonella typhimurium LT2
cgaggguggcaccgc

SEQ ID NO: 1883561 - RNA, 18 nt, Salmonella typhimurium LT2
cgaggugaauaaauccuu

SEQ ID NO: 1883562 - RNA, 22 nt, Salmonella typhimurium LT2
cgaggugguucguaacaccuua

SEQ ID NO: 1883563 - RNA, 18 nt, Salmonella typhimurium LT2
cgagguucccgccgccau

SEQ ID NO: 1883564 - RNA, 22 nt, Salmonella typhimurium LT2
cgagguucaccagcgcgccgcc

SEQ ID NO: 1883565 - RNA, 20 nt, Salmonella typhimurium LT2
cggcauuucaccgccaauaa

SEQ ID NO: 1883566 - RNA, 21 nt, Salmonella typhimurium LT2
cggcauuucaccgccaauaac

SEQ ID NO: 1883567 - RNA, 22 nt, Salmonella typhimurium LT2
cggcauucgcacacuauuccgc

SEQ ID NO: 1883568 - RNA, 20 nt, Salmonella typhimurium LT2
cggcauucacgucgcgcgcc

SEQ ID NO: 1883569 - RNA, 12 nt, Salmonella typhimurium LT2
cggcauuuuuaa

SEQ ID NO: 1883570 - RNA, 13 nt, Salmonella typhimurium LT2
cggcacuggcgcu

SEQ ID NO: 1883571 - RNA, 20 nt, Salmonella typhimurium LT2
cggcagcaauacgcccgccc

SEQ ID NO: 1883572 - RNA, 16 nt, Salmonella typhimurium LT2
cggcagauccuggcgc

SEQ ID NO: 1883573 - RNA, 16 nt, Salmonella typhimurium LT2
cggcagcagcgcgccg

SEQ ID NO: 1883574 - RNA, 17 nt, Salmonella typhimurium LT2
cggccacgcuaaaguca

SEQ ID NO: 1883575 - RNA, 17 nt, Salmonella typhimurium LT2
cggccagaaugcccagc

SEQ ID NO: 1883576 - RNA, 16 nt, Salmonella typhimurium LT2
cggccacagcgccaga

SEQ ID NO: 1883577 - RNA, 14 nt, Salmonella typhimurium LT2
cggccccgggcgac

SEQ ID NO: 1883578 - RNA, 21 nt, Salmonella typhimurium LT2
cggcccacucauccagcaaaa

SEQ ID NO: 1883579 - RNA, 13 nt, Salmonella typhimurium LT2
cggcccgcgcuga

SEQ ID NO: 1883580 - RNA, 23 nt, Salmonella typhimurium LT2
cggcccgcuucauuggcgucugc

SEQ ID NO: 1883581 - RNA, 17 nt, Salmonella typhimurium LT2
cggccuccgcagcuuca

SEQ ID NO: 1883582 - RNA, 14 nt, Salmonella typhimurium LT2
cggccuggcgcagc

SEQ ID NO: 1883583 - RNA, 18 nt, Salmonella typhimurium LT2
cggccuacacaucaucuu

SEQ ID NO: 1883584 - RNA, 22 nt, Salmonella typhimurium LT2
cggccuacauucucuuucgcug

SEQ ID NO: 1883585 - RNA, 15 nt, Salmonella typhimurium LT2
cggccuacaacucag

SEQ ID NO: 1883586 - RNA, 15 nt, Salmonella typhimurium LT2
cggcgaaggucgcgc

SEQ ID NO: 1883587 - RNA, 20 nt, Salmonella typhimurium LT2
cggcgaaaaaccaggcaaca

SEQ ID NO: 1883588 - RNA, 16 nt, Salmonella typhimurium LT2
cggcgaacgcuggcug

SEQ ID NO: 1883589 - RNA, 18 nt, Salmonella typhimurium LT2
cggcgaacgcuggcuggg

SEQ ID NO: 1883590 - RNA, 16 nt, Salmonella typhimurium LT2
cggcgacaagaauaug

SEQ ID NO: 1883591 - RNA, 13 nt, Salmonella typhimurium LT2
cggccgaggcagc

SEQ ID NO: 1883592 - RNA, 14 nt, Salmonella typhimurium LT2
cggccgaggcagcg

SEQ ID NO: 1883593 - RNA, 15 nt, Salmonella typhimurium LT2
cggcgcaaaucgcca

SEQ ID NO: 1883594 - RNA, 17 nt, Salmonella typhimurium LT2
cggcgccauccggcaga

SEQ ID NO: 1883595 - RNA, 15 nt, Salmonella typhimurium LT2
cggcgacgcccgcca

SEQ ID NO: 1883596 - RNA, 17 nt, Salmonella typhimurium LT2
cgcuuuugguuuuucaa

SEQ ID NO: 1883597 - RNA, 20 nt, Salmonella typhimurium LT2
cgcuuuugccgugacuuccg

SEQ ID NO: 1883598 - RNA, 13 nt, Salmonella typhimurium LT2
cgcuuuuucaaag

SEQ ID NO: 1883599 - RNA, 14 nt, Salmonella typhimurium LT2
cgcuuuuuucucug

SEQ ID NO: 1883600 - RNA, 12 nt, Salmonella typhimurium LT2
cgcuuuuuguag

SEQ ID NO: 1883601 - RNA, 22 nt, Salmonella typhimurium LT2
cgcuuugaggaucaauuuuucg

SEQ ID NO: 1883602 - RNA, 23 nt, Salmonella typhimurium LT2
cgcuuucuggggugaauuuuuug

SEQ ID NO: 1883603 - RNA, 12 nt, Salmonella typhimurium LT2
cgcuuuccaggc

SEQ ID NO: 1883604 - RNA, 13 nt, Salmonella typhimurium LT2
cgcuuucaccauc

SEQ ID NO: 1883605 - RNA, 16 nt, Salmonella typhimurium LT2
cgcuuucaccgccuca

SEQ ID NO: 1883606 - RNA, 12 nt, Salmonella typhimurium LT2
cgcuuucaaucg

SEQ ID NO: 1883607 - RNA, 19 nt, Salmonella typhimurium LT2
cgcuacauuaaugucauga

SEQ ID NO: 1883608 - RNA, 17 nt, Salmonella typhimurium LT2
cgcuaccagcgcggcgc

SEQ ID NO: 1883609 - RNA, 19 nt, Salmonella typhimurium LT2
cgcuaccagcgcggcgcca

SEQ ID NO: 1883610 - RNA, 16 nt, Salmonella typhimurium LT2
cgcuaauucucccugc

SEQ ID NO: 1883611 - RNA, 23 nt, Salmonella typhimurium LT2
cgcuuguaaauugcgucaucauc

SEQ ID NO: 1883612 - RNA, 15 nt, Salmonella typhimurium LT2
cgcuuuaccgccuuc

SEQ ID NO: 1883613 - RNA, 20 nt, Salmonella typhimurium LT2
cgcuuuacaugccgcucucc

SEQ ID NO: 1883614 - RNA, 14 nt, Salmonella typhimurium LT2
cgcuaaaugcauag

SEQ ID NO: 1883615 - RNA, 15 nt, Salmonella typhimurium LT2
cgcuaaagucagcau

SEQ ID NO: 1883616 - RNA, 16 nt, Salmonella typhimurium LT2
cgcguuuuuucaugaa

SEQ ID NO: 1883617 - RNA, 18 nt, Salmonella typhimurium LT2
cgcguuuuucugcccauu

SEQ ID NO: 1883618 - RNA, 23 nt, Salmonella typhimurium LT2
cgcuaaaccacaugaccagcgcc

SEQ ID NO: 1883619 - RNA, 16 nt, Salmonella typhimurium LT2
cgcuaacguccgccgu

SEQ ID NO: 1883620 - RNA, 17 nt, Salmonella typhimurium LT2
cgcuaauuuucagggug

SEQ ID NO: 1883621 - RNA, 17 nt, Salmonella typhimurium LT2
cgcuaauuuuuaaauga

SEQ ID NO: 1883622 - RNA, 20 nt, Salmonella typhimurium LT2
cggaauaauguaaaaaaaua

SEQ ID NO: 1883623 - RNA, 18 nt, Salmonella typhimurium LT2
cggaagcagauaccagcc

SEQ ID NO: 1883624 - RNA, 22 nt, Salmonella typhimurium LT2
cggaacucacuugucuucuuuc

SEQ ID NO: 1883625 - RNA, 20 nt, Salmonella typhimurium LT2
cggaacggggaaccagcacg

SEQ ID NO: 1883626 - RNA, 22 nt, Salmonella typhimurium LT2
cggaacgccccucgguuuaucc

SEQ ID NO: 1883627 - RNA, 14 nt, Salmonella typhimurium LT2
cggaagauccuguu

SEQ ID NO: 1883628 - RNA, 18 nt, Salmonella typhimurium LT2
cggaagacuggcgcagca

SEQ ID NO: 1883629 - RNA, 19 nt, Salmonella typhimurium LT2
cggaacaacgcaacacagg

SEQ ID NO: 1883630 - RNA, 18 nt, Salmonella typhimurium LT2
cggaaccaaaugcccagc

SEQ ID NO: 1883631 - RNA, 16 nt, Salmonella typhimurium LT2
cggaacaggcuuuuca

SEQ ID NO: 1883632 - RNA, 16 nt, Salmonella typhimurium LT2
cggaacagggccgcau

SEQ ID NO: 1883633 - RNA, 21 nt, Salmonella typhimurium LT2
cggaacaguccaggaaagagg

SEQ ID NO: 1883634 - RNA, 20 nt, Salmonella typhimurium LT2
cggaaacgucauuuuuucaa

SEQ ID NO: 1883635 - RNA, 21 nt, Salmonella typhimurium LT2
cggaaaccagauaccccgcca

SEQ ID NO: 1883636 - RNA, 23 nt, Salmonella typhimurium LT2
cggaaaucacaaacaccaccagu

SEQ ID NO: 1883637 - RNA, 23 nt, Salmonella typhimurium LT2
cggagauuaacagcgcgaccagc

SEQ ID NO: 1883638 - RNA, 20 nt, Salmonella typhimurium LT2
cggagccaaaagaaguggca

SEQ ID NO: 1883639 - RNA, 23 nt, Salmonella typhimurium LT2
cggagaugaucguuuccagcauc

SEQ ID NO: 1883640 - RNA, 15 nt, Salmonella typhimurium LT2
cggagaucuccagau

SEQ ID NO: 1883641 - RNA, 17 nt, Salmonella typhimurium LT2
cggagagagcaacuggc

SEQ ID NO: 1883642 - RNA, 18 nt, Salmonella typhimurium LT2
cggagagacguucauuuc

SEQ ID NO: 1883643 - RNA, 21 nt, Salmonella typhimurium LT2
cggagaguucauagcgcacaa

SEQ ID NO: 1883644 - RNA, 18 nt, Salmonella typhimurium LT2
cggagagucgcaccgcgc

SEQ ID NO: 1883645 - RNA, 17 nt, Salmonella typhimurium LT2
cggacgguaccugaagc

SEQ ID NO: 1883646 - RNA, 14 nt, Salmonella typhimurium LT2
cggacggcgcagcg

SEQ ID NO: 1883647 - RNA, 20 nt, Salmonella typhimurium LT2
cggacgcugacgccaggcca

SEQ ID NO: 1883648 - RNA, 16 nt, Salmonella typhimurium LT2
cggacuaauacuugcc

SEQ ID NO: 1883649 - RNA, 16 nt, Salmonella typhimurium LT2
cggacucgcuggacau

SEQ ID NO: 1883650 - RNA, 15 nt, Salmonella typhimurium LT2
cggacucgcuggaca

SEQ ID NO: 1883651 - RNA, 15 nt, Salmonella typhimurium LT2
cggagaccuuuuuca

SEQ ID NO: 1883652 - RNA, 12 nt, Salmonella typhimurium LT2
cggacugcucgc

SEQ ID NO: 1883653 - RNA, 14 nt, Salmonella typhimurium LT2
cggacacccgcagc

SEQ ID NO: 1883654 - RNA, 16 nt, Salmonella typhimurium LT2
cggacacgcucauaaa

SEQ ID NO: 1883655 - RNA, 15 nt, Salmonella typhimurium LT2
cggacagcggcagcg

SEQ ID NO: 1883656 - RNA, 15 nt, Salmonella typhimurium LT2
cggacagcagaauau

SEQ ID NO: 1883657 - RNA, 14 nt, Salmonella typhimurium LT2
cggacacuugcagc

SEQ ID NO: 1883658 - RNA, 15 nt, Salmonella typhimurium LT2
cggacaacgcuccag

SEQ ID NO: 1883659 - RNA, 13 nt, Salmonella typhimurium LT2
cggaaugcccacg

SEQ ID NO: 1883660 - RNA, 15 nt, Salmonella typhimurium LT2
cggaaugaugugcua

SEQ ID NO: 1883661 - RNA, 19 nt, Salmonella typhimurium LT2
cggaauaugcgcuuuuuuc

SEQ ID NO: 1883662 - RNA, 15 nt, Salmonella typhimurium LT2
cggaauaucuuuuuu

SEQ ID NO: 1883663 - RNA, 19 nt, Salmonella typhimurium LT2
cggaaucgcgauccagccc

SEQ ID NO: 1883664 - RNA, 14 nt, Salmonella typhimurium LT2
cggaccccucuucu

SEQ ID NO: 1883665 - RNA, 15 nt, Salmonella typhimurium LT2
cggaccccucuucuu

SEQ ID NO: 1883666 - RNA, 19 nt, Salmonella typhimurium LT2
cggaccgauaacaggaacg

SEQ ID NO: 1883667 - RNA, 21 nt, Salmonella typhimurium LT2
cggacgauagccaugcccggc

SEQ ID NO: 1883668 - RNA, 16 nt, Salmonella typhimurium LT2
cggcacguuuuccagg

SEQ ID NO: 1883669 - RNA, 16 nt, Salmonella typhimurium LT2
cggcacguacugcacc

SEQ ID NO: 1883670 - RNA, 13 nt, Salmonella typhimurium LT2
cggcacacagcac

SEQ ID NO: 1883671 - RNA, 19 nt, Salmonella typhimurium LT2
cggcacauauuccggcgcu

SEQ ID NO: 1883672 - RNA, 22 nt, Salmonella typhimurium LT2
cggcacauauuccggcgcuggc

SEQ ID NO: 1883673 - RNA, 15 nt, Salmonella typhimurium LT2
cggcacaaccuggcu

SEQ ID NO: 1883674 - RNA, 22 nt, Salmonella typhimurium LT2
cggcaccccuucaggcgugacg

SEQ ID NO: 1883675 - RNA, 14 nt, Salmonella typhimurium LT2
cggcaccagcaaug

SEQ ID NO: 1883676 - RNA, 15 nt, Salmonella typhimurium LT2
cggcaccacauuaaa

SEQ ID NO: 1883677 - RNA, 23 nt, Salmonella typhimurium LT2
cggcaccagaauccacucggcgc

SEQ ID NO: 1883678 - RNA, 17 nt, Salmonella typhimurium LT2
cggcaagcgcugggcga

SEQ ID NO: 1883679 - RNA, 18 nt, Salmonella typhimurium LT2
cggcaagcgggcguugcu

SEQ ID NO: 1883680 - RNA, 14 nt, Salmonella typhimurium LT2
cggcaagcgcgcca

SEQ ID NO: 1883681 - RNA, 21 nt, Salmonella typhimurium LT2
cggcaacgccuuccugccagc

SEQ ID NO: 1883682 - RNA, 19 nt, Salmonella typhimurium LT2
cggcaaccuacuccggguu

SEQ ID NO: 1883683 - RNA, 11 nt, Salmonella typhimurium LT2
cggcaaccuga

SEQ ID NO: 1883684 - RNA, 13 nt, Salmonella typhimurium LT2
cggcaaccggauc

SEQ ID NO: 1883685 - RNA, 17 nt, Salmonella typhimurium LT2
cggcaaucagcgccccc

SEQ ID NO: 1883686 - RNA, 18 nt, Salmonella typhimurium LT2
cggcaaugagcggccagc

SEQ ID NO: 1883687 - RNA, 18 nt, Salmonella typhimurium LT2
cggcaaggucugcgccca

SEQ ID NO: 1883688 - RNA, 20 nt, Salmonella typhimurium LT2
cggcaaaaaauauagccauu

SEQ ID NO: 1883689 - RNA, 16 nt, Salmonella typhimurium LT2
cggcaaaauacucagc

SEQ ID NO: 1883690 - RNA, 23 nt, Salmonella typhimurium LT2
cggcaaacggggggauucauuau

SEQ ID NO: 1883691 - RNA, 19 nt, Salmonella typhimurium LT2
cggauuuaccagcgcuucu

SEQ ID NO: 1883692 - RNA, 22 nt, Salmonella typhimurium LT2
cggcaaagaagcuuacaaggcu

SEQ ID NO: 1883693 - RNA, 17 nt, Salmonella typhimurium LT2
cggcaaauacaucgcca

SEQ ID NO: 1883694 - RNA, 12 nt, Salmonella typhimurium LT2
cggcaacaaaug

SEQ ID NO: 1883695 - RNA, 16 nt, Salmonella typhimurium LT2
cggcaaccaacgccca

SEQ ID NO: 1883696 - RNA, 19 nt, Salmonella typhimurium LT2
cggauuaucguccggcauc

SEQ ID NO: 1883697 - RNA, 20 nt, Salmonella typhimurium LT2
cggauucaauauugaacauu

SEQ ID NO: 1883698 - RNA, 18 nt, Salmonella typhimurium LT2
cggauugccgcgcucaau

SEQ ID NO: 1883699 - RNA, 14 nt, Salmonella typhimurium LT2
cggauugccuucuc

SEQ ID NO: 1883700 - RNA, 18 nt, Salmonella typhimurium LT2
cggauucucgaugauaaa

SEQ ID NO: 1883701 - RNA, 14 nt, Salmonella typhimurium LT2
cggauucuuccucu

SEQ ID NO: 1883702 - RNA, 16 nt, Salmonella typhimurium LT2
cggauggcggcuaccu

SEQ ID NO: 1883703 - RNA, 17 nt, Salmonella typhimurium LT2
cggauggccugcucgau

SEQ ID NO: 1883704 - RNA, 20 nt, Salmonella typhimurium LT2
cggaugcugcgccagccaua

SEQ ID NO: 1883705 - RNA, 15 nt, Salmonella typhimurium LT2
cggaugacgccgcuu

SEQ ID NO: 1883706 - RNA, 15 nt, Salmonella typhimurium LT2
cggaugaucaacggc

SEQ ID NO: 1883707 - RNA, 18 nt, Salmonella typhimurium LT2
cggaugacuucuucuacc

SEQ ID NO: 1883708 - RNA, 21 nt, Salmonella typhimurium LT2
cggaucgccaucgacagcagc

SEQ ID NO: 1883709 - RNA, 19 nt, Salmonella typhimurium LT2
cggaucaaaaaggugagca

SEQ ID NO: 1883710 - RNA, 15 nt, Salmonella typhimurium LT2
cggaucaauaaacag

SEQ ID NO: 1883711 - RNA, 14 nt, Salmonella typhimurium LT2
cggaucaaucacca

SEQ ID NO: 1883712 - RNA, 15 nt, Salmonella typhimurium LT2
cggaucaaucaccac

SEQ ID NO: 1883713 - RNA, 19 nt, Salmonella typhimurium LT2
cggaucaaucaccaccagg

SEQ ID NO: 1883714 - RNA, 17 nt, Salmonella typhimurium LT2
cggaucacgauauguuu

SEQ ID NO: 1883715 - RNA, 15 nt, Salmonella typhimurium LT2
cggaucaccggcauu

SEQ ID NO: 1883716 - RNA, 14 nt, Salmonella typhimurium LT2
cggauauguuugac

SEQ ID NO: 1883717 - RNA, 14 nt, Salmonella typhimurium LT2
cggauauuuauacu

SEQ ID NO: 1883718 - RNA, 16 nt, Salmonella typhimurium LT2
cggauaugcagcagcc

SEQ ID NO: 1883719 - RNA, 23 nt, Salmonella typhimurium LT2
cggauagcuacgauaaagcuggg

SEQ ID NO: 1883720 - RNA, 14 nt, Salmonella typhimurium LT2
cggauagucaucgc

SEQ ID NO: 1883721 - RNA, 12 nt, Salmonella typhimurium LT2
cggauaaauguu

SEQ ID NO: 1883722 - RNA, 14 nt, Salmonella typhimurium LT2
cggauaauaucuuu

SEQ ID NO: 1883723 - RNA, 19 nt, Salmonella typhimurium LT2
cggauaccguccaccagca

SEQ ID NO: 1883724 - RNA, 22 nt, Salmonella typhimurium LT2
cggauacugugucgggccaggc

SEQ ID NO: 1883725 - RNA, 21 nt, Salmonella typhimurium LT2
cggaggccagauucaccacca

SEQ ID NO: 1883726 - RNA, 14 nt, Salmonella typhimurium LT2
cggaguccagcaac

SEQ ID NO: 1883727 - RNA, 23 nt, Salmonella typhimurium LT2
cggauaaacgccccuucaucagc

SEQ ID NO: 1883728 - RNA, 15 nt, Human
ugaauggcuaagcaa

SEQ ID NO: 1883729 - RNA, 16 nt, Human
ugagcgacagugagac

SEQ ID NO: 1883730 - RNA, 17 nt, Human
uccacuuggucugugag

SEQ ID NO: 1883731 - RNA, 14 nt, Human
ugcuggagcucugc

SEQ ID NO: 1883732 - RNA, 18 nt, Human
gccucuuagaugcaguuc

SEQ ID NO: 1883733 - RNA, 11 nt, Human
gcuccagcugg

SEQ ID NO: 1883734 - RNA, 19 nt, Human
ccucaaaacuucagacaua

SEQ ID NO: 1883735 - RNA, 14 nt, Human
cgagcguugcuggg

SEQ ID NO: 1883736 - RNA, 17 nt, Human
cgagaaaacaauaacga

SEQ ID NO: 1883737 - RNA, 21 nt, Human
cgaaguauccuucagccugaa

SEQ ID NO: 1883738 - RNA, 20 nt, Human
uuaaaaaaaaaccugagccc

SEQ ID NO: 1883739 - RNA, 13 nt, Human
cuagacccacugg

SEQ ID NO: 1883740 - RNA, 21 nt, Human
cucagcccuggugggcagaga

SEQ ID NO: 1883741 - RNA, 17 nt, Human
cucuggccuucggccuc

SEQ ID NO: 1883742 - RNA, 15 nt, Human
cugagcuugcagaga

SEQ ID NO: 1883743 - RNA, 17 nt, Human
cuuggggcugaugcagu

SEQ ID NO: 1883744 - RNA, 17 nt, Human
gacgcucucuggccuuc

SEQ ID NO: 1883745 - RNA, 20 nt, Human
gacugcacaucaaaauaugc

SEQ ID NO: 1883746 - RNA, 19 nt, Human
cuuuccacagaagcuccag

SEQ ID NO: 1883747 - RNA, 16 nt, Human
cuuuucccaacuccag

SEQ ID NO: 1883748 - RNA, 11 nt, Human
gaaaauaacga

SEQ ID NO: 1883749 - RNA, 21 nt, Human
gaagaagcaccaaucaugaau

SEQ ID NO: 1883750 - RNA, 14 nt, Human
gaaaucauacuucu

SEQ ID NO: 1883751 - RNA, 15 nt, Human
gaaaucauacuucuu

SEQ ID NO: 1883752 - RNA, 21 nt, Human
gagaagaacugaaaucauacu

SEQ ID NO: 1883753 - RNA, 20 nt, Human
gaggacgcucucuggccuuc

SEQ ID NO: 1883754 - RNA, 20 nt, Human
gagcucguggaacaguuacc

SEQ ID NO: 1883755 - RNA, 15 nt, Human
gauccccaagccugg

SEQ ID NO: 1883756 - RNA, 19 nt, Human
gaugaagaaguugauaugc

SEQ ID NO: 1883757 - RNA, 17 nt, Human
gcaugguuuagaaagcu

SEQ ID NO: 1883758 - RNA, 18 nt, Human
aaagguauuuuaaucacc

SEQ ID NO: 1883759 - RNA, 15 nt, Human
aacucccuuucaaca

SEQ ID NO: 1883760 - RNA, 12 nt, Human
ugggaggcugag

SEQ ID NO: 1883761 - RNA, 16 nt, Human
ugagcagucaggaaag

SEQ ID NO: 1883762 - RNA, 18 nt, Human
ugagaugggagaaucacu

SEQ ID NO: 1883763 - RNA, 16 nt, Human
uccugccccugagccc

SEQ ID NO: 1883764 - RNA, 16 nt, Human
uaaaagacagugaaag

SEQ ID NO: 1883765 - RNA, 20 nt, Human
ggacgcucucuggccuucgg

SEQ ID NO: 1883766 - RNA, 16 nt, Human
guauccuucagccuga

SEQ ID NO: 1883767 - RNA, 16 nt, Human
uaagcauuccaacuau

SEQ ID NO: 1883768 - RNA, 19 nt, Human
uccagugagacagcucugc

SEQ ID NO: 1883769 - RNA, 14 nt, Human
cuggcuccagcugg

SEQ ID NO: 1883770 - RNA, 22 nt, Human
gaauuaguuuuauaugcuucug

SEQ ID NO: 1883771 - RNA, 13 nt, Human
cgcucucuggccu

SEQ ID NO: 1883772 - RNA, 11 nt, Human
gacagaaagca

SEQ ID NO: 1883773 - RNA, 19 nt, Human
gagcucgugggacagucac

SEQ ID NO: 1883774 - RNA, 16 nt, Human
ggaacaguuaccucug

SEQ ID NO: 1883775 - RNA, 17 nt, Human
caagcauuuagauguau

SEQ ID NO: 1883776 - RNA, 22 nt, Human
augugcuaguaauuggaaaggc

SEQ ID NO: 1883777 - RNA, 12 nt, Human
ccugcaaagccc

SEQ ID NO: 1883778 - RNA, 12 nt, Human
ccuucagccuga

SEQ ID NO: 1883779 - RNA, 19 nt, Human
cgagaaaacaauaacgaua

SEQ ID NO: 1883780 - RNA, 15 nt, Human
agaagaacugaaauc

SEQ ID NO: 1883781 - RNA, 20 nt, Human
aagacccaaaaggcagaagc

SEQ ID NO: 1883782 - RNA, 20 nt, Human
acacagauuugagcucagcc

SEQ ID NO: 1883783 - RNA, 17 nt, Human
acgcucucuggccuucg

SEQ ID NO: 1883784 - RNA, 12 nt, Human
acuccagccuga

SEQ ID NO: 1883785 - RNA, 17 nt, Human
uucucuucacagucaca

SEQ ID NO: 1883786 - RNA, 21 nt, Human
uucggccuccauccugaggcu

SEQ ID NO: 1883787 - RNA, 13 nt, Human
uuccucugagccu

SEQ ID NO: 1883788 - RNA, 14 nt, Human
ucuggagggaagcc

SEQ ID NO: 1883789 - RNA, 18 nt, Human
uggucugugagaugcuag

SEQ ID NO: 1883790 - RNA, 18 nt, Human
ugaaauaagccagacauc

SEQ ID NO: 1883791 - RNA, 22 nt, Human
ugaacccauauuuguacaccaa

SEQ ID NO: 1883792 - RNA, 19 nt, Human
gggacagggaggacgcucu

SEQ ID NO: 1883793 - RNA, 16 nt, Human
ggggcugaugcaguug

SEQ ID NO: 1883794 - RNA, 13 nt, Human
ggaggacgcucuc

SEQ ID NO: 1883795 - RNA, 16 nt, Human
ggacgcucucuggccu

SEQ ID NO: 1883796 - RNA, 20 nt, Human
uccaucaaggguacacugcc

SEQ ID NO: 1883797 - RNA, 15 nt, Human
uccauccugaggcuc

SEQ ID NO: 1883798 - RNA, 16 nt, Human
uccauccugaggcucc

SEQ ID NO: 1883799 - RNA, 18 nt, Human
uccauccugaggcuccac

SEQ ID NO: 1883800 - RNA, 20 nt, Human
uccauccugaggcuccacuu

SEQ ID NO: 1883801 - RNA, 22 nt, Human
gugccccugcacuccagccuga

SEQ ID NO: 1883802 - RNA, 13 nt, Human
uaagaagugaaaa

SEQ ID NO: 1883803 - RNA, 12 nt, Human
aaacacaacuau

SEQ ID NO: 1883804 - RNA, 22 nt, Human
aaagcuccauuuuuagugaaau

SEQ ID NO: 1883805 - RNA, 14 nt, Human
aggaauugacccac

SEQ ID NO: 1883806 - RNA, 13 nt, Human
aguguuugaaagc

SEQ ID NO: 1883807 - RNA, 16 nt, Human
aguuuuugugaaaagc

SEQ ID NO: 1883808 - RNA, 16 nt, Human
acagauccccaagccu

SEQ ID NO: 1883809 - RNA, 14 nt, Human
agcucguggaacag

SEQ ID NO: 1883810 - RNA, 12 nt, Human
caaauuuacaga

SEQ ID NO: 1883811 - RNA, 13 nt, Human
cacuccagccuga

SEQ ID NO: 1883812 - RNA, 13 nt, Human
auuugaaauauug

SEQ ID NO: 1883813 - RNA, 21 nt, Human
auugugccccugcacuccagc

SEQ ID NO: 1883814 - RNA, 15 nt, Human
auuauguuaaaacug

SEQ ID NO: 1883815 - RNA, 14 nt, Human
auaccacaggaacc

SEQ ID NO: 1883816 - RNA, 20 nt, Human
auacccccugcaaagcccag

SEQ ID NO: 1883817 - RNA, 14 nt, Human
auccuucagccuga

SEQ ID NO: 1883818 - RNA, 14 nt, Human
aucuacacuccagu

SEQ ID NO: 1883819 - RNA, 14 nt, Human
accacugcagaaga

SEQ ID NO: 1883820 - RNA, 15 nt, Human
acgcucucuggccuu

SEQ ID NO: 1883821 - RNA, 17 nt, Human
acauuugcucauggaau

SEQ ID NO: 1883822 - RNA, 14 nt, Human
cucuggcuccagcu

SEQ ID NO: 1883823 - RNA, 17 nt, Human
cugcacuccagccugag

SEQ ID NO: 1883824 - RNA, 23 nt, Human
agcagcuuauucacaagacccaa

SEQ ID NO: 1883825 - RNA, 14 nt, Human
caggcuagauguau

SEQ ID NO: 1883826 - RNA, 13 nt, Human
cuaucuuugagcg

SEQ ID NO: 1883827 - RNA, 17 nt, Human
cuaugucauuugcugga

SEQ ID NO: 1883828 - RNA, 14 nt, Human
cagugauuaccagg

SEQ ID NO: 1883829 - RNA, 17 nt, Human
gaaagaaaauaacgaua

SEQ ID NO: 1883830 - RNA, 15 nt, Human
gacgcucucuggccu

SEQ ID NO: 1883831 - RNA, 23 nt, Human
gaaaacuuuaugcuaagugaaau

SEQ ID NO: 1883832 - RNA, 16 nt, Human
gcaaagcccagcuuga

SEQ ID NO: 1883833 - RNA, 15 nt, Human
gauguauguacuuca

SEQ ID NO: 1883834 - RNA, 19 nt, Human
gauguauguacuucaugcu

SEQ ID NO: 1883835 - RNA, 21 nt, Human
gcuaguaauuggaaaggcagc

SEQ ID NO: 1883836 - RNA, 16 nt, Human
guguaaguagauaggc

SEQ ID NO: 1883837 - RNA, 20 nt, Human
gguuuuaauuagugaacugc

SEQ ID NO: 1883838 - RNA, 19 nt, Human
gugauaguuguaccgcaau

SEQ ID NO: 1883839 - RNA, 12 nt, Human
gugagaugcuag

SEQ ID NO: 1883840 - RNA, 16 nt, Human
ggugagugccuguaau

SEQ ID NO: 1883841 - RNA, 12 nt, Human
ugauccugcaau

SEQ ID NO: 1883842 - RNA, 19 nt, Human
ugagucccaggcugagccu

SEQ ID NO: 1883843 - RNA, 18 nt, Human
ugagugccuguaaucaca

SEQ ID NO: 1883844 - RNA, 14 nt, Human
ucaccaaggcugau

SEQ ID NO: 1883845 - RNA, 13 nt, Human
agggaggacgcuc

SEQ ID NO: 1883846 - RNA, 14 nt, Human
agcucgugggacag

SEQ ID NO: 1883847 - RNA, 22 nt, Human
uuggucugugagaugcuagaac

SEQ ID NO: 1883848 - RNA, 19 nt, Human
uugugugaaagguacuuca

SEQ ID NO: 1883849 - RNA, 18 nt, Human
auguuuaauucugaaagc

SEQ ID NO: 1883850 - RNA, 23 nt, Human
ccaccagucugacuguuuccauc

SEQ ID NO: 1883851 - RNA, 13 nt, Human
ccaugggacaggg

SEQ ID NO: 1883852 - RNA, 23 nt, Human
cccacagcuguaugauucccagc

SEQ ID NO: 1883853 - RNA, 15 nt, Human
ccagccagcacagcc

SEQ ID NO: 1883854 - RNA, 22 nt, Human
ccaaauguucaucaaugaauga

SEQ ID NO: 1883855 - RNA, 17 nt, Human
cauccugaggcuccacu

SEQ ID NO: 1883856 - RNA, 18 nt, Human
cagccucuuagaugcagu

SEQ ID NO: 1883857 - RNA, 17 nt, Human
auugucacaggacagcc

SEQ ID NO: 1883858 - RNA, 19 nt, Human
caacacacagauuugagcu

SEQ ID NO: 1883859 - RNA, 14 nt, Human
caagaaaugaaagc

SEQ ID NO: 1883860 - RNA, 13 nt, Human
caccucauggaau

SEQ ID NO: 1883861 - RNA, 22 nt, Human
cacuuguguuuugcaagccaga

SEQ ID NO: 1883862 - RNA, 18 nt, Human
cauggaauuggagcucgu

SEQ ID NO: 1883863 - RNA, 18 nt, Human
ugaaaaaguucugcagau

SEQ ID NO: 1883864 - RNA, 16 nt, Human
auccaaugaaaugagu

SEQ ID NO: 1883865 - RNA, 15 nt, Human
augguuguauuauuu

SEQ ID NO: 1883866 - RNA, 19 nt, Human
caucaaggguacacugccu

SEQ ID NO: 1883867 - RNA, 18 nt, Human
auuaaguuuuuuuuuaaa

SEQ ID NO: 1883868 - RNA, 20 nt, Human
guaucaaaagaaagaaaauc

SEQ ID NO: 1883869 - RNA, 13 nt, Human
cugagagugaaca

SEQ ID NO: 1883870 - RNA, 14 nt, Human
ugagacucugucuc

SEQ ID NO: 1883871 - RNA, 21 nt, Human
agcccuucuuuccacagaagc

SEQ ID NO: 1883872 - RNA, 17 nt, Human
acaaaugggaaacaaaa

SEQ ID NO: 1883873 - RNA, 18 nt, Human
uaguaucaaaagaaagaa

SEQ ID NO: 1883874 - RNA, 14 nt, Human
agaaaauaacaaua

SEQ ID NO: 1883875 - RNA, 14 nt, Human
cucagucucccucc

SEQ ID NO: 1883876 - RNA, 22 nt, Human
caccucccccaucucuucuggg

SEQ ID NO: 1883877 - RNA, 15 nt, Human
aaaauaacaaugaaa

SEQ ID NO: 1883878 - RNA, 19 nt, Human
uaucucauuuccaagcaag

SEQ ID NO: 1883879 - RNA, 17 nt, Human
ucagacauagaauuaac

SEQ ID NO: 1883880 - RNA, 18 nt, Human
aagggaauuucuucaacu

SEQ ID NO: 1883881 - RNA, 20 nt, Human
aacaagccuccuuuuaaagu

SEQ ID NO: 1883882 - RNA, 17 nt, Human
ccacuggacucaccucc

SEQ ID NO: 1883883 - RNA, 21 nt, Human
gaaauguuuacagauccccaa

SEQ ID NO: 1883884 - RNA, 20 nt, Human
auaacaaugcuguauuuuaa

SEQ ID NO: 1883885 - RNA, 22 nt, Human
cccuauccuacuuccccuuccu

SEQ ID NO: 1883886 - RNA, 16 nt, Human
ucuuauaauuuaaaau

SEQ ID NO: 1883887 - RNA, 19 nt, Human
ccauccugccccugagccc

SEQ ID NO: 1883888 - RNA, 18 nt, Human
gagcgacagugagacucu

SEQ ID NO: 1883889 - RNA, 13 nt, Human
agagguccacaac

SEQ ID NO: 1883890 - RNA, 16 nt, Human
cugcucucaguucacu

SEQ ID NO: 1883891 - RNA, 12 nt, Human
uguuugaaagcu

SEQ ID NO: 1883892 - RNA, 16 nt, Human
aaauauuauguuaaaa

SEQ ID NO: 1883893 - RNA, 19 nt, Human
ccgggcgugguggugagug

SEQ ID NO: 1883894 - RNA, 16 nt, Human
uguccccuauccuacu

SEQ ID NO: 1883895 - RNA, 16 nt, Human
ccaggcugagccucag

SEQ ID NO: 1883896 - RNA, 20 nt, Human
ucauucacucaacaaacaua

SEQ ID NO: 1883897 - RNA, 22 nt, Human
agugagcagucaggaaagagaa

SEQ ID NO: 1883898 - RNA, 18 nt, Human
auuuauuacuguaagaaa

SEQ ID NO: 1883899 - RNA, 20 nt, Human
agcuacuaauuuuaaaaugu

SEQ ID NO: 1883900 - RNA, 16 nt, Human
ccuacaugagguacug

SEQ ID NO: 1883901 - RNA, 23 nt, Human
ggcuaagcuucacuguaaaauaa

SEQ ID NO: 1883902 - RNA, 13 nt, Human
agcgacagugaga

SEQ ID NO: 1883903 - RNA, 13 nt, Human
cccaaaaggcaga

SEQ ID NO: 1883904 - RNA, 19 nt, Human
auguuuacagauccccaag

SEQ ID NO: 1883905 - RNA, 19 nt, Human
ccuccauccugaggcucca

SEQ ID NO: 1883906 - RNA, 20 nt, Human
aaaagacagugaaagaaaau

SEQ ID NO: 1883907 - RNA, 17 nt, Human
agcuucacuguaaaaua

SEQ ID NO: 1883908 - RNA, 18 nt, Human
cauagguuuaauaauuuu

SEQ ID NO: 1883909 - RNA, 19 nt, Human
auucccagccagcacagcc

SEQ ID NO: 1883910 - RNA, 12 nt, Human
caacccaaaugu

SEQ ID NO: 1883911 - RNA, 16 nt, Human
guucugcacacagcac

SEQ ID NO: 1883912 - RNA, 18 nt, Human
auuuuaacucuauaaugu

SEQ ID NO: 1883913 - RNA, 12 nt, Human
cuucaacucccu

SEQ ID NO: 1883914 - RNA, 20 nt, Human
gauugugccccugcacucca

SEQ ID NO: 1883915 - RNA, 17 nt, Human
aaacauccuacaagaca

SEQ ID NO: 1883916 - RNA, 13 nt, Human
ugagcgacaguga

SEQ ID NO: 1883917 - RNA, 21 nt, Human
auuccuuuuucucuccucucc

SEQ ID NO: 1883918 - RNA, 21 nt, Human
aauaauccucaguuuuuguga

SEQ ID NO: 1883919 - RNA, 14 nt, Human
ugagaugcuagaac

SEQ ID NO: 1883920 - RNA, 20 nt, Human
auacugugugcuaaaacaag

SEQ ID NO: 1883921 - RNA, 16 nt, Human
acaugaacuuguaaag

SEQ ID NO: 1883922 - RNA, 14 nt, Human
ugaagauguagagg

SEQ ID NO: 1883923 - RNA, 13 nt, Human
auugucuagugaa

SEQ ID NO: 1883924 - RNA, 16 nt, Human
auccuacaagacacag

SEQ ID NO: 1883925 - RNA, 18 nt, Human
cccucuggcuccagcugg

SEQ ID NO: 1883926 - RNA, 18 nt, Human
uacuuuauuuucuauaau

SEQ ID NO: 1883927 - RNA, 22 nt, Human
caagcacuaaacaaagagugaa

SEQ ID NO: 1883928 - RNA, 18 nt, Human
auccccaagccuggcaag

SEQ ID NO: 1883929 - RNA, 20 nt, Human
ggagccugaucaccugcccu

SEQ ID NO: 1883930 - RNA, 18 nt, Human
cuuucacauuuaaauaaa

SEQ ID NO: 1883931 - RNA, 21 nt, Human
auuauauuuauuacuguaaga

SEQ ID NO: 1883932 - RNA, 15 nt, Human
uuagugaaauauuau

SEQ ID NO: 1883933 - RNA, 12 nt, Human
ugagagacacac

SEQ ID NO: 1883934 - RNA, 11 nt, Human
acugggacagg

SEQ ID NO: 1883935 - RNA, 16 nt, Human
cugagcgacagugaga

SEQ ID NO: 1883936 - RNA, 20 nt, Human
cagugaaagaaaauaacgau

SEQ ID NO: 1883937 - RNA, 17 nt, Human
agaaucacuugaacccg

SEQ ID NO: 1883938 - RNA, 16 nt, Human
ucuuggucucaguguc

SEQ ID NO: 1883939 - RNA, 14 nt, Human
acacugaagaagca

SEQ ID NO: 1883940 - RNA, 17 nt, Human
agcucugcccauccugc

SEQ ID NO: 1883941 - RNA, 16 nt, Human
aggccaugggacaggg

SEQ ID NO: 1883942 - RNA, 13 nt, Human
uuaaaaaagaaac

SEQ ID NO: 1883943 - RNA, 17 nt, Human
cucgugggacagucacc

SEQ ID NO: 1883944 - RNA, 13 nt, Human
aaauaaaaauaau

SEQ ID NO: 1883945 - RNA, 20 nt, Human
aguuguuucuacuacaugga

SEQ ID NO: 1883946 - RNA, 18 nt, Human
ggaggacgcucucuggcc

SEQ ID NO: 1883947 - RNA, 15 nt, Human
auuugguaaggggaa

SEQ ID NO: 1883948 - RNA, 21 nt, Human
cccccauuguggucacaggaa

SEQ ID NO: 1883949 - RNA, 19 nt, Human
gcucauggaauuggagcuc

SEQ ID NO: 1883950 - RNA, 19 nt, Human
cugagccucagucucccuc

SEQ ID NO: 1883951 - RNA, 21 nt, Human
caaagcccagcuugaaaccuu

SEQ ID NO: 1883952 - RNA, 17 nt, Human
agugauuaccagggacu

SEQ ID NO: 1883953 - RNA, 22 nt, Human
guguccccuauccuacuucccc

SEQ ID NO: 1883954 - RNA, 14 nt, Human
gcuggagcucugcc

SEQ ID NO: 1883955 - RNA, 14 nt, Human
uucagccugaaaga

SEQ ID NO: 1883956 - RNA, 16 nt, Human
ugaaguccaagcauuu

SEQ ID NO: 1883957 - RNA, 14 nt, Human
uaguuucccuugca

SEQ ID NO: 1883958 - RNA, 15 nt, Human
cuggacucaccuccc

SEQ ID NO: 1883959 - RNA, 17 nt, Human
aagacagugaaagaaaa

SEQ ID NO: 1883960 - RNA, 16 nt, Human
auaucaauuuaaaaaa

SEQ ID NO: 1883961 - RNA, 16 nt, Human
uuguaaaggaauuuaa

SEQ ID NO: 1883962 - RNA, 19 nt, Human
ggaaaaaauaacaaugaaa

SEQ ID NO: 1883963 - RNA, 15 nt, Human
augaauuaaguuuuu

SEQ ID NO: 1883964 - RNA, 22 nt, Human
cuucagccugaaagaggaauga

SEQ ID NO: 1883965 - RNA, 18 nt, Human
cuuccucugagccuuggg

SEQ ID NO: 1883966 - RNA, 22 nt, Human
uauuccuuuuucucuccucucc

SEQ ID NO: 1883967 - RNA, 18 nt, Human
uauuuucaguuauuauau

SEQ ID NO: 1883968 - RNA, 14 nt, Human
cauagaaguaaaaa

SEQ ID NO: 1883969 - RNA, 18 nt, Human
cuucacuguaaaauaaua

SEQ ID NO: 1883970 - RNA, 23 nt, Human
ugcauagguuuaauaauuuuuaa

SEQ ID NO: 1883971 - RNA, 23 nt, Human
ugcagagguccacaacacacaga

SEQ ID NO: 1883972 - RNA, 16 nt, Human
ugugagaugcuagaac

SEQ ID NO: 1883973 - RNA, 19 nt, Human
uagugagcagucaggaaag

SEQ ID NO: 1883974 - RNA, 14 nt, Human
gauuaguacacacu

SEQ ID NO: 1883975 - RNA, 14 nt, Human
acccgggaggcaga

SEQ ID NO: 1883976 - RNA, 13 nt, Human
caccaaggagcca

SEQ ID NO: 1883977 - RNA, 15 nt, Human
gccucuuagaugcag

SEQ ID NO: 1883978 - RNA, 12 nt, Human
aauuuuaaaaug

SEQ ID NO: 1883979 - RNA, 19 nt, Human
acauuuguauaaaauaauu

SEQ ID NO: 1883980 - RNA, 15 nt, Human
auaaaguguuugaaa

SEQ ID NO: 1883981 - RNA, 23 nt, Human
uccaacuaucucauuuccaagca

SEQ ID NO: 1883982 - RNA, 22 nt, Human
caguauggcagcuuuccucaaa

SEQ ID NO: 1883983 - RNA, 18 nt, Human
acugccuucucaacucca

SEQ ID NO: 1883984 - RNA, 23 nt, Human
agccuugggaccccugagcuugc

SEQ ID NO: 1883985 - RNA, 13 nt, Human
uacagagacagaa

SEQ ID NO: 1883986 - RNA, 16 nt, Human
ugcuguauuuuaaaag

SEQ ID NO: 1883987 - RNA, 20 nt, Human
auuacuguaagaaaauauca

SEQ ID NO: 1883988 - RNA, 15 nt, Human
agcucuaucaccaag

SEQ ID NO: 1883989 - RNA, 18 nt, Human
cagggaggacgcucucug

SEQ ID NO: 1883990 - RNA, 20 nt, Human
uuucuucaacucccugcccc

SEQ ID NO: 1883991 - RNA, 15 nt, Human
uuuagugaaauauua

SEQ ID NO: 1883992 - RNA, 23 nt, Human
uccaaacugacucuuaagaagac

SEQ ID NO: 1883993 - RNA, 16 nt, Human
aagaaaauaacaauaa

SEQ ID NO: 1883994 - RNA, 20 nt, Human
agcccuggugggcagagagg

SEQ ID NO: 1883995 - RNA, 19 nt, Human
cccugccccccagcccucc

SEQ ID NO: 1883996 - RNA, 16 nt, Human
uacauuuguauaaaau

SEQ ID NO: 1883997 - RNA, 15 nt, Human
gacucaccuccccca

SEQ ID NO: 1883998 - RNA, 21 nt, Human
gauaaaagacagugaaagaaa

SEQ ID NO: 1883999 - RNA, 12 nt, Human
cucauggaauug

SEQ ID NO: 1884000 - RNA, 16 nt, Human
gagcucgugggacagu

SEQ ID NO: 1884001 - RNA, 16 nt, Human
ucucuaggaaauauuu

SEQ ID NO: 1884002 - RNA, 21 nt, Human
guccccuauccuacuuccccu

SEQ ID NO: 1884003 - RNA, 21 nt, Human
cauuuucuucucacauuuaua

SEQ ID NO: 1884004 - RNA, 22 nt, Human
gaaaaucuuauaauuuaaaaua

SEQ ID NO: 1884005 - RNA, 16 nt, Human
ugcaugguuuagaaag

SEQ ID NO: 1884006 - RNA, 19 nt, Human
cacaggaaccacaagacug

SEQ ID NO: 1884007 - RNA, 21 nt, Human
cgacagugagacucugucuca

SEQ ID NO: 1884008 - RNA, 16 nt, Human
uuaauaauuuuuaauu

SEQ ID NO: 1884009 - RNA, 20 nt, Human
agaugcaguucugaagaaga

SEQ ID NO: 1884010 - RNA, 17 nt, Human
gccugagcgacagugag

SEQ ID NO: 1884011 - RNA, 14 nt, Human
cacuuauaggaauu

SEQ ID NO: 1884012 - RNA, 17 nt, Human
ugguucccuugaugaag

SEQ ID NO: 1884013 - RNA, 18 nt, Human
gaugccccgucccccucu

SEQ ID NO: 1884014 - RNA, 19 nt, Human
auaaaagacaaggaaaaaa

SEQ ID NO: 1884015 - RNA, 19 nt, Human
uuauggcacuaguauuucu

SEQ ID NO: 1884016 - RNA, 15 nt, Human
cagugaaagaaaaua

SEQ ID NO: 1884017 - RNA, 22 nt, Human
accuaacgaaguauccuucagc

SEQ ID NO: 1884018 - RNA, 20 nt, Human
aaauaauuuuuauauuugaa

SEQ ID NO: 1884019 - RNA, 23 nt, Human
ucuccauguacuggcaagaccug

SEQ ID NO: 1884020 - RNA, 22 nt, Human
aaauaacaaugaaaguugauaa

SEQ ID NO: 1884021 - RNA, 18 nt, Human
gccuuggggcugaugcag

SEQ ID NO: 1884022 - RNA, 21 nt, Human
gaaaaaaagcuuuuuuugaau

SEQ ID NO: 1884023 - RNA, 17 nt, Human
aaauaacgauaaaagac

SEQ ID NO: 1884024 - RNA, 15 nt, Human
gcaacccaaauguuc

SEQ ID NO: 1884025 - RNA, 21 nt, Human
gcacuguggguagacacacau

SEQ ID NO: 1884026 - RNA, 16 nt, Human
uaaugaauacuuuaua

SEQ ID NO: 1884027 - RNA, 20 nt, Human
aagggcuguuauaaucuuuc

SEQ ID NO: 1884028 - RNA, 18 nt, Human
caaggcuagaaccaccug

SEQ ID NO: 1884029 - RNA, 23 nt, Human
ugaauuauguuugcauguucacu

SEQ ID NO: 1884030 - RNA, 12 nt, Human
aagaaaauaacg

SEQ ID NO: 1884031 - RNA, 12 nt, Human
ucuacacuccag

SEQ ID NO: 1884032 - RNA, 21 nt, Human
uagggugauauuaaccagggg

SEQ ID NO: 1884033 - RNA, 16 nt, Human
acauccuacaagacac

SEQ ID NO: 1884034 - RNA, 17 nt, Human
cagugaaagaaaauaac

SEQ ID NO: 1884035 - RNA, 21 nt, Human
uccuucagccugaaagaggaa

SEQ ID NO: 1884036 - RNA, 19 nt, Human
gugacuuaaugccacuaaa

SEQ ID NO: 1884037 - RNA, 20 nt, Human
uauaugcuaagucuuauaua

SEQ ID NO: 1884038 - RNA, 23 nt, Human
uagauguauagguugaugguggu

SEQ ID NO: 1884039 - RNA, 16 nt, Human
aauauaaauaaaaaua

SEQ ID NO: 1884040 - RNA, 21 nt, Human
cucaguccaugaagauguaga

SEQ ID NO: 1884041 - RNA, 13 nt, Human
cgggaggcagagg

SEQ ID NO: 1884042 - RNA, 17 nt, Human
ugaaauauuauuuuaua

SEQ ID NO: 1884043 - RNA, 13 nt, Human
ugauuauauguca

SEQ ID NO: 1884044 - RNA, 13 nt, Human
aucaaugaaugaa

SEQ ID NO: 1884045 - RNA, 16 nt, Human
accucugccucagaaa

SEQ ID NO: 1884046 - RNA, 13 nt, Human
aaaguguuugaaa

SEQ ID NO: 1884047 - RNA, 16 nt, Human
cccacuggacucaccu

SEQ ID NO: 1884048 - RNA, 23 nt, Human
uuguaacaagccuccuuuuaaag

SEQ ID NO: 1884049 - RNA, 15 nt, Human
uauaaauaaaaauaa

SEQ ID NO: 1884050 - RNA, 15 nt, Human
aauauaaauaaaaau

SEQ ID NO: 1884051 - RNA, 16 nt, Human
uaaaggaauuuaaaaa

SEQ ID NO: 1884052 - RNA, 16 nt, Human
aaaauaauccucaguu

SEQ ID NO: 1884053 - RNA, 16 nt, Human
aauuacauuuguauaa

SEQ ID NO: 1884054 - RNA, 22 nt, Human
ccaaacauccuacaagacacag

SEQ ID NO: 1884055 - RNA, 19 nt, Human
cagcacgggggccaaggau

SEQ ID NO: 1884056 - RNA, 17 nt, Human
aauaacaauaaaagaca

SEQ ID NO: 1884057 - RNA, 18 nt, Human
agcugcucaauaaaguac

SEQ ID NO: 1884058 - RNA, 21 nt, Human
aagacucgggauuaguacaca

SEQ ID NO: 1884059 - RNA, 14 nt, Human
uggcuugaguuuaa

SEQ ID NO: 1884060 - RNA, 17 nt, Human
caaauauaaauaaaaau

SEQ ID NO: 1884061 - RNA, 15 nt, Human
auaauuuugugaagc

SEQ ID NO: 1884062 - RNA, 23 nt, Human
cucuacuaaaaauacaaaaaaaa

SEQ ID NO: 1884063 - RNA, 21 nt, Human
ccugaucaccugcccugcuga

SEQ ID NO: 1884064 - RNA, 15 nt, Human
acucaacaaacauaa

SEQ ID NO: 1884065 - RNA, 14 nt, Human
ugcuagaacucccu

SEQ ID NO: 1884066 - RNA, 22 nt, Human
auauauaacaaugcuguauuuu

SEQ ID NO: 1884067 - RNA, 19 nt, Human
cucugcauacucauuagga

SEQ ID NO: 1884068 - RNA, 20 nt, Human
aauuuugugaagcaaaauuu

SEQ ID NO: 1884069 - RNA, 17 nt, Human
cgauaaaagacagugaa

SEQ ID NO: 1884070 - RNA, 17 nt, Human
ugaacuugguuuuaauu

SEQ ID NO: 1884071 - RNA, 14 nt, Human
agagacagaaagca

SEQ ID NO: 1884072 - RNA, 13 nt, Human
acuaauuuuaaaa

SEQ ID NO: 1884073 - RNA, 18 nt, Human
uuuuagugaaauauuauu

SEQ ID NO: 1884074 - RNA, 17 nt, Human
cccacuggacucaccuc

SEQ ID NO: 1884075 - RNA, 17 nt, Human
uuaaauggucaauuuug

SEQ ID NO: 1884076 - RNA, 16 nt, Human
uagcuacuaauuuuaa

SEQ ID NO: 1884077 - RNA, 22 nt, Human
gauaaaagacagugaaagaaaa

SEQ ID NO: 1884078 - RNA, 17 nt, Human
cugccucagaaaacaag

SEQ ID NO: 1884079 - RNA, 12 nt, Human
uuuuuuuuaaaa

SEQ ID NO: 1884080 - RNA, 17 nt, Human
ggccaugggacagggag

SEQ ID NO: 1884081 - RNA, 21 nt, Human
uccuacaagacacagugacca

SEQ ID NO: 1884082 - RNA, 13 nt, Human
aucuacacuccag

SEQ ID NO: 1884083 - RNA, 20 nt, Human
aagucuuucacauuuaaaua

SEQ ID NO: 1884084 - RNA, 15 nt, Human
gcagagguugcagug

SEQ ID NO: 1884085 - RNA, 13 nt, Human
gcucucuggccuu

SEQ ID NO: 1884086 - RNA, 16 nt, Human
augcuaagugaaauaa

SEQ ID NO: 1884087 - RNA, 21 nt, Human
uuccuaauuccacagcugcuc

SEQ ID NO: 1884088 - RNA, 18 nt, Human
ugccauaauuacuauguc

SEQ ID NO: 1884089 - RNA, 18 nt, Human
gccccugcacuccagccu

SEQ ID NO: 1884090 - RNA, 14 nt, Human
aauauuuauuuuaa

SEQ ID NO: 1884091 - RNA, 21 nt, Human
guauacugugugcuaaaacaa

SEQ ID NO: 1884092 - RNA, 20 nt, Human
agccuaguugaucagcuuau

SEQ ID NO: 1884093 - RNA, 15 nt, Human
ccucauguccacugg

SEQ ID NO: 1884094 - RNA, 16 nt, Human
aaaugggaaacaaaag

SEQ ID NO: 1884095 - RNA, 15 nt, Human
ugcaauuccacuuau

SEQ ID NO: 1884096 - RNA, 18 nt, Human
uuauuacuguaagaaaau

SEQ ID NO: 1884097 - RNA, 16 nt, Human
cuuauaauuuaaaaua

SEQ ID NO: 1884098 - RNA, 16 nt, Human
uuuuagugaaauauua

SEQ ID NO: 1884099 - RNA, 22 nt, Human
aauuuaaaaaaaaaccugagcc

SEQ ID NO: 1884100 - RNA, 13 nt, Human
agacacagugacc

SEQ ID NO: 1884101 - RNA, 17 nt, Human
cauuuguauaaaauaau

SEQ ID NO: 1884102 - RNA, 14 nt, Human
aaaagacagugaaa

SEQ ID NO: 1884103 - RNA, 15 nt, Human
uugcucauggaauug

SEQ ID NO: 1884104 - RNA, 16 nt, Human
uuauaauuuaaaauau

SEQ ID NO: 1884105 - RNA, 13 nt, Human
uucuauaauuuaa

SEQ ID NO: 1884106 - RNA, 18 nt, Human
gaccccugagcuugcaga

SEQ ID NO: 1884107 - RNA, 23 nt, Human
ugucaauucuugccaaauauaaa

SEQ ID NO: 1884108 - RNA, 12 nt, Human
uuuuauauuuga

SEQ ID NO: 1884109 - RNA, 14 nt, Human
cucccuuggggccu

SEQ ID NO: 1884110 - RNA, 18 nt, Human
uauuuucuauaauuuaaa

SEQ ID NO: 1884111 - RNA, 11 nt, Human
cgauaaaagac

SEQ ID NO: 1884112 - RNA, 22 nt, Human
caagcucuaucaccaaggagcc

SEQ ID NO: 1884113 - RNA, 20 nt, Human
uaacgauaaaagacagugaa

SEQ ID NO: 1884114 - RNA, 22 nt, Human
auauaaauaaaaauaauccuca

SEQ ID NO: 1884115 - RNA, 20 nt, Human
guauuauuuuuuaaaaaaau

SEQ ID NO: 1884116 - RNA, 15 nt, Human
uggacucaccucccc

SEQ ID NO: 1884117 - RNA, 16 nt, Human
ucaucaaugaaugaau

SEQ ID NO: 1884118 - RNA, 13 nt, Human
uuuaaaaaagaaa

SEQ ID NO: 1884119 - RNA, 19 nt, Human
auaauuuuuauauuugaaa

SEQ ID NO: 1884120 - RNA, 18 nt, Human
aaguugauaugccuuuuc

SEQ ID NO: 1884121 - RNA, 17 nt, Human
gacucaccucccccauc

SEQ ID NO: 1884122 - RNA, 18 nt, Human
acugugugcuaaaacaag

SEQ ID NO: 1884123 - RNA, 20 nt, Human
agagacacacugaagaagca

SEQ ID NO: 1884124 - RNA, 18 nt, Human
acagaaagcagaacagug

SEQ ID NO: 1884125 - RNA, 21 nt, Human
aaauaauuuuuauauuugaaa

SEQ ID NO: 1884126 - RNA, 15 nt, Human
gcaagcucuaucacc

SEQ ID NO: 1884127 - RNA, 23 nt, Human
uggcuugaguuuaaauuguaaua

SEQ ID NO: 1884128 - RNA, 18 nt, Human
cagauuugagcucagccc

SEQ ID NO: 1884129 - RNA, 15 nt, Human
cuacuaauuuuaaaa

SEQ ID NO: 1884130 - RNA, 12 nt, Human
aauaaaguacaa

SEQ ID NO: 1884131 - RNA, 12 nt, Human
ccuucagccuga

SEQ ID NO: 1884132 - RNA, 13 nt, Human
cucagaaaacaag

SEQ ID NO: 1884133 - RNA, 18 nt, Human
auuauuuuuuaaaaaaau

SEQ ID NO: 1884134 - RNA, 21 nt, Human
ugaugcuacaggauuugaaau

SEQ ID NO: 1884135 - RNA, 14 nt, Human
ugcucauggaauug

SEQ ID NO: 1884136 - RNA, 14 nt, Human
acaaauccaaugaa

SEQ ID NO: 1884137 - RNA, 18 nt, Human
uauaacaaugcuguauuu

SEQ ID NO: 1884138 - RNA, 15 nt, Human
acagugaaagaaaau

SEQ ID NO: 1884139 - RNA, 20 nt, Human
aauuaaguuuuuuuuuaaaa

SEQ ID NO: 1884140 - RNA, 20 nt, Human
ugccccccagcccuccuuau

SEQ ID NO: 1884141 - RNA, 15 nt, Human
cugcacuccagccug

SEQ ID NO: 1884142 - RNA, 23 nt, Human
uuuccaucaaggguacacugccu

SEQ ID NO: 1884143 - RNA, 14 nt, Human
ccccugagcuugca

SEQ ID NO: 1884144 - RNA, 19 nt, Human
auacuaauuauacccccug

SEQ ID NO: 1884145 - RNA, 14 nt, Human
auccaaugaaauga

SEQ ID NO: 1884146 - RNA, 15 nt, Human
gccucagucucccuc

SEQ ID NO: 1884147 - RNA, 15 nt, Human
cucguggaacaguua

SEQ ID NO: 1884148 - RNA, 20 nt, Human
uccagccugagcgacaguga

SEQ ID NO: 1884149 - RNA, 13 nt, Human
ccagcacagccuc

SEQ ID NO: 1884150 - RNA, 23 nt, Human
caugcugucuacacuaagagaga

SEQ ID NO: 1884151 - RNA, 14 nt, Human
uaaaauccauacau

SEQ ID NO: 1884152 - RNA, 17 nt, Human
uugugaagcaaaauuuu

SEQ ID NO: 1884153 - RNA, 23 nt, Human
cucauguccacugguucuucuug

SEQ ID NO: 1884154 - RNA, 22 nt, Human
caccagucugacuguuuccauc

SEQ ID NO: 1884155 - RNA, 19 nt, Human
aaaauaacgauaaaagaca

SEQ ID NO: 1884156 - RNA, 20 nt, Human
ucaagucuuucacauuuaaa

SEQ ID NO: 1884157 - RNA, 21 nt, Human
cagugagacagcucugcauac

SEQ ID NO: 1884158 - RNA, 14 nt, Human
auuucuaugaaaua

SEQ ID NO: 1884159 - RNA, 19 nt, Human
uaguuuaugauuccaccua

SEQ ID NO: 1884160 - RNA, 23 nt, Human
uguugcccacagcuguaugauuc

SEQ ID NO: 1884161 - RNA, 23 nt, Human
cuacacgagauacagaauuuuau

SEQ ID NO: 1884162 - RNA, 20 nt, Human
auaagccagacaucaacaga

SEQ ID NO: 1884163 - RNA, 15 nt, Human
ggccuucggccucca

SEQ ID NO: 1884164 - RNA, 13 nt, Human
ccaggcugagccu

SEQ ID NO: 1884165 - RNA, 17 nt, Human
uccacaacacacagauu

SEQ ID NO: 1884166 - RNA, 22 nt, Human
caaauuuacagagacagaaagc

SEQ ID NO: 1884167 - RNA, 14 nt, Human
cuuggucugugaga

SEQ ID NO: 1884168 - RNA, 14 nt, Human
aucaaaagaaagaa

SEQ ID NO: 1884169 - RNA, 11 nt, Human
caucuagugag

SEQ ID NO: 1884170 - RNA, 15 nt, Human
agaauaccacaggaa

SEQ ID NO: 1884171 - RNA, 20 nt, Human
uccaagccucauguccacug

SEQ ID NO: 1884172 - RNA, 22 nt, Human
uuugaaacgaggauugggaaaa

SEQ ID NO: 1884173 - RNA, 16 nt, Human
ucugcagauaaacagu

SEQ ID NO: 1884174 - RNA, 13 nt, Human
auaacgauaaaag

SEQ ID NO: 1884175 - RNA, 15 nt, Human
caaggaaaaaauaac

SEQ ID NO: 1884176 - RNA, 12 nt, Human
gccccugagccc

SEQ ID NO: 1884177 - RNA, 24 nt, Human
cauaugaaaaggcuaagcuucacu

SEQ ID NO: 1884178 - RNA, 12 nt, Human
aucguguccccu

SEQ ID NO: 1884179 - RNA, 19 nt, Human
caaggaugccccguccccc

SEQ ID NO: 1884180 - RNA, 13 nt, Human
caacaucuaguga

SEQ ID NO: 1884181 - RNA, 20 nt, Human
ucaaaacuucagacauagaa

SEQ ID NO: 1884182 - RNA, 22 nt, Human
aaacaaggaugaauuaaguuuu

SEQ ID NO: 1884183 - RNA, 20 nt, Human
acagcccuucuuuccacaga

SEQ ID NO: 1884184 - RNA, 19 nt, Human
auuuugugaagcaaaauuu

SEQ ID NO: 1884185 - RNA, 13 nt, Human
acacacaugaagu

SEQ ID NO: 1884186 - RNA, 16 nt, Human
ugcaaauugucacagg

SEQ ID NO: 1884187 - RNA, 22 nt, Human
gucacaggaaguagaggaggcc

SEQ ID NO: 1884188 - RNA, 15 nt, Human
ugucaauaaaaucca

SEQ ID NO: 1884189 - RNA, 21 nt, Human
caucuagcaugucgucaaagc

SEQ ID NO: 1884190 - RNA, 18 nt, Human
uuacaaaugggaaacaaa

SEQ ID NO: 1884191 - RNA, 11 nt, Human
cauaugaaaag

SEQ ID NO: 1884192 - RNA, 23 nt, Human
acgaggauugggaaaaaguaauu

SEQ ID NO: 1884193 - RNA, 14 nt, Human
aaccugagccccaa

SEQ ID NO: 1884194 - RNA, 21 nt, Human
ccucuguucugcacacagcac

SEQ ID NO: 1884195 - RNA, 18 nt, Human
uuggggccuaugcagagg

SEQ ID NO: 1884196 - RNA, 19 nt, Human
cucugccucagaaaacaag

SEQ ID NO: 1884197 - RNA, 22 nt, Human
gcacagccucuuagaugcaguu

SEQ ID NO: 1884198 - RNA, 22 nt, Human
gcuugcagagaugaggccgcca

SEQ ID NO: 1884199 - RNA, 22 nt, Human
aaauguugacaugggacauuug

SEQ ID NO: 1884200 - RNA, 22 nt, Human
ucuacuaaaaauacaaaaaaaa

SEQ ID NO: 1884201 - RNA, 23 nt, Human
auaucuuuuuuuuaauaaaccau

SEQ ID NO: 1884202 - RNA, 14 nt, Human
aaauauuauuuuau

SEQ ID NO: 1884203 - RNA, 20 nt, Human
uaaaagacaaggaaaaaaua

SEQ ID NO: 1884204 - RNA, 14 nt, Human
cugccccccagccc

SEQ ID NO: 1884205 - RNA, 11 nt, Human
augggacaggg

SEQ ID NO: 1884206 - RNA, 23 nt, Human
ggaggcagagguugcagugagcc

SEQ ID NO: 1884207 - RNA, 16 nt, Human
gugagacagcucugca

SEQ ID NO: 1884208 - RNA, 22 nt, Human
aggacaccauuuuggcaagcuc

SEQ ID NO: 1884209 - RNA, 17 nt, Human
cuauccuacuuccccuu

SEQ ID NO: 1884210 - RNA, 12 nt, Human
acaagacacagu

SEQ ID NO: 1884211 - RNA, 17 nt, Human
ugaaggauuuauguuua

SEQ ID NO: 1884212 - RNA, 20 nt, Human
uugauaaguacaugauaagc

SEQ ID NO: 1884213 - RNA, 14 nt, Human
gaaagcagaacagu

SEQ ID NO: 1884214 - RNA, 16 nt, Human
acaugaaguccaagca

SEQ ID NO: 1884215 - RNA, 16 nt, Human
auaacuggaaacuuca

SEQ ID NO: 1884216 - RNA, 17 nt, Human
acccacuggacucaccu

SEQ ID NO: 1884217 - RNA, 20 nt, Human
agcuuauugucuagugaaac

SEQ ID NO: 1884218 - RNA, 15 nt, Human
uccaagccucauguc

SEQ ID NO: 1884219 - RNA, 15 nt, Human
cccugcaaagcccag

SEQ ID NO: 1884220 - RNA, 14 nt, Human
ugcuguauuuuaaa

SEQ ID NO: 1884221 - RNA, 15 nt, Human
aaugaauggcuaagc

SEQ ID NO: 1884222 - RNA, 17 nt, Human
ccucagucucccucccu

SEQ ID NO: 1884223 - RNA, 18 nt, Human
acaaaaggauaaugaaua

SEQ ID NO: 1884224 - RNA, 12 nt, Human
ucaccccuugcc

SEQ ID NO: 1884225 - RNA, 19 nt, Human
cggccuccauccugaggcu

SEQ ID NO: 1884226 - RNA, 15 nt, Human
aagcacuaaacaaag

SEQ ID NO: 1884227 - RNA, 18 nt, Human
uaaaauccauacauuugu

SEQ ID NO: 1884228 - RNA, 18 nt, Human
cuccauuuuuagugaaau

SEQ ID NO: 1884229 - RNA, 13 nt, Human
ucucccucccuug

SEQ ID NO: 1884230 - RNA, 13 nt, Human
gaagaacugaaau

SEQ ID NO: 1884231 - RNA, 19 nt, Human
aguauuucuaugaaauauu

SEQ ID NO: 1884232 - RNA, 21 nt, Human
acaugagguacugagagugaa

SEQ ID NO: 1884233 - RNA, 15 nt, Human
ccuugccaugugcua

SEQ ID NO: 1884234 - RNA, 14 nt, Human
gagcccauggcacu

SEQ ID NO: 1884235 - RNA, 18 nt, Human
guauuauuuuuuaaaaaa

SEQ ID NO: 1884236 - RNA, 22 nt, Human
cugggacaggggagaaccuagg

SEQ ID NO: 1884237 - RNA, 11 nt, Human
auuuuugaagc

SEQ ID NO: 1884238 - RNA, 15 nt, Human
acaagacccaaaagg

SEQ ID NO: 1884239 - RNA, 16 nt, Human
ugacaagcucacagac

SEQ ID NO: 1884240 - RNA, 14 nt, Human
auuugaaauuguau

SEQ ID NO: 1884241 - RNA, 20 nt, Human
ugauuauaugucacuuugcu

SEQ ID NO: 1884242 - RNA, 12 nt, Human
cuugguuuuaau

SEQ ID NO: 1884243 - RNA, 21 nt, Human
caaggaaaaaauaacaaugaa

SEQ ID NO: 1884244 - RNA, 14 nt, Human
guauuuuaaaagaa

SEQ ID NO: 1884245 - RNA, 20 nt, Human
accugauuucugagcauuua

SEQ ID NO: 1884246 - RNA, 18 nt, Human
ucaaggguacacugccuu

SEQ ID NO: 1884247 - RNA, 23 nt, Human
gggagccugaucaccugcccugc

SEQ ID NO: 1884248 - RNA, 14 nt, Human
ggaaguagaggagg

SEQ ID NO: 1884249 - RNA, 15 nt, Human
cucaacaaacauaau

SEQ ID NO: 1884250 - RNA, 21 nt, Human
cugagccucagucucccuccc

SEQ ID NO: 1884251 - RNA, 15 nt, Human
aaaauacaaaaaaaa

SEQ ID NO: 1884252 - RNA, 18 nt, Human
cucccuuggggccuaugc

SEQ ID NO: 1884253 - RNA, 22 nt, Human
uuguaacaagccuccuuuuaaa

SEQ ID NO: 1884254 - RNA, 19 nt, Human
uggugagugccuguaauca

SEQ ID NO: 1884255 - RNA, 16 nt, Human
cuucuggguuccuucc

SEQ ID NO: 1884256 - RNA, 18 nt, Human
cuggaaacuucagcgguu

SEQ ID NO: 1884257 - RNA, 17 nt, Human
uaucaauuuaaaaaaaa

SEQ ID NO: 1884258 - RNA, 12 nt, Human
auucugaaagca

SEQ ID NO: 1884259 - RNA, 14 nt, Human
cuuucauaauaagu

SEQ ID NO: 1884260 - RNA, 23 nt, Human
aagagccuuuuuuugaaaaaaag

SEQ ID NO: 1884261 - RNA, 13 nt, Human
aagugcagccccg

SEQ ID NO: 1884262 - RNA, 20 nt, Human
ucaauaaaauccauacauuu

SEQ ID NO: 1884263 - RNA, 21 nt, Human
agggugauauuaaccaggggc

SEQ ID NO: 1884264 - RNA, 15 nt, Human
cauguccacugguuc

SEQ ID NO: 1884265 - RNA, 17 nt, Human
gucaaagcugaaaugga

SEQ ID NO: 1884266 - RNA, 20 nt, Human
cccuuccuaauuccacagcu

SEQ ID NO: 1884267 - RNA, 19 nt, Human
acagugauuaccagggacu

SEQ ID NO: 1884268 - RNA, 20 nt, Human
guuccuuccucugagccuug

SEQ ID NO: 1884269 - RNA, 14 nt, Human
uuucuaugaaauau

SEQ ID NO: 1884270 - RNA, 22 nt, Human
uuaccucugccucagaaaacaa

SEQ ID NO: 1884271 - RNA, 22 nt, Human
uuuauggcacuaguauuucuau

SEQ ID NO: 1884272 - RNA, 15 nt, Human
uacuaauuuuaaaau

SEQ ID NO: 1884273 - RNA, 13 nt, Human
cuaugaaauauua

SEQ ID NO: 1884274 - RNA, 18 nt, Human
aaaguaacccuacaaaac

SEQ ID NO: 1884275 - RNA, 22 nt, Human
agacucugucucaguccaugaa

SEQ ID NO: 1884276 - RNA, 22 nt, Human
ugggcacuguggguagacacac

SEQ ID NO: 1884277 - RNA, 18 nt, Human
uggucaauuuuguuaugu

SEQ ID NO: 1884278 - RNA, 14 nt, Human
acaagagcuuaaca

SEQ ID NO: 1884279 - RNA, 21 nt, Human
aagucuuucacauuuaaauaa

SEQ ID NO: 1884280 - RNA, 15 nt, Human
aagaagugaaaaucu

SEQ ID NO: 1884281 - RNA, 14 nt, Human
ccucagucucccuc

SEQ ID NO: 1884282 - RNA, 14 nt, Human
uugacccacaagaa

SEQ ID NO: 1884283 - RNA, 23 nt, Human
uauguuaaaacugggacagggga

SEQ ID NO: 1884284 - RNA, 15 nt, Human
agacaaggaaaaaau

SEQ ID NO: 1884285 - RNA, 16 nt, Human
aauuucuucaacuccc

SEQ ID NO: 1884286 - RNA, 22 nt, Human
caaugcuguauuuuaaaagaau

SEQ ID NO: 1884287 - RNA, 21 nt, Human
ccaaggaugccccgucccccu

SEQ ID NO: 1884288 - RNA, 14 nt, Human
aaaggaauuuaaaa

SEQ ID NO: 1884289 - RNA, 12 nt, Human
uucucuaggaaa

SEQ ID NO: 1884290 - RNA, 14 nt, Human
gccucagucucccu

SEQ ID NO: 1884291 - RNA, 13 nt, Human
uaacaauaaaaga

SEQ ID NO: 1884292 - RNA, 14 nt, Human
aaaacuucagacau

SEQ ID NO: 1884293 - RNA, 18 nt, Human
uuacuguaagaaaauauc

SEQ ID NO: 1884294 - RNA, 20 nt, Human
ccccuauccuacuuccccuu

SEQ ID NO: 1884295 - RNA, 20 nt, Human
aaaacaagcacuaaacaaag

SEQ ID NO: 1884296 - RNA, 11 nt, Human
ccugagcccca

SEQ ID NO: 1884297 - RNA, 17 nt, Human
agcgacagugagacucu

SEQ ID NO: 1884298 - RNA, 18 nt, Human
ccugcaaagcccagcuug

SEQ ID NO: 1884299 - RNA, 23 nt, Human
auuauauggcuugaguuuaaauu

SEQ ID NO: 1884300 - RNA, 15 nt, Human
cccugccccccagcc

SEQ ID NO: 1884301 - RNA, 19 nt, Human
auuuucaguuauuauauuu

SEQ ID NO: 1884302 - RNA, 21 nt, Human
gacagaaagcagaacagugau

SEQ ID NO: 1884303 - RNA, 15 nt, Human
ugaaauuguauuaca

SEQ ID NO: 1884304 - RNA, 18 nt, Human
uaaaagacagugaaagaa

SEQ ID NO: 1884305 - RNA, 22 nt, Human
gaugguucccuugaugaagaag

SEQ ID NO: 1884306 - RNA, 14 nt, Human
cagugaaagaaaau

SEQ ID NO: 1884307 - RNA, 15 nt, Human
cuuaagaagacugca

SEQ ID NO: 1884308 - RNA, 22 nt, Human
ugaaaaaguucugcagauaaac

SEQ ID NO: 1884309 - RNA, 22 nt, Human
cuggguuccuuccucugagccu

SEQ ID NO: 1884310 - RNA, 13 nt, Human
cuuaucaaaggac

SEQ ID NO: 1884311 - RNA, 17 nt, Human
gauaaaagacagugaaa

SEQ ID NO: 1884312 - RNA, 17 nt, Human
uaauuccacagcugcuc

SEQ ID NO: 1884313 - RNA, 16 nt, Human
aucaaaagaaagaaaa

SEQ ID NO: 1884314 - RNA, 13 nt, Human
ccaccugccuaua

SEQ ID NO: 1884315 - RNA, 14 nt, Human
uccacuuggucugu

SEQ ID NO: 1884316 - RNA, 15 nt, Human
uauaauuuaaauaua

SEQ ID NO: 1884317 - RNA, 22 nt, Human
aaagagugaaggauuuauguuu

SEQ ID NO: 1884318 - RNA, 22 nt, Human
ggguuccuuccucugagccuug

SEQ ID NO: 1884319 - RNA, 18 nt, Human
aaagaaaaucaggcuggc

SEQ ID NO: 1884320 - RNA, 19 nt, Human
auuuucuauaauuuaaaua

SEQ ID NO: 1884321 - RNA, 19 nt, Human
auugaggacacugauaugg

SEQ ID NO: 1884322 - RNA, 17 nt, Human
cccacuagacccacugg

SEQ ID NO: 1884323 - RNA, 18 nt, Human
cuucucacauuuauauuu

SEQ ID NO: 1884324 - RNA, 17 nt, Human
uucugagcauuuaauau

SEQ ID NO: 1884325 - RNA, 15 nt, Human
aagaaaauaacaaua

SEQ ID NO: 1884326 - RNA, 22 nt, Human
uuccccuuccuaauuccacagc

SEQ ID NO: 1884327 - RNA, 14 nt, Human
cagauuugagcuca

SEQ ID NO: 1884328 - RNA, 12 nt, Human
acaagaaaugaa

SEQ ID NO: 1884329 - RNA, 22 nt, Human
cuucaacucccugccccccagc

SEQ ID NO: 1884330 - RNA, 22 nt, Human
aagagccuuuuuuugaaaaaaa

SEQ ID NO: 1884331 - RNA, 12 nt, Human
aaaugaaagcag

SEQ ID NO: 1884332 - RNA, 20 nt, Human
aauaucuuuuuuuuaauaaa

SEQ ID NO: 1884333 - RNA, 15 nt, Human
uccagauccuggaaa

SEQ ID NO: 1884334 - RNA, 17 nt, Human
aaauaacaauaaaagac

SEQ ID NO: 1884335 - RNA, 13 nt, Human
agccucagucucc

SEQ ID NO: 1884336 - RNA, 17 nt, Human
uuuuuaauuauauggcu

SEQ ID NO: 1884337 - RNA, 17 nt, Human
agucccaggcugagccu

SEQ ID NO: 1884338 - RNA, 20 nt, Human
ugaaaaucuuauaauuuaaa

SEQ ID NO: 1884339 - RNA, 22 nt, Human
ugaccauacuaauuauaccccc

SEQ ID NO: 1884340 - RNA, 13 nt, Human
uggacgagaaaac

SEQ ID NO: 1884341 - RNA, 16 nt, Human
cacuuaaaaaugguuu

SEQ ID NO: 1884342 - RNA, 18 nt, Human
cuccauccugaggcucca

SEQ ID NO: 1884343 - RNA, 18 nt, Human
cuuugagcgcccacuaga

SEQ ID NO: 1884344 - RNA, 23 nt, Human
ucuaccaaaaaucucaauauuuc

SEQ ID NO: 1884345 - RNA, 21 nt, Human
acagugauuaccagggacuga

SEQ ID NO: 1884346 - RNA, 16 nt, Human
agugaaauauuauuuu

SEQ ID NO: 1884347 - RNA, 18 nt, Human
aagucuuucacauuuaaa

SEQ ID NO: 1884348 - RNA, 16 nt, Human
ugccucaccccuugcc

SEQ ID NO: 1884349 - RNA, 18 nt, Human
cugagccuugggaccccu

SEQ ID NO: 1884350 - RNA, 13 nt, Human
aagacagugaaag

SEQ ID NO: 1884351 - RNA, 15 nt, Human
aucuuauaauuuaaa

SEQ ID NO: 1884352 - RNA, 15 nt, Human
auaaauaaaaauaau

SEQ ID NO: 1884353 - RNA, 22 nt, Human
uaaaacaagcacuaaacaaaga

SEQ ID NO: 1884354 - RNA, 13 nt, Human
uuaaauuguaaua

SEQ ID NO: 1884355 - RNA, 13 nt, Human
aacucccugcccc

SEQ ID NO: 1884356 - RNA, 15 nt, Human
ccucagucucccucc

SEQ ID NO: 1884357 - RNA, 11 nt, Human
aaccugagccc

SEQ ID NO: 1884358 - RNA, 16 nt, Human
cacuggacucaccucc

SEQ ID NO: 1884359 - RNA, 19 nt, Human
caugaguaacugauuugua

SEQ ID NO: 1884360 - RNA, 19 nt, Human
gacagucaccucauggaau

SEQ ID NO: 1884361 - RNA, 20 nt, Human
uaauaaguugcauagguuua

SEQ ID NO: 1884362 - RNA, 22 nt, Human
aucaccaaggcugauuaaacca

SEQ ID NO: 1884363 - RNA, 21 nt, Human
acagcccuucuuuccacagaa

SEQ ID NO: 1884364 - RNA, 15 nt, Human
agggcucacagaauu

SEQ ID NO: 1884365 - RNA, 23 nt, Human
caaagcugaaauggacuuuugua

SEQ ID NO: 1884366 - RNA, 19 nt, Human
cuccagcuggccgggagcc

SEQ ID NO: 1884367 - RNA, 11 nt, Human
accauuuuuac

SEQ ID NO: 1884368 - RNA, 18 nt, Human
auuuuuagugaaauauua

SEQ ID NO: 1884369 - RNA, 16 nt, Human
gaauggcuaagcaaaa

SEQ ID NO: 1884370 - RNA, 19 nt, Human
cuggccuucggccuccauc

SEQ ID NO: 1884371 - RNA, 23 nt, Human
ugaauuacauuuguauaaaauaa

SEQ ID NO: 1884372 - RNA, 12 nt, Human
gcaaagcccagc

SEQ ID NO: 1884373 - RNA, 22 nt, Human
cagcccuggugggcagagaggu

SEQ ID NO: 1884374 - RNA, 12 nt, Human
aaggaugccccg

SEQ ID NO: 1884375 - RNA, 23 nt, Human
acugucuuguuggacgagaaaac

SEQ ID NO: 1884376 - RNA, 22 nt, Human
cuccugccuaagugcagccccg

SEQ ID NO: 1884377 - RNA, 14 nt, Human
agagguccacaaca

SEQ ID NO: 1884378 - RNA, 15 nt, Human
ugagcucagcccugg

SEQ ID NO: 1884379 - RNA, 19 nt, Human
uguaguguuggagaagaac

SEQ ID NO: 1884380 - RNA, 17 nt, Human
aauucuugccaaauaua

SEQ ID NO: 1884381 - RNA, 17 nt, Human
uaacgauaaaagacagu

SEQ ID NO: 1884382 - RNA, 16 nt, Human
ccauuuuuagugaaau

SEQ ID NO: 1884383 - RNA, 19 nt, Human
agacagugaaagaaaauaa

SEQ ID NO: 1884384 - RNA, 18 nt, Human
gaagcaccaaucaugaau

SEQ ID NO: 1884385 - RNA, 15 nt, Human
uucggccuccauccu

SEQ ID NO: 1884386 - RNA, 11 nt, Human
gccaugggaca

SEQ ID NO: 1884387 - RNA, 15 nt, Human
auagaaguaaaaaca

SEQ ID NO: 1884388 - RNA, 22 nt, Human
agucuuucacauuuaaauaaag

SEQ ID NO: 1884389 - RNA, 16 nt, Human
aauuccacagcugcuc

SEQ ID NO: 1884390 - RNA, 21 nt, Human
agccucuuagaugcaguucug

SEQ ID NO: 1884391 - RNA, 19 nt, Human
guacugagagugaacaaau

SEQ ID NO: 1884392 - RNA, 14 nt, Human
cugcaaagcccagc

SEQ ID NO: 1884393 - RNA, 13 nt, Human
agcccagcuugaa

SEQ ID NO: 1884394 - RNA, 20 nt, Human
cugagccucagucucccucc

SEQ ID NO: 1884395 - RNA, 23 nt, Human
cuaguaauuggaaaggcagcucu

SEQ ID NO: 1884396 - RNA, 20 nt, Human
auucccagccagcacagccu

SEQ ID NO: 1884397 - RNA, 21 nt, Human
agucucccucccuuggggccu

SEQ ID NO: 1884398 - RNA, 13 nt, Human
gacaaggaaaaaa

SEQ ID NO: 1884399 - RNA, 14 nt, Human
cugucucaguccau

SEQ ID NO: 1884400 - RNA, 16 nt, Human
ccugaucaccugcccu

SEQ ID NO: 1884401 - RNA, 19 nt, Human
uacuucuuaggguuaugau

SEQ ID NO: 1884402 - RNA, 22 nt, Human
cugcucaauaaaguacaagagc

SEQ ID NO: 1884403 - RNA, 15 nt, Human
agccucagucucccu

SEQ ID NO: 1884404 - RNA, 23 nt, Human
uuauagcuacuaauuuuaaaaug

SEQ ID NO: 1884405 - RNA, 14 nt, Human
ccuuaucaaaggac

SEQ ID NO: 1884406 - RNA, 15 nt, Human
cuacaagacacagug

SEQ ID NO: 1884407 - RNA, 12 nt, Human
uaguacacacuu

SEQ ID NO: 1884408 - RNA, 18 nt, Human
cuuuccacagaagcucca

SEQ ID NO: 1884409 - RNA, 20 nt, Human
caagagccuuuuuuugaaaa

SEQ ID NO: 1884410 - RNA, 22 nt, Human
gaauuaaguuuuuuuuuaaaaa

SEQ ID NO: 1884411 - RNA, 21 nt, Human
uuauuuucuauaauuuaaaua

SEQ ID NO: 1884412 - RNA, 17 nt, Human
gcaugguuuagaaagcu

SEQ ID NO: 1884413 - RNA, 14 nt, Human
ccaaauauaaauaa

SEQ ID NO: 1884414 - RNA, 16 nt, Human
auaauccuaaacauau

SEQ ID NO: 1884415 - RNA, 23 nt, Human
aggaugguucccuugaugaagaa

SEQ ID NO: 1884416 - RNA, 19 nt, Human
cucacauuuauauuuuugu

SEQ ID NO: 1884417 - RNA, 15 nt, Human
ucugcagauaaacag

SEQ ID NO: 1884418 - RNA, 13 nt, Human
cucugagccuugg

SEQ ID NO: 1884419 - RNA, 17 nt, Human
cuggagggaagccuugg

SEQ ID NO: 1884420 - RNA, 14 nt, Human
auuuauguuuaauu

SEQ ID NO: 1884421 - RNA, 22 nt, Human
ccauacuaauuauacccccugc

SEQ ID NO: 1884422 - RNA, 14 nt, Human
cucuggcuccagcu

SEQ ID NO: 1884423 - RNA, 17 nt, Human
uuaauaauuuuuaauua

SEQ ID NO: 1884424 - RNA, 22 nt, Human
agcagcauaaauguugacaugg

SEQ ID NO: 1884425 - RNA, 17 nt, Human
agcuacuaauuuuaaaa

SEQ ID NO: 1884426 - RNA, 17 nt, Human
uuauaaucuuucacagg

SEQ ID NO: 1884427 - RNA, 18 nt, Human
gcaaagcccagcuugaaa

SEQ ID NO: 1884428 - RNA, 15 nt, Human
gugaccacugcagaa

SEQ ID NO: 1884429 - RNA, 17 nt, Human
agaacucccuuucaaca

SEQ ID NO: 1884430 - RNA, 22 nt, Human
uugacccacaagaaaugaaagc

SEQ ID NO: 1884431 - RNA, 16 nt, Human
agugucaaugcagccc

SEQ ID NO: 1884432 - RNA, 22 nt, Human
gagccucagucucccucccuug

SEQ ID NO: 1884433 - RNA, 14 nt, Human
aaaagaaacauuug

SEQ ID NO: 1884434 - RNA, 14 nt, Human
ugcuaagucuuaua

SEQ ID NO: 1884435 - RNA, 15 nt, Human
cugcagauaaacagu

SEQ ID NO: 1884436 - RNA, 21 nt, Human
auuuguauaaaauaauuuuua

SEQ ID NO: 1884437 - RNA, 15 nt, Human
uucugcacacagcac

SEQ ID NO: 1884438 - RNA, 13 nt, Human
agacagcucugca

SEQ ID NO: 1884439 - RNA, 20 nt, Human
caaauauaaauaaaaauaau

SEQ ID NO: 1884440 - RNA, 14 nt, Human
auuuauuuuaauaa

SEQ ID NO: 1884441 - RNA, 20 nt, Human
aagaugguaccaccagucug

SEQ ID NO: 1884442 - RNA, 22 nt, Human
gaaauaagccagacaucaacag

SEQ ID NO: 1884443 - RNA, 13 nt, Human
uaaacauguuuau

SEQ ID NO: 1884444 - RNA, 24 nt, Human
uggccgggagccugaucaccugcc

SEQ ID NO: 1884445 - RNA, 18 nt, Human
cugcucaauaaaguacaa

SEQ ID NO: 1884446 - RNA, 13 nt, Human
uuuugaaucauca

SEQ ID NO: 1884447 - RNA, 13 nt, Human
agaaguaaaaaca

SEQ ID NO: 1884448 - RNA, 23 nt, Human
ugaaaaucuuauaauuuaaaaua

SEQ ID NO: 1884449 - RNA, 16 nt, Human
gaagauguagaggaga

SEQ ID NO: 1884450 - RNA, 12 nt, Human
accccugagcuu

SEQ ID NO: 1884451 - RNA, 22 nt, Human
aggcuccacuuggucugugaga

SEQ ID NO: 1884452 - RNA, 18 nt, Human
caagccucauguccacug

SEQ ID NO: 1884453 - RNA, 16 nt, Human
ggcagagagguaggga

SEQ ID NO: 1884454 - RNA, 16 nt, Human
aagcuucacuguaaaa

SEQ ID NO: 1884455 - RNA, 21 nt, Human
cuggccuucggccuccauccu

SEQ ID NO: 1884456 - RNA, 14 nt, Human
aagagugaaggauu

SEQ ID NO: 1884457 - RNA, 17 nt, Human
aagacaaggaaaaaaua

SEQ ID NO: 1884458 - RNA, 20 nt, Human
aaagacaaggaaaaaauaac

SEQ ID NO: 1884459 - RNA, 21 nt, Human
gcaaaauuuuuucucuaggaa

SEQ ID NO: 1884460 - RNA, 16 nt, Human
ugcuaagucuuauaua

SEQ ID NO: 1884461 - RNA, 22 nt, Human
agaaaacaauaacgauaaaaga

SEQ ID NO: 1884462 - RNA, 19 nt, Human
gagccugaucaccugcccu

SEQ ID NO: 1884463 - RNA, 18 nt, Human
ccugaaagaggaaugaag

SEQ ID NO: 1884464 - RNA, 18 nt, Human
gaggcuccacuuggucug

SEQ ID NO: 1884465 - RNA, 17 nt, Human
aaagacaaggaaaaaau

SEQ ID NO: 1884466 - RNA, 20 nt, Human
gaaaauaacaauaaaagaca

SEQ ID NO: 1884467 - RNA, 13 nt, Human
uauuuauuuuaau

SEQ ID NO: 1884468 - RNA, 21 nt, Human
cuaaauugacacuuaaaaaug

SEQ ID NO: 1884469 - RNA, 18 nt, Human
acuggacucaccuccccc

SEQ ID NO: 1884470 - RNA, 15 nt, Human
caagcucacagaccu

SEQ ID NO: 1884471 - RNA, 20 nt, Human
acuaaauugacacuuaaaaa

SEQ ID NO: 1884472 - RNA, 16 nt, Human
uugucaauaaaaucca

SEQ ID NO: 1884473 - RNA, 14 nt, Human
ccugccccugagcc

SEQ ID NO: 1884474 - RNA, 18 nt, Human
gaagcaaaauuuuuucuc

SEQ ID NO: 1884475 - RNA, 18 nt, Human
auaauccuaaacauauga

SEQ ID NO: 1884476 - RNA, 18 nt, Human
uaaauugacacuuaaaaa

SEQ ID NO: 1884477 - RNA, 17 nt, Human
acaaaugcauuucuaaa

SEQ ID NO: 1884478 - RNA, 17 nt, Human
uaugcuaagugaaauaa

SEQ ID NO: 1884479 - RNA, 15 nt, Human
aaggguacacugccu

SEQ ID NO: 1884480 - RNA, 16 nt, Human
ggccuccauccugagg

SEQ ID NO: 1884481 - RNA, 14 nt, Human
acauauauaacaau

SEQ ID NO: 1884482 - RNA, 18 nt, Human
cagcugcucaauaaagua

SEQ ID NO: 1884483 - RNA, 16 nt, Human
ggcugagccucagucu

SEQ ID NO: 1884484 - RNA, 14 nt, Human
cugcugagucccag

SEQ ID NO: 1884485 - RNA, 17 nt, Human
uuacagagacagaaagc

SEQ ID NO: 1884486 - RNA, 15 nt, Human
aucaauuuaaaaaaa

SEQ ID NO: 1884487 - RNA, 13 nt, Human
ccucauggaauug

SEQ ID NO: 1884488 - RNA, 23 nt, Human
aauauuuauuuuaauaauguuuc

SEQ ID NO: 1884489 - RNA, 15 nt, Human
ggacucaccuccccc

SEQ ID NO: 1884490 - RNA, 19 nt, Human
cccacuggacucaccuccc

SEQ ID NO: 1884491 - RNA, 17 nt, Human
gaagaccucauuuugaa

SEQ ID NO: 1884492 - RNA, 21 nt, Human
gcccauccugccccugagccc

SEQ ID NO: 1884493 - RNA, 16 nt, Human
uucuauaauuuaaaua

SEQ ID NO: 1884494 - RNA, 13 nt, Human
uaacgauaaaaga

SEQ ID NO: 1884495 - RNA, 23 nt, Human
agcucugcccauccugccccuga

SEQ ID NO: 1884496 - RNA, 11 nt, Human
gcaugguuuag

SEQ ID NO: 1884497 - RNA, 15 nt, Human
ccugccccccagccc

SEQ ID NO: 1884498 - RNA, 17 nt, Human
cccccugcaaagcccag

SEQ ID NO: 1884499 - RNA, 13 nt, Human
ucuaagaagugaa

SEQ ID NO: 1884500 - RNA, 20 nt, Human
uaaaacaagcacuaaacaaa

SEQ ID NO: 1884501 - RNA, 15 nt, Human
gaagauguagaggag

SEQ ID NO: 1884502 - RNA, 14 nt, Human
uugccaugugcuag

SEQ ID NO: 1884503 - RNA, 14 nt, Human
agaauucauucacu

SEQ ID NO: 1884504 - RNA, 19 nt, Human
uccauccugaggcuccacu

SEQ ID NO: 1884505 - RNA, 20 nt, Human
caaauguucaucaaugaaug

SEQ ID NO: 1884506 - RNA, 17 nt, Human
agacagugaaagaaaau

SEQ ID NO: 1884507 - RNA, 21 nt, Human
aagcuccauuuuuagugaaau

SEQ ID NO: 1884508 - RNA, 19 nt, Human
aagucuuucacauuuaaau

SEQ ID NO: 1884509 - RNA, 16 nt, Human
gacauagaauuaacac

SEQ ID NO: 1884510 - RNA, 19 nt, Human
gugaacuugguuuuaauua

SEQ ID NO: 1884511 - RNA, 18 nt, Human
ucuaugaaauauuauguu

SEQ ID NO: 1884512 - RNA, 18 nt, Human
uaucaaaagaaagaaaau

SEQ ID NO: 1884513 - RNA, 15 nt, Human
agucaccucauggaa

SEQ ID NO: 1884514 - RNA, 18 nt, Human
gaaaugaaagcagggacu

SEQ ID NO: 1884515 - RNA, 11 nt, Human
gagguaaaagc

SEQ ID NO: 1884516 - RNA, 23 nt, Human
uuuuauagcuacuaauuuuaaaa

SEQ ID NO: 1884517 - RNA, 14 nt, Human
agacaucaacagau

SEQ ID NO: 1884518 - RNA, 14 nt, Human
gcaaagcccagcuu

SEQ ID NO: 1884519 - RNA, 14 nt, Human
ugcuucuguuuuau

SEQ ID NO: 1884520 - RNA, 16 nt, Human
cacgggggccaaggau

SEQ ID NO: 1884521 - RNA, 22 nt, Human
caugaguaacugauuuguaaca

SEQ ID NO: 1884522 - RNA, 18 nt, Human
auagaauuaacacaugau

SEQ ID NO: 1884523 - RNA, 20 nt, Human
uauacugugugcuaaaacaa

SEQ ID NO: 1884524 - RNA, 12 nt, Human
gguuuauauaag

SEQ ID NO: 1884525 - RNA, 17 nt, Human
uguaaaggaauuuaaaa

SEQ ID NO: 1884526 - RNA, 15 nt, Human
aauaacgauaaaaga

SEQ ID NO: 1884527 - RNA, 15 nt, Human
acaaggaaaaaauaa

SEQ ID NO: 1884528 - RNA, 15 nt, Human
ucuggcuccagcugg

SEQ ID NO: 1884529 - RNA, 13 nt, Human
auuggacaguaaa

SEQ ID NO: 1884530 - RNA, 18 nt, Human
acaaaugggaaacaaaag

SEQ ID NO: 1884531 - RNA, 15 nt, Human
cacuuggucugugag

SEQ ID NO: 1884532 - RNA, 21 nt, Human
ugggaggcugagaugggagaa

SEQ ID NO: 1884533 - RNA, 16 nt, Human
ccacuuggucugugag

SEQ ID NO: 1884534 - RNA, 20 nt, Human
gaaacgaggauugggaaaaa

SEQ ID NO: 1884535 - RNA, 18 nt, Human
auagucaaauugugugaa

SEQ ID NO: 1884536 - RNA, 14 nt, Human
cagauccuggaaau

SEQ ID NO: 1884537 - RNA, 16 nt, Human
agguugcagugagccg

SEQ ID NO: 1884538 - RNA, 20 nt, Human
guccccuauccuacuucccc

SEQ ID NO: 1884539 - RNA, 17 nt, Human
auguugacaugggacau

SEQ ID NO: 1884540 - RNA, 22 nt, Human
accaaucaugaauuaguuuuau

SEQ ID NO: 1884541 - RNA, 21 nt, Human
uuuuauggcacuaguauuucu

SEQ ID NO: 1884542 - RNA, 21 nt, Human
cuucucacauuuauauuuuug

SEQ ID NO: 1884543 - RNA, 19 nt, Human
ugcacacagcacgggggcc

SEQ ID NO: 1884544 - RNA, 15 nt, Human
gucaaugcagccccc

SEQ ID NO: 1884545 - RNA, 19 nt, Human
auagcuacuaauuuuaaaa

SEQ ID NO: 1884546 - RNA, 17 nt, Human
uauauuguagauaauac

SEQ ID NO: 1884547 - RNA, 17 nt, Human
aaagcagggacuugaac

SEQ ID NO: 1884548 - RNA, 17 nt, Human
aaucuuucacaggggac

SEQ ID NO: 1884549 - RNA, 12 nt, Human
gaaaauaacaau

SEQ ID NO: 1884550 - RNA, 23 nt, Human
gaaaaucuuauaauuuaaaauau

SEQ ID NO: 1884551 - RNA, 16 nt, Human
cugagccucagucucc

SEQ ID NO: 1884552 - RNA, 18 nt, Human
agguccacaacacacaga

SEQ ID NO: 1884553 - RNA, 21 nt, Human
cccacuggacucaccuccccc

SEQ ID NO: 1884554 - RNA, 14 nt, Human
gaaaaaauaacaau

SEQ ID NO: 1884555 - RNA, 21 nt, Human
cuaccaaaaaucucaauauuu

SEQ ID NO: 1884556 - RNA, 21 nt, Human
uuauagcuacuaauuuuaaaa

SEQ ID NO: 1884557 - RNA, 21 nt, Human
gccaaauauaaauaaaaauaa

SEQ ID NO: 1884558 - RNA, 20 nt, Human
cuucaacucccugcccccca

SEQ ID NO: 1884559 - RNA, 21 nt, Human
aauuuacagagacagaaagca

SEQ ID NO: 1884560 - RNA, 15 nt, Human
cuucucuucacaguc

SEQ ID NO: 1884561 - RNA, 13 nt, Human
gcuggagcucugc

SEQ ID NO: 1884562 - RNA, 13 nt, Human
auuuuaaaagaau

SEQ ID NO: 1884563 - RNA, 18 nt, Human
cucuauguucuaagaagu

SEQ ID NO: 1884564 - RNA, 21 nt, Human
ccauccugccccugagcccau

SEQ ID NO: 1884565 - RNA, 21 nt, Human
uuacauuuguauaaaauaauu

SEQ ID NO: 1884566 - RNA, 21 nt, Human
aaacaauaacgauaaaagaca

SEQ ID NO: 1884567 - RNA, 13 nt, Human
ugaaauuguauua

SEQ ID NO: 1884568 - RNA, 17 nt, Human
auaaaguacaagagcuu

SEQ ID NO: 1884569 - RNA, 14 nt, Human
aaagagaacuucca

SEQ ID NO: 1884570 - RNA, 23 nt, Human
caucaacagauaaauaguuuaug

SEQ ID NO: 1884571 - RNA, 16 nt, Human
ccugcaaagcccagcu

SEQ ID NO: 1884572 - RNA, 22 nt, Human
uagacacacaugaaguccaagc

SEQ ID NO: 1884573 - RNA, 21 nt, Human
gaagugaaaaucuacacucca

SEQ ID NO: 1884574 - RNA, 18 nt, Human
uguauuauuuuuuaaaaa

SEQ ID NO: 1884575 - RNA, 18 nt, Human
uuguaaaggaauuuaaaa

SEQ ID NO: 1884576 - RNA, 14 nt, Human
uccacaacacacag

SEQ ID NO: 1884577 - RNA, 13 nt, Human
aaaaauccuacuu

SEQ ID NO: 1884578 - RNA, 17 nt, Human
gccaugggacagggagg

SEQ ID NO: 1884579 - RNA, 21 nt, Human
uaaaagacagugaaagaaaau

SEQ ID NO: 1884580 - RNA, 14 nt, Human
accauuuuuacuug

SEQ ID NO: 1884581 - RNA, 23 nt, Human
cuucaacucccugccccccagcc

SEQ ID NO: 1884582 - RNA, 21 nt, Human
ucacaugaacuuguaaaggaa

SEQ ID NO: 1884583 - RNA, 22 nt, Human
gaugcaguuguugcccacagcu

SEQ ID NO: 1884584 - RNA, 12 nt, Human
guagacacacau

SEQ ID NO: 1884585 - RNA, 19 nt, Human
uauauuuuugugauuuugu

SEQ ID NO: 1884586 - RNA, 19 nt, Human
augaaguacucauacaugu

SEQ ID NO: 1884587 - RNA, 16 nt, Human
gagaaacuggaacucu

SEQ ID NO: 1884588 - RNA, 13 nt, Human
ucacuguaaaaua

SEQ ID NO: 1884589 - RNA, 14 nt, Human
cagagguugcagug

SEQ ID NO: 1884590 - RNA, 17 nt, Human
acuuccagauccuggaa

SEQ ID NO: 1884591 - RNA, 16 nt, Human
ccuccuuuuaaaguaa

SEQ ID NO: 1884592 - RNA, 14 nt, Human
cacuaaacaaagag

SEQ ID NO: 1884593 - RNA, 16 nt, Human
ugagcucagcccuggu

SEQ ID NO: 1884594 - RNA, 18 nt, Human
gacccacuggacucaccu

SEQ ID NO: 1884595 - RNA, 14 nt, Human
ggacucaccucccc

SEQ ID NO: 1884596 - RNA, 19 nt, Human
gcuuguauuccuuuuucuc

SEQ ID NO: 1884597 - RNA, 15 nt, Human
aaauauaaauaaaaa

SEQ ID NO: 1884598 - RNA, 21 nt, Human
aaugaauggcuaagcaaaaug

SEQ ID NO: 1884599 - RNA, 13 nt, Human
cccugcacuccag

SEQ ID NO: 1884600 - RNA, 13 nt, Human
uccuacuuccccu

SEQ ID NO: 1884601 - RNA, 17 nt, Human
uaaaagacagugaaaga

SEQ ID NO: 1884602 - RNA, 22 nt, Human
uauuucagauaaucacaauaca

SEQ ID NO: 1884603 - RNA, 15 nt, Human
aacgauaaaagacag

SEQ ID NO: 1884604 - RNA, 14 nt, Human
caaggaaaaaauaa

SEQ ID NO: 1884605 - RNA, 19 nt, Human
gagccucagucucccuccc

SEQ ID NO: 1884606 - RNA, 22 nt, Human
caaaugggaaacaaaaggauaa

SEQ ID NO: 1884607 - RNA, 21 nt, Human
uauacugugugcuaaaacaag

SEQ ID NO: 1884608 - RNA, 19 nt, Human
ugagucccaggcugagccu

SEQ ID NO: 1884609 - RNA, 21 nt, Human
cuaguaucaaaagaaagaaaa

SEQ ID NO: 1884610 - RNA, 12 nt, Human
acacuuaaaaau

SEQ ID NO: 1884611 - RNA, 12 nt, Human
uauaauuuaaaa

SEQ ID NO: 1884612 - RNA, 19 nt, Human
auuaaguuuuuuuuuaaaa

SEQ ID NO: 1884613 - RNA, 12 nt, Human
cauuauauuuau

SEQ ID NO: 1884614 - RNA, 14 nt, Human
cuugagguaaaagc

SEQ ID NO: 1884615 - RNA, 21 nt, Human
ccuuuuuuugaaaaaaagcuu

SEQ ID NO: 1884616 - RNA, 18 nt, Human
gccugagcgacagugaga

SEQ ID NO: 1884617 - RNA, 13 nt, Human
augauuccaccua

SEQ ID NO: 1884618 - RNA, 13 nt, Human
uggcuccagcugg

SEQ ID NO: 1884619 - RNA, 19 nt, Human
ucugagcauuuaauaugga

SEQ ID NO: 1884620 - RNA, 23 nt, Human
aguaauuggaaaggcagcucuaa

SEQ ID NO: 1884621 - RNA, 13 nt, Human
aucucaauauuuc

SEQ ID NO: 1884622 - RNA, 13 nt, Human
cauuuguauaaaa

SEQ ID NO: 1884623 - RNA, 23 nt, Human
ucuagcaugucgucaaagcugaa

SEQ ID NO: 1884624 - RNA, 15 nt, Human
gagaugcuagaacuc

SEQ ID NO: 1884625 - RNA, 18 nt, Human
uuuuaaaaaagaaacauu

SEQ ID NO: 1884626 - RNA, 15 nt, Human
ugcagauaaacagua

SEQ ID NO: 1884627 - RNA, 16 nt, Human
uauaucaauuuaaaaa

SEQ ID NO: 1884628 - RNA, 13 nt, Human
aacaagccuccuu

SEQ ID NO: 1884629 - RNA, 21 nt, Human
uacaugagguacugagaguga

SEQ ID NO: 1884630 - RNA, 18 nt, Human
uuuuauaucaauuuaaaa

SEQ ID NO: 1884631 - RNA, 20 nt, Human
ccagcuggccgggagccuga

SEQ ID NO: 1884632 - RNA, 16 nt, Human
augccccgucccccuc

SEQ ID NO: 1884633 - RNA, 22 nt, Human
aucucuucuggguuccuuccuc

SEQ ID NO: 1884634 - RNA, 15 nt, Human
auauaaauaaaaaua

SEQ ID NO: 1884635 - RNA, 19 nt, Human
gguuccuuccucugagccu

SEQ ID NO: 1884636 - RNA, 17 nt, Human
accugagccccaaaagg

SEQ ID NO: 1884637 - RNA, 22 nt, Human
agacucgggauuaguacacacu

SEQ ID NO: 1884638 - RNA, 20 nt, Human
uuacaaauccaaugaaauga

SEQ ID NO: 1884639 - RNA, 12 nt, Human
agggauggggcu

SEQ ID NO: 1884640 - RNA, 15 nt, Human
uucacuguaaaauaa

SEQ ID NO: 1884641 - RNA, 14 nt, Human
ugaucaccugcccu

SEQ ID NO: 1884642 - RNA, 16 nt, Human
ccucagucucccuccc

SEQ ID NO: 1884643 - RNA, 17 nt, Human
agggcauagaaguaaaa

SEQ ID NO: 1884644 - RNA, 12 nt, Human
uucagccugaaa

SEQ ID NO: 1884645 - RNA, 19 nt, Human
uauauuuuuuguuaaauga

SEQ ID NO: 1884646 - RNA, 17 nt, Human
gcaaauugucacaggac

SEQ ID NO: 1884647 - RNA, 14 nt, Human
auuuucuauaauuu

SEQ ID NO: 1884648 - RNA, 14 nt, Human
aagcaucacaugaa

SEQ ID NO: 1884649 - RNA, 19 nt, Human
auuguaguccuguaaugga

SEQ ID NO: 1884650 - RNA, 13 nt, Human
uuuucuuuucauu

SEQ ID NO: 1884651 - RNA, 14 nt, Human
uaaaagacaaggaa

SEQ ID NO: 1884652 - RNA, 22 nt, Human
aucaucaagucuuucacauuua

SEQ ID NO: 1884653 - RNA, 20 nt, Human
caagcucuaucaccaaggag

SEQ ID NO: 1884654 - RNA, 18 nt, Human
cagccucuuagaugcagu

SEQ ID NO: 1884655 - RNA, 15 nt, Human
uaggaaauauuuauu

SEQ ID NO: 1884656 - RNA, 14 nt, Human
aaugauuaugaauu

SEQ ID NO: 1884657 - RNA, 21 nt, Human
uauuacuguaagaaaauauca

SEQ ID NO: 1884658 - RNA, 19 nt, Human
gguuuaauaauuuuuaauu

SEQ ID NO: 1884659 - RNA, 18 nt, Human
acucuuaagaagacugca

SEQ ID NO: 1884660 - RNA, 21 nt, Human
cgaaguauccuucagccugaa

SEQ ID NO: 1884661 - RNA, 22 nt, Human
augcagagguccacaacacaca

SEQ ID NO: 1884662 - RNA, 12 nt, Human
ggaggcugagau

SEQ ID NO: 1884663 - RNA, 22 nt, Human
ggacagcccuucuuuccacaga

SEQ ID NO: 1884664 - RNA, 20 nt, Human
uuccacagaagcuccaggua

SEQ ID NO: 1884665 - RNA, 20 nt, Human
ugguuguauuauuuuuuaaa

SEQ ID NO: 1884666 - RNA, 17 nt, Human
auauuugaaauauugac

SEQ ID NO: 1884667 - RNA, 16 nt, Human
cacuaguauuucuaug

SEQ ID NO: 1884668 - RNA, 22 nt, Human
auauuuacaaaugggaaacaaa

SEQ ID NO: 1884669 - RNA, 22 nt, Human
ggcuaagcuucacuguaaaaua

SEQ ID NO: 1884670 - RNA, 11 nt, Human
ugcagugagcc

SEQ ID NO: 1884671 - RNA, 16 nt, Human
uguaguccuguaaugg

SEQ ID NO: 1884672 - RNA, 17 nt, Human
agagacagaaagcagaa

SEQ ID NO: 1884673 - RNA, 19 nt, Human
uguauacugugugcuaaaa

SEQ ID NO: 1884674 - RNA, 19 nt, Human
aaguugcauagguuuaaua

SEQ ID NO: 1884675 - RNA, 14 nt, Human
uugaaauuguauua

SEQ ID NO: 1884676 - RNA, 12 nt, Human
gauaaaagacag

SEQ ID NO: 1884677 - RNA, 19 nt, Human
cagcuacuugggaggcuga

SEQ ID NO: 1884678 - RNA, 16 nt, Human
acauuugcucauggaa

SEQ ID NO: 1884679 - RNA, 16 nt, Human
cuacacuccagugaga

SEQ ID NO: 1884680 - RNA, 16 nt, Human
cagggcucacagaauu

SEQ ID NO: 1884681 - RNA, 19 nt, Human
ggaauuucuucaacucccu

SEQ ID NO: 1884682 - RNA, 22 nt, Human
ucuagcaugucgucaaagcuga

SEQ ID NO: 1884683 - RNA, 16 nt, Human
acauuuauauuuuugu

SEQ ID NO: 1884684 - RNA, 14 nt, Human
cucccugcccccca

SEQ ID NO: 1884685 - RNA, 22 nt, Human
gagucccaggcugagccucagu

SEQ ID NO: 1884686 - RNA, 22 nt, Human
caucgcaauguaagacucggga

SEQ ID NO: 1884687 - RNA, 16 nt, Human
cuccauccugaggcuc

SEQ ID NO: 1884688 - RNA, 15 nt, Human
gccuugggaccccug

SEQ ID NO: 1884689 - RNA, 15 nt, Human
uugacacuuaaaaau

SEQ ID NO: 1884690 - RNA, 12 nt, Human
auauaaauaaaa

SEQ ID NO: 1884691 - RNA, 21 nt, Human
cucuucuggguuccuuccucu

SEQ ID NO: 1884692 - RNA, 14 nt, Human
ugugaaaagcucca

SEQ ID NO: 1884693 - RNA, 22 nt, Human
cauaaauguugacaugggacau

SEQ ID NO: 1884694 - RNA, 15 nt, Human
ccaaggagccaaaca

SEQ ID NO: 1884695 - RNA, 17 nt, Human
uuccaagugauugaaac

SEQ ID NO: 1884696 - RNA, 15 nt, Human
guuuuucuuuucauu

SEQ ID NO: 1884697 - RNA, 19 nt, Human
accauuuuggcaagcucua

SEQ ID NO: 1884698 - RNA, 21 nt, Human
accaccugccuauauuuuuug

SEQ ID NO: 1884699 - RNA, 18 nt, Human
uuuucucuccucucccca

SEQ ID NO: 1884700 - RNA, 16 nt, Human
gaaucacuugaacccg

SEQ ID NO: 1884701 - RNA, 21 nt, Human
uaguauuucuaugaaauauua

SEQ ID NO: 1884702 - RNA, 20 nt, Human
aaucuuucacaggggacagg

SEQ ID NO: 1884703 - RNA, 17 nt, Human
auaucaauuuaaaaaaa

SEQ ID NO: 1884704 - RNA, 15 nt, Human
aaugauuaugaauua

SEQ ID NO: 1884705 - RNA, 17 nt, Human
augccccgucccccucu

SEQ ID NO: 1884706 - RNA, 17 nt, Human
auuauuuuuuaaaaaaa

SEQ ID NO: 1884707 - RNA, 21 nt, Human
cccuauccuacuuccccuucc

SEQ ID NO: 1884708 - RNA, 18 nt, Human
gaaacaaaaggauaauga

SEQ ID NO: 1884709 - RNA, 19 nt, Human
aauuuuguuauguauauuu

SEQ ID NO: 1884710 - RNA, 20 nt, Human
uaagugaaauaagccagaca

SEQ ID NO: 1884711 - RNA, 18 nt, Human
ccaaccuggaguugaaaa

SEQ ID NO: 1884712 - RNA, 12 nt, Human
aagaaaauaaca

SEQ ID NO: 1884713 - RNA, 22 nt, Human
auggaaauguuuacagaucccc

SEQ ID NO: 1884714 - RNA, 18 nt, Human
aguucuccacuagcuaug

SEQ ID NO: 1884715 - RNA, 20 nt, Human
cccugccccccagcccuccu

SEQ ID NO: 1884716 - RNA, 19 nt, Human
ucaguuauuauauuuacaa

SEQ ID NO: 1884717 - RNA, 22 nt, Human
ccccuuccuaauuccacagcug

SEQ ID NO: 1884718 - RNA, 16 nt, Human
uugccauaauuacuau

SEQ ID NO: 1884719 - RNA, 22 nt, Human
aguauguuagugcaaauuguca

SEQ ID NO: 1884720 - RNA, 15 nt, Human
gaaaugaaagcaggg

SEQ ID NO: 1884721 - RNA, 18 nt, Human
acagagacagaaagcaga

SEQ ID NO: 1884722 - RNA, 13 nt, Human
ccaaaagguauuu

SEQ ID NO: 1884723 - RNA, 22 nt, Human
uauuucuaugaaauauuauguu

SEQ ID NO: 1884724 - RNA, 20 nt, Human
uguaauaggcguaacuaauu

SEQ ID NO: 1884725 - RNA, 15 nt, Human
uccuacaagacacag

SEQ ID NO: 1884726 - RNA, 15 nt, Human
ggcaauagucaaauu

SEQ ID NO: 1884727 - RNA, 14 nt, Human
cuguaaucacagcu

SEQ ID NO: 1884728 - RNA, 23 nt, Human
augaauuaaguuuuuuuuuaaaa

SEQ ID NO: 1884729 - RNA, 17 nt, Human
ggaaauauuuauuuuaa

SEQ ID NO: 1884730 - RNA, 21 nt, Human
cccccucuggcuccagcuggc

SEQ ID NO: 1884731 - RNA, 16 nt, Human
uaggauguugaaaaag

SEQ ID NO: 1884732 - RNA, 14 nt, Human
aagaagugaaaauc

SEQ ID NO: 1884733 - RNA, 19 nt, Human
acaaauuuacagagacaga

SEQ ID NO: 1884734 - RNA, 20 nt, Human
uuugcaagccagauuuuccu

SEQ ID NO: 1884735 - RNA, 24 nt, Human
ccccugagcuugcagagaugaggc

SEQ ID NO: 1884736 - RNA, 17 nt, Human
caagaaaugaaagcagg

SEQ ID NO: 1884737 - RNA, 15 nt, Human
ccccugagcuugcag

SEQ ID NO: 1884738 - RNA, 18 nt, Human
uucaauaucuuuuuuuua

SEQ ID NO: 1884739 - RNA, 23 nt, Human
cagagguugcagugagccgagau

SEQ ID NO: 1884740 - RNA, 17 nt, Human
aguugauaaguacauga

SEQ ID NO: 1884741 - RNA, 15 nt, Human
uuaauuuguaguguu

SEQ ID NO: 1884742 - RNA, 13 nt, Human
cucaccuccccca

SEQ ID NO: 1884743 - RNA, 18 nt, Human
accaccugccuauauuuu

SEQ ID NO: 1884744 - RNA, 16 nt, Human
cauuuguauaaaauaa

SEQ ID NO: 1884745 - RNA, 17 nt, Human
aaaaauccuacuuucau

SEQ ID NO: 1884746 - RNA, 23 nt, Human
auuuuauagcuacuaauuuuaaa

SEQ ID NO: 1884747 - RNA, 15 nt, Human
uguauuuuaaaagaa

SEQ ID NO: 1884748 - RNA, 12 nt, Human
agugcagccccg

SEQ ID NO: 1884749 - RNA, 12 nt, Human
aauacuuuauaa

SEQ ID NO: 1884750 - RNA, 18 nt, Human
agugucaaugcagccccc

SEQ ID NO: 1884751 - RNA, 19 nt, Human
aauguuuacagauccccaa

SEQ ID NO: 1884752 - RNA, 16 nt, Human
cuuuaugcuaagugaa

SEQ ID NO: 1884753 - RNA, 21 nt, Human
ccuggugccucaccccuugcc

SEQ ID NO: 1884754 - RNA, 13 nt, Human
uaugaaauauuau

SEQ ID NO: 1884755 - RNA, 14 nt, Human
acuaauuuuaaaau

SEQ ID NO: 1884756 - RNA, 16 nt, Human
cagcuuuccucaaaac

SEQ ID NO: 1884757 - RNA, 15 nt, Human
agacagcucugcaua

SEQ ID NO: 1884758 - RNA, 14 nt, Human
cgucccccucuggc

SEQ ID NO: 1884759 - RNA, 16 nt, Human
gcuucacuguaaaaua

SEQ ID NO: 1884760 - RNA, 18 nt, Human
acaugaacuuguaaagga

SEQ ID NO: 1884761 - RNA, 21 nt, Human
ucuucaacucccugcccccca

SEQ ID NO: 1884762 - RNA, 16 nt, Human
ugacacuuaaaaaugg

SEQ ID NO: 1884763 - RNA, 16 nt, Human
auuauacccccugcaa

SEQ ID NO: 1884764 - RNA, 19 nt, Human
ucaguccaugaagauguag

SEQ ID NO: 1884765 - RNA, 19 nt, Human
aaacaaaaggauaaugaau

SEQ ID NO: 1884766 - RNA, 21 nt, Human
augucauuugcuggagcucug

SEQ ID NO: 1884767 - RNA, 17 nt, Human
uuauaucaauuuaaaaa

SEQ ID NO: 1884768 - RNA, 12 nt, Human
ccccuugccaua

SEQ ID NO: 1884769 - RNA, 22 nt, Human
aggauggcuaguaucaaaagaa

SEQ ID NO: 1884770 - RNA, 17 nt, Human
ucgggauuaguacacac

SEQ ID NO: 1884771 - RNA, 19 nt, Human
aaaaucuuauaauuuaaaa

SEQ ID NO: 1884772 - RNA, 21 nt, Human
ccccugcaaagcccagcuuga

SEQ ID NO: 1884773 - RNA, 16 nt, Human
auuccaccuacaugag

SEQ ID NO: 1884774 - RNA, 13 nt, Human
aucaggcuggcca

SEQ ID NO: 1884775 - RNA, 12 nt, Human
gaauuggagcuc

SEQ ID NO: 1884776 - RNA, 17 nt, Human
ccaaggaugccccgucc

SEQ ID NO: 1884777 - RNA, 20 nt, Human
acggacgaaccuugaaaacu

SEQ ID NO: 1884778 - RNA, 14 nt, Human
uauguauauuuuau

SEQ ID NO: 1884779 - RNA, 15 nt, Human
aucaaaggacaccau

SEQ ID NO: 1884780 - RNA, 16 nt, Human
aaagacaaggaaaaaa

SEQ ID NO: 1884781 - RNA, 22 nt, Human
aagacccaaaaggcagaagcaa

SEQ ID NO: 1884782 - RNA, 17 nt, Human
uuauuacuguaagaaaa

SEQ ID NO: 1884783 - RNA, 15 nt, Human
auccugccccugagc

SEQ ID NO: 1884784 - RNA, 18 nt, Human
cccacuggacucaccucc

SEQ ID NO: 1884785 - RNA, 19 nt, Human
ggacucaccucccccaucu

SEQ ID NO: 1884786 - RNA, 21 nt, Human
gacagucaccucauggaauug

SEQ ID NO: 1884787 - RNA, 18 nt, Human
gagccucagucucccucc

SEQ ID NO: 1884788 - RNA, 17 nt, Human
aaccuagggugauauua

SEQ ID NO: 1884789 - RNA, 15 nt, Human
uguuaaaugauuuca

SEQ ID NO: 1884790 - RNA, 22 nt, Human
gaagugaaaaucuacacuccag

SEQ ID NO: 1884791 - RNA, 17 nt, Human
aaauccuacuuucauaa

SEQ ID NO: 1884792 - RNA, 20 nt, Human
cagccugagcgacagugaga

SEQ ID NO: 1884793 - RNA, 21 nt, Human
auuuuccugaaaacccuugcc

SEQ ID NO: 1884794 - RNA, 11 nt, Human
caacucccugc

SEQ ID NO: 1884795 - RNA, 13 nt, Human
uuuaaaaaaaaac

SEQ ID NO: 1884796 - RNA, 18 nt, Human
ucucuaggaaauauuuau

SEQ ID NO: 1884797 - RNA, 18 nt, Human
auuugcuggagcucugcc

SEQ ID NO: 1884798 - RNA, 21 nt, Human
ugagcucagcccuggugggca

SEQ ID NO: 1884799 - RNA, 16 nt, Human
augcuguauuuuaaaa

SEQ ID NO: 1884800 - RNA, 17 nt, Human
ucuuucacauuuaaaua

SEQ ID NO: 1884801 - RNA, 21 nt, Human
augcuacaggauuugaaauug

SEQ ID NO: 1884802 - RNA, 21 nt, Human
uguauaaaauaauuuuuauau

SEQ ID NO: 1884803 - RNA, 17 nt, Human
gccuccuuuuaaaguaa

SEQ ID NO: 1884804 - RNA, 23 nt, Human
uguagguagaucuggucuuuaga

SEQ ID NO: 1884805 - RNA, 20 nt, Human
uagaugcaguucugaagaag

SEQ ID NO: 1884806 - RNA, 18 nt, Human
uggagggaagccuugggg

SEQ ID NO: 1884807 - RNA, 13 nt, Human
aggaaaaaauaac

SEQ ID NO: 1884808 - RNA, 16 nt, Human
ugagaugcuagaacuc

SEQ ID NO: 1884809 - RNA, 18 nt, Human
agagaaugagagacacac

SEQ ID NO: 1884810 - RNA, 22 nt, Human
uguucugauauuggacaguaaa

SEQ ID NO: 1884811 - RNA, 14 nt, Human
acauagugaggagc

SEQ ID NO: 1884812 - RNA, 13 nt, Human
uuccucugagccu

SEQ ID NO: 1884813 - RNA, 16 nt, Human
cccccagcccuccuua

SEQ ID NO: 1884814 - RNA, 19 nt, Human
uuuauaucaauuuaaaaaa

SEQ ID NO: 1884815 - RNA, 14 nt, Human
cuaagucuuauaua

SEQ ID NO: 1884816 - RNA, 22 nt, Human
gugugaccacugcagaagacag

SEQ ID NO: 1884817 - RNA, 21 nt, Human
ucaagucuuucacauuuaaau

SEQ ID NO: 1884818 - RNA, 18 nt, Human
cagaaagcagaacaguga

SEQ ID NO: 1884819 - RNA, 20 nt, Human
cuggccuucggccuccaucc

SEQ ID NO: 1884820 - RNA, 15 nt, Human
aagccagauuuuccu

SEQ ID NO: 1884821 - RNA, 23 nt, Human
cacaagaaaugaaagcagggacu

SEQ ID NO: 1884822 - RNA, 23 nt, Human
ucggccuccauccugaggcucca

SEQ ID NO: 1884823 - RNA, 15 nt, Human
gaaagaaaauaacga

SEQ ID NO: 1884824 - RNA, 20 nt, Human
uguuggugaacuugguuuua

SEQ ID NO: 1884825 - RNA, 18 nt, Human
cugagggcauagaaguaa

SEQ ID NO: 1884826 - RNA, 23 nt, Human
cucagcccuggugggcagagagg

SEQ ID NO: 1884827 - RNA, 12 nt, Human
auaacuggaaac

SEQ ID NO: 1884828 - RNA, 18 nt, Human
cuccagccugagcgacag

SEQ ID NO: 1884829 - RNA, 23 nt, Human
cccagcccuccuuaucaaaggac

SEQ ID NO: 1884830 - RNA, 12 nt, Human
aauuuaaauaua

SEQ ID NO: 1884831 - RNA, 22 nt, Human
accccugagcuugcagagauga

SEQ ID NO: 1884832 - RNA, 16 nt, Human
gaaaaaauaacaauga

SEQ ID NO: 1884833 - RNA, 18 nt, Human
uuuauguuuaauucugaa

SEQ ID NO: 1884834 - RNA, 23 nt, Human
aucucuucuggguuccuuccucu

SEQ ID NO: 1884835 - RNA, 18 nt, Human
auagcuacuaauuuuaaa

SEQ ID NO: 1884836 - RNA, 22 nt, Human
agccaaacauccuacaagacac

SEQ ID NO: 1884837 - RNA, 18 nt, Human
auccuucagccugaaaga

SEQ ID NO: 1884838 - RNA, 13 nt, Human
ugcauuucuaaag

SEQ ID NO: 1884839 - RNA, 14 nt, Human
uuaugauuaaguaa

SEQ ID NO: 1884840 - RNA, 22 nt, Human
gcuaaaacaagcacuaaacaaa

SEQ ID NO: 1884841 - RNA, 19 nt, Human
uauacugugugcuaaaaca

SEQ ID NO: 1884842 - RNA, 14 nt, Human
gagcucagcccugg

SEQ ID NO: 1884843 - RNA, 16 nt, Human
uucucuaggaaauauu

SEQ ID NO: 1884844 - RNA, 14 nt, Human
ucaaugcagccccc

SEQ ID NO: 1884845 - RNA, 14 nt, Human
ccaugggacaggga

SEQ ID NO: 1884846 - RNA, 18 nt, Human
acuuuaugcuaagugaaa

SEQ ID NO: 1884847 - RNA, 18 nt, Human
caguuguugcccacagcu

SEQ ID NO: 1884848 - RNA, 19 nt, Human
aauuuuuauauuugaaaua

SEQ ID NO: 1884849 - RNA, 21 nt, Human
aauucauucacucaacaaaca

SEQ ID NO: 1884850 - RNA, 20 nt, Human
cuacuuccccuuccuaauuc

SEQ ID NO: 1884851 - RNA, 22 nt, Human
ccgggagccugaucaccugccc

SEQ ID NO: 1884852 - RNA, 14 nt, Human
caaaugcauuucua

SEQ ID NO: 1884853 - RNA, 12 nt, Human
cccccagcccuc

SEQ ID NO: 1884854 - RNA, 15 nt, Human
uaacgauaaaagaca

SEQ ID NO: 1884855 - RNA, 20 nt, Human
cuugccauaauuacuauguc

SEQ ID NO: 1884856 - RNA, 22 nt, Human
ggacaguaaaauccacagacca

SEQ ID NO: 1884857 - RNA, 22 nt, Human
aauaugccccauucaacaucua

SEQ ID NO: 1884858 - RNA, 16 nt, Human
aaaaugugauauguac

SEQ ID NO: 1884859 - RNA, 17 nt, Human
guauuauuuuuuaaaaa

SEQ ID NO: 1884860 - RNA, 23 nt, Human
uagacacacaugaaguccaagca

SEQ ID NO: 1884861 - RNA, 19 nt, Human
cuaguaucaaaagaaagaa

SEQ ID NO: 1884862 - RNA, 15 nt, Human
auauugacuuuuuau

SEQ ID NO: 1884863 - RNA, 22 nt, Human
auuacuguaagaaaauaucacu

SEQ ID NO: 1884864 - RNA, 18 nt, Human
cagcuuauugucuaguga

SEQ ID NO: 1884865 - RNA, 22 nt, Human
aaaaaaccugagccccaaaagg

SEQ ID NO: 1884866 - RNA, 19 nt, Human
cuggacucaccucccccau

SEQ ID NO: 1884867 - RNA, 14 nt, Human
uuuguauaaaauaa

SEQ ID NO: 1884868 - RNA, 20 nt, Human
uaaaagacagugaaagaaaa

SEQ ID NO: 1884869 - RNA, 22 nt, Human
agacccacuggacucaccuccc

SEQ ID NO: 1884870 - RNA, 13 nt, Human
ccugagcuugcag

SEQ ID NO: 1884871 - RNA, 15 nt, Human
auaauccuaaacaua

SEQ ID NO: 1884872 - RNA, 14 nt, Human
uucuaugaaauauu

SEQ ID NO: 1884873 - RNA, 17 nt, Human
caauaacgauaaaagac

SEQ ID NO: 1884874 - RNA, 12 nt, Human
aaaagaaagaaa

SEQ ID NO: 1884875 - RNA, 14 nt, Human
uauuuauuuuaaua

SEQ ID NO: 1884876 - RNA, 15 nt, Human
uuacagagacagaaa

SEQ ID NO: 1884877 - RNA, 21 nt, Human
aucuuuuuuuuaauaaaccau

SEQ ID NO: 1884878 - RNA, 19 nt, Human
acagucaccucauggaauu

SEQ ID NO: 1884879 - RNA, 17 nt, Human
uccuacaagacacagug

SEQ ID NO: 1884880 - RNA, 21 nt, Human
auauaugcuaagucuuauaua

SEQ ID NO: 1884881 - RNA, 14 nt, Human
ggccgggagccuga

SEQ ID NO: 1884882 - RNA, 18 nt, Human
acauuugcucauggaauu

SEQ ID NO: 1884883 - RNA, 20 nt, Human
aaugaauacuuuauaaagga

SEQ ID NO: 1884884 - RNA, 22 nt, Human
gacucaccucccccaucucuuc

SEQ ID NO: 1884885 - RNA, 20 nt, Human
aaacuuuaugcuaagugaaa

SEQ ID NO: 1884886 - RNA, 20 nt, Human
augguuuagaaagcuugccc

SEQ ID NO: 1884887 - RNA, 19 nt, Human
aggucuaccaaaaaucuca

SEQ ID NO: 1884888 - RNA, 14 nt, Human
aagcaacccaaaug

SEQ ID NO: 1884889 - RNA, 12 nt, Human
gcucagcccugg

SEQ ID NO: 1884890 - RNA, 17 nt, Human
agaugggagaaucacuu

SEQ ID NO: 1884891 - RNA, 23 nt, Human
cacagauuugagcucagcccugg

SEQ ID NO: 1884892 - RNA, 17 nt, Human
cuccuuaucaaaggaca

SEQ ID NO: 1884893 - RNA, 12 nt, Human
cuggcuccagcu

SEQ ID NO: 1884894 - RNA, 19 nt, Human
agucaaauugugugaaagg

SEQ ID NO: 1884895 - RNA, 17 nt, Human
uugccaaauauaaauaa

SEQ ID NO: 1884896 - RNA, 17 nt, Human
ucuauaauguguucauu

SEQ ID NO: 1884897 - RNA, 14 nt, Human
cuucucuucacagu

SEQ ID NO: 1884898 - RNA, 16 nt, Human
aauaaaguguuugaaa

SEQ ID NO: 1884899 - RNA, 17 nt, Human
cugaucaccugcccugc

SEQ ID NO: 1884900 - RNA, 22 nt, Human
guacacugccuucucaacucca

SEQ ID NO: 1884901 - RNA, 15 nt, Human
uuuaauaauuuuuaa

SEQ ID NO: 1884902 - RNA, 20 nt, Human
uguaagaaaauaucacuugu

SEQ ID NO: 1884903 - RNA, 19 nt, Human
gaggcagagguugcaguga

SEQ ID NO: 1884904 - RNA, 16 nt, Human
ccucaaaacuucagac

SEQ ID NO: 1884905 - RNA, 21 nt, Human
augaauacuuuauaaaggauu

SEQ ID NO: 1884906 - RNA, 16 nt, Human
uaaaauccauacauuu

SEQ ID NO: 1884907 - RNA, 15 nt, Human
gccuaagugcagccc

SEQ ID NO: 1884908 - RNA, 23 nt, Human
agaaugauuaugaauuacauuug

SEQ ID NO: 1884909 - RNA, 17 nt, Human
cagacaucaacagauaa

SEQ ID NO: 1884910 - RNA, 19 nt, Human
cuaagcuucacuguaaaau

SEQ ID NO: 1884911 - RNA, 22 nt, Human
cucugagccuugggaccccuga

SEQ ID NO: 1884912 - RNA, 14 nt, Human
cuggccgggagccu

SEQ ID NO: 1884913 - RNA, 14 nt, Human
gaaaacaauaacga

SEQ ID NO: 1884914 - RNA, 20 nt, Human
cugauauuggacaguaaaau

SEQ ID NO: 1884915 - RNA, 19 nt, Human
ggagccugaucaccugccc

SEQ ID NO: 1884916 - RNA, 20 nt, Human
gaaacauuugguaaggggaa

SEQ ID NO: 1884917 - RNA, 16 nt, Human
uccugcaauuccacuu

SEQ ID NO: 1884918 - RNA, 14 nt, Human
augauguuuagaaa

SEQ ID NO: 1884919 - RNA, 22 nt, Human
ugagacucugucucaguccaug

SEQ ID NO: 1884920 - RNA, 21 nt, Human
caccagucugacuguuuccau

SEQ ID NO: 1884921 - RNA, 16 nt, Human
ucuucaacucccugcc

SEQ ID NO: 1884922 - RNA, 18 nt, Human
cagucucccucccuuggg

SEQ ID NO: 1884923 - RNA, 16 nt, Human
cugcacuccagccuga

SEQ ID NO: 1884924 - RNA, 22 nt, Human
aaacauguuuaucguauuugau

SEQ ID NO: 1884925 - RNA, 17 nt, Human
cuaucucauuuccaagc

SEQ ID NO: 1884926 - RNA, 19 nt, Human
cagagaugaggccgccaug

SEQ ID NO: 1884927 - RNA, 18 nt, Human
uuuugugaagcaaaauuu

SEQ ID NO: 1884928 - RNA, 16 nt, Human
cauuucuaaagccauu

SEQ ID NO: 1884929 - RNA, 20 nt, Human
ucuucuggguuccuuccucu

SEQ ID NO: 1884930 - RNA, 14 nt, Human
cugagucccaggcu

SEQ ID NO: 1884931 - RNA, 22 nt, Human
ugguuguauuauuuuuuaaaaa

SEQ ID NO: 1884932 - RNA, 19 nt, Human
agacucgggauuaguacac

SEQ ID NO: 1884933 - RNA, 19 nt, Human
cauggaauuggagcucgug

SEQ ID NO: 1884934 - RNA, 13 nt, Human
aagacaaggaaaa

SEQ ID NO: 1884935 - RNA, 22 nt, Human
uggguuccuuccucugagccuu

SEQ ID NO: 1884936 - RNA, 21 nt, Human
ucuuaggguuaugauuaagua

SEQ ID NO: 1884937 - RNA, 17 nt, Human
uccagcuggccgggagc

SEQ ID NO: 1884938 - RNA, 18 nt, Human
acaaaugcauuucuaaag

SEQ ID NO: 1884939 - RNA, 15 nt, Human
uagauaggccauggg

SEQ ID NO: 1884940 - RNA, 14 nt, Human
ggcuccagcuggcc

SEQ ID NO: 1884941 - RNA, 15 nt, Human
cuguaaaauaauaac

SEQ ID NO: 1884942 - RNA, 17 nt, Human
uaacugauuuguaacaa

SEQ ID NO: 1884943 - RNA, 22 nt, Human
cucagcccuggugggcagagag

SEQ ID NO: 1884944 - RNA, 16 nt, Human
uuuauauuugaaauau

SEQ ID NO: 1884945 - RNA, 13 nt, Human
aaauccuugaaga

SEQ ID NO: 1884946 - RNA, 20 nt, Human
gccgggcgugguggugagug

SEQ ID NO: 1884947 - RNA, 13 nt, Human
ccucccccaucuc

SEQ ID NO: 1884948 - RNA, 15 nt, Human
gcuguauuuuaaaag

SEQ ID NO: 1884949 - RNA, 21 nt, Human
aacuuguaaaggaauuuaaaa

SEQ ID NO: 1884950 - RNA, 20 nt, Human
guucugcagauaaacaguag

SEQ ID NO: 1884951 - RNA, 14 nt, Human
caguucugaagaag

SEQ ID NO: 1884952 - RNA, 20 nt, Human
accucugccucagaaaacaa

SEQ ID NO: 1884953 - RNA, 17 nt, Human
ucuauaauuuaaauaua

SEQ ID NO: 1884954 - RNA, 17 nt, Human
augauuaaguaaugaua

SEQ ID NO: 1884955 - RNA, 21 nt, Human
ugaaauggacuuuuguacaua

SEQ ID NO: 1884956 - RNA, 20 nt, Human
gaaaauaacgauaaaagaca

SEQ ID NO: 1884957 - RNA, 17 nt, Human
uuauauuugaaauauug

SEQ ID NO: 1884958 - RNA, 17 nt, Human
aucaaggguacacugcc

SEQ ID NO: 1884959 - RNA, 19 nt, Human
gccccccagcccuccuuau

SEQ ID NO: 1884960 - RNA, 21 nt, Human
auaauuuuuauauuugaaaua

SEQ ID NO: 1884961 - RNA, 13 nt, Human
uuuuaaaaaagaa

SEQ ID NO: 1884962 - RNA, 15 nt, Human
cuucaacucccugcc

SEQ ID NO: 1884963 - RNA, 19 nt, Human
gucuuucacauuuaaauaa

SEQ ID NO: 1884964 - RNA, 18 nt, Human
ccuuccuaauuccacagc

SEQ ID NO: 1884965 - RNA, 19 nt, Human
aaucuacacuccagugaga

SEQ ID NO: 1884966 - RNA, 22 nt, Human
uaauaggcguaacuaauuuuaa

SEQ ID NO: 1884967 - RNA, 18 nt, Human
uaauaauguuucaaacau

SEQ ID NO: 1884968 - RNA, 14 nt, Human
aauuguauuacaaa

SEQ ID NO: 1884969 - RNA, 19 nt, Human
ccccucuggcuccagcugg

SEQ ID NO: 1884970 - RNA, 16 nt, Human
guuuuuuuuuaaaaaa

SEQ ID NO: 1884971 - RNA, 20 nt, Human
ccagcuugaaaccuucacuu

SEQ ID NO: 1884972 - RNA, 14 nt, Human
aauaguuuaugauu

SEQ ID NO: 1884973 - RNA, 14 nt, Human
gucccaggcugagc

SEQ ID NO: 1884974 - RNA, 14 nt, Human
cuggagcucugccc

SEQ ID NO: 1884975 - RNA, 23 nt, Human
auaauguguucauucuggaauaa

SEQ ID NO: 1884976 - RNA, 17 nt, Human
aguauuucuaugaaaua

SEQ ID NO: 1884977 - RNA, 15 nt, Human
aaggaaaaaauaaca

SEQ ID NO: 1884978 - RNA, 12 nt, Human
gacagugaaaga

SEQ ID NO: 1884979 - RNA, 14 nt, Human
agcucguggaacag

SEQ ID NO: 1884980 - RNA, 16 nt, Human
uuuucucuaggaaaua

SEQ ID NO: 1884981 - RNA, 17 nt, Human
uuccaagccucaugucc

SEQ ID NO: 1884982 - RNA, 23 nt, Human
uaaaagacagugaaagaaaauaa

SEQ ID NO: 1884983 - RNA, 19 nt, Human
gucaaauugugugaaaggu

SEQ ID NO: 1884984 - RNA, 15 nt, Human
uuauagcuacuaauu

SEQ ID NO: 1884985 - RNA, 14 nt, Human
cucaacaaacauaa

SEQ ID NO: 1884986 - RNA, 12 nt, Human
auuuuaaaagaa

SEQ ID NO: 1884987 - RNA, 16 nt, Human
uaacaauaaaagacaa

SEQ ID NO: 1884988 - RNA, 22 nt, Human
cuuccuaauuccacagcugcuc

SEQ ID NO: 1884989 - RNA, 19 nt, Human
auuauuuuuuaaaaaaauu

SEQ ID NO: 1884990 - RNA, 20 nt, Human
aagacagugaaagaaaauaa

SEQ ID NO: 1884991 - RNA, 20 nt, Human
ccauacuaauuauacccccu

SEQ ID NO: 1884992 - RNA, 13 nt, Human
ugaaagaaaauaa

SEQ ID NO: 1884993 - RNA, 16 nt, Human
gccaaggaugccccgu

SEQ ID NO: 1884994 - RNA, 16 nt, Human
cugagcauuuaauaug

SEQ ID NO: 1884995 - RNA, 16 nt, Human
acagagacagaaagca

SEQ ID NO: 1884996 - RNA, 13 nt, Human
uuaugcuaaguga

SEQ ID NO: 1884997 - RNA, 23 nt, Human
ggccuccauccugaggcuccacu

SEQ ID NO: 1884998 - RNA, 22 nt, Human
aaaucaggguuaguauugucca

SEQ ID NO: 1884999 - RNA, 20 nt, Human
augcuucuguuuuauaauuu

SEQ ID NO: 1885000 - RNA, 19 nt, Human
acuggacucaccuccccca

SEQ ID NO: 1885001 - RNA, 20 nt, Human
augucgucaaagcugaaaug

SEQ ID NO: 1885002 - RNA, 13 nt, Human
uuuaaaaauccua

SEQ ID NO: 1885003 - RNA, 22 nt, Human
ucuggguuccuuccucugagcc

SEQ ID NO: 1885004 - RNA, 17 nt, Human
aacaguuaccucugccu

SEQ ID NO: 1885005 - RNA, 16 nt, Human
ccccaucucuucuggg

SEQ ID NO: 1885006 - RNA, 15 nt, Human
acaucaacagauaaa

SEQ ID NO: 1885007 - RNA, 15 nt, Human
acaaaugggaaacaa

SEQ ID NO: 1885008 - RNA, 23 nt, Human
ucaauaucuuuuuuuuaauaaac

SEQ ID NO: 1885009 - RNA, 15 nt, Human
aauucugaaagcaac

SEQ ID NO: 1885010 - RNA, 21 nt, Human
aggcucuuuugggauuuuuga

SEQ ID NO: 1885011 - RNA, 18 nt, Human
aaaaguucugcagauaaa

SEQ ID NO: 1885012 - RNA, 23 nt, Human
aucacagcuacuugggaggcuga

SEQ ID NO: 1885013 - RNA, 16 nt, Human
ugaauuaguuuuauau

SEQ ID NO: 1885014 - RNA, 18 nt, Human
aaauauuuauuuuaauaa

SEQ ID NO: 1885015 - RNA, 15 nt, Human
ucugucucaguccau

SEQ ID NO: 1885016 - RNA, 17 nt, Human
gugccuguaaucacagc

SEQ ID NO: 1885017 - RNA, 19 nt, Human
uucccuugaugaagaaguu

SEQ ID NO: 1885018 - RNA, 19 nt, Human
uuccucccuucucuucaca

SEQ ID NO: 1885019 - RNA, 13 nt, Human
gaaccuaggguga

SEQ ID NO: 1885020 - RNA, 16 nt, Human
uuucuauaauuuaaau

SEQ ID NO: 1885021 - RNA, 15 nt, Human
aauacuuuauaaagg

SEQ ID NO: 1885022 - RNA, 22 nt, Human
uugaaaaucuuauaauuuaaaa

SEQ ID NO: 1885023 - RNA, 23 nt, Human
gaggcauuuaggccaugggacag

SEQ ID NO: 1885024 - RNA, 17 nt, Human
uucucuaggaaauauuu

SEQ ID NO: 1885025 - RNA, 19 nt, Human
aaacaauaacgauaaaaga

SEQ ID NO: 1885026 - RNA, 15 nt, Human
uggacgagaaaacaa

SEQ ID NO: 1885027 - RNA, 13 nt, Human
aaaugggaaacaa

SEQ ID NO: 1885028 - RNA, 16 nt, Human
caauaacgauaaaaga

SEQ ID NO: 1885029 - RNA, 17 nt, Human
ugaccacugcagaagac

SEQ ID NO: 1885030 - RNA, 22 nt, Human
acaugagguacugagagugaac

SEQ ID NO: 1885031 - RNA, 14 nt, Human
auaaaauaauuuuu

SEQ ID NO: 1885032 - RNA, 18 nt, Human
gaugcaguucugaagaag

SEQ ID NO: 1885033 - RNA, 14 nt, Human
caaggcuagaacca

SEQ ID NO: 1885034 - RNA, 13 nt, Human
ucuacuaaaaaua

SEQ ID NO: 1885035 - RNA, 14 nt, Human
ccagcuggccggga

SEQ ID NO: 1885036 - RNA, 18 nt, Human
aagaccucauuuugaagg

SEQ ID NO: 1885037 - RNA, 23 nt, Human
acguaaucguguccccuauccua

SEQ ID NO: 1885038 - RNA, 15 nt, Human
ucaguuuuugugaaa

SEQ ID NO: 1885039 - RNA, 14 nt, Human
uugcuggagcucug

SEQ ID NO: 1885040 - RNA, 20 nt, Human
cucuguucugcacacagcac

SEQ ID NO: 1885041 - RNA, 22 nt, Human
cucuggccuucggccuccaucc

SEQ ID NO: 1885042 - RNA, 11 nt, Human
auuuaaaaauc

SEQ ID NO: 1885043 - RNA, 14 nt, Human
ucagucucccuccc

SEQ ID NO: 1885044 - RNA, 13 nt, Human
uuauucacaagac

SEQ ID NO: 1885045 - RNA, 22 nt, Human
cagcacgggggccaaggaugcc

SEQ ID NO: 1885046 - RNA, 15 nt, Human
cuugaaaacuuuaug

SEQ ID NO: 1885047 - RNA, 23 nt, Human
gauauuaaccaggggccaugaau

SEQ ID NO: 1885048 - RNA, 22 nt, Human
acauccuacaagacacagugac

SEQ ID NO: 1885049 - RNA, 16 nt, Human
aaaagcuccauuuuua

SEQ ID NO: 1885050 - RNA, 15 nt, Human
ucagucucccucccu

SEQ ID NO: 1885051 - RNA, 14 nt, Human
uaaauaaaaauaau

SEQ ID NO: 1885052 - RNA, 12 nt, Human
aagagcuuaaca

SEQ ID NO: 1885053 - RNA, 14 nt, Human
aacgauaaaagaca

SEQ ID NO: 1885054 - RNA, 22 nt, Human
caucucuucuggguuccuuccu

SEQ ID NO: 1885055 - RNA, 22 nt, Human
aauuuuuucucuaggaaauauu

SEQ ID NO: 1885056 - RNA, 21 nt, Human
aauuaaguuuuuuuuuaaaaa

SEQ ID NO: 1885057 - RNA, 17 nt, Human
uccucugagccuuggga

SEQ ID NO: 1885058 - RNA, 14 nt, Human
uaguaucaaaagaa

SEQ ID NO: 1885059 - RNA, 20 nt, Human
aauaagccagacaucaacag

SEQ ID NO: 1885060 - RNA, 16 nt, Human
ccuggugggcagagag

SEQ ID NO: 1885061 - RNA, 19 nt, Human
aagcauuccaacuaucuca

SEQ ID NO: 1885062 - RNA, 13 nt, Human
aguuaccucugcc

SEQ ID NO: 1885063 - RNA, 15 nt, Human
ugaaacccugucucu

SEQ ID NO: 1885064 - RNA, 19 nt, Human
ugagcgcccacuagaccca

SEQ ID NO: 1885065 - RNA, 13 nt, Human
aacaauaaaagac

SEQ ID NO: 1885066 - RNA, 20 nt, Human
agccuuggggcugaugcagu

SEQ ID NO: 1885067 - RNA, 14 nt, Human
ugagcuugcagaga

SEQ ID NO: 1885068 - RNA, 11 nt, Human
uucacagggga

SEQ ID NO: 1885069 - RNA, 14 nt, Human
acagaauuuuaugc

SEQ ID NO: 1885070 - RNA, 16 nt, Human
caggcugagccucagu

SEQ ID NO: 1885071 - RNA, 13 nt, Human
auuuuuuaaaaaa

SEQ ID NO: 1885072 - RNA, 17 nt, Human
cuggacucaccuccccc

SEQ ID NO: 1885073 - RNA, 18 nt, Human
auuuguauaaaauaauuu

SEQ ID NO: 1885074 - RNA, 20 nt, Human
uugaacccgggaggcagagg

SEQ ID NO: 1885075 - RNA, 23 nt, Human
cuagacccacuggacucaccucc

SEQ ID NO: 1885076 - RNA, 10 nt, Human
caacucccug

SEQ ID NO: 1885077 - RNA, 13 nt, Human
aacucuauaaugu

SEQ ID NO: 1885078 - RNA, 18 nt, Human
guuuaugguuguauuauu

SEQ ID NO: 1885079 - RNA, 15 nt, Human
ugcuucuguuuuaua

SEQ ID NO: 1885080 - RNA, 22 nt, Human
ugaagcaaaauuuuuucucuag

SEQ ID NO: 1885081 - RNA, 20 nt, Human
aaagagugaaggauuuaugu

SEQ ID NO: 1885082 - RNA, 13 nt, Human
uauuucuaugaaa

SEQ ID NO: 1885083 - RNA, 18 nt, Human
auguuaaaacugggacag

SEQ ID NO: 1885084 - RNA, 22 nt, Human
cugaggcuccacuuggucugug

SEQ ID NO: 1885085 - RNA, 17 nt, Human
ccccaguuguuucuacu

SEQ ID NO: 1885086 - RNA, 17 nt, Human
uaucuuuuuuuuaauaa

SEQ ID NO: 1885087 - RNA, 14 nt, Human
uauaauuuaaauau

SEQ ID NO: 1885088 - RNA, 17 nt, Human
auuuuaauaauguuuca

SEQ ID NO: 1885089 - RNA, 18 nt, Human
uguaaaggaauuuaaaaa

SEQ ID NO: 1885090 - RNA, 15 nt, Human
ccagauccuggaaau

SEQ ID NO: 1885091 - RNA, 18 nt, Human
ugugaccacugcagaaga

SEQ ID NO: 1885092 - RNA, 12 nt, Human
aaugcagccccc

SEQ ID NO: 1885093 - RNA, 14 nt, Human
gugagcuacaaaug

SEQ ID NO: 1885094 - RNA, 19 nt, Human
cagaaagcagaacagugau

SEQ ID NO: 1885095 - RNA, 18 nt, Human
uaauuuuaacucuauaau

SEQ ID NO: 1885096 - RNA, 17 nt, Human
agguccacaacacacag

SEQ ID NO: 1885097 - RNA, 16 nt, Human
cucagcccuggugggc

SEQ ID NO: 1885098 - RNA, 10 nt, Human
ccugagcccc

SEQ ID NO: 1885099 - RNA, 17 nt, Human
ccugccccccagcccuc

SEQ ID NO: 1885100 - RNA, 14 nt, Human
accacaagacugca

SEQ ID NO: 1885101 - RNA, 15 nt, Human
agugacaagcucaca

SEQ ID NO: 1885102 - RNA, 20 nt, Human
gcagagaugaggccgccaug

SEQ ID NO: 1885103 - RNA, 22 nt, Human
agaauuuuaugcggcauuuucu

SEQ ID NO: 1885104 - RNA, 23 nt, Human
caucucuucuggguuccuuccuc

SEQ ID NO: 1885105 - RNA, 15 nt, Human
aaaaaauaacaauga

SEQ ID NO: 1885106 - RNA, 15 nt, Human
cuaguaauuggaaag

SEQ ID NO: 1885107 - RNA, 13 nt, Human
uguauauuuuaua

SEQ ID NO: 1885108 - RNA, 20 nt, Human
cuuauucacaagacccaaaa

SEQ ID NO: 1885109 - RNA, 13 nt, Human
caguuauuauauu

SEQ ID NO: 1885110 - RNA, 18 nt, Human
aaaaucuuauaauuuaaa

SEQ ID NO: 1885111 - RNA, 21 nt, Human
ugcucaauaaaguacaagagc

SEQ ID NO: 1885112 - RNA, 13 nt, Human
aaacauccuacaa

SEQ ID NO: 1885113 - RNA, 15 nt, Human
aaaagacaaggaaaa

SEQ ID NO: 1885114 - RNA, 17 nt, Human
agaaaugaaagcaggga

SEQ ID NO: 1885115 - RNA, 13 nt, Human
acaauaaaagaca

SEQ ID NO: 1885116 - RNA, 21 nt, Human
gccuuuucccaacuccagaaa

SEQ ID NO: 1885117 - RNA, 20 nt, Human
aagcuucacuguaaaauaau

SEQ ID NO: 1885118 - RNA, 18 nt, Human
cccaggcugagccucagu

SEQ ID NO: 1885119 - RNA, 17 nt, Human
caaauccaaugaaauga

SEQ ID NO: 1885120 - RNA, 16 nt, Human
uauccuacuuccccuu

SEQ ID NO: 1885121 - RNA, 21 nt, Human
gccugaucaccugcccugcug

SEQ ID NO: 1885122 - RNA, 20 nt, Human
cucccugccccccagcccuc

SEQ ID NO: 1885123 - RNA, 16 nt, Human
auuuuaauaauguuuc

SEQ ID NO: 1885124 - RNA, 13 nt, Human
ccugccccccagc

SEQ ID NO: 1885125 - RNA, 15 nt, Human
ugagcgcccacuaga

SEQ ID NO: 1885126 - RNA, 15 nt, Human
gccccugcacuccag

SEQ ID NO: 1885127 - RNA, 23 nt, Human
agcccuccuuaucaaaggacacc

SEQ ID NO: 1885128 - RNA, 20 nt, Human
aauuuuuucucuaggaaaua

SEQ ID NO: 1885129 - RNA, 20 nt, Human
ugagcgcccacuagacccac

SEQ ID NO: 1885130 - RNA, 14 nt, Human
ucuaggaaauauuu

SEQ ID NO: 1885131 - RNA, 13 nt, Human
augcuagaacucc

SEQ ID NO: 1885132 - RNA, 18 nt, Human
aucuacacuccagugaga

SEQ ID NO: 1885133 - RNA, 14 nt, Human
cguguccccuaucc

SEQ ID NO: 1885134 - RNA, 19 nt, Human
uugugccccugcacuccag

SEQ ID NO: 1885135 - RNA, 23 nt, Human
cacuggacucaccucccccaucu

SEQ ID NO: 1885136 - RNA, 20 nt, Human
uuaaguuuuuuuuuaaaaaa

SEQ ID NO: 1885137 - RNA, 17 nt, Human
auggcuaguaucaaaag

SEQ ID NO: 1885138 - RNA, 19 nt, Human
uggaacaguuaccucugcc

SEQ ID NO: 1885139 - RNA, 19 nt, Human
agccugaucaccugcccug

SEQ ID NO: 1885140 - RNA, 15 nt, Human
uaaaagacaaggaaa

SEQ ID NO: 1885141 - RNA, 14 nt, Human
agauguagaggaga

SEQ ID NO: 1885142 - RNA, 17 nt, Human
gccccccagcccuccuu

SEQ ID NO: 1885143 - RNA, 18 nt, Human
agccugaucaccugcccu

SEQ ID NO: 1885144 - RNA, 17 nt, Human
ccugagcuugcagagau

SEQ ID NO: 1885145 - RNA, 21 nt, Human
accaaggagccaaacauccua

SEQ ID NO: 1885146 - RNA, 18 nt, Human
ccuucggccuccauccug

SEQ ID NO: 1885147 - RNA, 23 nt, Human
uagauaggucagugcaaauacuc

SEQ ID NO: 1885148 - RNA, 18 nt, Human
aaggaugccccguccccc

SEQ ID NO: 1885149 - RNA, 17 nt, Human
ccacugcagaagacagu

SEQ ID NO: 1885150 - RNA, 20 nt, Human
acaagacccaaaaggcagaa

SEQ ID NO: 1885151 - RNA, 14 nt, Human
acuuggucugugag

SEQ ID NO: 1885152 - RNA, 16 nt, Human
uaaaagacaaggaaaa

SEQ ID NO: 1885153 - RNA, 12 nt, Human
uaauuccacagc

SEQ ID NO: 1885154 - RNA, 15 nt, Human
cagaauucauucacu

SEQ ID NO: 1885155 - RNA, 12 nt, Human
caggacagcccu

SEQ ID NO: 1885156 - RNA, 13 nt, Human
cacauuuaaauaa

SEQ ID NO: 1885157 - RNA, 17 nt, Human
aaaguacaagagcuuaa

SEQ ID NO: 1885158 - RNA, 16 nt, Human
aaauaacaaugaaagu

SEQ ID NO: 1885159 - RNA, 15 nt, Human
cugaaagaggaauga

SEQ ID NO: 1885160 - RNA, 23 nt, Human
cuugauaaauggcuuccuggcaa

SEQ ID NO: 1885161 - RNA, 22 nt, Human
uggacgagaaaacaauaacgau

SEQ ID NO: 1885162 - RNA, 14 nt, Human
uuuuaaaaaagaaa

SEQ ID NO: 1885163 - RNA, 12 nt, Human
acugaaaucaua

SEQ ID NO: 1885164 - RNA, 13 nt, Human
uaauuuuuauauu

SEQ ID NO: 1885165 - RNA, 18 nt, Human
uagugaaauauuauuuua

SEQ ID NO: 1885166 - RNA, 12 nt, Human
cuacaagacaca

SEQ ID NO: 1885167 - RNA, 13 nt, Human
aaaauaacaauga

SEQ ID NO: 1885168 - RNA, 15 nt, Human
uaucaauuuaaaaaa

SEQ ID NO: 1885169 - RNA, 13 nt, Human
caacucccugccc

SEQ ID NO: 1885170 - RNA, 13 nt, Human
aagcauuccaacu

SEQ ID NO: 1885171 - RNA, 17 nt, Human
cucuuuugggauuuuug

SEQ ID NO: 1885172 - RNA, 21 nt, Human
uauaaaauaauuuuuauauuu

SEQ ID NO: 1885173 - RNA, 22 nt, Human
accauuucuugagguaaaagca

SEQ ID NO: 1885174 - RNA, 20 nt, Human
agaggagaaacuggaacucu

SEQ ID NO: 1885175 - RNA, 11 nt, Human
aauuccacagc

SEQ ID NO: 1885176 - RNA, 15 nt, Human
guaaggggaauugag

SEQ ID NO: 1885177 - RNA, 18 nt, Human
gcacuccagccugagcga

SEQ ID NO: 1885178 - RNA, 15 nt, Human
gauccugcaauucca

SEQ ID NO: 1885179 - RNA, 21 nt, Human
acgcucucuggccuucggccu

SEQ ID NO: 1885180 - RNA, 18 nt, Human
uccuaauuccacagcugc

SEQ ID NO: 1885181 - RNA, 17 nt, Human
cucagucucccucccuu

SEQ ID NO: 1885182 - RNA, 18 nt, Human
ccauccugccccugagcc

SEQ ID NO: 1885183 - RNA, 16 nt, Human
aagcauuuagauguau

SEQ ID NO: 1885184 - RNA, 15 nt, Human
cacaggacagcccuu

SEQ ID NO: 1885185 - RNA, 22 nt, Human
cuccagccugagcgacagugag

SEQ ID NO: 1885186 - RNA, 16 nt, Human
ucaguuuuugugaaaa

SEQ ID NO: 1885187 - RNA, 15 nt, Human
ucauaauaaguugca

SEQ ID NO: 1885188 - RNA, 21 nt, Human
aaucaccaaggcugauuaaac

SEQ ID NO: 1885189 - RNA, 22 nt, Human
aauuacauuuguauaaaauaau

SEQ ID NO: 1885190 - RNA, 17 nt, Human
cuacacuccagugagac

SEQ ID NO: 1885191 - RNA, 23 nt, Human
uuagaugcaguucugaagaagau

SEQ ID NO: 1885192 - RNA, 19 nt, Human
uuggcaagcucuaucacca

SEQ ID NO: 1885193 - RNA, 19 nt, Human
agaugcuagaacucccuuu

SEQ ID NO: 1885194 - RNA, 20 nt, Human
aaaaucuuauaauuuaaaau

SEQ ID NO: 1885195 - RNA, 18 nt, Human
gccccgucccccucuggc

SEQ ID NO: 1885196 - RNA, 23 nt, Human
uaaguuuuuuuuuaaaaaagaaa

SEQ ID NO: 1885197 - RNA, 18 nt, Human
aaauauaaauaaaaauaa

SEQ ID NO: 1885198 - RNA, 14 nt, Human
cagauccccaagcc

SEQ ID NO: 1885199 - RNA, 16 nt, Human
cuucaacucccugccc

SEQ ID NO: 1885200 - RNA, 23 nt, Human
uaauuuguaguguuggagaagaa

SEQ ID NO: 1885201 - RNA, 23 nt, Human
gaccccugagcuugcagagauga

SEQ ID NO: 1885202 - RNA, 15 nt, Human
cuuuucccaacucca

SEQ ID NO: 1885203 - RNA, 16 nt, Human
cuucacuguaaaauaa

SEQ ID NO: 1885204 - RNA, 22 nt, Human
acaccuuguacuuuauuuucua

SEQ ID NO: 1885205 - RNA, 15 nt, Human
acaggguuuauguuu

SEQ ID NO: 1885206 - RNA, 19 nt, Human
caauucuugccaaauauaa

SEQ ID NO: 1885207 - RNA, 17 nt, Human
aauaaaguguuugaaag

SEQ ID NO: 1885208 - RNA, 17 nt, Human
agacacacugaagaagc

SEQ ID NO: 1885209 - RNA, 15 nt, Human
cuggguuccuuccuc

SEQ ID NO: 1885210 - RNA, 19 nt, Human
ccugccuaagugcagcccc

SEQ ID NO: 1885211 - RNA, 21 nt, Human
ugccuguaaucacagcuacuu

SEQ ID NO: 1885212 - RNA, 15 nt, Human
aguucugaagaagau

SEQ ID NO: 1885213 - RNA, 19 nt, Human
ugaaauggacuuuuguaca

SEQ ID NO: 1885214 - RNA, 22 nt, Human
agaaugagagacacacugaaga

SEQ ID NO: 1885215 - RNA, 17 nt, Human
cuuccuaauuccacagc

SEQ ID NO: 1885216 - RNA, 15 nt, Human
ugauuucauucaaua

SEQ ID NO: 1885217 - RNA, 21 nt, Human
caagacugcacaucaaaauau

SEQ ID NO: 1885218 - RNA, 17 nt, Human
cucguggaacaguuacc

SEQ ID NO: 1885219 - RNA, 16 nt, Human
auugucuagugaaacu

SEQ ID NO: 1885220 - RNA, 14 nt, Human
ugguauguuuucag

SEQ ID NO: 1885221 - RNA, 17 nt, Human
auaaguacaugauaagc

SEQ ID NO: 1885222 - RNA, 15 nt, Human
gaccacugcagaaga

SEQ ID NO: 1885223 - RNA, 22 nt, Human
acagauuugagcucagcccugg

SEQ ID NO: 1885224 - RNA, 19 nt, Human
accccugagcuugcagaga

SEQ ID NO: 1885225 - RNA, 16 nt, Human
uuucacauuuaaauaa

SEQ ID NO: 1885226 - RNA, 22 nt, Human
uauccuacuuccccuuccuaau

SEQ ID NO: 1885227 - RNA, 16 nt, Human
aacaauaaaagacaag

SEQ ID NO: 1885228 - RNA, 17 nt, Human
agucugacuguuuccau

SEQ ID NO: 1885229 - RNA, 19 nt, Human
ugggacaggggagaaccua

SEQ ID NO: 1885230 - RNA, 13 nt, Human
cugccuucucaac

SEQ ID NO: 1885231 - RNA, 21 nt, Human
uuuguauaaaauaauuuuuau

SEQ ID NO: 1885232 - RNA, 19 nt, Human
augaaagcagggacuugaa

SEQ ID NO: 1885233 - RNA, 14 nt, Human
ugcuggagcucugc

SEQ ID NO: 1885234 - RNA, 13 nt, Human
aaaaaugguuuaa

SEQ ID NO: 1885235 - RNA, 17 nt, Human
uucacuguaaaauaaua

SEQ ID NO: 1885236 - RNA, 20 nt, Human
augcaguuguugcccacagc

SEQ ID NO: 1885237 - RNA, 23 nt, Human
aaaauaucacuugucaauaaaau

SEQ ID NO: 1885238 - RNA, 20 nt, Human
uuaacacaugauccugcaau

SEQ ID NO: 1885239 - RNA, 17 nt, Human
ccaaaaaucucaauauu

SEQ ID NO: 1885240 - RNA, 23 nt, Human
uuuauaugcuucuguuuuauaau

SEQ ID NO: 1885241 - RNA, 19 nt, Human
ccccugagcuugcagagau

SEQ ID NO: 1885242 - RNA, 17 nt, Human
acaagaaaugaaagcag

SEQ ID NO: 1885243 - RNA, 23 nt, Human
guaauuccguagguuauuuucag

SEQ ID NO: 1885244 - RNA, 22 nt, Human
ccacagcuguaugauucccagc

SEQ ID NO: 1885245 - RNA, 15 nt, Human
auauuuuuuguuaaa

SEQ ID NO: 1885246 - RNA, 20 nt, Human
uuaaauggucaauuuuguua

SEQ ID NO: 1885247 - RNA, 21 nt, Human
gaaaugaguuuuucuuuucau

SEQ ID NO: 1885248 - RNA, 14 nt, Human
auacaaaaaaaaaa

SEQ ID NO: 1885249 - RNA, 11 nt, Human
ggucacaggaa

SEQ ID NO: 1885250 - RNA, 19 nt, Human
uggcaagcucuaucaccaa

SEQ ID NO: 1885251 - RNA, 16 nt, Human
ugcacaucaaaauaug

SEQ ID NO: 1885252 - RNA, 15 nt, Human
ggcaagcucuaucac

SEQ ID NO: 1885253 - RNA, 13 nt, Human
cacaacacacaga

SEQ ID NO: 1885254 - RNA, 14 nt, Human
cucugccucagaaa

SEQ ID NO: 1885255 - RNA, 12 nt, Human
cuuccucugagc

SEQ ID NO: 1885256 - RNA, 21 nt, Human
aaacgaggauugggaaaaagu

SEQ ID NO: 1885257 - RNA, 20 nt, Human
ccaaauguucaucaaugaau

SEQ ID NO: 1885258 - RNA, 17 nt, Human
ccucuggcuccagcugg

SEQ ID NO: 1885259 - RNA, 17 nt, Human
aaagaaacauuugguaa

SEQ ID NO: 1885260 - RNA, 20 nt, Human
uuaaugccacuaaauugaca

SEQ ID NO: 1885261 - RNA, 16 nt, Human
ccccugcacuccagcc

SEQ ID NO: 1885262 - RNA, 20 nt, Human
acuucuuaggguuaugauua

SEQ ID NO: 1885263 - RNA, 16 nt, Human
acaaggaugaauuaag

SEQ ID NO: 1885264 - RNA, 17 nt, Human
acuugaacccauauuug

SEQ ID NO: 1885265 - RNA, 15 nt, Human
auuuuaaaagaauga

SEQ ID NO: 1885266 - RNA, 12 nt, Human
acagagacagaa

SEQ ID NO: 1885267 - RNA, 17 nt, Human
guugcugggggggauug

SEQ ID NO: 1885268 - RNA, 20 nt, Human
acuuuauuuucuauaauuua

SEQ ID NO: 1885269 - RNA, 19 nt, Human
agugaggagcuuugaaacg

SEQ ID NO: 1885270 - RNA, 14 nt, Human
aauauaaauaaaaa

SEQ ID NO: 1885271 - RNA, 11 nt, Human
uuauauuuauu

SEQ ID NO: 1885272 - RNA, 16 nt, Human
uaucaaaagaaagaaa

SEQ ID NO: 1885273 - RNA, 13 nt, Human
agcucugcccauc

SEQ ID NO: 1885274 - RNA, 12 nt, Human
ggcugaugcagu

SEQ ID NO: 1885275 - RNA, 21 nt, Human
cugauauuggacaguaaaauc

SEQ ID NO: 1885276 - RNA, 16 nt, Human
acuaaacaaagaguga

SEQ ID NO: 1885277 - RNA, 22 nt, Human
uacugagagugaacaaauuuac

SEQ ID NO: 1885278 - RNA, 15 nt, Human
acucaccucccccau

SEQ ID NO: 1885279 - RNA, 21 nt, Human
aaaaaguucugcagauaaaca

SEQ ID NO: 1885280 - RNA, 14 nt, Human
aagcucuaucacca

SEQ ID NO: 1885281 - RNA, 21 nt, Human
cuuguuggacgagaaaacaau

SEQ ID NO: 1885282 - RNA, 17 nt, Human
cccaggcugagccucag

SEQ ID NO: 1885283 - RNA, 19 nt, Human
uggugaacuugguuuuaau

SEQ ID NO: 1885284 - RNA, 16 nt, Human
ugcauagguuuaauaa

SEQ ID NO: 1885285 - RNA, 15 nt, Human
gacaguauggcagcu

SEQ ID NO: 1885286 - RNA, 18 nt, Human
uucugauauuggacagua

SEQ ID NO: 1885287 - RNA, 16 nt, Human
agggaggacgcucucu

SEQ ID NO: 1885288 - RNA, 23 nt, Human
cugaaaucauacuucuuaggguu

SEQ ID NO: 1885289 - RNA, 13 nt, Human
cccuccuuaucaa

SEQ ID NO: 1885290 - RNA, 18 nt, Human
guuaguauuguccagguc

SEQ ID NO: 1885291 - RNA, 21 nt, Human
aaugugacuuaaugccacuaa

SEQ ID NO: 1885292 - RNA, 16 nt, Human
uggcaagcucuaucac

SEQ ID NO: 1885293 - RNA, 21 nt, Human
aaaauuuuuucucuaggaaau

SEQ ID NO: 1885294 - RNA, 21 nt, Human
aaaauaugccccauucaacau

SEQ ID NO: 1885295 - RNA, 18 nt, Human
cagugaaagaaaauaaca

SEQ ID NO: 1885296 - RNA, 18 nt, Human
uuuauggcacuaguauuu

SEQ ID NO: 1885297 - RNA, 16 nt, Human
agaugcuagaacuccc

SEQ ID NO: 1885298 - RNA, 18 nt, Human
uccagcuggccgggagcc

SEQ ID NO: 1885299 - RNA, 15 nt, Human
acuuuauaaaggauu

SEQ ID NO: 1885300 - RNA, 20 nt, Human
acaugagguacugagaguga

SEQ ID NO: 1885301 - RNA, 13 nt, Human
ggaaguagaggag

SEQ ID NO: 1885302 - RNA, 17 nt, Human
cuucacuguaaaauaau

SEQ ID NO: 1885303 - RNA, 14 nt, Human
cacaacacacagau

SEQ ID NO: 1885304 - RNA, 15 nt, Human
uaacaauaaaagaca

SEQ ID NO: 1885305 - RNA, 21 nt, Human
cauuucuugagguaaaagcau

SEQ ID NO: 1885306 - RNA, 23 nt, Human
ucuuagaugcaguucugaagaag

SEQ ID NO: 1885307 - RNA, 18 nt, Human
cuuuucccaacuccagaa

SEQ ID NO: 1885308 - RNA, 21 nt, Human
uaauaggcguaacuaauuuua

SEQ ID NO: 1885309 - RNA, 15 nt, Human
gaaaacaaggaugaa

SEQ ID NO: 1885310 - RNA, 16 nt, Human
uauuuuugugauuuug

SEQ ID NO: 1885311 - RNA, 18 nt, Human
gaaaauaacgauaaaaga

SEQ ID NO: 1885312 - RNA, 17 nt, Human
ucuuauaauuuaaaaua

SEQ ID NO: 1885313 - RNA, 19 nt, Human
ccccuauccuacuuccccu

SEQ ID NO: 1885314 - RNA, 15 nt, Human
gcacagccucuuaga

SEQ ID NO: 1885315 - RNA, 16 nt, Human
uucacauuuaaauaaa

SEQ ID NO: 1885316 - RNA, 13 nt, Human
aguguuugaaagc

SEQ ID NO: 1885317 - RNA, 18 nt, Human
agaagcaacccaaauguu

SEQ ID NO: 1885318 - RNA, 20 nt, Human
uaugaaaaggcuaagcuuca

SEQ ID NO: 1885319 - RNA, 16 nt, Human
cugaucaccugcccug

SEQ ID NO: 1885320 - RNA, 22 nt, Human
aaugggcacaggguuuauguuu

SEQ ID NO: 1885321 - RNA, 21 nt, Human
acaguuaccucugccucagaa

SEQ ID NO: 1885322 - RNA, 14 nt, Human
caugaacuuguaaa

SEQ ID NO: 1885323 - RNA, 19 nt, Human
ugaaauuguauuacaaauc

SEQ ID NO: 1885324 - RNA, 13 nt, Human
aaaauaacgauaa

SEQ ID NO: 1885325 - RNA, 13 nt, Human
uacuuuauuuucu

SEQ ID NO: 1885326 - RNA, 15 nt, Human
ucacaggacagcccu

SEQ ID NO: 1885327 - RNA, 12 nt, Human
acaugagguacu

SEQ ID NO: 1885328 - RNA, 15 nt, Human
aaucucaauauuuca

SEQ ID NO: 1885329 - RNA, 18 nt, Human
aacaaugcuguauuuuaa

SEQ ID NO: 1885330 - RNA, 19 nt, Human
cgcccacuagacccacugg

SEQ ID NO: 1885331 - RNA, 23 nt, Human
aucaccaaggcugauuaaaccaa

SEQ ID NO: 1885332 - RNA, 19 nt, Human
cugccccccagcccuccuu

SEQ ID NO: 1885333 - RNA, 10 nt, Human
accugagccc

SEQ ID NO: 1885334 - RNA, 16 nt, Human
uguucuaagaagugaa

SEQ ID NO: 1885335 - RNA, 23 nt, Human
aaguauccuucagccugaaagag

SEQ ID NO: 1885336 - RNA, 17 nt, Human
gacagucaccucaugga

SEQ ID NO: 1885337 - RNA, 16 nt, Human
ucaaaagaaagaaaau

SEQ ID NO: 1885338 - RNA, 12 nt, Human
uauucacaagac

SEQ ID NO: 1885339 - RNA, 18 nt, Human
uguggucacaggaaguag

SEQ ID NO: 1885340 - RNA, 23 nt, Human
aaauuuacagagacagaaagcag

SEQ ID NO: 1885341 - RNA, 18 nt, Human
uucucuaggaaauauuua

SEQ ID NO: 1885342 - RNA, 17 nt, Human
uggcuaagcaaaaugug

SEQ ID NO: 1885343 - RNA, 20 nt, Human
uaggaauugacccacaagaa

SEQ ID NO: 1885344 - RNA, 17 nt, Human
cugagaugggagaauca

SEQ ID NO: 1885345 - RNA, 14 nt, Human
agguugcagugagc

SEQ ID NO: 1885346 - RNA, 19 nt, Human
uuugccaaguucuccacua

SEQ ID NO: 1885347 - RNA, 18 nt, Human
aaagagugaaggauuuau

SEQ ID NO: 1885348 - RNA, 20 nt, Human
cccugcacuccagccugagc

SEQ ID NO: 1885349 - RNA, 15 nt, Human
acauccuacaagaca

SEQ ID NO: 1885350 - RNA, 18 nt, Human
cacuccagugagacagcu

SEQ ID NO: 1885351 - RNA, 20 nt, Human
ccauuguggucacaggaagu

SEQ ID NO: 1885352 - RNA, 21 nt, Human
gacagugaaagaaaauaacaa

SEQ ID NO: 1885353 - RNA, 21 nt, Human
aguuguugcccacagcuguau

SEQ ID NO: 1885354 - RNA, 23 nt, Human
auucaauaucuuuuuuuuaauaa

SEQ ID NO: 1885355 - RNA, 22 nt, Human
ucaacuccaaacugacucuuaa

SEQ ID NO: 1885356 - RNA, 16 nt, Human
ucagucucccucccuu

SEQ ID NO: 1885357 - RNA, 20 nt, Human
gagccugaucaccugcccug

SEQ ID NO: 1885358 - RNA, 17 nt, Human
guuuaauaauuuuuaau

SEQ ID NO: 1885359 - RNA, 16 nt, Human
auaaugaauacuuuau

SEQ ID NO: 1885360 - RNA, 19 nt, Human
cugcaaagcccagcuugaa

SEQ ID NO: 1885361 - RNA, 16 nt, Human
caugggacagggagga

SEQ ID NO: 1885362 - RNA, 22 nt, Human
ccauuucuugagguaaaagcau

SEQ ID NO: 1885363 - RNA, 19 nt, Human
agagccuuuuuuugaaaaa

SEQ ID NO: 1885364 - RNA, 22 nt, Human
uuuccaagcaaguauuagaaua

SEQ ID NO: 1885365 - RNA, 17 nt, Human
acacuaagagagaauga

SEQ ID NO: 1885366 - RNA, 12 nt, Human
ucugcacacagc

SEQ ID NO: 1885367 - RNA, 16 nt, Human
cugcugagucccaggc

SEQ ID NO: 1885368 - RNA, 18 nt, Human
acugacucuuaagaagac

SEQ ID NO: 1885369 - RNA, 17 nt, Human
ggagcucguggaacagu

SEQ ID NO: 1885370 - RNA, 22 nt, Human
cauuuaaauaaaguguuugaaa

SEQ ID NO: 1885371 - RNA, 14 nt, Human
acuggacucaccuc

SEQ ID NO: 1885372 - RNA, 21 nt, Human
cucagugucaaugcagccccc

SEQ ID NO: 1885373 - RNA, 16 nt, Human
ccuaagugcagccccg

SEQ ID NO: 1885374 - RNA, 15 nt, Human
cugacucuuaagaag

SEQ ID NO: 1885375 - RNA, 22 nt, Human
aaagacagugaaagaaaauaac

SEQ ID NO: 1885376 - RNA, 14 nt, Human
aucaccaaggcuga

SEQ ID NO: 1885377 - RNA, 17 nt, Human
aaagcuccauuuuuagu

SEQ ID NO: 1885378 - RNA, 13 nt, Human
acagcccuucuuu

SEQ ID NO: 1885379 - RNA, 22 nt, Human
ugaauggcuaagcaaaauguga

SEQ ID NO: 1885380 - RNA, 19 nt, Human
auaaaagacagugaaagaa

SEQ ID NO: 1885381 - RNA, 14 nt, Human
aguuuuuuuuuaaa

SEQ ID NO: 1885382 - RNA, 22 nt, Human
uggaaaguuuaugguuguauua

SEQ ID NO: 1885383 - RNA, 21 nt, Human
gaaaaguauguuagugcaaau

SEQ ID NO: 1885384 - RNA, 14 nt, Human
uacuaauuuuaaaa

SEQ ID NO: 1885385 - RNA, 16 nt, Human
caggaaguagaggagg

SEQ ID NO: 1885386 - RNA, 13 nt, Human
guaacuaauuuua

SEQ ID NO: 1885387 - RNA, 23 nt, Human
ggaugaauuaaguuuuuuuuuaa

SEQ ID NO: 1885388 - RNA, 23 nt, Human
uaggauggcuaguaucaaaagaa

SEQ ID NO: 1885389 - RNA, 16 nt, Human
cagggacuugaaccca

SEQ ID NO: 1885390 - RNA, 20 nt, Human
gagccucagucucccucccu

SEQ ID NO: 1885391 - RNA, 16 nt, Human
cucaauaaaguacaag

SEQ ID NO: 1885392 - RNA, 22 nt, Human
aggaugccccgucccccucugg

SEQ ID NO: 1885393 - RNA, 14 nt, Human
ccaaugaaaugagu

SEQ ID NO: 1885394 - RNA, 17 nt, Human
aaucuuauaauuuaaaa

SEQ ID NO: 1885395 - RNA, 15 nt, Human
cucccuuggggccua

SEQ ID NO: 1885396 - RNA, 19 nt, Human
agaaaauaacaauaaaaga

SEQ ID NO: 1885397 - RNA, 15 nt, Human
ucccccaucucuucu

SEQ ID NO: 1885398 - RNA, 23 nt, Human
uuuguauaaaauaauuuuuauau

SEQ ID NO: 1885399 - RNA, 23 nt, Human
gaaaaaguucugcagauaaacag

SEQ ID NO: 1885400 - RNA, 15 nt, Human
ugguuuagaaagcuu

SEQ ID NO: 1885401 - RNA, 17 nt, Human
cuaagcuucacuguaaa

SEQ ID NO: 1885402 - RNA, 17 nt, Human
ucugugagaugcuagaa

SEQ ID NO: 1885403 - RNA, 22 nt, Human
cacuuccaagagccuuuuuuug

SEQ ID NO: 1885404 - RNA, 20 nt, Human
auuuucaguuauuauauuua

SEQ ID NO: 1885405 - RNA, 15 nt, Human
aaauaauuuuuauau

SEQ ID NO: 1885406 - RNA, 14 nt, Human
uucacauuuaaaua

SEQ ID NO: 1885407 - RNA, 15 nt, Human
auuucuaugaaauau

SEQ ID NO: 1885408 - RNA, 16 nt, Human
uggucugugagaugcu

SEQ ID NO: 1885409 - RNA, 12 nt, Human
cacaacacacag

SEQ ID NO: 1885410 - RNA, 20 nt, Human
cacagcacgggggccaagga

SEQ ID NO: 1885411 - RNA, 23 nt, Human
agaguuuagcuggaaaaguaugu

SEQ ID NO: 1885412 - RNA, 21 nt, Human
gucucagugucaaugcagccc

SEQ ID NO: 1885413 - RNA, 15 nt, Human
agccugaaagaggaa

SEQ ID NO: 1885414 - RNA, 19 nt, Human
gaaagaaaauaacaauaaa

SEQ ID NO: 1885415 - RNA, 17 nt, Human
caccucccccaucucuu

SEQ ID NO: 1885416 - RNA, 13 nt, Human
auugauuauaugu

SEQ ID NO: 1885417 - RNA, 16 nt, Human
uauguucuaagaagug

SEQ ID NO: 1885418 - RNA, 17 nt, Human
cugcacuccagccugag

SEQ ID NO: 1885419 - RNA, 17 nt, Human
uguucuaagaagugaaa

SEQ ID NO: 1885420 - RNA, 16 nt, Human
agugaaagaaaauaac

SEQ ID NO: 1885421 - RNA, 18 nt, Human
cagagacagaaagcagaa

SEQ ID NO: 1885422 - RNA, 17 nt, Human
ugcacaucaaaauaugc

SEQ ID NO: 1885423 - RNA, 16 nt, Human
gccuaagugcagcccc

SEQ ID NO: 1885424 - RNA, 18 nt, Human
auggcuugaguuuaaauu

SEQ ID NO: 1885425 - RNA, 23 nt, Human
auguuaaaacugggacaggggag

SEQ ID NO: 1885426 - RNA, 22 nt, Human
aaacauccuacaagacacagug

SEQ ID NO: 1885427 - RNA, 23 nt, Human
cccacuggacucaccucccccau

SEQ ID NO: 1885428 - RNA, 20 nt, Human
gacauuugcucauggaauug

SEQ ID NO: 1885429 - RNA, 21 nt, Human
uguaaaauggugugaccacug

SEQ ID NO: 1885430 - RNA, 18 nt, Human
ccaagccuggcaagggaa

SEQ ID NO: 1885431 - RNA, 14 nt, Human
agaaaugaaagcag

SEQ ID NO: 1885432 - RNA, 14 nt, Human
uggacucaccuccc

SEQ ID NO: 1885433 - RNA, 20 nt, Human
uaugcuucuguuuuauaauu

SEQ ID NO: 1885434 - RNA, 15 nt, Human
ccagcacagccucuu

SEQ ID NO: 1885435 - RNA, 14 nt, Human
uaaauaguuuauga

SEQ ID NO: 1885436 - RNA, 18 nt, Human
uaaguuuuuuuuuaaaaa

SEQ ID NO: 1885437 - RNA, 12 nt, Human
gcugaugcaguu

SEQ ID NO: 1885438 - RNA, 16 nt, Human
aacuugguuuuaauua

SEQ ID NO: 1885439 - RNA, 19 nt, Human
uguuggacgagaaaacaau

SEQ ID NO: 1885440 - RNA, 16 nt, Human
cauagaaguaaaaaca

SEQ ID NO: 1885441 - RNA, 12 nt, Human
cuccauuuuuag

SEQ ID NO: 1885442 - RNA, 23 nt, Human
ggucuaucuuugagcgcccacua

SEQ ID NO: 1885443 - RNA, 14 nt, Human
ggcaauagucaaau

SEQ ID NO: 1885444 - RNA, 12 nt, Human
ucccccucuggc

SEQ ID NO: 1885445 - RNA, 13 nt, Human
uuggacgagaaaa

SEQ ID NO: 1885446 - RNA, 20 nt, Human
ugagagacacacugaagaag

SEQ ID NO: 1885447 - RNA, 11 nt, Human
auaauuuaaau

SEQ ID NO: 1885448 - RNA, 18 nt, Human
caaggcugauuaaaccaa

SEQ ID NO: 1885449 - RNA, 14 nt, Human
uauuugaaauauug

SEQ ID NO: 1885450 - RNA, 15 nt, Human
gccccauucaacauc

SEQ ID NO: 1885451 - RNA, 13 nt, Human
cugcacuccagcc

SEQ ID NO: 1885452 - RNA, 21 nt, Human
auucauagcagcuuauucaca

SEQ ID NO: 1885453 - RNA, 20 nt, Human
ccagugagacagcucugcau

SEQ ID NO: 1885454 - RNA, 13 nt, Human
cuucucaacucca

SEQ ID NO: 1885455 - RNA, 17 nt, Human
aaauguucaucaaugaa

SEQ ID NO: 1885456 - RNA, 23 nt, Human
ugaaaugaguuuuucuuuucauu

SEQ ID NO: 1885457 - RNA, 13 nt, Human
aaaugaaagcagg

SEQ ID NO: 1885458 - RNA, 17 nt, Human
ugaaauaagccagacau

SEQ ID NO: 1885459 - RNA, 23 nt, Human
ggaacaguuaccucugccucaga

SEQ ID NO: 1885460 - RNA, 22 nt, Human
auaacaaugcuguauuuuaaaa

SEQ ID NO: 1885461 - RNA, 16 nt, Human
cuagaacucccuuuca

SEQ ID NO: 1885462 - RNA, 22 nt, Human
auuuucuucucacauuuauauu

SEQ ID NO: 1885463 - RNA, 12 nt, Human
uuaauaaaccau

SEQ ID NO: 1885464 - RNA, 17 nt, Human
gccuaagugcagccccg

SEQ ID NO: 1885465 - RNA, 19 nt, Human
guaguccuguaauggaagc

SEQ ID NO: 1885466 - RNA, 22 nt, Human
gaauuucuucaacucccugccc

SEQ ID NO: 1885467 - RNA, 14 nt, Human
gcugauuaaaccaa

SEQ ID NO: 1885468 - RNA, 15 nt, Human
aagccuccuuuuaaa

SEQ ID NO: 1885469 - RNA, 13 nt, Human
auaaauaaaaaua

SEQ ID NO: 1885470 - RNA, 17 nt, Human
guuuaauucugaaagca

SEQ ID NO: 1885471 - RNA, 16 nt, Human
caaaaggauaaugaau

SEQ ID NO: 1885472 - RNA, 15 nt, Human
uacaaaugcauuucu

SEQ ID NO: 1885473 - RNA, 11 nt, Human
cuguuuuauaa

SEQ ID NO: 1885474 - RNA, 19 nt, Human
agcagcuuauucacaagac

SEQ ID NO: 1885475 - RNA, 14 nt, Human
aaagaggaaugaag

SEQ ID NO: 1885476 - RNA, 22 nt, Human
uguugcccacagcuguaugauu

SEQ ID NO: 1885477 - RNA, 19 nt, Human
cucaccucccccaucucuu

SEQ ID NO: 1885478 - RNA, 20 nt, Human
cagcuggccgggagccugau

SEQ ID NO: 1885479 - RNA, 12 nt, Human
gucccaggcuga

SEQ ID NO: 1885480 - RNA, 21 nt, Human
auaguuguaccgcaaugugac

SEQ ID NO: 1885481 - RNA, 19 nt, Human
uuuccugaaaacccuugcc

SEQ ID NO: 1885482 - RNA, 17 nt, Human
auaauuuaaauauaugc

SEQ ID NO: 1885483 - RNA, 19 nt, Human
agcuacuaauuuuaaaaug

SEQ ID NO: 1885484 - RNA, 22 nt, Human
gugccucaccccuugccauaau

SEQ ID NO: 1885485 - RNA, 19 nt, Human
acuaucucauuuccaagca

SEQ ID NO: 1885486 - RNA, 16 nt, Human
aaaauaacaauaaaag

SEQ ID NO: 1885487 - RNA, 16 nt, Human
ccugagcuugcagaga

SEQ ID NO: 1885488 - RNA, 14 nt, Human
uuauuauauuuaca

SEQ ID NO: 1885489 - RNA, 19 nt, Human
ucaccaaggcugauuaaac

SEQ ID NO: 1885490 - RNA, 15 nt, Human
caaauccaaugaaau

SEQ ID NO: 1885491 - RNA, 13 nt, Human
aauuuuuauauuu

SEQ ID NO: 1885492 - RNA, 21 nt, Human
cucaaaacuucagacauagaa

SEQ ID NO: 1885493 - RNA, 19 nt, Human
gccugaucaccugcccugc

SEQ ID NO: 1885494 - RNA, 17 nt, Human
ucucuggccuucggccu

SEQ ID NO: 1885495 - RNA, 13 nt, Human
auaacuggaaacu

SEQ ID NO: 1885496 - RNA, 13 nt, Human
gguccacaacaca

SEQ ID NO: 1885497 - RNA, 21 nt, Human
auggcagcuuuccucaaaacu

SEQ ID NO: 1885498 - RNA, 22 nt, Human
ugucucuacuaaaaauacaaaa

SEQ ID NO: 1885499 - RNA, 15 nt, Human
ccacaggaaccacaa

SEQ ID NO: 1885500 - RNA, 16 nt, Human
ccuaugcagaggucca

SEQ ID NO: 1885501 - RNA, 16 nt, Human
aauuuuuaauuauaug

SEQ ID NO: 1885502 - RNA, 20 nt, Human
caggcugagccucagucucc

SEQ ID NO: 1885503 - RNA, 16 nt, Human
auuuuuagugaaauau

SEQ ID NO: 1885504 - RNA, 23 nt, Human
ggucucagugucaaugcagcccc

SEQ ID NO: 1885505 - RNA, 23 nt, Human
uaacgauaaaagacagugaaaga

SEQ ID NO: 1885506 - RNA, 18 nt, Human
aucuuauaauuuaaaaua

SEQ ID NO: 1885507 - RNA, 19 nt, Human
cuuccuaauuccacagcug

SEQ ID NO: 1885508 - RNA, 16 nt, Human
agguacuucaaauccu

SEQ ID NO: 1885509 - RNA, 19 nt, Human
cucuguucugcacacagca

SEQ ID NO: 1885510 - RNA, 12 nt, Human
gacgagaaaaca

SEQ ID NO: 1885511 - RNA, 14 nt, Human
aaucucaauauuuc

SEQ ID NO: 1885512 - RNA, 13 nt, Human
uaagugcagcccc

SEQ ID NO: 1885513 - RNA, 20 nt, Human
aggcugagaugggagaauca

SEQ ID NO: 1885514 - RNA, 19 nt, Human
guuauuauauuuacaaaug

SEQ ID NO: 1885515 - RNA, 19 nt, Human
ugaacaaauuuacagagac

SEQ ID NO: 1885516 - RNA, 15 nt, Human
ucuuauaauuuaaaa

SEQ ID NO: 1885517 - RNA, 18 nt, Human
gagucccaggcugagccu

SEQ ID NO: 1885518 - RNA, 15 nt, Human
uuaauucugaaagca

SEQ ID NO: 1885519 - RNA, 13 nt, Human
uuauguuuaauuc

SEQ ID NO: 1885520 - RNA, 17 nt, Human
uaaaagacaaggaaaaa

SEQ ID NO: 1885521 - RNA, 13 nt, Human
uuuagugaaauau

SEQ ID NO: 1885522 - RNA, 20 nt, Human
uuuaaauaaaguguuugaaa

SEQ ID NO: 1885523 - RNA, 16 nt, Human
gacauuugcucaugga

SEQ ID NO: 1885524 - RNA, 20 nt, Human
aauucuugccaaauauaaau

SEQ ID NO: 1885525 - RNA, 19 nt, Human
gcacuaguauuucuaugaa

SEQ ID NO: 1885526 - RNA, 19 nt, Human
ucaauucuugccaaauaua

SEQ ID NO: 1885527 - RNA, 19 nt, Human
auuuacagagacagaaagc

SEQ ID NO: 1885528 - RNA, 16 nt, Human
ccacuuauaggaauug

SEQ ID NO: 1885529 - RNA, 18 nt, Human
auaaaguguuugaaagcu

SEQ ID NO: 1885530 - RNA, 15 nt, Human
agaaaacaauaacga

SEQ ID NO: 1885531 - RNA, 19 nt, Human
augaauuacauuuguauaa

SEQ ID NO: 1885532 - RNA, 18 nt, Human
uuuguuaaaugauuucau

SEQ ID NO: 1885533 - RNA, 16 nt, Human
ugaaguacucauacau

SEQ ID NO: 1885534 - RNA, 12 nt, Human
cucccugccccc

SEQ ID NO: 1885535 - RNA, 19 nt, Human
augcagagguccacaacac

SEQ ID NO: 1885536 - RNA, 21 nt, Human
cacuugaacccgggaggcaga

SEQ ID NO: 1885537 - RNA, 22 nt, Human
aacucccugccccccagcccuc

SEQ ID NO: 1885538 - RNA, 14 nt, Human
uccagauccuggaa

SEQ ID NO: 1885539 - RNA, 21 nt, Human
uuauguuuaauucugaaagca

SEQ ID NO: 1885540 - RNA, 21 nt, Human
caagacccaaaaggcagaagc

SEQ ID NO: 1885541 - RNA, 19 nt, Human
uauuuuaauaauguuucaa

SEQ ID NO: 1885542 - RNA, 17 nt, Human
cugagcgacagugagac

SEQ ID NO: 1885543 - RNA, 21 nt, Human
aaagaaaauaacgauaaaaga

SEQ ID NO: 1885544 - RNA, 19 nt, Human
augaguaacugauuuguaa

SEQ ID NO: 1885545 - RNA, 21 nt, Human
aaaagguauuuuaaucaccaa

SEQ ID NO: 1885546 - RNA, 14 nt, Human
auuguccaggucua

SEQ ID NO: 1885547 - RNA, 20 nt, Human
uggaauaauccuaaacauau

SEQ ID NO: 1885548 - RNA, 19 nt, Human
cccugcaaagcccagcuug

SEQ ID NO: 1885549 - RNA, 19 nt, Human
acucugucucaguccauga

SEQ ID NO: 1885550 - RNA, 18 nt, Human
gacauuugcucauggaau

SEQ ID NO: 1885551 - RNA, 17 nt, Human
uaauuuuuauauuugaa

SEQ ID NO: 1885552 - RNA, 13 nt, Human
cacaacuauauug

SEQ ID NO: 1885553 - RNA, 12 nt, Human
acacugaagaag

SEQ ID NO: 1885554 - RNA, 20 nt, Human
cacuguggguagacacacau

SEQ ID NO: 1885555 - RNA, 14 nt, Human
ggccuucggccucc

SEQ ID NO: 1885556 - RNA, 14 nt, Human
uauaauuuaaaaua

SEQ ID NO: 1885557 - RNA, 14 nt, Human
auuauuuuuuaaaa

SEQ ID NO: 1885558 - RNA, 15 nt, Human
auaucaauuuaaaaa

SEQ ID NO: 1885559 - RNA, 18 nt, Human
uaaaagacaaggaaaaaa

SEQ ID NO: 1885560 - RNA, 17 nt, Human
gcaagcucuaucaccaa

SEQ ID NO: 1885561 - RNA, 16 nt, Human
aaugaaagcagggacu

SEQ ID NO: 1885562 - RNA, 19 nt, Human
cccauggcacucuauguuc

SEQ ID NO: 1885563 - RNA, 12 nt, Human
aguguuugaaag

SEQ ID NO: 1885564 - RNA, 14 nt, Human
acgagaaaacaaua

SEQ ID NO: 1885565 - RNA, 15 nt, Human
uauuuauuuuaauaa

SEQ ID NO: 1885566 - RNA, 16 nt, Human
gucuaucuuugagcgc

SEQ ID NO: 1885567 - RNA, 23 nt, Human
cuuaagaagacugcauuauauuu

SEQ ID NO: 1885568 - RNA, 12 nt, Human
agacagugaaag

SEQ ID NO: 1885569 - RNA, 21 nt, Human
auaugcucuaaacauguuuau

SEQ ID NO: 1885570 - RNA, 19 nt, Human
auccuacaagacacaguga

SEQ ID NO: 1885571 - RNA, 14 nt, Human
cacaagaaaugaaa

SEQ ID NO: 1885572 - RNA, 19 nt, Human
aaugaauggcuaagcaaaa

SEQ ID NO: 1885573 - RNA, 15 nt, Human
ugggacagggaggac

SEQ ID NO: 1885574 - RNA, 14 nt, Human
guaacugauuugua

SEQ ID NO: 1885575 - RNA, 21 nt, Human
uauuauuuuauagcuacuaau

SEQ ID NO: 1885576 - RNA, 19 nt, Human
uggaaauguuuacagaucc

SEQ ID NO: 1885577 - RNA, 14 nt, Human
ucccuugaugaaga

SEQ ID NO: 1885578 - RNA, 22 nt, Human
cuuguaaaggaauuuaaaaauc

SEQ ID NO: 1885579 - RNA, 16 nt, Human
uacaaaugggaaacaa

SEQ ID NO: 1885580 - RNA, 20 nt, Human
uaacaagccuccuuuuaaag

SEQ ID NO: 1885581 - RNA, 14 nt, Human
cugaggcuccacuu

SEQ ID NO: 1885582 - RNA, 22 nt, Human
ugauaguuguaccgcaauguga

SEQ ID NO: 1885583 - RNA, 22 nt, Human
agaagcaccaaucaugaauuag

SEQ ID NO: 1885584 - RNA, 18 nt, Human
uguacuuuauuuucuaua

SEQ ID NO: 1885585 - RNA, 19 nt, Human
caacucccugccccccagc

SEQ ID NO: 1885586 - RNA, 22 nt, Human
gcagagagguagggauggggcu

SEQ ID NO: 1885587 - RNA, 18 nt, Human
aaaagacaaggaaaaaau

SEQ ID NO: 1885588 - RNA, 19 nt, Human
gucaaucagccuaguugau

SEQ ID NO: 1885589 - RNA, 20 nt, Human
acuccagugagacagcucug

SEQ ID NO: 1885590 - RNA, 17 nt, Human
uacaaaugcauuucuaa

SEQ ID NO: 1885591 - RNA, 14 nt, Human
ccacuggacucacc

SEQ ID NO: 1885592 - RNA, 16 nt, Human
uucaguuauuauauuu

SEQ ID NO: 1885593 - RNA, 17 nt, Human
caagacccaaaaggcag

SEQ ID NO: 1885594 - RNA, 21 nt, Human
cagagguccacaacacacaga

SEQ ID NO: 1885595 - RNA, 21 nt, Human
ugcccauccugccccugagcc

SEQ ID NO: 1885596 - RNA, 17 nt, Human
agugagacagcucugca

SEQ ID NO: 1885597 - RNA, 20 nt, Human
aguuuuuuuuuaaaaaagaa

SEQ ID NO: 1885598 - RNA, 18 nt, Human
ccucuggcuccagcuggc

SEQ ID NO: 1885599 - RNA, 16 nt, Human
ccugagcgacagugag

SEQ ID NO: 1885600 - RNA, 16 nt, Human
aggguguguaaguaga

SEQ ID NO: 1885601 - RNA, 13 nt, Human
ccccagcccuccu

SEQ ID NO: 1885602 - RNA, 20 nt, Human
gcuugcagagaugaggccgc

SEQ ID NO: 1885603 - RNA, 14 nt, Human
aauggcuaagcaaa

SEQ ID NO: 1885604 - RNA, 20 nt, Human
ggccuaugcagagguccaca

SEQ ID NO: 1885605 - RNA, 20 nt, Human
ccugccuaagugcagccccg

SEQ ID NO: 1885606 - RNA, 21 nt, Human
caacacacagauuugagcuca

SEQ ID NO: 1885607 - RNA, 21 nt, Human
cuccagcuggccgggagccug

SEQ ID NO: 1885608 - RNA, 14 nt, Human
cuccagugagacag

SEQ ID NO: 1885609 - RNA, 21 nt, Human
uuuauauaagcuuguauuccu

SEQ ID NO: 1885610 - RNA, 14 nt, Human
ugagcucagcccug

SEQ ID NO: 1885611 - RNA, 16 nt, Human
caugguuuagaaagcu

SEQ ID NO: 1885612 - RNA, 12 nt, Human
cagaacagugau

SEQ ID NO: 1885613 - RNA, 15 nt, Human
augauaacuggaaac

SEQ ID NO: 1885614 - RNA, 18 nt, Human
gaauaauccuaaacauau

SEQ ID NO: 1885615 - RNA, 12 nt, Human
aaaauaacaaua

SEQ ID NO: 1885616 - RNA, 14 nt, Human
uauaaauaaaaaua

SEQ ID NO: 1885617 - RNA, 21 nt, Human
gaaagcagggacuugaaccca

SEQ ID NO: 1885618 - RNA, 22 nt, Human
gaggggagcaugggaagugacg

SEQ ID NO: 1885619 - RNA, 11 nt, Human
aauuuaaauau

SEQ ID NO: 1885620 - RNA, 20 nt, Human
accuacacgagauacagaau

SEQ ID NO: 1885621 - RNA, 23 nt, Human
uacaaaugggaaacaaaaggaua

SEQ ID NO: 1885622 - RNA, 16 nt, Human
ugaaauuguauuacaa

SEQ ID NO: 1885623 - RNA, 22 nt, Human
agcuuguauuccuuuuucucuc

SEQ ID NO: 1885624 - RNA, 18 nt, Human
aaauaacgauaaaagaca

SEQ ID NO: 1885625 - RNA, 18 nt, Human
acaaauccaaugaaauga

SEQ ID NO: 1885626 - RNA, 12 nt, Human
agaaaacaauaa

SEQ ID NO: 1885627 - RNA, 14 nt, Human
uucuggaauaaucc

SEQ ID NO: 1885628 - RNA, 20 nt, Human
aacaaugcuguauuuuaaaa

SEQ ID NO: 1885629 - RNA, 23 nt, Human
gaaaacaauaacgauaaaagaca

SEQ ID NO: 1885630 - RNA, 22 nt, Human
caauaaaagacaaggaaaaaau

SEQ ID NO: 1885631 - RNA, 15 nt, Human
ucaaaggacaccauu

SEQ ID NO: 1885632 - RNA, 19 nt, Human
gagguacugagagugaaca

SEQ ID NO: 1885633 - RNA, 13 nt, Human
ucuauaauuuaaa

SEQ ID NO: 1885634 - RNA, 18 nt, Human
ugaacuugguuuuaauua

SEQ ID NO: 1885635 - RNA, 14 nt, Human
ugacacuuaaaaau

SEQ ID NO: 1885636 - RNA, 18 nt, Human
aggaaaaaauaacaauga

SEQ ID NO: 1885637 - RNA, 22 nt, Human
gaugcaguucugaagaagaugg

SEQ ID NO: 1885638 - RNA, 15 nt, Human
ucuaugaaauauuau

SEQ ID NO: 1885639 - RNA, 16 nt, Human
aauugacccacaagaa

SEQ ID NO: 1885640 - RNA, 14 nt, Human
gaaugauuaugaau

SEQ ID NO: 1885641 - RNA, 23 nt, Human
cucagucucccucccuuggggcc

SEQ ID NO: 1885642 - RNA, 13 nt, Human
acaagagcuuaac

SEQ ID NO: 1885643 - RNA, 20 nt, Human
uauuuauuacuguaagaaaa

SEQ ID NO: 1885644 - RNA, 14 nt, Human
aaauauaaauaaaa

SEQ ID NO: 1885645 - RNA, 14 nt, Human
auaaauaaaaauaa

SEQ ID NO: 1885646 - RNA, 15 nt, Human
aaacauaugaauuau

SEQ ID NO: 1885647 - RNA, 19 nt, Human
aauauuauguuaaaacugg

SEQ ID NO: 1885648 - RNA, 19 nt, Human
cagauccccaagccuggca

SEQ ID NO: 1885649 - RNA, 19 nt, Human
uccagaaagugacaagcuc

SEQ ID NO: 1885650 - RNA, 13 nt, Human
aagaaaauaacga

SEQ ID NO: 1885651 - RNA, 20 nt, Human
auauuuuauaucaauuuaaa

SEQ ID NO: 1885652 - RNA, 19 nt, Human
cuuggggccuaugcagagg

SEQ ID NO: 1885653 - RNA, 21 nt, Human
cacaugaacuuguaaaggaau

SEQ ID NO: 1885654 - RNA, 15 nt, Human
cuaucuuugagcgcc

SEQ ID NO: 1885655 - RNA, 20 nt, Human
cacuagacccacuggacuca

SEQ ID NO: 1885656 - RNA, 15 nt, Human
ggccuccauccugag

SEQ ID NO: 1885657 - RNA, 21 nt, Human
ccaaauauaaauaaaaauaau

SEQ ID NO: 1885658 - RNA, 12 nt, Human
cagugaaagaaa

SEQ ID NO: 1885659 - RNA, 21 nt, Human
aauuuuuauauuugaaauauu

SEQ ID NO: 1885660 - RNA, 12 nt, Human
uaagaagacugc

SEQ ID NO: 1885661 - RNA, 15 nt, Human
cuaagcaaaauguga

SEQ ID NO: 1885662 - RNA, 23 nt, Human
augucaauucuugccaaauauaa

SEQ ID NO: 1885663 - RNA, 15 nt, Human
cucccugccccccag

SEQ ID NO: 1885664 - RNA, 17 nt, Human
caagccuccuuuuaaag

SEQ ID NO: 1885665 - RNA, 19 nt, Human
cuuccagauccuggaaauc

SEQ ID NO: 1885666 - RNA, 19 nt, Human
gcacacagcacgggggcca

SEQ ID NO: 1885667 - RNA, 15 nt, Human
accucccccaucucu

SEQ ID NO: 1885668 - RNA, 15 nt, Human
gcccacuagacccac

SEQ ID NO: 1885669 - RNA, 23 nt, Human
uggaaauguuuacagauccccaa

SEQ ID NO: 1885670 - RNA, 19 nt, Human
aaagacagugaaagaaaau

SEQ ID NO: 1885671 - RNA, 17 nt, Human
cguaaucguguccccua

SEQ ID NO: 1885672 - RNA, 19 nt, Human
uaucacuugucaauaaaau

SEQ ID NO: 1885673 - RNA, 16 nt, Human
acaaauccaaugaaau

SEQ ID NO: 1885674 - RNA, 16 nt, Human
gccucagucucccucc

SEQ ID NO: 1885675 - RNA, 23 nt, Human
gccccugcacuccagccugagcg

SEQ ID NO: 1885676 - RNA, 14 nt, Human
cuacaagacacagu

SEQ ID NO: 1885677 - RNA, 18 nt, Human
ugcauagguuuaauaauu

SEQ ID NO: 1885678 - RNA, 16 nt, Human
ggaugccccguccccc

SEQ ID NO: 1885679 - RNA, 16 nt, Human
acuaguuucccuugca

SEQ ID NO: 1885680 - RNA, 20 nt, Human
uacaucccuuaccugggaaa

SEQ ID NO: 1885681 - RNA, 18 nt, Human
auuuaggccaugggacag

SEQ ID NO: 1885682 - RNA, 15 nt, Human
auuauuuuuuaaaaa

SEQ ID NO: 1885683 - RNA, 16 nt, Human
uuaaauuguaauaggc

SEQ ID NO: 1885684 - RNA, 14 nt, Human
agucugacuguuuc

SEQ ID NO: 1885685 - RNA, 22 nt, Human
uuuuauagcuacuaauuuuaaa

SEQ ID NO: 1885686 - RNA, 16 nt, Human
aaaagcaucacaugaa

SEQ ID NO: 1885687 - RNA, 22 nt, Human
uuugaugcuacaggauuugaaa

SEQ ID NO: 1885688 - RNA, 12 nt, Human
cagauuuuccug

SEQ ID NO: 1885689 - RNA, 15 nt, Human
aaaaaagaaacauuu

SEQ ID NO: 1885690 - RNA, 17 nt, Human
augcagagguccacaac

SEQ ID NO: 1885691 - RNA, 23 nt, Human
caccucauggaauuggagcucgu

SEQ ID NO: 1885692 - RNA, 22 nt, Human
uucaauaucuuuuuuuuaauaa

SEQ ID NO: 1885693 - RNA, 16 nt, Human
auccuugaagauuuac

SEQ ID NO: 1885694 - RNA, 14 nt, Human
gagagugaacaaau

SEQ ID NO: 1885695 - RNA, 18 nt, Human
ucuucuggguuccuuccu

SEQ ID NO: 1885696 - RNA, 16 nt, Human
uaaauaaaaauaaucc

SEQ ID NO: 1885697 - RNA, 12 nt, Human
cuaagaagugaa

SEQ ID NO: 1885698 - RNA, 15 nt, Human
caggaaguagaggag

SEQ ID NO: 1885699 - RNA, 23 nt, Human
gauagauaggucagugcaaauac

SEQ ID NO: 1885700 - RNA, 19 nt, Human
auagugaggagcuuugaaa

SEQ ID NO: 1885701 - RNA, 14 nt, Human
aaaagaaagaaaau

SEQ ID NO: 1885702 - RNA, 18 nt, Human
aaaucuuauaauuuaaaa

SEQ ID NO: 1885703 - RNA, 15 nt, Human
cagccagcacagccu

SEQ ID NO: 1885704 - RNA, 22 nt, Human
uuuaauaauguuucaaacauau

SEQ ID NO: 1885705 - RNA, 20 nt, Human
gggaggcagagguugcagug

SEQ ID NO: 1885706 - RNA, 20 nt, Human
aauaauuuuuauauuugaaa

SEQ ID NO: 1885707 - RNA, 13 nt, Human
acuguaaaauaau

SEQ ID NO: 1885708 - RNA, 14 nt, Human
cuaaacauaugaau

SEQ ID NO: 1885709 - RNA, 19 nt, Human
uccccuauccuacuucccc

SEQ ID NO: 1885710 - RNA, 14 nt, Human
aauauuauuuuaua

SEQ ID NO: 1885711 - RNA, 19 nt, Human
cucauggaauuggagcucg

SEQ ID NO: 1885712 - RNA, 17 nt, Human
aauaugcucuaaacaug

SEQ ID NO: 1885713 - RNA, 24 nt, Human
uaauuuaaaauaugcucuaaacau

SEQ ID NO: 1885714 - RNA, 19 nt, Human
ucagugucaaugcagcccc

SEQ ID NO: 1885715 - RNA, 13 nt, Human
ccucuggcuccag

SEQ ID NO: 1885716 - RNA, 17 nt, Human
gacaaggaaaaaauaac

SEQ ID NO: 1885717 - RNA, 18 nt, Human
ccacuuggucugugagau

SEQ ID NO: 1885718 - RNA, 19 nt, Human
ccccugcaaagcccagcuu

SEQ ID NO: 1885719 - RNA, 16 nt, Human
gccaugugcuaguaau

SEQ ID NO: 1885720 - RNA, 22 nt, Human
ccgggaggcagagguugcagug

SEQ ID NO: 1885721 - RNA, 21 nt, Human
gaaaacaauaacgauaaaaga

SEQ ID NO: 1885722 - RNA, 14 nt, Human
ccugccccccagcc

SEQ ID NO: 1885723 - RNA, 19 nt, Human
agaguuuagcuggaaaagu

SEQ ID NO: 1885724 - RNA, 22 nt, Human
agcacagccucuuagaugcagu

SEQ ID NO: 1885725 - RNA, 17 nt, Human
ugaucaccugcccugcu

SEQ ID NO: 1885726 - RNA, 18 nt, Human
guuucaaacauauauaac

SEQ ID NO: 1885727 - RNA, 16 nt, Human
cuggccuucggccucc

SEQ ID NO: 1885728 - RNA, 24 nt, Human
cauucuggaauaauccuaaacaua

SEQ ID NO: 1885729 - RNA, 19 nt, Human
agauuugagcucagcccug

SEQ ID NO: 1885730 - RNA, 21 nt, Human
ccucccuuggggccuaugcag

SEQ ID NO: 1885731 - RNA, 14 nt, Human
agcaaguauuagaa

SEQ ID NO: 1885732 - RNA, 19 nt, Human
guuguauuauuuuuuaaaa

SEQ ID NO: 1885733 - RNA, 14 nt, Human
uugggaaaaaguaa

SEQ ID NO: 1885734 - RNA, 11 nt, Human
ucaccugcccu

SEQ ID NO: 1885735 - RNA, 20 nt, Human
auuacauuuguauaaaauaa

SEQ ID NO: 1885736 - RNA, 22 nt, Human
auauaugcuaagucuuauauau

SEQ ID NO: 1885737 - RNA, 20 nt, Human
gaccauacuaauuauacccc

SEQ ID NO: 1885738 - RNA, 23 nt, Human
ccccucuggcuccagcuggccgg

SEQ ID NO: 1885739 - RNA, 15 nt, Human
aagugaaaaucuaca

SEQ ID NO: 1885740 - RNA, 15 nt, Human
ugcuguauuuuaaaa

SEQ ID NO: 1885741 - RNA, 22 nt, Human
cuaagcuucacuguaaaauaau

SEQ ID NO: 1885742 - RNA, 19 nt, Human
acuucagcgguuuauauaa

SEQ ID NO: 1885743 - RNA, 12 nt, Human
aauaauuuuuaa

SEQ ID NO: 1885744 - RNA, 23 nt, Human
caacggggugaaacccugucucu

SEQ ID NO: 1885745 - RNA, 16 nt, Human
auuugaugcuacagga

SEQ ID NO: 1885746 - RNA, 13 nt, Human
ccacaacacacag

SEQ ID NO: 1885747 - RNA, 13 nt, Human
cacuguaaaauaa

SEQ ID NO: 1885748 - RNA, 13 nt, Human
ccagcccuccuua

SEQ ID NO: 1885749 - RNA, 20 nt, Human
acuagaguuuagcuggaaaa

SEQ ID NO: 1885750 - RNA, 19 nt, Human
agaaaauaacgauaaaaga

SEQ ID NO: 1885751 - RNA, 16 nt, Human
aaauauuuauuuuaau

SEQ ID NO: 1885752 - RNA, 18 nt, Human
uaaugaauacuuuauaaa

SEQ ID NO: 1885753 - RNA, 20 nt, Human
acaagacacagugaccauac

SEQ ID NO: 1885754 - RNA, 18 nt, Human
uaagcuucacuguaaaau

SEQ ID NO: 1885755 - RNA, 17 nt, Human
aggcuagaaccaccugc

SEQ ID NO: 1885756 - RNA, 14 nt, Human
cuaagcauuccaac

SEQ ID NO: 1885757 - RNA, 22 nt, Human
cccccugcaaagcccagcuuga

SEQ ID NO: 1885758 - RNA, 22 nt, Human
ccucccuuggggccuaugcaga

SEQ ID NO: 1885759 - RNA, 11 nt, Human
ucaccuccccc

SEQ ID NO: 1885760 - RNA, 15 nt, Human
ccacaagaaaugaaa

SEQ ID NO: 1885761 - RNA, 14 nt, Human
guaacuaauuuuaa

SEQ ID NO: 1885762 - RNA, 15 nt, Human
aaagaaagaaaauca

SEQ ID NO: 1885763 - RNA, 16 nt, Human
aaauaguuuaugauuc

SEQ ID NO: 1885764 - RNA, 19 nt, Human
aaauaugccccauucaaca

SEQ ID NO: 1885765 - RNA, 23 nt, Human
aaagcccagcuugaaaccuucac

SEQ ID NO: 1885766 - RNA, 17 nt, Human
uccugccccugagccca

SEQ ID NO: 1885767 - RNA, 18 nt, Human
ucuucaacucccugcccc

SEQ ID NO: 1885768 - RNA, 21 nt, Human
aaaugucuugcuugauuguau

SEQ ID NO: 1885769 - RNA, 12 nt, Human
acucccugcccc

SEQ ID NO: 1885770 - RNA, 22 nt, Human
augguuguauuauuuuuuaaaa

SEQ ID NO: 1885771 - RNA, 21 nt, Human
gcugagucccaggcugagccu

SEQ ID NO: 1885772 - RNA, 12 nt, Human
gaagaccucauu

SEQ ID NO: 1885773 - RNA, 21 nt, Human
auuuuuucucuaggaaauauu

SEQ ID NO: 1885774 - RNA, 16 nt, Human
cagucucccucccuug

SEQ ID NO: 1885775 - RNA, 17 nt, Human
gaagcaccaaucaugaa

SEQ ID NO: 1885776 - RNA, 23 nt, Human
auauaacaaugcuguauuuuaaa

SEQ ID NO: 1885777 - RNA, 21 nt, Human
ucauucacucaacaaacauaa

SEQ ID NO: 1885778 - RNA, 14 nt, Human
uaacuaauuuuaac

SEQ ID NO: 1885779 - RNA, 16 nt, Human
augaauacuuuauaaa

SEQ ID NO: 1885780 - RNA, 23 nt, Human
caauaacgauaaaagacagugaa

SEQ ID NO: 1885781 - RNA, 15 nt, Human
gacagggaggacgcu

SEQ ID NO: 1885782 - RNA, 19 nt, Human
cuagaguuuagcuggaaaa

SEQ ID NO: 1885783 - RNA, 12 nt, Human
cauagaaguaaa

SEQ ID NO: 1885784 - RNA, 21 nt, Human
cuauguucuaagaagugaaaa

SEQ ID NO: 1885785 - RNA, 17 nt, Human
auguuuacagaucccca

SEQ ID NO: 1885786 - RNA, 21 nt, Human
auguuuaauucugaaagcaac

SEQ ID NO: 1885787 - RNA, 23 nt, Human
uccagguagaggguguguaagua

SEQ ID NO: 1885788 - RNA, 23 nt, Human
agcaugucgucaaagcugaaaug

SEQ ID NO: 1885789 - RNA, 15 nt, Human
uuuaugguuguauua

SEQ ID NO: 1885790 - RNA, 10 nt, Human
auguuuucag

SEQ ID NO: 1885791 - RNA, 21 nt, Human
caauuuuguuauguauauuuu

SEQ ID NO: 1885792 - RNA, 16 nt, Human
aaaauccauacauuug

SEQ ID NO: 1885793 - RNA, 15 nt, Human
cccccagcccuccuu

SEQ ID NO: 1885794 - RNA, 20 nt, Human
caagccuccuuuuaaaguaa

SEQ ID NO: 1885795 - RNA, 12 nt, Human
uauuauuuuuua

SEQ ID NO: 1885796 - RNA, 14 nt, Human
uaaaggaauuuaaa

SEQ ID NO: 1885797 - RNA, 20 nt, Human
auuuugugauugauuauaug

SEQ ID NO: 1885798 - RNA, 13 nt, Human
acaaggaaaaaau

SEQ ID NO: 1885799 - RNA, 13 nt, Human
ccuccuuuuaaag

SEQ ID NO: 1885800 - RNA, 14 nt, Human
auauuugaaauauu

SEQ ID NO: 1885801 - RNA, 19 nt, Human
aaaauaacaauaaaagaca

SEQ ID NO: 1885802 - RNA, 17 nt, Human
aaauauaaauaaaaaua

SEQ ID NO: 1885803 - RNA, 21 nt, Human
ugaaacgaggauugggaaaaa

SEQ ID NO: 1885804 - RNA, 13 nt, Human
gcagaacagugau

SEQ ID NO: 1885805 - RNA, 22 nt, Human
cuuuccacagaagcuccaggua

SEQ ID NO: 1885806 - RNA, 22 nt, Human
gugaacaaauuuacagagacag

SEQ ID NO: 1885807 - RNA, 22 nt, Human
caaggaugccccgucccccucu

SEQ ID NO: 1885808 - RNA, 21 nt, Human
auuauauggcuugaguuuaaa

SEQ ID NO: 1885809 - RNA, 15 nt, Human
uccauccugaggcuc

SEQ ID NO: 1885810 - RNA, 18 nt, Human
auucuugccaaauauaaa

SEQ ID NO: 1885811 - RNA, 22 nt, Human
auaucuuuuuuuuaauaaacca

SEQ ID NO: 1885812 - RNA, 16 nt, Human
ucuugagguaaaagca

SEQ ID NO: 1885813 - RNA, 14 nt, Human
uaauccuaaacaua

SEQ ID NO: 1885814 - RNA, 16 nt, Human
uucccaacuccagaaa

SEQ ID NO: 1885815 - RNA, 19 nt, Human
ugaucaccugcccugcuga

SEQ ID NO: 1885816 - RNA, 20 nt, Human
ugagagugaacaaauuuaca

SEQ ID NO: 1885817 - RNA, 22 nt, Human
gucucuacuaaaaauacaaaaa

SEQ ID NO: 1885818 - RNA, 19 nt, Human
auuggagcucgugggacag

SEQ ID NO: 1885819 - RNA, 15 nt, Human
uugacccacaagaaa

SEQ ID NO: 1885820 - RNA, 21 nt, Human
ugaccauacuaauuauacccc

SEQ ID NO: 1885821 - RNA, 17 nt, Human
auuuucuauaauuuaaa

SEQ ID NO: 1885822 - RNA, 22 nt, Human
aauugacccacaagaaaugaaa

SEQ ID NO: 1885823 - RNA, 20 nt, Human
accucauggaauuggagcuc

SEQ ID NO: 1885824 - RNA, 21 nt, Human
acagugaaagaaaauaacaau

SEQ ID NO: 1885825 - RNA, 20 nt, Human
aaggaugccccgucccccuc

SEQ ID NO: 1885826 - RNA, 14 nt, Human
cuggaaaucagggu

SEQ ID NO: 1885827 - RNA, 14 nt, Human
auccuugaagauuu

SEQ ID NO: 1885828 - RNA, 13 nt, Human
agaaaugaaagca

SEQ ID NO: 1885829 - RNA, 21 nt, Human
auguuuacagauccccaagcc

SEQ ID NO: 1885830 - RNA, 15 nt, Human
aaauauuuauuuuaa

SEQ ID NO: 1885831 - RNA, 17 nt, Human
ccuauccuacuuccccu

SEQ ID NO: 1885832 - RNA, 17 nt, Human
aggguguguaaguagau

SEQ ID NO: 1885833 - RNA, 23 nt, Human
cauuguggucacaggaaguagag

SEQ ID NO: 1885834 - RNA, 18 nt, Human
cucuggccuucggccucc

SEQ ID NO: 1885835 - RNA, 17 nt, Human
aagcuuuuuuugaauca

SEQ ID NO: 1885836 - RNA, 23 nt, Human
gggccuaugcagagguccacaac

SEQ ID NO: 1885837 - RNA, 16 nt, Human
agagguccacaacaca

SEQ ID NO: 1885838 - RNA, 13 nt, Human
ucuuauaauuuaa

SEQ ID NO: 1885839 - RNA, 15 nt, Human
aauugacccacaaga

SEQ ID NO: 1885840 - RNA, 17 nt, Human
uccauccugaggcucca

SEQ ID NO: 1885841 - RNA, 23 nt, Human
cuggccgggagccugaucaccug

SEQ ID NO: 1885842 - RNA, 16 nt, Human
aaaguguuugaaagcu

SEQ ID NO: 1885843 - RNA, 14 nt, Human
auauuuauuuuaau

SEQ ID NO: 1885844 - RNA, 18 nt, Human
agcaaaauuuuuucucua

SEQ ID NO: 1885845 - RNA, 20 nt, Human
auaaauggcuuccuggcaau

SEQ ID NO: 1885846 - RNA, 12 nt, Human
caugggaaguga

SEQ ID NO: 1885847 - RNA, 14 nt, Human
augggccauaugaa

SEQ ID NO: 1885848 - RNA, 22 nt, Human
agaaagugacaagcucacagac

SEQ ID NO: 1885849 - RNA, 19 nt, Human
guccaggucuaccaaaaau

SEQ ID NO: 1885850 - RNA, 20 nt, Human
ugauuucugagcauuuaaua

SEQ ID NO: 1885851 - RNA, 12 nt, Human
gguauuuuaauc

SEQ ID NO: 1885852 - RNA, 16 nt, Human
ugacuuaaugccacua

SEQ ID NO: 1885853 - RNA, 13 nt, Human
auccugaggcucc

SEQ ID NO: 1885854 - RNA, 17 nt, Human
caaacauauauaacaau

SEQ ID NO: 1885855 - RNA, 16 nt, Human
guuccuuccucugagc

SEQ ID NO: 1885856 - RNA, 20 nt, Human
caaacauccuacaagacaca

SEQ ID NO: 1885857 - RNA, 20 nt, Human
aaaaaccugagccccaaaag

SEQ ID NO: 1885858 - RNA, 16 nt, Human
gacaaggaaaaaauaa

SEQ ID NO: 1885859 - RNA, 13 nt, Human
cacacugaagaag

SEQ ID NO: 1885860 - RNA, 14 nt, Human
cccugccccccagc

SEQ ID NO: 1885861 - RNA, 20 nt, Human
agaagaacugaaaucauacu

SEQ ID NO: 1885862 - RNA, 23 nt, Human
gcccuggugccucaccccuugcc

SEQ ID NO: 1885863 - RNA, 15 nt, Human
cauuccaagccucau

SEQ ID NO: 1885864 - RNA, 20 nt, Human
ccuccugccuaagugcagcc

SEQ ID NO: 1885865 - RNA, 21 nt, Human
aaagcugaaauggacuuuugu

SEQ ID NO: 1885866 - RNA, 22 nt, Human
gaaaacaauaacgauaaaagac

SEQ ID NO: 1885867 - RNA, 14 nt, Human
agucucccucccuu

SEQ ID NO: 1885868 - RNA, 15 nt, Human
cucgugggacaguca

SEQ ID NO: 1885869 - RNA, 21 nt, Human
aggacagcccuucuuuccaca

SEQ ID NO: 1885870 - RNA, 18 nt, Human
cugagucccaggcugagc

SEQ ID NO: 1885871 - RNA, 15 nt, Human
ccuggugggcagaga

SEQ ID NO: 1885872 - RNA, 13 nt, Human
ugaaaaucuuaua

SEQ ID NO: 1885873 - RNA, 14 nt, Human
cucccucccuuggg

SEQ ID NO: 1885874 - RNA, 21 nt, Human
gcccugcugagucccaggcug

SEQ ID NO: 1885875 - RNA, 13 nt, Human
gauuguaaaaugg

SEQ ID NO: 1885876 - RNA, 18 nt, Human
agauccccaagccuggca

SEQ ID NO: 1885877 - RNA, 22 nt, Human
uacaugagguacugagagugaa

SEQ ID NO: 1885878 - RNA, 14 nt, Human
aaaauacaaaaaaa

SEQ ID NO: 1885879 - RNA, 20 nt, Human
ugagucccaggcugagccuc

SEQ ID NO: 1885880 - RNA, 16 nt, Human
cuagaaccaccugccu

SEQ ID NO: 1885881 - RNA, 17 nt, Human
uuucacauuuaaauaaa

SEQ ID NO: 1885882 - RNA, 23 nt, Human
gaaugagagacacacugaagaag

SEQ ID NO: 1885883 - RNA, 16 nt, Human
aaauauaaauaaaaau

SEQ ID NO: 1885884 - RNA, 18 nt, Human
caugaagauguagaggag

SEQ ID NO: 1885885 - RNA, 15 nt, Human
ugccccgucccccuc

SEQ ID NO: 1885886 - RNA, 16 nt, Human
aaaaauuccaagugau

SEQ ID NO: 1885887 - RNA, 16 nt, Human
agccucagucucccuc

SEQ ID NO: 1885888 - RNA, 13 nt, Human
aacacaacuauau

SEQ ID NO: 1885889 - RNA, 15 nt, Human
auuucauucaauauc

SEQ ID NO: 1885890 - RNA, 14 nt, Human
uaugaauuacauuu

SEQ ID NO: 1885891 - RNA, 23 nt, Human
caccaaggagccaaacauccuac

SEQ ID NO: 1885892 - RNA, 17 nt, Human
gacgagaaaacaauaac

SEQ ID NO: 1885893 - RNA, 14 nt, Human
ucuauaauuuaaau

SEQ ID NO: 1885894 - RNA, 15 nt, Human
cgggagccugaucac

SEQ ID NO: 1885895 - RNA, 20 nt, Human
cugcacacagcacgggggcc

SEQ ID NO: 1885896 - RNA, 15 nt, Human
cagucucccucccuu

SEQ ID NO: 1885897 - RNA, 22 nt, Human
uguauacugugugcuaaaacaa

SEQ ID NO: 1885898 - RNA, 16 nt, Human
auacauguuacaacac

SEQ ID NO: 1885899 - RNA, 22 nt, Human
uaaaauaauuuuuauauuugaa

SEQ ID NO: 1885900 - RNA, 20 nt, Human
agcuucacuguaaaauaaua

SEQ ID NO: 1885901 - RNA, 18 nt, Human
gaaaauaacaauaaaaga

SEQ ID NO: 1885902 - RNA, 15 nt, Human
accaaggcugauuaa

SEQ ID NO: 1885903 - RNA, 20 nt, Human
agccuuuuuuugaaaaaaag

SEQ ID NO: 1885904 - RNA, 19 nt, Human
cccccucuggcuccagcug

SEQ ID NO: 1885905 - RNA, 22 nt, Human
aaccuacacgagauacagaauu

SEQ ID NO: 1885906 - RNA, 16 nt, Human
agugagacagcucugc

SEQ ID NO: 1885907 - RNA, 20 nt, Human
uguaaaggaauuuaaaaauc

SEQ ID NO: 1885908 - RNA, 18 nt, Human
uauagcuacuaauuuuaa

SEQ ID NO: 1885909 - RNA, 18 nt, Human
gcuccauuuuuagugaaa

SEQ ID NO: 1885910 - RNA, 23 nt, Human
acucuauguucuaagaagugaaa

SEQ ID NO: 1885911 - RNA, 17 nt, Human
ccuacuuccccuuccua

SEQ ID NO: 1885912 - RNA, 18 nt, Human
caugaauuaguuuuauau

SEQ ID NO: 1885913 - RNA, 21 nt, Human
auuuacaaaugggaaacaaaa

SEQ ID NO: 1885914 - RNA, 14 nt, Human
gauaaaagacagug

SEQ ID NO: 1885915 - RNA, 14 nt, Human
ccuugaugaagaag

SEQ ID NO: 1885916 - RNA, 15 nt, Human
agagacagaaagcag

SEQ ID NO: 1885917 - RNA, 19 nt, Human
gaaaauaacgauaaaagac

SEQ ID NO: 1885918 - RNA, 20 nt, Human
aaauccuugaagauuuacca

SEQ ID NO: 1885919 - RNA, 15 nt, Human
guucugcagauaaac

SEQ ID NO: 1885920 - RNA, 22 nt, Human
cccaugauguuuagaaacacaa

SEQ ID NO: 1885921 - RNA, 13 nt, Human
acggggugaaacc

SEQ ID NO: 1885922 - RNA, 15 nt, Human
ccugcaaagcccagc

SEQ ID NO: 1885923 - RNA, 19 nt, Human
ccaccugccuauauuuuuu

SEQ ID NO: 1885924 - RNA, 23 nt, Human
auuucugagcauuuaauauggau

SEQ ID NO: 1885925 - RNA, 15 nt, Human
uucacauuuaaauaa

SEQ ID NO: 1885926 - RNA, 22 nt, Human
ugaguuuuucuuuucauuuacc

SEQ ID NO: 1885927 - RNA, 20 nt, Human
ggccaugggacagggaggac

SEQ ID NO: 1885928 - RNA, 14 nt, Human
auuuguauaaaaua

SEQ ID NO: 1885929 - RNA, 23 nt, Human
gucucccucccuuggggccuaug

SEQ ID NO: 1885930 - RNA, 19 nt, Human
uacaaaaaaaaaaaaaaau

SEQ ID NO: 1885931 - RNA, 22 nt, Human
cccagcccuccuuaucaaagga

SEQ ID NO: 1885932 - RNA, 16 nt, Human
ccugccccccagcccu

SEQ ID NO: 1885933 - RNA, 21 nt, Human
gggagccugaucaccugcccu

SEQ ID NO: 1885934 - RNA, 16 nt, Human
aucaauuuaaaaaaaa

SEQ ID NO: 1885935 - RNA, 21 nt, Human
aaguuuaugguuguauuauuu

SEQ ID NO: 1885936 - RNA, 22 nt, Human
ggcauuuaggccaugggacagg

SEQ ID NO: 1885937 - RNA, 20 nt, Human
gaacguaaucguguccccua

SEQ ID NO: 1885938 - RNA, 15 nt, Human
uagggugauauuaac

SEQ ID NO: 1885939 - RNA, 16 nt, Human
agcuugaaaccuucac

SEQ ID NO: 1885940 - RNA, 18 nt, Human
acauuuauauuuuuguga

SEQ ID NO: 1885941 - RNA, 17 nt, Human
gacagugaaagaaaaua

SEQ ID NO: 1885942 - RNA, 17 nt, Human
cuuccucugagccuugg

SEQ ID NO: 1885943 - RNA, 16 nt, Human
uccuguaauggaagca

SEQ ID NO: 1885944 - RNA, 20 nt, Human
auaauccuaaacauaugaau

SEQ ID NO: 1885945 - RNA, 14 nt, Human
cagucucccucccu

SEQ ID NO: 1885946 - RNA, 20 nt, Human
aaggagccaaacauccuaca

SEQ ID NO: 1885947 - RNA, 19 nt, Human
aaaagacagugaaagaaaa

SEQ ID NO: 1885948 - RNA, 20 nt, Human
gaauucauucacucaacaaa

SEQ ID NO: 1885949 - RNA, 21 nt, Human
aauaauguuucaaacauauau

SEQ ID NO: 1885950 - RNA, 16 nt, Human
ucccugccccccagcc

SEQ ID NO: 1885951 - RNA, 16 nt, Human
agugaaggauuuaugu

SEQ ID NO: 1885952 - RNA, 20 nt, Human
ggguuccuuccucugagccu

SEQ ID NO: 1885953 - RNA, 15 nt, Human
uacaggauuugaaau

SEQ ID NO: 1885954 - RNA, 22 nt, Human
cacagauuugagcucagcccug

SEQ ID NO: 1885955 - RNA, 15 nt, Human
aaggaauuuaaaaau

SEQ ID NO: 1885956 - RNA, 22 nt, Human
aauaauccuaaacauaugaauu

SEQ ID NO: 1885957 - RNA, 20 nt, Human
aaagacagugaaagaaaaua

SEQ ID NO: 1885958 - RNA, 18 nt, Human
cccacuagacccacugga

SEQ ID NO: 1885959 - RNA, 15 nt, Human
aaaaauaacaaugaa

SEQ ID NO: 1885960 - RNA, 13 nt, Human
aggauuugaaauu

SEQ ID NO: 1885961 - RNA, 16 nt, Human
cagaagcaacccaaau

SEQ ID NO: 1885962 - RNA, 13 nt, Human
acacuuaaaaaug

SEQ ID NO: 1885963 - RNA, 16 nt, Human
cccuauccuacuuccc

SEQ ID NO: 1885964 - RNA, 18 nt, Human
gccuucggccuccauccu

SEQ ID NO: 1885965 - RNA, 15 nt, Human
augggacagggagga

SEQ ID NO: 1885966 - RNA, 15 nt, Human
acugaagaagcacca

SEQ ID NO: 1885967 - RNA, 17 nt, Human
ucauacuucuuaggguu

SEQ ID NO: 1885968 - RNA, 17 nt, Human
guguccccuauccuacu

SEQ ID NO: 1885969 - RNA, 21 nt, Human
cugcccugcugagucccaggc

SEQ ID NO: 1885970 - RNA, 21 nt, Human
uuuucaggcuagauguaugua

SEQ ID NO: 1885971 - RNA, 19 nt, Human
guacaagagcuuaacagug

SEQ ID NO: 1885972 - RNA, 14 nt, Human
agaugcuagaacuc

SEQ ID NO: 1885973 - RNA, 19 nt, Human
cuucuggguuccuuccucu

SEQ ID NO: 1885974 - RNA, 21 nt, Human
cuaagcuucacuguaaaauaa

SEQ ID NO: 1885975 - RNA, 18 nt, Human
cccaagccuggcaaggga

SEQ ID NO: 1885976 - RNA, 16 nt, Human
uggggauagugaggca

SEQ ID NO: 1885977 - RNA, 23 nt, Human
aauaauccucaguuuuugugaaa

SEQ ID NO: 1885978 - RNA, 19 nt, Human
aagcuuguauuccuuuuuc

SEQ ID NO: 1885979 - RNA, 18 nt, Human
ugggcacaggguuuaugu

SEQ ID NO: 1885980 - RNA, 15 nt, Human
acgagauacagaauu

SEQ ID NO: 1885981 - RNA, 15 nt, Human
ugccccccagcccuc

SEQ ID NO: 1885982 - RNA, 18 nt, Human
acaagccuccuuuuaaag

SEQ ID NO: 1885983 - RNA, 14 nt, Human
agcucuaucaccaa

SEQ ID NO: 1885984 - RNA, 14 nt, Human
acccaaaaggcaga

SEQ ID NO: 1885985 - RNA, 17 nt, Human
gaaugagagacacacug

SEQ ID NO: 1885986 - RNA, 15 nt, Human
gucccaggcugagcc

SEQ ID NO: 1885987 - RNA, 15 nt, Human
cuaagugcagccccg

SEQ ID NO: 1885988 - RNA, 20 nt, Human
cuaaaugucaaucagccuag

SEQ ID NO: 1885989 - RNA, 16 nt, Human
auuuguauaaaauaau

SEQ ID NO: 1885990 - RNA, 18 nt, Human
ccuugggaccccugagcu

SEQ ID NO: 1885991 - RNA, 18 nt, Human
gcccuggugggcagagag

SEQ ID NO: 1885992 - RNA, 21 nt, Human
uccauccugaggcuccacuug

SEQ ID NO: 1885993 - RNA, 23 nt, Human
gggaaacaaaaggauaaugaaua

SEQ ID NO: 1885994 - RNA, 22 nt, Human
cacuaguauuucuaugaaauau

SEQ ID NO: 1885995 - RNA, 20 nt, Human
gcccauccugccccugagcc

SEQ ID NO: 1885996 - RNA, 13 nt, Human
acaagaaaugaaa

SEQ ID NO: 1885997 - RNA, 15 nt, Human
ccgucccccucuggc

SEQ ID NO: 1885998 - RNA, 14 nt, Human
cucaccccuugcca

SEQ ID NO: 1885999 - RNA, 17 nt, Human
gaaaaucaggcuggcca

SEQ ID NO: 1886000 - RNA, 16 nt, Human
aagacugcacaucaaa

SEQ ID NO: 1886001 - RNA, 13 nt, Human
aggcuagauguau

SEQ ID NO: 1886002 - RNA, 22 nt, Human
uucauucacucaacaaacauaa

SEQ ID NO: 1886003 - RNA, 18 nt, Human
acauguuacaacacggac

SEQ ID NO: 1886004 - RNA, 16 nt, Human
uauaugucacuuugcu

SEQ ID NO: 1886005 - RNA, 14 nt, Human
aauauuauguuaaa

SEQ ID NO: 1886006 - RNA, 14 nt, Human
auuuaaauauaugc

SEQ ID NO: 1886007 - RNA, 20 nt, Human
ucacaugaacuuguaaagga

SEQ ID NO: 1886008 - RNA, 16 nt, Human
cugagcuugcagagau

SEQ ID NO: 1886009 - RNA, 12 nt, Human
ucuuaagaagac

SEQ ID NO: 1886010 - RNA, 18 nt, Human
uacauuuguauaaaauaa

SEQ ID NO: 1886011 - RNA, 18 nt, Human
gaaaauaucacuugucaa

SEQ ID NO: 1886012 - RNA, 19 nt, Human
auuucuucaacucccugcc

SEQ ID NO: 1886013 - RNA, 14 nt, Human
ucuuuuuuuuaaua

SEQ ID NO: 1886014 - RNA, 17 nt, Human
aggccaugggacaggga

SEQ ID NO: 1886015 - RNA, 16 nt, Human
gacaagcucacagacc

SEQ ID NO: 1886016 - RNA, 16 nt, Human
ccuccuuaucaaagga

SEQ ID NO: 1886017 - RNA, 12 nt, Human
ccaggcugagcc

SEQ ID NO: 1886018 - RNA, 17 nt, Human
ugaaaaucuuauaauuu

SEQ ID NO: 1886019 - RNA, 21 nt, Human
aggguuaugauuaaguaauga

SEQ ID NO: 1886020 - RNA, 21 nt, Human
auccccaagccuggcaaggga

SEQ ID NO: 1886021 - RNA, 17 nt, Human
aauaacgauaaaagaca

SEQ ID NO: 1886022 - RNA, 19 nt, Human
agcucugcccauccugccc

SEQ ID NO: 1886023 - RNA, 13 nt, Human
gagacagcucugc

SEQ ID NO: 1886024 - RNA, 17 nt, Human
acucaccucccccaucu

SEQ ID NO: 1886025 - RNA, 21 nt, Human
ugaacaaauuuacagagacag

SEQ ID NO: 1886026 - RNA, 16 nt, Human
cagauccccaagccug

SEQ ID NO: 1886027 - RNA, 22 nt, Human
ggcagcuuuccucaaaacuuca

SEQ ID NO: 1886028 - RNA, 18 nt, Human
ugagcucagcccuggugg

SEQ ID NO: 1886029 - RNA, 16 nt, Human
cuucggccuccauccu

SEQ ID NO: 1886030 - RNA, 14 nt, Human
auugucuagugaaa

SEQ ID NO: 1886031 - RNA, 23 nt, Human
aacuuguaaaggaauuuaaaaau

SEQ ID NO: 1886032 - RNA, 13 nt, Human
ccaaggaugcccc

SEQ ID NO: 1886033 - RNA, 23 nt, Human
ggaugguucccuugaugaagaag

SEQ ID NO: 1886034 - RNA, 15 nt, Human
gugaacuugguuuua

SEQ ID NO: 1886035 - RNA, 18 nt, Human
ccugccuaagugcagccc

SEQ ID NO: 1886036 - RNA, 22 nt, Human
uuuauagcuacuaauuuuaaaa

SEQ ID NO: 1886037 - RNA, 23 nt, Human
gcuuuggucuaucuuugagcgcc

SEQ ID NO: 1886038 - RNA, 17 nt, Human
ccaaaagguauuuuaau

SEQ ID NO: 1886039 - RNA, 22 nt, Human
agcccuccuuaucaaaggacac

SEQ ID NO: 1886040 - RNA, 20 nt, Human
ugaggcuccacuuggucugu

SEQ ID NO: 1886041 - RNA, 23 nt, Human
aguacucauacauguuacaacac

SEQ ID NO: 1886042 - RNA, 14 nt, Human
uugugauugauuau

SEQ ID NO: 1886043 - RNA, 11 nt, Human
caauaaaagac

SEQ ID NO: 1886044 - RNA, 20 nt, Human
cugcacuccagccugagcga

SEQ ID NO: 1886045 - RNA, 19 nt, Human
acaauaacgauaaaagaca

SEQ ID NO: 1886046 - RNA, 15 nt, Human
aagccuggcaaggga

SEQ ID NO: 1886047 - RNA, 13 nt, Human
ugggaggcugaga

SEQ ID NO: 1886048 - RNA, 16 nt, Shigella flexneri 2a str. 2457T
uuuuugacgcuuuuac

SEQ ID NO: 1886049 - RNA, 13 nt, Shigella flexneri 2a str. 2457T
uuuuuugcauuac

SEQ ID NO: 1886050 - RNA, 14 nt, Shigella flexneri 2a str. 2457T
uuuuugucugcuau

SEQ ID NO: 1886051 - RNA, 18 nt, Shigella flexneri 2a str. 2457T
uuucgccgcauccggcaa

SEQ ID NO: 1886052 - RNA, 14 nt, Shigella flexneri 2a str. 2457T
uuucgccagcaccg

SEQ ID NO: 1886053 - RNA, 11 nt, Shigella flexneri 2a str. 2457T
uuucgucgcua

SEQ ID NO: 1886054 - RNA, 12 nt, Shigella flexneri 2a str. 2457T
uuugcagcagcg

SEQ ID NO: 1886055 - RNA, 12 nt, Shigella flexneri 2a str. 2457T
uuugcacauucc

SEQ ID NO: 1886056 - RNA, 15 nt, Shigella flexneri 2a str. 2457T
uuugcccacagagcu

SEQ ID NO: 1886057 - RNA, 15 nt, Shigella flexneri 2a str. 2457T
uuugccgccaucauc

SEQ ID NO: 1886058 - RNA, 13 nt, Shigella flexneri 2a str. 2457T
uuugcaucgccau

SEQ ID NO: 1886059 - RNA, 21 nt, Shigella flexneri 2a str. 2457T
uuugccagucuggcuucgcug

SEQ ID NO: 1886060 - RNA, 13 nt, Shigella flexneri 2a str. 2457T
uuugcauccagcu

SEQ ID NO: 1886061 - RNA, 21 nt, Shigella flexneri 2a str. 2457T
uuugccugccagucaaucauc

SEQ ID NO: 1886062 - RNA, 12 nt, Shigella flexneri 2a str. 2457T
uuugguaggcgu

SEQ ID NO: 1886063 - RNA, 17 nt, Shigella flexneri 2a str. 2457T
uuuuacuaucuugccga

SEQ ID NO: 1886064 - RNA, 13 nt, Shigella flexneri 2a str. 2457T
uuuguagaacgua

SEQ ID NO: 1886065 - RNA, 15 nt, Shigella flexneri 2a str. 2457T
uuuguaucugcagau

SEQ ID NO: 1886066 - RNA, 14 nt, Shigella flexneri 2a str. 2457T
uuuuaucugugaac

SEQ ID NO: 1886067 - RNA, 17 nt, Shigella flexneri 2a str. 2457T
uuuucacuccgaaguaa

SEQ ID NO: 1886068 - RNA, 22 nt, Shigella flexneri 2a str. 2457T
uuguuuuuugagcgguacacca

SEQ ID NO: 1886069 - RNA, 15 nt, Shigella flexneri 2a str. 2457T
uugugaucgcugccc

SEQ ID NO: 1886070 - RNA, 16 nt, Shigella flexneri 2a str. 2457T
uugugugaaaucagca

SEQ ID NO: 1886071 - RNA, 19 nt, Shigella flexneri 2a str. 2457T
uuguauuuuaucugaggca

SEQ ID NO: 1886072 - RNA, 18 nt, Shigella flexneri 2a str. 2457T
uuguauuacaacgugcuc

SEQ ID NO: 1886073 - RNA, 21 nt, Shigella flexneri 2a str. 2457T
uugggcguuacagcuggagua

SEQ ID NO: 1886074 - RNA, 20 nt, Shigella flexneri 2a str. 2457T
uuggcgacaucgacguagug

SEQ ID NO: 1886075 - RNA, 23 nt, Shigella flexneri 2a str. 2457T
uuggggaucgucaggaucagcca

SEQ ID NO: 1886076 - RNA, 15 nt, Shigella flexneri 2a str. 2457T
uugguaaugacucca

SEQ ID NO: 1886077 - RNA, 17 nt, Shigella flexneri 2a str. 2457T
uuggucagcucaaagcg

SEQ ID NO: 1886078 - RNA, 14 nt, Shigella flexneri 2a str. 2457T
uugguuucgucgug

SEQ ID NO: 1886079 - RNA, 12 nt, Shigella flexneri 2a str. 2457T
uugguucaucgu

SEQ ID NO: 1886080 - RNA, 14 nt, Shigella flexneri 2a str. 2457T
uugguuauccagca

SEQ ID NO: 1886081 - RNA, 22 nt, Shigella flexneri 2a str. 2457T
uuuaacggacacuccuuccuga

SEQ ID NO: 1886082 - RNA, 17 nt, Shigella flexneri 2a str. 2457T
uuuaaggaaaaacgaau

SEQ ID NO: 1886083 - RNA, 16 nt, Shigella flexneri 2a str. 2457T
uuucaaaacggucacg

SEQ ID NO: 1886084 - RNA, 17 nt, Shigella flexneri 2a str. 2457T
uuuauagcguugcccga

SEQ ID NO: 1886085 - RNA, 17 nt, Shigella flexneri 2a str. 2457T
uuucaguuuuacucuuu

SEQ ID NO: 1886086 - RNA, 18 nt, Shigella flexneri 2a str. 2457T
uuucgagaaugucgauaa

SEQ ID NO: 1886087 - RNA, 14 nt, Shigella flexneri 2a str. 2457T
uuccgucagucaca

SEQ ID NO: 1886088 - RNA, 23 nt, Shigella flexneri 2a str. 2457T
uugaacgcaccgccaccaccgau

SEQ ID NO: 1886089 - RNA, 16 nt, Shigella flexneri 2a str. 2457T
uugagcguauccagca

SEQ ID NO: 1886090 - RNA, 17 nt, Shigella flexneri 2a str. 2457T
uugaggaugcuaaggcu

SEQ ID NO: 1886091 - RNA, 15 nt, Shigella flexneri 2a str. 2457T
uugacgaaaaggccu

SEQ ID NO: 1886092 - RNA, 19 nt, Shigella flexneri 2a str. 2457T
uugacgcgucuuaucaggc

SEQ ID NO: 1886093 - RNA, 13 nt, Shigella flexneri 2a str. 2457T
uugacguccagcc

SEQ ID NO: 1886094 - RNA, 21 nt, Shigella flexneri 2a str. 2457T
uugauccccgcuuccugcagc

SEQ ID NO: 1886095 - RNA, 11 nt, Shigella flexneri 2a str. 2457T
uugaucgccaa

SEQ ID NO: 1886096 - RNA, 18 nt, Shigella flexneri 2a str. 2457T
uugaguuggcaugcguau

SEQ ID NO: 1886097 - RNA, 19 nt, Shigella flexneri 2a str. 2457T
uugaugcgaguaaucaggc

SEQ ID NO: 1886098 - RNA, 12 nt, Shigella flexneri 2a str. 2457T
uugauguacgcu

SEQ ID NO: 1886099 - RNA, 19 nt, Shigella flexneri 2a str. 2457T
uugaugugcuucaucagac

SEQ ID NO: 1886100 - RNA, 20 nt, Shigella flexneri 2a str. 2457T
uugauuauuggacgguaaaa

SEQ ID NO: 1886101 - RNA, 17 nt, Shigella flexneri 2a str. 2457T
uugcaaccacacaggca

SEQ ID NO: 1886102 - RNA, 14 nt, Shigella flexneri 2a str. 2457T
uugcagagcauccu

SEQ ID NO: 1886103 - RNA, 20 nt, Shigella flexneri 2a str. 2457T
uugcaggccagauaaggcgu

SEQ ID NO: 1886104 - RNA, 22 nt, Shigella flexneri 2a str. 2457T
uugcaggggagcgaauacuccc

SEQ ID NO: 1886105 - RNA, 20 nt, Shigella flexneri 2a str. 2457T
uugcauaaugguggaguggc

SEQ ID NO: 1886106 - RNA, 17 nt, Shigella flexneri 2a str. 2457T
uugcccccugaagcagu

SEQ ID NO: 1886107 - RNA, 12 nt, Shigella flexneri 2a str. 2457T
uuggaccggcac

SEQ ID NO: 1886108 - RNA, 15 nt, Shigella flexneri 2a str. 2457T
uuggcaucaucagcg

SEQ ID NO: 1886109 - RNA, 15 nt, Shigella flexneri 2a str. 2457T
uugcucaagcugaac

SEQ ID NO: 1886110 - RNA, 19 nt, Shigella flexneri 2a str. 2457T
uugcucagaaucacgccaa

SEQ ID NO: 1886111 - RNA, 16 nt, Shigella flexneri 2a str. 2457T
uugcucugcagcagcc

SEQ ID NO: 1886112 - RNA, 17 nt, Shigella flexneri 2a str. 2457T
uugcugcugauccagcu

SEQ ID NO: 1886113 - RNA, 21 nt, Shigella flexneri 2a str. 2457T
uugcuucgaucucaaucuuca

SEQ ID NO: 1886114 - RNA, 17 nt, Shigella flexneri 2a str. 2457T
uugcuucaccagcagcg

SEQ ID NO: 1886115 - RNA, 22 nt, Shigella flexneri 2a str. 2457T
uugcuguuuuacagcugauccu

SEQ ID NO: 1886116 - RNA, 10 nt, Shigella flexneri 2a str. 2457T
uugccugaug

SEQ ID NO: 1886117 - RNA, 17 nt, Shigella flexneri 2a str. 2457T
uugccgggcgcaucaga

SEQ ID NO: 1886118 - RNA, 18 nt, Shigella flexneri 2a str. 2457T
uugccguccggcaucgca

SEQ ID NO: 1886119 - RNA, 20 nt, Shigella flexneri 2a str. 2457T
uugccgagaaaaucgugcca

SEQ ID NO: 1886120 - RNA, 13 nt, Shigella flexneri 2a str. 2457T
uugcgucaaugcc

SEQ ID NO: 1886121 - RNA, 13 nt, Shigella flexneri 2a str. 2457T
uugcgucgccagu

SEQ ID NO: 1886122 - RNA, 13 nt, Shigella flexneri 2a str. 2457T
uugcgucacaucu

SEQ ID NO: 1886123 - RNA, 18 nt, Shigella flexneri 2a str. 2457T
uugcggcggcgcaaagcg

SEQ ID NO: 1886124 - RNA, 18 nt, Shigella flexneri 2a str. 2457T
uugcgccacuaacgcauu

SEQ ID NO: 1886125 - RNA, 16 nt, Shigella flexneri 2a str. 2457T
uugcgcauccagcgcu

SEQ ID NO: 1886126 - RNA, 17 nt, Shigella flexneri 2a str. 2457T
uugcgaucgaccugcgc

SEQ ID NO: 1886127 - RNA, 18 nt, Shigella flexneri 2a str. 2457T
uugcgcguaacgaucgcc

SEQ ID NO: 1886128 - RNA, 20 nt, Shigella flexneri 2a str. 2457T
uucagguuacgcccuucacc

SEQ ID NO: 1886129 - RNA, 20 nt, Shigella flexneri 2a str. 2457T
uucacgguauuauucaucgc

SEQ ID NO: 1886130 - RNA, 16 nt, Shigella flexneri 2a str. 2457T
uucacccaucgccaga

SEQ ID NO: 1886131 - RNA, 13 nt, Shigella flexneri 2a str. 2457T
uucacgcugucgg

SEQ ID NO: 1886132 - RNA, 13 nt, Shigella flexneri 2a str. 2457T
uucacggcaccag

SEQ ID NO: 1886133 - RNA, 19 nt, Shigella flexneri 2a str. 2457T
uucacucacgccguuaacu

SEQ ID NO: 1886134 - RNA, 16 nt, Shigella flexneri 2a str. 2457T
uucacuggcaccgcac

SEQ ID NO: 1886135 - RNA, 21 nt, Shigella flexneri 2a str. 2457T
uucaccaguugguagguccag

SEQ ID NO: 1886136 - RNA, 23 nt, Shigella flexneri 2a str. 2457T
uucaccaguuguaaaucgcccac

SEQ ID NO: 1886137 - RNA, 22 nt, Shigella flexneri 2a str. 2457T
uucaccaucgcgaucaucagua

SEQ ID NO: 1886138 - RNA, 22 nt, Shigella flexneri 2a str. 2457T
uucacaaugaugcccgguugcu

SEQ ID NO: 1886139 - RNA, 13 nt, Shigella flexneri 2a str. 2457T
uucacaucaucau

SEQ ID NO: 1886140 - RNA, 20 nt, Shigella flexneri 2a str. 2457T
uucaccacuguuaacggccg

SEQ ID NO: 1886141 - RNA, 16 nt, Shigella flexneri 2a str. 2457T
uuaugaucaucaaggc

SEQ ID NO: 1886142 - RNA, 21 nt, Shigella flexneri 2a str. 2457T
uuaugccauguucaucaagcu

SEQ ID NO: 1886143 - RNA, 20 nt, Shigella flexneri 2a str. 2457T
uuaugguagugccgucagca

SEQ ID NO: 1886144 - RNA, 15 nt, Shigella flexneri 2a str. 2457T
uucaacggcggcuug

SEQ ID NO: 1886145 - RNA, 15 nt, Shigella flexneri 2a str. 2457T
uucaacagcggcauu

SEQ ID NO: 1886146 - RNA, 17 nt, Shigella flexneri 2a str. 2457T
uucaaccauucgcgcac

SEQ ID NO: 1886147 - RNA, 16 nt, Shigella flexneri 2a str. 2457T
uucaacagauuucgaa

SEQ ID NO: 1886148 - RNA, 13 nt, Shigella flexneri 2a str. 2457T
uucauccagcagu

SEQ ID NO: 1886149 - RNA, 20 nt, Shigella flexneri 2a str. 2457T
uucauauuuuacauccggca

SEQ ID NO: 1886150 - RNA, 14 nt, Shigella flexneri 2a str. 2457T
uucauaucugccag

SEQ ID NO: 1886151 - RNA, 13 nt, Shigella flexneri 2a str. 2457T
uuccaccgcuauu

SEQ ID NO: 1886152 - RNA, 21 nt, Shigella flexneri 2a str. 2457T
uuccacgccugcauccgccau

SEQ ID NO: 1886153 - RNA, 16 nt, Shigella flexneri 2a str. 2457T
uuccacgcaucaagca

SEQ ID NO: 1886154 - RNA, 17 nt, Shigella flexneri 2a str. 2457T
uuccggcaaucgucgau

SEQ ID NO: 1886155 - RNA, 17 nt, Shigella flexneri 2a str. 2457T
uuccggcaccacaaacu

SEQ ID NO: 1886156 - RNA, 15 nt, Shigella flexneri 2a str. 2457T
uuccggcaagcaaau

SEQ ID NO: 1886157 - RNA, 17 nt, Shigella flexneri 2a str. 2457T
uucccgcacguuggcgg

SEQ ID NO: 1886158 - RNA, 23 nt, Shigella flexneri 2a str. 2457T
uuccagcguagugaaggcaaacu

SEQ ID NO: 1886159 - RNA, 11 nt, Shigella flexneri 2a str. 2457T
uuaaucaucaa

SEQ ID NO: 1886160 - RNA, 14 nt, Shigella flexneri 2a str. 2457T
uuaacugcuccgcc

SEQ ID NO: 1886161 - RNA, 19 nt, Shigella flexneri 2a str. 2457T
uuaacgcgcugaugaccgc

SEQ ID NO: 1886162 - RNA, 23 nt, Shigella flexneri 2a str. 2457T
uuaacgcgccggaaauugccacu

SEQ ID NO: 1886163 - RNA, 17 nt, Shigella flexneri 2a str. 2457T
uuaaccaccuccacgcc

SEQ ID NO: 1886164 - RNA, 22 nt, Shigella flexneri 2a str. 2457T
uuaagccaucccagacaccgcc

SEQ ID NO: 1886165 - RNA, 15 nt, Shigella flexneri 2a str. 2457T
uuaagcgcaaaggcc

SEQ ID NO: 1886166 - RNA, 15 nt, Shigella flexneri 2a str. 2457T
uguuugacaacucau

SEQ ID NO: 1886167 - RNA, 21 nt, Shigella flexneri 2a str. 2457T
uuaacaucuccacagucaggc

SEQ ID NO: 1886168 - RNA, 22 nt, Shigella flexneri 2a str. 2457T
uguuugaaccagauaucgcgga

SEQ ID NO: 1886169 - RNA, 16 nt, Shigella flexneri 2a str. 2457T
uuaucaacuaucagau

SEQ ID NO: 1886170 - RNA, 20 nt, Shigella flexneri 2a str. 2457T
uuaucuggccuacaaagggc

SEQ ID NO: 1886171 - RNA, 19 nt, Shigella flexneri 2a str. 2457T
uuaucuccauccgggauca

SEQ ID NO: 1886172 - RNA, 15 nt, Shigella flexneri 2a str. 2457T
uuagggacaaagaau

SEQ ID NO: 1886173 - RNA, 21 nt, Shigella flexneri 2a str. 2457T
uuagucgcccauuuugccacc

SEQ ID NO: 1886174 - RNA, 21 nt, Shigella flexneri 2a str. 2457T
uuacccaggaagaccugcagc

SEQ ID NO: 1886175 - RNA, 23 nt, Shigella flexneri 2a str. 2457T
uuaccgccacagcagccuucgcc

SEQ ID NO: 1886176 - RNA, 20 nt, Shigella flexneri 2a str. 2457T
uuacuuucggugacuucaaa

SEQ ID NO: 1886177 - RNA, 23 nt, Shigella flexneri 2a str. 2457T
uuaccagcauuuaagcauuagca

SEQ ID NO: 1886178 - RNA, 16 nt, Shigella flexneri 2a str. 2457T
uuaccagcggccggau

SEQ ID NO: 1886179 - RNA, 16 nt, Shigella flexneri 2a str. 2457T
uuacccaaucccccac

SEQ ID NO: 1886180 - RNA, 17 nt, Shigella flexneri 2a str. 2457T
uuaccgcaccaccagca

SEQ ID NO: 1886181 - RNA, 20 nt, Shigella flexneri 2a str. 2457T
uuacagcuggaguacggccu

SEQ ID NO: 1886182 - RNA, 13 nt, Shigella flexneri 2a str. 2457T
uuacagcaacgcc

SEQ ID NO: 1886183 - RNA, 22 nt, Shigella flexneri 2a str. 2457T
uuacauaugcgcuggcaguuuc

SEQ ID NO: 1886184 - RNA, 17 nt, Shigella flexneri 2a str. 2457T
uggugcgugcggcaaau

SEQ ID NO: 1886185 - RNA, 16 nt, Shigella flexneri 2a str. 2457T
ugguaaugaucgccgu

SEQ ID NO: 1886186 - RNA, 13 nt, Shigella flexneri 2a str. 2457T
ugguugucgcagg

SEQ ID NO: 1886187 - RNA, 18 nt, Shigella flexneri 2a str. 2457T
ugguguagggcaggcgug

SEQ ID NO: 1886188 - RNA, 20 nt, Shigella flexneri 2a str. 2457T
uguaccuucacgcgcuccag

SEQ ID NO: 1886189 - RNA, 15 nt, Shigella flexneri 2a str. 2457T
uguacggcagugaac

SEQ ID NO: 1886190 - RNA, 21 nt, Shigella flexneri 2a str. 2457T
uguaccaccagaaucgccagc

SEQ ID NO: 1886191 - RNA, 14 nt, Shigella flexneri 2a str. 2457T
uguaauccucuuug

SEQ ID NO: 1886192 - RNA, 15 nt, Shigella flexneri 2a str. 2457T
uguacuccagcagac

SEQ ID NO: 1886193 - RNA, 19 nt, Shigella flexneri 2a str. 2457T
uguacuggcaauagcggac

SEQ ID NO: 1886194 - RNA, 20 nt, Shigella flexneri 2a str. 2457T
uguagcgcaucacuuccagu

SEQ ID NO: 1886195 - RNA, 19 nt, Shigella flexneri 2a str. 2457T
uguaggccggauaaggcgu

SEQ ID NO: 1886196 - RNA, 23 nt, Shigella flexneri 2a str. 2457T
uguaggccagauaagacguucac

SEQ ID NO: 1886197 - RNA, 20 nt, Shigella flexneri 2a str. 2457T
uguaggccggauaaggcgcu

SEQ ID NO: 1886198 - RNA, 19 nt, Shigella flexneri 2a str. 2457T
uguaggccggauaaggcau

SEQ ID NO: 1886199 - RNA, 15 nt, Shigella flexneri 2a str. 2457T
ugucagaugcggcgu

SEQ ID NO: 1886200 - RNA, 15 nt, Shigella flexneri 2a str. 2457T
ugucacuuugaccgc

SEQ ID NO: 1886201 - RNA, 21 nt, Shigella flexneri 2a str. 2457T
ugucauguauauuauccauca

SEQ ID NO: 1886202 - RNA, 18 nt, Shigella flexneri 2a str. 2457T
ugucaucagucuagcccg

SEQ ID NO: 1886203 - RNA, 20 nt, Shigella flexneri 2a str. 2457T
ugucaucggucagaucggca

SEQ ID NO: 1886204 - RNA, 18 nt, Shigella flexneri 2a str. 2457T
uguugaaaagccggaaug

SEQ ID NO: 1886205 - RNA, 19 nt, Shigella flexneri 2a str. 2457T
uguucuggucacucucgac

SEQ ID NO: 1886206 - RNA, 23 nt, Shigella flexneri 2a str. 2457T
uguugcauccggucagacaacuu

SEQ ID NO: 1886207 - RNA, 14 nt, Shigella flexneri 2a str. 2457T
uguuaucguuugca

SEQ ID NO: 1886208 - RNA, 16 nt, Shigella flexneri 2a str. 2457T
uguucacgccaucauc

SEQ ID NO: 1886209 - RNA, 18 nt, Shigella flexneri 2a str. 2457T
uguucagccugaccgcac

SEQ ID NO: 1886210 - RNA, 11 nt, Shigella flexneri 2a str. 2457T
uguucacugcc

SEQ ID NO: 1886211 - RNA, 22 nt, Shigella flexneri 2a str. 2457T
uguuccauaccgucgccagacg

SEQ ID NO: 1886212 - RNA, 22 nt, Shigella flexneri 2a str. 2457T
ugugcagguggaauauccguca

SEQ ID NO: 1886213 - RNA, 21 nt, Shigella flexneri 2a str. 2457T
ugugcaauauuacuucagacg

SEQ ID NO: 1886214 - RNA, 12 nt, Shigella flexneri 2a str. 2457T
ugugucgccagc

SEQ ID NO: 1886215 - RNA, 23 nt, Shigella flexneri 2a str. 2457T
ugucgauaaacaguuucgccagg

SEQ ID NO: 1886216 - RNA, 15 nt, Shigella flexneri 2a str. 2457T
uggcccaucgccagu

SEQ ID NO: 1886217 - RNA, 14 nt, Shigella flexneri 2a str. 2457T
uggcccaucgccag

SEQ ID NO: 1886218 - RNA, 18 nt, Shigella flexneri 2a str. 2457T
uggcccagccuuuccggc

SEQ ID NO: 1886219 - RNA, 20 nt, Shigella flexneri 2a str. 2457T
uggccagagugcguucaccg

SEQ ID NO: 1886220 - RNA, 21 nt, Shigella flexneri 2a str. 2457T
uggccagagugcguucaccga

SEQ ID NO: 1886221 - RNA, 17 nt, Shigella flexneri 2a str. 2457T
uggcauuggcagagcga

SEQ ID NO: 1886222 - RNA, 17 nt, Shigella flexneri 2a str. 2457T
uggcauccgugguggca

SEQ ID NO: 1886223 - RNA, 14 nt, Shigella flexneri 2a str. 2457T
uggcauaucgccgu

SEQ ID NO: 1886224 - RNA, 19 nt, Shigella flexneri 2a str. 2457T
uggcaucugauaagcccag

SEQ ID NO: 1886225 - RNA, 20 nt, Shigella flexneri 2a str. 2457T
uggcagaagagcguaaaguc

SEQ ID NO: 1886226 - RNA, 20 nt, Shigella flexneri 2a str. 2457T
uggcagaguaucgccauccg

SEQ ID NO: 1886227 - RNA, 18 nt, Shigella flexneri 2a str. 2457T
uggcagcaagugcggcgc

SEQ ID NO: 1886228 - RNA, 13 nt, Shigella flexneri 2a str. 2457T
uggcacugucgag

SEQ ID NO: 1886229 - RNA, 22 nt, Shigella flexneri 2a str. 2457T
uggcagcgcgcauucagcagca

SEQ ID NO: 1886230 - RNA, 14 nt, Shigella flexneri 2a str. 2457T
uggcaaucaguggc

SEQ ID NO: 1886231 - RNA, 18 nt, Shigella flexneri 2a str. 2457T
uggcaauaaagacauccg

SEQ ID NO: 1886232 - RNA, 20 nt, Shigella flexneri 2a str. 2457T
uggcaacuaacugacuuccg

SEQ ID NO: 1886233 - RNA, 18 nt, Shigella flexneri 2a str. 2457T
uggcacaugcauaaagcg

SEQ ID NO: 1886234 - RNA, 23 nt, Shigella flexneri 2a str. 2457T
uggcacgaccgccuuucacgccg

SEQ ID NO: 1886235 - RNA, 19 nt, Shigella flexneri 2a str. 2457T
uggcaacgacgagcggaca

SEQ ID NO: 1886236 - RNA, 13 nt, Shigella flexneri 2a str. 2457T
uggcaaaugacau

SEQ ID NO: 1886237 - RNA, 20 nt, Shigella flexneri 2a str. 2457T
uggaucuggaguuccuggau

SEQ ID NO: 1886238 - RNA, 20 nt, Shigella flexneri 2a str. 2457T
uggaucaguguacuuaucuu

SEQ ID NO: 1886239 - RNA, 23 nt, Shigella flexneri 2a str. 2457T
uggaugcagucaaaucuuauaug

SEQ ID NO: 1886240 - RNA, 21 nt, Shigella flexneri 2a str. 2457T
uggaugaacuucgcagccgug

SEQ ID NO: 1886241 - RNA, 20 nt, Shigella flexneri 2a str. 2457T
uggaugacauugaugcgcca

SEQ ID NO: 1886242 - RNA, 21 nt, Shigella flexneri 2a str. 2457T
uggaugcggcaugaacaccuu

SEQ ID NO: 1886243 - RNA, 22 nt, Shigella flexneri 2a str. 2457T
uggauaaugaagucugccguug

SEQ ID NO: 1886244 - RNA, 21 nt, Shigella flexneri 2a str. 2457T
uggaucaacgaccagcgcgug

SEQ ID NO: 1886245 - RNA, 21 nt, Shigella flexneri 2a str. 2457T
uggaucaaggauugcagcacu

SEQ ID NO: 1886246 - RNA, 15 nt, Shigella flexneri 2a str. 2457T
uggagacugaugaca

SEQ ID NO: 1886247 - RNA, 15 nt, Shigella flexneri 2a str. 2457T
uggagcagcaaagac

SEQ ID NO: 1886248 - RNA, 13 nt, Shigella flexneri 2a str. 2457T
uggagcaggaacu

SEQ ID NO: 1886249 - RNA, 17 nt, Shigella flexneri 2a str. 2457T
uggagagugacaguuca

SEQ ID NO: 1886250 - RNA, 15 nt, Shigella flexneri 2a str. 2457T
ugcggguaaccagcc

SEQ ID NO: 1886251 - RNA, 12 nt, Shigella flexneri 2a str. 2457T
uggaagcaaaau

SEQ ID NO: 1886252 - RNA, 16 nt, Shigella flexneri 2a str. 2457T
uggccgagaggcugaa

SEQ ID NO: 1886253 - RNA, 23 nt, Shigella flexneri 2a str. 2457T
uggccgcaguacugggccgccug

SEQ ID NO: 1886254 - RNA, 19 nt, Shigella flexneri 2a str. 2457T
uggcgcgaaccaucaccuc

SEQ ID NO: 1886255 - RNA, 23 nt, Shigella flexneri 2a str. 2457T
uggcgcuucacuggcgacaugca

SEQ ID NO: 1886256 - RNA, 22 nt, Shigella flexneri 2a str. 2457T
uggcggacgggugaguaauguc

SEQ ID NO: 1886257 - RNA, 16 nt, Shigella flexneri 2a str. 2457T
uggcgcaucggucaga

SEQ ID NO: 1886258 - RNA, 21 nt, Shigella flexneri 2a str. 2457T
uggcgcauaacucaccaucaa

SEQ ID NO: 1886259 - RNA, 22 nt, Shigella flexneri 2a str. 2457T
uggcgcaguggauagacgcagg

SEQ ID NO: 1886260 - RNA, 13 nt, Shigella flexneri 2a str. 2457T
uggcgcagugggc

SEQ ID NO: 1886261 - RNA, 21 nt, Shigella flexneri 2a str. 2457T
uggcguacucaauuuucaccg

SEQ ID NO: 1886262 - RNA, 22 nt, Shigella flexneri 2a str. 2457T
uggcgugagccgucaccgccug

SEQ ID NO: 1886263 - RNA, 18 nt, Shigella flexneri 2a str. 2457T
uggcguuauggcaaucuu

SEQ ID NO: 1886264 - RNA, 15 nt, Shigella flexneri 2a str. 2457T
uggcguucagcgacg

SEQ ID NO: 1886265 - RNA, 22 nt, Shigella flexneri 2a str. 2457T
uggcugagcaaacaguucugca

SEQ ID NO: 1886266 - RNA, 19 nt, Shigella flexneri 2a str. 2457T
uggcugaauauuuuagccg

SEQ ID NO: 1886267 - RNA, 16 nt, Shigella flexneri 2a str. 2457T
uggcugcauggcaauu

SEQ ID NO: 1886268 - RNA, 19 nt, Shigella flexneri 2a str. 2457T
ugggcaguucgggccgauc

SEQ ID NO: 1886269 - RNA, 21 nt, Shigella flexneri 2a str. 2457T
ugggcaucggcaaucacauca

SEQ ID NO: 1886270 - RNA, 21 nt, Shigella flexneri 2a str. 2457T
ugggcgaagagaaagaacgag

SEQ ID NO: 1886271 - RNA, 19 nt, Shigella flexneri 2a str. 2457T
ugggcgaugcuggcagaag

SEQ ID NO: 1886272 - RNA, 18 nt, Shigella flexneri 2a str. 2457T
ugggugccgcgcagcgug

SEQ ID NO: 1886273 - RNA, 23 nt, Shigella flexneri 2a str. 2457T
uggggguccugagcacuuuucug

SEQ ID NO: 1886274 - RNA, 17 nt, Shigella flexneri 2a str. 2457T
uggguggugauuuucgc

SEQ ID NO: 1886275 - RNA, 15 nt, Shigella flexneri 2a str. 2457T
uaaagaaaaagcgcc

SEQ ID NO: 1886276 - RNA, 21 nt, Shigella flexneri 2a str. 2457T
uaaagaaaucaccugccggag

SEQ ID NO: 1886277 - RNA, 19 nt, Shigella flexneri 2a str. 2457T
uaaaccaggcgagaucggc

SEQ ID NO: 1886278 - RNA, 23 nt, Shigella flexneri 2a str. 2457T
uaaaccacugacacaggcagcaa

SEQ ID NO: 1886279 - RNA, 16 nt, Shigella flexneri 2a str. 2457T
uaaacccuggccgcac

SEQ ID NO: 1886280 - RNA, 16 nt, Shigella flexneri 2a str. 2457T
uaaaccacugacacag

SEQ ID NO: 1886281 - RNA, 15 nt, Shigella flexneri 2a str. 2457T
guuuauuucccagau

SEQ ID NO: 1886282 - RNA, 23 nt, Shigella flexneri 2a str. 2457T
guuucaacgacccagccagacgc

SEQ ID NO: 1886283 - RNA, 13 nt, Shigella flexneri 2a str. 2457T
guuucaccgcgua

SEQ ID NO: 1886284 - RNA, 15 nt, Shigella flexneri 2a str. 2457T
uaaaaagaaaaucgu

SEQ ID NO: 1886285 - RNA, 22 nt, Shigella flexneri 2a str. 2457T
uaaaaacuccgccgcaucuucc

SEQ ID NO: 1886286 - RNA, 19 nt, Shigella flexneri 2a str. 2457T
uaaaaagguccuguaauga

SEQ ID NO: 1886287 - RNA, 18 nt, Shigella flexneri 2a str. 2457T
uaaauaccuuccggcgua

SEQ ID NO: 1886288 - RNA, 16 nt, Shigella flexneri 2a str. 2457T
uaaaucccuggcugca

SEQ ID NO: 1886289 - RNA, 17 nt, Shigella flexneri 2a str. 2457T
uaaaugcacccgccaga

SEQ ID NO: 1886290 - RNA, 20 nt, Shigella flexneri 2a str. 2457T
uaaaugccgcguggccugga

SEQ ID NO: 1886291 - RNA, 15 nt, Shigella flexneri 2a str. 2457T
uaacaaccaggccag

SEQ ID NO: 1886292 - RNA, 18 nt, Shigella flexneri 2a str. 2457T
uaacauuuuucucggcaa

SEQ ID NO: 1886293 - RNA, 21 nt, Shigella flexneri 2a str. 2457T
uaaccaaacguggucgccagc

SEQ ID NO: 1886294 - RNA, 15 nt, Shigella flexneri 2a str. 2457T
uaacaccacgccugc

SEQ ID NO: 1886295 - RNA, 19 nt, Shigella flexneri 2a str. 2457T
uaaccaguugucgcacauu

SEQ ID NO: 1886296 - RNA, 12 nt, Shigella flexneri 2a str. 2457T
uaaccaucagcu

SEQ ID NO: 1886297 - RNA, 18 nt, Shigella flexneri 2a str. 2457T
uaaccaugacgccgaauc

SEQ ID NO: 1886298 - RNA, 12 nt, Shigella flexneri 2a str. 2457T
uaaccacuucag

SEQ ID NO: 1886299 - RNA, 19 nt, Shigella flexneri 2a str. 2457T
uaacgccuucccuuucagc

SEQ ID NO: 1886300 - RNA, 22 nt, Shigella flexneri 2a str. 2457T
uaacgccuucccuuucagcaaa

SEQ ID NO: 1886301 - RNA, 21 nt, Shigella flexneri 2a str. 2457T
uaacgaucgccugguaccagc

SEQ ID NO: 1886302 - RNA, 16 nt, Shigella flexneri 2a str. 2457T
uaacgacugcggauuu

SEQ ID NO: 1886303 - RNA, 13 nt, Shigella flexneri 2a str. 2457T
uaacgaaagcgcc

SEQ ID NO: 1886304 - RNA, 14 nt, Shigella flexneri 2a str. 2457T
uaauuaauacgcca

SEQ ID NO: 1886305 - RNA, 11 nt, Shigella flexneri 2a str. 2457T
uaaugucuggg

SEQ ID NO: 1886306 - RNA, 18 nt, Shigella flexneri 2a str. 2457T
uaaugucuuuaauggcac

SEQ ID NO: 1886307 - RNA, 18 nt, Shigella flexneri 2a str. 2457T
uaaugcaaaaugccgucg

SEQ ID NO: 1886308 - RNA, 20 nt, Shigella flexneri 2a str. 2457T
uacaccauuaacuacaccgu

SEQ ID NO: 1886309 - RNA, 17 nt, Shigella flexneri 2a str. 2457T
uaauuuuuccagcauuu

SEQ ID NO: 1886310 - RNA, 17 nt, Shigella flexneri 2a str. 2457T
uacaccaacaucacgca

SEQ ID NO: 1886311 - RNA, 21 nt, Shigella flexneri 2a str. 2457T
uacaaucccgcuuacaucaac

SEQ ID NO: 1886312 - RNA, 13 nt, Shigella flexneri 2a str. 2457T
uaagcccaguuca

SEQ ID NO: 1886313 - RNA, 16 nt, Shigella flexneri 2a str. 2457T
uaagccaaauccagcg

SEQ ID NO: 1886314 - RNA, 14 nt, Shigella flexneri 2a str. 2457T
uaaguuuaacugcc

SEQ ID NO: 1886315 - RNA, 20 nt, Shigella flexneri 2a str. 2457T
uaagcgauaaaaauaccgag

SEQ ID NO: 1886316 - RNA, 14 nt, Shigella flexneri 2a str. 2457T
uaagcgauucagca

SEQ ID NO: 1886317 - RNA, 20 nt, Shigella flexneri 2a str. 2457T
uaaucggcgcggcgguugac

SEQ ID NO: 1886318 - RNA, 22 nt, Shigella flexneri 2a str. 2457T
uaaucaucuguugugccacauc

SEQ ID NO: 1886319 - RNA, 18 nt, Shigella flexneri 2a str. 2457T
uaaucauauuguccugua

SEQ ID NO: 1886320 - RNA, 18 nt, Shigella flexneri 2a str. 2457T
uaaguuugccguugaucu

SEQ ID NO: 1886321 - RNA, 19 nt, Shigella flexneri 2a str. 2457T
uaauaaaauagcgugauug

SEQ ID NO: 1886322 - RNA, 22 nt, Shigella flexneri 2a str. 2457T
uagcgcauaagccaccucaacg

SEQ ID NO: 1886323 - RNA, 14 nt, Shigella flexneri 2a str. 2457T
uagcaugaaccauu

SEQ ID NO: 1886324 - RNA, 11 nt, Shigella flexneri 2a str. 2457T
uagcaucagcg

SEQ ID NO: 1886325 - RNA, 20 nt, Shigella flexneri 2a str. 2457T
uagcaguaauugcagcagcu

SEQ ID NO: 1886326 - RNA, 18 nt, Shigella flexneri 2a str. 2457T
uagcaucccaauacccgc

SEQ ID NO: 1886327 - RNA, 12 nt, Shigella flexneri 2a str. 2457T
uagccagcgcac

SEQ ID NO: 1886328 - RNA, 23 nt, Shigella flexneri 2a str. 2457T
uagcaauauuuuuaugccggauc

SEQ ID NO: 1886329 - RNA, 15 nt, Shigella flexneri 2a str. 2457T
uagcacaacaggcua

SEQ ID NO: 1886330 - RNA, 16 nt, Shigella flexneri 2a str. 2457T
uagcaggaugacaaag

SEQ ID NO: 1886331 - RNA, 22 nt, Shigella flexneri 2a str. 2457T
uacuugcaccgauucccgggca

SEQ ID NO: 1886332 - RNA, 17 nt, Shigella flexneri 2a str. 2457T
uacuuucaucaaacgac

SEQ ID NO: 1886333 - RNA, 17 nt, Shigella flexneri 2a str. 2457T
uagaaaacgaaagcgcc

SEQ ID NO: 1886334 - RNA, 19 nt, Shigella flexneri 2a str. 2457T
uagaauccgcgacuggcau

SEQ ID NO: 1886335 - RNA, 18 nt, Shigella flexneri 2a str. 2457T
uacgccgcauccggcaua

SEQ ID NO: 1886336 - RNA, 18 nt, Shigella flexneri 2a str. 2457T
uacgccgcaucuggcaua

SEQ ID NO: 1886337 - RNA, 15 nt, Shigella flexneri 2a str. 2457T
uacuaaucucaccca

SEQ ID NO: 1886338 - RNA, 14 nt, Shigella flexneri 2a str. 2457T
uacugauugacgcg

SEQ ID NO: 1886339 - RNA, 14 nt, Shigella flexneri 2a str. 2457T
uacuucugaccagg

SEQ ID NO: 1886340 - RNA, 24 nt, Shigella flexneri 2a str. 2457T
uacgcaaaaccucuuccagcagau

SEQ ID NO: 1886341 - RNA, 17 nt, Shigella flexneri 2a str. 2457T
uacgcagacguaagcgg

SEQ ID NO: 1886342 - RNA, 17 nt, Shigella flexneri 2a str. 2457T
uacgcaucaccagacaa

SEQ ID NO: 1886343 - RNA, 19 nt, Shigella flexneri 2a str. 2457T
uacgcauaugcaucagauc

SEQ ID NO: 1886344 - RNA, 14 nt, Shigella flexneri 2a str. 2457T
uacgccagacugcg

SEQ ID NO: 1886345 - RNA, 16 nt, Shigella flexneri 2a str. 2457T
uacgcccucgaucggc

SEQ ID NO: 1886346 - RNA, 15 nt, Shigella flexneri 2a str. 2457T
uaccgucgaugccaa

SEQ ID NO: 1886347 - RNA, 18 nt, Shigella flexneri 2a str. 2457T
uaccgucuguaaccagau

SEQ ID NO: 1886348 - RNA, 17 nt, Shigella flexneri 2a str. 2457T
uaccggugccagcaacu

SEQ ID NO: 1886349 - RNA, 21 nt, Shigella flexneri 2a str. 2457T
uaccgucagcgaucagcauuu

SEQ ID NO: 1886350 - RNA, 18 nt, Shigella flexneri 2a str. 2457T
uaccgccgaucucaccga

SEQ ID NO: 1886351 - RNA, 20 nt, Shigella flexneri 2a str. 2457T
uaccgccgaucucaccgauc

SEQ ID NO: 1886352 - RNA, 19 nt, Shigella flexneri 2a str. 2457T
uaccgauuacucagcaacu

SEQ ID NO: 1886353 - RNA, 13 nt, Shigella flexneri 2a str. 2457T
uaccggacuccag

SEQ ID NO: 1886354 - RNA, 16 nt, Shigella flexneri 2a str. 2457T
uaccggcacuggcagc

SEQ ID NO: 1886355 - RNA, 16 nt, Shigella flexneri 2a str. 2457T
uaccgcguaauacauc

SEQ ID NO: 1886356 - RNA, 20 nt, Shigella flexneri 2a str. 2457T
uacauacuuaaauaaugcuu

SEQ ID NO: 1886357 - RNA, 12 nt, Shigella flexneri 2a str. 2457T
uacaucagcgac

SEQ ID NO: 1886358 - RNA, 17 nt, Shigella flexneri 2a str. 2457T
uaccaauaaacuucaau

SEQ ID NO: 1886359 - RNA, 19 nt, Shigella flexneri 2a str. 2457T
uacauccacugcauacuga

SEQ ID NO: 1886360 - RNA, 19 nt, Shigella flexneri 2a str. 2457T
uaccagcgacaucaccgcc

SEQ ID NO: 1886361 - RNA, 23 nt, Shigella flexneri 2a str. 2457T
uaccagauuaauuauugauucca

SEQ ID NO: 1886362 - RNA, 20 nt, Shigella flexneri 2a str. 2457T
uaccagcagcccugccggaa

SEQ ID NO: 1886363 - RNA, 13 nt, Shigella flexneri 2a str. 2457T
uaccacuacauca

SEQ ID NO: 1886364 - RNA, 22 nt, Shigella flexneri 2a str. 2457T
uaccacuucauccggauacagc

SEQ ID NO: 1886365 - RNA, 13 nt, Shigella flexneri 2a str. 2457T
uaccacaaccugc

SEQ ID NO: 1886366 - RNA, 22 nt, Shigella flexneri 2a str. 2457T
uacccggccuguuuauccauca

SEQ ID NO: 1886367 - RNA, 21 nt, Shigella flexneri 2a str. 2457T
uacccgcuggcguaccaucuu

SEQ ID NO: 1886368 - RNA, 23 nt, Shigella flexneri 2a str. 2457T
uacccgauggcgugcccggguca

SEQ ID NO: 1886369 - RNA, 18 nt, Shigella flexneri 2a str. 2457T
uacccuucaucacgcagc

SEQ ID NO: 1886370 - RNA, 18 nt, Shigella flexneri 2a str. 2457T
uacccaaaucgcccgguu

SEQ ID NO: 1886371 - RNA, 19 nt, Shigella flexneri 2a str. 2457T
uacccagcacggauaccgc

SEQ ID NO: 1886372 - RNA, 15 nt, Shigella flexneri 2a str. 2457T
uacccaggccugccc

SEQ ID NO: 1886373 - RNA, 14 nt, Shigella flexneri 2a str. 2457T
guuaacaaucacaa

SEQ ID NO: 1886374 - RNA, 13 nt, Shigella flexneri 2a str. 2457T
guuaagcaauacc

SEQ ID NO: 1886375 - RNA, 22 nt, Shigella flexneri 2a str. 2457T
guuaacugcuuaucaucacgca

SEQ ID NO: 1886376 - RNA, 18 nt, Shigella flexneri 2a str. 2457T
guuaauaaaauuuacagu

SEQ ID NO: 1886377 - RNA, 22 nt, Shigella flexneri 2a str. 2457T
guguucacgccgcauccggcau

SEQ ID NO: 1886378 - RNA, 16 nt, Shigella flexneri 2a str. 2457T
guguuaaccaacggcg

SEQ ID NO: 1886379 - RNA, 13 nt, Shigella flexneri 2a str. 2457T
guguggcgcgcca

SEQ ID NO: 1886380 - RNA, 15 nt, Shigella flexneri 2a str. 2457T
gugugccaccagcgc

SEQ ID NO: 1886381 - RNA, 14 nt, Shigella flexneri 2a str. 2457T
gugucauggcugac

SEQ ID NO: 1886382 - RNA, 16 nt, Shigella flexneri 2a str. 2457T
gugguuucgccagcac

SEQ ID NO: 1886383 - RNA, 18 nt, Shigella flexneri 2a str. 2457T
guguaagaaaggcagagu

SEQ ID NO: 1886384 - RNA, 14 nt, Shigella flexneri 2a str. 2457T
gugguugucgcagg

SEQ ID NO: 1886385 - RNA, 15 nt, Shigella flexneri 2a str. 2457T
gugguguagggcagg

SEQ ID NO: 1886386 - RNA, 16 nt, Shigella flexneri 2a str. 2457T
gugcguggcgauacgg

SEQ ID NO: 1886387 - RNA, 21 nt, Shigella flexneri 2a str. 2457T
guucaucaagcugugccugaa

SEQ ID NO: 1886388 - RNA, 22 nt, Shigella flexneri 2a str. 2457T
guuccagcuucagauucagcgu

SEQ ID NO: 1886389 - RNA, 20 nt, Shigella flexneri 2a str. 2457T
guuccacauaaaguagccaa

SEQ ID NO: 1886390 - RNA, 20 nt, Shigella flexneri 2a str. 2457T
guuccagcaucuccugcaac

SEQ ID NO: 1886391 - RNA, 12 nt, Shigella flexneri 2a str. 2457T
guuccacuauuu

SEQ ID NO: 1886392 - RNA, 22 nt, Shigella flexneri 2a str. 2457T
guucaggucggugugaaugacu

SEQ ID NO: 1886393 - RNA, 23 nt, Shigella flexneri 2a str. 2457T
guucagcguacguucauggcgcg

SEQ ID NO: 1886394 - RNA, 23 nt, Shigella flexneri 2a str. 2457T
guucagcggcccguuggugcggu

SEQ ID NO: 1886395 - RNA, 13 nt, Shigella flexneri 2a str. 2457T
guucacugccgua

SEQ ID NO: 1886396 - RNA, 21 nt, Shigella flexneri 2a str. 2457T
guucacuuaaucucugacgcg

SEQ ID NO: 1886397 - RNA, 19 nt, Shigella flexneri 2a str. 2457T
guucagaaagcgccagcaa

SEQ ID NO: 1886398 - RNA, 20 nt, Shigella flexneri 2a str. 2457T
guuaauuuuucaaacucuuc

SEQ ID NO: 1886399 - RNA, 17 nt, Shigella flexneri 2a str. 2457T
guuacgccccgguuucu

SEQ ID NO: 1886400 - RNA, 16 nt, Shigella flexneri 2a str. 2457T
guuacccgacgcgcca

SEQ ID NO: 1886401 - RNA, 18 nt, Shigella flexneri 2a str. 2457T
guuagcgggucaggucgu

SEQ ID NO: 1886402 - RNA, 14 nt, Shigella flexneri 2a str. 2457T
guuagcucaacgca

SEQ ID NO: 1886403 - RNA, 15 nt, Shigella flexneri 2a str. 2457T
guuacggaucucccg

SEQ ID NO: 1886404 - RNA, 18 nt, Shigella flexneri 2a str. 2457T
guuagaaaacgccugcuc

SEQ ID NO: 1886405 - RNA, 23 nt, Shigella flexneri 2a str. 2457T
guuaucuaccgcaccuuccggaa

SEQ ID NO: 1886406 - RNA, 23 nt, Shigella flexneri 2a str. 2457T
guuaucgcucgucgcgacgacca

SEQ ID NO: 1886407 - RNA, 17 nt, Shigella flexneri 2a str. 2457T
guuaucagcaacuggca

SEQ ID NO: 1886408 - RNA, 16 nt, Shigella flexneri 2a str. 2457T
guuauccgccaguuug

SEQ ID NO: 1886409 - RNA, 23 nt, Shigella flexneri 2a str. 2457T
guuauccugaucaagcacaugcu

SEQ ID NO: 1886410 - RNA, 18 nt, Shigella flexneri 2a str. 2457T
guucaacgcccgcuuuca

SEQ ID NO: 1886411 - RNA, 17 nt, Shigella flexneri 2a str. 2457T
guucaacagauuucgaa

SEQ ID NO: 1886412 - RNA, 19 nt, Shigella flexneri 2a str. 2457T
guucaaugcgaucuacccg

SEQ ID NO: 1886413 - RNA, 21 nt, Shigella flexneri 2a str. 2457T
guuccggcaugauucauccgu

SEQ ID NO: 1886414 - RNA, 16 nt, Shigella flexneri 2a str. 2457T
guuccgcugcugacuu

SEQ ID NO: 1886415 - RNA, 22 nt, Shigella flexneri 2a str. 2457T
guuccggcaacgacgucgauuu

SEQ ID NO: 1886416 - RNA, 15 nt, Shigella flexneri 2a str. 2457T
guuccugcaucgccu

SEQ ID NO: 1886417 - RNA, 20 nt, Shigella flexneri 2a str. 2457T
guucgacaagcguuagcgug

SEQ ID NO: 1886418 - RNA, 16 nt, Shigella flexneri 2a str. 2457T
guucgauggcgcgcca

SEQ ID NO: 1886419 - RNA, 20 nt, Shigella flexneri 2a str. 2457T
guucugccgcgcacgucagc

SEQ ID NO: 1886420 - RNA, 13 nt, Shigella flexneri 2a str. 2457T
guucuguggcagg

SEQ ID NO: 1886421 - RNA, 18 nt, Shigella flexneri 2a str. 2457T
guucgcgcgcugccagaa

SEQ ID NO: 1886422 - RNA, 13 nt, Shigella flexneri 2a str. 2457T
guugcccagcgca

SEQ ID NO: 1886423 - RNA, 12 nt, Shigella flexneri 2a str. 2457T
guugccaucauc

SEQ ID NO: 1886424 - RNA, 20 nt, Shigella flexneri 2a str. 2457T
guugauguuuggccgcgcca

SEQ ID NO: 1886425 - RNA, 23 nt, Shigella flexneri 2a str. 2457T
guugaucgccccggaagcaucaa

SEQ ID NO: 1886426 - RNA, 12 nt, Shigella flexneri 2a str. 2457T
guugaucgccac

SEQ ID NO: 1886427 - RNA, 14 nt, Shigella flexneri 2a str. 2457T
guugcgccgggaug

SEQ ID NO: 1886428 - RNA, 16 nt, Shigella flexneri 2a str. 2457T
guuuaaggcaguucuc

SEQ ID NO: 1886429 - RNA, 16 nt, Shigella flexneri 2a str. 2457T
guugugucgccagcaa

SEQ ID NO: 1886430 - RNA, 22 nt, Shigella flexneri 2a str. 2457T
guugucgguaauugcgccguug

SEQ ID NO: 1886431 - RNA, 17 nt, Shigella flexneri 2a str. 2457T
guuggguucacuuuccc

SEQ ID NO: 1886432 - RNA, 19 nt, Shigella flexneri 2a str. 2457T
guugcugagaucaaacucu

SEQ ID NO: 1886433 - RNA, 23 nt, Shigella flexneri 2a str. 2457T
ucccgcuguuuguucaagcgcaa

SEQ ID NO: 1886434 - RNA, 22 nt, Shigella flexneri 2a str. 2457T
ucccgaaaaaccugacguuguu

SEQ ID NO: 1886435 - RNA, 21 nt, Shigella flexneri 2a str. 2457T
uccccugcccgcgauccagcg

SEQ ID NO: 1886436 - RNA, 14 nt, Shigella flexneri 2a str. 2457T
uccccuccagcgag

SEQ ID NO: 1886437 - RNA, 16 nt, Shigella flexneri 2a str. 2457T
uccccgagcacaugca

SEQ ID NO: 1886438 - RNA, 17 nt, Shigella flexneri 2a str. 2457T
uccccgaagacgugcgc

SEQ ID NO: 1886439 - RNA, 23 nt, Shigella flexneri 2a str. 2457T
ucccagccucccauuuccuguaa

SEQ ID NO: 1886440 - RNA, 23 nt, Shigella flexneri 2a str. 2457T
ucccacugacgcucggcgcaauc

SEQ ID NO: 1886441 - RNA, 11 nt, Shigella flexneri 2a str. 2457T
uccauacagcu

SEQ ID NO: 1886442 - RNA, 20 nt, Shigella flexneri 2a str. 2457T
ucccagucauccggcucgua

SEQ ID NO: 1886443 - RNA, 13 nt, Shigella flexneri 2a str. 2457T
ucccagcgcguuc

SEQ ID NO: 1886444 - RNA, 20 nt, Shigella flexneri 2a str. 2457T
uccgcgucaaucugcccgac

SEQ ID NO: 1886445 - RNA, 14 nt, Shigella flexneri 2a str. 2457T
uccgcugagacgcg

SEQ ID NO: 1886446 - RNA, 13 nt, Shigella flexneri 2a str. 2457T
uccggcaaggcgc

SEQ ID NO: 1886447 - RNA, 16 nt, Shigella flexneri 2a str. 2457T
uccggaucgccaaagc

SEQ ID NO: 1886448 - RNA, 22 nt, Shigella flexneri 2a str. 2457T
uccggaucgccaaagcggcagu

SEQ ID NO: 1886449 - RNA, 14 nt, Shigella flexneri 2a str. 2457T
uccggcgucgaaaa

SEQ ID NO: 1886450 - RNA, 12 nt, Shigella flexneri 2a str. 2457T
uccggcgcaauu

SEQ ID NO: 1886451 - RNA, 21 nt, Shigella flexneri 2a str. 2457T
uccggcgggucgcugccgaua

SEQ ID NO: 1886452 - RNA, 13 nt, Shigella flexneri 2a str. 2457T
uccgcaaagccca

SEQ ID NO: 1886453 - RNA, 16 nt, Shigella flexneri 2a str. 2457T
uccgcaaauaacguaa

SEQ ID NO: 1886454 - RNA, 18 nt, Shigella flexneri 2a str. 2457T
uccgccauccaccagcau

SEQ ID NO: 1886455 - RNA, 15 nt, Shigella flexneri 2a str. 2457T
uccgacaucaaccgc

SEQ ID NO: 1886456 - RNA, 15 nt, Shigella flexneri 2a str. 2457T
uccgauucccgcaac

SEQ ID NO: 1886457 - RNA, 14 nt, Shigella flexneri 2a str. 2457T
uccaguuucacaaa

SEQ ID NO: 1886458 - RNA, 19 nt, Shigella flexneri 2a str. 2457T
uccagugcauccagcacga

SEQ ID NO: 1886459 - RNA, 12 nt, Shigella flexneri 2a str. 2457T
uccagucgcugc

SEQ ID NO: 1886460 - RNA, 16 nt, Shigella flexneri 2a str. 2457T
uccagucgcugcugac

SEQ ID NO: 1886461 - RNA, 17 nt, Shigella flexneri 2a str. 2457T
uccagugccucaagaau

SEQ ID NO: 1886462 - RNA, 16 nt, Shigella flexneri 2a str. 2457T
uccagugcauccagca

SEQ ID NO: 1886463 - RNA, 17 nt, Shigella flexneri 2a str. 2457T
uccagcgauuccgggua

SEQ ID NO: 1886464 - RNA, 17 nt, Shigella flexneri 2a str. 2457T
uccagcgcaauaccgau

SEQ ID NO: 1886465 - RNA, 22 nt, Shigella flexneri 2a str. 2457T
uccagcagaccuucugccagac

SEQ ID NO: 1886466 - RNA, 15 nt, Shigella flexneri 2a str. 2457T
uccaccagcgcguag

SEQ ID NO: 1886467 - RNA, 13 nt, Shigella flexneri 2a str. 2457T
uccaccaucacgc

SEQ ID NO: 1886468 - RNA, 12 nt, Shigella flexneri 2a str. 2457T
ucauuagcccaa

SEQ ID NO: 1886469 - RNA, 21 nt, Shigella flexneri 2a str. 2457T
ucauuagcccaauaaucaccg

SEQ ID NO: 1886470 - RNA, 17 nt, Shigella flexneri 2a str. 2457T
ucauuuauguucagccg

SEQ ID NO: 1886471 - RNA, 22 nt, Shigella flexneri 2a str. 2457T
uccacgccaagcucauaacggc

SEQ ID NO: 1886472 - RNA, 21 nt, Shigella flexneri 2a str. 2457T
uccaccuuaucgacaugcggu

SEQ ID NO: 1886473 - RNA, 16 nt, Shigella flexneri 2a str. 2457T
uccagauaaguuugcc

SEQ ID NO: 1886474 - RNA, 17 nt, Shigella flexneri 2a str. 2457T
uccagauaauaaucaac

SEQ ID NO: 1886475 - RNA, 15 nt, Shigella flexneri 2a str. 2457T
ucauccugcugcacg

SEQ ID NO: 1886476 - RNA, 19 nt, Shigella flexneri 2a str. 2457T
ucauccggcacgcuaccau

SEQ ID NO: 1886477 - RNA, 17 nt, Shigella flexneri 2a str. 2457T
ucaucccggaugcgucg

SEQ ID NO: 1886478 - RNA, 14 nt, Shigella flexneri 2a str. 2457T
ucaucaaacgucuu

SEQ ID NO: 1886479 - RNA, 20 nt, Shigella flexneri 2a str. 2457T
ucauccuucauuauccuucg

SEQ ID NO: 1886480 - RNA, 14 nt, Shigella flexneri 2a str. 2457T
ucaucgaccccagg

SEQ ID NO: 1886481 - RNA, 22 nt, Shigella flexneri 2a str. 2457T
ucaucgcaaacccaaccgguaa

SEQ ID NO: 1886482 - RNA, 14 nt, Shigella flexneri 2a str. 2457T
ucaucgcaucgccu

SEQ ID NO: 1886483 - RNA, 17 nt, Shigella flexneri 2a str. 2457T
ucaucgcauccagugcg

SEQ ID NO: 1886484 - RNA, 19 nt, Shigella flexneri 2a str. 2457T
ucaucguugaucuguaacg

SEQ ID NO: 1886485 - RNA, 22 nt, Shigella flexneri 2a str. 2457T
ucaucguugaucuguaacgcac

SEQ ID NO: 1886486 - RNA, 16 nt, Shigella flexneri 2a str. 2457T
ucauuaagaacuccug

SEQ ID NO: 1886487 - RNA, 15 nt, Shigella flexneri 2a str. 2457T
ucauuacaaccgcug

SEQ ID NO: 1886488 - RNA, 22 nt, Shigella flexneri 2a str. 2457T
ucaugcugcggcuguccggcac

SEQ ID NO: 1886489 - RNA, 24 nt, Shigella flexneri 2a str. 2457T
ucaugcugcuggguguagcgcauc

SEQ ID NO: 1886490 - RNA, 15 nt, Shigella flexneri 2a str. 2457T
ucaucuggcguacca

SEQ ID NO: 1886491 - RNA, 15 nt, Shigella flexneri 2a str. 2457T
ucaucugcaccgauu

SEQ ID NO: 1886492 - RNA, 20 nt, Shigella flexneri 2a str. 2457T
ucaugccuacaaccguugcc

SEQ ID NO: 1886493 - RNA, 20 nt, Shigella flexneri 2a str. 2457T
ucaggcguuuacgccgcauc

SEQ ID NO: 1886494 - RNA, 20 nt, Shigella flexneri 2a str. 2457T
ucaggcuguguuuaagacgc

SEQ ID NO: 1886495 - RNA, 14 nt, Shigella flexneri 2a str. 2457T
ucagccugacagca

SEQ ID NO: 1886496 - RNA, 16 nt, Shigella flexneri 2a str. 2457T
ucagcgaacaccagca

SEQ ID NO: 1886497 - RNA, 14 nt, Shigella flexneri 2a str. 2457T
ucaguagcgcaauc

SEQ ID NO: 1886498 - RNA, 15 nt, Shigella flexneri 2a str. 2457T
ucauacgaacgccug

SEQ ID NO: 1886499 - RNA, 16 nt, Shigella flexneri 2a str. 2457T
ucauagguaaacauca

SEQ ID NO: 1886500 - RNA, 19 nt, Shigella flexneri 2a str. 2457T
ucauaggucaguguaccgg

SEQ ID NO: 1886501 - RNA, 22 nt, Shigella flexneri 2a str. 2457T
ucacccggggugauaacgccug

SEQ ID NO: 1886502 - RNA, 22 nt, Shigella flexneri 2a str. 2457T
ucacccacguuacgcgaucguc

SEQ ID NO: 1886503 - RNA, 23 nt, Shigella flexneri 2a str. 2457T
ucaccauaaaacgcgcuacugaa

SEQ ID NO: 1886504 - RNA, 23 nt, Shigella flexneri 2a str. 2457T
ucaccauaaagggaauaaauucg

SEQ ID NO: 1886505 - RNA, 14 nt, Shigella flexneri 2a str. 2457T
ucaccagccugcaa

SEQ ID NO: 1886506 - RNA, 17 nt, Shigella flexneri 2a str. 2457T
ucaccagccugcaaacg

SEQ ID NO: 1886507 - RNA, 14 nt, Shigella flexneri 2a str. 2457T
ucaccagcgcauug

SEQ ID NO: 1886508 - RNA, 22 nt, Shigella flexneri 2a str. 2457T
ucaccagcaaauccagcgguug

SEQ ID NO: 1886509 - RNA, 13 nt, Shigella flexneri 2a str. 2457T
ucaccacuguuaa

SEQ ID NO: 1886510 - RNA, 19 nt, Shigella flexneri 2a str. 2457T
ucaccagcaguaaaccgcu

SEQ ID NO: 1886511 - RNA, 19 nt, Shigella flexneri 2a str. 2457T
ucaaugcggcggcgcaccg

SEQ ID NO: 1886512 - RNA, 21 nt, Shigella flexneri 2a str. 2457T
ucaauuaccaacucaucgccg

SEQ ID NO: 1886513 - RNA, 22 nt, Shigella flexneri 2a str. 2457T
ucacaugcuggaaccacagcgc

SEQ ID NO: 1886514 - RNA, 16 nt, Shigella flexneri 2a str. 2457T
ucacagucugaaugcc

SEQ ID NO: 1886515 - RNA, 21 nt, Shigella flexneri 2a str. 2457T
ucacacuccagucccaguuca

SEQ ID NO: 1886516 - RNA, 16 nt, Shigella flexneri 2a str. 2457T
ucacauccugauagca

SEQ ID NO: 1886517 - RNA, 18 nt, Shigella flexneri 2a str. 2457T
ucacgcgcaucuguaacg

SEQ ID NO: 1886518 - RNA, 21 nt, Shigella flexneri 2a str. 2457T
ucacgcgcaucuguaacggag

SEQ ID NO: 1886519 - RNA, 18 nt, Shigella flexneri 2a str. 2457T
ucacgccgcauccggcaa

SEQ ID NO: 1886520 - RNA, 20 nt, Shigella flexneri 2a str. 2457T
ucaccugcacaccaaccgcu

SEQ ID NO: 1886521 - RNA, 19 nt, Shigella flexneri 2a str. 2457T
ucacgccgcauccggcaua

SEQ ID NO: 1886522 - RNA, 16 nt, Shigella flexneri 2a str. 2457T
ucaccuaacagcaucg

SEQ ID NO: 1886523 - RNA, 13 nt, Shigella flexneri 2a str. 2457T
ucagaagacgcuc

SEQ ID NO: 1886524 - RNA, 19 nt, Shigella flexneri 2a str. 2457T
ucacuuuugccagacgaau

SEQ ID NO: 1886525 - RNA, 21 nt, Shigella flexneri 2a str. 2457T
ucagaaagcccgaaucaguaa

SEQ ID NO: 1886526 - RNA, 20 nt, Shigella flexneri 2a str. 2457T
ucagaaaugccaguaacuca

SEQ ID NO: 1886527 - RNA, 16 nt, Shigella flexneri 2a str. 2457T
ucacuauguaauccug

SEQ ID NO: 1886528 - RNA, 12 nt, Shigella flexneri 2a str. 2457T
ucacucaccgca

SEQ ID NO: 1886529 - RNA, 21 nt, Shigella flexneri 2a str. 2457T
ucacuauuucuuuguagauga

SEQ ID NO: 1886530 - RNA, 14 nt, Shigella flexneri 2a str. 2457T
ucacuuucuggcag

SEQ ID NO: 1886531 - RNA, 19 nt, Shigella flexneri 2a str. 2457T
ucacggucagcauauccag

SEQ ID NO: 1886532 - RNA, 16 nt, Shigella flexneri 2a str. 2457T
ucacuaaaacaggcuu

SEQ ID NO: 1886533 - RNA, 14 nt, Shigella flexneri 2a str. 2457T
ucagcccggcaacg

SEQ ID NO: 1886534 - RNA, 16 nt, Shigella flexneri 2a str. 2457T
ucagccaaauccagcg

SEQ ID NO: 1886535 - RNA, 14 nt, Shigella flexneri 2a str. 2457T
ucagcauaaucacc

SEQ ID NO: 1886536 - RNA, 17 nt, Shigella flexneri 2a str. 2457T
ucagcaugauucaccgu

SEQ ID NO: 1886537 - RNA, 22 nt, Shigella flexneri 2a str. 2457T
ucagcacuucacccaucgccag

SEQ ID NO: 1886538 - RNA, 15 nt, Shigella flexneri 2a str. 2457T
ucagauuguugauua

SEQ ID NO: 1886539 - RNA, 16 nt, Shigella flexneri 2a str. 2457T
ucagaugcugcggcgg

SEQ ID NO: 1886540 - RNA, 13 nt, Shigella flexneri 2a str. 2457T
ucagacaccgauu

SEQ ID NO: 1886541 - RNA, 20 nt, Shigella flexneri 2a str. 2457T
ucagaaugcccacgccgcau

SEQ ID NO: 1886542 - RNA, 21 nt, Shigella flexneri 2a str. 2457T
ucagauaaaugcaaacgcauc

SEQ ID NO: 1886543 - RNA, 16 nt, Shigella flexneri 2a str. 2457T
ucaaucugauagugau

SEQ ID NO: 1886544 - RNA, 18 nt, Shigella flexneri 2a str. 2457T
ucaaucaucucucgcauc

SEQ ID NO: 1886545 - RNA, 15 nt, Shigella flexneri 2a str. 2457T
ucaauaaacgccugc

SEQ ID NO: 1886546 - RNA, 13 nt, Shigella flexneri 2a str. 2457T
ucaagacaucaau

SEQ ID NO: 1886547 - RNA, 15 nt, Shigella flexneri 2a str. 2457T
ucaagaaugacgcca

SEQ ID NO: 1886548 - RNA, 17 nt, Shigella flexneri 2a str. 2457T
ucaagcacaaucacguc

SEQ ID NO: 1886549 - RNA, 13 nt, Shigella flexneri 2a str. 2457T
ucaagcgccgcca

SEQ ID NO: 1886550 - RNA, 16 nt, Shigella flexneri 2a str. 2457T
ucaaaggccgacagca

SEQ ID NO: 1886551 - RNA, 13 nt, Shigella flexneri 2a str. 2457T
ucaacacauccag

SEQ ID NO: 1886552 - RNA, 13 nt, Shigella flexneri 2a str. 2457T
ucaacaacacucu

SEQ ID NO: 1886553 - RNA, 19 nt, Shigella flexneri 2a str. 2457T
ucaacaaacgauuuaucga

SEQ ID NO: 1886554 - RNA, 21 nt, Shigella flexneri 2a str. 2457T
ucaacaaaauagaauccgcga

SEQ ID NO: 1886555 - RNA, 13 nt, Shigella flexneri 2a str. 2457T
ucaacaucgcguu

SEQ ID NO: 1886556 - RNA, 21 nt, Shigella flexneri 2a str. 2457T
ucaacauucccugcaccggug

SEQ ID NO: 1886557 - RNA, 22 nt, Shigella flexneri 2a str. 2457T
ucaaccacucaccgcuggcgua

SEQ ID NO: 1886558 - RNA, 13 nt, Shigella flexneri 2a str. 2457T
ucaacccauuucg

SEQ ID NO: 1886559 - RNA, 22 nt, Shigella flexneri 2a str. 2457T
ucaacgacccagccagacgcca

SEQ ID NO: 1886560 - RNA, 16 nt, Shigella flexneri 2a str. 2457T
ucaacgaugccuuaug

SEQ ID NO: 1886561 - RNA, 15 nt, Shigella flexneri 2a str. 2457T
ucaacgccaucgcca

SEQ ID NO: 1886562 - RNA, 17 nt, Shigella flexneri 2a str. 2457T
ucaacgccaucgccagg

SEQ ID NO: 1886563 - RNA, 14 nt, Shigella flexneri 2a str. 2457T
uauuucacuucaac

SEQ ID NO: 1886564 - RNA, 22 nt, Shigella flexneri 2a str. 2457T
uauuucccagauagcaacagca

SEQ ID NO: 1886565 - RNA, 16 nt, Shigella flexneri 2a str. 2457T
uauuuucggcaccuuu

SEQ ID NO: 1886566 - RNA, 18 nt, Shigella flexneri 2a str. 2457T
uauuuugcuuccggcaag

SEQ ID NO: 1886567 - RNA, 19 nt, Shigella flexneri 2a str. 2457T
ucaaaacggucacggcugu

SEQ ID NO: 1886568 - RNA, 15 nt, Shigella flexneri 2a str. 2457T
uaugcuuugccguca

SEQ ID NO: 1886569 - RNA, 20 nt, Shigella flexneri 2a str. 2457T
uaugccuguccucuucagca

SEQ ID NO: 1886570 - RNA, 15 nt, Shigella flexneri 2a str. 2457T
uaugcugcgccaguu

SEQ ID NO: 1886571 - RNA, 14 nt, Shigella flexneri 2a str. 2457T
uaugccuggcauuu

SEQ ID NO: 1886572 - RNA, 13 nt, Shigella flexneri 2a str. 2457T
uaugcgcauugcc

SEQ ID NO: 1886573 - RNA, 13 nt, Shigella flexneri 2a str. 2457T
uauuaucuaucgc

SEQ ID NO: 1886574 - RNA, 22 nt, Shigella flexneri 2a str. 2457T
uauugaauuuacgggccggaua

SEQ ID NO: 1886575 - RNA, 17 nt, Shigella flexneri 2a str. 2457T
uauucuugacgccauuu

SEQ ID NO: 1886576 - RNA, 18 nt, Shigella flexneri 2a str. 2457T
uauugccgaagaccagau

SEQ ID NO: 1886577 - RNA, 20 nt, Shigella flexneri 2a str. 2457T
uagcgggugaagagauccac

SEQ ID NO: 1886578 - RNA, 14 nt, Shigella flexneri 2a str. 2457T
uaucgaacguccag

SEQ ID NO: 1886579 - RNA, 20 nt, Shigella flexneri 2a str. 2457T
uaucgcacagaugcgacggc

SEQ ID NO: 1886580 - RNA, 19 nt, Shigella flexneri 2a str. 2457T
uaucgauuucuacacccag

SEQ ID NO: 1886581 - RNA, 17 nt, Shigella flexneri 2a str. 2457T
uaucgacagacgccagc

SEQ ID NO: 1886582 - RNA, 17 nt, Shigella flexneri 2a str. 2457T
uaucgauaaauggcgca

SEQ ID NO: 1886583 - RNA, 16 nt, Shigella flexneri 2a str. 2457T
uaucgcgauacaccag

SEQ ID NO: 1886584 - RNA, 19 nt, Shigella flexneri 2a str. 2457T
uaucgcccugcuccagcaa

SEQ ID NO: 1886585 - RNA, 15 nt, Shigella flexneri 2a str. 2457T
uaucucaccccauuu

SEQ ID NO: 1886586 - RNA, 18 nt, Shigella flexneri 2a str. 2457T
uaucuuccagggugacaa

SEQ ID NO: 1886587 - RNA, 21 nt, Shigella flexneri 2a str. 2457T
uaucuucccgccguugccgca

SEQ ID NO: 1886588 - RNA, 14 nt, Shigella flexneri 2a str. 2457T
uaugaucuugcccg

SEQ ID NO: 1886589 - RNA, 14 nt, Shigella flexneri 2a str. 2457T
uaugcccuuucaau

SEQ ID NO: 1886590 - RNA, 15 nt, Shigella flexneri 2a str. 2457T
uaugccucaacccuu

SEQ ID NO: 1886591 - RNA, 16 nt, Shigella flexneri 2a str. 2457T
uaugccugauuacggu

SEQ ID NO: 1886592 - RNA, 18 nt, Shigella flexneri 2a str. 2457T
uaugcagugcauccagca

SEQ ID NO: 1886593 - RNA, 19 nt, Shigella flexneri 2a str. 2457T
ugaagaacaaguucaagau

SEQ ID NO: 1886594 - RNA, 18 nt, Shigella flexneri 2a str. 2457T
ugaagcugauugcggaga

SEQ ID NO: 1886595 - RNA, 23 nt, Shigella flexneri 2a str. 2457T
ugaagcucacuucgcuuacgccu

SEQ ID NO: 1886596 - RNA, 15 nt, Shigella flexneri 2a str. 2457T
ugaaggcggcgcauc

SEQ ID NO: 1886597 - RNA, 17 nt, Shigella flexneri 2a str. 2457T
ugaauuucacuucgcca

SEQ ID NO: 1886598 - RNA, 16 nt, Shigella flexneri 2a str. 2457T
ugaauuacgcaaacgu

SEQ ID NO: 1886599 - RNA, 16 nt, Shigella flexneri 2a str. 2457T
ugacaaagugcgcuuu

SEQ ID NO: 1886600 - RNA, 22 nt, Shigella flexneri 2a str. 2457T
ugaaucgucagacgaugcgucu

SEQ ID NO: 1886601 - RNA, 22 nt, Shigella flexneri 2a str. 2457T
ugaaucccugcgaacugcgcag

SEQ ID NO: 1886602 - RNA, 15 nt, Shigella flexneri 2a str. 2457T
ugaaugccgcuaccg

SEQ ID NO: 1886603 - RNA, 19 nt, Shigella flexneri 2a str. 2457T
ugaaucgucggaauggcau

SEQ ID NO: 1886604 - RNA, 17 nt, Shigella flexneri 2a str. 2457T
ugaaagcucauaacgga

SEQ ID NO: 1886605 - RNA, 23 nt, Shigella flexneri 2a str. 2457T
ugaaaggcgcgguuucugcuugu

SEQ ID NO: 1886606 - RNA, 21 nt, Shigella flexneri 2a str. 2457T
ugaaacggaaucgcccgcugu

SEQ ID NO: 1886607 - RNA, 20 nt, Shigella flexneri 2a str. 2457T
ucuuugcuuccugaguaaua

SEQ ID NO: 1886608 - RNA, 18 nt, Shigella flexneri 2a str. 2457T
ucuuugccugaucgguga

SEQ ID NO: 1886609 - RNA, 15 nt, Shigella flexneri 2a str. 2457T
ucucccagccgcccu

SEQ ID NO: 1886610 - RNA, 17 nt, Shigella flexneri 2a str. 2457T
ugaacuguacaaagccg

SEQ ID NO: 1886611 - RNA, 20 nt, Shigella flexneri 2a str. 2457T
ugaacgcaccuuccaguuug

SEQ ID NO: 1886612 - RNA, 21 nt, Shigella flexneri 2a str. 2457T
ugaacgaaaagcgcacaacgu

SEQ ID NO: 1886613 - RNA, 22 nt, Shigella flexneri 2a str. 2457T
ugaaccagauaucgcggauaug

SEQ ID NO: 1886614 - RNA, 13 nt, Shigella flexneri 2a str. 2457T
ugaaauugcuggu

SEQ ID NO: 1886615 - RNA, 14 nt, Shigella flexneri 2a str. 2457T
ugaaaucacgcauc

SEQ ID NO: 1886616 - RNA, 13 nt, Shigella flexneri 2a str. 2457T
ugaaaugcggcga

SEQ ID NO: 1886617 - RNA, 21 nt, Shigella flexneri 2a str. 2457T
ugacagcggugauuuccgccg

SEQ ID NO: 1886618 - RNA, 23 nt, Shigella flexneri 2a str. 2457T
ugacaggcgggaagaacggcaac

SEQ ID NO: 1886619 - RNA, 14 nt, Shigella flexneri 2a str. 2457T
ugacaguagccuuu

SEQ ID NO: 1886620 - RNA, 17 nt, Shigella flexneri 2a str. 2457T
ugacagaguuccggccc

SEQ ID NO: 1886621 - RNA, 19 nt, Shigella flexneri 2a str. 2457T
ugacagcgcccgacaagau

SEQ ID NO: 1886622 - RNA, 18 nt, Shigella flexneri 2a str. 2457T
ugacagauuuugccagca

SEQ ID NO: 1886623 - RNA, 21 nt, Shigella flexneri 2a str. 2457T
ugacauucaccucacgacgua

SEQ ID NO: 1886624 - RNA, 19 nt, Shigella flexneri 2a str. 2457T
ugacauaaacggcgcauug

SEQ ID NO: 1886625 - RNA, 14 nt, Shigella flexneri 2a str. 2457T
ugacaucagcaucc

SEQ ID NO: 1886626 - RNA, 18 nt, Shigella flexneri 2a str. 2457T
ugaccgucgaugaaagcg

SEQ ID NO: 1886627 - RNA, 16 nt, Shigella flexneri 2a str. 2457T
ugaccgugaucguggc

SEQ ID NO: 1886628 - RNA, 18 nt, Shigella flexneri 2a str. 2457T
ugaccugugccagccauu

SEQ ID NO: 1886629 - RNA, 14 nt, Shigella flexneri 2a str. 2457T
ugacgacaccaucu

SEQ ID NO: 1886630 - RNA, 15 nt, Shigella flexneri 2a str. 2457T
ugaccgcgaguaauc

SEQ ID NO: 1886631 - RNA, 20 nt, Shigella flexneri 2a str. 2457T
ugaccgcgaguaaucacauc

SEQ ID NO: 1886632 - RNA, 16 nt, Shigella flexneri 2a str. 2457T
ugaccgcuccgccauc

SEQ ID NO: 1886633 - RNA, 18 nt, Shigella flexneri 2a str. 2457T
ugaucuauaccaccgcuc

SEQ ID NO: 1886634 - RNA, 22 nt, Shigella flexneri 2a str. 2457T
ugaugcgcuacgcucaucaggc

SEQ ID NO: 1886635 - RNA, 17 nt, Shigella flexneri 2a str. 2457T
ugaucgccagcggaaua

SEQ ID NO: 1886636 - RNA, 16 nt, Shigella flexneri 2a str. 2457T
ugaucgaggcaaagag

SEQ ID NO: 1886637 - RNA, 14 nt, Shigella flexneri 2a str. 2457T
ugaucggcgagaua

SEQ ID NO: 1886638 - RNA, 13 nt, Shigella flexneri 2a str. 2457T
ugaucauccgccu

SEQ ID NO: 1886639 - RNA, 17 nt, Shigella flexneri 2a str. 2457T
ugauccgccgcgcggug

SEQ ID NO: 1886640 - RNA, 16 nt, Shigella flexneri 2a str. 2457T
ugauaaacccaacggc

SEQ ID NO: 1886641 - RNA, 22 nt, Shigella flexneri 2a str. 2457T
ugaguucccggcagggaagcuc

SEQ ID NO: 1886642 - RNA, 22 nt, Shigella flexneri 2a str. 2457T
ugcaauuuguggugaagccacc

SEQ ID NO: 1886643 - RNA, 20 nt, Shigella flexneri 2a str. 2457T
ugcaaucuuuaacggcggca

SEQ ID NO: 1886644 - RNA, 12 nt, Shigella flexneri 2a str. 2457T
ugcaaucaucuu

SEQ ID NO: 1886645 - RNA, 24 nt, Shigella flexneri 2a str. 2457T
ugcaaggcgagcaaucacuugcgc

SEQ ID NO: 1886646 - RNA, 18 nt, Shigella flexneri 2a str. 2457T
ugcaagacgaugacauua

SEQ ID NO: 1886647 - RNA, 23 nt, Shigella flexneri 2a str. 2457T
ugcaaacguaaaacugccugaug

SEQ ID NO: 1886648 - RNA, 12 nt, Shigella flexneri 2a str. 2457T
ugaugcguaccu

SEQ ID NO: 1886649 - RNA, 18 nt, Shigella flexneri 2a str. 2457T
ugauggaccgugccggac

SEQ ID NO: 1886650 - RNA, 14 nt, Shigella flexneri 2a str. 2457T
ugauuaacgccaga

SEQ ID NO: 1886651 - RNA, 14 nt, Shigella flexneri 2a str. 2457T
ugcaaaugccagau

SEQ ID NO: 1886652 - RNA, 15 nt, Shigella flexneri 2a str. 2457T
ugcaacugcgcggca

SEQ ID NO: 1886653 - RNA, 23 nt, Shigella flexneri 2a str. 2457T
ugcaaaauuuucauugccgcauc

SEQ ID NO: 1886654 - RNA, 16 nt, Shigella flexneri 2a str. 2457T
ugcaaaauauggggca

SEQ ID NO: 1886655 - RNA, 16 nt, Shigella flexneri 2a str. 2457T
ugauuccgaauccaac

SEQ ID NO: 1886656 - RNA, 16 nt, Shigella flexneri 2a str. 2457T
ugacggugauacagca

SEQ ID NO: 1886657 - RNA, 13 nt, Shigella flexneri 2a str. 2457T
ugacgcuggcaga

SEQ ID NO: 1886658 - RNA, 21 nt, Shigella flexneri 2a str. 2457T
ugacgcgucuuaucuggccua

SEQ ID NO: 1886659 - RNA, 21 nt, Shigella flexneri 2a str. 2457T
ugacgcauccgaucgcgcauc

SEQ ID NO: 1886660 - RNA, 20 nt, Shigella flexneri 2a str. 2457T
ugacgcacuuucgcuuuauc

SEQ ID NO: 1886661 - RNA, 21 nt, Shigella flexneri 2a str. 2457T
ugacgaugcuccacuccugcc

SEQ ID NO: 1886662 - RNA, 16 nt, Shigella flexneri 2a str. 2457T
ugacgcgggcagcaga

SEQ ID NO: 1886663 - RNA, 15 nt, Shigella flexneri 2a str. 2457T
ugacgcgggcagcag

SEQ ID NO: 1886664 - RNA, 20 nt, Shigella flexneri 2a str. 2457T
ugacgcgucuuaucaggccu

SEQ ID NO: 1886665 - RNA, 21 nt, Shigella flexneri 2a str. 2457T
ugagcaguagcgucgccagca

SEQ ID NO: 1886666 - RNA, 11 nt, Shigella flexneri 2a str. 2457T
ugagcgcaaau

SEQ ID NO: 1886667 - RNA, 17 nt, Shigella flexneri 2a str. 2457T
ugacucagcgucugaua

SEQ ID NO: 1886668 - RNA, 14 nt, Shigella flexneri 2a str. 2457T
ugacguaucaccga

SEQ ID NO: 1886669 - RNA, 16 nt, Shigella flexneri 2a str. 2457T
ugacugccccaguucc

SEQ ID NO: 1886670 - RNA, 14 nt, Shigella flexneri 2a str. 2457T
ugacugacuucaac

SEQ ID NO: 1886671 - RNA, 19 nt, Shigella flexneri 2a str. 2457T
ugacugcuuugcacaggca

SEQ ID NO: 1886672 - RNA, 17 nt, Shigella flexneri 2a str. 2457T
ugacuguaggccggaua

SEQ ID NO: 1886673 - RNA, 19 nt, Shigella flexneri 2a str. 2457T
ugagccaaaaugccugaug

SEQ ID NO: 1886674 - RNA, 19 nt, Shigella flexneri 2a str. 2457T
ugaggcgcuacgcuaucag

SEQ ID NO: 1886675 - RNA, 21 nt, Shigella flexneri 2a str. 2457T
ugcgacaaacauugcugccag

SEQ ID NO: 1886676 - RNA, 19 nt, Shigella flexneri 2a str. 2457T
ugcgacaaacaggaaguuu

SEQ ID NO: 1886677 - RNA, 15 nt, Shigella flexneri 2a str. 2457T
ugccuguacggcagu

SEQ ID NO: 1886678 - RNA, 22 nt, Shigella flexneri 2a str. 2457T
ugccuguacggcagugaacgcg

SEQ ID NO: 1886679 - RNA, 21 nt, Shigella flexneri 2a str. 2457T
ugccuguccucuucagcauca

SEQ ID NO: 1886680 - RNA, 19 nt, Shigella flexneri 2a str. 2457T
ugcgacgcaacgcgcguga

SEQ ID NO: 1886681 - RNA, 15 nt, Shigella flexneri 2a str. 2457T
ugcgacucucagccg

SEQ ID NO: 1886682 - RNA, 21 nt, Shigella flexneri 2a str. 2457T
ugcgauggugguugcgccgua

SEQ ID NO: 1886683 - RNA, 17 nt, Shigella flexneri 2a str. 2457T
ugcgcaucaugccaccc

SEQ ID NO: 1886684 - RNA, 14 nt, Shigella flexneri 2a str. 2457T
ugcgcaucaaagcc

SEQ ID NO: 1886685 - RNA, 18 nt, Shigella flexneri 2a str. 2457T
ugccgguuccugcaucgc

SEQ ID NO: 1886686 - RNA, 17 nt, Shigella flexneri 2a str. 2457T
ugccugaugcgacgcug

SEQ ID NO: 1886687 - RNA, 18 nt, Shigella flexneri 2a str. 2457T
ugccugaugcgacgcuua

SEQ ID NO: 1886688 - RNA, 13 nt, Shigella flexneri 2a str. 2457T
ugccuccagcgac

SEQ ID NO: 1886689 - RNA, 22 nt, Shigella flexneri 2a str. 2457T
ugcgcguaacgaucgccuggua

SEQ ID NO: 1886690 - RNA, 19 nt, Shigella flexneri 2a str. 2457T
ugcgcggauccacaccuga

SEQ ID NO: 1886691 - RNA, 14 nt, Shigella flexneri 2a str. 2457T
ugcgccugcuaaac

SEQ ID NO: 1886692 - RNA, 20 nt, Shigella flexneri 2a str. 2457T
ugcggcguaaacgccuuauc

SEQ ID NO: 1886693 - RNA, 20 nt, Shigella flexneri 2a str. 2457T
ugcggcguaaaugccuuauc

SEQ ID NO: 1886694 - RNA, 18 nt, Shigella flexneri 2a str. 2457T
ugcggcggcgcaccggcc

SEQ ID NO: 1886695 - RNA, 20 nt, Shigella flexneri 2a str. 2457T
ugcggcgugaaugccuuauc

SEQ ID NO: 1886696 - RNA, 15 nt, Shigella flexneri 2a str. 2457T
ugcggcgugggcgcu

SEQ ID NO: 1886697 - RNA, 17 nt, Shigella flexneri 2a str. 2457T
ugcggcgugggcgcugu

SEQ ID NO: 1886698 - RNA, 17 nt, Shigella flexneri 2a str. 2457T
ugcggcgugaacgccuu

SEQ ID NO: 1886699 - RNA, 18 nt, Shigella flexneri 2a str. 2457T
ugcggauugucauagcga

SEQ ID NO: 1886700 - RNA, 17 nt, Shigella flexneri 2a str. 2457T
ugcggcaaugcguagcu

SEQ ID NO: 1886701 - RNA, 17 nt, Shigella flexneri 2a str. 2457T
ugcggauuccggagcaa

SEQ ID NO: 1886702 - RNA, 15 nt, Shigella flexneri 2a str. 2457T
ugcggauauugccgg

SEQ ID NO: 1886703 - RNA, 17 nt, Shigella flexneri 2a str. 2457T
ugcggauauugccggau

SEQ ID NO: 1886704 - RNA, 17 nt, Shigella flexneri 2a str. 2457T
ugcgcuauccagcgcau

SEQ ID NO: 1886705 - RNA, 18 nt, Shigella flexneri 2a str. 2457T
ugcgcuauaucgcugaua

SEQ ID NO: 1886706 - RNA, 13 nt, Shigella flexneri 2a str. 2457T
ugcgcgucuuauc

SEQ ID NO: 1886707 - RNA, 13 nt, Shigella flexneri 2a str. 2457T
ugccagcguggcg

SEQ ID NO: 1886708 - RNA, 13 nt, Shigella flexneri 2a str. 2457T
ugccagccaggau

SEQ ID NO: 1886709 - RNA, 22 nt, Shigella flexneri 2a str. 2457T
ugccagcgauuuaucggcaauu

SEQ ID NO: 1886710 - RNA, 18 nt, Shigella flexneri 2a str. 2457T
ugccagcccuaaucccgu

SEQ ID NO: 1886711 - RNA, 19 nt, Shigella flexneri 2a str. 2457T
ugcccaccugcggcaccua

SEQ ID NO: 1886712 - RNA, 18 nt, Shigella flexneri 2a str. 2457T
ugcccaccgguuuccggg

SEQ ID NO: 1886713 - RNA, 17 nt, Shigella flexneri 2a str. 2457T
ugcccaacugccugaug

SEQ ID NO: 1886714 - RNA, 20 nt, Shigella flexneri 2a str. 2457T
ugcacgaggcuggcuuuauc

SEQ ID NO: 1886715 - RNA, 16 nt, Shigella flexneri 2a str. 2457T
ugcaccucgagaucau

SEQ ID NO: 1886716 - RNA, 15 nt, Shigella flexneri 2a str. 2457T
ugcacgauauaccgu

SEQ ID NO: 1886717 - RNA, 16 nt, Shigella flexneri 2a str. 2457T
ugcacgaugccugaug

SEQ ID NO: 1886718 - RNA, 22 nt, Shigella flexneri 2a str. 2457T
ugcacgcccugauaaaucaccu

SEQ ID NO: 1886719 - RNA, 18 nt, Shigella flexneri 2a str. 2457T
ugcauaauccgccgcugu

SEQ ID NO: 1886720 - RNA, 16 nt, Shigella flexneri 2a str. 2457T
ugcaucgacagcgccu

SEQ ID NO: 1886721 - RNA, 23 nt, Shigella flexneri 2a str. 2457T
ugcaucggggaauugugcuuuca

SEQ ID NO: 1886722 - RNA, 23 nt, Shigella flexneri 2a str. 2457T
ugcaucugaaugcuggcguggcg

SEQ ID NO: 1886723 - RNA, 15 nt, Shigella flexneri 2a str. 2457T
ugcauauaaucgauc

SEQ ID NO: 1886724 - RNA, 21 nt, Shigella flexneri 2a str. 2457T
ugcaucccgccguaccggcaa

SEQ ID NO: 1886725 - RNA, 20 nt, Shigella flexneri 2a str. 2457T
ugcaucccgccguaccggca

SEQ ID NO: 1886726 - RNA, 14 nt, Shigella flexneri 2a str. 2457T
ugccacaucacugu

SEQ ID NO: 1886727 - RNA, 16 nt, Shigella flexneri 2a str. 2457T
ugccgauaaauacagc

SEQ ID NO: 1886728 - RNA, 17 nt, Shigella flexneri 2a str. 2457T
ugccgauuacguaauuc

SEQ ID NO: 1886729 - RNA, 15 nt, Shigella flexneri 2a str. 2457T
ugccgcaauggccgu

SEQ ID NO: 1886730 - RNA, 18 nt, Shigella flexneri 2a str. 2457T
ugccgcguuggcaauguc

SEQ ID NO: 1886731 - RNA, 23 nt, Shigella flexneri 2a str. 2457T
ugccgcuuuaugugcuucuacca

SEQ ID NO: 1886732 - RNA, 19 nt, Shigella flexneri 2a str. 2457T
ugccgcuucauugaccuuu

SEQ ID NO: 1886733 - RNA, 19 nt, Shigella flexneri 2a str. 2457T
ugccgcuuuaugugcuucu

SEQ ID NO: 1886734 - RNA, 14 nt, Shigella flexneri 2a str. 2457T
ugccggaacgugca

SEQ ID NO: 1886735 - RNA, 15 nt, Shigella flexneri 2a str. 2457T
ugccggaugcggcgu

SEQ ID NO: 1886736 - RNA, 23 nt, Shigella flexneri 2a str. 2457T
ugccggaugcgaugcugacgcau

SEQ ID NO: 1886737 - RNA, 19 nt, Shigella flexneri 2a str. 2457T
ucgcaaauccauucaucgc

SEQ ID NO: 1886738 - RNA, 20 nt, Shigella flexneri 2a str. 2457T
ucgcacaaaaucaugagguu

SEQ ID NO: 1886739 - RNA, 20 nt, Shigella flexneri 2a str. 2457T
ucgcaaucggguuaccggaa

SEQ ID NO: 1886740 - RNA, 19 nt, Shigella flexneri 2a str. 2457T
ucgcaaauaugugaucgaa

SEQ ID NO: 1886741 - RNA, 12 nt, Shigella flexneri 2a str. 2457T
ucgcacuaucga

SEQ ID NO: 1886742 - RNA, 17 nt, Shigella flexneri 2a str. 2457T
ucgaugcgcuggcggcu

SEQ ID NO: 1886743 - RNA, 21 nt, Shigella flexneri 2a str. 2457T
ucgaugguguuauugauaucu

SEQ ID NO: 1886744 - RNA, 19 nt, Shigella flexneri 2a str. 2457T
ucgaucagugaaggcgccu

SEQ ID NO: 1886745 - RNA, 22 nt, Shigella flexneri 2a str. 2457T
ucgaucguuaagcgauucagca

SEQ ID NO: 1886746 - RNA, 15 nt, Shigella flexneri 2a str. 2457T
ucgaugaucaaccgc

SEQ ID NO: 1886747 - RNA, 14 nt, Shigella flexneri 2a str. 2457T
ucgaugaaagcgcc

SEQ ID NO: 1886748 - RNA, 12 nt, Shigella flexneri 2a str. 2457T
ucgauaaaccau

SEQ ID NO: 1886749 - RNA, 13 nt, Shigella flexneri 2a str. 2457T
ucgauaaccaucc

SEQ ID NO: 1886750 - RNA, 22 nt, Shigella flexneri 2a str. 2457T
ucgauaaauggcgcauccagcc

SEQ ID NO: 1886751 - RNA, 11 nt, Shigella flexneri 2a str. 2457T
ucgauaccaga

SEQ ID NO: 1886752 - RNA, 17 nt, Shigella flexneri 2a str. 2457T
ucgagugcaauaacguu

SEQ ID NO: 1886753 - RNA, 20 nt, Shigella flexneri 2a str. 2457T
ucgauaucgcugucgccauc

SEQ ID NO: 1886754 - RNA, 12 nt, Shigella flexneri 2a str. 2457T
ucgaggccaauu

SEQ ID NO: 1886755 - RNA, 18 nt, Shigella flexneri 2a str. 2457T
ucgagguacgcuccagca

SEQ ID NO: 1886756 - RNA, 19 nt, Shigella flexneri 2a str. 2457T
ucgacgcgccagcaccgca

SEQ ID NO: 1886757 - RNA, 15 nt, Shigella flexneri 2a str. 2457T
ucgacugcgcccuga

SEQ ID NO: 1886758 - RNA, 20 nt, Shigella flexneri 2a str. 2457T
ucgacuccuauuaucggcac

SEQ ID NO: 1886759 - RNA, 17 nt, Shigella flexneri 2a str. 2457T
ucgagaaugucgauaaa

SEQ ID NO: 1886760 - RNA, 13 nt, Shigella flexneri 2a str. 2457T
ucgagaaucagcg

SEQ ID NO: 1886761 - RNA, 20 nt, Shigella flexneri 2a str. 2457T
ucgccacggcaugaaagcga

SEQ ID NO: 1886762 - RNA, 14 nt, Shigella flexneri 2a str. 2457T
ucgccagcagccau

SEQ ID NO: 1886763 - RNA, 15 nt, Shigella flexneri 2a str. 2457T
ucgccagaucgguaa

SEQ ID NO: 1886764 - RNA, 22 nt, Shigella flexneri 2a str. 2457T
ucgccaaaugucaccagccgau

SEQ ID NO: 1886765 - RNA, 13 nt, Shigella flexneri 2a str. 2457T
ucgccaaguucga

SEQ ID NO: 1886766 - RNA, 14 nt, Shigella flexneri 2a str. 2457T
ucgccacaucaggu

SEQ ID NO: 1886767 - RNA, 20 nt, Shigella flexneri 2a str. 2457T
ucgccaaguucgaacgccgc

SEQ ID NO: 1886768 - RNA, 22 nt, Shigella flexneri 2a str. 2457T
ucgcaucccgguaucaaagcgc

SEQ ID NO: 1886769 - RNA, 15 nt, Shigella flexneri 2a str. 2457T
ucgcauccggcacua

SEQ ID NO: 1886770 - RNA, 14 nt, Shigella flexneri 2a str. 2457T
ucgcagucgccagc

SEQ ID NO: 1886771 - RNA, 23 nt, Shigella flexneri 2a str. 2457T
ucgccgcauaguaagccggauaa

SEQ ID NO: 1886772 - RNA, 15 nt, Shigella flexneri 2a str. 2457T
ucgccgcacgcucaa

SEQ ID NO: 1886773 - RNA, 13 nt, Shigella flexneri 2a str. 2457T
ucgccagcucaag

SEQ ID NO: 1886774 - RNA, 18 nt, Shigella flexneri 2a str. 2457T
ucgccagucccuuucagg

SEQ ID NO: 1886775 - RNA, 19 nt, Shigella flexneri 2a str. 2457T
ucgccagccucccagccau

SEQ ID NO: 1886776 - RNA, 20 nt, Shigella flexneri 2a str. 2457T
ucgccagccucccagccauu

SEQ ID NO: 1886777 - RNA, 19 nt, Shigella flexneri 2a str. 2457T
ucgccauaauaagcgccau

SEQ ID NO: 1886778 - RNA, 16 nt, Shigella flexneri 2a str. 2457T
ucgccugcaucaccau

SEQ ID NO: 1886779 - RNA, 18 nt, Shigella flexneri 2a str. 2457T
ucgcgcuaauuccagucg

SEQ ID NO: 1886780 - RNA, 15 nt, Shigella flexneri 2a str. 2457T
ucgcgcucaucagcg

SEQ ID NO: 1886781 - RNA, 17 nt, Shigella flexneri 2a str. 2457T
ucgccugguacuggauu

SEQ ID NO: 1886782 - RNA, 17 nt, Shigella flexneri 2a str. 2457T
ucgccugcaucaccauc

SEQ ID NO: 1886783 - RNA, 16 nt, Shigella flexneri 2a str. 2457T
ucgccugccagaugca

SEQ ID NO: 1886784 - RNA, 15 nt, Shigella flexneri 2a str. 2457T
ucgccuuccagcgau

SEQ ID NO: 1886785 - RNA, 15 nt, Shigella flexneri 2a str. 2457T
ucgcgaaaugcagcg

SEQ ID NO: 1886786 - RNA, 12 nt, Shigella flexneri 2a str. 2457T
ucucauccauca

SEQ ID NO: 1886787 - RNA, 13 nt, Shigella flexneri 2a str. 2457T
ucucaucaccauu

SEQ ID NO: 1886788 - RNA, 22 nt, Shigella flexneri 2a str. 2457T
ucuccaacaucgaaaacgccac

SEQ ID NO: 1886789 - RNA, 23 nt, Shigella flexneri 2a str. 2457T
ucguuggucgcgcacugcgggau

SEQ ID NO: 1886790 - RNA, 18 nt, Shigella flexneri 2a str. 2457T
ucguuguuuaugccggau

SEQ ID NO: 1886791 - RNA, 21 nt, Shigella flexneri 2a str. 2457T
ucguuucaugccauccgcauc

SEQ ID NO: 1886792 - RNA, 15 nt, Shigella flexneri 2a str. 2457T
ucguugcguugacca

SEQ ID NO: 1886793 - RNA, 20 nt, Shigella flexneri 2a str. 2457T
ucgugcgucgcauccggcaa

SEQ ID NO: 1886794 - RNA, 22 nt, Shigella flexneri 2a str. 2457T
ucgucguuaagccuuucgcaaa

SEQ ID NO: 1886795 - RNA, 23 nt, Shigella flexneri 2a str. 2457T
ucgugaaugcccggcugcgcgac

SEQ ID NO: 1886796 - RNA, 21 nt, Shigella flexneri 2a str. 2457T
ucgugacaauaauacccagca

SEQ ID NO: 1886797 - RNA, 17 nt, Shigella flexneri 2a str. 2457T
ucgguacccagacgcag

SEQ ID NO: 1886798 - RNA, 15 nt, Shigella flexneri 2a str. 2457T
ucgguccaccacgua

SEQ ID NO: 1886799 - RNA, 20 nt, Shigella flexneri 2a str. 2457T
ucguaggccggauaaggcgu

SEQ ID NO: 1886800 - RNA, 19 nt, Shigella flexneri 2a str. 2457T
ucguagccuuuuucagccg

SEQ ID NO: 1886801 - RNA, 16 nt, Shigella flexneri 2a str. 2457T
ucgguuucaucacaua

SEQ ID NO: 1886802 - RNA, 20 nt, Shigella flexneri 2a str. 2457T
ucguaucuggcaagcaggac

SEQ ID NO: 1886803 - RNA, 15 nt, Shigella flexneri 2a str. 2457T
ucguagugaugccau

SEQ ID NO: 1886804 - RNA, 20 nt, Shigella flexneri 2a str. 2457T
ucggccaugauaaacgguac

SEQ ID NO: 1886805 - RNA, 13 nt, Shigella flexneri 2a str. 2457T
ucggcauacagcg

SEQ ID NO: 1886806 - RNA, 13 nt, Shigella flexneri 2a str. 2457T
ucggcauaaucau

SEQ ID NO: 1886807 - RNA, 14 nt, Shigella flexneri 2a str. 2457T
ucggaguaacaggu

SEQ ID NO: 1886808 - RNA, 22 nt, Shigella flexneri 2a str. 2457T
ucggagaacugcaacucaccuu

SEQ ID NO: 1886809 - RNA, 14 nt, Shigella flexneri 2a str. 2457T
ucgcuacugauaau

SEQ ID NO: 1886810 - RNA, 17 nt, Shigella flexneri 2a str. 2457T
ucgcgcuuaucgccagc

SEQ ID NO: 1886811 - RNA, 14 nt, Shigella flexneri 2a str. 2457T
ucgcugccagcacu

SEQ ID NO: 1886812 - RNA, 21 nt, Shigella flexneri 2a str. 2457T
ucggccuuccauaaugcugac

SEQ ID NO: 1886813 - RNA, 19 nt, Shigella flexneri 2a str. 2457T
ucggcgucuuguugaacag

SEQ ID NO: 1886814 - RNA, 17 nt, Shigella flexneri 2a str. 2457T
ucgggauugccagaugc

SEQ ID NO: 1886815 - RNA, 23 nt, Shigella flexneri 2a str. 2457T
ucggcuggcgaaccaggaagaug

SEQ ID NO: 1886816 - RNA, 20 nt, Shigella flexneri 2a str. 2457T
gcuucccacagacgacgaac

SEQ ID NO: 1886817 - RNA, 12 nt, Shigella flexneri 2a str. 2457T
gcuuccugcaac

SEQ ID NO: 1886818 - RNA, 15 nt, Shigella flexneri 2a str. 2457T
gcuuccggcaauggc

SEQ ID NO: 1886819 - RNA, 21 nt, Shigella flexneri 2a str. 2457T
gcuucgccuuuuaccagcgcc

SEQ ID NO: 1886820 - RNA, 23 nt, Shigella flexneri 2a str. 2457T
gcuucgcaucccgguaucaaagc

SEQ ID NO: 1886821 - RNA, 18 nt, Shigella flexneri 2a str. 2457T
gcuucuauaccaaugauu

SEQ ID NO: 1886822 - RNA, 23 nt, Shigella flexneri 2a str. 2457T
gcuucuggcgacauuuucucuac

SEQ ID NO: 1886823 - RNA, 17 nt, Shigella flexneri 2a str. 2457T
gcuucguagacgcuuuc

SEQ ID NO: 1886824 - RNA, 14 nt, Shigella flexneri 2a str. 2457T
gcuucggcggguuu

SEQ ID NO: 1886825 - RNA, 22 nt, Shigella flexneri 2a str. 2457T
gcuucagugacuucugccagcu

SEQ ID NO: 1886826 - RNA, 17 nt, Shigella flexneri 2a str. 2457T
gcuucaucagacgcuua

SEQ ID NO: 1886827 - RNA, 12 nt, Shigella flexneri 2a str. 2457T
gcuucaucgccc

SEQ ID NO: 1886828 - RNA, 21 nt, Shigella flexneri 2a str. 2457T
gcuucaucgugcucgcuuucc

SEQ ID NO: 1886829 - RNA, 15 nt, Shigella flexneri 2a str. 2457T
gcuucaugcccgcca

SEQ ID NO: 1886830 - RNA, 23 nt, Shigella flexneri 2a str. 2457T
gcuucaaaucauuacaguuucgg

SEQ ID NO: 1886831 - RNA, 14 nt, Shigella flexneri 2a str. 2457T
gcuucaaucugaua

SEQ ID NO: 1886832 - RNA, 15 nt, Shigella flexneri 2a str. 2457T
gcuucaccagcagcg

SEQ ID NO: 1886833 - RNA, 16 nt, Shigella flexneri 2a str. 2457T
gcuucaaggugcgcga

SEQ ID NO: 1886834 - RNA, 21 nt, Shigella flexneri 2a str. 2457T
gcuucacuucuuaccgcuuca

SEQ ID NO: 1886835 - RNA, 14 nt, Shigella flexneri 2a str. 2457T
gcuucagcgcgucg

SEQ ID NO: 1886836 - RNA, 14 nt, Shigella flexneri 2a str. 2457T
gcuuaucaggccua

SEQ ID NO: 1886837 - RNA, 19 nt, Shigella flexneri 2a str. 2457T
gcuuaucaggccuacauga

SEQ ID NO: 1886838 - RNA, 17 nt, Shigella flexneri 2a str. 2457T
gcuguucuucugcugau

SEQ ID NO: 1886839 - RNA, 14 nt, Shigella flexneri 2a str. 2457T
gcuuaacugcgcuu

SEQ ID NO: 1886840 - RNA, 17 nt, Shigella flexneri 2a str. 2457T
gcuuaacugcgcuuucg

SEQ ID NO: 1886841 - RNA, 13 nt, Shigella flexneri 2a str. 2457T
gcuuaaucugcca

SEQ ID NO: 1886842 - RNA, 14 nt, Shigella flexneri 2a str. 2457T
gcuggucagcaacu

SEQ ID NO: 1886843 - RNA, 21 nt, Shigella flexneri 2a str. 2457T
gcuggguuucgccugccagau

SEQ ID NO: 1886844 - RNA, 22 nt, Shigella flexneri 2a str. 2457T
gcuggcuuuccgggagcaauuu

SEQ ID NO: 1886845 - RNA, 14 nt, Shigella flexneri 2a str. 2457T
gcugguucugcggg

SEQ ID NO: 1886846 - RNA, 18 nt, Shigella flexneri 2a str. 2457T
gcugguguaacugcgcca

SEQ ID NO: 1886847 - RNA, 15 nt, Shigella flexneri 2a str. 2457T
gcuguaaccagcgca

SEQ ID NO: 1886848 - RNA, 14 nt, Shigella flexneri 2a str. 2457T
gcuguacgccuuca

SEQ ID NO: 1886849 - RNA, 19 nt, Shigella flexneri 2a str. 2457T
gcuguagcaguuccagcau

SEQ ID NO: 1886850 - RNA, 22 nt, Shigella flexneri 2a str. 2457T
gcugugguuugcccgcaaagau

SEQ ID NO: 1886851 - RNA, 20 nt, Shigella flexneri 2a str. 2457T
gcuguguguaggccagcgau

SEQ ID NO: 1886852 - RNA, 16 nt, Shigella flexneri 2a str. 2457T
gcuguucuucugcuga

SEQ ID NO: 1886853 - RNA, 16 nt, Shigella flexneri 2a str. 2457T
ggaaaauaucgcccau

SEQ ID NO: 1886854 - RNA, 13 nt, Shigella flexneri 2a str. 2457T
ggaaaaucaucuu

SEQ ID NO: 1886855 - RNA, 21 nt, Shigella flexneri 2a str. 2457T
ggaaaauagcauaauauaaca

SEQ ID NO: 1886856 - RNA, 12 nt, Shigella flexneri 2a str. 2457T
gcuuuuacgcau

SEQ ID NO: 1886857 - RNA, 18 nt, Shigella flexneri 2a str. 2457T
gcuuuguuuaugccagau

SEQ ID NO: 1886858 - RNA, 15 nt, Shigella flexneri 2a str. 2457T
gcuuuggugccagau

SEQ ID NO: 1886859 - RNA, 18 nt, Shigella flexneri 2a str. 2457T
gcuuuguucaugccggau

SEQ ID NO: 1886860 - RNA, 21 nt, Shigella flexneri 2a str. 2457T
gcuuugccacugccggugucg

SEQ ID NO: 1886861 - RNA, 19 nt, Shigella flexneri 2a str. 2457T
ggaaacccaacgcaaagag

SEQ ID NO: 1886862 - RNA, 13 nt, Shigella flexneri 2a str. 2457T
gcuucuuccggcg

SEQ ID NO: 1886863 - RNA, 16 nt, Shigella flexneri 2a str. 2457T
gcuucuucagccugca

SEQ ID NO: 1886864 - RNA, 23 nt, Shigella flexneri 2a str. 2457T
gcuucuuuuuaccuucauuugcc

SEQ ID NO: 1886865 - RNA, 21 nt, Shigella flexneri 2a str. 2457T
gcuuuaaauuacugagcaauu

SEQ ID NO: 1886866 - RNA, 21 nt, Shigella flexneri 2a str. 2457T
gcuuuaacgaaagcgccucaa

SEQ ID NO: 1886867 - RNA, 17 nt, Shigella flexneri 2a str. 2457T
gcuuuccgggagcaauu

SEQ ID NO: 1886868 - RNA, 20 nt, Shigella flexneri 2a str. 2457T
gcuuuccgucagcggcaauu

SEQ ID NO: 1886869 - RNA, 14 nt, Shigella flexneri 2a str. 2457T
gcuuuccugauaau

SEQ ID NO: 1886870 - RNA, 14 nt, Shigella flexneri 2a str. 2457T
gcuuucgugaagcu

SEQ ID NO: 1886871 - RNA, 23 nt, Shigella flexneri 2a str. 2457T
gcuuucugggaugaucaccugca

SEQ ID NO: 1886872 - RNA, 15 nt, Shigella flexneri 2a str. 2457T
ggaacauuuaccgca

SEQ ID NO: 1886873 - RNA, 21 nt, Shigella flexneri 2a str. 2457T
ggaaaugggugacaucgcccu

SEQ ID NO: 1886874 - RNA, 19 nt, Shigella flexneri 2a str. 2457T
ggaaaugaggaauuaacga

SEQ ID NO: 1886875 - RNA, 17 nt, Shigella flexneri 2a str. 2457T
ggaaauuaaacggcaaa

SEQ ID NO: 1886876 - RNA, 21 nt, Shigella flexneri 2a str. 2457T
ggaaauugcagagcugcguuu

SEQ ID NO: 1886877 - RNA, 23 nt, Shigella flexneri 2a str. 2457T
ggaagagauauuuucccaacgug

SEQ ID NO: 1886878 - RNA, 20 nt, Shigella flexneri 2a str. 2457T
ggacgagucgucgauaucga

SEQ ID NO: 1886879 - RNA, 18 nt, Shigella flexneri 2a str. 2457T
ggaauauaccuuccgguu

SEQ ID NO: 1886880 - RNA, 17 nt, Shigella flexneri 2a str. 2457T
ggaauauuucaccgguu

SEQ ID NO: 1886881 - RNA, 14 nt, Shigella flexneri 2a str. 2457T
ggagaagcaucagc

SEQ ID NO: 1886882 - RNA, 22 nt, Shigella flexneri 2a str. 2457T
ggagacauuacguccaucacaa

SEQ ID NO: 1886883 - RNA, 16 nt, Shigella flexneri 2a str. 2457T
ggagacauuacgucca

SEQ ID NO: 1886884 - RNA, 18 nt, Shigella flexneri 2a str. 2457T
gcugcuacgccgucauua

SEQ ID NO: 1886885 - RNA, 19 nt, Shigella flexneri 2a str. 2457T
gcugcugauccagcuucca

SEQ ID NO: 1886886 - RNA, 20 nt, Shigella flexneri 2a str. 2457T
gcugcggcgcgcaucuucgu

SEQ ID NO: 1886887 - RNA, 15 nt, Shigella flexneri 2a str. 2457T
gcugcguggcgcuuu

SEQ ID NO: 1886888 - RNA, 13 nt, Shigella flexneri 2a str. 2457T
gcugcgcggcagc

SEQ ID NO: 1886889 - RNA, 15 nt, Shigella flexneri 2a str. 2457T
gcugcagcucuuuca

SEQ ID NO: 1886890 - RNA, 14 nt, Shigella flexneri 2a str. 2457T
gcugcccaugcgcu

SEQ ID NO: 1886891 - RNA, 19 nt, Shigella flexneri 2a str. 2457T
gcugacugauauugcccgu

SEQ ID NO: 1886892 - RNA, 12 nt, Shigella flexneri 2a str. 2457T
gcugaccgcuug

SEQ ID NO: 1886893 - RNA, 22 nt, Shigella flexneri 2a str. 2457T
gcugacugucgcagccagcgcg

SEQ ID NO: 1886894 - RNA, 14 nt, Shigella flexneri 2a str. 2457T
gcugaggcguuuca

SEQ ID NO: 1886895 - RNA, 15 nt, Shigella flexneri 2a str. 2457T
gcugauaaaucccgc

SEQ ID NO: 1886896 - RNA, 17 nt, Shigella flexneri 2a str. 2457T
gcugauaacaauaucaa

SEQ ID NO: 1886897 - RNA, 19 nt, Shigella flexneri 2a str. 2457T
gcugcacaauugccagccc

SEQ ID NO: 1886898 - RNA, 22 nt, Shigella flexneri 2a str. 2457T
gcugcacacagggcgcuagcca

SEQ ID NO: 1886899 - RNA, 22 nt, Shigella flexneri 2a str. 2457T
gcugcaauugcggcaggucauc

SEQ ID NO: 1886900 - RNA, 18 nt, Shigella flexneri 2a str. 2457T
gcugaacgaaaagcgcac

SEQ ID NO: 1886901 - RNA, 19 nt, Shigella flexneri 2a str. 2457T
gcugaauuucaucaccagc

SEQ ID NO: 1886902 - RNA, 20 nt, Shigella flexneri 2a str. 2457T
gcugacaacgcugaauggcg

SEQ ID NO: 1886903 - RNA, 20 nt, Shigella flexneri 2a str. 2457T
gcugacauuaucagacaccg

SEQ ID NO: 1886904 - RNA, 22 nt, Shigella flexneri 2a str. 2457T
gcugacacuauucgccagcacg

SEQ ID NO: 1886905 - RNA, 22 nt, Shigella flexneri 2a str. 2457T
gcucucccaaauaugaaaucuc

SEQ ID NO: 1886906 - RNA, 16 nt, Shigella flexneri 2a str. 2457T
gcucgugggauugccg

SEQ ID NO: 1886907 - RNA, 24 nt, Shigella flexneri 2a str. 2457T
gcucgcgcuugcggaagcaaccgg

SEQ ID NO: 1886908 - RNA, 13 nt, Shigella flexneri 2a str. 2457T
gcucgcgcagaua

SEQ ID NO: 1886909 - RNA, 14 nt, Shigella flexneri 2a str. 2457T
gcucgccgccgcug

SEQ ID NO: 1886910 - RNA, 22 nt, Shigella flexneri 2a str. 2457T
gcuccggcgcgauaucgacgac

SEQ ID NO: 1886911 - RNA, 21 nt, Shigella flexneri 2a str. 2457T
gcuaaucaaaucaaugccuuu

SEQ ID NO: 1886912 - RNA, 13 nt, Shigella flexneri 2a str. 2457T
gcuacauaacgca

SEQ ID NO: 1886913 - RNA, 21 nt, Shigella flexneri 2a str. 2457T
gcuacagcaucaucgcuuugu

SEQ ID NO: 1886914 - RNA, 16 nt, Shigella flexneri 2a str. 2457T
gcuaauuuugccauca

SEQ ID NO: 1886915 - RNA, 22 nt, Shigella flexneri 2a str. 2457T
gcuaauuccagucguguuccgg

SEQ ID NO: 1886916 - RNA, 17 nt, Shigella flexneri 2a str. 2457T
gcuaccaugcuaauaau

SEQ ID NO: 1886917 - RNA, 20 nt, Shigella flexneri 2a str. 2457T
gcucgacgucacaggccauc

SEQ ID NO: 1886918 - RNA, 17 nt, Shigella flexneri 2a str. 2457T
gcucgacaagauacugc

SEQ ID NO: 1886919 - RNA, 21 nt, Shigella flexneri 2a str. 2457T
gcguaauggugguguuuucga

SEQ ID NO: 1886920 - RNA, 13 nt, Shigella flexneri 2a str. 2457T
gcguaauuugcga

SEQ ID NO: 1886921 - RNA, 13 nt, Shigella flexneri 2a str. 2457T
gcggucguaaucg

SEQ ID NO: 1886922 - RNA, 20 nt, Shigella flexneri 2a str. 2457T
gcgucacgccgaccagaccg

SEQ ID NO: 1886923 - RNA, 19 nt, Shigella flexneri 2a str. 2457T
gcgucacgccgaccagacc

SEQ ID NO: 1886924 - RNA, 23 nt, Shigella flexneri 2a str. 2457T
gcgucaauuuguuccgccagcga

SEQ ID NO: 1886925 - RNA, 13 nt, Shigella flexneri 2a str. 2457T
gcgucagcaucgc

SEQ ID NO: 1886926 - RNA, 17 nt, Shigella flexneri 2a str. 2457T
gcgucagaguuuagcga

SEQ ID NO: 1886927 - RNA, 16 nt, Shigella flexneri 2a str. 2457T
gcguacuggcaaucgc

SEQ ID NO: 1886928 - RNA, 13 nt, Shigella flexneri 2a str. 2457T
gcguauggcgaca

SEQ ID NO: 1886929 - RNA, 22 nt, Shigella flexneri 2a str. 2457T
gcgucaacaacacucucugaag

SEQ ID NO: 1886930 - RNA, 20 nt, Shigella flexneri 2a str. 2457T
gcgugaagugugcaaacgau

SEQ ID NO: 1886931 - RNA, 16 nt, Shigella flexneri 2a str. 2457T
gcgugaccaguugcuc

SEQ ID NO: 1886932 - RNA, 16 nt, Shigella flexneri 2a str. 2457T
gcgucuuauccggccu

SEQ ID NO: 1886933 - RNA, 18 nt, Shigella flexneri 2a str. 2457T
gcgucuuccgugccugac

SEQ ID NO: 1886934 - RNA, 17 nt, Shigella flexneri 2a str. 2457T
gcgucuuguugaacagg

SEQ ID NO: 1886935 - RNA, 12 nt, Shigella flexneri 2a str. 2457T
gcgucgguuucg

SEQ ID NO: 1886936 - RNA, 22 nt, Shigella flexneri 2a str. 2457T
gcguuuacgccgcauccggcau

SEQ ID NO: 1886937 - RNA, 19 nt, Shigella flexneri 2a str. 2457T
gcguuguaacaauccgaua

SEQ ID NO: 1886938 - RNA, 23 nt, Shigella flexneri 2a str. 2457T
gcguugcggaaagcuugcgucgc

SEQ ID NO: 1886939 - RNA, 19 nt, Shigella flexneri 2a str. 2457T
gcuaagcaggcuggcuacg

SEQ ID NO: 1886940 - RNA, 16 nt, Shigella flexneri 2a str. 2457T
gcuaaccacgccgcuu

SEQ ID NO: 1886941 - RNA, 14 nt, Shigella flexneri 2a str. 2457T
gcguuugccagcgu

SEQ ID NO: 1886942 - RNA, 21 nt, Shigella flexneri 2a str. 2457T
gcguuucuggcuuaaacgcag

SEQ ID NO: 1886943 - RNA, 13 nt, Shigella flexneri 2a str. 2457T
gcguuuguccggu

SEQ ID NO: 1886944 - RNA, 15 nt, Shigella flexneri 2a str. 2457T
gcguuuucgccgcau

SEQ ID NO: 1886945 - RNA, 22 nt, Shigella flexneri 2a str. 2457T
gcguuuugauuuucaccagcau

SEQ ID NO: 1886946 - RNA, 18 nt, Shigella flexneri 2a str. 2457T
gcguuccugcucuuccgg

SEQ ID NO: 1886947 - RNA, 20 nt, Shigella flexneri 2a str. 2457T
gcguucacgccgcauccggc

SEQ ID NO: 1886948 - RNA, 15 nt, Shigella flexneri 2a str. 2457T
gcguucacgccgcau

SEQ ID NO: 1886949 - RNA, 18 nt, Shigella flexneri 2a str. 2457T
gcguucgauggcgcgcca

SEQ ID NO: 1886950 - RNA, 21 nt, Shigella flexneri 2a str. 2457T
gcggcggcagauugagcguca

SEQ ID NO: 1886951 - RNA, 19 nt, Shigella flexneri 2a str. 2457T
gcggccggaugcgccgcca

SEQ ID NO: 1886952 - RNA, 14 nt, Shigella flexneri 2a str. 2457T
gcggaaaucuccag

SEQ ID NO: 1886953 - RNA, 18 nt, Shigella flexneri 2a str. 2457T
gcggcaguggcuaagcag

SEQ ID NO: 1886954 - RNA, 15 nt, Shigella flexneri 2a str. 2457T
gcgacuuuaaucacc

SEQ ID NO: 1886955 - RNA, 21 nt, Shigella flexneri 2a str. 2457T
gcgacgcuggucgcgucuuau

SEQ ID NO: 1886956 - RNA, 13 nt, Shigella flexneri 2a str. 2457T
gcgagaacugaac

SEQ ID NO: 1886957 - RNA, 15 nt, Shigella flexneri 2a str. 2457T
gcgagucgcuccugc

SEQ ID NO: 1886958 - RNA, 13 nt, Shigella flexneri 2a str. 2457T
gcgagucgucagu

SEQ ID NO: 1886959 - RNA, 22 nt, Shigella flexneri 2a str. 2457T
gcgauaacgccccaauccacgc

SEQ ID NO: 1886960 - RNA, 12 nt, Shigella flexneri 2a str. 2457T
gcgauacgcagu

SEQ ID NO: 1886961 - RNA, 13 nt, Shigella flexneri 2a str. 2457T
gcgauaaucgaac

SEQ ID NO: 1886962 - RNA, 16 nt, Shigella flexneri 2a str. 2457T
gcgauagccgcuuucu

SEQ ID NO: 1886963 - RNA, 21 nt, Shigella flexneri 2a str. 2457T
gcgaggaaauugcgaauuccu

SEQ ID NO: 1886964 - RNA, 15 nt, Shigella flexneri 2a str. 2457T
gcgacaagcgucgca

SEQ ID NO: 1886965 - RNA, 16 nt, Shigella flexneri 2a str. 2457T
gcgacaguaucaucau

SEQ ID NO: 1886966 - RNA, 15 nt, Shigella flexneri 2a str. 2457T
gcgaccaaacugcuc

SEQ ID NO: 1886967 - RNA, 19 nt, Shigella flexneri 2a str. 2457T
gcgacgcugcgcgucuuau

SEQ ID NO: 1886968 - RNA, 21 nt, Shigella flexneri 2a str. 2457T
gcgacgcuggccgcgucuuau

SEQ ID NO: 1886969 - RNA, 20 nt, Shigella flexneri 2a str. 2457T
gcgacgcuggcgcgucuuau

SEQ ID NO: 1886970 - RNA, 20 nt, Shigella flexneri 2a str. 2457T
gcgacgcugacgcgucuuau

SEQ ID NO: 1886971 - RNA, 20 nt, Shigella flexneri 2a str. 2457T
gcgaaauguguuggcaccau

SEQ ID NO: 1886972 - RNA, 15 nt, Shigella flexneri 2a str. 2457T
gcgaaaccuccgcaa

SEQ ID NO: 1886973 - RNA, 18 nt, Shigella flexneri 2a str. 2457T
gccuuuuccuuucagagu

SEQ ID NO: 1886974 - RNA, 15 nt, Shigella flexneri 2a str. 2457T
gcgaaaaucaaccau

SEQ ID NO: 1886975 - RNA, 14 nt, Shigella flexneri 2a str. 2457T
gcgaaccaggaaga

SEQ ID NO: 1886976 - RNA, 15 nt, Shigella flexneri 2a str. 2457T
gcgaaccaggccgua

SEQ ID NO: 1886977 - RNA, 17 nt, Shigella flexneri 2a str. 2457T
gcgaagauacccgcgag

SEQ ID NO: 1886978 - RNA, 12 nt, Shigella flexneri 2a str. 2457T
gccuggugaccg

SEQ ID NO: 1886979 - RNA, 15 nt, Shigella flexneri 2a str. 2457T
gccuguaaugccagu

SEQ ID NO: 1886980 - RNA, 15 nt, Shigella flexneri 2a str. 2457T
gccuguaacgccuuu

SEQ ID NO: 1886981 - RNA, 21 nt, Shigella flexneri 2a str. 2457T
gccuguacggcagugaacgcg

SEQ ID NO: 1886982 - RNA, 21 nt, Shigella flexneri 2a str. 2457T
gccuugaguaccauuugcaua

SEQ ID NO: 1886983 - RNA, 19 nt, Shigella flexneri 2a str. 2457T
gccuuauccguccuacgaa

SEQ ID NO: 1886984 - RNA, 23 nt, Shigella flexneri 2a str. 2457T
gccuguuaucgcucgucgcgacg

SEQ ID NO: 1886985 - RNA, 20 nt, Shigella flexneri 2a str. 2457T
gccuucagugauggugauaa

SEQ ID NO: 1886986 - RNA, 16 nt, Shigella flexneri 2a str. 2457T
gccugcgcgauacuac

SEQ ID NO: 1886987 - RNA, 13 nt, Shigella flexneri 2a str. 2457T
gccugcucuuauu

SEQ ID NO: 1886988 - RNA, 15 nt, Shigella flexneri 2a str. 2457T
gccguugaucucucc

SEQ ID NO: 1886989 - RNA, 14 nt, Shigella flexneri 2a str. 2457T
gccgugcagcacgg

SEQ ID NO: 1886990 - RNA, 13 nt, Shigella flexneri 2a str. 2457T
gccguuggcggcg

SEQ ID NO: 1886991 - RNA, 13 nt, Shigella flexneri 2a str. 2457T
gccguugucgacg

SEQ ID NO: 1886992 - RNA, 21 nt, Shigella flexneri 2a str. 2457T
gccuauuaugacuccagcgcc

SEQ ID NO: 1886993 - RNA, 15 nt, Shigella flexneri 2a str. 2457T
gccgugacgaaucag

SEQ ID NO: 1886994 - RNA, 15 nt, Shigella flexneri 2a str. 2457T
gccggugcggucagg

SEQ ID NO: 1886995 - RNA, 18 nt, Shigella flexneri 2a str. 2457T
gccgggauuuauucccgg

SEQ ID NO: 1886996 - RNA, 17 nt, Shigella flexneri 2a str. 2457T
gcgcgcaaucagcaccg

SEQ ID NO: 1886997 - RNA, 14 nt, Shigella flexneri 2a str. 2457T
gcgcugaugagcaa

SEQ ID NO: 1886998 - RNA, 22 nt, Shigella flexneri 2a str. 2457T
gcgcucgugccgcauccggcau

SEQ ID NO: 1886999 - RNA, 19 nt, Shigella flexneri 2a str. 2457T
gcgcuuaucaggccuacag

SEQ ID NO: 1887000 - RNA, 14 nt, Shigella flexneri 2a str. 2457T
gcgcuuauccggcc

SEQ ID NO: 1887001 - RNA, 15 nt, Shigella flexneri 2a str. 2457T
gcgcuuaucaggccu

SEQ ID NO: 1887002 - RNA, 15 nt, Shigella flexneri 2a str. 2457T
gcgcuucucaggccu

SEQ ID NO: 1887003 - RNA, 20 nt, Shigella flexneri 2a str. 2457T
gcgcuucgcuuauccgaccu

SEQ ID NO: 1887004 - RNA, 20 nt, Shigella flexneri 2a str. 2457T
gcgcuucgcuuaucaggccu

SEQ ID NO: 1887005 - RNA, 22 nt, Shigella flexneri 2a str. 2457T
gcgcguccgcagacacuuuccc

SEQ ID NO: 1887006 - RNA, 19 nt, Shigella flexneri 2a str. 2457T
gcgcguuuuuuaugccgga

SEQ ID NO: 1887007 - RNA, 19 nt, Shigella flexneri 2a str. 2457T
gcgcucacaccacagcagc

SEQ ID NO: 1887008 - RNA, 14 nt, Shigella flexneri 2a str. 2457T
gcgcguaagcguca

SEQ ID NO: 1887009 - RNA, 22 nt, Shigella flexneri 2a str. 2457T
gcgcguaaauaccuuccggcgu

SEQ ID NO: 1887010 - RNA, 14 nt, Shigella flexneri 2a str. 2457T
gcgcggcaggcauc

SEQ ID NO: 1887011 - RNA, 18 nt, Shigella flexneri 2a str. 2457T
gcgcauaacucaccauca

SEQ ID NO: 1887012 - RNA, 21 nt, Shigella flexneri 2a str. 2457T
gcgcauaaaagcuauacaucg

SEQ ID NO: 1887013 - RNA, 18 nt, Shigella flexneri 2a str. 2457T
gcgcaucaaagccaggca

SEQ ID NO: 1887014 - RNA, 22 nt, Shigella flexneri 2a str. 2457T
gcgcauccggcaccagcgcaca

SEQ ID NO: 1887015 - RNA, 16 nt, Shigella flexneri 2a str. 2457T
gcgcaggucauccggc

SEQ ID NO: 1887016 - RNA, 21 nt, Shigella flexneri 2a str. 2457T
gcgcagggcaugacacagaau

SEQ ID NO: 1887017 - RNA, 16 nt, Shigella flexneri 2a str. 2457T
gcgcagucaccagcau

SEQ ID NO: 1887018 - RNA, 21 nt, Shigella flexneri 2a str. 2457T
gcgcagugccgguggaagggc

SEQ ID NO: 1887019 - RNA, 19 nt, Shigella flexneri 2a str. 2457T
gcgcagucacaccagcgau

SEQ ID NO: 1887020 - RNA, 22 nt, Shigella flexneri 2a str. 2457T
gcgcagcguucauaaauacaga

SEQ ID NO: 1887021 - RNA, 17 nt, Shigella flexneri 2a str. 2457T
gcgcaggagccacauag

SEQ ID NO: 1887022 - RNA, 20 nt, Shigella flexneri 2a str. 2457T
gcgauauccagugccagaau

SEQ ID NO: 1887023 - RNA, 20 nt, Shigella flexneri 2a str. 2457T
gcgauauccagcgauaccgg

SEQ ID NO: 1887024 - RNA, 21 nt, Shigella flexneri 2a str. 2457T
gcgauaucgcgguacuucuca

SEQ ID NO: 1887025 - RNA, 13 nt, Shigella flexneri 2a str. 2457T
gcgauaugccggc

SEQ ID NO: 1887026 - RNA, 20 nt, Shigella flexneri 2a str. 2457T
gcgccagaacacgcucccag

SEQ ID NO: 1887027 - RNA, 18 nt, Shigella flexneri 2a str. 2457T
gcgccacucgauaccaga

SEQ ID NO: 1887028 - RNA, 18 nt, Shigella flexneri 2a str. 2457T
gcgcaucggucgaugaaa

SEQ ID NO: 1887029 - RNA, 16 nt, Shigella flexneri 2a str. 2457T
gcgccaggaucagaau

SEQ ID NO: 1887030 - RNA, 14 nt, Shigella flexneri 2a str. 2457T
gcgccgcauccgac

SEQ ID NO: 1887031 - RNA, 15 nt, Shigella flexneri 2a str. 2457T
gcgccgcauccggca

SEQ ID NO: 1887032 - RNA, 16 nt, Shigella flexneri 2a str. 2457T
gcgccgcauccggcau

SEQ ID NO: 1887033 - RNA, 18 nt, Shigella flexneri 2a str. 2457T
gucgagaauaucgauauc

SEQ ID NO: 1887034 - RNA, 11 nt, Shigella flexneri 2a str. 2457T
gucgagaucgc

SEQ ID NO: 1887035 - RNA, 13 nt, Shigella flexneri 2a str. 2457T
gucgcgcagcacu

SEQ ID NO: 1887036 - RNA, 13 nt, Shigella flexneri 2a str. 2457T
gucagaugcggcu

SEQ ID NO: 1887037 - RNA, 19 nt, Shigella flexneri 2a str. 2457T
gucacggugcagcucgcaa

SEQ ID NO: 1887038 - RNA, 20 nt, Shigella flexneri 2a str. 2457T
guccgcgaacagcagcgguu

SEQ ID NO: 1887039 - RNA, 21 nt, Shigella flexneri 2a str. 2457T
guccgcuuuaagcuuuaucgg

SEQ ID NO: 1887040 - RNA, 16 nt, Shigella flexneri 2a str. 2457T
guccucuucagcauca

SEQ ID NO: 1887041 - RNA, 23 nt, Shigella flexneri 2a str. 2457T
gucgugauugucggugccggaac

SEQ ID NO: 1887042 - RNA, 14 nt, Shigella flexneri 2a str. 2457T
gucgugaaacgcgu

SEQ ID NO: 1887043 - RNA, 15 nt, Shigella flexneri 2a str. 2457T
gucuggcccaugcca

SEQ ID NO: 1887044 - RNA, 14 nt, Shigella flexneri 2a str. 2457T
gucugggccgauaa

SEQ ID NO: 1887045 - RNA, 13 nt, Shigella flexneri 2a str. 2457T
gugaauucacaau

SEQ ID NO: 1887046 - RNA, 20 nt, Shigella flexneri 2a str. 2457T
gugacagauuugauuaucaa

SEQ ID NO: 1887047 - RNA, 21 nt, Shigella flexneri 2a str. 2457T
gucgguacuucgauuucgcca

SEQ ID NO: 1887048 - RNA, 18 nt, Shigella flexneri 2a str. 2457T
gucggggccagcauucca

SEQ ID NO: 1887049 - RNA, 15 nt, Shigella flexneri 2a str. 2457T
gucggcagauaacac

SEQ ID NO: 1887050 - RNA, 14 nt, Shigella flexneri 2a str. 2457T
gucgguuucgcgca

SEQ ID NO: 1887051 - RNA, 16 nt, Shigella flexneri 2a str. 2457T
gucgucaguuccauaa

SEQ ID NO: 1887052 - RNA, 17 nt, Shigella flexneri 2a str. 2457T
gugauuagggcggacaa

SEQ ID NO: 1887053 - RNA, 23 nt, Shigella flexneri 2a str. 2457T
gugauuguggcaaucauauucac

SEQ ID NO: 1887054 - RNA, 15 nt, Shigella flexneri 2a str. 2457T
gugaucgugccggau

SEQ ID NO: 1887055 - RNA, 16 nt, Shigella flexneri 2a str. 2457T
gugauuuugugaacau

SEQ ID NO: 1887056 - RNA, 17 nt, Shigella flexneri 2a str. 2457T
gugcacgauugccggau

SEQ ID NO: 1887057 - RNA, 21 nt, Shigella flexneri 2a str. 2457T
gugcagaacggugagcgugcg

SEQ ID NO: 1887058 - RNA, 17 nt, Shigella flexneri 2a str. 2457T
gugagagugaagccuga

SEQ ID NO: 1887059 - RNA, 19 nt, Shigella flexneri 2a str. 2457T
gugccacaccagcuuucgc

SEQ ID NO: 1887060 - RNA, 14 nt, Shigella flexneri 2a str. 2457T
gugcaguacaucgu

SEQ ID NO: 1887061 - RNA, 21 nt, Shigella flexneri 2a str. 2457T
guacaguacugggauucacgu

SEQ ID NO: 1887062 - RNA, 19 nt, Shigella flexneri 2a str. 2457T
guaccaccagaaucgccag

SEQ ID NO: 1887063 - RNA, 15 nt, Shigella flexneri 2a str. 2457T
guacauuaagcgcau

SEQ ID NO: 1887064 - RNA, 15 nt, Shigella flexneri 2a str. 2457T
guacagauccgccau

SEQ ID NO: 1887065 - RNA, 16 nt, Shigella flexneri 2a str. 2457T
guacagauccgccauu

SEQ ID NO: 1887066 - RNA, 12 nt, Shigella flexneri 2a str. 2457T
guacaccaccua

SEQ ID NO: 1887067 - RNA, 21 nt, Shigella flexneri 2a str. 2457T
guacaacuaagccaguucauu

SEQ ID NO: 1887068 - RNA, 19 nt, Shigella flexneri 2a str. 2457T
guaauugcuuuuaccauac

SEQ ID NO: 1887069 - RNA, 22 nt, Shigella flexneri 2a str. 2457T
guaaugccagucaguuaagcaa

SEQ ID NO: 1887070 - RNA, 11 nt, Shigella flexneri 2a str. 2457T
guaaugagaac

SEQ ID NO: 1887071 - RNA, 20 nt, Shigella flexneri 2a str. 2457T
guaacucacugaugccguuu

SEQ ID NO: 1887072 - RNA, 19 nt, Shigella flexneri 2a str. 2457T
guaaaguacguguggucuu

SEQ ID NO: 1887073 - RNA, 19 nt, Shigella flexneri 2a str. 2457T
guaaaggcggcagaacaga

SEQ ID NO: 1887074 - RNA, 13 nt, Shigella flexneri 2a str. 2457T
guaaauaauaucc

SEQ ID NO: 1887075 - RNA, 14 nt, Shigella flexneri 2a str. 2457T
guaaaugacagcga

SEQ ID NO: 1887076 - RNA, 12 nt, Shigella flexneri 2a str. 2457T
guaaaucgccau

SEQ ID NO: 1887077 - RNA, 20 nt, Shigella flexneri 2a str. 2457T
guaaaucccagugccugcau

SEQ ID NO: 1887078 - RNA, 13 nt, Shigella flexneri 2a str. 2457T
guaacgaucgccu

SEQ ID NO: 1887079 - RNA, 15 nt, Shigella flexneri 2a str. 2457T
guaacgcacacaucc

SEQ ID NO: 1887080 - RNA, 14 nt, Shigella flexneri 2a str. 2457T
gguuugcaucgcca

SEQ ID NO: 1887081 - RNA, 20 nt, Shigella flexneri 2a str. 2457T
gguuuuucuugguucugcac

SEQ ID NO: 1887082 - RNA, 18 nt, Shigella flexneri 2a str. 2457T
gguuuucgcgcgcaguua

SEQ ID NO: 1887083 - RNA, 13 nt, Shigella flexneri 2a str. 2457T
gguuuucaaugau

SEQ ID NO: 1887084 - RNA, 18 nt, Shigella flexneri 2a str. 2457T
gguuuguaggccggauaa

SEQ ID NO: 1887085 - RNA, 19 nt, Shigella flexneri 2a str. 2457T
gguuuucucccucgcucug

SEQ ID NO: 1887086 - RNA, 19 nt, Shigella flexneri 2a str. 2457T
gguuuucugucuuaacgca

SEQ ID NO: 1887087 - RNA, 13 nt, Shigella flexneri 2a str. 2457T
ggugucacggugu

SEQ ID NO: 1887088 - RNA, 18 nt, Shigella flexneri 2a str. 2457T
ggugucacaugcagcgcc

SEQ ID NO: 1887089 - RNA, 19 nt, Shigella flexneri 2a str. 2457T
gguuaccaccugcucguca

SEQ ID NO: 1887090 - RNA, 18 nt, Shigella flexneri 2a str. 2457T
gguuauccgccagcgcca

SEQ ID NO: 1887091 - RNA, 19 nt, Shigella flexneri 2a str. 2457T
gucacgccgaccagaccgg

SEQ ID NO: 1887092 - RNA, 21 nt, Shigella flexneri 2a str. 2457T
gucaccacacgccgcaauggc

SEQ ID NO: 1887093 - RNA, 22 nt, Shigella flexneri 2a str. 2457T
gucaaacgcacgucugauguaa

SEQ ID NO: 1887094 - RNA, 22 nt, Shigella flexneri 2a str. 2457T
guaucaggcugaaaaucuucuc

SEQ ID NO: 1887095 - RNA, 14 nt, Shigella flexneri 2a str. 2457T
guaucaaacccuuc

SEQ ID NO: 1887096 - RNA, 19 nt, Shigella flexneri 2a str. 2457T
guaucaagcccgccgggac

SEQ ID NO: 1887097 - RNA, 18 nt, Shigella flexneri 2a str. 2457T
guauccugucauacgcgu

SEQ ID NO: 1887098 - RNA, 20 nt, Shigella flexneri 2a str. 2457T
guagcugcaggaauaaucag

SEQ ID NO: 1887099 - RNA, 20 nt, Shigella flexneri 2a str. 2457T
guagcuggcggcaaugaaag

SEQ ID NO: 1887100 - RNA, 22 nt, Shigella flexneri 2a str. 2457T
guagcugguaccuugaaacgau

SEQ ID NO: 1887101 - RNA, 18 nt, Shigella flexneri 2a str. 2457T
guagcgccauacugacua

SEQ ID NO: 1887102 - RNA, 19 nt, Shigella flexneri 2a str. 2457T
guacuuuuaccuguccggc

SEQ ID NO: 1887103 - RNA, 14 nt, Shigella flexneri 2a str. 2457T
guagaaaaucucaa

SEQ ID NO: 1887104 - RNA, 22 nt, Shigella flexneri 2a str. 2457T
guacuuccggacguucagccau

SEQ ID NO: 1887105 - RNA, 17 nt, Shigella flexneri 2a str. 2457T
guacuucacaaucagcg

SEQ ID NO: 1887106 - RNA, 20 nt, Shigella flexneri 2a str. 2457T
guagcaccgacgucgauaua

SEQ ID NO: 1887107 - RNA, 22 nt, Shigella flexneri 2a str. 2457T
guagccaugcauaaugcagcca

SEQ ID NO: 1887108 - RNA, 17 nt, Shigella flexneri 2a str. 2457T
guaccuucagcggcagc

SEQ ID NO: 1887109 - RNA, 18 nt, Shigella flexneri 2a str. 2457T
guacgaaauaacugaaua

SEQ ID NO: 1887110 - RNA, 19 nt, Shigella flexneri 2a str. 2457T
guacgucauccguggcgac

SEQ ID NO: 1887111 - RNA, 18 nt, Shigella flexneri 2a str. 2457T
guacguagcguuaacgcg

SEQ ID NO: 1887112 - RNA, 19 nt, Shigella flexneri 2a str. 2457T
guacguguuguuccaguaa

SEQ ID NO: 1887113 - RNA, 15 nt, Shigella flexneri 2a str. 2457T
guacguucauggcgc

SEQ ID NO: 1887114 - RNA, 22 nt, Shigella flexneri 2a str. 2457T
guaccguugcugccagugcggu

SEQ ID NO: 1887115 - RNA, 15 nt, Shigella flexneri 2a str. 2457T
guaccaccgcgaaaa

SEQ ID NO: 1887116 - RNA, 13 nt, Shigella flexneri 2a str. 2457T
guaccaucgccag

SEQ ID NO: 1887117 - RNA, 20 nt, Shigella flexneri 2a str. 2457T
gggcguccugcuugccagau

SEQ ID NO: 1887118 - RNA, 20 nt, Shigella flexneri 2a str. 2457T
gguaaguacgccaucacgca

SEQ ID NO: 1887119 - RNA, 23 nt, Shigella flexneri 2a str. 2457T
gguaagcgccacaaucgcuucau

SEQ ID NO: 1887120 - RNA, 15 nt, Shigella flexneri 2a str. 2457T
gguaagccgccggua

SEQ ID NO: 1887121 - RNA, 13 nt, Shigella flexneri 2a str. 2457T
gguaagcaaaggu

SEQ ID NO: 1887122 - RNA, 21 nt, Shigella flexneri 2a str. 2457T
gguaaugacuccaacuuacug

SEQ ID NO: 1887123 - RNA, 22 nt, Shigella flexneri 2a str. 2457T
gguaaugccagucaguuaagca

SEQ ID NO: 1887124 - RNA, 14 nt, Shigella flexneri 2a str. 2457T
gguaaacauccguu

SEQ ID NO: 1887125 - RNA, 22 nt, Shigella flexneri 2a str. 2457T
gguaaagaagagcggcaaacgu

SEQ ID NO: 1887126 - RNA, 19 nt, Shigella flexneri 2a str. 2457T
ggguuagucugcauuuucu

SEQ ID NO: 1887127 - RNA, 17 nt, Shigella flexneri 2a str. 2457T
ggguucaccgcgagcau

SEQ ID NO: 1887128 - RNA, 15 nt, Shigella flexneri 2a str. 2457T
ggguguuaagcgcag

SEQ ID NO: 1887129 - RNA, 17 nt, Shigella flexneri 2a str. 2457T
ggguugccaccgguaca

SEQ ID NO: 1887130 - RNA, 20 nt, Shigella flexneri 2a str. 2457T
ggucacgauggaaccguaca

SEQ ID NO: 1887131 - RNA, 18 nt, Shigella flexneri 2a str. 2457T
ggucaccaguucacgcga

SEQ ID NO: 1887132 - RNA, 22 nt, Shigella flexneri 2a str. 2457T
ggucaccugccagggugcuggc

SEQ ID NO: 1887133 - RNA, 22 nt, Shigella flexneri 2a str. 2457T
ggucaacauucccugcaccggu

SEQ ID NO: 1887134 - RNA, 22 nt, Shigella flexneri 2a str. 2457T
ggucaauguugaggcuaccgga

SEQ ID NO: 1887135 - RNA, 21 nt, Shigella flexneri 2a str. 2457T
gguagagcagcgcauucguaa

SEQ ID NO: 1887136 - RNA, 19 nt, Shigella flexneri 2a str. 2457T
gguacuucgauuucgccac

SEQ ID NO: 1887137 - RNA, 15 nt, Shigella flexneri 2a str. 2457T
gguaggccugauaag

SEQ ID NO: 1887138 - RNA, 18 nt, Shigella flexneri 2a str. 2457T
gguauaccgaaaucgcca

SEQ ID NO: 1887139 - RNA, 13 nt, Shigella flexneri 2a str. 2457T
gguauauaacgca

SEQ ID NO: 1887140 - RNA, 15 nt, Shigella flexneri 2a str. 2457T
ggucgcuuuguggcg

SEQ ID NO: 1887141 - RNA, 21 nt, Shigella flexneri 2a str. 2457T
ggucuuacuggggaaguggcg

SEQ ID NO: 1887142 - RNA, 15 nt, Shigella flexneri 2a str. 2457T
ggucuggaacuggcu

SEQ ID NO: 1887143 - RNA, 22 nt, Shigella flexneri 2a str. 2457T
ggucguucgcccauuccaguaa

SEQ ID NO: 1887144 - RNA, 15 nt, Shigella flexneri 2a str. 2457T
ggugauguauaucgg

SEQ ID NO: 1887145 - RNA, 12 nt, Shigella flexneri 2a str. 2457T
ggugcagccgug

SEQ ID NO: 1887146 - RNA, 16 nt, Shigella flexneri 2a str. 2457T
ggugaaggcaaacugu

SEQ ID NO: 1887147 - RNA, 13 nt, Shigella flexneri 2a str. 2457T
ggugaaggcaaac

SEQ ID NO: 1887148 - RNA, 15 nt, Shigella flexneri 2a str. 2457T
ggucaucacauccca

SEQ ID NO: 1887149 - RNA, 17 nt, Shigella flexneri 2a str. 2457T
ggucaguugccagacgg

SEQ ID NO: 1887150 - RNA, 13 nt, Shigella flexneri 2a str. 2457T
ggucagugccugc

SEQ ID NO: 1887151 - RNA, 14 nt, Shigella flexneri 2a str. 2457T
ggucagcaucguca

SEQ ID NO: 1887152 - RNA, 17 nt, Shigella flexneri 2a str. 2457T
ggucgaaauaauguuuc

SEQ ID NO: 1887153 - RNA, 20 nt, Shigella flexneri 2a str. 2457T
ggucgaaaauaucgguuccg

SEQ ID NO: 1887154 - RNA, 18 nt, Shigella flexneri 2a str. 2457T
gguccuggucugaugaau

SEQ ID NO: 1887155 - RNA, 20 nt, Shigella flexneri 2a str. 2457T
gguccuaacaaccaucccca

SEQ ID NO: 1887156 - RNA, 14 nt, Shigella flexneri 2a str. 2457T
ggucgacagcagcc

SEQ ID NO: 1887157 - RNA, 19 nt, Shigella flexneri 2a str. 2457T
ggucgcugacgccaugcca

SEQ ID NO: 1887158 - RNA, 21 nt, Shigella flexneri 2a str. 2457T
ggucgccagcauucccgccag

SEQ ID NO: 1887159 - RNA, 18 nt, Shigella flexneri 2a str. 2457T
ggccuuuuuauuuauuca

SEQ ID NO: 1887160 - RNA, 18 nt, Shigella flexneri 2a str. 2457T
ggccguaacugugccaaa

SEQ ID NO: 1887161 - RNA, 11 nt, Shigella flexneri 2a str. 2457T
ggccgcuuucu

SEQ ID NO: 1887162 - RNA, 18 nt, Shigella flexneri 2a str. 2457T
ggccggaugucgcugcua

SEQ ID NO: 1887163 - RNA, 19 nt, Shigella flexneri 2a str. 2457T
ggccgccacacagcacgca

SEQ ID NO: 1887164 - RNA, 17 nt, Shigella flexneri 2a str. 2457T
ggccgcaaaccagcgca

SEQ ID NO: 1887165 - RNA, 20 nt, Shigella flexneri 2a str. 2457T
ggagacgguuucugcucgca

SEQ ID NO: 1887166 - RNA, 19 nt, Shigella flexneri 2a str. 2457T
ggauuaugcccgcagcgca

SEQ ID NO: 1887167 - RNA, 19 nt, Shigella flexneri 2a str. 2457T
ggauguucgacuuaacgcg

SEQ ID NO: 1887168 - RNA, 18 nt, Shigella flexneri 2a str. 2457T
ggauugcuccugcucauc

SEQ ID NO: 1887169 - RNA, 19 nt, Shigella flexneri 2a str. 2457T
ggauuuucaccaucgccau

SEQ ID NO: 1887170 - RNA, 16 nt, Shigella flexneri 2a str. 2457T
ggcaaauaccggacac

SEQ ID NO: 1887171 - RNA, 20 nt, Shigella flexneri 2a str. 2457T
ggcaaauuacuggcggcaaa

SEQ ID NO: 1887172 - RNA, 16 nt, Shigella flexneri 2a str. 2457T
ggcaaauucuucacgg

SEQ ID NO: 1887173 - RNA, 22 nt, Shigella flexneri 2a str. 2457T
ggcaaauacaguugcgccagua

SEQ ID NO: 1887174 - RNA, 12 nt, Shigella flexneri 2a str. 2457T
ggcaaacgcccu

SEQ ID NO: 1887175 - RNA, 20 nt, Shigella flexneri 2a str. 2457T
ggcaagugguuaaacccgcu

SEQ ID NO: 1887176 - RNA, 20 nt, Shigella flexneri 2a str. 2457T
ggcaagaaaauuauucgccg

SEQ ID NO: 1887177 - RNA, 18 nt, Shigella flexneri 2a str. 2457T
ggcaacugcugcgguuga

SEQ ID NO: 1887178 - RNA, 12 nt, Shigella flexneri 2a str. 2457T
ggcaacguucca

SEQ ID NO: 1887179 - RNA, 14 nt, Shigella flexneri 2a str. 2457T
ggcaauuucacguu

SEQ ID NO: 1887180 - RNA, 12 nt, Shigella flexneri 2a str. 2457T
ggcaauucaccg

SEQ ID NO: 1887181 - RNA, 18 nt, Shigella flexneri 2a str. 2457T
ggcaauguagcgcugcaa

SEQ ID NO: 1887182 - RNA, 15 nt, Shigella flexneri 2a str. 2457T
ggcaaugcccggugu

SEQ ID NO: 1887183 - RNA, 21 nt, Shigella flexneri 2a str. 2457T
ggcacauuucacucacgccgu

SEQ ID NO: 1887184 - RNA, 22 nt, Shigella flexneri 2a str. 2457T
ggcacaucgacggugacacuuu

SEQ ID NO: 1887185 - RNA, 13 nt, Shigella flexneri 2a str. 2457T
ggcaccacuugca

SEQ ID NO: 1887186 - RNA, 11 nt, Shigella flexneri 2a str. 2457T
ggcaccauuua

SEQ ID NO: 1887187 - RNA, 16 nt, Shigella flexneri 2a str. 2457T
ggcacgucuucgauau

SEQ ID NO: 1887188 - RNA, 20 nt, Shigella flexneri 2a str. 2457T
ggcacuuacucauuaaugca

SEQ ID NO: 1887189 - RNA, 19 nt, Shigella flexneri 2a str. 2457T
ggcacuggauuauuacugg

SEQ ID NO: 1887190 - RNA, 21 nt, Shigella flexneri 2a str. 2457T
ggcagaauaacggcugauaac

SEQ ID NO: 1887191 - RNA, 17 nt, Shigella flexneri 2a str. 2457T
ggcagaauaacggcaga

SEQ ID NO: 1887192 - RNA, 12 nt, Shigella flexneri 2a str. 2457T
ggcaucgugcac

SEQ ID NO: 1887193 - RNA, 15 nt, Shigella flexneri 2a str. 2457T
ggcauuuacgccgca

SEQ ID NO: 1887194 - RNA, 21 nt, Shigella flexneri 2a str. 2457T
ggcauuuacgccgcauccggc

SEQ ID NO: 1887195 - RNA, 15 nt, Shigella flexneri 2a str. 2457T
ggcaugauucauccg

SEQ ID NO: 1887196 - RNA, 23 nt, Shigella flexneri 2a str. 2457T
ggccaggaacgggauugccagca

SEQ ID NO: 1887197 - RNA, 18 nt, Shigella flexneri 2a str. 2457T
ggcauuugcuccagacgc

SEQ ID NO: 1887198 - RNA, 18 nt, Shigella flexneri 2a str. 2457T
ggcauuuggcucucgaug

SEQ ID NO: 1887199 - RNA, 18 nt, Shigella flexneri 2a str. 2457T
ggcgcgucgaaaacggcu

SEQ ID NO: 1887200 - RNA, 12 nt, Shigella flexneri 2a str. 2457T
ggcgcgguuucu

SEQ ID NO: 1887201 - RNA, 12 nt, Shigella flexneri 2a str. 2457T
ggcgcgcgcuuu

SEQ ID NO: 1887202 - RNA, 19 nt, Shigella flexneri 2a str. 2457T
ggcggucaugacgauacgg

SEQ ID NO: 1887203 - RNA, 22 nt, Shigella flexneri 2a str. 2457T
ggcgaugcggggugcaucgccc

SEQ ID NO: 1887204 - RNA, 16 nt, Shigella flexneri 2a str. 2457T
ggcuggcacgcucuuc

SEQ ID NO: 1887205 - RNA, 18 nt, Shigella flexneri 2a str. 2457T
ggcuggagagggugaccg

SEQ ID NO: 1887206 - RNA, 12 nt, Shigella flexneri 2a str. 2457T
ggcuggccaauu

SEQ ID NO: 1887207 - RNA, 14 nt, Shigella flexneri 2a str. 2457T
ggcugcauaaugcg

SEQ ID NO: 1887208 - RNA, 22 nt, Shigella flexneri 2a str. 2457T
ggcugagcaaacaguucugcag

SEQ ID NO: 1887209 - RNA, 14 nt, Shigella flexneri 2a str. 2457T
ggcuccgcaagcga

SEQ ID NO: 1887210 - RNA, 14 nt, Shigella flexneri 2a str. 2457T
ggcgugaacgcgcu

SEQ ID NO: 1887211 - RNA, 22 nt, Shigella flexneri 2a str. 2457T
ggcguucugccuggcgcagcaa

SEQ ID NO: 1887212 - RNA, 21 nt, Shigella flexneri 2a str. 2457T
ggcuaucucaccccauuugcc

SEQ ID NO: 1887213 - RNA, 19 nt, Shigella flexneri 2a str. 2457T
ggcguuuacgccgcaucag

SEQ ID NO: 1887214 - RNA, 21 nt, Shigella flexneri 2a str. 2457T
ggcuaacacccgucguugcaa

SEQ ID NO: 1887215 - RNA, 13 nt, Shigella flexneri 2a str. 2457T
gggcgcgcucagc

SEQ ID NO: 1887216 - RNA, 21 nt, Shigella flexneri 2a str. 2457T
gggcgcggaaagcaccugcgc

SEQ ID NO: 1887217 - RNA, 18 nt, Shigella flexneri 2a str. 2457T
gggcgcggaaagcaccug

SEQ ID NO: 1887218 - RNA, 14 nt, Shigella flexneri 2a str. 2457T
gggccugaguuacc

SEQ ID NO: 1887219 - RNA, 22 nt, Shigella flexneri 2a str. 2457T
ggcuucuucagguggacgccgu

SEQ ID NO: 1887220 - RNA, 15 nt, Shigella flexneri 2a str. 2457T
ggcuuguacgccgcc

SEQ ID NO: 1887221 - RNA, 17 nt, Shigella flexneri 2a str. 2457T
ggcuuucacgucaggau

SEQ ID NO: 1887222 - RNA, 17 nt, Shigella flexneri 2a str. 2457T
ggcuuucgcaauaauca

SEQ ID NO: 1887223 - RNA, 12 nt, Shigella flexneri 2a str. 2457T
gggaauggcaga

SEQ ID NO: 1887224 - RNA, 13 nt, Shigella flexneri 2a str. 2457T
gggauguguaagu

SEQ ID NO: 1887225 - RNA, 19 nt, Shigella flexneri 2a str. 2457T
gggauguaauuaagcgcaa

SEQ ID NO: 1887226 - RNA, 14 nt, Shigella flexneri 2a str. 2457T
cucuggccgcuucc

SEQ ID NO: 1887227 - RNA, 21 nt, Shigella flexneri 2a str. 2457T
cucucaccacgcuccaucaug

SEQ ID NO: 1887228 - RNA, 14 nt, Shigella flexneri 2a str. 2457T
cucuccugccaguu

SEQ ID NO: 1887229 - RNA, 11 nt, Shigella flexneri 2a str. 2457T
cucuuccaguc

SEQ ID NO: 1887230 - RNA, 17 nt, Shigella flexneri 2a str. 2457T
cucuucgcgaucaaacg

SEQ ID NO: 1887231 - RNA, 14 nt, Shigella flexneri 2a str. 2457T
cucuguuuccagau

SEQ ID NO: 1887232 - RNA, 17 nt, Shigella flexneri 2a str. 2457T
cucuguuggcgacguuu

SEQ ID NO: 1887233 - RNA, 22 nt, Shigella flexneri 2a str. 2457T
cugaaaccgugcaucuguuggu

SEQ ID NO: 1887234 - RNA, 22 nt, Shigella flexneri 2a str. 2457T
cucuugaaauggucgauaucga

SEQ ID NO: 1887235 - RNA, 14 nt, Shigella flexneri 2a str. 2457T
cucuucuuccggca

SEQ ID NO: 1887236 - RNA, 12 nt, Shigella flexneri 2a str. 2457T
cucggugaccga

SEQ ID NO: 1887237 - RNA, 21 nt, Shigella flexneri 2a str. 2457T
cucgucagcauuacccagaua

SEQ ID NO: 1887238 - RNA, 18 nt, Shigella flexneri 2a str. 2457T
cucgguaaaacuaacgcc

SEQ ID NO: 1887239 - RNA, 19 nt, Shigella flexneri 2a str. 2457T
cugauggaauuucaucauc

SEQ ID NO: 1887240 - RNA, 18 nt, Shigella flexneri 2a str. 2457T
cugauaaaucaccugcgc

SEQ ID NO: 1887241 - RNA, 19 nt, Shigella flexneri 2a str. 2457T
cugauaagcccagcgacca

SEQ ID NO: 1887242 - RNA, 15 nt, Shigella flexneri 2a str. 2457T
cugauaacgugcagc

SEQ ID NO: 1887243 - RNA, 17 nt, Shigella flexneri 2a str. 2457T
cugauaaaaaccauuca

SEQ ID NO: 1887244 - RNA, 20 nt, Shigella flexneri 2a str. 2457T
cugaguugccaucaucacca

SEQ ID NO: 1887245 - RNA, 18 nt, Shigella flexneri 2a str. 2457T
cugagucaauuucugcaa

SEQ ID NO: 1887246 - RNA, 13 nt, Shigella flexneri 2a str. 2457T
cugauucgucaau

SEQ ID NO: 1887247 - RNA, 19 nt, Shigella flexneri 2a str. 2457T
cugauuccgguuggccugc

SEQ ID NO: 1887248 - RNA, 21 nt, Shigella flexneri 2a str. 2457T
cugauuugauaaugccagccu

SEQ ID NO: 1887249 - RNA, 14 nt, Shigella flexneri 2a str. 2457T
cugauguucgccag

SEQ ID NO: 1887250 - RNA, 19 nt, Shigella flexneri 2a str. 2457T
cugcacaaauagccagcag

SEQ ID NO: 1887251 - RNA, 18 nt, Shigella flexneri 2a str. 2457T
cugcacaccgcggaacgc

SEQ ID NO: 1887252 - RNA, 14 nt, Shigella flexneri 2a str. 2457T
cugaccuucuucag

SEQ ID NO: 1887253 - RNA, 13 nt, Shigella flexneri 2a str. 2457T
cugaagcaaacuu

SEQ ID NO: 1887254 - RNA, 16 nt, Shigella flexneri 2a str. 2457T
cugacugucgcagcca

SEQ ID NO: 1887255 - RNA, 14 nt, Shigella flexneri 2a str. 2457T
cugacugcgccacu

SEQ ID NO: 1887256 - RNA, 19 nt, Shigella flexneri 2a str. 2457T
cugacguuuucucguccag

SEQ ID NO: 1887257 - RNA, 23 nt, Shigella flexneri 2a str. 2457T
cugacguuaagaaaacggaagcu

SEQ ID NO: 1887258 - RNA, 11 nt, Shigella flexneri 2a str. 2457T
cugagaacgca

SEQ ID NO: 1887259 - RNA, 14 nt, Shigella flexneri 2a str. 2457T
cugagacgcgcuug

SEQ ID NO: 1887260 - RNA, 12 nt, Shigella flexneri 2a str. 2457T
cucccgccagcg

SEQ ID NO: 1887261 - RNA, 14 nt, Shigella flexneri 2a str. 2457T
cuccgucagcacgc

SEQ ID NO: 1887262 - RNA, 16 nt, Shigella flexneri 2a str. 2457T
cuccugcccuugccaa

SEQ ID NO: 1887263 - RNA, 12 nt, Shigella flexneri 2a str. 2457T
cucgacgucaca

SEQ ID NO: 1887264 - RNA, 14 nt, Shigella flexneri 2a str. 2457T
cucgcgccgcaucc

SEQ ID NO: 1887265 - RNA, 23 nt, Shigella flexneri 2a str. 2457T
cucgcuccauuccaucgccuggu

SEQ ID NO: 1887266 - RNA, 17 nt, Shigella flexneri 2a str. 2457T
cucggcuuugguaucga

SEQ ID NO: 1887267 - RNA, 20 nt, Shigella flexneri 2a str. 2457T
cuccagacgccagaugcggc

SEQ ID NO: 1887268 - RNA, 16 nt, Shigella flexneri 2a str. 2457T
cuccagguuaacggag

SEQ ID NO: 1887269 - RNA, 19 nt, Shigella flexneri 2a str. 2457T
cuccagauuaccagcgaca

SEQ ID NO: 1887270 - RNA, 20 nt, Shigella flexneri 2a str. 2457T
cuccaguuuguucagcugcg

SEQ ID NO: 1887271 - RNA, 21 nt, Shigella flexneri 2a str. 2457T
cucauuuuccgggauugagau

SEQ ID NO: 1887272 - RNA, 22 nt, Shigella flexneri 2a str. 2457T
cucaucaggccuggacucuuau

SEQ ID NO: 1887273 - RNA, 15 nt, Shigella flexneri 2a str. 2457T
cuccaacacaucgau

SEQ ID NO: 1887274 - RNA, 18 nt, Shigella flexneri 2a str. 2457T
cucauacaccagcggcac

SEQ ID NO: 1887275 - RNA, 23 nt, Shigella flexneri 2a str. 2457T
cucaguuuauagaacggcagaga

SEQ ID NO: 1887276 - RNA, 16 nt, Shigella flexneri 2a str. 2457T
cuccacagucaggcug

SEQ ID NO: 1887277 - RNA, 19 nt, Shigella flexneri 2a str. 2457T
cucagauucagauuauguc

SEQ ID NO: 1887278 - RNA, 13 nt, Shigella flexneri 2a str. 2457T
cucaccgccagca

SEQ ID NO: 1887279 - RNA, 20 nt, Shigella flexneri 2a str. 2457T
cucaccugauacgcgccaau

SEQ ID NO: 1887280 - RNA, 18 nt, Shigella flexneri 2a str. 2457T
cucaccgaugaucgccau

SEQ ID NO: 1887281 - RNA, 14 nt, Shigella flexneri 2a str. 2457T
cuauuucuugugca

SEQ ID NO: 1887282 - RNA, 13 nt, Shigella flexneri 2a str. 2457T
cuauugcgcuaaa

SEQ ID NO: 1887283 - RNA, 15 nt, Shigella flexneri 2a str. 2457T
cuauucgccagcacg

SEQ ID NO: 1887284 - RNA, 14 nt, Shigella flexneri 2a str. 2457T
cuauuuccggcgac

SEQ ID NO: 1887285 - RNA, 19 nt, Shigella flexneri 2a str. 2457T
cucaaaacguccggcaaua

SEQ ID NO: 1887286 - RNA, 16 nt, Shigella flexneri 2a str. 2457T
cucaaaccaauggcau

SEQ ID NO: 1887287 - RNA, 18 nt, Shigella flexneri 2a str. 2457T
cuacgcucaucaggccua

SEQ ID NO: 1887288 - RNA, 18 nt, Shigella flexneri 2a str. 2457T
cuacgugaggcaucagac

SEQ ID NO: 1887289 - RNA, 17 nt, Shigella flexneri 2a str. 2457T
cuauuaugacuccagcg

SEQ ID NO: 1887290 - RNA, 17 nt, Shigella flexneri 2a str. 2457T
cuaugucgcauccggca

SEQ ID NO: 1887291 - RNA, 15 nt, Shigella flexneri 2a str. 2457T
cuaauguauggcgau

SEQ ID NO: 1887292 - RNA, 22 nt, Shigella flexneri 2a str. 2457T
cuacaaaaccacacuucuucag

SEQ ID NO: 1887293 - RNA, 13 nt, Shigella flexneri 2a str. 2457T
cuaauucaacgcc

SEQ ID NO: 1887294 - RNA, 18 nt, Shigella flexneri 2a str. 2457T
cuaauuuuuugcgccacu

SEQ ID NO: 1887295 - RNA, 14 nt, Shigella flexneri 2a str. 2457T
cuacaaaaucuauu

SEQ ID NO: 1887296 - RNA, 18 nt, Shigella flexneri 2a str. 2457T
cuaccaugaugauaucac

SEQ ID NO: 1887297 - RNA, 15 nt, Shigella flexneri 2a str. 2457T
cuaccagcaccugcu

SEQ ID NO: 1887298 - RNA, 16 nt, Shigella flexneri 2a str. 2457T
cuaaggcagccagaug

SEQ ID NO: 1887299 - RNA, 15 nt, Shigella flexneri 2a str. 2457T
cuaacggaauugcca

SEQ ID NO: 1887300 - RNA, 16 nt, Shigella flexneri 2a str. 2457T
cuaacgaugccagcac

SEQ ID NO: 1887301 - RNA, 22 nt, Shigella flexneri 2a str. 2457T
cuaacccgcagcuuaaugaacu

SEQ ID NO: 1887302 - RNA, 14 nt, Shigella flexneri 2a str. 2457T
cuaaucgagccgau

SEQ ID NO: 1887303 - RNA, 17 nt, Shigella flexneri 2a str. 2457T
cuaaggucaccaguuca

SEQ ID NO: 1887304 - RNA, 18 nt, Shigella flexneri 2a str. 2457T
cuaaguugaaucggcugc

SEQ ID NO: 1887305 - RNA, 19 nt, Shigella flexneri 2a str. 2457T
cguugcuuuuugcgcaucc

SEQ ID NO: 1887306 - RNA, 14 nt, Shigella flexneri 2a str. 2457T
cguugcgaucgacc

SEQ ID NO: 1887307 - RNA, 20 nt, Shigella flexneri 2a str. 2457T
cguugaaggguauugccgau

SEQ ID NO: 1887308 - RNA, 15 nt, Shigella flexneri 2a str. 2457T
cguugcaaucagcgg

SEQ ID NO: 1887309 - RNA, 20 nt, Shigella flexneri 2a str. 2457T
cguuccuggaaccagugaau

SEQ ID NO: 1887310 - RNA, 18 nt, Shigella flexneri 2a str. 2457T
cguuuucuauuaucagaa

SEQ ID NO: 1887311 - RNA, 18 nt, Shigella flexneri 2a str. 2457T
cguuuuucuucagcagcc

SEQ ID NO: 1887312 - RNA, 20 nt, Shigella flexneri 2a str. 2457T
cguuucucuguucagccuga

SEQ ID NO: 1887313 - RNA, 17 nt, Shigella flexneri 2a str. 2457T
cguuugccagugccguu

SEQ ID NO: 1887314 - RNA, 17 nt, Shigella flexneri 2a str. 2457T
cuaacacugcguacagc

SEQ ID NO: 1887315 - RNA, 14 nt, Shigella flexneri 2a str. 2457T
cuaaacaacgccgc

SEQ ID NO: 1887316 - RNA, 16 nt, Shigella flexneri 2a str. 2457T
cuaaacguuagcacga

SEQ ID NO: 1887317 - RNA, 17 nt, Shigella flexneri 2a str. 2457T
cguuggugauaaaacgc

SEQ ID NO: 1887318 - RNA, 18 nt, Shigella flexneri 2a str. 2457T
cguuguaguguuccugcg

SEQ ID NO: 1887319 - RNA, 21 nt, Shigella flexneri 2a str. 2457T
cguuuacgccgcauccggcau

SEQ ID NO: 1887320 - RNA, 16 nt, Shigella flexneri 2a str. 2457T
cguuuagccgccguua

SEQ ID NO: 1887321 - RNA, 15 nt, Shigella flexneri 2a str. 2457T
cguuucaucuucagu

SEQ ID NO: 1887322 - RNA, 14 nt, Shigella flexneri 2a str. 2457T
cguuuccagcacca

SEQ ID NO: 1887323 - RNA, 16 nt, Shigella flexneri 2a str. 2457T
cguuucagguuaaugc

SEQ ID NO: 1887324 - RNA, 22 nt, Shigella flexneri 2a str. 2457T
cguuuauuuccccgcucuaccu

SEQ ID NO: 1887325 - RNA, 17 nt, Shigella flexneri 2a str. 2457T
cguuucaccgcacgacg

SEQ ID NO: 1887326 - RNA, 16 nt, Shigella flexneri 2a str. 2457T
cguuucacugccggac

SEQ ID NO: 1887327 - RNA, 14 nt, Shigella flexneri 2a str. 2457T
cguugugauuaaac

SEQ ID NO: 1887328 - RNA, 14 nt, Shigella flexneri 2a str. 2457T
cguugugucgccag

SEQ ID NO: 1887329 - RNA, 15 nt, Shigella flexneri 2a str. 2457T
cguuguucuacgugc

SEQ ID NO: 1887330 - RNA, 19 nt, Shigella flexneri 2a str. 2457T
cgucucccgaugccagcac

SEQ ID NO: 1887331 - RNA, 23 nt, Shigella flexneri 2a str. 2457T
cgucuggaacggcagauccaaac

SEQ ID NO: 1887332 - RNA, 11 nt, Shigella flexneri 2a str. 2457T
cgucugcugga

SEQ ID NO: 1887333 - RNA, 21 nt, Shigella flexneri 2a str. 2457T
cgucgucagcaguucacgcag

SEQ ID NO: 1887334 - RNA, 13 nt, Shigella flexneri 2a str. 2457T
cgugccgccagca

SEQ ID NO: 1887335 - RNA, 14 nt, Shigella flexneri 2a str. 2457T
cgugccgguaaugc

SEQ ID NO: 1887336 - RNA, 18 nt, Shigella flexneri 2a str. 2457T
cgugcgcaauaacccaga

SEQ ID NO: 1887337 - RNA, 18 nt, Shigella flexneri 2a str. 2457T
cgugcgggagaguaucca

SEQ ID NO: 1887338 - RNA, 19 nt, Shigella flexneri 2a str. 2457T
cgugcucgacagcgcuaau

SEQ ID NO: 1887339 - RNA, 21 nt, Shigella flexneri 2a str. 2457T
cgugcagaacauccagcucgc

SEQ ID NO: 1887340 - RNA, 16 nt, Shigella flexneri 2a str. 2457T
cgucaucagcgccaac

SEQ ID NO: 1887341 - RNA, 15 nt, Shigella flexneri 2a str. 2457T
cgucaggcaaccgcu

SEQ ID NO: 1887342 - RNA, 18 nt, Shigella flexneri 2a str. 2457T
cguccauuucagcgcaga

SEQ ID NO: 1887343 - RNA, 13 nt, Shigella flexneri 2a str. 2457T
cgucccagccuug

SEQ ID NO: 1887344 - RNA, 22 nt, Shigella flexneri 2a str. 2457T
cguccaugcugucggcugccag

SEQ ID NO: 1887345 - RNA, 18 nt, Shigella flexneri 2a str. 2457T
cgucgccagacgcagcaa

SEQ ID NO: 1887346 - RNA, 15 nt, Shigella flexneri 2a str. 2457T
cgucgcauccggcaa

SEQ ID NO: 1887347 - RNA, 20 nt, Shigella flexneri 2a str. 2457T
cgucggcaucgggcagcauc

SEQ ID NO: 1887348 - RNA, 14 nt, Shigella flexneri 2a str. 2457T
cgucgcuuuccagu

SEQ ID NO: 1887349 - RNA, 13 nt, Shigella flexneri 2a str. 2457T
cgucaccggaacc

SEQ ID NO: 1887350 - RNA, 21 nt, Shigella flexneri 2a str. 2457T
cguauagaucacuuugcggau

SEQ ID NO: 1887351 - RNA, 18 nt, Shigella flexneri 2a str. 2457T
cgucaaggguugccggau

SEQ ID NO: 1887352 - RNA, 21 nt, Shigella flexneri 2a str. 2457T
cgucaauuuguuccgccagcg

SEQ ID NO: 1887353 - RNA, 20 nt, Shigella flexneri 2a str. 2457T
cguaucuucaugcuccagca

SEQ ID NO: 1887354 - RNA, 14 nt, Shigella flexneri 2a str. 2457T
cguaguaguucauc

SEQ ID NO: 1887355 - RNA, 20 nt, Shigella flexneri 2a str. 2457T
cguaggccugauaagcguag

SEQ ID NO: 1887356 - RNA, 20 nt, Shigella flexneri 2a str. 2457T
cguaggccagauaaggcguu

SEQ ID NO: 1887357 - RNA, 20 nt, Shigella flexneri 2a str. 2457T
cguaggccggauaaggcgua

SEQ ID NO: 1887358 - RNA, 22 nt, Shigella flexneri 2a str. 2457T
cguaccaaccgcaauugcugua

SEQ ID NO: 1887359 - RNA, 21 nt, Shigella flexneri 2a str. 2457T
cguacauugccgacauggcaa

SEQ ID NO: 1887360 - RNA, 19 nt, Shigella flexneri 2a str. 2457T
cguaccacgcacagcccgc

SEQ ID NO: 1887361 - RNA, 18 nt, Shigella flexneri 2a str. 2457T
cguaccacgcacagcccg

SEQ ID NO: 1887362 - RNA, 16 nt, Shigella flexneri 2a str. 2457T
cguacuguuauccgcc

SEQ ID NO: 1887363 - RNA, 13 nt, Shigella flexneri 2a str. 2457T
cguacccggcgac

SEQ ID NO: 1887364 - RNA, 16 nt, Shigella flexneri 2a str. 2457T
cguaccaugcgcauca

SEQ ID NO: 1887365 - RNA, 20 nt, Shigella flexneri 2a str. 2457T
cgguguccacuuccgcguca

SEQ ID NO: 1887366 - RNA, 19 nt, Shigella flexneri 2a str. 2457T
cgguguccacuuccgcguc

SEQ ID NO: 1887367 - RNA, 14 nt, Shigella flexneri 2a str. 2457T
cgguuccagcuuca

SEQ ID NO: 1887368 - RNA, 20 nt, Shigella flexneri 2a str. 2457T
cggugugcgggaacauauca

SEQ ID NO: 1887369 - RNA, 15 nt, Shigella flexneri 2a str. 2457T
cgguucgucauacuc

SEQ ID NO: 1887370 - RNA, 19 nt, Shigella flexneri 2a str. 2457T
cgguuucacuauuaccgau

SEQ ID NO: 1887371 - RNA, 17 nt, Shigella flexneri 2a str. 2457T
cgguuucagcagcggca

SEQ ID NO: 1887372 - RNA, 16 nt, Shigella flexneri 2a str. 2457T
cgguuucaauccaggu

SEQ ID NO: 1887373 - RNA, 13 nt, Shigella flexneri 2a str. 2457T
cguaaacgccuua

SEQ ID NO: 1887374 - RNA, 21 nt, Shigella flexneri 2a str. 2457T
cguaaacgccuuauccggccu

SEQ ID NO: 1887375 - RNA, 17 nt, Shigella flexneri 2a str. 2457T
cguaaucgcccgcuucc

SEQ ID NO: 1887376 - RNA, 16 nt, Shigella flexneri 2a str. 2457T
cguaaaacugccugau

SEQ ID NO: 1887377 - RNA, 15 nt, Shigella flexneri 2a str. 2457T
cguaaugucggugaa

SEQ ID NO: 1887378 - RNA, 21 nt, Shigella flexneri 2a str. 2457T
cggugauaaacccaacggcaa

SEQ ID NO: 1887379 - RNA, 14 nt, Shigella flexneri 2a str. 2457T
cggugcaccgcauc

SEQ ID NO: 1887380 - RNA, 18 nt, Shigella flexneri 2a str. 2457T
cggugcaaaugccagaua

SEQ ID NO: 1887381 - RNA, 13 nt, Shigella flexneri 2a str. 2457T
cggugauuuccgc

SEQ ID NO: 1887382 - RNA, 16 nt, Shigella flexneri 2a str. 2457T
cggugcaaaugccaga

SEQ ID NO: 1887383 - RNA, 17 nt, Shigella flexneri 2a str. 2457T
cggugcaaaugccagau

SEQ ID NO: 1887384 - RNA, 19 nt, Shigella flexneri 2a str. 2457T
cgguggcguuuccagcagu

SEQ ID NO: 1887385 - RNA, 18 nt, Shigella flexneri 2a str. 2457T
cgguggaacauuuaccgc

SEQ ID NO: 1887386 - RNA, 22 nt, Shigella flexneri 2a str. 2457T
cgguggaccacggcgugccguc

SEQ ID NO: 1887387 - RNA, 15 nt, Shigella flexneri 2a str. 2457T
cggugcgaacaauca

SEQ ID NO: 1887388 - RNA, 16 nt, Shigella flexneri 2a str. 2457T
cugucauuacgggcaa

SEQ ID NO: 1887389 - RNA, 15 nt, Shigella flexneri 2a str. 2457T
cugucguccagacgc

SEQ ID NO: 1887390 - RNA, 14 nt, Shigella flexneri 2a str. 2457T
cuguauacgggcuu

SEQ ID NO: 1887391 - RNA, 19 nt, Shigella flexneri 2a str. 2457T
cuguaucccagcccagcgg

SEQ ID NO: 1887392 - RNA, 13 nt, Shigella flexneri 2a str. 2457T
cuguggcgcgaag

SEQ ID NO: 1887393 - RNA, 18 nt, Shigella flexneri 2a str. 2457T
cuguguuguacaguacug

SEQ ID NO: 1887394 - RNA, 17 nt, Shigella flexneri 2a str. 2457T
cuguguuuaugccggau

SEQ ID NO: 1887395 - RNA, 14 nt, Shigella flexneri 2a str. 2457T
cugugugugcugau

SEQ ID NO: 1887396 - RNA, 23 nt, Shigella flexneri 2a str. 2457T
cugugaacucaggcugccagauc

SEQ ID NO: 1887397 - RNA, 19 nt, Shigella flexneri 2a str. 2457T
cugucugaugauaaucaga

SEQ ID NO: 1887398 - RNA, 17 nt, Shigella flexneri 2a str. 2457T
cugucuccggcauccag

SEQ ID NO: 1887399 - RNA, 20 nt, Shigella flexneri 2a str. 2457T
cugugcucugggccaugauc

SEQ ID NO: 1887400 - RNA, 21 nt, Shigella flexneri 2a str. 2457T
cugugcagcgacgucugccgg

SEQ ID NO: 1887401 - RNA, 13 nt, Shigella flexneri 2a str. 2457T
cuucaaucgccac

SEQ ID NO: 1887402 - RNA, 16 nt, Shigella flexneri 2a str. 2457T
cuucaauauuaaugcu

SEQ ID NO: 1887403 - RNA, 16 nt, Shigella flexneri 2a str. 2457T
cuucaaggucaacauu

SEQ ID NO: 1887404 - RNA, 19 nt, Shigella flexneri 2a str. 2457T
cuuaucuuuuucgguauau

SEQ ID NO: 1887405 - RNA, 13 nt, Shigella flexneri 2a str. 2457T
cuuauugaagcuc

SEQ ID NO: 1887406 - RNA, 21 nt, Shigella flexneri 2a str. 2457T
cuuauucgggauugccagaug

SEQ ID NO: 1887407 - RNA, 19 nt, Shigella flexneri 2a str. 2457T
cuuacuggggaaguggcga

SEQ ID NO: 1887408 - RNA, 18 nt, Shigella flexneri 2a str. 2457T
cuguuucgcuucuucagc

SEQ ID NO: 1887409 - RNA, 14 nt, Shigella flexneri 2a str. 2457T
cuguuacugucggc

SEQ ID NO: 1887410 - RNA, 16 nt, Shigella flexneri 2a str. 2457T
cuguuaaucgcauuga

SEQ ID NO: 1887411 - RNA, 16 nt, Shigella flexneri 2a str. 2457T
cuguuaccccugcggc

SEQ ID NO: 1887412 - RNA, 14 nt, Shigella flexneri 2a str. 2457T
cuuaccuucacgaa

SEQ ID NO: 1887413 - RNA, 15 nt, Shigella flexneri 2a str. 2457T
cuuacccuaaauccg

SEQ ID NO: 1887414 - RNA, 16 nt, Shigella flexneri 2a str. 2457T
cuuacauuccgucuca

SEQ ID NO: 1887415 - RNA, 20 nt, Shigella flexneri 2a str. 2457T
cuuaaucuuagguaaugacu

SEQ ID NO: 1887416 - RNA, 19 nt, Shigella flexneri 2a str. 2457T
cuuaacuguaaaucgccau

SEQ ID NO: 1887417 - RNA, 22 nt, Shigella flexneri 2a str. 2457T
cuucgacuuucaguggcuuauc

SEQ ID NO: 1887418 - RNA, 12 nt, Shigella flexneri 2a str. 2457T
cuuccgccagcg

SEQ ID NO: 1887419 - RNA, 15 nt, Shigella flexneri 2a str. 2457T
cuuccgccagcggcg

SEQ ID NO: 1887420 - RNA, 14 nt, Shigella flexneri 2a str. 2457T
cuuccgcgaaggcg

SEQ ID NO: 1887421 - RNA, 12 nt, Shigella flexneri 2a str. 2457T
cuucccugcggu

SEQ ID NO: 1887422 - RNA, 17 nt, Shigella flexneri 2a str. 2457T
cuuccgcaaacaggcgc

SEQ ID NO: 1887423 - RNA, 19 nt, Shigella flexneri 2a str. 2457T
cuucacacugaugacaggc

SEQ ID NO: 1887424 - RNA, 16 nt, Shigella flexneri 2a str. 2457T
cuucacaguggcgagc

SEQ ID NO: 1887425 - RNA, 13 nt, Shigella flexneri 2a str. 2457T
cuucccagcccag

SEQ ID NO: 1887426 - RNA, 12 nt, Shigella flexneri 2a str. 2457T
cuucccagcgca

SEQ ID NO: 1887427 - RNA, 22 nt, Shigella flexneri 2a str. 2457T
cuucuggcgacauuuucucuac

SEQ ID NO: 1887428 - RNA, 12 nt, Shigella flexneri 2a str. 2457T
cuucugccggag

SEQ ID NO: 1887429 - RNA, 16 nt, Shigella flexneri 2a str. 2457T
cuucuuccagcggcag

SEQ ID NO: 1887430 - RNA, 13 nt, Shigella flexneri 2a str. 2457T
cuucuauauucug

SEQ ID NO: 1887431 - RNA, 13 nt, Shigella flexneri 2a str. 2457T
cuucggucaccgu

SEQ ID NO: 1887432 - RNA, 16 nt, Shigella flexneri 2a str. 2457T
gaaaacaucaugguuu

SEQ ID NO: 1887433 - RNA, 20 nt, Shigella flexneri 2a str. 2457T
gaaaaaucgacaaaaucgga

SEQ ID NO: 1887434 - RNA, 22 nt, Shigella flexneri 2a str. 2457T
gaaaaacgggucgccagaaggu

SEQ ID NO: 1887435 - RNA, 19 nt, Shigella flexneri 2a str. 2457T
cuuugugucagcgccagaa

SEQ ID NO: 1887436 - RNA, 16 nt, Shigella flexneri 2a str. 2457T
cuuuguaggccggaua

SEQ ID NO: 1887437 - RNA, 18 nt, Shigella flexneri 2a str. 2457T
gaaaaaccuccggcguuu

SEQ ID NO: 1887438 - RNA, 15 nt, Shigella flexneri 2a str. 2457T
gaaaaaccugacguu

SEQ ID NO: 1887439 - RNA, 22 nt, Shigella flexneri 2a str. 2457T
gaaacaggcgacgcguccgguu

SEQ ID NO: 1887440 - RNA, 18 nt, Shigella flexneri 2a str. 2457T
gaaacaguuguaaaguac

SEQ ID NO: 1887441 - RNA, 19 nt, Shigella flexneri 2a str. 2457T
gaaaccgcuauuuacggua

SEQ ID NO: 1887442 - RNA, 16 nt, Shigella flexneri 2a str. 2457T
gaaaccaaacuuaugc

SEQ ID NO: 1887443 - RNA, 18 nt, Shigella flexneri 2a str. 2457T
cuuucagagaagcaccgc

SEQ ID NO: 1887444 - RNA, 18 nt, Shigella flexneri 2a str. 2457T
cuuucacuacaaucaggc

SEQ ID NO: 1887445 - RNA, 18 nt, Shigella flexneri 2a str. 2457T
cuuucaauaccgccugca

SEQ ID NO: 1887446 - RNA, 15 nt, Shigella flexneri 2a str. 2457T
cuuguaggccugaua

SEQ ID NO: 1887447 - RNA, 18 nt, Shigella flexneri 2a str. 2457T
cuuuccauaccggcugca

SEQ ID NO: 1887448 - RNA, 16 nt, Shigella flexneri 2a str. 2457T
cuuuccgucagcggca

SEQ ID NO: 1887449 - RNA, 23 nt, Shigella flexneri 2a str. 2457T
cuuucagcaccagcccgacgaua

SEQ ID NO: 1887450 - RNA, 13 nt, Shigella flexneri 2a str. 2457T
cuuucagcaccgc

SEQ ID NO: 1887451 - RNA, 16 nt, Shigella flexneri 2a str. 2457T
cuuugacaacaucauc

SEQ ID NO: 1887452 - RNA, 16 nt, Shigella flexneri 2a str. 2457T
cuuucgcaauaaucau

SEQ ID NO: 1887453 - RNA, 23 nt, Shigella flexneri 2a str. 2457T
cuuucgauugcacaaagguuucg

SEQ ID NO: 1887454 - RNA, 19 nt, Shigella flexneri 2a str. 2457T
cuuucggaaagaucgccac

SEQ ID NO: 1887455 - RNA, 15 nt, Shigella flexneri 2a str. 2457T
cuuucgcuguaaacg

SEQ ID NO: 1887456 - RNA, 21 nt, Shigella flexneri 2a str. 2457T
cuuugaaaauaacaucgccag

SEQ ID NO: 1887457 - RNA, 17 nt, Shigella flexneri 2a str. 2457T
cuuucugcccgcguuuc

SEQ ID NO: 1887458 - RNA, 16 nt, Shigella flexneri 2a str. 2457T
cuugcaaucuuuagca

SEQ ID NO: 1887459 - RNA, 18 nt, Shigella flexneri 2a str. 2457T
cuugccagauacgauguu

SEQ ID NO: 1887460 - RNA, 17 nt, Shigella flexneri 2a str. 2457T
cuugauauaaaucccag

SEQ ID NO: 1887461 - RNA, 13 nt, Shigella flexneri 2a str. 2457T
cuuggcaccauua

SEQ ID NO: 1887462 - RNA, 18 nt, Shigella flexneri 2a str. 2457T
cuugcguaucgacggcgu

SEQ ID NO: 1887463 - RNA, 21 nt, Shigella flexneri 2a str. 2457T
cuugcguuuuucaucuuccgu

SEQ ID NO: 1887464 - RNA, 17 nt, Shigella flexneri 2a str. 2457T
cugcgugccuaauuccg

SEQ ID NO: 1887465 - RNA, 14 nt, Shigella flexneri 2a str. 2457T
cugcgucgcuuucc

SEQ ID NO: 1887466 - RNA, 20 nt, Shigella flexneri 2a str. 2457T
cugcucagacggugaccaga

SEQ ID NO: 1887467 - RNA, 18 nt, Shigella flexneri 2a str. 2457T
cugcguucagcaguucug

SEQ ID NO: 1887468 - RNA, 21 nt, Shigella flexneri 2a str. 2457T
cugcguuguaccaguucgcuu

SEQ ID NO: 1887469 - RNA, 20 nt, Shigella flexneri 2a str. 2457T
cugcgugucggacggaauuu

SEQ ID NO: 1887470 - RNA, 17 nt, Shigella flexneri 2a str. 2457T
cugcuccuccuucucac

SEQ ID NO: 1887471 - RNA, 18 nt, Shigella flexneri 2a str. 2457T
cugcugcauccgcgcuuu

SEQ ID NO: 1887472 - RNA, 18 nt, Shigella flexneri 2a str. 2457T
cugcucuuucagcaccgc

SEQ ID NO: 1887473 - RNA, 23 nt, Shigella flexneri 2a str. 2457T
cugcacgaccggguuuucaauga

SEQ ID NO: 1887474 - RNA, 15 nt, Shigella flexneri 2a str. 2457T
cugcgauaacggucg

SEQ ID NO: 1887475 - RNA, 13 nt, Shigella flexneri 2a str. 2457T
cugcgccaauacc

SEQ ID NO: 1887476 - RNA, 15 nt, Shigella flexneri 2a str. 2457T
cugcgcccgccagca

SEQ ID NO: 1887477 - RNA, 18 nt, Shigella flexneri 2a str. 2457T
cugcgcccugcagcuggu

SEQ ID NO: 1887478 - RNA, 22 nt, Shigella flexneri 2a str. 2457T
cugcgccaguugcuuauccagc

SEQ ID NO: 1887479 - RNA, 17 nt, Shigella flexneri 2a str. 2457T
cugcgcccagcgugcgu

SEQ ID NO: 1887480 - RNA, 15 nt, Shigella flexneri 2a str. 2457T
cugcgccagccagcc

SEQ ID NO: 1887481 - RNA, 21 nt, Shigella flexneri 2a str. 2457T
cugcgcgaccaucggaucggc

SEQ ID NO: 1887482 - RNA, 14 nt, Shigella flexneri 2a str. 2457T
cugcgcuauccagc

SEQ ID NO: 1887483 - RNA, 13 nt, Shigella flexneri 2a str. 2457T
cugcgcuuaucag

SEQ ID NO: 1887484 - RNA, 19 nt, Shigella flexneri 2a str. 2457T
cugcggauccugagcaaac

SEQ ID NO: 1887485 - RNA, 16 nt, Shigella flexneri 2a str. 2457T
cuggcuggcaucuuga

SEQ ID NO: 1887486 - RNA, 15 nt, Shigella flexneri 2a str. 2457T
cuggucauugccagg

SEQ ID NO: 1887487 - RNA, 21 nt, Shigella flexneri 2a str. 2457T
cuggguagaguuugaacucac

SEQ ID NO: 1887488 - RNA, 17 nt, Shigella flexneri 2a str. 2457T
cugguaucgcgccagcc

SEQ ID NO: 1887489 - RNA, 17 nt, Shigella flexneri 2a str. 2457T
cugcuuaucaucacgca

SEQ ID NO: 1887490 - RNA, 16 nt, Shigella flexneri 2a str. 2457T
cugcuuacaggcuggu

SEQ ID NO: 1887491 - RNA, 17 nt, Shigella flexneri 2a str. 2457T
cugcuguuccgcaaagc

SEQ ID NO: 1887492 - RNA, 20 nt, Shigella flexneri 2a str. 2457T
cugcuguagcaguuccagca

SEQ ID NO: 1887493 - RNA, 13 nt, Shigella flexneri 2a str. 2457T
cuggaacgaugcc

SEQ ID NO: 1887494 - RNA, 23 nt, Shigella flexneri 2a str. 2457T
cuggaaggugaaauugucggcgu

SEQ ID NO: 1887495 - RNA, 22 nt, Shigella flexneri 2a str. 2457T
cugcuuuucccuccacuccggu

SEQ ID NO: 1887496 - RNA, 20 nt, Shigella flexneri 2a str. 2457T
cuggcaguggcaaccagcgg

SEQ ID NO: 1887497 - RNA, 14 nt, Shigella flexneri 2a str. 2457T
cuggcacgaccugg

SEQ ID NO: 1887498 - RNA, 19 nt, Shigella flexneri 2a str. 2457T
cuggcauuuggcucucgau

SEQ ID NO: 1887499 - RNA, 13 nt, Shigella flexneri 2a str. 2457T
cuggaauaaucgu

SEQ ID NO: 1887500 - RNA, 14 nt, Shigella flexneri 2a str. 2457T
cuggccgcuuccag

SEQ ID NO: 1887501 - RNA, 15 nt, Shigella flexneri 2a str. 2457T
cuggccgcuuccagc

SEQ ID NO: 1887502 - RNA, 18 nt, Shigella flexneri 2a str. 2457T
cuggccauuucugccagu

SEQ ID NO: 1887503 - RNA, 16 nt, Shigella flexneri 2a str. 2457T
cuggcccaugccaguu

SEQ ID NO: 1887504 - RNA, 17 nt, Shigella flexneri 2a str. 2457T
gaauuauucacuggaga

SEQ ID NO: 1887505 - RNA, 21 nt, Shigella flexneri 2a str. 2457T
gaaugccccauugcaacgugg

SEQ ID NO: 1887506 - RNA, 16 nt, Shigella flexneri 2a str. 2457T
gaaugaugcggcgcuu

SEQ ID NO: 1887507 - RNA, 16 nt, Shigella flexneri 2a str. 2457T
gaaugccuuauccgau

SEQ ID NO: 1887508 - RNA, 18 nt, Shigella flexneri 2a str. 2457T
gaaugcgcaacgccguaa

SEQ ID NO: 1887509 - RNA, 13 nt, Shigella flexneri 2a str. 2457T
gaauuaaugguga

SEQ ID NO: 1887510 - RNA, 19 nt, Shigella flexneri 2a str. 2457T
gaauguuuuccugcuucac

SEQ ID NO: 1887511 - RNA, 18 nt, Shigella flexneri 2a str. 2457T
gaaguuuugucgcugauu

SEQ ID NO: 1887512 - RNA, 15 nt, Shigella flexneri 2a str. 2457T
gaauaacaccagcca

SEQ ID NO: 1887513 - RNA, 14 nt, Shigella flexneri 2a str. 2457T
gaauaaauugagcu

SEQ ID NO: 1887514 - RNA, 23 nt, Shigella flexneri 2a str. 2457T
gaauagucccuucgguagcagcu

SEQ ID NO: 1887515 - RNA, 19 nt, Shigella flexneri 2a str. 2457T
gaauaguuugauuaacgca

SEQ ID NO: 1887516 - RNA, 13 nt, Shigella flexneri 2a str. 2457T
gaauauggcggcg

SEQ ID NO: 1887517 - RNA, 19 nt, Shigella flexneri 2a str. 2457T
gaaucaacuccagaauacc

SEQ ID NO: 1887518 - RNA, 16 nt, Shigella flexneri 2a str. 2457T
gaaucaaccaugguuu

SEQ ID NO: 1887519 - RNA, 16 nt, Shigella flexneri 2a str. 2457T
gaaucgcaaagccgau

SEQ ID NO: 1887520 - RNA, 19 nt, Shigella flexneri 2a str. 2457T
gaaugaucaaacgaagcgg

SEQ ID NO: 1887521 - RNA, 16 nt, Shigella flexneri 2a str. 2457T
gaagggauugugcagg

SEQ ID NO: 1887522 - RNA, 22 nt, Shigella flexneri 2a str. 2457T
gaaggcuagguugaccuggaag

SEQ ID NO: 1887523 - RNA, 21 nt, Shigella flexneri 2a str. 2457T
gaaguaauaaucaacgcaccg

SEQ ID NO: 1887524 - RNA, 16 nt, Shigella flexneri 2a str. 2457T
gaaguagccuucauca

SEQ ID NO: 1887525 - RNA, 17 nt, Shigella flexneri 2a str. 2457T
gaaguuauccugguacu

SEQ ID NO: 1887526 - RNA, 21 nt, Shigella flexneri 2a str. 2457T
gaaguauggaaaucacccagc

SEQ ID NO: 1887527 - RNA, 17 nt, Shigella flexneri 2a str. 2457T
gaaguaguugcugucga

SEQ ID NO: 1887528 - RNA, 20 nt, Shigella flexneri 2a str. 2457T
gaaguauuggugaguccuga

SEQ ID NO: 1887529 - RNA, 21 nt, Shigella flexneri 2a str. 2457T
gaccaauaauccccaauacga

SEQ ID NO: 1887530 - RNA, 20 nt, Shigella flexneri 2a str. 2457T
gaccaauaacgcuuuucuca

SEQ ID NO: 1887531 - RNA, 17 nt, Shigella flexneri 2a str. 2457T
gaccaauaaacgccagg

SEQ ID NO: 1887532 - RNA, 16 nt, Shigella flexneri 2a str. 2457T
gacauuguuuccauau

SEQ ID NO: 1887533 - RNA, 14 nt, Shigella flexneri 2a str. 2457T
gacaucaccaguac

SEQ ID NO: 1887534 - RNA, 19 nt, Shigella flexneri 2a str. 2457T
gacaaccagcuucaacgau

SEQ ID NO: 1887535 - RNA, 14 nt, Shigella flexneri 2a str. 2457T
gacagauucaggcg

SEQ ID NO: 1887536 - RNA, 14 nt, Shigella flexneri 2a str. 2457T
gacagauucaugcu

SEQ ID NO: 1887537 - RNA, 19 nt, Shigella flexneri 2a str. 2457T
gacagaccugcgucaccac

SEQ ID NO: 1887538 - RNA, 14 nt, Shigella flexneri 2a str. 2457T
gacacuuugcgcca

SEQ ID NO: 1887539 - RNA, 20 nt, Shigella flexneri 2a str. 2457T
gacacuuucagcgcagcgcg

SEQ ID NO: 1887540 - RNA, 21 nt, Shigella flexneri 2a str. 2457T
gaagccaaaucauccagaccg

SEQ ID NO: 1887541 - RNA, 14 nt, Shigella flexneri 2a str. 2457T
gaagccagucacau

SEQ ID NO: 1887542 - RNA, 14 nt, Shigella flexneri 2a str. 2457T
gaagccagucagcu

SEQ ID NO: 1887543 - RNA, 20 nt, Shigella flexneri 2a str. 2457T
gaagcaguuucaccagcagu

SEQ ID NO: 1887544 - RNA, 22 nt, Shigella flexneri 2a str. 2457T
gaagcacugcaucaaugccgga

SEQ ID NO: 1887545 - RNA, 20 nt, Shigella flexneri 2a str. 2457T
gaaggcgauuaaacgccauc

SEQ ID NO: 1887546 - RNA, 15 nt, Shigella flexneri 2a str. 2457T
gaagcuggucagcau

SEQ ID NO: 1887547 - RNA, 22 nt, Shigella flexneri 2a str. 2457T
gaaggcacuggucgaugccgac

SEQ ID NO: 1887548 - RNA, 23 nt, Shigella flexneri 2a str. 2457T
gaagcgggggagucgcugguuaa

SEQ ID NO: 1887549 - RNA, 22 nt, Shigella flexneri 2a str. 2457T
gaagcgguagaauuucugacug

SEQ ID NO: 1887550 - RNA, 12 nt, Shigella flexneri 2a str. 2457T
gaagcggccguc

SEQ ID NO: 1887551 - RNA, 23 nt, Shigella flexneri 2a str. 2457T
gaagcucguuguuuaugccggau

SEQ ID NO: 1887552 - RNA, 12 nt, Shigella flexneri 2a str. 2457T
gaacgggccauc

SEQ ID NO: 1887553 - RNA, 20 nt, Shigella flexneri 2a str. 2457T
gaacgguucuugaaaaucaa

SEQ ID NO: 1887554 - RNA, 15 nt, Shigella flexneri 2a str. 2457T
gaacgggugauuucc

SEQ ID NO: 1887555 - RNA, 18 nt, Shigella flexneri 2a str. 2457T
gaacggcuguugaugucc

SEQ ID NO: 1887556 - RNA, 20 nt, Shigella flexneri 2a str. 2457T
gaacgcauugccacgccgua

SEQ ID NO: 1887557 - RNA, 16 nt, Shigella flexneri 2a str. 2457T
gaacgcaccgaccauc

SEQ ID NO: 1887558 - RNA, 17 nt, Shigella flexneri 2a str. 2457T
gaacgaucccagcgugg

SEQ ID NO: 1887559 - RNA, 19 nt, Shigella flexneri 2a str. 2457T
gaacgauuuuagcaaacug

SEQ ID NO: 1887560 - RNA, 18 nt, Shigella flexneri 2a str. 2457T
gaaacgcauaccuaccug

SEQ ID NO: 1887561 - RNA, 13 nt, Shigella flexneri 2a str. 2457T
gaagauaccgaac

SEQ ID NO: 1887562 - RNA, 18 nt, Shigella flexneri 2a str. 2457T
gaagacgcagcaugcauc

SEQ ID NO: 1887563 - RNA, 22 nt, Shigella flexneri 2a str. 2457T
gaagaccugggcgaugcuggca

SEQ ID NO: 1887564 - RNA, 13 nt, Shigella flexneri 2a str. 2457T
gaagaaaccgcua

SEQ ID NO: 1887565 - RNA, 17 nt, Shigella flexneri 2a str. 2457T
gaacuugcucauccgga

SEQ ID NO: 1887566 - RNA, 17 nt, Shigella flexneri 2a str. 2457T
gaacuuucucccgaaaa

SEQ ID NO: 1887567 - RNA, 16 nt, Shigella flexneri 2a str. 2457T
gaacguguaggccuga

SEQ ID NO: 1887568 - RNA, 23 nt, Shigella flexneri 2a str. 2457T
gaacuguggcgcgaagcccucaa

SEQ ID NO: 1887569 - RNA, 16 nt, Shigella flexneri 2a str. 2457T
gaacgugcaaaaucaa

SEQ ID NO: 1887570 - RNA, 14 nt, Shigella flexneri 2a str. 2457T
gacgauacaacgcu

SEQ ID NO: 1887571 - RNA, 12 nt, Shigella flexneri 2a str. 2457T
gacgcauugcau

SEQ ID NO: 1887572 - RNA, 14 nt, Shigella flexneri 2a str. 2457T
gacgcauugauaau

SEQ ID NO: 1887573 - RNA, 18 nt, Shigella flexneri 2a str. 2457T
gacgcagaauggcgaacg

SEQ ID NO: 1887574 - RNA, 17 nt, Shigella flexneri 2a str. 2457T
gacgcacuuucgcuuua

SEQ ID NO: 1887575 - RNA, 17 nt, Shigella flexneri 2a str. 2457T
gacgccaccauucacca

SEQ ID NO: 1887576 - RNA, 19 nt, Shigella flexneri 2a str. 2457T
gacgcgaccggcgucgcau

SEQ ID NO: 1887577 - RNA, 15 nt, Shigella flexneri 2a str. 2457T
gacgcgacaagcguc

SEQ ID NO: 1887578 - RNA, 21 nt, Shigella flexneri 2a str. 2457T
gacgcgacaagcgucgcauca

SEQ ID NO: 1887579 - RNA, 18 nt, Shigella flexneri 2a str. 2457T
gacgcguuagugucuuau

SEQ ID NO: 1887580 - RNA, 18 nt, Shigella flexneri 2a str. 2457T
gacgacguaccagcgucg

SEQ ID NO: 1887581 - RNA, 20 nt, Shigella flexneri 2a str. 2457T
gaccugucggggccagcgca

SEQ ID NO: 1887582 - RNA, 17 nt, Shigella flexneri 2a str. 2457T
gaccggcaaccagcacc

SEQ ID NO: 1887583 - RNA, 18 nt, Shigella flexneri 2a str. 2457T
gacccagcaccaguacca

SEQ ID NO: 1887584 - RNA, 16 nt, Shigella flexneri 2a str. 2457T
gaccaaucccgccaua

SEQ ID NO: 1887585 - RNA, 23 nt, Shigella flexneri 2a str. 2457T
gaccauugaugcucuccgccauc

SEQ ID NO: 1887586 - RNA, 18 nt, Shigella flexneri 2a str. 2457T
gaccacccguaaucccgg

SEQ ID NO: 1887587 - RNA, 17 nt, Shigella flexneri 2a str. 2457T
gaccgccgccaaucacc

SEQ ID NO: 1887588 - RNA, 15 nt, Shigella flexneri 2a str. 2457T
gaccgccagcgccau

SEQ ID NO: 1887589 - RNA, 14 nt, Shigella flexneri 2a str. 2457T
gaccgccagcgcca

SEQ ID NO: 1887590 - RNA, 17 nt, Shigella flexneri 2a str. 2457T
gccaccagugcaggcac

SEQ ID NO: 1887591 - RNA, 15 nt, Shigella flexneri 2a str. 2457T
gccacccgaucgcuc

SEQ ID NO: 1887592 - RNA, 23 nt, Shigella flexneri 2a str. 2457T
gccaccccacgauguauccggca

SEQ ID NO: 1887593 - RNA, 16 nt, Shigella flexneri 2a str. 2457T
gccaccagcugacaau

SEQ ID NO: 1887594 - RNA, 23 nt, Shigella flexneri 2a str. 2457T
gccaccguguucaugaccgugau

SEQ ID NO: 1887595 - RNA, 14 nt, Shigella flexneri 2a str. 2457T
gccaccgcgcguuu

SEQ ID NO: 1887596 - RNA, 18 nt, Shigella flexneri 2a str. 2457T
gccaauaaucgcgcuaau

SEQ ID NO: 1887597 - RNA, 18 nt, Shigella flexneri 2a str. 2457T
gccaaucccggaagccac

SEQ ID NO: 1887598 - RNA, 21 nt, Shigella flexneri 2a str. 2457T
gccaacuucaugaccuuccag

SEQ ID NO: 1887599 - RNA, 21 nt, Shigella flexneri 2a str. 2457T
gcauccggucagacaacuucc

SEQ ID NO: 1887600 - RNA, 20 nt, Shigella flexneri 2a str. 2457T
gccacagcagccuucgccac

SEQ ID NO: 1887601 - RNA, 13 nt, Shigella flexneri 2a str. 2457T
gccaccacaccgg

SEQ ID NO: 1887602 - RNA, 23 nt, Shigella flexneri 2a str. 2457T
gccacauugcugcacauccggua

SEQ ID NO: 1887603 - RNA, 20 nt, Shigella flexneri 2a str. 2457T
gccacauugcaucugauaac

SEQ ID NO: 1887604 - RNA, 13 nt, Shigella flexneri 2a str. 2457T
gccacauccgcgg

SEQ ID NO: 1887605 - RNA, 19 nt, Shigella flexneri 2a str. 2457T
gccacauccgcgguaucgc

SEQ ID NO: 1887606 - RNA, 12 nt, Shigella flexneri 2a str. 2457T
gccacauccggc

SEQ ID NO: 1887607 - RNA, 19 nt, Shigella flexneri 2a str. 2457T
gccaaucucuacgacuuga

SEQ ID NO: 1887608 - RNA, 20 nt, Shigella flexneri 2a str. 2457T
gccaaugaaguggcauccga

SEQ ID NO: 1887609 - RNA, 17 nt, Shigella flexneri 2a str. 2457T
gccacacaccgcaaacu

SEQ ID NO: 1887610 - RNA, 17 nt, Shigella flexneri 2a str. 2457T
gccacaaucucacccgc

SEQ ID NO: 1887611 - RNA, 14 nt, Shigella flexneri 2a str. 2457T
gccacaaucugaua

SEQ ID NO: 1887612 - RNA, 20 nt, Shigella flexneri 2a str. 2457T
gccacaauacugaucaucau

SEQ ID NO: 1887613 - RNA, 22 nt, Shigella flexneri 2a str. 2457T
gccacacgagucauuccggccc

SEQ ID NO: 1887614 - RNA, 22 nt, Shigella flexneri 2a str. 2457T
gccagcccgaucggcuggcauu

SEQ ID NO: 1887615 - RNA, 16 nt, Shigella flexneri 2a str. 2457T
gccagcgauaucgcga

SEQ ID NO: 1887616 - RNA, 16 nt, Shigella flexneri 2a str. 2457T
gccagcucaaacgaau

SEQ ID NO: 1887617 - RNA, 22 nt, Shigella flexneri 2a str. 2457T
gccagcuucgcuucccaacgca

SEQ ID NO: 1887618 - RNA, 17 nt, Shigella flexneri 2a str. 2457T
gccagcgccgacagcag

SEQ ID NO: 1887619 - RNA, 15 nt, Shigella flexneri 2a str. 2457T
gccagcgcgccuuca

SEQ ID NO: 1887620 - RNA, 16 nt, Shigella flexneri 2a str. 2457T
gccagcggguucccgg

SEQ ID NO: 1887621 - RNA, 17 nt, Shigella flexneri 2a str. 2457T
gccagaggagccaucac

SEQ ID NO: 1887622 - RNA, 16 nt, Shigella flexneri 2a str. 2457T
gccagauacaucagcg

SEQ ID NO: 1887623 - RNA, 17 nt, Shigella flexneri 2a str. 2457T
gccagcaacugauaaac

SEQ ID NO: 1887624 - RNA, 16 nt, Shigella flexneri 2a str. 2457T
gccagcacggcgcuga

SEQ ID NO: 1887625 - RNA, 15 nt, Shigella flexneri 2a str. 2457T
gccacuucaucgccc

SEQ ID NO: 1887626 - RNA, 21 nt, Shigella flexneri 2a str. 2457T
gccacugguuuuccugagcaa

SEQ ID NO: 1887627 - RNA, 15 nt, Shigella flexneri 2a str. 2457T
gccacgcugccgcgc

SEQ ID NO: 1887628 - RNA, 16 nt, Shigella flexneri 2a str. 2457T
gcccagcccccagcau

SEQ ID NO: 1887629 - RNA, 16 nt, Shigella flexneri 2a str. 2457T
gcccaccaccagcgaa

SEQ ID NO: 1887630 - RNA, 19 nt, Shigella flexneri 2a str. 2457T
gccaguucgaaauccagac

SEQ ID NO: 1887631 - RNA, 19 nt, Shigella flexneri 2a str. 2457T
gccaguucaaaguugcauu

SEQ ID NO: 1887632 - RNA, 22 nt, Shigella flexneri 2a str. 2457T
gccaguguuggcgucagaccgg

SEQ ID NO: 1887633 - RNA, 14 nt, Shigella flexneri 2a str. 2457T
gccaguaaagcagc

SEQ ID NO: 1887634 - RNA, 16 nt, Shigella flexneri 2a str. 2457T
gccaguaaauuuauca

SEQ ID NO: 1887635 - RNA, 21 nt, Shigella flexneri 2a str. 2457T
gccaguaagcaguccagcgcc

SEQ ID NO: 1887636 - RNA, 20 nt, Shigella flexneri 2a str. 2457T
gccagguuucauagcguccc

SEQ ID NO: 1887637 - RNA, 22 nt, Shigella flexneri 2a str. 2457T
gccaggaaccugugacagcagc

SEQ ID NO: 1887638 - RNA, 19 nt, Shigella flexneri 2a str. 2457T
gccaggaaucagauacugc

SEQ ID NO: 1887639 - RNA, 17 nt, Shigella flexneri 2a str. 2457T
gccaugcccgugcugac

SEQ ID NO: 1887640 - RNA, 20 nt, Shigella flexneri 2a str. 2457T
gccaugcacgcaagaacgca

SEQ ID NO: 1887641 - RNA, 21 nt, Shigella flexneri 2a str. 2457T
gccaugcacgcaagaacgcau

SEQ ID NO: 1887642 - RNA, 21 nt, Shigella flexneri 2a str. 2457T
gccaucucaaaacguccggca

SEQ ID NO: 1887643 - RNA, 21 nt, Shigella flexneri 2a str. 2457T
gccaucugccagcaagcgcac

SEQ ID NO: 1887644 - RNA, 22 nt, Shigella flexneri 2a str. 2457T
gccauacugacuaucaucgccg

SEQ ID NO: 1887645 - RNA, 22 nt, Shigella flexneri 2a str. 2457T
gccauaaacgguuucagcagcg

SEQ ID NO: 1887646 - RNA, 21 nt, Shigella flexneri 2a str. 2457T
gcccgauacgcuugcgcaucg

SEQ ID NO: 1887647 - RNA, 13 nt, Shigella flexneri 2a str. 2457T
gcccgccagcauc

SEQ ID NO: 1887648 - RNA, 14 nt, Shigella flexneri 2a str. 2457T
gcccaucagcaucc

SEQ ID NO: 1887649 - RNA, 23 nt, Shigella flexneri 2a str. 2457T
gcccauaugaacauuacuuuccg

SEQ ID NO: 1887650 - RNA, 14 nt, Shigella flexneri 2a str. 2457T
gcccaucaucaucg

SEQ ID NO: 1887651 - RNA, 17 nt, Shigella flexneri 2a str. 2457T
gcccaucaugcgccagg

SEQ ID NO: 1887652 - RNA, 15 nt, Shigella flexneri 2a str. 2457T
gcccagccgugaaug

SEQ ID NO: 1887653 - RNA, 15 nt, Shigella flexneri 2a str. 2457T
gccccagcaggaugu

SEQ ID NO: 1887654 - RNA, 21 nt, Shigella flexneri 2a str. 2457T
gccccgagaaguacguagcgu

SEQ ID NO: 1887655 - RNA, 23 nt, Shigella flexneri 2a str. 2457T
gccccgacgaacgcagcgucuca

SEQ ID NO: 1887656 - RNA, 22 nt, Shigella flexneri 2a str. 2457T
gccccaguuccuuaacuucauc

SEQ ID NO: 1887657 - RNA, 15 nt, Shigella flexneri 2a str. 2457T
gccgaacaggcugcu

SEQ ID NO: 1887658 - RNA, 23 nt, Shigella flexneri 2a str. 2457T
gcccuucuuucacuucagcaacg

SEQ ID NO: 1887659 - RNA, 13 nt, Shigella flexneri 2a str. 2457T
gcccuugccaacg

SEQ ID NO: 1887660 - RNA, 19 nt, Shigella flexneri 2a str. 2457T
gcccugucgaggccaauuu

SEQ ID NO: 1887661 - RNA, 22 nt, Shigella flexneri 2a str. 2457T
gcccguuguuuuauuuaugugg

SEQ ID NO: 1887662 - RNA, 20 nt, Shigella flexneri 2a str. 2457T
gcccguguuucugauacagc

SEQ ID NO: 1887663 - RNA, 16 nt, Shigella flexneri 2a str. 2457T
gcccgguuguaugugc

SEQ ID NO: 1887664 - RNA, 17 nt, Shigella flexneri 2a str. 2457T
gcccugcaaugucauca

SEQ ID NO: 1887665 - RNA, 17 nt, Shigella flexneri 2a str. 2457T
gcccugccaggucauca

SEQ ID NO: 1887666 - RNA, 14 nt, Shigella flexneri 2a str. 2457T
gcccugcgucgcac

SEQ ID NO: 1887667 - RNA, 21 nt, Shigella flexneri 2a str. 2457T
gcccugaaccaucgacgucca

SEQ ID NO: 1887668 - RNA, 17 nt, Shigella flexneri 2a str. 2457T
gccgaucauuggccgga

SEQ ID NO: 1887669 - RNA, 15 nt, Shigella flexneri 2a str. 2457T
gccgagcugaacaag

SEQ ID NO: 1887670 - RNA, 20 nt, Shigella flexneri 2a str. 2457T
gccgauggcaaaagugauau

SEQ ID NO: 1887671 - RNA, 15 nt, Shigella flexneri 2a str. 2457T
gccgacggcgcacag

SEQ ID NO: 1887672 - RNA, 17 nt, Shigella flexneri 2a str. 2457T
gccgagcaaaucgcggc

SEQ ID NO: 1887673 - RNA, 13 nt, Shigella flexneri 2a str. 2457T
gccgaauaacgcg

SEQ ID NO: 1887674 - RNA, 20 nt, Shigella flexneri 2a str. 2457T
gccgcgucugaauaucaucc

SEQ ID NO: 1887675 - RNA, 16 nt, Shigella flexneri 2a str. 2457T
gccgcuaucgcugaua

SEQ ID NO: 1887676 - RNA, 19 nt, Shigella flexneri 2a str. 2457T
gccggaucgguagaccgga

SEQ ID NO: 1887677 - RNA, 18 nt, Shigella flexneri 2a str. 2457T
gccggaugaucauccggc

SEQ ID NO: 1887678 - RNA, 14 nt, Shigella flexneri 2a str. 2457T
gccggaugcggcgu

SEQ ID NO: 1887679 - RNA, 13 nt, Shigella flexneri 2a str. 2457T
gccggaugcggcg

SEQ ID NO: 1887680 - RNA, 16 nt, Shigella flexneri 2a str. 2457T
gccggaguugcagauu

SEQ ID NO: 1887681 - RNA, 15 nt, Shigella flexneri 2a str. 2457T
gccggcacaggcauc

SEQ ID NO: 1887682 - RNA, 13 nt, Shigella flexneri 2a str. 2457T
gccgcuuuccagg

SEQ ID NO: 1887683 - RNA, 18 nt, Shigella flexneri 2a str. 2457T
gccggagucgcauuaaca

SEQ ID NO: 1887684 - RNA, 21 nt, Shigella flexneri 2a str. 2457T
gccggagcuucccccgcaucg

SEQ ID NO: 1887685 - RNA, 21 nt, Shigella flexneri 2a str. 2457T
gccgcugucuaccagcaccug

SEQ ID NO: 1887686 - RNA, 16 nt, Shigella flexneri 2a str. 2457T
gccgcuucugcagcuu

SEQ ID NO: 1887687 - RNA, 19 nt, Shigella flexneri 2a str. 2457T
gccgcagcacccugaguuu

SEQ ID NO: 1887688 - RNA, 14 nt, Shigella flexneri 2a str. 2457T
gccgcagcgauggu

SEQ ID NO: 1887689 - RNA, 22 nt, Shigella flexneri 2a str. 2457T
gccgccuuguuguaaugacaac

SEQ ID NO: 1887690 - RNA, 14 nt, Shigella flexneri 2a str. 2457T
gccgcgcaguuucu

SEQ ID NO: 1887691 - RNA, 16 nt, Shigella flexneri 2a str. 2457T
gcacggaaagcagcau

SEQ ID NO: 1887692 - RNA, 19 nt, Shigella flexneri 2a str. 2457T
gcacuccgccacgucauca

SEQ ID NO: 1887693 - RNA, 15 nt, Shigella flexneri 2a str. 2457T
gcacggugugcggca

SEQ ID NO: 1887694 - RNA, 20 nt, Shigella flexneri 2a str. 2457T
gcacgauuuuguaggccgga

SEQ ID NO: 1887695 - RNA, 19 nt, Shigella flexneri 2a str. 2457T
gcacgauuuguaggccgga

SEQ ID NO: 1887696 - RNA, 21 nt, Shigella flexneri 2a str. 2457T
gcaccuggcgcauuaacggca

SEQ ID NO: 1887697 - RNA, 13 nt, Shigella flexneri 2a str. 2457T
gcaccuguaccag

SEQ ID NO: 1887698 - RNA, 22 nt, Shigella flexneri 2a str. 2457T
gcaccgacguucagcgcaacuu

SEQ ID NO: 1887699 - RNA, 14 nt, Shigella flexneri 2a str. 2457T
gcaccgacuggcuc

SEQ ID NO: 1887700 - RNA, 18 nt, Shigella flexneri 2a str. 2457T
gcaaucgaccaggccauc

SEQ ID NO: 1887701 - RNA, 15 nt, Shigella flexneri 2a str. 2457T
gcaaucgacgccguu

SEQ ID NO: 1887702 - RNA, 16 nt, Shigella flexneri 2a str. 2457T
gcaaucacugccagaa

SEQ ID NO: 1887703 - RNA, 20 nt, Shigella flexneri 2a str. 2457T
gcacaaaaaaucgugcugca

SEQ ID NO: 1887704 - RNA, 14 nt, Shigella flexneri 2a str. 2457T
gcaauuuuuaccgc

SEQ ID NO: 1887705 - RNA, 18 nt, Shigella flexneri 2a str. 2457T
gcaauggguaacggcaga

SEQ ID NO: 1887706 - RNA, 14 nt, Shigella flexneri 2a str. 2457T
gcaauggcugcggc

SEQ ID NO: 1887707 - RNA, 17 nt, Shigella flexneri 2a str. 2457T
gcaaacggcgcgacuuu

SEQ ID NO: 1887708 - RNA, 12 nt, Shigella flexneri 2a str. 2457T
gcaauaccgcga

SEQ ID NO: 1887709 - RNA, 20 nt, Shigella flexneri 2a str. 2457T
gcaauacagccagccagcac

SEQ ID NO: 1887710 - RNA, 14 nt, Shigella flexneri 2a str. 2457T
gcaauaucgcggca

SEQ ID NO: 1887711 - RNA, 16 nt, Shigella flexneri 2a str. 2457T
gcaauaucgcggcaca

SEQ ID NO: 1887712 - RNA, 20 nt, Shigella flexneri 2a str. 2457T
gcaaucaaauaccaccagcg

SEQ ID NO: 1887713 - RNA, 15 nt, Shigella flexneri 2a str. 2457T
gcaauauucuuuugc

SEQ ID NO: 1887714 - RNA, 14 nt, Shigella flexneri 2a str. 2457T
gcaauagcacugcu

SEQ ID NO: 1887715 - RNA, 14 nt, Shigella flexneri 2a str. 2457T
gcaauacguuucau

SEQ ID NO: 1887716 - RNA, 15 nt, Shigella flexneri 2a str. 2457T
gcaauagcgccugcu

SEQ ID NO: 1887717 - RNA, 15 nt, Shigella flexneri 2a str. 2457T
gcaauaccuggcgca

SEQ ID NO: 1887718 - RNA, 15 nt, Shigella flexneri 2a str. 2457T
gcacacggauauugc

SEQ ID NO: 1887719 - RNA, 20 nt, Shigella flexneri 2a str. 2457T
gcacacuguucauuaaagcc

SEQ ID NO: 1887720 - RNA, 23 nt, Shigella flexneri 2a str. 2457T
gcacagcaucaggcuaaucgcca

SEQ ID NO: 1887721 - RNA, 22 nt, Shigella flexneri 2a str. 2457T
gcacauccagauuuuucaguau

SEQ ID NO: 1887722 - RNA, 12 nt, Shigella flexneri 2a str. 2457T
gcacaucagcca

SEQ ID NO: 1887723 - RNA, 18 nt, Shigella flexneri 2a str. 2457T
gcacauagcgugacacca

SEQ ID NO: 1887724 - RNA, 16 nt, Shigella flexneri 2a str. 2457T
gcacaguaaugcgcca

SEQ ID NO: 1887725 - RNA, 18 nt, Shigella flexneri 2a str. 2457T
gcaccauugcugccgcca

SEQ ID NO: 1887726 - RNA, 23 nt, Shigella flexneri 2a str. 2457T
gcaccaggcaguuuauccagcca

SEQ ID NO: 1887727 - RNA, 14 nt, Shigella flexneri 2a str. 2457T
gcaccaacaaauag

SEQ ID NO: 1887728 - RNA, 19 nt, Shigella flexneri 2a str. 2457T
gcaccaaucaccgccagca

SEQ ID NO: 1887729 - RNA, 17 nt, Shigella flexneri 2a str. 2457T
gcacauccgcgucggca

SEQ ID NO: 1887730 - RNA, 19 nt, Shigella flexneri 2a str. 2457T
gcaccaaagggcaaaguca

SEQ ID NO: 1887731 - RNA, 14 nt, Shigella flexneri 2a str. 2457T
gcaccaaagcguuu

SEQ ID NO: 1887732 - RNA, 14 nt, Shigella flexneri 2a str. 2457T
gcaccagcaacaag

SEQ ID NO: 1887733 - RNA, 20 nt, Shigella flexneri 2a str. 2457T
gcaguagcgucgccagcagu

SEQ ID NO: 1887734 - RNA, 19 nt, Shigella flexneri 2a str. 2457T
gcaguccagcgccugacgc

SEQ ID NO: 1887735 - RNA, 23 nt, Shigella flexneri 2a str. 2457T
gcaguguuuguuaaaacuuucca

SEQ ID NO: 1887736 - RNA, 19 nt, Shigella flexneri 2a str. 2457T
gcagugaucgugugccacc

SEQ ID NO: 1887737 - RNA, 14 nt, Shigella flexneri 2a str. 2457T
gcagucuucccagc

SEQ ID NO: 1887738 - RNA, 18 nt, Shigella flexneri 2a str. 2457T
gcauaccggacgacggca

SEQ ID NO: 1887739 - RNA, 16 nt, Shigella flexneri 2a str. 2457T
gcauacaugcuuagca

SEQ ID NO: 1887740 - RNA, 12 nt, Shigella flexneri 2a str. 2457T
gcaguuaacgcg

SEQ ID NO: 1887741 - RNA, 18 nt, Shigella flexneri 2a str. 2457T
gcaguucacagcgcagau

SEQ ID NO: 1887742 - RNA, 13 nt, Shigella flexneri 2a str. 2457T
gcaguucacgcag

SEQ ID NO: 1887743 - RNA, 18 nt, Shigella flexneri 2a str. 2457T
gcauacugcgugucguaa

SEQ ID NO: 1887744 - RNA, 19 nt, Shigella flexneri 2a str. 2457T
gcaucagcgauucauugag

SEQ ID NO: 1887745 - RNA, 19 nt, Shigella flexneri 2a str. 2457T
gcaucaggcuaaucgccag

SEQ ID NO: 1887746 - RNA, 13 nt, Shigella flexneri 2a str. 2457T
gcaucaggcaauu

SEQ ID NO: 1887747 - RNA, 12 nt, Shigella flexneri 2a str. 2457T
gcaucagauggg

SEQ ID NO: 1887748 - RNA, 13 nt, Shigella flexneri 2a str. 2457T
gcaucaugccgcu

SEQ ID NO: 1887749 - RNA, 14 nt, Shigella flexneri 2a str. 2457T
gcaucaucgauacc

SEQ ID NO: 1887750 - RNA, 20 nt, Shigella flexneri 2a str. 2457T
gcaggccugauaagcgcagc

SEQ ID NO: 1887751 - RNA, 19 nt, Shigella flexneri 2a str. 2457T
gcaggcggauugcuucugc

SEQ ID NO: 1887752 - RNA, 14 nt, Shigella flexneri 2a str. 2457T
gcaggcgcaauggc

SEQ ID NO: 1887753 - RNA, 20 nt, Shigella flexneri 2a str. 2457T
gcagggccguuuucguuacu

SEQ ID NO: 1887754 - RNA, 23 nt, Shigella flexneri 2a str. 2457T
gcagggcaaacagcacggucagg

SEQ ID NO: 1887755 - RNA, 22 nt, Shigella flexneri 2a str. 2457T
gcaggcuucaacacaggccggc

SEQ ID NO: 1887756 - RNA, 23 nt, Shigella flexneri 2a str. 2457T
gcaggcuguuaccccugcggccg

SEQ ID NO: 1887757 - RNA, 16 nt, Shigella flexneri 2a str. 2457T
gcaggcggcuggcauc

SEQ ID NO: 1887758 - RNA, 20 nt, Shigella flexneri 2a str. 2457T
gcagcuucucgugaaacuca

SEQ ID NO: 1887759 - RNA, 22 nt, Shigella flexneri 2a str. 2457T
gcaggaacagugccucgcuaau

SEQ ID NO: 1887760 - RNA, 22 nt, Shigella flexneri 2a str. 2457T
gcaggaacugcucauaaacgcg

SEQ ID NO: 1887761 - RNA, 20 nt, Shigella flexneri 2a str. 2457T
gcaggaaauacguaggccug

SEQ ID NO: 1887762 - RNA, 19 nt, Shigella flexneri 2a str. 2457T
gcaggaaaagguaggccug

SEQ ID NO: 1887763 - RNA, 20 nt, Shigella flexneri 2a str. 2457T
gcaggaaaacaauguucauc

SEQ ID NO: 1887764 - RNA, 21 nt, Shigella flexneri 2a str. 2457T
gcaggaaucacguaggccuga

SEQ ID NO: 1887765 - RNA, 17 nt, Shigella flexneri 2a str. 2457T
gcaggagauaauauccu

SEQ ID NO: 1887766 - RNA, 21 nt, Shigella flexneri 2a str. 2457T
gcaggauuucuucaccagccu

SEQ ID NO: 1887767 - RNA, 15 nt, Shigella flexneri 2a str. 2457T
gcagcaauugucgca

SEQ ID NO: 1887768 - RNA, 15 nt, Shigella flexneri 2a str. 2457T
gcagcacccugaguu

SEQ ID NO: 1887769 - RNA, 24 nt, Shigella flexneri 2a str. 2457T
gcagaucaaauucaaugacaguau

SEQ ID NO: 1887770 - RNA, 21 nt, Shigella flexneri 2a str. 2457T
gcagauaccacaucaacccgc

SEQ ID NO: 1887771 - RNA, 22 nt, Shigella flexneri 2a str. 2457T
gcagagccugaauaaacgccau

SEQ ID NO: 1887772 - RNA, 22 nt, Shigella flexneri 2a str. 2457T
gcagcauauaguuuugcauggc

SEQ ID NO: 1887773 - RNA, 13 nt, Shigella flexneri 2a str. 2457T
gcagcaucgucau

SEQ ID NO: 1887774 - RNA, 14 nt, Shigella flexneri 2a str. 2457T
gcagcacugauaau

SEQ ID NO: 1887775 - RNA, 20 nt, Shigella flexneri 2a str. 2457T
gcagcacuacaccccagcgu

SEQ ID NO: 1887776 - RNA, 13 nt, Shigella flexneri 2a str. 2457T
gcagcaguugcca

SEQ ID NO: 1887777 - RNA, 19 nt, Shigella flexneri 2a str. 2457T
gcagcaggugcgccagcga

SEQ ID NO: 1887778 - RNA, 22 nt, Shigella flexneri 2a str. 2457T
gcagcguggugcugauacgcgc

SEQ ID NO: 1887779 - RNA, 20 nt, Shigella flexneri 2a str. 2457T
gcagcgucgcaucaggcauu

SEQ ID NO: 1887780 - RNA, 16 nt, Shigella flexneri 2a str. 2457T
gcagcgucagcaccag

SEQ ID NO: 1887781 - RNA, 21 nt, Shigella flexneri 2a str. 2457T
gcagcguuucgaacaggccga

SEQ ID NO: 1887782 - RNA, 13 nt, Shigella flexneri 2a str. 2457T
gcagcucaucaac

SEQ ID NO: 1887783 - RNA, 16 nt, Shigella flexneri 2a str. 2457T
gcagcgccagcgaagc

SEQ ID NO: 1887784 - RNA, 13 nt, Shigella flexneri 2a str. 2457T
gcagccagcgcgc

SEQ ID NO: 1887785 - RNA, 14 nt, Shigella flexneri 2a str. 2457T
gauggcgucgauaa

SEQ ID NO: 1887786 - RNA, 22 nt, Shigella flexneri 2a str. 2457T
gaugucagcacuuccagcuccg

SEQ ID NO: 1887787 - RNA, 19 nt, Shigella flexneri 2a str. 2457T
gaugucgagguacgcucca

SEQ ID NO: 1887788 - RNA, 17 nt, Shigella flexneri 2a str. 2457T
gauguuugcugcgacgc

SEQ ID NO: 1887789 - RNA, 17 nt, Shigella flexneri 2a str. 2457T
gaugugcaguuccugca

SEQ ID NO: 1887790 - RNA, 16 nt, Shigella flexneri 2a str. 2457T
gauugcuucaguugcc

SEQ ID NO: 1887791 - RNA, 19 nt, Shigella flexneri 2a str. 2457T
gauugccagaugcgacgcu

SEQ ID NO: 1887792 - RNA, 24 nt, Shigella flexneri 2a str. 2457T
gauugcccuguuugucgaucauca

SEQ ID NO: 1887793 - RNA, 22 nt, Shigella flexneri 2a str. 2457T
gauugcaacaagaggcaauagu

SEQ ID NO: 1887794 - RNA, 17 nt, Shigella flexneri 2a str. 2457T
gauuacaucgcgaagaa

SEQ ID NO: 1887795 - RNA, 21 nt, Shigella flexneri 2a str. 2457T
gauuccgccgccauugacguu

SEQ ID NO: 1887796 - RNA, 14 nt, Shigella flexneri 2a str. 2457T
gauucccagucauc

SEQ ID NO: 1887797 - RNA, 14 nt, Shigella flexneri 2a str. 2457T
gauugaauuagcaa

SEQ ID NO: 1887798 - RNA, 17 nt, Shigella flexneri 2a str. 2457T
gauuuugcguucuucca

SEQ ID NO: 1887799 - RNA, 23 nt, Shigella flexneri 2a str. 2457T
gauuuugccagcaugacuaccgg

SEQ ID NO: 1887800 - RNA, 19 nt, Shigella flexneri 2a str. 2457T
gauuuuaauaaaucacgcu

SEQ ID NO: 1887801 - RNA, 20 nt, Shigella flexneri 2a str. 2457T
gauuugugcacgugccagau

SEQ ID NO: 1887802 - RNA, 20 nt, Shigella flexneri 2a str. 2457T
gcaaaaacuuccauguguuu

SEQ ID NO: 1887803 - RNA, 19 nt, Shigella flexneri 2a str. 2457T
gaugcgggugaacgcguua

SEQ ID NO: 1887804 - RNA, 17 nt, Shigella flexneri 2a str. 2457T
gaugcgcuacgcuuauc

SEQ ID NO: 1887805 - RNA, 21 nt, Shigella flexneri 2a str. 2457T
gaugccgggacgaucggcgag

SEQ ID NO: 1887806 - RNA, 16 nt, Shigella flexneri 2a str. 2457T
gaugcgccagcauccg

SEQ ID NO: 1887807 - RNA, 16 nt, Shigella flexneri 2a str. 2457T
gaugcauagcaaccgc

SEQ ID NO: 1887808 - RNA, 15 nt, Shigella flexneri 2a str. 2457T
gaugccagcgaagaa

SEQ ID NO: 1887809 - RNA, 21 nt, Shigella flexneri 2a str. 2457T
gauccugcacuuucagcacgu

SEQ ID NO: 1887810 - RNA, 21 nt, Shigella flexneri 2a str. 2457T
gauccgggcuaaucgucaucg

SEQ ID NO: 1887811 - RNA, 21 nt, Shigella flexneri 2a str. 2457T
gaucacguacacaacgcggca

SEQ ID NO: 1887812 - RNA, 16 nt, Shigella flexneri 2a str. 2457T
gauccaguuacccagc

SEQ ID NO: 1887813 - RNA, 16 nt, Shigella flexneri 2a str. 2457T
gaucacgcgaccaucg

SEQ ID NO: 1887814 - RNA, 13 nt, Shigella flexneri 2a str. 2457T
gaucgcgcaguaa

SEQ ID NO: 1887815 - RNA, 21 nt, Shigella flexneri 2a str. 2457T
gaucgcgccagaaagcagcau

SEQ ID NO: 1887816 - RNA, 19 nt, Shigella flexneri 2a str. 2457T
gaucgcgccaaucagcgca

SEQ ID NO: 1887817 - RNA, 17 nt, Shigella flexneri 2a str. 2457T
gaucgcggcauuaccgg

SEQ ID NO: 1887818 - RNA, 13 nt, Shigella flexneri 2a str. 2457T
gaucguguggcgg

SEQ ID NO: 1887819 - RNA, 20 nt, Shigella flexneri 2a str. 2457T
gaucucaagacaauuagugg

SEQ ID NO: 1887820 - RNA, 17 nt, Shigella flexneri 2a str. 2457T
gaucuuucuucagccgu

SEQ ID NO: 1887821 - RNA, 17 nt, Shigella flexneri 2a str. 2457T
gaucuuuaucaaucacc

SEQ ID NO: 1887822 - RNA, 17 nt, Shigella flexneri 2a str. 2457T
gaucuggcgcguuauca

SEQ ID NO: 1887823 - RNA, 23 nt, Shigella flexneri 2a str. 2457T
gaucuggcgcguuaucagcaacu

SEQ ID NO: 1887824 - RNA, 21 nt, Shigella flexneri 2a str. 2457T
gaugaucgcggcauuaccggc

SEQ ID NO: 1887825 - RNA, 14 nt, Shigella flexneri 2a str. 2457T
gaugcacagaaccg

SEQ ID NO: 1887826 - RNA, 13 nt, Shigella flexneri 2a str. 2457T
gaugcacagcacg

SEQ ID NO: 1887827 - RNA, 17 nt, Shigella flexneri 2a str. 2457T
gaugcaggcccagcggu

SEQ ID NO: 1887828 - RNA, 21 nt, Shigella flexneri 2a str. 2457T
gaugacgcgucaggcgcguga

SEQ ID NO: 1887829 - RNA, 14 nt, Shigella flexneri 2a str. 2457T
gaugagggcgcuaa

SEQ ID NO: 1887830 - RNA, 16 nt, Shigella flexneri 2a str. 2457T
gagcgccagccauuca

SEQ ID NO: 1887831 - RNA, 17 nt, Shigella flexneri 2a str. 2457T
gagcgccccagaccuga

SEQ ID NO: 1887832 - RNA, 18 nt, Shigella flexneri 2a str. 2457T
gagcgauaacccagcgca

SEQ ID NO: 1887833 - RNA, 19 nt, Shigella flexneri 2a str. 2457T
gagccugaauaaacgccau

SEQ ID NO: 1887834 - RNA, 22 nt, Shigella flexneri 2a str. 2457T
gagcgcuuuuuuccugccgcua

SEQ ID NO: 1887835 - RNA, 22 nt, Shigella flexneri 2a str. 2457T
gagcgguuuuuuuaauuacugc

SEQ ID NO: 1887836 - RNA, 22 nt, Shigella flexneri 2a str. 2457T
gagcugauacgggaggucauca

SEQ ID NO: 1887837 - RNA, 12 nt, Shigella flexneri 2a str. 2457T
gagccgcaguaa

SEQ ID NO: 1887838 - RNA, 19 nt, Shigella flexneri 2a str. 2457T
gacgucugccgguacuuca

SEQ ID NO: 1887839 - RNA, 14 nt, Shigella flexneri 2a str. 2457T
gagcagcauuaccu

SEQ ID NO: 1887840 - RNA, 18 nt, Shigella flexneri 2a str. 2457T
gagcaugguaacgcccca

SEQ ID NO: 1887841 - RNA, 20 nt, Shigella flexneri 2a str. 2457T
gauaucgcuggcagaaagcc

SEQ ID NO: 1887842 - RNA, 23 nt, Shigella flexneri 2a str. 2457T
gauaucuacaaaaccacacuucu

SEQ ID NO: 1887843 - RNA, 16 nt, Shigella flexneri 2a str. 2457T
gauaucggaggccugu

SEQ ID NO: 1887844 - RNA, 23 nt, Shigella flexneri 2a str. 2457T
gaucaccaguccaucggcauuaa

SEQ ID NO: 1887845 - RNA, 18 nt, Shigella flexneri 2a str. 2457T
gaucacagcaguccagcg

SEQ ID NO: 1887846 - RNA, 21 nt, Shigella flexneri 2a str. 2457T
gauaauuaugccgaucaucau

SEQ ID NO: 1887847 - RNA, 14 nt, Shigella flexneri 2a str. 2457T
gauacguugccgua

SEQ ID NO: 1887848 - RNA, 14 nt, Shigella flexneri 2a str. 2457T
gauaggcaccgcca

SEQ ID NO: 1887849 - RNA, 18 nt, Shigella flexneri 2a str. 2457T
gauaucccgccagcacca

SEQ ID NO: 1887850 - RNA, 16 nt, Shigella flexneri 2a str. 2457T
gauaauagcguuucag

SEQ ID NO: 1887851 - RNA, 23 nt, Shigella flexneri 2a str. 2457T
gauaauauugaugcacaccaucg

SEQ ID NO: 1887852 - RNA, 16 nt, Shigella flexneri 2a str. 2457T
gauaaucacaaugguc

SEQ ID NO: 1887853 - RNA, 16 nt, Shigella flexneri 2a str. 2457T
gauaaucaacgcgccg

SEQ ID NO: 1887854 - RNA, 20 nt, Shigella flexneri 2a str. 2457T
gauaaugguuuccagcaucg

SEQ ID NO: 1887855 - RNA, 20 nt, Shigella flexneri 2a str. 2457T
gauaauggcuguugaaugcc

SEQ ID NO: 1887856 - RNA, 16 nt, Shigella flexneri 2a str. 2457T
gauaaugaucccgacg

SEQ ID NO: 1887857 - RNA, 16 nt, Shigella flexneri 2a str. 2457T
gaguccuuccagguca

SEQ ID NO: 1887858 - RNA, 20 nt, Shigella flexneri 2a str. 2457T
gauaacggugcaacccgcca

SEQ ID NO: 1887859 - RNA, 15 nt, Shigella flexneri 2a str. 2457T
gauaaccgcaccuuc

SEQ ID NO: 1887860 - RNA, 14 nt, Shigella flexneri 2a str. 2457T
gagggaauccagca

SEQ ID NO: 1887861 - RNA, 19 nt, Shigella flexneri 2a str. 2457T
gagucacucgacagcaccg

SEQ ID NO: 1887862 - RNA, 17 nt, Shigella flexneri 2a str. 2457T
gaguaugcgcgucagag

SEQ ID NO: 1887863 - RNA, 14 nt, Shigella flexneri 2a str. 2457T
gaggaugcggguca

SEQ ID NO: 1887864 - RNA, 13 nt, Shigella flexneri 2a str. 2457T
gaggaagcgcagc

SEQ ID NO: 1887865 - RNA, 20 nt, Shigella flexneri 2a str. 2457T
cgggcguagugcccgcagua

SEQ ID NO: 1887866 - RNA, 17 nt, Shigella flexneri 2a str. 2457T
cgggaauaaaagccagg

SEQ ID NO: 1887867 - RNA, 18 nt, Shigella flexneri 2a str. 2457T
cgggaauaaaagccagga

SEQ ID NO: 1887868 - RNA, 18 nt, Shigella flexneri 2a str. 2457T
cgggcaccaguaacgaua

SEQ ID NO: 1887869 - RNA, 19 nt, Shigella flexneri 2a str. 2457T
cgguaucaccacccagcgg

SEQ ID NO: 1887870 - RNA, 18 nt, Shigella flexneri 2a str. 2457T
cgguaguuaaacuuucau

SEQ ID NO: 1887871 - RNA, 17 nt, Shigella flexneri 2a str. 2457T
cgguaguuucagcggcg

SEQ ID NO: 1887872 - RNA, 22 nt, Shigella flexneri 2a str. 2457T
cgguagauuauuucgcugcgga

SEQ ID NO: 1887873 - RNA, 16 nt, Shigella flexneri 2a str. 2457T
cggguuggagcgcguc

SEQ ID NO: 1887874 - RNA, 20 nt, Shigella flexneri 2a str. 2457T
cggguaacggaccgcauuca

SEQ ID NO: 1887875 - RNA, 14 nt, Shigella flexneri 2a str. 2457T
cggguaaccagcca

SEQ ID NO: 1887876 - RNA, 20 nt, Shigella flexneri 2a str. 2457T
cggguaaauaauauccccag

SEQ ID NO: 1887877 - RNA, 23 nt, Shigella flexneri 2a str. 2457T
cgggguaaauccacguuccugga

SEQ ID NO: 1887878 - RNA, 18 nt, Shigella flexneri 2a str. 2457T
cggggcuaccgccagacc

SEQ ID NO: 1887879 - RNA, 18 nt, Shigella flexneri 2a str. 2457T
cggcgcuaauucaacgcc

SEQ ID NO: 1887880 - RNA, 23 nt, Shigella flexneri 2a str. 2457T
cggcgcugcaauuggucgcgcaa

SEQ ID NO: 1887881 - RNA, 18 nt, Shigella flexneri 2a str. 2457T
cggcgcugacggucuggu

SEQ ID NO: 1887882 - RNA, 13 nt, Shigella flexneri 2a str. 2457T
cggcgcuuucagc

SEQ ID NO: 1887883 - RNA, 16 nt, Shigella flexneri 2a str. 2457T
cggcggcgcggcgaaa

SEQ ID NO: 1887884 - RNA, 13 nt, Shigella flexneri 2a str. 2457T
cggcggcacagcg

SEQ ID NO: 1887885 - RNA, 15 nt, Shigella flexneri 2a str. 2457T
cggcguuuccagcuc

SEQ ID NO: 1887886 - RNA, 16 nt, Shigella flexneri 2a str. 2457T
cggcguuucacuucug

SEQ ID NO: 1887887 - RNA, 22 nt, Shigella flexneri 2a str. 2457T
cggcgugaaugcuuuauucggc

SEQ ID NO: 1887888 - RNA, 16 nt, Shigella flexneri 2a str. 2457T
cggcguccaccugcgu

SEQ ID NO: 1887889 - RNA, 17 nt, Shigella flexneri 2a str. 2457T
cggcuuugcagguucug

SEQ ID NO: 1887890 - RNA, 23 nt, Shigella flexneri 2a str. 2457T
cggcuuuggcaaauggcgcuaac

SEQ ID NO: 1887891 - RNA, 23 nt, Shigella flexneri 2a str. 2457T
cggcuuugucauuaaagccgcca

SEQ ID NO: 1887892 - RNA, 23 nt, Shigella flexneri 2a str. 2457T
cggcugggaaaucaccaccagca

SEQ ID NO: 1887893 - RNA, 16 nt, Shigella flexneri 2a str. 2457T
cggcuuauucauuacu

SEQ ID NO: 1887894 - RNA, 23 nt, Shigella flexneri 2a str. 2457T
cggcugaacugauacucgucgcg

SEQ ID NO: 1887895 - RNA, 21 nt, Shigella flexneri 2a str. 2457T
cggcugcuucggucagcacgc

SEQ ID NO: 1887896 - RNA, 13 nt, Shigella flexneri 2a str. 2457T
cggcugcccauca

SEQ ID NO: 1887897 - RNA, 12 nt, Shigella flexneri 2a str. 2457T
cggcugccggau

SEQ ID NO: 1887898 - RNA, 21 nt, Shigella flexneri 2a str. 2457T
cggaccugucggggccagcgc

SEQ ID NO: 1887899 - RNA, 14 nt, Shigella flexneri 2a str. 2457T
cggaccccacgcuc

SEQ ID NO: 1887900 - RNA, 19 nt, Shigella flexneri 2a str. 2457T
cggaccccacgcucucgca

SEQ ID NO: 1887901 - RNA, 15 nt, Shigella flexneri 2a str. 2457T
cggacggacuuccag

SEQ ID NO: 1887902 - RNA, 22 nt, Shigella flexneri 2a str. 2457T
cggaccagacgaucguaauggc

SEQ ID NO: 1887903 - RNA, 21 nt, Shigella flexneri 2a str. 2457T
cggacaugaaccgugucgcca

SEQ ID NO: 1887904 - RNA, 14 nt, Shigella flexneri 2a str. 2457T
cggacagaccugcg

SEQ ID NO: 1887905 - RNA, 16 nt, Shigella flexneri 2a str. 2457T
cggaauucccgcuucu

SEQ ID NO: 1887906 - RNA, 22 nt, Shigella flexneri 2a str. 2457T
cggaauugccgguacagccgga

SEQ ID NO: 1887907 - RNA, 15 nt, Shigella flexneri 2a str. 2457T
cggacaaccagcuuc

SEQ ID NO: 1887908 - RNA, 22 nt, Shigella flexneri 2a str. 2457T
cggaauuguggugaucacccag

SEQ ID NO: 1887909 - RNA, 20 nt, Shigella flexneri 2a str. 2457T
cgcuggugacaucgccagag

SEQ ID NO: 1887910 - RNA, 19 nt, Shigella flexneri 2a str. 2457T
cggauaucuuucgccaugg

SEQ ID NO: 1887911 - RNA, 14 nt, Shigella flexneri 2a str. 2457T
cggauaagacgcga

SEQ ID NO: 1887912 - RNA, 16 nt, Shigella flexneri 2a str. 2457T
cggauccugagcaaac

SEQ ID NO: 1887913 - RNA, 17 nt, Shigella flexneri 2a str. 2457T
cggaucgguagaccgga

SEQ ID NO: 1887914 - RNA, 14 nt, Shigella flexneri 2a str. 2457T
cggacuucacaucc

SEQ ID NO: 1887915 - RNA, 15 nt, Shigella flexneri 2a str. 2457T
cggacguucgcccac

SEQ ID NO: 1887916 - RNA, 13 nt, Shigella flexneri 2a str. 2457T
cggagcaaugauc

SEQ ID NO: 1887917 - RNA, 14 nt, Shigella flexneri 2a str. 2457T
cggagccagccguu

SEQ ID NO: 1887918 - RNA, 21 nt, Shigella flexneri 2a str. 2457T
cggagcagcagucaggcgcgc

SEQ ID NO: 1887919 - RNA, 23 nt, Shigella flexneri 2a str. 2457T
cggcaaguaauaauaucuccagc

SEQ ID NO: 1887920 - RNA, 20 nt, Shigella flexneri 2a str. 2457T
cggcaaguguuggcgacauc

SEQ ID NO: 1887921 - RNA, 14 nt, Shigella flexneri 2a str. 2457T
cggaugcgccguca

SEQ ID NO: 1887922 - RNA, 17 nt, Shigella flexneri 2a str. 2457T
cggaugcgaugcuggcg

SEQ ID NO: 1887923 - RNA, 13 nt, Shigella flexneri 2a str. 2457T
cggcaaucgccag

SEQ ID NO: 1887924 - RNA, 18 nt, Shigella flexneri 2a str. 2457T
cggcaauccccgccagca

SEQ ID NO: 1887925 - RNA, 18 nt, Shigella flexneri 2a str. 2457T
cggcaaugcguuccagca

SEQ ID NO: 1887926 - RNA, 15 nt, Shigella flexneri 2a str. 2457T
cggcaaucggugcaa

SEQ ID NO: 1887927 - RNA, 20 nt, Shigella flexneri 2a str. 2457T
cggcagccugggucgccauc

SEQ ID NO: 1887928 - RNA, 23 nt, Shigella flexneri 2a str. 2457T
cggcaucaccccacgucaucacg

SEQ ID NO: 1887929 - RNA, 18 nt, Shigella flexneri 2a str. 2457T
cggcaucagaaacacacu

SEQ ID NO: 1887930 - RNA, 11 nt, Shigella flexneri 2a str. 2457T
cggcauaauca

SEQ ID NO: 1887931 - RNA, 22 nt, Shigella flexneri 2a str. 2457T
cggcauacuuugauuaaccguu

SEQ ID NO: 1887932 - RNA, 13 nt, Shigella flexneri 2a str. 2457T
cggcauaaacgcu

SEQ ID NO: 1887933 - RNA, 20 nt, Shigella flexneri 2a str. 2457T
cggcauaaccggaucgccaa

SEQ ID NO: 1887934 - RNA, 14 nt, Shigella flexneri 2a str. 2457T
cggcagcuccagca

SEQ ID NO: 1887935 - RNA, 23 nt, Shigella flexneri 2a str. 2457T
cggcagcgucggaagcgagguau

SEQ ID NO: 1887936 - RNA, 15 nt, Shigella flexneri 2a str. 2457T
cggcauuuuucggcg

SEQ ID NO: 1887937 - RNA, 14 nt, Shigella flexneri 2a str. 2457T
cggcauuuccgcca

SEQ ID NO: 1887938 - RNA, 12 nt, Shigella flexneri 2a str. 2457T
cggcauccagcg

SEQ ID NO: 1887939 - RNA, 13 nt, Shigella flexneri 2a str. 2457T
cggccccgguucu

SEQ ID NO: 1887940 - RNA, 15 nt, Shigella flexneri 2a str. 2457T
cggccagguuaacca

SEQ ID NO: 1887941 - RNA, 18 nt, Shigella flexneri 2a str. 2457T
cggccaguaaccuuucag

SEQ ID NO: 1887942 - RNA, 19 nt, Shigella flexneri 2a str. 2457T
cggccuacaaaaucgugca

SEQ ID NO: 1887943 - RNA, 14 nt, Shigella flexneri 2a str. 2457T
cggcgaacuuaauc

SEQ ID NO: 1887944 - RNA, 13 nt, Shigella flexneri 2a str. 2457T
cggcgaguauucu

SEQ ID NO: 1887945 - RNA, 13 nt, Shigella flexneri 2a str. 2457T
cggcgagccagcg

SEQ ID NO: 1887946 - RNA, 13 nt, Shigella flexneri 2a str. 2457T
cgccgcugacggc

SEQ ID NO: 1887947 - RNA, 16 nt, Shigella flexneri 2a str. 2457T
cgccgcuuucgucugg

SEQ ID NO: 1887948 - RNA, 21 nt, Shigella flexneri 2a str. 2457T
cgccgcguuuaucgacagacg

SEQ ID NO: 1887949 - RNA, 20 nt, Shigella flexneri 2a str. 2457T
cgccguuuuuacccagcagc

SEQ ID NO: 1887950 - RNA, 19 nt, Shigella flexneri 2a str. 2457T
cgccugauggacauucucc

SEQ ID NO: 1887951 - RNA, 20 nt, Shigella flexneri 2a str. 2457T
cgccugcaccauugcugccg

SEQ ID NO: 1887952 - RNA, 20 nt, Shigella flexneri 2a str. 2457T
cgccugcagggcuuucacgc

SEQ ID NO: 1887953 - RNA, 15 nt, Shigella flexneri 2a str. 2457T
cgccugauucaauga

SEQ ID NO: 1887954 - RNA, 13 nt, Shigella flexneri 2a str. 2457T
cgccuucauucag

SEQ ID NO: 1887955 - RNA, 14 nt, Shigella flexneri 2a str. 2457T
cgccuuauccggcu

SEQ ID NO: 1887956 - RNA, 23 nt, Shigella flexneri 2a str. 2457T
cgccuuaucaggcggcuucgucg

SEQ ID NO: 1887957 - RNA, 19 nt, Shigella flexneri 2a str. 2457T
cgccuuauccggccuacaa

SEQ ID NO: 1887958 - RNA, 14 nt, Shigella flexneri 2a str. 2457T
cgccuuauccggcc

SEQ ID NO: 1887959 - RNA, 17 nt, Shigella flexneri 2a str. 2457T
cgccuuaaagcggcggu

SEQ ID NO: 1887960 - RNA, 18 nt, Shigella flexneri 2a str. 2457T
cgccuuacgcugcggucg

SEQ ID NO: 1887961 - RNA, 11 nt, Shigella flexneri 2a str. 2457T
cgccuggcagu

SEQ ID NO: 1887962 - RNA, 17 nt, Shigella flexneri 2a str. 2457T
cgccugcggccagcagc

SEQ ID NO: 1887963 - RNA, 18 nt, Shigella flexneri 2a str. 2457T
cgccugcggccagcagcu

SEQ ID NO: 1887964 - RNA, 14 nt, Shigella flexneri 2a str. 2457T
cgccuggugaccgc

SEQ ID NO: 1887965 - RNA, 17 nt, Shigella flexneri 2a str. 2457T
cgccugguaccagcacc

SEQ ID NO: 1887966 - RNA, 12 nt, Shigella flexneri 2a str. 2457T
cgccuucugcgc

SEQ ID NO: 1887967 - RNA, 22 nt, Shigella flexneri 2a str. 2457T
cgcgaacagcacaucagccaga

SEQ ID NO: 1887968 - RNA, 19 nt, Shigella flexneri 2a str. 2457T
cgcgacaagcgucgcauca

SEQ ID NO: 1887969 - RNA, 19 nt, Shigella flexneri 2a str. 2457T
cgcgaagcuggucagcauc

SEQ ID NO: 1887970 - RNA, 17 nt, Shigella flexneri 2a str. 2457T
cgccgcccugcagcauc

SEQ ID NO: 1887971 - RNA, 15 nt, Shigella flexneri 2a str. 2457T
cgccgcccagccagc

SEQ ID NO: 1887972 - RNA, 18 nt, Shigella flexneri 2a str. 2457T
cgccgaggauacagccga

SEQ ID NO: 1887973 - RNA, 17 nt, Shigella flexneri 2a str. 2457T
cgccauuuucugccgca

SEQ ID NO: 1887974 - RNA, 23 nt, Shigella flexneri 2a str. 2457T
cgcccaacuaaaugcugcagcca

SEQ ID NO: 1887975 - RNA, 14 nt, Shigella flexneri 2a str. 2457T
cgcccagcuaaucg

SEQ ID NO: 1887976 - RNA, 12 nt, Shigella flexneri 2a str. 2457T
cgcccagcagac

SEQ ID NO: 1887977 - RNA, 20 nt, Shigella flexneri 2a str. 2457T
cgcccagugcggugccgcga

SEQ ID NO: 1887978 - RNA, 11 nt, Shigella flexneri 2a str. 2457T
cgcccaucauu

SEQ ID NO: 1887979 - RNA, 21 nt, Shigella flexneri 2a str. 2457T
cgcccaguugaucaccagugc

SEQ ID NO: 1887980 - RNA, 15 nt, Shigella flexneri 2a str. 2457T
cgcccccgauccagc

SEQ ID NO: 1887981 - RNA, 15 nt, Shigella flexneri 2a str. 2457T
cgccccacagaccca

SEQ ID NO: 1887982 - RNA, 18 nt, Shigella flexneri 2a str. 2457T
cgcguuuuuucgauauca

SEQ ID NO: 1887983 - RNA, 13 nt, Shigella flexneri 2a str. 2457T
cgcucaucagcgg

SEQ ID NO: 1887984 - RNA, 21 nt, Shigella flexneri 2a str. 2457T
cgcguuucugcgcuucugcca

SEQ ID NO: 1887985 - RNA, 14 nt, Shigella flexneri 2a str. 2457T
cgcugacggcagcg

SEQ ID NO: 1887986 - RNA, 19 nt, Shigella flexneri 2a str. 2457T
cgcugaccuucuucagcaa

SEQ ID NO: 1887987 - RNA, 19 nt, Shigella flexneri 2a str. 2457T
cgcucuuguucuuccggca

SEQ ID NO: 1887988 - RNA, 16 nt, Shigella flexneri 2a str. 2457T
cgcugccguugcuuga

SEQ ID NO: 1887989 - RNA, 22 nt, Shigella flexneri 2a str. 2457T
cgcugcuaauuuaucggcguua

SEQ ID NO: 1887990 - RNA, 18 nt, Shigella flexneri 2a str. 2457T
cgcugggagaauugcgaa

SEQ ID NO: 1887991 - RNA, 18 nt, Shigella flexneri 2a str. 2457T
cgcuggaugucuggcaga

SEQ ID NO: 1887992 - RNA, 17 nt, Shigella flexneri 2a str. 2457T
cgcgugacgcuggcaga

SEQ ID NO: 1887993 - RNA, 22 nt, Shigella flexneri 2a str. 2457T
cgcguugaugccgugcagcacg

SEQ ID NO: 1887994 - RNA, 21 nt, Shigella flexneri 2a str. 2457T
cgcguuggcaagauaggcauc

SEQ ID NO: 1887995 - RNA, 20 nt, Shigella flexneri 2a str. 2457T
cgcgucguccccacagcguc

SEQ ID NO: 1887996 - RNA, 16 nt, Shigella flexneri 2a str. 2457T
cgcgucgucaaccuga

SEQ ID NO: 1887997 - RNA, 16 nt, Shigella flexneri 2a str. 2457T
cgcgucuuauccggcc

SEQ ID NO: 1887998 - RNA, 15 nt, Shigella flexneri 2a str. 2457T
cgcgggucguugauc

SEQ ID NO: 1887999 - RNA, 14 nt, Shigella flexneri 2a str. 2457T
cgcgggucaccgcg

SEQ ID NO: 1888000 - RNA, 22 nt, Shigella flexneri 2a str. 2457T
cgcgguugcggguuuucgcugc

SEQ ID NO: 1888001 - RNA, 21 nt, Shigella flexneri 2a str. 2457T
cgcguaaauuugcucaucgau

SEQ ID NO: 1888002 - RNA, 21 nt, Shigella flexneri 2a str. 2457T
cgcguaaaacagccagcgcug

SEQ ID NO: 1888003 - RNA, 14 nt, Shigella flexneri 2a str. 2457T
cgcguaauacauca

SEQ ID NO: 1888004 - RNA, 22 nt, Shigella flexneri 2a str. 2457T
cgcgucaacagggcagacauuc

SEQ ID NO: 1888005 - RNA, 13 nt, Shigella flexneri 2a str. 2457T
cgcgccgcauccg

SEQ ID NO: 1888006 - RNA, 21 nt, Shigella flexneri 2a str. 2457T
cgcgccauauaauacgcaucg

SEQ ID NO: 1888007 - RNA, 14 nt, Shigella flexneri 2a str. 2457T
cgcgccaaucagcg

SEQ ID NO: 1888008 - RNA, 13 nt, Shigella flexneri 2a str. 2457T
cgcgccaccauuc

SEQ ID NO: 1888009 - RNA, 17 nt, Shigella flexneri 2a str. 2457T
cgcgcaaucagcaccgc

SEQ ID NO: 1888010 - RNA, 20 nt, Shigella flexneri 2a str. 2457T
cgcgcacgcugguaacggcg

SEQ ID NO: 1888011 - RNA, 21 nt, Shigella flexneri 2a str. 2457T
cgcgcacuaugugccagcuuc

SEQ ID NO: 1888012 - RNA, 17 nt, Shigella flexneri 2a str. 2457T
cgcgcagcgucgcauca

SEQ ID NO: 1888013 - RNA, 22 nt, Shigella flexneri 2a str. 2457T
cgcgcaguuugucuucaaugcg

SEQ ID NO: 1888014 - RNA, 19 nt, Shigella flexneri 2a str. 2457T
cgcggcagugacugcccca

SEQ ID NO: 1888015 - RNA, 20 nt, Shigella flexneri 2a str. 2457T
cgcggcaauuuuuaccgguc

SEQ ID NO: 1888016 - RNA, 21 nt, Shigella flexneri 2a str. 2457T
cgcgcggucauaaaauccgua

SEQ ID NO: 1888017 - RNA, 15 nt, Shigella flexneri 2a str. 2457T
ccggcauuacggauu

SEQ ID NO: 1888018 - RNA, 22 nt, Shigella flexneri 2a str. 2457T
ccggcauuaucacaucagcgca

SEQ ID NO: 1888019 - RNA, 13 nt, Shigella flexneri 2a str. 2457T
ccggcaucgacag

SEQ ID NO: 1888020 - RNA, 21 nt, Shigella flexneri 2a str. 2457T
ccggcaucgcaaaccagacgc

SEQ ID NO: 1888021 - RNA, 13 nt, Shigella flexneri 2a str. 2457T
ccggcaucaacca

SEQ ID NO: 1888022 - RNA, 23 nt, Shigella flexneri 2a str. 2457T
ccggcauaaacaaagugcacuuu

SEQ ID NO: 1888023 - RNA, 20 nt, Shigella flexneri 2a str. 2457T
ccggcauaaacaacgagcuu

SEQ ID NO: 1888024 - RNA, 18 nt, Shigella flexneri 2a str. 2457T
ccggaauaauugcgguuu

SEQ ID NO: 1888025 - RNA, 18 nt, Shigella flexneri 2a str. 2457T
ccggaaguaccaauggca

SEQ ID NO: 1888026 - RNA, 22 nt, Shigella flexneri 2a str. 2457T
ccggaauaacucccuauaaugc

SEQ ID NO: 1888027 - RNA, 19 nt, Shigella flexneri 2a str. 2457T
ccggaaggaagacgcagca

SEQ ID NO: 1888028 - RNA, 22 nt, Shigella flexneri 2a str. 2457T
ccggaaggaagacgcagcaugc

SEQ ID NO: 1888029 - RNA, 21 nt, Shigella flexneri 2a str. 2457T
ccggaauaaaugucacgucau

SEQ ID NO: 1888030 - RNA, 22 nt, Shigella flexneri 2a str. 2457T
ccggcauuuuuuagcgccagcc

SEQ ID NO: 1888031 - RNA, 15 nt, Shigella flexneri 2a str. 2457T
ccggccacagcgcca

SEQ ID NO: 1888032 - RNA, 21 nt, Shigella flexneri 2a str. 2457T
ccggccccugaucggccauga

SEQ ID NO: 1888033 - RNA, 14 nt, Shigella flexneri 2a str. 2457T
ccggcgcauccaug

SEQ ID NO: 1888034 - RNA, 13 nt, Shigella flexneri 2a str. 2457T
ccggcgcauccau

SEQ ID NO: 1888035 - RNA, 19 nt, Shigella flexneri 2a str. 2457T
ccggcgacccgcgacuggu

SEQ ID NO: 1888036 - RNA, 17 nt, Shigella flexneri 2a str. 2457T
ccggcgucccaucggca

SEQ ID NO: 1888037 - RNA, 22 nt, Shigella flexneri 2a str. 2457T
ccggcgggaaaaaucuucgauc

SEQ ID NO: 1888038 - RNA, 23 nt, Shigella flexneri 2a str. 2457T
ccggcuuucugcaaccaggaagu

SEQ ID NO: 1888039 - RNA, 17 nt, Shigella flexneri 2a str. 2457T
ccgggcuucucgcucga

SEQ ID NO: 1888040 - RNA, 16 nt, Shigella flexneri 2a str. 2457T
ccggguaccagaauca

SEQ ID NO: 1888041 - RNA, 14 nt, Shigella flexneri 2a str. 2457T
ccggguaccacgca

SEQ ID NO: 1888042 - RNA, 15 nt, Shigella flexneri 2a str. 2457T
ccgggucauccagga

SEQ ID NO: 1888043 - RNA, 21 nt, Shigella flexneri 2a str. 2457T
ccgggcugaugccgcguuggu

SEQ ID NO: 1888044 - RNA, 17 nt, Shigella flexneri 2a str. 2457T
ccgggcugguuuucagc

SEQ ID NO: 1888045 - RNA, 17 nt, Shigella flexneri 2a str. 2457T
ccgucauuguuaacgcc

SEQ ID NO: 1888046 - RNA, 15 nt, Shigella flexneri 2a str. 2457T
ccgucaaagcgccag

SEQ ID NO: 1888047 - RNA, 14 nt, Shigella flexneri 2a str. 2457T
ccgucaccacuuca

SEQ ID NO: 1888048 - RNA, 16 nt, Shigella flexneri 2a str. 2457T
ccgucagauccgccag

SEQ ID NO: 1888049 - RNA, 13 nt, Shigella flexneri 2a str. 2457T
ccgucagcggcaa

SEQ ID NO: 1888050 - RNA, 19 nt, Shigella flexneri 2a str. 2457T
ccguaugaugugcgcuaac

SEQ ID NO: 1888051 - RNA, 15 nt, Shigella flexneri 2a str. 2457T
ccguaccaucgccag

SEQ ID NO: 1888052 - RNA, 15 nt, Shigella flexneri 2a str. 2457T
ccguaccagccuugc

SEQ ID NO: 1888053 - RNA, 18 nt, Shigella flexneri 2a str. 2457T
ccguacauagcgucaaga

SEQ ID NO: 1888054 - RNA, 21 nt, Shigella flexneri 2a str. 2457T
ccgguuugcgccgugcgaaua

SEQ ID NO: 1888055 - RNA, 14 nt, Shigella flexneri 2a str. 2457T
ccgguuuagugaua

SEQ ID NO: 1888056 - RNA, 16 nt, Shigella flexneri 2a str. 2457T
ccgguugucaggaagc

SEQ ID NO: 1888057 - RNA, 22 nt, Shigella flexneri 2a str. 2457T
ccgguugccugaugcgacgcug

SEQ ID NO: 1888058 - RNA, 13 nt, Shigella flexneri 2a str. 2457T
ccgguugaccggc

SEQ ID NO: 1888059 - RNA, 15 nt, Shigella flexneri 2a str. 2457T
ccguggaugcgaugu

SEQ ID NO: 1888060 - RNA, 16 nt, Shigella flexneri 2a str. 2457T
ccgugugccgacaucg

SEQ ID NO: 1888061 - RNA, 15 nt, Shigella flexneri 2a str. 2457T
ccguuaaccacuuca

SEQ ID NO: 1888062 - RNA, 15 nt, Shigella flexneri 2a str. 2457T
ccguuaaccguggga

SEQ ID NO: 1888063 - RNA, 19 nt, Shigella flexneri 2a str. 2457T
ccguuauuaaaaagccugc

SEQ ID NO: 1888064 - RNA, 22 nt, Shigella flexneri 2a str. 2457T
ccguuaccguaccaaccgcaau

SEQ ID NO: 1888065 - RNA, 16 nt, Shigella flexneri 2a str. 2457T
ccgugccggacggucg

SEQ ID NO: 1888066 - RNA, 16 nt, Shigella flexneri 2a str. 2457T
ccuccacgcccagcgc

SEQ ID NO: 1888067 - RNA, 13 nt, Shigella flexneri 2a str. 2457T
ccguucaguuccg

SEQ ID NO: 1888068 - RNA, 13 nt, Shigella flexneri 2a str. 2457T
ccguucauccgcu

SEQ ID NO: 1888069 - RNA, 23 nt, Shigella flexneri 2a str. 2457T
ccguucgccaggucagagagcca

SEQ ID NO: 1888070 - RNA, 15 nt, Shigella flexneri 2a str. 2457T
ccuacaucguuccug

SEQ ID NO: 1888071 - RNA, 14 nt, Shigella flexneri 2a str. 2457T
ccuaccugcaguuc

SEQ ID NO: 1888072 - RNA, 18 nt, Shigella flexneri 2a str. 2457T
ccugauugaccgccagcg

SEQ ID NO: 1888073 - RNA, 14 nt, Shigella flexneri 2a str. 2457T
ccugcacuuucagc

SEQ ID NO: 1888074 - RNA, 13 nt, Shigella flexneri 2a str. 2457T
ccugcauccgcca

SEQ ID NO: 1888075 - RNA, 23 nt, Shigella flexneri 2a str. 2457T
ccugcauccgccauccaccagca

SEQ ID NO: 1888076 - RNA, 16 nt, Shigella flexneri 2a str. 2457T
ccugccaguuauagcg

SEQ ID NO: 1888077 - RNA, 19 nt, Shigella flexneri 2a str. 2457T
ccugaugcgacgcuugacg

SEQ ID NO: 1888078 - RNA, 14 nt, Shigella flexneri 2a str. 2457T
ccugauaagcgcag

SEQ ID NO: 1888079 - RNA, 20 nt, Shigella flexneri 2a str. 2457T
ccugauaagacgcgccagcg

SEQ ID NO: 1888080 - RNA, 18 nt, Shigella flexneri 2a str. 2457T
ccugacacaacuggcgca

SEQ ID NO: 1888081 - RNA, 15 nt, Shigella flexneri 2a str. 2457T
ccugacagcagagca

SEQ ID NO: 1888082 - RNA, 16 nt, Shigella flexneri 2a str. 2457T
ccucuccuguucucac

SEQ ID NO: 1888083 - RNA, 17 nt, Shigella flexneri 2a str. 2457T
ccucuucccagacccag

SEQ ID NO: 1888084 - RNA, 13 nt, Shigella flexneri 2a str. 2457T
ccucuuucuagac

SEQ ID NO: 1888085 - RNA, 19 nt, Shigella flexneri 2a str. 2457T
ccucuugucaggccggaau

SEQ ID NO: 1888086 - RNA, 18 nt, Shigella flexneri 2a str. 2457T
ccucuuuacgcaaaauca

SEQ ID NO: 1888087 - RNA, 15 nt, Shigella flexneri 2a str. 2457T
ccucuuucauccgau

SEQ ID NO: 1888088 - RNA, 17 nt, Shigella flexneri 2a str. 2457T
ccugaagguguuugacu

SEQ ID NO: 1888089 - RNA, 19 nt, Shigella flexneri 2a str. 2457T
ccugaaaguauuugacugu

SEQ ID NO: 1888090 - RNA, 21 nt, Shigella flexneri 2a str. 2457T
ccgauacacaucgucgccaga

SEQ ID NO: 1888091 - RNA, 19 nt, Shigella flexneri 2a str. 2457T
ccgaucgaagagacgcugg

SEQ ID NO: 1888092 - RNA, 19 nt, Shigella flexneri 2a str. 2457T
ccgaugaucaacagcauca

SEQ ID NO: 1888093 - RNA, 17 nt, Shigella flexneri 2a str. 2457T
ccgaugaccuugucaug

SEQ ID NO: 1888094 - RNA, 14 nt, Shigella flexneri 2a str. 2457T
ccgcaccaccagca

SEQ ID NO: 1888095 - RNA, 20 nt, Shigella flexneri 2a str. 2457T
ccgcacauuucccggccacg

SEQ ID NO: 1888096 - RNA, 19 nt, Shigella flexneri 2a str. 2457T
ccgccaaaacgguccggca

SEQ ID NO: 1888097 - RNA, 19 nt, Shigella flexneri 2a str. 2457T
ccgccacuuuacaggugcu

SEQ ID NO: 1888098 - RNA, 17 nt, Shigella flexneri 2a str. 2457T
ccgccagacguccggcg

SEQ ID NO: 1888099 - RNA, 18 nt, Shigella flexneri 2a str. 2457T
ccgccacuaucgccauca

SEQ ID NO: 1888100 - RNA, 16 nt, Shigella flexneri 2a str. 2457T
ccgcaguguaguucug

SEQ ID NO: 1888101 - RNA, 17 nt, Shigella flexneri 2a str. 2457T
ccgcaguaaagcgcagg

SEQ ID NO: 1888102 - RNA, 12 nt, Shigella flexneri 2a str. 2457T
ccgcauccggca

SEQ ID NO: 1888103 - RNA, 21 nt, Shigella flexneri 2a str. 2457T
ccgcacgcguagagaauccag

SEQ ID NO: 1888104 - RNA, 13 nt, Shigella flexneri 2a str. 2457T
ccgauaaccacgc

SEQ ID NO: 1888105 - RNA, 13 nt, Shigella flexneri 2a str. 2457T
ccgaggcgcuggc

SEQ ID NO: 1888106 - RNA, 20 nt, Shigella flexneri 2a str. 2457T
ccgagcgccaccaucgauac

SEQ ID NO: 1888107 - RNA, 13 nt, Shigella flexneri 2a str. 2457T
ccgagcgccagcc

SEQ ID NO: 1888108 - RNA, 14 nt, Shigella flexneri 2a str. 2457T
ccgagcguggcgau

SEQ ID NO: 1888109 - RNA, 17 nt, Shigella flexneri 2a str. 2457T
ccgagcagccacugcgg

SEQ ID NO: 1888110 - RNA, 23 nt, Shigella flexneri 2a str. 2457T
ccgacgugguuaacgaccagcgg

SEQ ID NO: 1888111 - RNA, 15 nt, Shigella flexneri 2a str. 2457T
ccgacgugcagcauc

SEQ ID NO: 1888112 - RNA, 19 nt, Shigella flexneri 2a str. 2457T
ccgacuucaauaacgguag

SEQ ID NO: 1888113 - RNA, 22 nt, Shigella flexneri 2a str. 2457T
ccgagaagauuuuuugccagca

SEQ ID NO: 1888114 - RNA, 21 nt, Shigella flexneri 2a str. 2457T
ccgacgcaguggguaaugcug

SEQ ID NO: 1888115 - RNA, 14 nt, Shigella flexneri 2a str. 2457T
ccgacgccaguucu

SEQ ID NO: 1888116 - RNA, 17 nt, Shigella flexneri 2a str. 2457T
ccgacaaauaccaccgu

SEQ ID NO: 1888117 - RNA, 20 nt, Shigella flexneri 2a str. 2457T
ccgacgauuugugcacgugc

SEQ ID NO: 1888118 - RNA, 19 nt, Shigella flexneri 2a str. 2457T
ccgacgcuugaagcacacg

SEQ ID NO: 1888119 - RNA, 23 nt, Shigella flexneri 2a str. 2457T
ccgcgcucgaagcgggcgcgcag

SEQ ID NO: 1888120 - RNA, 21 nt, Shigella flexneri 2a str. 2457T
ccgcgcggcgcaggcgcuugu

SEQ ID NO: 1888121 - RNA, 15 nt, Shigella flexneri 2a str. 2457T
ccgcucgucacauca

SEQ ID NO: 1888122 - RNA, 19 nt, Shigella flexneri 2a str. 2457T
ccgcuaacagcagcagcgc

SEQ ID NO: 1888123 - RNA, 15 nt, Shigella flexneri 2a str. 2457T
ccgcuaccgcccuga

SEQ ID NO: 1888124 - RNA, 13 nt, Shigella flexneri 2a str. 2457T
ccgcuggccauuu

SEQ ID NO: 1888125 - RNA, 14 nt, Shigella flexneri 2a str. 2457T
ccgcucucauccau

SEQ ID NO: 1888126 - RNA, 15 nt, Shigella flexneri 2a str. 2457T
ccgcguguuuccggg

SEQ ID NO: 1888127 - RNA, 20 nt, Shigella flexneri 2a str. 2457T
ccgcguggacggucaacuga

SEQ ID NO: 1888128 - RNA, 14 nt, Shigella flexneri 2a str. 2457T
ccgcguggcgcaag

SEQ ID NO: 1888129 - RNA, 14 nt, Shigella flexneri 2a str. 2457T
ccgccgcaauccgc

SEQ ID NO: 1888130 - RNA, 22 nt, Shigella flexneri 2a str. 2457T
ccgccgauuuccugcgucgcua

SEQ ID NO: 1888131 - RNA, 18 nt, Shigella flexneri 2a str. 2457T
ccgcccguuuucuccagc

SEQ ID NO: 1888132 - RNA, 20 nt, Shigella flexneri 2a str. 2457T
ccgcccguuuucuccagcgc

SEQ ID NO: 1888133 - RNA, 21 nt, Shigella flexneri 2a str. 2457T
ccgcgcauuacgcucacugca

SEQ ID NO: 1888134 - RNA, 12 nt, Shigella flexneri 2a str. 2457T
ccgcgcaguucg

SEQ ID NO: 1888135 - RNA, 18 nt, Shigella flexneri 2a str. 2457T
ccgcgauaaaaauccugu

SEQ ID NO: 1888136 - RNA, 14 nt, Shigella flexneri 2a str. 2457T
ccgcgauccagcgc

SEQ ID NO: 1888137 - RNA, 19 nt, Shigella flexneri 2a str. 2457T
ccgccugauagaccggacc

SEQ ID NO: 1888138 - RNA, 15 nt, Shigella flexneri 2a str. 2457T
cgaagaacugcugga

SEQ ID NO: 1888139 - RNA, 20 nt, Shigella flexneri 2a str. 2457T
cgaagccugcgaugucugau

SEQ ID NO: 1888140 - RNA, 23 nt, Shigella flexneri 2a str. 2457T
cgaagcuggcggcggcgggcgca

SEQ ID NO: 1888141 - RNA, 16 nt, Shigella flexneri 2a str. 2457T
cgaacuaaacaacgcc

SEQ ID NO: 1888142 - RNA, 15 nt, Shigella flexneri 2a str. 2457T
cgaacucuuccggca

SEQ ID NO: 1888143 - RNA, 12 nt, Shigella flexneri 2a str. 2457T
cgaacggucagu

SEQ ID NO: 1888144 - RNA, 15 nt, Shigella flexneri 2a str. 2457T
cgaacaccagcagua

SEQ ID NO: 1888145 - RNA, 13 nt, Shigella flexneri 2a str. 2457T
cgaacaccagcag

SEQ ID NO: 1888146 - RNA, 16 nt, Shigella flexneri 2a str. 2457T
cgaaaucuacggugga

SEQ ID NO: 1888147 - RNA, 22 nt, Shigella flexneri 2a str. 2457T
cgaauugaagccaaaucaucca

SEQ ID NO: 1888148 - RNA, 22 nt, Shigella flexneri 2a str. 2457T
cgacaacgcaacgccgccggaa

SEQ ID NO: 1888149 - RNA, 17 nt, Shigella flexneri 2a str. 2457T
cgacaaaugcgccgcca

SEQ ID NO: 1888150 - RNA, 14 nt, Shigella flexneri 2a str. 2457T
cgaauacacccuga

SEQ ID NO: 1888151 - RNA, 14 nt, Shigella flexneri 2a str. 2457T
cgaaggcggcgaag

SEQ ID NO: 1888152 - RNA, 23 nt, Shigella flexneri 2a str. 2457T
cgaauacguugcuucaugccgga

SEQ ID NO: 1888153 - RNA, 19 nt, Shigella flexneri 2a str. 2457T
cgaauaccuucuuccugcg

SEQ ID NO: 1888154 - RNA, 18 nt, Shigella flexneri 2a str. 2457T
cgaaucagauucacggua

SEQ ID NO: 1888155 - RNA, 17 nt, Shigella flexneri 2a str. 2457T
cgacaguaccagcagua

SEQ ID NO: 1888156 - RNA, 21 nt, Shigella flexneri 2a str. 2457T
cgacauaucauuuugcugcca

SEQ ID NO: 1888157 - RNA, 19 nt, Shigella flexneri 2a str. 2457T
cgacagggaucucuuccag

SEQ ID NO: 1888158 - RNA, 16 nt, Shigella flexneri 2a str. 2457T
cgacagggaucucuuc

SEQ ID NO: 1888159 - RNA, 20 nt, Shigella flexneri 2a str. 2457T
cgacaggcuuucuucgucgu

SEQ ID NO: 1888160 - RNA, 16 nt, Shigella flexneri 2a str. 2457T
cgacaaucaucgccuu

SEQ ID NO: 1888161 - RNA, 15 nt, Shigella flexneri 2a str. 2457T
cgacaaucaaccagc

SEQ ID NO: 1888162 - RNA, 17 nt, Shigella flexneri 2a str. 2457T
cgacaaggcaucagauc

SEQ ID NO: 1888163 - RNA, 13 nt, Shigella flexneri 2a str. 2457T
cgacacaacgcuu

SEQ ID NO: 1888164 - RNA, 17 nt, Shigella flexneri 2a str. 2457T
cgacacagguaucgaca

SEQ ID NO: 1888165 - RNA, 16 nt, Shigella flexneri 2a str. 2457T
cgacagacgccagcgc

SEQ ID NO: 1888166 - RNA, 18 nt, Shigella flexneri 2a str. 2457T
cgacagauucaggcgcag

SEQ ID NO: 1888167 - RNA, 17 nt, Shigella flexneri 2a str. 2457T
ccuugcgggaucaggcg

SEQ ID NO: 1888168 - RNA, 12 nt, Shigella flexneri 2a str. 2457T
ccuugccagaug

SEQ ID NO: 1888169 - RNA, 19 nt, Shigella flexneri 2a str. 2457T
ccuucaucuucauccggcu

SEQ ID NO: 1888170 - RNA, 21 nt, Shigella flexneri 2a str. 2457T
ccuucacuuuugccagacgaa

SEQ ID NO: 1888171 - RNA, 12 nt, Shigella flexneri 2a str. 2457T
ccuucagcggca

SEQ ID NO: 1888172 - RNA, 22 nt, Shigella flexneri 2a str. 2457T
ccuucaucacgcagcgucagca

SEQ ID NO: 1888173 - RNA, 22 nt, Shigella flexneri 2a str. 2457T
ccuuugaacaaccagaaagaug

SEQ ID NO: 1888174 - RNA, 15 nt, Shigella flexneri 2a str. 2457T
ccuuuaugacgaucg

SEQ ID NO: 1888175 - RNA, 13 nt, Shigella flexneri 2a str. 2457T
ccuuuccggcaau

SEQ ID NO: 1888176 - RNA, 15 nt, Shigella flexneri 2a str. 2457T
cgaaaaaugcuggau

SEQ ID NO: 1888177 - RNA, 14 nt, Shigella flexneri 2a str. 2457T
ccuuuagcgagcga

SEQ ID NO: 1888178 - RNA, 11 nt, Shigella flexneri 2a str. 2457T
ccuuuaccaga

SEQ ID NO: 1888179 - RNA, 16 nt, Shigella flexneri 2a str. 2457T
ccuuuaaaucccgcuu

SEQ ID NO: 1888180 - RNA, 19 nt, Shigella flexneri 2a str. 2457T
cgaaaccggauacccugcc

SEQ ID NO: 1888181 - RNA, 20 nt, Shigella flexneri 2a str. 2457T
cgaaacaaucguugccugau

SEQ ID NO: 1888182 - RNA, 20 nt, Shigella flexneri 2a str. 2457T
cgaaaucaccgccaccagcg

SEQ ID NO: 1888183 - RNA, 19 nt, Shigella flexneri 2a str. 2457T
cgaaauccauguugcugga

SEQ ID NO: 1888184 - RNA, 23 nt, Shigella flexneri 2a str. 2457T
ccugguaaaaaaugauuuccugc

SEQ ID NO: 1888185 - RNA, 14 nt, Shigella flexneri 2a str. 2457T
ccuguaccagcccg

SEQ ID NO: 1888186 - RNA, 20 nt, Shigella flexneri 2a str. 2457T
ccugguugcuggauaagaug

SEQ ID NO: 1888187 - RNA, 19 nt, Shigella flexneri 2a str. 2457T
ccugccuucacuuccggca

SEQ ID NO: 1888188 - RNA, 19 nt, Shigella flexneri 2a str. 2457T
ccugccgcaggacgggcaa

SEQ ID NO: 1888189 - RNA, 20 nt, Shigella flexneri 2a str. 2457T
ccuggcgaacccaaccguga

SEQ ID NO: 1888190 - RNA, 22 nt, Shigella flexneri 2a str. 2457T
cgacguugauuuugucauggcg

SEQ ID NO: 1888191 - RNA, 17 nt, Shigella flexneri 2a str. 2457T
cgacucaaaucacgcag

SEQ ID NO: 1888192 - RNA, 21 nt, Shigella flexneri 2a str. 2457T
cgacuucuucauucauccgcc

SEQ ID NO: 1888193 - RNA, 21 nt, Shigella flexneri 2a str. 2457T
cgagcgccguugcgcccauca

SEQ ID NO: 1888194 - RNA, 18 nt, Shigella flexneri 2a str. 2457T
cgagcccagaugccggau

SEQ ID NO: 1888195 - RNA, 21 nt, Shigella flexneri 2a str. 2457T
cgagaauuucucgugccacca

SEQ ID NO: 1888196 - RNA, 19 nt, Shigella flexneri 2a str. 2457T
cgagauacagguugccgau

SEQ ID NO: 1888197 - RNA, 13 nt, Shigella flexneri 2a str. 2457T
cgagaguaacaca

SEQ ID NO: 1888198 - RNA, 16 nt, Shigella flexneri 2a str. 2457T
cgagcagcacaaugcc

SEQ ID NO: 1888199 - RNA, 21 nt, Shigella flexneri 2a str. 2457T
cgacaugacccggcguaugcc

SEQ ID NO: 1888200 - RNA, 16 nt, Shigella flexneri 2a str. 2457T
cgacccgacagaugcu

SEQ ID NO: 1888201 - RNA, 23 nt, Shigella flexneri 2a str. 2457T
cgacccgccuugauauaaauccc

SEQ ID NO: 1888202 - RNA, 19 nt, Shigella flexneri 2a str. 2457T
cgaccgccucgcgccagcg

SEQ ID NO: 1888203 - RNA, 15 nt, Shigella flexneri 2a str. 2457T
cgacgaugaucaagc

SEQ ID NO: 1888204 - RNA, 13 nt, Shigella flexneri 2a str. 2457T
cgacgcucacgcg

SEQ ID NO: 1888205 - RNA, 23 nt, Shigella flexneri 2a str. 2457T
cgacgagaaaugucggcccgcau

SEQ ID NO: 1888206 - RNA, 21 nt, Shigella flexneri 2a str. 2457T
cgacgacugccgcucaccuga

SEQ ID NO: 1888207 - RNA, 19 nt, Shigella flexneri 2a str. 2457T
cgaccuguaccuucagcgg

SEQ ID NO: 1888208 - RNA, 21 nt, Shigella flexneri 2a str. 2457T
cgaccuguaccuucagcggca

SEQ ID NO: 1888209 - RNA, 21 nt, Shigella flexneri 2a str. 2457T
cgaucgaugugauaaauacga

SEQ ID NO: 1888210 - RNA, 18 nt, Shigella flexneri 2a str. 2457T
cgaucuuccacgccugca

SEQ ID NO: 1888211 - RNA, 20 nt, Shigella flexneri 2a str. 2457T
cgaucuggugcaauuucagc

SEQ ID NO: 1888212 - RNA, 19 nt, Shigella flexneri 2a str. 2457T
cgaucugacgugcgcaaac

SEQ ID NO: 1888213 - RNA, 12 nt, Shigella flexneri 2a str. 2457T
cgaugcacagca

SEQ ID NO: 1888214 - RNA, 16 nt, Shigella flexneri 2a str. 2457T
cgaugcaagaggguua

SEQ ID NO: 1888215 - RNA, 12 nt, Shigella flexneri 2a str. 2457T
cgaugccgacga

SEQ ID NO: 1888216 - RNA, 23 nt, Shigella flexneri 2a str. 2457T
cgaugggagcagccagccagacg

SEQ ID NO: 1888217 - RNA, 20 nt, Shigella flexneri 2a str. 2457T
cgaugcggcucagccagacg

SEQ ID NO: 1888218 - RNA, 18 nt, Shigella flexneri 2a str. 2457T
cgauuucaaccacucacg

SEQ ID NO: 1888219 - RNA, 15 nt, Shigella flexneri 2a str. 2457T
cgauuuacuggcaga

SEQ ID NO: 1888220 - RNA, 19 nt, Shigella flexneri 2a str. 2457T
cgauugaucucguugauca

SEQ ID NO: 1888221 - RNA, 19 nt, Shigella flexneri 2a str. 2457T
cgauguuguacaugcugcu

SEQ ID NO: 1888222 - RNA, 14 nt, Shigella flexneri 2a str. 2457T
cgauguuugcugcg

SEQ ID NO: 1888223 - RNA, 17 nt, Shigella flexneri 2a str. 2457T
cgauuaaaaacccugca

SEQ ID NO: 1888224 - RNA, 22 nt, Shigella flexneri 2a str. 2457T
cgauuaacgccagacucgccag

SEQ ID NO: 1888225 - RNA, 15 nt, Shigella flexneri 2a str. 2457T
cgcaacgacaccguu

SEQ ID NO: 1888226 - RNA, 15 nt, Shigella flexneri 2a str. 2457T
cgcaacggcugcugc

SEQ ID NO: 1888227 - RNA, 19 nt, Shigella flexneri 2a str. 2457T
cgcaaagagagaagccaga

SEQ ID NO: 1888228 - RNA, 13 nt, Shigella flexneri 2a str. 2457T
cgcaaauucggcg

SEQ ID NO: 1888229 - RNA, 22 nt, Shigella flexneri 2a str. 2457T
cgauuugugcacgugccagaug

SEQ ID NO: 1888230 - RNA, 21 nt, Shigella flexneri 2a str. 2457T
cgagguuaaacgcuauuugcc

SEQ ID NO: 1888231 - RNA, 18 nt, Shigella flexneri 2a str. 2457T
cgagguuauccgccagcg

SEQ ID NO: 1888232 - RNA, 14 nt, Shigella flexneri 2a str. 2457T
cgagucaacgcuuc

SEQ ID NO: 1888233 - RNA, 13 nt, Shigella flexneri 2a str. 2457T
cgaguagaucaac

SEQ ID NO: 1888234 - RNA, 19 nt, Shigella flexneri 2a str. 2457T
cgaguccuguugucuuucc

SEQ ID NO: 1888235 - RNA, 11 nt, Shigella flexneri 2a str. 2457T
cgauccacgcc

SEQ ID NO: 1888236 - RNA, 22 nt, Shigella flexneri 2a str. 2457T
cgaucauguaccguugcugcca

SEQ ID NO: 1888237 - RNA, 18 nt, Shigella flexneri 2a str. 2457T
cgaucacuuucugcgcca

SEQ ID NO: 1888238 - RNA, 21 nt, Shigella flexneri 2a str. 2457T
cgaucacuuucugcgccagcg

SEQ ID NO: 1888239 - RNA, 12 nt, Shigella flexneri 2a str. 2457T
cgaucagcggac

SEQ ID NO: 1888240 - RNA, 13 nt, Shigella flexneri 2a str. 2457T
cgaucagcggacg

SEQ ID NO: 1888241 - RNA, 22 nt, Shigella flexneri 2a str. 2457T
cgauacgcugcacaauugccag

SEQ ID NO: 1888242 - RNA, 20 nt, Shigella flexneri 2a str. 2457T
cgauagagcaaccaccugca

SEQ ID NO: 1888243 - RNA, 16 nt, Shigella flexneri 2a str. 2457T
cgauaucuggaucaac

SEQ ID NO: 1888244 - RNA, 12 nt, Shigella flexneri 2a str. 2457T
cgauaccguuca

SEQ ID NO: 1888245 - RNA, 20 nt, Shigella flexneri 2a str. 2457T
cgauacgcaguacggcagca

SEQ ID NO: 1888246 - RNA, 12 nt, Shigella flexneri 2a str. 2457T
cgauacccauuu

SEQ ID NO: 1888247 - RNA, 13 nt, Shigella flexneri 2a str. 2457T
cgaguugaucacg

SEQ ID NO: 1888248 - RNA, 12 nt, Shigella flexneri 2a str. 2457T
cgccaccggcuu

SEQ ID NO: 1888249 - RNA, 15 nt, Shigella flexneri 2a str. 2457T
cgccaccgcaagcca

SEQ ID NO: 1888250 - RNA, 13 nt, Shigella flexneri 2a str. 2457T
cgccaccggcaau

SEQ ID NO: 1888251 - RNA, 18 nt, Shigella flexneri 2a str. 2457T
cgccacuucccagccuuc

SEQ ID NO: 1888252 - RNA, 17 nt, Shigella flexneri 2a str. 2457T
cgccagaaaaccuggcg

SEQ ID NO: 1888253 - RNA, 16 nt, Shigella flexneri 2a str. 2457T
cgccacuuuucggcaa

SEQ ID NO: 1888254 - RNA, 22 nt, Shigella flexneri 2a str. 2457T
cgccacuuuaaauucagcauua

SEQ ID NO: 1888255 - RNA, 17 nt, Shigella flexneri 2a str. 2457T
cgccagauagccgaccg

SEQ ID NO: 1888256 - RNA, 17 nt, Shigella flexneri 2a str. 2457T
cgccagcggcagcucgc

SEQ ID NO: 1888257 - RNA, 16 nt, Shigella flexneri 2a str. 2457T
cgccagcugcauuuca

SEQ ID NO: 1888258 - RNA, 21 nt, Shigella flexneri 2a str. 2457T
cgcaguaccagcaacgcuuca

SEQ ID NO: 1888259 - RNA, 18 nt, Shigella flexneri 2a str. 2457T
cgcaguaagcgacgggcg

SEQ ID NO: 1888260 - RNA, 11 nt, Shigella flexneri 2a str. 2457T
cgcauccggca

SEQ ID NO: 1888261 - RNA, 16 nt, Shigella flexneri 2a str. 2457T
cgcauccucuuuacgc

SEQ ID NO: 1888262 - RNA, 16 nt, Shigella flexneri 2a str. 2457T
cgcaguaaauccgcca

SEQ ID NO: 1888263 - RNA, 13 nt, Shigella flexneri 2a str. 2457T
cgcagguuccgca

SEQ ID NO: 1888264 - RNA, 14 nt, Shigella flexneri 2a str. 2457T
cgcauccgggaugg

SEQ ID NO: 1888265 - RNA, 15 nt, Shigella flexneri 2a str. 2457T
cgcaucgcugcgcuu

SEQ ID NO: 1888266 - RNA, 15 nt, Shigella flexneri 2a str. 2457T
cgcaucggcgucgug

SEQ ID NO: 1888267 - RNA, 13 nt, Shigella flexneri 2a str. 2457T
cgcaucggucaga

SEQ ID NO: 1888268 - RNA, 16 nt, Shigella flexneri 2a str. 2457T
cgcaucgggcgcuauc

SEQ ID NO: 1888269 - RNA, 21 nt, Shigella flexneri 2a str. 2457T
cgcaucugccggaaccagcca

SEQ ID NO: 1888270 - RNA, 22 nt, Shigella flexneri 2a str. 2457T
cgcauggcugcgaaucgcuuca

SEQ ID NO: 1888271 - RNA, 22 nt, Shigella flexneri 2a str. 2457T
cgccaccaccagacgcaacaga

SEQ ID NO: 1888272 - RNA, 13 nt, Shigella flexneri 2a str. 2457T
cgccacagcaauu

SEQ ID NO: 1888273 - RNA, 12 nt, Shigella flexneri 2a str. 2457T
cgccaccagcgu

SEQ ID NO: 1888274 - RNA, 15 nt, Shigella flexneri 2a str. 2457T
cgccacccagcgccg

SEQ ID NO: 1888275 - RNA, 19 nt, Shigella flexneri 2a str. 2457T
cgccacccagcgccgccau

SEQ ID NO: 1888276 - RNA, 23 nt, Shigella flexneri 2a str. 2457T
cgccaacuucaugaccuuccagc

SEQ ID NO: 1888277 - RNA, 16 nt, Shigella flexneri 2a str. 2457T
cgccaacuucaugacc

SEQ ID NO: 1888278 - RNA, 13 nt, Shigella flexneri 2a str. 2457T
cgccaagcagcgc

SEQ ID NO: 1888279 - RNA, 21 nt, Shigella flexneri 2a str. 2457T
cgccaaugaccgcgccaucca

SEQ ID NO: 1888280 - RNA, 19 nt, Shigella flexneri 2a str. 2457T
cgccacaauauuccggcau

SEQ ID NO: 1888281 - RNA, 13 nt, Shigella flexneri 2a str. 2457T
cgccacaaucuga

SEQ ID NO: 1888282 - RNA, 14 nt, Shigella flexneri 2a str. 2457T
cgcagcgcgcgaau

SEQ ID NO: 1888283 - RNA, 19 nt, Shigella flexneri 2a str. 2457T
cgcaggucauccggcacgc

SEQ ID NO: 1888284 - RNA, 21 nt, Shigella flexneri 2a str. 2457T
cgcagguagguucugcggcgu

SEQ ID NO: 1888285 - RNA, 20 nt, Shigella flexneri 2a str. 2457T
cgcaggcugagaaaugccag

SEQ ID NO: 1888286 - RNA, 21 nt, Shigella flexneri 2a str. 2457T
cgcagccagcacugccgcauc

SEQ ID NO: 1888287 - RNA, 13 nt, Shigella flexneri 2a str. 2457T
cgcagccaguuaa

SEQ ID NO: 1888288 - RNA, 14 nt, Shigella flexneri 2a str. 2457T
cgcagccagcgcgc

SEQ ID NO: 1888289 - RNA, 18 nt, Shigella flexneri 2a str. 2457T
cgcacuuuuuaaacgaau

SEQ ID NO: 1888290 - RNA, 13 nt, Shigella flexneri 2a str. 2457T
cgcagcagcgcgc

SEQ ID NO: 1888291 - RNA, 17 nt, Shigella flexneri 2a str. 2457T
cgcacgcagaaucucug

SEQ ID NO: 1888292 - RNA, 20 nt, Shigella flexneri 2a str. 2457T
cgcaagccgaauaacggcuc

SEQ ID NO: 1888293 - RNA, 22 nt, Shigella flexneri 2a str. 2457T
cagcgaaccuuccaucgcaucu

SEQ ID NO: 1888294 - RNA, 17 nt, Shigella flexneri 2a str. 2457T
cagcgaagcccacgccg

SEQ ID NO: 1888295 - RNA, 14 nt, Shigella flexneri 2a str. 2457T
cagccucugccgcg

SEQ ID NO: 1888296 - RNA, 21 nt, Shigella flexneri 2a str. 2457T
cagccccagaauucacgcacu

SEQ ID NO: 1888297 - RNA, 22 nt, Shigella flexneri 2a str. 2457T
cagcccauuggcgagauaucga

SEQ ID NO: 1888298 - RNA, 15 nt, Shigella flexneri 2a str. 2457T
cagccagcagcgaau

SEQ ID NO: 1888299 - RNA, 20 nt, Shigella flexneri 2a str. 2457T
cagccagccgaacagcgcca

SEQ ID NO: 1888300 - RNA, 17 nt, Shigella flexneri 2a str. 2457T
cagccauuaaccagcca

SEQ ID NO: 1888301 - RNA, 13 nt, Shigella flexneri 2a str. 2457T
cagcccaauaccu

SEQ ID NO: 1888302 - RNA, 13 nt, Shigella flexneri 2a str. 2457T
cagccauuuugca

SEQ ID NO: 1888303 - RNA, 22 nt, Shigella flexneri 2a str. 2457T
cagccauuuugcacauuccaga

SEQ ID NO: 1888304 - RNA, 20 nt, Shigella flexneri 2a str. 2457T
cagccauugcuaccgcuucg

SEQ ID NO: 1888305 - RNA, 18 nt, Shigella flexneri 2a str. 2457T
cagcccagcggaaauuac

SEQ ID NO: 1888306 - RNA, 15 nt, Shigella flexneri 2a str. 2457T
cagcaucaugccgcu

SEQ ID NO: 1888307 - RNA, 14 nt, Shigella flexneri 2a str. 2457T
cagccagcagcgaa

SEQ ID NO: 1888308 - RNA, 17 nt, Shigella flexneri 2a str. 2457T
cagccagcaccaggcuu

SEQ ID NO: 1888309 - RNA, 15 nt, Shigella flexneri 2a str. 2457T
cagccaaauccagcg

SEQ ID NO: 1888310 - RNA, 19 nt, Shigella flexneri 2a str. 2457T
cagccaacuggagaacgcg

SEQ ID NO: 1888311 - RNA, 20 nt, Shigella flexneri 2a str. 2457T
cagcacggagagacguugcg

SEQ ID NO: 1888312 - RNA, 17 nt, Shigella flexneri 2a str. 2457T
cagcagaacgaccagcg

SEQ ID NO: 1888313 - RNA, 16 nt, Shigella flexneri 2a str. 2457T
cagcagacugauaucc

SEQ ID NO: 1888314 - RNA, 20 nt, Shigella flexneri 2a str. 2457T
cagcagagaaaauaucccgu

SEQ ID NO: 1888315 - RNA, 22 nt, Shigella flexneri 2a str. 2457T
cagcagauggcagugcgccaua

SEQ ID NO: 1888316 - RNA, 21 nt, Shigella flexneri 2a str. 2457T
cagcagauaucccgccagcac

SEQ ID NO: 1888317 - RNA, 22 nt, Shigella flexneri 2a str. 2457T
cagcagauauugccccacaccg

SEQ ID NO: 1888318 - RNA, 18 nt, Shigella flexneri 2a str. 2457T
cagcagcugcguggcgcu

SEQ ID NO: 1888319 - RNA, 22 nt, Shigella flexneri 2a str. 2457T
cagcaccuuaccucaggcaccu

SEQ ID NO: 1888320 - RNA, 15 nt, Shigella flexneri 2a str. 2457T
cagcacgaccgccau

SEQ ID NO: 1888321 - RNA, 14 nt, Shigella flexneri 2a str. 2457T
cagcaccgcagaga

SEQ ID NO: 1888322 - RNA, 16 nt, Shigella flexneri 2a str. 2457T
cagcaaucgcgccagc

SEQ ID NO: 1888323 - RNA, 21 nt, Shigella flexneri 2a str. 2457T
cagcaaucugauugacaucau

SEQ ID NO: 1888324 - RNA, 13 nt, Shigella flexneri 2a str. 2457T
cagcacaucauca

SEQ ID NO: 1888325 - RNA, 15 nt, Shigella flexneri 2a str. 2457T
cagcacaucagccag

SEQ ID NO: 1888326 - RNA, 14 nt, Shigella flexneri 2a str. 2457T
cagcaaccgcuucc

SEQ ID NO: 1888327 - RNA, 18 nt, Shigella flexneri 2a str. 2457T
cagauugagcauuggcau

SEQ ID NO: 1888328 - RNA, 16 nt, Shigella flexneri 2a str. 2457T
cagcaaccgcuuccgg

SEQ ID NO: 1888329 - RNA, 16 nt, Shigella flexneri 2a str. 2457T
cagaaugaugccgcca

SEQ ID NO: 1888330 - RNA, 15 nt, Shigella flexneri 2a str. 2457T
cagaaugcgggcgaa

SEQ ID NO: 1888331 - RNA, 15 nt, Shigella flexneri 2a str. 2457T
cagaaucgccagcau

SEQ ID NO: 1888332 - RNA, 20 nt, Shigella flexneri 2a str. 2457T
cagaaucgcaaccagcguca

SEQ ID NO: 1888333 - RNA, 15 nt, Shigella flexneri 2a str. 2457T
cagaaucgcgcccca

SEQ ID NO: 1888334 - RNA, 20 nt, Shigella flexneri 2a str. 2457T
cagaaucgccagcaucggca

SEQ ID NO: 1888335 - RNA, 17 nt, Shigella flexneri 2a str. 2457T
cagaaucaaucccauca

SEQ ID NO: 1888336 - RNA, 14 nt, Shigella flexneri 2a str. 2457T
cagaagugaccguc

SEQ ID NO: 1888337 - RNA, 20 nt, Shigella flexneri 2a str. 2457T
cagaauagccgcagccauca

SEQ ID NO: 1888338 - RNA, 19 nt, Shigella flexneri 2a str. 2457T
cagaauaaacaacuguggu

SEQ ID NO: 1888339 - RNA, 17 nt, Shigella flexneri 2a str. 2457T
cagauacgaccguucca

SEQ ID NO: 1888340 - RNA, 21 nt, Shigella flexneri 2a str. 2457T
cagauacgaccguuccauuca

SEQ ID NO: 1888341 - RNA, 17 nt, Shigella flexneri 2a str. 2457T
cagauaauggaaucgcu

SEQ ID NO: 1888342 - RNA, 16 nt, Shigella flexneri 2a str. 2457T
cagauacaaccaaucg

SEQ ID NO: 1888343 - RNA, 17 nt, Shigella flexneri 2a str. 2457T
cagauaccacaucaacc

SEQ ID NO: 1888344 - RNA, 19 nt, Shigella flexneri 2a str. 2457T
cagauaccaaaaucggcaa

SEQ ID NO: 1888345 - RNA, 20 nt, Shigella flexneri 2a str. 2457T
cagaugugccaguugcauaa

SEQ ID NO: 1888346 - RNA, 23 nt, Shigella flexneri 2a str. 2457T
cagauaguucgcgaucgcgccag

SEQ ID NO: 1888347 - RNA, 16 nt, Shigella flexneri 2a str. 2457T
cagaucagaccaaucc

SEQ ID NO: 1888348 - RNA, 21 nt, Shigella flexneri 2a str. 2457T
cagaucacgcagcaagccguc

SEQ ID NO: 1888349 - RNA, 16 nt, Shigella flexneri 2a str. 2457T
cagaucauccugcggc

SEQ ID NO: 1888350 - RNA, 13 nt, Shigella flexneri 2a str. 2457T
cagaugcgcuuca

SEQ ID NO: 1888351 - RNA, 14 nt, Shigella flexneri 2a str. 2457T
cacgaugccugaug

SEQ ID NO: 1888352 - RNA, 14 nt, Shigella flexneri 2a str. 2457T
cacgacgaccaccg

SEQ ID NO: 1888353 - RNA, 17 nt, Shigella flexneri 2a str. 2457T
cacgauauccagcguca

SEQ ID NO: 1888354 - RNA, 20 nt, Shigella flexneri 2a str. 2457T
cacgcagaagcgcagaucga

SEQ ID NO: 1888355 - RNA, 13 nt, Shigella flexneri 2a str. 2457T
cacgcaucgcgaa

SEQ ID NO: 1888356 - RNA, 18 nt, Shigella flexneri 2a str. 2457T
cacgccagcagcgcaauc

SEQ ID NO: 1888357 - RNA, 20 nt, Shigella flexneri 2a str. 2457T
cacgccuuuuuucacuaugu

SEQ ID NO: 1888358 - RNA, 15 nt, Shigella flexneri 2a str. 2457T
cacgccuggcaguca

SEQ ID NO: 1888359 - RNA, 14 nt, Shigella flexneri 2a str. 2457T
cacgccgccagacc

SEQ ID NO: 1888360 - RNA, 14 nt, Shigella flexneri 2a str. 2457T
cacgccgcauuacc

SEQ ID NO: 1888361 - RNA, 17 nt, Shigella flexneri 2a str. 2457T
cacgccgcauccggcau

SEQ ID NO: 1888362 - RNA, 16 nt, Shigella flexneri 2a str. 2457T
cacgccgcaucuggca

SEQ ID NO: 1888363 - RNA, 12 nt, Shigella flexneri 2a str. 2457T
cacgccgcaucc

SEQ ID NO: 1888364 - RNA, 14 nt, Shigella flexneri 2a str. 2457T
cacgccgcauccgg

SEQ ID NO: 1888365 - RNA, 20 nt, Shigella flexneri 2a str. 2457T
caccugcgcaggcauucaga

SEQ ID NO: 1888366 - RNA, 14 nt, Shigella flexneri 2a str. 2457T
caccuucuggcgac

SEQ ID NO: 1888367 - RNA, 15 nt, Shigella flexneri 2a str. 2457T
caccuucauccagca

SEQ ID NO: 1888368 - RNA, 14 nt, Shigella flexneri 2a str. 2457T
cacgaagcaauggc

SEQ ID NO: 1888369 - RNA, 22 nt, Shigella flexneri 2a str. 2457T
cacgaacacagugguuuuaacg

SEQ ID NO: 1888370 - RNA, 18 nt, Shigella flexneri 2a str. 2457T
cacuccuaucaccagcgg

SEQ ID NO: 1888371 - RNA, 14 nt, Shigella flexneri 2a str. 2457T
cacugaaagccgca

SEQ ID NO: 1888372 - RNA, 20 nt, Shigella flexneri 2a str. 2457T
cacugaaugccggaugcggc

SEQ ID NO: 1888373 - RNA, 16 nt, Shigella flexneri 2a str. 2457T
cacuccggccagagca

SEQ ID NO: 1888374 - RNA, 19 nt, Shigella flexneri 2a str. 2457T
cacugcucuuuuugcauaa

SEQ ID NO: 1888375 - RNA, 22 nt, Shigella flexneri 2a str. 2457T
cacugcuguuccgcaaagcgcc

SEQ ID NO: 1888376 - RNA, 17 nt, Shigella flexneri 2a str. 2457T
cacugccguacaggcag

SEQ ID NO: 1888377 - RNA, 18 nt, Shigella flexneri 2a str. 2457T
cacugcgcccgccagcau

SEQ ID NO: 1888378 - RNA, 14 nt, Shigella flexneri 2a str. 2457T
cacugacaccagca

SEQ ID NO: 1888379 - RNA, 16 nt, Shigella flexneri 2a str. 2457T
cagaaccgccaucaug

SEQ ID NO: 1888380 - RNA, 14 nt, Shigella flexneri 2a str. 2457T
cagaaccgccauca

SEQ ID NO: 1888381 - RNA, 16 nt, Shigella flexneri 2a str. 2457T
cagaaauuuccugagc

SEQ ID NO: 1888382 - RNA, 19 nt, Shigella flexneri 2a str. 2457T
cacuuucaucgcggucagc

SEQ ID NO: 1888383 - RNA, 14 nt, Shigella flexneri 2a str. 2457T
cacuuucuggcagc

SEQ ID NO: 1888384 - RNA, 15 nt, Shigella flexneri 2a str. 2457T
cacuuugaccgccag

SEQ ID NO: 1888385 - RNA, 20 nt, Shigella flexneri 2a str. 2457T
cacuuuucggcaaccgcauc

SEQ ID NO: 1888386 - RNA, 15 nt, Shigella flexneri 2a str. 2457T
cacuuuugccagacg

SEQ ID NO: 1888387 - RNA, 12 nt, Shigella flexneri 2a str. 2457T
cagaaaugccag

SEQ ID NO: 1888388 - RNA, 17 nt, Shigella flexneri 2a str. 2457T
cacuuucaaauccggcc

SEQ ID NO: 1888389 - RNA, 16 nt, Shigella flexneri 2a str. 2457T
cacuuucacggucagc

SEQ ID NO: 1888390 - RNA, 19 nt, Shigella flexneri 2a str. 2457T
cacuggcagccaggcgcga

SEQ ID NO: 1888391 - RNA, 14 nt, Shigella flexneri 2a str. 2457T
cacuggcggcagca

SEQ ID NO: 1888392 - RNA, 16 nt, Shigella flexneri 2a str. 2457T
cacuggcggcagcagg

SEQ ID NO: 1888393 - RNA, 17 nt, Shigella flexneri 2a str. 2457T
cacuucacugacauugc

SEQ ID NO: 1888394 - RNA, 22 nt, Shigella flexneri 2a str. 2457T
cacuucaauauuaaugcugacc

SEQ ID NO: 1888395 - RNA, 21 nt, Shigella flexneri 2a str. 2457T
cacuuaaucgcccucgccuuu

SEQ ID NO: 1888396 - RNA, 23 nt, Shigella flexneri 2a str. 2457T
cacgcgaguggucuccuggaacg

SEQ ID NO: 1888397 - RNA, 17 nt, Shigella flexneri 2a str. 2457T
cacggagauauccagcg

SEQ ID NO: 1888398 - RNA, 22 nt, Shigella flexneri 2a str. 2457T
cacgguuacggccuucggucag

SEQ ID NO: 1888399 - RNA, 15 nt, Shigella flexneri 2a str. 2457T
cacgguuacgcuacc

SEQ ID NO: 1888400 - RNA, 13 nt, Shigella flexneri 2a str. 2457T
cacggugucggua

SEQ ID NO: 1888401 - RNA, 20 nt, Shigella flexneri 2a str. 2457T
cacguccgguggcauccgca

SEQ ID NO: 1888402 - RNA, 17 nt, Shigella flexneri 2a str. 2457T
cacgguaguuagccgga

SEQ ID NO: 1888403 - RNA, 14 nt, Shigella flexneri 2a str. 2457T
caguuccugcaacu

SEQ ID NO: 1888404 - RNA, 22 nt, Shigella flexneri 2a str. 2457T
caguucaaaguuaccggaagcg

SEQ ID NO: 1888405 - RNA, 20 nt, Shigella flexneri 2a str. 2457T
cagugguuucgccagcaccg

SEQ ID NO: 1888406 - RNA, 21 nt, Shigella flexneri 2a str. 2457T
cagucgcgcaauugccagaca

SEQ ID NO: 1888407 - RNA, 17 nt, Shigella flexneri 2a str. 2457T
caguggcugauuggcau

SEQ ID NO: 1888408 - RNA, 15 nt, Shigella flexneri 2a str. 2457T
cauauaauacgcauc

SEQ ID NO: 1888409 - RNA, 12 nt, Shigella flexneri 2a str. 2457T
cauacugacgga

SEQ ID NO: 1888410 - RNA, 17 nt, Shigella flexneri 2a str. 2457T
cauacucuuucccggca

SEQ ID NO: 1888411 - RNA, 19 nt, Shigella flexneri 2a str. 2457T
cauacugcccgagcgccau

SEQ ID NO: 1888412 - RNA, 14 nt, Shigella flexneri 2a str. 2457T
cauacugcuccaua

SEQ ID NO: 1888413 - RNA, 17 nt, Shigella flexneri 2a str. 2457T
cauacugcaucagcgcc

SEQ ID NO: 1888414 - RNA, 18 nt, Shigella flexneri 2a str. 2457T
caguuguugauaagcccc

SEQ ID NO: 1888415 - RNA, 19 nt, Shigella flexneri 2a str. 2457T
caguuucagccccaucaac

SEQ ID NO: 1888416 - RNA, 12 nt, Shigella flexneri 2a str. 2457T
caguuucaccug

SEQ ID NO: 1888417 - RNA, 16 nt, Shigella flexneri 2a str. 2457T
caguuucaccagcagu

SEQ ID NO: 1888418 - RNA, 12 nt, Shigella flexneri 2a str. 2457T
caguugucggua

SEQ ID NO: 1888419 - RNA, 16 nt, Shigella flexneri 2a str. 2457T
caguugucgguaauug

SEQ ID NO: 1888420 - RNA, 14 nt, Shigella flexneri 2a str. 2457T
caguuuguucagcu

SEQ ID NO: 1888421 - RNA, 17 nt, Shigella flexneri 2a str. 2457T
cauaaccggaucgccaa

SEQ ID NO: 1888422 - RNA, 13 nt, Shigella flexneri 2a str. 2457T
cauaccaccgacg

SEQ ID NO: 1888423 - RNA, 18 nt, Shigella flexneri 2a str. 2457T
cauacaguggaucgacgc

SEQ ID NO: 1888424 - RNA, 22 nt, Shigella flexneri 2a str. 2457T
caucccgguaucaaagcgccag

SEQ ID NO: 1888425 - RNA, 14 nt, Shigella flexneri 2a str. 2457T
caucccuaccgccc

SEQ ID NO: 1888426 - RNA, 22 nt, Shigella flexneri 2a str. 2457T
caucauuucaaucacaucauca

SEQ ID NO: 1888427 - RNA, 23 nt, Shigella flexneri 2a str. 2457T
caucaugucggcagugauuuucc

SEQ ID NO: 1888428 - RNA, 13 nt, Shigella flexneri 2a str. 2457T
caucauugcaguc

SEQ ID NO: 1888429 - RNA, 24 nt, Shigella flexneri 2a str. 2457T
caucauucgccgcuuaccauaacg

SEQ ID NO: 1888430 - RNA, 20 nt, Shigella flexneri 2a str. 2457T
caucaugucgcccacgccag

SEQ ID NO: 1888431 - RNA, 23 nt, Shigella flexneri 2a str. 2457T
caucaggcguucgcggcggcacu

SEQ ID NO: 1888432 - RNA, 16 nt, Shigella flexneri 2a str. 2457T
caucaggggcagcacc

SEQ ID NO: 1888433 - RNA, 14 nt, Shigella flexneri 2a str. 2457T
caucacuuccagua

SEQ ID NO: 1888434 - RNA, 15 nt, Shigella flexneri 2a str. 2457T
caucagaaaugccag

SEQ ID NO: 1888435 - RNA, 18 nt, Shigella flexneri 2a str. 2457T
caucagacuuugcgccau

SEQ ID NO: 1888436 - RNA, 20 nt, Shigella flexneri 2a str. 2457T
caucaucgguaccgccagca

SEQ ID NO: 1888437 - RNA, 14 nt, Shigella flexneri 2a str. 2457T
caucaucgcuuuca

SEQ ID NO: 1888438 - RNA, 14 nt, Shigella flexneri 2a str. 2457T
caucaucaauauga

SEQ ID NO: 1888439 - RNA, 16 nt, Shigella flexneri 2a str. 2457T
caucaguuccaguuca

SEQ ID NO: 1888440 - RNA, 18 nt, Shigella flexneri 2a str. 2457T
caucaggcuaaucgccag

SEQ ID NO: 1888441 - RNA, 17 nt, Shigella flexneri 2a str. 2457T
caucaacgccaucgcca

SEQ ID NO: 1888442 - RNA, 13 nt, Shigella flexneri 2a str. 2457T
caucaacgccagc

SEQ ID NO: 1888443 - RNA, 17 nt, Shigella flexneri 2a str. 2457T
caucacaucccagcaga

SEQ ID NO: 1888444 - RNA, 14 nt, Shigella flexneri 2a str. 2457T
caucaccggagaau

SEQ ID NO: 1888445 - RNA, 17 nt, Shigella flexneri 2a str. 2457T
caucaccgcgaggccua

SEQ ID NO: 1888446 - RNA, 14 nt, Shigella flexneri 2a str. 2457T
caucaccauccacg

SEQ ID NO: 1888447 - RNA, 23 nt, Shigella flexneri 2a str. 2457T
cauauguguuugugccgcgacag

SEQ ID NO: 1888448 - RNA, 20 nt, Shigella flexneri 2a str. 2457T
cauauuauucauaaugccca

SEQ ID NO: 1888449 - RNA, 15 nt, Shigella flexneri 2a str. 2457T
cauaugcgcuggcag

SEQ ID NO: 1888450 - RNA, 17 nt, Shigella flexneri 2a str. 2457T
cauauguguuugugccg

SEQ ID NO: 1888451 - RNA, 21 nt, Shigella flexneri 2a str. 2457T
cauaugcgccagacugaucau

SEQ ID NO: 1888452 - RNA, 17 nt, Shigella flexneri 2a str. 2457T
cauauggaagaaacgcu

SEQ ID NO: 1888453 - RNA, 14 nt, Shigella flexneri 2a str. 2457T
cauauccgaugagu

SEQ ID NO: 1888454 - RNA, 18 nt, Shigella flexneri 2a str. 2457T
cauaucauuuugcugcca

SEQ ID NO: 1888455 - RNA, 19 nt, Shigella flexneri 2a str. 2457T
cauaucaauaguaaccaga

SEQ ID NO: 1888456 - RNA, 11 nt, Shigella flexneri 2a str. 2457T
cauaucagcgc

SEQ ID NO: 1888457 - RNA, 16 nt, Shigella flexneri 2a str. 2457T
cauauaggaggccucg

SEQ ID NO: 1888458 - RNA, 16 nt, Shigella flexneri 2a str. 2457T
cauaucgaaccagcgg

SEQ ID NO: 1888459 - RNA, 12 nt, Shigella flexneri 2a str. 2457T
cagggccaggaa

SEQ ID NO: 1888460 - RNA, 13 nt, Shigella flexneri 2a str. 2457T
cagguaaacaccu

SEQ ID NO: 1888461 - RNA, 23 nt, Shigella flexneri 2a str. 2457T
cagguaaucugucuuuuacauca

SEQ ID NO: 1888462 - RNA, 16 nt, Shigella flexneri 2a str. 2457T
cagggucuuccagcaa

SEQ ID NO: 1888463 - RNA, 21 nt, Shigella flexneri 2a str. 2457T
cagguauaccgaaaucgccau

SEQ ID NO: 1888464 - RNA, 23 nt, Shigella flexneri 2a str. 2457T
caguagccaugcauaaugcagcc

SEQ ID NO: 1888465 - RNA, 23 nt, Shigella flexneri 2a str. 2457T
cagucccguacccagcaagaccg

SEQ ID NO: 1888466 - RNA, 17 nt, Shigella flexneri 2a str. 2457T
cagguuuaaacagagau

SEQ ID NO: 1888467 - RNA, 14 nt, Shigella flexneri 2a str. 2457T
caguaaugaucggc

SEQ ID NO: 1888468 - RNA, 23 nt, Shigella flexneri 2a str. 2457T
caguacaggccgcaccaggaucu

SEQ ID NO: 1888469 - RNA, 14 nt, Shigella flexneri 2a str. 2457T
caguacauagccau

SEQ ID NO: 1888470 - RNA, 19 nt, Shigella flexneri 2a str. 2457T
caguacauuguuuuccaga

SEQ ID NO: 1888471 - RNA, 21 nt, Shigella flexneri 2a str. 2457T
caguaccgccagugcagcgaa

SEQ ID NO: 1888472 - RNA, 14 nt, Shigella flexneri 2a str. 2457T
caggccaucacauc

SEQ ID NO: 1888473 - RNA, 15 nt, Shigella flexneri 2a str. 2457T
caggccaucacaucc

SEQ ID NO: 1888474 - RNA, 17 nt, Shigella flexneri 2a str. 2457T
caggccaggauuacgcu

SEQ ID NO: 1888475 - RNA, 14 nt, Shigella flexneri 2a str. 2457T
caggcauauucgcg

SEQ ID NO: 1888476 - RNA, 16 nt, Shigella flexneri 2a str. 2457T
caggcauauucgcgcu

SEQ ID NO: 1888477 - RNA, 15 nt, Shigella flexneri 2a str. 2457T
caggcaucagcaaca

SEQ ID NO: 1888478 - RNA, 22 nt, Shigella flexneri 2a str. 2457T
caggccuacaugauuucugcaa

SEQ ID NO: 1888479 - RNA, 21 nt, Shigella flexneri 2a str. 2457T
caggccuacccggugaaucgc

SEQ ID NO: 1888480 - RNA, 14 nt, Shigella flexneri 2a str. 2457T
caggccuaccggug

SEQ ID NO: 1888481 - RNA, 23 nt, Shigella flexneri 2a str. 2457T
caggccuaccgguguuucgacga

SEQ ID NO: 1888482 - RNA, 22 nt, Shigella flexneri 2a str. 2457T
caggccuacaggauaucuggca

SEQ ID NO: 1888483 - RNA, 22 nt, Shigella flexneri 2a str. 2457T
caggccuacaauguuucugcaa

SEQ ID NO: 1888484 - RNA, 18 nt, Shigella flexneri 2a str. 2457T
caggcgaaacccgcugcc

SEQ ID NO: 1888485 - RNA, 21 nt, Shigella flexneri 2a str. 2457T
caggcagauacaaccaaucgc

SEQ ID NO: 1888486 - RNA, 19 nt, Shigella flexneri 2a str. 2457T
caggcagauuuuuuaacug

SEQ ID NO: 1888487 - RNA, 14 nt, Shigella flexneri 2a str. 2457T
caggcagcaaucac

SEQ ID NO: 1888488 - RNA, 16 nt, Shigella flexneri 2a str. 2457T
caggagcaacuggagu

SEQ ID NO: 1888489 - RNA, 21 nt, Shigella flexneri 2a str. 2457T
caggacgcccgguaucaacga

SEQ ID NO: 1888490 - RNA, 20 nt, Shigella flexneri 2a str. 2457T
caggacgcaguccagacucc

SEQ ID NO: 1888491 - RNA, 12 nt, Shigella flexneri 2a str. 2457T
cagcuucaacga

SEQ ID NO: 1888492 - RNA, 18 nt, Shigella flexneri 2a str. 2457T
cagcuucacaaaggcuug

SEQ ID NO: 1888493 - RNA, 13 nt, Shigella flexneri 2a str. 2457T
cagcuuauucacc

SEQ ID NO: 1888494 - RNA, 16 nt, Shigella flexneri 2a str. 2457T
cagcuuagaaauucac

SEQ ID NO: 1888495 - RNA, 16 nt, Shigella flexneri 2a str. 2457T
cagcuuagaaaucgac

SEQ ID NO: 1888496 - RNA, 18 nt, Shigella flexneri 2a str. 2457T
caggaacgggauugccag

SEQ ID NO: 1888497 - RNA, 21 nt, Shigella flexneri 2a str. 2457T
cagcuuuaaauuacugagcaa

SEQ ID NO: 1888498 - RNA, 21 nt, Shigella flexneri 2a str. 2457T
cagcugguguaacugcgccag

SEQ ID NO: 1888499 - RNA, 22 nt, Shigella flexneri 2a str. 2457T
cagcugguguaacugcgccaga

SEQ ID NO: 1888500 - RNA, 14 nt, Shigella flexneri 2a str. 2457T
cagcugggcgauuu

SEQ ID NO: 1888501 - RNA, 17 nt, Shigella flexneri 2a str. 2457T
cagcugccgacgccagu

SEQ ID NO: 1888502 - RNA, 22 nt, Shigella flexneri 2a str. 2457T
cagcugcgcgcgaacugucggu

SEQ ID NO: 1888503 - RNA, 22 nt, Shigella flexneri 2a str. 2457T
cagcgcggaaaggaucacaaua

SEQ ID NO: 1888504 - RNA, 17 nt, Shigella flexneri 2a str. 2457T
cagcgcggcgaacuuaa

SEQ ID NO: 1888505 - RNA, 15 nt, Shigella flexneri 2a str. 2457T
cagcgcuaauacgau

SEQ ID NO: 1888506 - RNA, 17 nt, Shigella flexneri 2a str. 2457T
cagcgcuaaccgccuga

SEQ ID NO: 1888507 - RNA, 13 nt, Shigella flexneri 2a str. 2457T
cagcgcuucgcuc

SEQ ID NO: 1888508 - RNA, 23 nt, Shigella flexneri 2a str. 2457T
cagcggcagaucaaauucaauga

SEQ ID NO: 1888509 - RNA, 22 nt, Shigella flexneri 2a str. 2457T
cagcggauacaggaagcgaauc

SEQ ID NO: 1888510 - RNA, 20 nt, Shigella flexneri 2a str. 2457T
cagcggaauuuuugcacggg

SEQ ID NO: 1888511 - RNA, 15 nt, Shigella flexneri 2a str. 2457T
cagcggcuucgacga

SEQ ID NO: 1888512 - RNA, 21 nt, Shigella flexneri 2a str. 2457T
cagcguguugcggagcuuguu

SEQ ID NO: 1888513 - RNA, 15 nt, Shigella flexneri 2a str. 2457T
cagcucaucaagcug

SEQ ID NO: 1888514 - RNA, 14 nt, Shigella flexneri 2a str. 2457T
cagcucauccagcg

SEQ ID NO: 1888515 - RNA, 15 nt, Shigella flexneri 2a str. 2457T
cagcucacuucgauc

SEQ ID NO: 1888516 - RNA, 14 nt, Shigella flexneri 2a str. 2457T
cagcgucagcacca

SEQ ID NO: 1888517 - RNA, 14 nt, Shigella flexneri 2a str. 2457T
cagcgucauuguca

SEQ ID NO: 1888518 - RNA, 13 nt, Shigella flexneri 2a str. 2457T
cagcgucagcgaa

SEQ ID NO: 1888519 - RNA, 20 nt, Shigella flexneri 2a str. 2457T
cagcgucggcgucaucgaca

SEQ ID NO: 1888520 - RNA, 13 nt, Shigella flexneri 2a str. 2457T
ccaacgacggcca

SEQ ID NO: 1888521 - RNA, 22 nt, Shigella flexneri 2a str. 2457T
ccaaaguacggacgcggcauuu

SEQ ID NO: 1888522 - RNA, 19 nt, Shigella flexneri 2a str. 2457T
ccaaaucgccauauccgca

SEQ ID NO: 1888523 - RNA, 18 nt, Shigella flexneri 2a str. 2457T
ccaaauauccgcgcuaag

SEQ ID NO: 1888524 - RNA, 17 nt, Shigella flexneri 2a str. 2457T
cauuugccagcuucagc

SEQ ID NO: 1888525 - RNA, 19 nt, Shigella flexneri 2a str. 2457T
cauuugcuugccggaagca

SEQ ID NO: 1888526 - RNA, 16 nt, Shigella flexneri 2a str. 2457T
cauuuguggguucagc

SEQ ID NO: 1888527 - RNA, 23 nt, Shigella flexneri 2a str. 2457T
cauugugaccuuugacucagcgu

SEQ ID NO: 1888528 - RNA, 23 nt, Shigella flexneri 2a str. 2457T
cauugucgggccgcacgcuguau

SEQ ID NO: 1888529 - RNA, 17 nt, Shigella flexneri 2a str. 2457T
cauuguguuaucccgau

SEQ ID NO: 1888530 - RNA, 18 nt, Shigella flexneri 2a str. 2457T
cauuuucucuuucagcgu

SEQ ID NO: 1888531 - RNA, 16 nt, Shigella flexneri 2a str. 2457T
cauuuuacauccugau

SEQ ID NO: 1888532 - RNA, 14 nt, Shigella flexneri 2a str. 2457T
ccaaacagcgccag

SEQ ID NO: 1888533 - RNA, 15 nt, Shigella flexneri 2a str. 2457T
ccaaacagcgccaga

SEQ ID NO: 1888534 - RNA, 17 nt, Shigella flexneri 2a str. 2457T
ccaaacguggucgccag

SEQ ID NO: 1888535 - RNA, 19 nt, Shigella flexneri 2a str. 2457T
ccaaacguggucgccagca

SEQ ID NO: 1888536 - RNA, 13 nt, Shigella flexneri 2a str. 2457T
cauugcaucaucg

SEQ ID NO: 1888537 - RNA, 22 nt, Shigella flexneri 2a str. 2457T
cauugcauaaacaccugcggcg

SEQ ID NO: 1888538 - RNA, 19 nt, Shigella flexneri 2a str. 2457T
cauucgguugccagcgcca

SEQ ID NO: 1888539 - RNA, 12 nt, Shigella flexneri 2a str. 2457T
ccacauccggca

SEQ ID NO: 1888540 - RNA, 12 nt, Shigella flexneri 2a str. 2457T
ccacaucagcgg

SEQ ID NO: 1888541 - RNA, 21 nt, Shigella flexneri 2a str. 2457T
ccacaugaucauucaccagcc

SEQ ID NO: 1888542 - RNA, 16 nt, Shigella flexneri 2a str. 2457T
ccacauucgaaugccg

SEQ ID NO: 1888543 - RNA, 23 nt, Shigella flexneri 2a str. 2457T
ccacauucugcaucgcgcugaac

SEQ ID NO: 1888544 - RNA, 17 nt, Shigella flexneri 2a str. 2457T
ccacaccguugccgcgu

SEQ ID NO: 1888545 - RNA, 18 nt, Shigella flexneri 2a str. 2457T
ccaccaaaaacgccaugu

SEQ ID NO: 1888546 - RNA, 15 nt, Shigella flexneri 2a str. 2457T
ccaccagcagcugcu

SEQ ID NO: 1888547 - RNA, 18 nt, Shigella flexneri 2a str. 2457T
ccaccagcaccgcgacaa

SEQ ID NO: 1888548 - RNA, 21 nt, Shigella flexneri 2a str. 2457T
ccaccauauucgccaccgcgc

SEQ ID NO: 1888549 - RNA, 22 nt, Shigella flexneri 2a str. 2457T
ccaacuccacuucaccgcgaau

SEQ ID NO: 1888550 - RNA, 12 nt, Shigella flexneri 2a str. 2457T
ccaagccugaua

SEQ ID NO: 1888551 - RNA, 14 nt, Shigella flexneri 2a str. 2457T
ccaauaaaugccac

SEQ ID NO: 1888552 - RNA, 19 nt, Shigella flexneri 2a str. 2457T
ccaauaauccccaauacga

SEQ ID NO: 1888553 - RNA, 18 nt, Shigella flexneri 2a str. 2457T
ccaaguugugauugagau

SEQ ID NO: 1888554 - RNA, 14 nt, Shigella flexneri 2a str. 2457T
ccaacuguugaucc

SEQ ID NO: 1888555 - RNA, 23 nt, Shigella flexneri 2a str. 2457T
cauggugcacauugcggacuucc

SEQ ID NO: 1888556 - RNA, 21 nt, Shigella flexneri 2a str. 2457T
cauggcauuggccguugccau

SEQ ID NO: 1888557 - RNA, 23 nt, Shigella flexneri 2a str. 2457T
caugcuucugcacgcuugccugu

SEQ ID NO: 1888558 - RNA, 13 nt, Shigella flexneri 2a str. 2457T
caugcgauggagu

SEQ ID NO: 1888559 - RNA, 15 nt, Shigella flexneri 2a str. 2457T
caugcgaagaccgca

SEQ ID NO: 1888560 - RNA, 17 nt, Shigella flexneri 2a str. 2457T
caugcgcagcauaaucg

SEQ ID NO: 1888561 - RNA, 13 nt, Shigella flexneri 2a str. 2457T
caugccauccgca

SEQ ID NO: 1888562 - RNA, 16 nt, Shigella flexneri 2a str. 2457T
caugcaguaccagaua

SEQ ID NO: 1888563 - RNA, 18 nt, Shigella flexneri 2a str. 2457T
caugccgaugccgacgau

SEQ ID NO: 1888564 - RNA, 14 nt, Shigella flexneri 2a str. 2457T
caugccggucgcgc

SEQ ID NO: 1888565 - RNA, 12 nt, Shigella flexneri 2a str. 2457T
caugccggugau

SEQ ID NO: 1888566 - RNA, 16 nt, Shigella flexneri 2a str. 2457T
caugccgaugccgacg

SEQ ID NO: 1888567 - RNA, 20 nt, Shigella flexneri 2a str. 2457T
caugccuuguuugaucaucg

SEQ ID NO: 1888568 - RNA, 12 nt, Shigella flexneri 2a str. 2457T
caugaguugcug

SEQ ID NO: 1888569 - RNA, 15 nt, Shigella flexneri 2a str. 2457T
caugagaacaguuca

SEQ ID NO: 1888570 - RNA, 15 nt, Shigella flexneri 2a str. 2457T
caugaccuuucaguu

SEQ ID NO: 1888571 - RNA, 20 nt, Shigella flexneri 2a str. 2457T
caugacgcacuuucgcuuua

SEQ ID NO: 1888572 - RNA, 21 nt, Shigella flexneri 2a str. 2457T
caugauauuggcaucgccaga

SEQ ID NO: 1888573 - RNA, 20 nt, Shigella flexneri 2a str. 2457T
caugauaagacgcgccagcg

SEQ ID NO: 1888574 - RNA, 18 nt, Shigella flexneri 2a str. 2457T
caugaugacaacauagcu

SEQ ID NO: 1888575 - RNA, 22 nt, Shigella flexneri 2a str. 2457T
caugaugacuugccuccagcga

SEQ ID NO: 1888576 - RNA, 14 nt, Shigella flexneri 2a str. 2457T
caugcacugcaacg

SEQ ID NO: 1888577 - RNA, 14 nt, Shigella flexneri 2a str. 2457T
caucuuauccggcc

SEQ ID NO: 1888578 - RNA, 17 nt, Shigella flexneri 2a str. 2457T
caucuguaggccagaua

SEQ ID NO: 1888579 - RNA, 18 nt, Shigella flexneri 2a str. 2457T
caucuuucagaaucaggu

SEQ ID NO: 1888580 - RNA, 14 nt, Shigella flexneri 2a str. 2457T
caucucuuccggca

SEQ ID NO: 1888581 - RNA, 19 nt, Shigella flexneri 2a str. 2457T
caucugcauuccgguguaa

SEQ ID NO: 1888582 - RNA, 21 nt, Shigella flexneri 2a str. 2457T
caucugcguggcgcgcgucac

SEQ ID NO: 1888583 - RNA, 15 nt, Shigella flexneri 2a str. 2457T
caucugccuuauuga

SEQ ID NO: 1888584 - RNA, 22 nt, Shigella flexneri 2a str. 2457T
caucugccggaaccagccagga

SEQ ID NO: 1888585 - RNA, 24 nt, Shigella flexneri 2a str. 2457T
caucucccacgcggcaacggcuuc

SEQ ID NO: 1888586 - RNA, 17 nt, Shigella flexneri 2a str. 2457T
cauccgggguucgaauc

SEQ ID NO: 1888587 - RNA, 13 nt, Shigella flexneri 2a str. 2457T
cauccgcgcaaua

SEQ ID NO: 1888588 - RNA, 22 nt, Shigella flexneri 2a str. 2457T
caucggcuuauucauaucaaac

SEQ ID NO: 1888589 - RNA, 13 nt, Shigella flexneri 2a str. 2457T
caucgugauaaac

SEQ ID NO: 1888590 - RNA, 15 nt, Shigella flexneri 2a str. 2457T
caucguauuucagac

SEQ ID NO: 1888591 - RNA, 12 nt, Shigella flexneri 2a str. 2457T
caucggugcgcu

SEQ ID NO: 1888592 - RNA, 21 nt, Shigella flexneri 2a str. 2457T
caucguccuuuuauuacgugg

SEQ ID NO: 1888593 - RNA, 15 nt, Shigella flexneri 2a str. 2457T
caucguccagcagca

SEQ ID NO: 1888594 - RNA, 14 nt, Shigella flexneri 2a str. 2457T
caucgucacugaua

SEQ ID NO: 1888595 - RNA, 18 nt, Shigella flexneri 2a str. 2457T
ccagcgcaucaggcaauc

SEQ ID NO: 1888596 - RNA, 15 nt, Shigella flexneri 2a str. 2457T
ccagcgcaucaggca

SEQ ID NO: 1888597 - RNA, 15 nt, Shigella flexneri 2a str. 2457T
ccagcguacguaacu

SEQ ID NO: 1888598 - RNA, 19 nt, Shigella flexneri 2a str. 2457T
ccagcgguuuaucaauggc

SEQ ID NO: 1888599 - RNA, 15 nt, Shigella flexneri 2a str. 2457T
ccagcgcgcguugcu

SEQ ID NO: 1888600 - RNA, 18 nt, Shigella flexneri 2a str. 2457T
ccagcacgaccgccauua

SEQ ID NO: 1888601 - RNA, 22 nt, Shigella flexneri 2a str. 2457T
ccagcacuucgccaucugccag

SEQ ID NO: 1888602 - RNA, 18 nt, Shigella flexneri 2a str. 2457T
ccagcagauauugcccca

SEQ ID NO: 1888603 - RNA, 21 nt, Shigella flexneri 2a str. 2457T
ccagcauaguacgggcaauuu

SEQ ID NO: 1888604 - RNA, 15 nt, Shigella flexneri 2a str. 2457T
ccagcauaaucacca

SEQ ID NO: 1888605 - RNA, 18 nt, Shigella flexneri 2a str. 2457T
ccagcauauguuuacgcu

SEQ ID NO: 1888606 - RNA, 18 nt, Shigella flexneri 2a str. 2457T
ccagccacugcgccauca

SEQ ID NO: 1888607 - RNA, 14 nt, Shigella flexneri 2a str. 2457T
ccagccauccguca

SEQ ID NO: 1888608 - RNA, 11 nt, Shigella flexneri 2a str. 2457T
ccagccagcag

SEQ ID NO: 1888609 - RNA, 22 nt, Shigella flexneri 2a str. 2457T
ccagcccgaucggcuggcauuu

SEQ ID NO: 1888610 - RNA, 16 nt, Shigella flexneri 2a str. 2457T
ccagcccgcgcgauga

SEQ ID NO: 1888611 - RNA, 14 nt, Shigella flexneri 2a str. 2457T
ccacccaccagcgc

SEQ ID NO: 1888612 - RNA, 19 nt, Shigella flexneri 2a str. 2457T
ccaccucauuaagaugcau

SEQ ID NO: 1888613 - RNA, 15 nt, Shigella flexneri 2a str. 2457T
ccaccuacaccggca

SEQ ID NO: 1888614 - RNA, 17 nt, Shigella flexneri 2a str. 2457T
ccacgcaaaggcguuau

SEQ ID NO: 1888615 - RNA, 12 nt, Shigella flexneri 2a str. 2457T
ccacgccugccg

SEQ ID NO: 1888616 - RNA, 19 nt, Shigella flexneri 2a str. 2457T
ccacgccugccgccagcau

SEQ ID NO: 1888617 - RNA, 18 nt, Shigella flexneri 2a str. 2457T
ccacgccugcauccgcca

SEQ ID NO: 1888618 - RNA, 23 nt, Shigella flexneri 2a str. 2457T
ccacuccacuggagacgacggaa

SEQ ID NO: 1888619 - RNA, 21 nt, Shigella flexneri 2a str. 2457T
ccacucaacgguucgccauca

SEQ ID NO: 1888620 - RNA, 19 nt, Shigella flexneri 2a str. 2457T
ccacuaucgccaucaggca

SEQ ID NO: 1888621 - RNA, 17 nt, Shigella flexneri 2a str. 2457T
ccagaucgccugccgcc

SEQ ID NO: 1888622 - RNA, 19 nt, Shigella flexneri 2a str. 2457T
ccagaucgcgguaaucacg

SEQ ID NO: 1888623 - RNA, 18 nt, Shigella flexneri 2a str. 2457T
ccagauacaucagcgaca

SEQ ID NO: 1888624 - RNA, 22 nt, Shigella flexneri 2a str. 2457T
ccagauaauauugauauccgca

SEQ ID NO: 1888625 - RNA, 17 nt, Shigella flexneri 2a str. 2457T
ccagacaucccagugca

SEQ ID NO: 1888626 - RNA, 14 nt, Shigella flexneri 2a str. 2457T
ccacugcgccagcg

SEQ ID NO: 1888627 - RNA, 16 nt, Shigella flexneri 2a str. 2457T
ccagacgagagugacg

SEQ ID NO: 1888628 - RNA, 15 nt, Shigella flexneri 2a str. 2457T
ccagaccuuaucaca

SEQ ID NO: 1888629 - RNA, 12 nt, Shigella flexneri 2a str. 2457T
ccagacgccaga

SEQ ID NO: 1888630 - RNA, 17 nt, Shigella flexneri 2a str. 2457T
ccagacgccagccacag

SEQ ID NO: 1888631 - RNA, 22 nt, Shigella flexneri 2a str. 2457T
ccagaccggcaaucgcgccaga

SEQ ID NO: 1888632 - RNA, 21 nt, Shigella flexneri 2a str. 2457T
ccaggcaucagcaacacgcug

SEQ ID NO: 1888633 - RNA, 18 nt, Shigella flexneri 2a str. 2457T
ccaggcaucagcaacacg

SEQ ID NO: 1888634 - RNA, 19 nt, Shigella flexneri 2a str. 2457T
ccaggcaaguagcgccaua

SEQ ID NO: 1888635 - RNA, 13 nt, Shigella flexneri 2a str. 2457T
ccaggcaccguca

SEQ ID NO: 1888636 - RNA, 17 nt, Shigella flexneri 2a str. 2457T
ccaggauuacgcucacc

SEQ ID NO: 1888637 - RNA, 21 nt, Shigella flexneri 2a str. 2457T
ccaggcggcguuaaauacggc

SEQ ID NO: 1888638 - RNA, 17 nt, Shigella flexneri 2a str. 2457T
ccaggcguuaauauugc

SEQ ID NO: 1888639 - RNA, 21 nt, Shigella flexneri 2a str. 2457T
ccagugcucccucggugccgc

SEQ ID NO: 1888640 - RNA, 16 nt, Shigella flexneri 2a str. 2457T
ccaguggcagcaauuu

SEQ ID NO: 1888641 - RNA, 18 nt, Shigella flexneri 2a str. 2457T
ccaguucgauauccaguc

SEQ ID NO: 1888642 - RNA, 21 nt, Shigella flexneri 2a str. 2457T
ccagugcgccccagguaauuu

SEQ ID NO: 1888643 - RNA, 12 nt, Shigella flexneri 2a str. 2457T
ccagugccgccu

SEQ ID NO: 1888644 - RNA, 15 nt, Shigella flexneri 2a str. 2457T
ccaguccauuaccga

SEQ ID NO: 1888645 - RNA, 15 nt, Shigella flexneri 2a str. 2457T
ccagugccaaagcca

SEQ ID NO: 1888646 - RNA, 14 nt, Shigella flexneri 2a str. 2457T
ccaguccaucggca

SEQ ID NO: 1888647 - RNA, 16 nt, Shigella flexneri 2a str. 2457T
ccagucacaucagcga

SEQ ID NO: 1888648 - RNA, 20 nt, Shigella flexneri 2a str. 2457T
ccagucagcgaacaccagca

SEQ ID NO: 1888649 - RNA, 14 nt, Shigella flexneri 2a str. 2457T
ccagucauccggcu

SEQ ID NO: 1888650 - RNA, 22 nt, Shigella flexneri 2a str. 2457T
ccauaagauugcauagcggcga

SEQ ID NO: 1888651 - RNA, 20 nt, Shigella flexneri 2a str. 2457T
ccauaagccugauaagcguu

SEQ ID NO: 1888652 - RNA, 11 nt, Shigella flexneri 2a str. 2457T
ccaguuugcgu

SEQ ID NO: 1888653 - RNA, 12 nt, Shigella flexneri 2a str. 2457T
ccauaaagacgu

SEQ ID NO: 1888654 - RNA, 14 nt, Shigella flexneri 2a str. 2457T
ccauaucaagcaug

SEQ ID NO: 1888655 - RNA, 19 nt, Shigella flexneri 2a str. 2457T
ccauauacgccaucgccag

SEQ ID NO: 1888656 - RNA, 23 nt, Shigella flexneri 2a str. 2457T
ccaucaaucacuuugcgcucgcu

SEQ ID NO: 1888657 - RNA, 21 nt, Shigella flexneri 2a str. 2457T
ccaucaacgccaucgccagga

SEQ ID NO: 1888658 - RNA, 15 nt, Shigella flexneri 2a str. 2457T
ccaucaacuucucgc

SEQ ID NO: 1888659 - RNA, 15 nt, Shigella flexneri 2a str. 2457T
ccauauucagcagca

SEQ ID NO: 1888660 - RNA, 17 nt, Shigella flexneri 2a str. 2457T
ccaucaacaaacgccag

SEQ ID NO: 1888661 - RNA, 13 nt, Shigella flexneri 2a str. 2457T
ccaggcuuuccgu

SEQ ID NO: 1888662 - RNA, 22 nt, Shigella flexneri 2a str. 2457T
ccaguaaucggcugaacgugcu

SEQ ID NO: 1888663 - RNA, 14 nt, Shigella flexneri 2a str. 2457T
ccaguaaucgggca

SEQ ID NO: 1888664 - RNA, 14 nt, Shigella flexneri 2a str. 2457T
ccaguacaugaagc

SEQ ID NO: 1888665 - RNA, 19 nt, Shigella flexneri 2a str. 2457T
ccaguaaaccaauuucugu

SEQ ID NO: 1888666 - RNA, 16 nt, Shigella flexneri 2a str. 2457T
cccaaacagcagaacg

SEQ ID NO: 1888667 - RNA, 16 nt, Shigella flexneri 2a str. 2457T
ccauguugcuggaaga

SEQ ID NO: 1888668 - RNA, 20 nt, Shigella flexneri 2a str. 2457T
ccauugcugccgccaguucu

SEQ ID NO: 1888669 - RNA, 23 nt, Shigella flexneri 2a str. 2457T
ccaugguuucgaacgccaguuca

SEQ ID NO: 1888670 - RNA, 16 nt, Shigella flexneri 2a str. 2457T
ccaugucgcauccgac

SEQ ID NO: 1888671 - RNA, 17 nt, Shigella flexneri 2a str. 2457T
cccaacaacagcgcgcu

SEQ ID NO: 1888672 - RNA, 15 nt, Shigella flexneri 2a str. 2457T
ccaucuccagcugcu

SEQ ID NO: 1888673 - RNA, 20 nt, Shigella flexneri 2a str. 2457T
ccaucuccgcauguuucgac

SEQ ID NO: 1888674 - RNA, 20 nt, Shigella flexneri 2a str. 2457T
ccaucucaaaacguccggca

SEQ ID NO: 1888675 - RNA, 20 nt, Shigella flexneri 2a str. 2457T
ccaucguugaaagauaauca

SEQ ID NO: 1888676 - RNA, 18 nt, Shigella flexneri 2a str. 2457T
ccaugcgaaugccaauuu

SEQ ID NO: 1888677 - RNA, 18 nt, Shigella flexneri 2a str. 2457T
ccaucacuaaggguaaaa

SEQ ID NO: 1888678 - RNA, 18 nt, Shigella flexneri 2a str. 2457T
ccaucagacuuugcgcca

SEQ ID NO: 1888679 - RNA, 17 nt, Shigella flexneri 2a str. 2457T
ccaucacggcagccuga

SEQ ID NO: 1888680 - RNA, 21 nt, Shigella flexneri 2a str. 2457T
ccaucggcaaucauucccaga

SEQ ID NO: 1888681 - RNA, 16 nt, Shigella flexneri 2a str. 2457T
ccaucguccagcagca

SEQ ID NO: 1888682 - RNA, 22 nt, Shigella flexneri 2a str. 2457T
cccauaauuaaacgcgcgcugg

SEQ ID NO: 1888683 - RNA, 12 nt, Shigella flexneri 2a str. 2457T
cccauagacagg

SEQ ID NO: 1888684 - RNA, 19 nt, Shigella flexneri 2a str. 2457T
cccaugagguuugguagca

SEQ ID NO: 1888685 - RNA, 23 nt, Shigella flexneri 2a str. 2457T
cccaucgucacaccuucagcgaa

SEQ ID NO: 1888686 - RNA, 17 nt, Shigella flexneri 2a str. 2457T
cccagaauucacgcacu

SEQ ID NO: 1888687 - RNA, 20 nt, Shigella flexneri 2a str. 2457T
cccagaacgccgaauaacgc

SEQ ID NO: 1888688 - RNA, 16 nt, Shigella flexneri 2a str. 2457T
cccagacacaguucuu

SEQ ID NO: 1888689 - RNA, 21 nt, Shigella flexneri 2a str. 2457T
cccacugacgcucggcgcaau

SEQ ID NO: 1888690 - RNA, 12 nt, Shigella flexneri 2a str. 2457T
cccgaagacgug

SEQ ID NO: 1888691 - RNA, 19 nt, Shigella flexneri 2a str. 2457T
cccgaaggaauuuuacagc

SEQ ID NO: 1888692 - RNA, 15 nt, Shigella flexneri 2a str. 2457T
ccccucuauccagcu

SEQ ID NO: 1888693 - RNA, 22 nt, Shigella flexneri 2a str. 2457T
ccccgucucccgaugccagcac

SEQ ID NO: 1888694 - RNA, 23 nt, Shigella flexneri 2a str. 2457T
ccccugcgccagcgcgcguugcu

SEQ ID NO: 1888695 - RNA, 14 nt, Shigella flexneri 2a str. 2457T
ccccuggcgagcau

SEQ ID NO: 1888696 - RNA, 16 nt, Shigella flexneri 2a str. 2457T
cccauuacaagcccgc

SEQ ID NO: 1888697 - RNA, 13 nt, Shigella flexneri 2a str. 2457T
cccgccagcacga

SEQ ID NO: 1888698 - RNA, 15 nt, Shigella flexneri 2a str. 2457T
cccgauaagggagca

SEQ ID NO: 1888699 - RNA, 16 nt, Shigella flexneri 2a str. 2457T
cccuguccgccauggc

SEQ ID NO: 1888700 - RNA, 13 nt, Shigella flexneri 2a str. 2457T
cccugcccgcgau

SEQ ID NO: 1888701 - RNA, 14 nt, Shigella flexneri 2a str. 2457T
cccugaaggcgacg

SEQ ID NO: 1888702 - RNA, 14 nt, Shigella flexneri 2a str. 2457T
cccugccuccauga

SEQ ID NO: 1888703 - RNA, 15 nt, Shigella flexneri 2a str. 2457T
cccuggaugcaguca

SEQ ID NO: 1888704 - RNA, 18 nt, Shigella flexneri 2a str. 2457T
cccuggcaauagcgcacg

SEQ ID NO: 1888705 - RNA, 19 nt, Shigella flexneri 2a str. 2457T
cccgucucccgaugccagc

SEQ ID NO: 1888706 - RNA, 23 nt, Shigella flexneri 2a str. 2457T
cccguggcgagcgauaacccagc

SEQ ID NO: 1888707 - RNA, 16 nt, Shigella flexneri 2a str. 2457T
cccggcuggauaccaa

SEQ ID NO: 1888708 - RNA, 21 nt, Shigella flexneri 2a str. 2457T
augccgugcagcacggagaga

SEQ ID NO: 1888709 - RNA, 12 nt, Shigella flexneri 2a str. 2457T
augccggaagcu

SEQ ID NO: 1888710 - RNA, 18 nt, Shigella flexneri 2a str. 2457T
augccggaugcggcguga

SEQ ID NO: 1888711 - RNA, 16 nt, Shigella flexneri 2a str. 2457T
augccggcaucaaacg

SEQ ID NO: 1888712 - RNA, 18 nt, Shigella flexneri 2a str. 2457T
augccggguaauuucauu

SEQ ID NO: 1888713 - RNA, 20 nt, Shigella flexneri 2a str. 2457T
augccgcguggccuggaauu

SEQ ID NO: 1888714 - RNA, 20 nt, Shigella flexneri 2a str. 2457T
augccgaucaucauccagca

SEQ ID NO: 1888715 - RNA, 13 nt, Shigella flexneri 2a str. 2457T
augccgacgaugu

SEQ ID NO: 1888716 - RNA, 16 nt, Shigella flexneri 2a str. 2457T
augccuggcaaugcgc

SEQ ID NO: 1888717 - RNA, 21 nt, Shigella flexneri 2a str. 2457T
augccugcacuuugugucagc

SEQ ID NO: 1888718 - RNA, 19 nt, Shigella flexneri 2a str. 2457T
augccuuguuugaucaucg

SEQ ID NO: 1888719 - RNA, 19 nt, Shigella flexneri 2a str. 2457T
augcgcuccucgccguuaa

SEQ ID NO: 1888720 - RNA, 13 nt, Shigella flexneri 2a str. 2457T
augcgcuggcagu

SEQ ID NO: 1888721 - RNA, 16 nt, Shigella flexneri 2a str. 2457T
augcguuuagccgccg

SEQ ID NO: 1888722 - RNA, 15 nt, Shigella flexneri 2a str. 2457T
augcguuugccagcg

SEQ ID NO: 1888723 - RNA, 16 nt, Shigella flexneri 2a str. 2457T
augcguugucgccauc

SEQ ID NO: 1888724 - RNA, 20 nt, Shigella flexneri 2a str. 2457T
augacuugccuccagcgacg

SEQ ID NO: 1888725 - RNA, 16 nt, Shigella flexneri 2a str. 2457T
augagacguuaucucg

SEQ ID NO: 1888726 - RNA, 17 nt, Shigella flexneri 2a str. 2457T
augaugauacugacauu

SEQ ID NO: 1888727 - RNA, 13 nt, Shigella flexneri 2a str. 2457T
augaugccugaug

SEQ ID NO: 1888728 - RNA, 21 nt, Shigella flexneri 2a str. 2457T
augaugccugaugcgacgcug

SEQ ID NO: 1888729 - RNA, 16 nt, Shigella flexneri 2a str. 2457T
augauucccagucagg

SEQ ID NO: 1888730 - RNA, 18 nt, Shigella flexneri 2a str. 2457T
augauucccuugucgcag

SEQ ID NO: 1888731 - RNA, 13 nt, Shigella flexneri 2a str. 2457T
augauuccggcaa

SEQ ID NO: 1888732 - RNA, 21 nt, Shigella flexneri 2a str. 2457T
aucugaauauucggcuccaga

SEQ ID NO: 1888733 - RNA, 23 nt, Shigella flexneri 2a str. 2457T
aucugaguugccaucaucaccag

SEQ ID NO: 1888734 - RNA, 23 nt, Shigella flexneri 2a str. 2457T
aucugaccacggccacagccagc

SEQ ID NO: 1888735 - RNA, 15 nt, Shigella flexneri 2a str. 2457T
aucugcaauuacugc

SEQ ID NO: 1888736 - RNA, 18 nt, Shigella flexneri 2a str. 2457T
aucugccagcaagcgcac

SEQ ID NO: 1888737 - RNA, 15 nt, Shigella flexneri 2a str. 2457T
aucugcaaaucugcg

SEQ ID NO: 1888738 - RNA, 22 nt, Shigella flexneri 2a str. 2457T
augacggucaucaccuccagcc

SEQ ID NO: 1888739 - RNA, 17 nt, Shigella flexneri 2a str. 2457T
aucugccuguccggcau

SEQ ID NO: 1888740 - RNA, 20 nt, Shigella flexneri 2a str. 2457T
augcccggucgcuccggcua

SEQ ID NO: 1888741 - RNA, 22 nt, Shigella flexneri 2a str. 2457T
augcccggccugugucacuuug

SEQ ID NO: 1888742 - RNA, 20 nt, Shigella flexneri 2a str. 2457T
augccaucuacacgcuacca

SEQ ID NO: 1888743 - RNA, 21 nt, Shigella flexneri 2a str. 2457T
augcaacguuaccguaaccau

SEQ ID NO: 1888744 - RNA, 16 nt, Shigella flexneri 2a str. 2457T
augcaaccgagcgccc

SEQ ID NO: 1888745 - RNA, 14 nt, Shigella flexneri 2a str. 2457T
augcaaaaaggcau

SEQ ID NO: 1888746 - RNA, 17 nt, Shigella flexneri 2a str. 2457T
augauuucauaacugau

SEQ ID NO: 1888747 - RNA, 22 nt, Shigella flexneri 2a str. 2457T
augccagaaagcguauccauca

SEQ ID NO: 1888748 - RNA, 18 nt, Shigella flexneri 2a str. 2457T
augccacaaacgccgugc

SEQ ID NO: 1888749 - RNA, 21 nt, Shigella flexneri 2a str. 2457T
augccacagaauucccccauu

SEQ ID NO: 1888750 - RNA, 14 nt, Shigella flexneri 2a str. 2457T
augccaccacaccg

SEQ ID NO: 1888751 - RNA, 22 nt, Shigella flexneri 2a str. 2457T
auuaaucccugcuucggucaga

SEQ ID NO: 1888752 - RNA, 21 nt, Shigella flexneri 2a str. 2457T
auuacacccugaugugaugcc

SEQ ID NO: 1888753 - RNA, 15 nt, Shigella flexneri 2a str. 2457T
auuacaugcuggugu

SEQ ID NO: 1888754 - RNA, 17 nt, Shigella flexneri 2a str. 2457T
auuaccaacucaucgcc

SEQ ID NO: 1888755 - RNA, 19 nt, Shigella flexneri 2a str. 2457T
auuacacgcggcuguugcc

SEQ ID NO: 1888756 - RNA, 18 nt, Shigella flexneri 2a str. 2457T
auuaccgccacuaucgcc

SEQ ID NO: 1888757 - RNA, 18 nt, Shigella flexneri 2a str. 2457T
auuacgcccgacgaggcg

SEQ ID NO: 1888758 - RNA, 19 nt, Shigella flexneri 2a str. 2457T
auuaccgccaccaggaacg

SEQ ID NO: 1888759 - RNA, 22 nt, Shigella flexneri 2a str. 2457T
auuacccuucgcccugcgucgc

SEQ ID NO: 1888760 - RNA, 19 nt, Shigella flexneri 2a str. 2457T
auuaccaccggauaaaggc

SEQ ID NO: 1888761 - RNA, 13 nt, Shigella flexneri 2a str. 2457T
augucgcgccagg

SEQ ID NO: 1888762 - RNA, 16 nt, Shigella flexneri 2a str. 2457T
augucgcucaaugcgc

SEQ ID NO: 1888763 - RNA, 18 nt, Shigella flexneri 2a str. 2457T
auuaacgccagacucgcc

SEQ ID NO: 1888764 - RNA, 22 nt, Shigella flexneri 2a str. 2457T
auuagcccaauaaucaccguga

SEQ ID NO: 1888765 - RNA, 11 nt, Shigella flexneri 2a str. 2457T
auuacgcgccc

SEQ ID NO: 1888766 - RNA, 13 nt, Shigella flexneri 2a str. 2457T
auuacugauugcu

SEQ ID NO: 1888767 - RNA, 18 nt, Shigella flexneri 2a str. 2457T
auuacuuuaagccuuccg

SEQ ID NO: 1888768 - RNA, 14 nt, Shigella flexneri 2a str. 2457T
auuccaguccacau

SEQ ID NO: 1888769 - RNA, 23 nt, Shigella flexneri 2a str. 2457T
auucauugccugaugcgacgcuu

SEQ ID NO: 1888770 - RNA, 17 nt, Shigella flexneri 2a str. 2457T
auucacaaacagcgccu

SEQ ID NO: 1888771 - RNA, 12 nt, Shigella flexneri 2a str. 2457T
auuauccaugcc

SEQ ID NO: 1888772 - RNA, 20 nt, Shigella flexneri 2a str. 2457T
auuauccgcaucacuccaca

SEQ ID NO: 1888773 - RNA, 16 nt, Shigella flexneri 2a str. 2457T
auuauccgucagccac

SEQ ID NO: 1888774 - RNA, 17 nt, Shigella flexneri 2a str. 2457T
auucaaacgugaacggc

SEQ ID NO: 1888775 - RNA, 12 nt, Shigella flexneri 2a str. 2457T
auucaagaucau

SEQ ID NO: 1888776 - RNA, 14 nt, Shigella flexneri 2a str. 2457T
auggcgucgauaau

SEQ ID NO: 1888777 - RNA, 20 nt, Shigella flexneri 2a str. 2457T
augcuccacgcugcaucgcc

SEQ ID NO: 1888778 - RNA, 12 nt, Shigella flexneri 2a str. 2457T
augcuccacgcu

SEQ ID NO: 1888779 - RNA, 18 nt, Shigella flexneri 2a str. 2457T
augcucagaugccugaug

SEQ ID NO: 1888780 - RNA, 20 nt, Shigella flexneri 2a str. 2457T
augcugaaauuacgcggugc

SEQ ID NO: 1888781 - RNA, 13 nt, Shigella flexneri 2a str. 2457T
auggcgcauccag

SEQ ID NO: 1888782 - RNA, 15 nt, Shigella flexneri 2a str. 2457T
auggcgcccaucggc

SEQ ID NO: 1888783 - RNA, 17 nt, Shigella flexneri 2a str. 2457T
auggcgcacauugugcg

SEQ ID NO: 1888784 - RNA, 22 nt, Shigella flexneri 2a str. 2457T
auggccgguuuguuauccaccg

SEQ ID NO: 1888785 - RNA, 21 nt, Shigella flexneri 2a str. 2457T
auguccugcggacagucacgu

SEQ ID NO: 1888786 - RNA, 21 nt, Shigella flexneri 2a str. 2457T
auguccguuggauaagcggua

SEQ ID NO: 1888787 - RNA, 22 nt, Shigella flexneri 2a str. 2457T
augucgauauggggauccccau

SEQ ID NO: 1888788 - RNA, 23 nt, Shigella flexneri 2a str. 2457T
auggucagcuucaccuuccagua

SEQ ID NO: 1888789 - RNA, 17 nt, Shigella flexneri 2a str. 2457T
auggucgccccggaacg

SEQ ID NO: 1888790 - RNA, 18 nt, Shigella flexneri 2a str. 2457T
auggugcaccgauugccg

SEQ ID NO: 1888791 - RNA, 17 nt, Shigella flexneri 2a str. 2457T
aucgcuguuaauguuga

SEQ ID NO: 1888792 - RNA, 19 nt, Shigella flexneri 2a str. 2457T
aucggaaacagcgguacaa

SEQ ID NO: 1888793 - RNA, 16 nt, Shigella flexneri 2a str. 2457T
aucgcgaaaccacggu

SEQ ID NO: 1888794 - RNA, 13 nt, Shigella flexneri 2a str. 2457T
aucgccugccgca

SEQ ID NO: 1888795 - RNA, 22 nt, Shigella flexneri 2a str. 2457T
aucgccugcgcgauacuacguu

SEQ ID NO: 1888796 - RNA, 12 nt, Shigella flexneri 2a str. 2457T
aucgcagcgcaa

SEQ ID NO: 1888797 - RNA, 15 nt, Shigella flexneri 2a str. 2457T
aucgccagcucaaac

SEQ ID NO: 1888798 - RNA, 13 nt, Shigella flexneri 2a str. 2457T
aucgccaggaaca

SEQ ID NO: 1888799 - RNA, 19 nt, Shigella flexneri 2a str. 2457T
aucgaggccauauuucaca

SEQ ID NO: 1888800 - RNA, 15 nt, Shigella flexneri 2a str. 2457T
aucgauaaucaguaa

SEQ ID NO: 1888801 - RNA, 20 nt, Shigella flexneri 2a str. 2457T
aucgaugacgcgguagcacg

SEQ ID NO: 1888802 - RNA, 23 nt, Shigella flexneri 2a str. 2457T
aucgauaugaccauugguaaugg

SEQ ID NO: 1888803 - RNA, 18 nt, Shigella flexneri 2a str. 2457T
aucgcaaaccagacgcgc

SEQ ID NO: 1888804 - RNA, 20 nt, Shigella flexneri 2a str. 2457T
aucggugguguaaccuucac

SEQ ID NO: 1888805 - RNA, 15 nt, Shigella flexneri 2a str. 2457T
aucggugcaaaugcc

SEQ ID NO: 1888806 - RNA, 18 nt, Shigella flexneri 2a str. 2457T
aucggugaggaucaccag

SEQ ID NO: 1888807 - RNA, 19 nt, Shigella flexneri 2a str. 2457T
aucgggaugccauuugcca

SEQ ID NO: 1888808 - RNA, 17 nt, Shigella flexneri 2a str. 2457T
aucgggauaucgccggu

SEQ ID NO: 1888809 - RNA, 22 nt, Shigella flexneri 2a str. 2457T
aucggagaacugcaacucaccu

SEQ ID NO: 1888810 - RNA, 15 nt, Shigella flexneri 2a str. 2457T
aucggcaucgcucca

SEQ ID NO: 1888811 - RNA, 20 nt, Shigella flexneri 2a str. 2457T
aucucuucgcgaucaaacgc

SEQ ID NO: 1888812 - RNA, 16 nt, Shigella flexneri 2a str. 2457T
aucucuugcuggcauu

SEQ ID NO: 1888813 - RNA, 18 nt, Shigella flexneri 2a str. 2457T
aucucuucguuuucaacg

SEQ ID NO: 1888814 - RNA, 21 nt, Shigella flexneri 2a str. 2457T
aucucugguuuguuuucagau

SEQ ID NO: 1888815 - RNA, 23 nt, Shigella flexneri 2a str. 2457T
aucucugcgcuauccagcgcaua

SEQ ID NO: 1888816 - RNA, 22 nt, Shigella flexneri 2a str. 2457T
aucuccagaucuuuuugcgcaa

SEQ ID NO: 1888817 - RNA, 13 nt, Shigella flexneri 2a str. 2457T
aucuccagcgcau

SEQ ID NO: 1888818 - RNA, 23 nt, Shigella flexneri 2a str. 2457T
aucguuauauagaacaagugcca

SEQ ID NO: 1888819 - RNA, 16 nt, Shigella flexneri 2a str. 2457T
aucucaagcgcgucga

SEQ ID NO: 1888820 - RNA, 16 nt, Shigella flexneri 2a str. 2457T
aucucagauaaaugca

SEQ ID NO: 1888821 - RNA, 19 nt, Shigella flexneri 2a str. 2457T
aucucagauaaaugcaaac

SEQ ID NO: 1888822 - RNA, 21 nt, Shigella flexneri 2a str. 2457T
aucgugcugguagaagcuggc

SEQ ID NO: 1888823 - RNA, 16 nt, Shigella flexneri 2a str. 2457T
aucguuaauuaacgcg

SEQ ID NO: 1888824 - RNA, 13 nt, Shigella flexneri 2a str. 2457T
aucaucagaaaug

SEQ ID NO: 1888825 - RNA, 17 nt, Shigella flexneri 2a str. 2457T
aucauccagcacgguga

SEQ ID NO: 1888826 - RNA, 23 nt, Shigella flexneri 2a str. 2457T
aucaucgcccaguugaucaccag

SEQ ID NO: 1888827 - RNA, 21 nt, Shigella flexneri 2a str. 2457T
aucaucggcaaacaucgacuc

SEQ ID NO: 1888828 - RNA, 15 nt, Shigella flexneri 2a str. 2457T
aucaucgcggucaac

SEQ ID NO: 1888829 - RNA, 20 nt, Shigella flexneri 2a str. 2457T
aucaucgcguacucaccgcu

SEQ ID NO: 1888830 - RNA, 22 nt, Shigella flexneri 2a str. 2457T
aucaucuuccgguagaugccag

SEQ ID NO: 1888831 - RNA, 18 nt, Shigella flexneri 2a str. 2457T
aucaugccggccagcgcc

SEQ ID NO: 1888832 - RNA, 21 nt, Shigella flexneri 2a str. 2457T
aucaugcucagaugccugaug

SEQ ID NO: 1888833 - RNA, 13 nt, Shigella flexneri 2a str. 2457T
aucauuacgccag

SEQ ID NO: 1888834 - RNA, 16 nt, Shigella flexneri 2a str. 2457T
aucauucccggucagu

SEQ ID NO: 1888835 - RNA, 22 nt, Shigella flexneri 2a str. 2457T
aucauuagcuggaaauguccgc

SEQ ID NO: 1888836 - RNA, 19 nt, Shigella flexneri 2a str. 2457T
aucaugucgcccacgccag

SEQ ID NO: 1888837 - RNA, 22 nt, Shigella flexneri 2a str. 2457T
aucaugguaucgggcaguuuac

SEQ ID NO: 1888838 - RNA, 18 nt, Shigella flexneri 2a str. 2457T
aucauuuuuucccauuac

SEQ ID NO: 1888839 - RNA, 23 nt, Shigella flexneri 2a str. 2457T
auccaccauuggcgcauagccgu

SEQ ID NO: 1888840 - RNA, 16 nt, Shigella flexneri 2a str. 2457T
aucaggggcagcacca

SEQ ID NO: 1888841 - RNA, 15 nt, Shigella flexneri 2a str. 2457T
aucaggcguucgcgg

SEQ ID NO: 1888842 - RNA, 21 nt, Shigella flexneri 2a str. 2457T
aucaggcuuuuuuauugccau

SEQ ID NO: 1888843 - RNA, 17 nt, Shigella flexneri 2a str. 2457T
aucaggcuaaucgccag

SEQ ID NO: 1888844 - RNA, 20 nt, Shigella flexneri 2a str. 2457T
aucaggcuaucuucgauaaa

SEQ ID NO: 1888845 - RNA, 17 nt, Shigella flexneri 2a str. 2457T
auauugccguccggcau

SEQ ID NO: 1888846 - RNA, 14 nt, Shigella flexneri 2a str. 2457T
aucagcuccggcag

SEQ ID NO: 1888847 - RNA, 14 nt, Shigella flexneri 2a str. 2457T
aucccgccgcuuca

SEQ ID NO: 1888848 - RNA, 12 nt, Shigella flexneri 2a str. 2457T
auccccugcgcg

SEQ ID NO: 1888849 - RNA, 21 nt, Shigella flexneri 2a str. 2457T
aucccgcuaaguugaaucggc

SEQ ID NO: 1888850 - RNA, 14 nt, Shigella flexneri 2a str. 2457T
aucccucucaucca

SEQ ID NO: 1888851 - RNA, 20 nt, Shigella flexneri 2a str. 2457T
auccgcgcuuucuggcgcag

SEQ ID NO: 1888852 - RNA, 22 nt, Shigella flexneri 2a str. 2457T
auccggucuaccgauccggcac

SEQ ID NO: 1888853 - RNA, 15 nt, Shigella flexneri 2a str. 2457T
auccguaaagcccau

SEQ ID NO: 1888854 - RNA, 13 nt, Shigella flexneri 2a str. 2457T
auccggccuuccu

SEQ ID NO: 1888855 - RNA, 22 nt, Shigella flexneri 2a str. 2457T
auccaggguuuuauuauuccau

SEQ ID NO: 1888856 - RNA, 14 nt, Shigella flexneri 2a str. 2457T
auccagguacgcag

SEQ ID NO: 1888857 - RNA, 17 nt, Shigella flexneri 2a str. 2457T
auccacugucaaaucca

SEQ ID NO: 1888858 - RNA, 22 nt, Shigella flexneri 2a str. 2457T
auccacguugugguaaagcggc

SEQ ID NO: 1888859 - RNA, 21 nt, Shigella flexneri 2a str. 2457T
auccacugccugucacggcgc

SEQ ID NO: 1888860 - RNA, 18 nt, Shigella flexneri 2a str. 2457T
auccagcaacaacagcgc

SEQ ID NO: 1888861 - RNA, 14 nt, Shigella flexneri 2a str. 2457T
auccagcaaagcgu

SEQ ID NO: 1888862 - RNA, 21 nt, Shigella flexneri 2a str. 2457T
auccauuccggccaucgccug

SEQ ID NO: 1888863 - RNA, 22 nt, Shigella flexneri 2a str. 2457T
auccauuccggccaucgccuga

SEQ ID NO: 1888864 - RNA, 22 nt, Shigella flexneri 2a str. 2457T
auccauacggcagagaucgccg

SEQ ID NO: 1888865 - RNA, 15 nt, Shigella flexneri 2a str. 2457T
auccauaagauugca

SEQ ID NO: 1888866 - RNA, 18 nt, Shigella flexneri 2a str. 2457T
auccccagccuaagccau

SEQ ID NO: 1888867 - RNA, 17 nt, Shigella flexneri 2a str. 2457T
aucccaucgccgguaau

SEQ ID NO: 1888868 - RNA, 21 nt, Shigella flexneri 2a str. 2457T
aucccagaagguuucgccgcu

SEQ ID NO: 1888869 - RNA, 20 nt, Shigella flexneri 2a str. 2457T
auuuacgccgcauccggcaa

SEQ ID NO: 1888870 - RNA, 22 nt, Shigella flexneri 2a str. 2457T
auuuaucgacugccagagucaa

SEQ ID NO: 1888871 - RNA, 12 nt, Shigella flexneri 2a str. 2457T
auuuauaucagu

SEQ ID NO: 1888872 - RNA, 21 nt, Shigella flexneri 2a str. 2457T
auucccagcaccuguugugcg

SEQ ID NO: 1888873 - RNA, 18 nt, Shigella flexneri 2a str. 2457T
auuuaaauucgcugcgga

SEQ ID NO: 1888874 - RNA, 14 nt, Shigella flexneri 2a str. 2457T
auuucauccaugcc

SEQ ID NO: 1888875 - RNA, 13 nt, Shigella flexneri 2a str. 2457T
auuucaucugccu

SEQ ID NO: 1888876 - RNA, 13 nt, Shigella flexneri 2a str. 2457T
auuuccgcugauu

SEQ ID NO: 1888877 - RNA, 22 nt, Shigella flexneri 2a str. 2457T
auuuccgccaccugauccaucg

SEQ ID NO: 1888878 - RNA, 17 nt, Shigella flexneri 2a str. 2457T
auuuccgcgcaaucgcc

SEQ ID NO: 1888879 - RNA, 20 nt, Shigella flexneri 2a str. 2457T
auuucaauaucguuaucacc

SEQ ID NO: 1888880 - RNA, 19 nt, Shigella flexneri 2a str. 2457T
auuucaaugcauuaucaga

SEQ ID NO: 1888881 - RNA, 18 nt, Shigella flexneri 2a str. 2457T
auuucguugugucgccag

SEQ ID NO: 1888882 - RNA, 20 nt, Shigella flexneri 2a str. 2457T
auuucgauagacucccagcc

SEQ ID NO: 1888883 - RNA, 19 nt, Shigella flexneri 2a str. 2457T
auuucuucaccagccugca

SEQ ID NO: 1888884 - RNA, 15 nt, Shigella flexneri 2a str. 2457T
auuucugccagcggg

SEQ ID NO: 1888885 - RNA, 18 nt, Shigella flexneri 2a str. 2457T
auuuguaguuugauaauu

SEQ ID NO: 1888886 - RNA, 16 nt, Shigella flexneri 2a str. 2457T
auuugauugcagauuc

SEQ ID NO: 1888887 - RNA, 16 nt, Shigella flexneri 2a str. 2457T
auuugauugccggaug

SEQ ID NO: 1888888 - RNA, 13 nt, Shigella flexneri 2a str. 2457T
auuugccaaacgc

SEQ ID NO: 1888889 - RNA, 13 nt, Shigella flexneri 2a str. 2457T
auuugagaucgga

SEQ ID NO: 1888890 - RNA, 17 nt, Shigella flexneri 2a str. 2457T
auuugcggucguaugcu

SEQ ID NO: 1888891 - RNA, 18 nt, Shigella flexneri 2a str. 2457T
auuugcgccgcaucgcca

SEQ ID NO: 1888892 - RNA, 19 nt, Shigella flexneri 2a str. 2457T
auuugcgccgcaucgccag

SEQ ID NO: 1888893 - RNA, 16 nt, Shigella flexneri 2a str. 2457T
auuugcuccagcgaac

SEQ ID NO: 1888894 - RNA, 20 nt, Shigella flexneri 2a str. 2457T
auuuucaggauggucaacgu

SEQ ID NO: 1888895 - RNA, 17 nt, Shigella flexneri 2a str. 2457T
auuuugcaucguccacu

SEQ ID NO: 1888896 - RNA, 22 nt, Shigella flexneri 2a str. 2457T
auuuugaugauaucagccugca

SEQ ID NO: 1888897 - RNA, 13 nt, Shigella flexneri 2a str. 2457T
auuuugugcagca

SEQ ID NO: 1888898 - RNA, 17 nt, Shigella flexneri 2a str. 2457T
caaaaaauugcgucagu

SEQ ID NO: 1888899 - RNA, 16 nt, Shigella flexneri 2a str. 2457T
caaaaacaucgcgaau

SEQ ID NO: 1888900 - RNA, 17 nt, Shigella flexneri 2a str. 2457T
caaaaacuucggcgcga

SEQ ID NO: 1888901 - RNA, 20 nt, Shigella flexneri 2a str. 2457T
caaaaacgcgguugccagau

SEQ ID NO: 1888902 - RNA, 18 nt, Shigella flexneri 2a str. 2457T
caaaaagcguauccugac

SEQ ID NO: 1888903 - RNA, 22 nt, Shigella flexneri 2a str. 2457T
auuuuuuuuccgguuaaccuuu

SEQ ID NO: 1888904 - RNA, 16 nt, Shigella flexneri 2a str. 2457T
auuuuuucgacaucaa

SEQ ID NO: 1888905 - RNA, 21 nt, Shigella flexneri 2a str. 2457T
auuuuuaugccggaucaggcg

SEQ ID NO: 1888906 - RNA, 20 nt, Shigella flexneri 2a str. 2457T
caaacgcaacauugccugau

SEQ ID NO: 1888907 - RNA, 15 nt, Shigella flexneri 2a str. 2457T
caaacgcaucgccaa

SEQ ID NO: 1888908 - RNA, 20 nt, Shigella flexneri 2a str. 2457T
caaacgcaaaacugccugau

SEQ ID NO: 1888909 - RNA, 20 nt, Shigella flexneri 2a str. 2457T
caaacgcaaaauugccugau

SEQ ID NO: 1888910 - RNA, 19 nt, Shigella flexneri 2a str. 2457T
caaacgcucccugccaguc

SEQ ID NO: 1888911 - RNA, 12 nt, Shigella flexneri 2a str. 2457T
caaacgcugacg

SEQ ID NO: 1888912 - RNA, 15 nt, Shigella flexneri 2a str. 2457T
caaaccaacgcuguc

SEQ ID NO: 1888913 - RNA, 19 nt, Shigella flexneri 2a str. 2457T
caaacauuagcgcaugacc

SEQ ID NO: 1888914 - RNA, 17 nt, Shigella flexneri 2a str. 2457T
caaaccacccagcagcg

SEQ ID NO: 1888915 - RNA, 23 nt, Shigella flexneri 2a str. 2457T
caaacaugacgcgcaucacgaca

SEQ ID NO: 1888916 - RNA, 23 nt, Shigella flexneri 2a str. 2457T
caaagcaggcgauuuacuggcag

SEQ ID NO: 1888917 - RNA, 17 nt, Shigella flexneri 2a str. 2457T
caaagacaauuuaccga

SEQ ID NO: 1888918 - RNA, 20 nt, Shigella flexneri 2a str. 2457T
caaagaugucaccauuggca

SEQ ID NO: 1888919 - RNA, 16 nt, Shigella flexneri 2a str. 2457T
caaagcagaguugcug

SEQ ID NO: 1888920 - RNA, 20 nt, Shigella flexneri 2a str. 2457T
caaagauaaaauaaccaucu

SEQ ID NO: 1888921 - RNA, 22 nt, Shigella flexneri 2a str. 2457T
caaaaccgauuaauugccgcca

SEQ ID NO: 1888922 - RNA, 14 nt, Shigella flexneri 2a str. 2457T
caaaacugccugau

SEQ ID NO: 1888923 - RNA, 17 nt, Shigella flexneri 2a str. 2457T
caaaauagguaucguaa

SEQ ID NO: 1888924 - RNA, 21 nt, Shigella flexneri 2a str. 2457T
caaaaucuucuaacgacauuu

SEQ ID NO: 1888925 - RNA, 21 nt, Shigella flexneri 2a str. 2457T
caaacagcgcgccagccacca

SEQ ID NO: 1888926 - RNA, 18 nt, Shigella flexneri 2a str. 2457T
caaacaggaacaccagca

SEQ ID NO: 1888927 - RNA, 19 nt, Shigella flexneri 2a str. 2457T
caaacaggaacaccagcau

SEQ ID NO: 1888928 - RNA, 15 nt, Shigella flexneri 2a str. 2457T
caagauuagcgacga

SEQ ID NO: 1888929 - RNA, 16 nt, Shigella flexneri 2a str. 2457T
caagauugauccccgc

SEQ ID NO: 1888930 - RNA, 14 nt, Shigella flexneri 2a str. 2457T
caagauugccugau

SEQ ID NO: 1888931 - RNA, 23 nt, Shigella flexneri 2a str. 2457T
caagauguuugauucacuggcaa

SEQ ID NO: 1888932 - RNA, 13 nt, Shigella flexneri 2a str. 2457T
caagaugccugau

SEQ ID NO: 1888933 - RNA, 22 nt, Shigella flexneri 2a str. 2457T
caagcagagagacaaucgccac

SEQ ID NO: 1888934 - RNA, 22 nt, Shigella flexneri 2a str. 2457T
caagccagguuuugaccagucg

SEQ ID NO: 1888935 - RNA, 20 nt, Shigella flexneri 2a str. 2457T
caagcagccagguuaacgca

SEQ ID NO: 1888936 - RNA, 22 nt, Shigella flexneri 2a str. 2457T
caagcggagaagguuggcgucg

SEQ ID NO: 1888937 - RNA, 20 nt, Shigella flexneri 2a str. 2457T
caagcguaugauugccugau

SEQ ID NO: 1888938 - RNA, 18 nt, Shigella flexneri 2a str. 2457T
caagcgucgcaucaggca

SEQ ID NO: 1888939 - RNA, 15 nt, Shigella flexneri 2a str. 2457T
caaggcaucgugauc

SEQ ID NO: 1888940 - RNA, 16 nt, Shigella flexneri 2a str. 2457T
caagcggaaacguaac

SEQ ID NO: 1888941 - RNA, 21 nt, Shigella flexneri 2a str. 2457T
caagcggaauauuuuuaccgu

SEQ ID NO: 1888942 - RNA, 19 nt, Shigella flexneri 2a str. 2457T
caagcguaacguguuuagc

SEQ ID NO: 1888943 - RNA, 19 nt, Shigella flexneri 2a str. 2457T
caacggccaaauauccgcg

SEQ ID NO: 1888944 - RNA, 13 nt, Shigella flexneri 2a str. 2457T
caacuugccggau

SEQ ID NO: 1888945 - RNA, 13 nt, Shigella flexneri 2a str. 2457T
caacuucaugacc

SEQ ID NO: 1888946 - RNA, 20 nt, Shigella flexneri 2a str. 2457T
caagaacagccuuaaacuca

SEQ ID NO: 1888947 - RNA, 22 nt, Shigella flexneri 2a str. 2457T
caagaaacaccagaaugcccca

SEQ ID NO: 1888948 - RNA, 22 nt, Shigella flexneri 2a str. 2457T
caaccaguuacgugcugcgcag

SEQ ID NO: 1888949 - RNA, 14 nt, Shigella flexneri 2a str. 2457T
caaccagcgucagc

SEQ ID NO: 1888950 - RNA, 21 nt, Shigella flexneri 2a str. 2457T
caaccagcagauguagcucac

SEQ ID NO: 1888951 - RNA, 17 nt, Shigella flexneri 2a str. 2457T
caacagguaaggcgcga

SEQ ID NO: 1888952 - RNA, 21 nt, Shigella flexneri 2a str. 2457T
caacagacgacgagucacgga

SEQ ID NO: 1888953 - RNA, 18 nt, Shigella flexneri 2a str. 2457T
caaaguaaaaaagggcga

SEQ ID NO: 1888954 - RNA, 13 nt, Shigella flexneri 2a str. 2457T
caaaguuaccgga

SEQ ID NO: 1888955 - RNA, 20 nt, Shigella flexneri 2a str. 2457T
caacacucaguccgccuuca

SEQ ID NO: 1888956 - RNA, 15 nt, Shigella flexneri 2a str. 2457T
caaccgaagaaguaa

SEQ ID NO: 1888957 - RNA, 14 nt, Shigella flexneri 2a str. 2457T
caacgccagcagca

SEQ ID NO: 1888958 - RNA, 19 nt, Shigella flexneri 2a str. 2457T
caacgacccagccagacgc

SEQ ID NO: 1888959 - RNA, 23 nt, Shigella flexneri 2a str. 2457T
caacgacccagccagacgccagc

SEQ ID NO: 1888960 - RNA, 15 nt, Shigella flexneri 2a str. 2457T
caacgccgccagacc

SEQ ID NO: 1888961 - RNA, 14 nt, Shigella flexneri 2a str. 2457T
caacgcgcggugau

SEQ ID NO: 1888962 - RNA, 16 nt, Shigella flexneri 2a str. 2457T
caacggaugugacgga

SEQ ID NO: 1888963 - RNA, 14 nt, Shigella flexneri 2a str. 2457T
caacggagcaccgu

SEQ ID NO: 1888964 - RNA, 15 nt, Shigella flexneri 2a str. 2457T
caacgcggcggugau

SEQ ID NO: 1888965 - RNA, 22 nt, Shigella flexneri 2a str. 2457T
cacccuauuuuuacccaggccu

SEQ ID NO: 1888966 - RNA, 19 nt, Shigella flexneri 2a str. 2457T
cacccgguaucaaacccuu

SEQ ID NO: 1888967 - RNA, 17 nt, Shigella flexneri 2a str. 2457T
cacccggggugauaacg

SEQ ID NO: 1888968 - RNA, 23 nt, Shigella flexneri 2a str. 2457T
caccgcaaaauagguaucguaau

SEQ ID NO: 1888969 - RNA, 12 nt, Shigella flexneri 2a str. 2457T
caccgcagccgc

SEQ ID NO: 1888970 - RNA, 21 nt, Shigella flexneri 2a str. 2457T
caccgcaccuguaauacggcu

SEQ ID NO: 1888971 - RNA, 17 nt, Shigella flexneri 2a str. 2457T
caccgccagcaucggcg

SEQ ID NO: 1888972 - RNA, 14 nt, Shigella flexneri 2a str. 2457T
caccgcaguaaucg

SEQ ID NO: 1888973 - RNA, 18 nt, Shigella flexneri 2a str. 2457T
cacccggaucucagcuca

SEQ ID NO: 1888974 - RNA, 15 nt, Shigella flexneri 2a str. 2457T
cacccgcagccauca

SEQ ID NO: 1888975 - RNA, 14 nt, Shigella flexneri 2a str. 2457T
cacccgcagcacgg

SEQ ID NO: 1888976 - RNA, 19 nt, Shigella flexneri 2a str. 2457T
caccccguugguuggauaa

SEQ ID NO: 1888977 - RNA, 15 nt, Shigella flexneri 2a str. 2457T
caccccugauaaccg

SEQ ID NO: 1888978 - RNA, 19 nt, Shigella flexneri 2a str. 2457T
caccauugauaauccauca

SEQ ID NO: 1888979 - RNA, 21 nt, Shigella flexneri 2a str. 2457T
caccaguuuucggauuuaccg

SEQ ID NO: 1888980 - RNA, 16 nt, Shigella flexneri 2a str. 2457T
caccauauucagcagc

SEQ ID NO: 1888981 - RNA, 21 nt, Shigella flexneri 2a str. 2457T
caccauauucagcagcagaca

SEQ ID NO: 1888982 - RNA, 18 nt, Shigella flexneri 2a str. 2457T
caccaucggacggaagac

SEQ ID NO: 1888983 - RNA, 17 nt, Shigella flexneri 2a str. 2457T
caccaucucuuacuuga

SEQ ID NO: 1888984 - RNA, 22 nt, Shigella flexneri 2a str. 2457T
caccaugucccggaacaggcag

SEQ ID NO: 1888985 - RNA, 16 nt, Shigella flexneri 2a str. 2457T
caccaugccacagaau

SEQ ID NO: 1888986 - RNA, 15 nt, Shigella flexneri 2a str. 2457T
caccacuucacccgc

SEQ ID NO: 1888987 - RNA, 15 nt, Shigella flexneri 2a str. 2457T
caccaguaccgccac

SEQ ID NO: 1888988 - RNA, 13 nt, Shigella flexneri 2a str. 2457T
caccaggcuugcu

SEQ ID NO: 1888989 - RNA, 18 nt, Shigella flexneri 2a str. 2457T
caauggccguuccggcaa

SEQ ID NO: 1888990 - RNA, 19 nt, Shigella flexneri 2a str. 2457T
caauuacgccgagcgccag

SEQ ID NO: 1888991 - RNA, 22 nt, Shigella flexneri 2a str. 2457T
caauuaccuuccacaauggcau

SEQ ID NO: 1888992 - RNA, 17 nt, Shigella flexneri 2a str. 2457T
caauuaccgccaccagg

SEQ ID NO: 1888993 - RNA, 23 nt, Shigella flexneri 2a str. 2457T
caauuagugggauucaccaaucg

SEQ ID NO: 1888994 - RNA, 15 nt, Shigella flexneri 2a str. 2457T
caauuauaauacgcu

SEQ ID NO: 1888995 - RNA, 20 nt, Shigella flexneri 2a str. 2457T
caauguucguccauuucagc

SEQ ID NO: 1888996 - RNA, 16 nt, Shigella flexneri 2a str. 2457T
caauucucucuucagc

SEQ ID NO: 1888997 - RNA, 22 nt, Shigella flexneri 2a str. 2457T
caaugcgcugaguguaacgcuu

SEQ ID NO: 1888998 - RNA, 17 nt, Shigella flexneri 2a str. 2457T
caaugaccacuccggca

SEQ ID NO: 1888999 - RNA, 13 nt, Shigella flexneri 2a str. 2457T
cacagcggcgaau

SEQ ID NO: 1889000 - RNA, 22 nt, Shigella flexneri 2a str. 2457T
cacagcggaguaaucgccagca

SEQ ID NO: 1889001 - RNA, 15 nt, Shigella flexneri 2a str. 2457T
cacagaaggccagga

SEQ ID NO: 1889002 - RNA, 15 nt, Shigella flexneri 2a str. 2457T
cacacgcccagcuca

SEQ ID NO: 1889003 - RNA, 20 nt, Shigella flexneri 2a str. 2457T
cacagaggcagcaucucgcg

SEQ ID NO: 1889004 - RNA, 13 nt, Shigella flexneri 2a str. 2457T
cacaaacuggcug

SEQ ID NO: 1889005 - RNA, 14 nt, Shigella flexneri 2a str. 2457T
cacaaacagcgccu

SEQ ID NO: 1889006 - RNA, 13 nt, Shigella flexneri 2a str. 2457T
cacaaaagacgau

SEQ ID NO: 1889007 - RNA, 20 nt, Shigella flexneri 2a str. 2457T
caauuuugcauucacccggg

SEQ ID NO: 1889008 - RNA, 16 nt, Shigella flexneri 2a str. 2457T
cacaccacugcgcaua

SEQ ID NO: 1889009 - RNA, 18 nt, Shigella flexneri 2a str. 2457T
cacaccacaucgccgacc

SEQ ID NO: 1889010 - RNA, 17 nt, Shigella flexneri 2a str. 2457T
cacaccauugauaaucc

SEQ ID NO: 1889011 - RNA, 19 nt, Shigella flexneri 2a str. 2457T
caccacaccggaccagacg

SEQ ID NO: 1889012 - RNA, 22 nt, Shigella flexneri 2a str. 2457T
caccacaaacucuuuuccggaa

SEQ ID NO: 1889013 - RNA, 23 nt, Shigella flexneri 2a str. 2457T
caccaauguaggccugauaagac

SEQ ID NO: 1889014 - RNA, 16 nt, Shigella flexneri 2a str. 2457T
cacauucgacaacgcc

SEQ ID NO: 1889015 - RNA, 20 nt, Shigella flexneri 2a str. 2457T
caccaaacgggcaagccagc

SEQ ID NO: 1889016 - RNA, 22 nt, Shigella flexneri 2a str. 2457T
caccaaacgggcaagccagcau

SEQ ID NO: 1889017 - RNA, 18 nt, Shigella flexneri 2a str. 2457T
caccaaucgucaaugccg

SEQ ID NO: 1889018 - RNA, 13 nt, Shigella flexneri 2a str. 2457T
caccaauauugac

SEQ ID NO: 1889019 - RNA, 12 nt, Shigella flexneri 2a str. 2457T
caccaaucagaa

SEQ ID NO: 1889020 - RNA, 11 nt, Shigella flexneri 2a str. 2457T
cacauccggcc

SEQ ID NO: 1889021 - RNA, 20 nt, Shigella flexneri 2a str. 2457T
cacaucuucaauccacgguu

SEQ ID NO: 1889022 - RNA, 23 nt, Shigella flexneri 2a str. 2457T
cacaugaugauggcuaucaagau

SEQ ID NO: 1889023 - RNA, 16 nt, Shigella flexneri 2a str. 2457T
cacaucaucaaagcca

SEQ ID NO: 1889024 - RNA, 18 nt, Shigella flexneri 2a str. 2457T
cacauacugcaucagcgc

SEQ ID NO: 1889025 - RNA, 18 nt, Shigella flexneri 2a str. 2457T
cacagucacuacgcgacc

SEQ ID NO: 1889026 - RNA, 19 nt, Shigella flexneri 2a str. 2457T
cacaggcaaaacacugcgc

SEQ ID NO: 1889027 - RNA, 14 nt, Shigella flexneri 2a str. 2457T
cacaggcaucguga

SEQ ID NO: 1889028 - RNA, 20 nt, Shigella flexneri 2a str. 2457T
aggcgcagcaagucggcauc

SEQ ID NO: 1889029 - RNA, 19 nt, Shigella flexneri 2a str. 2457T
aggcgcagaacuucacucu

SEQ ID NO: 1889030 - RNA, 16 nt, Shigella flexneri 2a str. 2457T
aggcgaggcggacuga

SEQ ID NO: 1889031 - RNA, 22 nt, Shigella flexneri 2a str. 2457T
aggccugauaagcgcagcgcau

SEQ ID NO: 1889032 - RNA, 17 nt, Shigella flexneri 2a str. 2457T
aggccugauaagcguag

SEQ ID NO: 1889033 - RNA, 14 nt, Shigella flexneri 2a str. 2457T
aggccugauaagcg

SEQ ID NO: 1889034 - RNA, 14 nt, Shigella flexneri 2a str. 2457T
aggcgaaacgccug

SEQ ID NO: 1889035 - RNA, 22 nt, Shigella flexneri 2a str. 2457T
aggcgucaauuuguuccgccag

SEQ ID NO: 1889036 - RNA, 14 nt, Shigella flexneri 2a str. 2457T
agggcuggcaauga

SEQ ID NO: 1889037 - RNA, 17 nt, Shigella flexneri 2a str. 2457T
aggguugaaauauaucc

SEQ ID NO: 1889038 - RNA, 23 nt, Shigella flexneri 2a str. 2457T
agguauaccggaccaauaacgcu

SEQ ID NO: 1889039 - RNA, 20 nt, Shigella flexneri 2a str. 2457T
agguauaccgaaaucgccau

SEQ ID NO: 1889040 - RNA, 22 nt, Shigella flexneri 2a str. 2457T
aggucaaccuagccuuccuugu

SEQ ID NO: 1889041 - RNA, 14 nt, Shigella flexneri 2a str. 2457T
agguauuggcggca

SEQ ID NO: 1889042 - RNA, 20 nt, Shigella flexneri 2a str. 2457T
agguccuccuguaccuucac

SEQ ID NO: 1889043 - RNA, 19 nt, Shigella flexneri 2a str. 2457T
agggcugccggaaggcagc

SEQ ID NO: 1889044 - RNA, 18 nt, Shigella flexneri 2a str. 2457T
agggcgauuauccgccag

SEQ ID NO: 1889045 - RNA, 17 nt, Shigella flexneri 2a str. 2457T
agggcggacaaccagcu

SEQ ID NO: 1889046 - RNA, 20 nt, Shigella flexneri 2a str. 2457T
aggcuucaacacaggccggc

SEQ ID NO: 1889047 - RNA, 12 nt, Shigella flexneri 2a str. 2457T
aggcuugcugca

SEQ ID NO: 1889048 - RNA, 16 nt, Shigella flexneri 2a str. 2457T
aggacuucuuugcgcc

SEQ ID NO: 1889049 - RNA, 23 nt, Shigella flexneri 2a str. 2457T
aggaggcguaauuuccacgccaa

SEQ ID NO: 1889050 - RNA, 22 nt, Shigella flexneri 2a str. 2457T
aggcacgauaaguuugcgcauc

SEQ ID NO: 1889051 - RNA, 14 nt, Shigella flexneri 2a str. 2457T
aggcacaccgccgc

SEQ ID NO: 1889052 - RNA, 17 nt, Shigella flexneri 2a str. 2457T
aggcaaaaaaaaugccc

SEQ ID NO: 1889053 - RNA, 14 nt, Shigella flexneri 2a str. 2457T
aggcaguuuaucca

SEQ ID NO: 1889054 - RNA, 12 nt, Shigella flexneri 2a str. 2457T
aggccagcaauc

SEQ ID NO: 1889055 - RNA, 15 nt, Shigella flexneri 2a str. 2457T
agcuucaccgcaucg

SEQ ID NO: 1889056 - RNA, 18 nt, Shigella flexneri 2a str. 2457T
agcuucaccgcaucguca

SEQ ID NO: 1889057 - RNA, 20 nt, Shigella flexneri 2a str. 2457T
agcuucaaauuagccgcagg

SEQ ID NO: 1889058 - RNA, 23 nt, Shigella flexneri 2a str. 2457T
agcugugggguauuuccagggcc

SEQ ID NO: 1889059 - RNA, 13 nt, Shigella flexneri 2a str. 2457T
agcuguacggagc

SEQ ID NO: 1889060 - RNA, 22 nt, Shigella flexneri 2a str. 2457T
agcugcguuugaaauaccaggu

SEQ ID NO: 1889061 - RNA, 13 nt, Shigella flexneri 2a str. 2457T
agcgucguggcaa

SEQ ID NO: 1889062 - RNA, 20 nt, Shigella flexneri 2a str. 2457T
agcgucguggcaaaaugcau

SEQ ID NO: 1889063 - RNA, 17 nt, Shigella flexneri 2a str. 2457T
agcgucgugaaacgcgu

SEQ ID NO: 1889064 - RNA, 16 nt, Shigella flexneri 2a str. 2457T
agcuggacggucugcu

SEQ ID NO: 1889065 - RNA, 19 nt, Shigella flexneri 2a str. 2457T
agcugcucgcgagaacggc

SEQ ID NO: 1889066 - RNA, 20 nt, Shigella flexneri 2a str. 2457T
aggaaauacguaggccugau

SEQ ID NO: 1889067 - RNA, 16 nt, Shigella flexneri 2a str. 2457T
aggaaccacaaccacu

SEQ ID NO: 1889068 - RNA, 16 nt, Shigella flexneri 2a str. 2457T
aggaaccugugacagc

SEQ ID NO: 1889069 - RNA, 12 nt, Shigella flexneri 2a str. 2457T
aggaacuccaga

SEQ ID NO: 1889070 - RNA, 12 nt, Shigella flexneri 2a str. 2457T
aggacagcaucg

SEQ ID NO: 1889071 - RNA, 13 nt, Shigella flexneri 2a str. 2457T
aggaaggcaagaa

SEQ ID NO: 1889072 - RNA, 21 nt, Shigella flexneri 2a str. 2457T
aggaaucaggcaggucuuuca

SEQ ID NO: 1889073 - RNA, 17 nt, Shigella flexneri 2a str. 2457T
agcuuuaaauuacugag

SEQ ID NO: 1889074 - RNA, 19 nt, Shigella flexneri 2a str. 2457T
agcuuucgcuuaacgccca

SEQ ID NO: 1889075 - RNA, 16 nt, Shigella flexneri 2a str. 2457T
agcuucccccgcaucg

SEQ ID NO: 1889076 - RNA, 19 nt, Shigella flexneri 2a str. 2457T
auaucaacaauacgcaccg

SEQ ID NO: 1889077 - RNA, 16 nt, Shigella flexneri 2a str. 2457T
auaucgcgcagaaauu

SEQ ID NO: 1889078 - RNA, 19 nt, Shigella flexneri 2a str. 2457T
auaucgcugucgccauccc

SEQ ID NO: 1889079 - RNA, 16 nt, Shigella flexneri 2a str. 2457T
auauaaagcugaucac

SEQ ID NO: 1889080 - RNA, 15 nt, Shigella flexneri 2a str. 2457T
auauagccaaagcac

SEQ ID NO: 1889081 - RNA, 17 nt, Shigella flexneri 2a str. 2457T
auauacgccaucgccag

SEQ ID NO: 1889082 - RNA, 16 nt, Shigella flexneri 2a str. 2457T
auauagaaugccugug

SEQ ID NO: 1889083 - RNA, 13 nt, Shigella flexneri 2a str. 2457T
auauucguucaga

SEQ ID NO: 1889084 - RNA, 16 nt, Shigella flexneri 2a str. 2457T
auauucuccagcuuca

SEQ ID NO: 1889085 - RNA, 15 nt, Shigella flexneri 2a str. 2457T
auaucuucaacgcac

SEQ ID NO: 1889086 - RNA, 21 nt, Shigella flexneri 2a str. 2457T
auaugaaauccggcaccuguc

SEQ ID NO: 1889087 - RNA, 13 nt, Shigella flexneri 2a str. 2457T
auaucguggcacg

SEQ ID NO: 1889088 - RNA, 20 nt, Shigella flexneri 2a str. 2457T
auagucaucucuuccggcac

SEQ ID NO: 1889089 - RNA, 15 nt, Shigella flexneri 2a str. 2457T
auaggaauccggguc

SEQ ID NO: 1889090 - RNA, 23 nt, Shigella flexneri 2a str. 2457T
auagcuaaucaucuguugugcca

SEQ ID NO: 1889091 - RNA, 20 nt, Shigella flexneri 2a str. 2457T
auacuugcaagaucgcgcau

SEQ ID NO: 1889092 - RNA, 18 nt, Shigella flexneri 2a str. 2457T
auacguaaaaucgauaac

SEQ ID NO: 1889093 - RNA, 15 nt, Shigella flexneri 2a str. 2457T
auaaccggaugacgu

SEQ ID NO: 1889094 - RNA, 23 nt, Shigella flexneri 2a str. 2457T
auaaccguaauaguuauagccgu

SEQ ID NO: 1889095 - RNA, 16 nt, Shigella flexneri 2a str. 2457T
auaaccuuccagcuuc

SEQ ID NO: 1889096 - RNA, 11 nt, Shigella flexneri 2a str. 2457T
auaaccuucaa

SEQ ID NO: 1889097 - RNA, 21 nt, Shigella flexneri 2a str. 2457T
auaacggcaacggcggaucac

SEQ ID NO: 1889098 - RNA, 15 nt, Shigella flexneri 2a str. 2457T
aguuugauuaacgca

SEQ ID NO: 1889099 - RNA, 13 nt, Shigella flexneri 2a str. 2457T
aguuugccguuga

SEQ ID NO: 1889100 - RNA, 20 nt, Shigella flexneri 2a str. 2457T
auaacccagcgcacuaugcg

SEQ ID NO: 1889101 - RNA, 21 nt, Shigella flexneri 2a str. 2457T
auaaguugccacgcuucaauc

SEQ ID NO: 1889102 - RNA, 20 nt, Shigella flexneri 2a str. 2457T
auaacugcuauucaccagca

SEQ ID NO: 1889103 - RNA, 14 nt, Shigella flexneri 2a str. 2457T
auaacugccggaug

SEQ ID NO: 1889104 - RNA, 16 nt, Shigella flexneri 2a str. 2457T
auaacucauauaacgc

SEQ ID NO: 1889105 - RNA, 22 nt, Shigella flexneri 2a str. 2457T
auaagacgcguuagcaucgcau

SEQ ID NO: 1889106 - RNA, 17 nt, Shigella flexneri 2a str. 2457T
auaagguucauugagcg

SEQ ID NO: 1889107 - RNA, 20 nt, Shigella flexneri 2a str. 2457T
auacacgcccgucaugccgu

SEQ ID NO: 1889108 - RNA, 20 nt, Shigella flexneri 2a str. 2457T
auacaacucgcuuaagccau

SEQ ID NO: 1889109 - RNA, 15 nt, Shigella flexneri 2a str. 2457T
auaccggaucgcauc

SEQ ID NO: 1889110 - RNA, 23 nt, Shigella flexneri 2a str. 2457T
auaccggacgacggcaucgccau

SEQ ID NO: 1889111 - RNA, 23 nt, Shigella flexneri 2a str. 2457T
auaccagccuucuucauccagcg

SEQ ID NO: 1889112 - RNA, 15 nt, Shigella flexneri 2a str. 2457T
auaccagaccuuuac

SEQ ID NO: 1889113 - RNA, 15 nt, Shigella flexneri 2a str. 2457T
auacgccaucgccag

SEQ ID NO: 1889114 - RNA, 15 nt, Shigella flexneri 2a str. 2457T
auacgccccacagac

SEQ ID NO: 1889115 - RNA, 18 nt, Shigella flexneri 2a str. 2457T
auacgcauagcggcucac

SEQ ID NO: 1889116 - RNA, 17 nt, Shigella flexneri 2a str. 2457T
auacgcauaugcaucag

SEQ ID NO: 1889117 - RNA, 21 nt, Shigella flexneri 2a str. 2457T
auacgcaccgcuccaucgccu

SEQ ID NO: 1889118 - RNA, 22 nt, Shigella flexneri 2a str. 2457T
auacgcaccgggcuuccggcaa

SEQ ID NO: 1889119 - RNA, 16 nt, Shigella flexneri 2a str. 2457T
auacgcucaucggcau

SEQ ID NO: 1889120 - RNA, 16 nt, Shigella flexneri 2a str. 2457T
auacggaauaucgcug

SEQ ID NO: 1889121 - RNA, 17 nt, Shigella flexneri 2a str. 2457T
aguagcggccugaccgc

SEQ ID NO: 1889122 - RNA, 14 nt, Shigella flexneri 2a str. 2457T
aguacguucacgca

SEQ ID NO: 1889123 - RNA, 16 nt, Shigella flexneri 2a str. 2457T
aguacgccaucacgca

SEQ ID NO: 1889124 - RNA, 14 nt, Shigella flexneri 2a str. 2457T
agucaaugaaauua

SEQ ID NO: 1889125 - RNA, 14 nt, Shigella flexneri 2a str. 2457T
aguauuaagccagu

SEQ ID NO: 1889126 - RNA, 22 nt, Shigella flexneri 2a str. 2457T
aguccacgguugguuuuaucca

SEQ ID NO: 1889127 - RNA, 16 nt, Shigella flexneri 2a str. 2457T
agucgcgcaauugcca

SEQ ID NO: 1889128 - RNA, 22 nt, Shigella flexneri 2a str. 2457T
aguccuacacacgccagugcgc

SEQ ID NO: 1889129 - RNA, 22 nt, Shigella flexneri 2a str. 2457T
aguccggcugcgauauucggaa

SEQ ID NO: 1889130 - RNA, 15 nt, Shigella flexneri 2a str. 2457T
agucggcaucgccac

SEQ ID NO: 1889131 - RNA, 23 nt, Shigella flexneri 2a str. 2457T
agucgcuucaugcuuaaucaucg

SEQ ID NO: 1889132 - RNA, 16 nt, Shigella flexneri 2a str. 2457T
agucgcgccuuacgcu

SEQ ID NO: 1889133 - RNA, 16 nt, Shigella flexneri 2a str. 2457T
agucguaggccugaua

SEQ ID NO: 1889134 - RNA, 19 nt, Shigella flexneri 2a str. 2457T
agucgggauauucagcuca

SEQ ID NO: 1889135 - RNA, 21 nt, Shigella flexneri 2a str. 2457T
agucugaaugauguggucagc

SEQ ID NO: 1889136 - RNA, 21 nt, Shigella flexneri 2a str. 2457T
agucugaaugccgcuaccgcc

SEQ ID NO: 1889137 - RNA, 21 nt, Shigella flexneri 2a str. 2457T
agucucuucuuugcagggagg

SEQ ID NO: 1889138 - RNA, 15 nt, Shigella flexneri 2a str. 2457T
agucuggcuucgcug

SEQ ID NO: 1889139 - RNA, 14 nt, Shigella flexneri 2a str. 2457T
agucuggaagccag

SEQ ID NO: 1889140 - RNA, 19 nt, Shigella flexneri 2a str. 2457T
agugaauagcgcccggaaa

SEQ ID NO: 1889141 - RNA, 16 nt, Shigella flexneri 2a str. 2457T
agucuuuccccguuga

SEQ ID NO: 1889142 - RNA, 19 nt, Shigella flexneri 2a str. 2457T
agugcauaaauaccggcau

SEQ ID NO: 1889143 - RNA, 15 nt, Shigella flexneri 2a str. 2457T
agugauccagggcaa

SEQ ID NO: 1889144 - RNA, 20 nt, Shigella flexneri 2a str. 2457T
agugaguuuugcauucggau

SEQ ID NO: 1889145 - RNA, 19 nt, Shigella flexneri 2a str. 2457T
agugaggcuauuccacgca

SEQ ID NO: 1889146 - RNA, 12 nt, Shigella flexneri 2a str. 2457T
agugaccaauca

SEQ ID NO: 1889147 - RNA, 15 nt, Shigella flexneri 2a str. 2457T
aguggccacagauaa

SEQ ID NO: 1889148 - RNA, 21 nt, Shigella flexneri 2a str. 2457T
aguggacgaacaguucaacgc

SEQ ID NO: 1889149 - RNA, 20 nt, Shigella flexneri 2a str. 2457T
agugcugaguuucagaccaa

SEQ ID NO: 1889150 - RNA, 21 nt, Shigella flexneri 2a str. 2457T
agugcuaugcgccacggaagc

SEQ ID NO: 1889151 - RNA, 22 nt, Shigella flexneri 2a str. 2457T
agugcgcguuuuuuaugccgga

SEQ ID NO: 1889152 - RNA, 20 nt, Shigella flexneri 2a str. 2457T
aguucgcgaucgcgccagaa

SEQ ID NO: 1889153 - RNA, 14 nt, Shigella flexneri 2a str. 2457T
aguucacagcgcag

SEQ ID NO: 1889154 - RNA, 22 nt, Shigella flexneri 2a str. 2457T
aguucgaucucuucgccugccu

SEQ ID NO: 1889155 - RNA, 22 nt, Shigella flexneri 2a str. 2457T
aguuaguccacacgccaggcca

SEQ ID NO: 1889156 - RNA, 16 nt, Shigella flexneri 2a str. 2457T
aguuacccagccugca

SEQ ID NO: 1889157 - RNA, 15 nt, Shigella flexneri 2a str. 2457T
aguuaccacgccuug

SEQ ID NO: 1889158 - RNA, 23 nt, Shigella flexneri 2a str. 2457T
aguuaagcccaguucagcggcug

SEQ ID NO: 1889159 - RNA, 12 nt, Shigella flexneri 2a str. 2457T
aguguggcggcu

SEQ ID NO: 1889160 - RNA, 11 nt, Shigella flexneri 2a str. 2457T
aguggcgcauc

SEQ ID NO: 1889161 - RNA, 16 nt, Shigella flexneri 2a str. 2457T
acugcuggaagcuggc

SEQ ID NO: 1889162 - RNA, 14 nt, Shigella flexneri 2a str. 2457T
acugcugacgcaga

SEQ ID NO: 1889163 - RNA, 18 nt, Shigella flexneri 2a str. 2457T
acugcugcggaauugccg

SEQ ID NO: 1889164 - RNA, 14 nt, Shigella flexneri 2a str. 2457T
agaaauaccacccg

SEQ ID NO: 1889165 - RNA, 22 nt, Shigella flexneri 2a str. 2457T
agaaccucaacaggcuaccagc

SEQ ID NO: 1889166 - RNA, 11 nt, Shigella flexneri 2a str. 2457T
agaacggcaga

SEQ ID NO: 1889167 - RNA, 16 nt, Shigella flexneri 2a str. 2457T
agaacggauucaguga

SEQ ID NO: 1889168 - RNA, 21 nt, Shigella flexneri 2a str. 2457T
agaacugagcgccgucgcgaa

SEQ ID NO: 1889169 - RNA, 23 nt, Shigella flexneri 2a str. 2457T
agaagcguagguguuacgcggau

SEQ ID NO: 1889170 - RNA, 12 nt, Shigella flexneri 2a str. 2457T
agaagcaaucau

SEQ ID NO: 1889171 - RNA, 15 nt, Shigella flexneri 2a str. 2457T
agaauaauaccgucc

SEQ ID NO: 1889172 - RNA, 22 nt, Shigella flexneri 2a str. 2457T
agaauaccuugcugcuccagcg

SEQ ID NO: 1889173 - RNA, 13 nt, Shigella flexneri 2a str. 2457T
agaaugacgccau

SEQ ID NO: 1889174 - RNA, 18 nt, Shigella flexneri 2a str. 2457T
agaauccgcgacuggcau

SEQ ID NO: 1889175 - RNA, 19 nt, Shigella flexneri 2a str. 2457T
agaaucaggccauuacuac

SEQ ID NO: 1889176 - RNA, 19 nt, Shigella flexneri 2a str. 2457T
agaauaugcgccagcguua

SEQ ID NO: 1889177 - RNA, 18 nt, Shigella flexneri 2a str. 2457T
agaauaugcuuugccuua

SEQ ID NO: 1889178 - RNA, 12 nt, Shigella flexneri 2a str. 2457T
agacaucaaacc

SEQ ID NO: 1889179 - RNA, 14 nt, Shigella flexneri 2a str. 2457T
agacaucaccaaua

SEQ ID NO: 1889180 - RNA, 18 nt, Shigella flexneri 2a str. 2457T
agacaugcugacaaaaua

SEQ ID NO: 1889181 - RNA, 15 nt, Shigella flexneri 2a str. 2457T
agaccaaacagcaua

SEQ ID NO: 1889182 - RNA, 23 nt, Shigella flexneri 2a str. 2457T
agaccaaucccgccauaacggcu

SEQ ID NO: 1889183 - RNA, 15 nt, Shigella flexneri 2a str. 2457T
agacagcgucacauc

SEQ ID NO: 1889184 - RNA, 16 nt, Shigella flexneri 2a str. 2457T
agacacuaacgcgucu

SEQ ID NO: 1889185 - RNA, 16 nt, Shigella flexneri 2a str. 2457T
agaauuuguaggccgg

SEQ ID NO: 1889186 - RNA, 20 nt, Shigella flexneri 2a str. 2457T
agacaagaaguuccagggca

SEQ ID NO: 1889187 - RNA, 18 nt, Shigella flexneri 2a str. 2457T
agaauuagcguccggcug

SEQ ID NO: 1889188 - RNA, 21 nt, Shigella flexneri 2a str. 2457T
agacggcugucauccagcagc

SEQ ID NO: 1889189 - RNA, 14 nt, Shigella flexneri 2a str. 2457T
agacggugaccaga

SEQ ID NO: 1889190 - RNA, 14 nt, Shigella flexneri 2a str. 2457T
agacugaauacgcu

SEQ ID NO: 1889191 - RNA, 13 nt, Shigella flexneri 2a str. 2457T
agagaagcaccgc

SEQ ID NO: 1889192 - RNA, 16 nt, Shigella flexneri 2a str. 2457T
agagaacugcgccaga

SEQ ID NO: 1889193 - RNA, 13 nt, Shigella flexneri 2a str. 2457T
agacugauauccc

SEQ ID NO: 1889194 - RNA, 22 nt, Shigella flexneri 2a str. 2457T
agauagcugucccagucuuucc

SEQ ID NO: 1889195 - RNA, 16 nt, Shigella flexneri 2a str. 2457T
agauacaaccaaucgc

SEQ ID NO: 1889196 - RNA, 15 nt, Shigella flexneri 2a str. 2457T
agauacaucagcgac

SEQ ID NO: 1889197 - RNA, 23 nt, Shigella flexneri 2a str. 2457T
agauaaggcguucacgccgcauc

SEQ ID NO: 1889198 - RNA, 18 nt, Shigella flexneri 2a str. 2457T
agagugacgacgcugacg

SEQ ID NO: 1889199 - RNA, 20 nt, Shigella flexneri 2a str. 2457T
agagugacuucgccgugaaa

SEQ ID NO: 1889200 - RNA, 16 nt, Shigella flexneri 2a str. 2457T
agaguuccaacgcagc

SEQ ID NO: 1889201 - RNA, 15 nt, Shigella flexneri 2a str. 2457T
agagcggagcaauga

SEQ ID NO: 1889202 - RNA, 17 nt, Shigella flexneri 2a str. 2457T
agaccauugcaucaucg

SEQ ID NO: 1889203 - RNA, 18 nt, Shigella flexneri 2a str. 2457T
agaccagauuaaucagca

SEQ ID NO: 1889204 - RNA, 14 nt, Shigella flexneri 2a str. 2457T
agacgccaucaauu

SEQ ID NO: 1889205 - RNA, 21 nt, Shigella flexneri 2a str. 2457T
agacgcgacaagcgucgcauc

SEQ ID NO: 1889206 - RNA, 13 nt, Shigella flexneri 2a str. 2457T
agacgccacaauc

SEQ ID NO: 1889207 - RNA, 21 nt, Shigella flexneri 2a str. 2457T
agacgcgaccggcgucgcauc

SEQ ID NO: 1889208 - RNA, 20 nt, Shigella flexneri 2a str. 2457T
agacgcgccagcgucgcauc

SEQ ID NO: 1889209 - RNA, 20 nt, Shigella flexneri 2a str. 2457T
agacgcggcagcgucgcauc

SEQ ID NO: 1889210 - RNA, 20 nt, Shigella flexneri 2a str. 2457T
agacgcguuagcaucgcauc

SEQ ID NO: 1889211 - RNA, 21 nt, Shigella flexneri 2a str. 2457T
agacgcgucaagcgucgcauc

SEQ ID NO: 1889212 - RNA, 16 nt, Shigella flexneri 2a str. 2457T
agcagcugaccgccgu

SEQ ID NO: 1889213 - RNA, 14 nt, Shigella flexneri 2a str. 2457T
agcaggauguuccg

SEQ ID NO: 1889214 - RNA, 16 nt, Shigella flexneri 2a str. 2457T
agcaggaugccugaug

SEQ ID NO: 1889215 - RNA, 23 nt, Shigella flexneri 2a str. 2457T
agcaguuacuccgauuaccggca

SEQ ID NO: 1889216 - RNA, 18 nt, Shigella flexneri 2a str. 2457T
agcaguugcuucaucuca

SEQ ID NO: 1889217 - RNA, 22 nt, Shigella flexneri 2a str. 2457T
agcaucuguucuuuuaacgcau

SEQ ID NO: 1889218 - RNA, 21 nt, Shigella flexneri 2a str. 2457T
agcauuggguaaaauggccga

SEQ ID NO: 1889219 - RNA, 13 nt, Shigella flexneri 2a str. 2457T
agcauuuaagcau

SEQ ID NO: 1889220 - RNA, 21 nt, Shigella flexneri 2a str. 2457T
agcaccugcuugaacgcaccg

SEQ ID NO: 1889221 - RNA, 14 nt, Shigella flexneri 2a str. 2457T
agcaccaccgcccg

SEQ ID NO: 1889222 - RNA, 22 nt, Shigella flexneri 2a str. 2457T
agcacgauuuguaggccggaua

SEQ ID NO: 1889223 - RNA, 17 nt, Shigella flexneri 2a str. 2457T
agcacuucacccaucgc

SEQ ID NO: 1889224 - RNA, 15 nt, Shigella flexneri 2a str. 2457T
agcacuggcggcagc

SEQ ID NO: 1889225 - RNA, 13 nt, Shigella flexneri 2a str. 2457T
agcacuggcggca

SEQ ID NO: 1889226 - RNA, 15 nt, Shigella flexneri 2a str. 2457T
agauugauccccgcu

SEQ ID NO: 1889227 - RNA, 21 nt, Shigella flexneri 2a str. 2457T
agauccuggcgaaaacgcccg

SEQ ID NO: 1889228 - RNA, 15 nt, Shigella flexneri 2a str. 2457T
agauuuauuuaccgc

SEQ ID NO: 1889229 - RNA, 13 nt, Shigella flexneri 2a str. 2457T
agcaaaacgcccc

SEQ ID NO: 1889230 - RNA, 17 nt, Shigella flexneri 2a str. 2457T
agcaaaaauaagcgacg

SEQ ID NO: 1889231 - RNA, 17 nt, Shigella flexneri 2a str. 2457T
agcaaacaguucugcag

SEQ ID NO: 1889232 - RNA, 15 nt, Shigella flexneri 2a str. 2457T
agcacaaucacguca

SEQ ID NO: 1889233 - RNA, 22 nt, Shigella flexneri 2a str. 2457T
agcaaacgaaagcagggcggca

SEQ ID NO: 1889234 - RNA, 19 nt, Shigella flexneri 2a str. 2457T
agcaagucggcaucgccac

SEQ ID NO: 1889235 - RNA, 19 nt, Shigella flexneri 2a str. 2457T
agcaaggguuuguaggccg

SEQ ID NO: 1889236 - RNA, 18 nt, Shigella flexneri 2a str. 2457T
agcaagccgucgugaaug

SEQ ID NO: 1889237 - RNA, 19 nt, Shigella flexneri 2a str. 2457T
agcggcaggaaaaaagcgc

SEQ ID NO: 1889238 - RNA, 12 nt, Shigella flexneri 2a str. 2457T
agcggcggcaaa

SEQ ID NO: 1889239 - RNA, 13 nt, Shigella flexneri 2a str. 2457T
agcgucagccaga

SEQ ID NO: 1889240 - RNA, 14 nt, Shigella flexneri 2a str. 2457T
agcgucauuucuac

SEQ ID NO: 1889241 - RNA, 21 nt, Shigella flexneri 2a str. 2457T
agcguccacagccaacacauu

SEQ ID NO: 1889242 - RNA, 17 nt, Shigella flexneri 2a str. 2457T
agcgucagcaccagaga

SEQ ID NO: 1889243 - RNA, 13 nt, Shigella flexneri 2a str. 2457T
agcgucacaucag

SEQ ID NO: 1889244 - RNA, 15 nt, Shigella flexneri 2a str. 2457T
agcgguuuucaaaga

SEQ ID NO: 1889245 - RNA, 13 nt, Shigella flexneri 2a str. 2457T
agcguauucagca

SEQ ID NO: 1889246 - RNA, 16 nt, Shigella flexneri 2a str. 2457T
agcguauucagcaauu

SEQ ID NO: 1889247 - RNA, 22 nt, Shigella flexneri 2a str. 2457T
agcguagcgcaucaggcaguuu

SEQ ID NO: 1889248 - RNA, 14 nt, Shigella flexneri 2a str. 2457T
agcguagcgcauca

SEQ ID NO: 1889249 - RNA, 17 nt, Shigella flexneri 2a str. 2457T
agcguagcgcaucgggc

SEQ ID NO: 1889250 - RNA, 13 nt, Shigella flexneri 2a str. 2457T
agcguauccauca

SEQ ID NO: 1889251 - RNA, 24 nt, Shigella flexneri 2a str. 2457T
agcgcgucuggaacggcagaucca

SEQ ID NO: 1889252 - RNA, 15 nt, Shigella flexneri 2a str. 2457T
agcgcgcaguugcaa

SEQ ID NO: 1889253 - RNA, 16 nt, Shigella flexneri 2a str. 2457T
agcgccuaaauccacc

SEQ ID NO: 1889254 - RNA, 14 nt, Shigella flexneri 2a str. 2457T
agcgcaaauugcug

SEQ ID NO: 1889255 - RNA, 24 nt, Shigella flexneri 2a str. 2457T
agcgcaaaacgcaggauccacgcc

SEQ ID NO: 1889256 - RNA, 18 nt, Shigella flexneri 2a str. 2457T
agcgauuuguaggccuga

SEQ ID NO: 1889257 - RNA, 20 nt, Shigella flexneri 2a str. 2457T
agcgauuuguaggccugaua

SEQ ID NO: 1889258 - RNA, 20 nt, Shigella flexneri 2a str. 2457T
agcgauucucgccgcccuga

SEQ ID NO: 1889259 - RNA, 19 nt, Shigella flexneri 2a str. 2457T
agcgaugcccagugaccaa

SEQ ID NO: 1889260 - RNA, 18 nt, Shigella flexneri 2a str. 2457T
agcgagagcaaugcgcau

SEQ ID NO: 1889261 - RNA, 14 nt, Shigella flexneri 2a str. 2457T
agccgccacgaccu

SEQ ID NO: 1889262 - RNA, 19 nt, Shigella flexneri 2a str. 2457T
agccggaugaucauccggc

SEQ ID NO: 1889263 - RNA, 15 nt, Shigella flexneri 2a str. 2457T
agccggaugccucuc

SEQ ID NO: 1889264 - RNA, 18 nt, Shigella flexneri 2a str. 2457T
agccaccucaacggcaau

SEQ ID NO: 1889265 - RNA, 18 nt, Shigella flexneri 2a str. 2457T
agccugcaaacgcuggug

SEQ ID NO: 1889266 - RNA, 18 nt, Shigella flexneri 2a str. 2457T
agcgaaaacgaauacgcc

SEQ ID NO: 1889267 - RNA, 14 nt, Shigella flexneri 2a str. 2457T
agccuggcuggauu

SEQ ID NO: 1889268 - RNA, 19 nt, Shigella flexneri 2a str. 2457T
uaaaauucaucaaauggca

SEQ ID NO: 1889269 - RNA, 13 nt, Shigella flexneri 2a str. 2457T
guuuccagcacca

SEQ ID NO: 1889270 - RNA, 20 nt, Shigella flexneri 2a str. 2457T
guuucaccgcacgacgaauc

SEQ ID NO: 1889271 - RNA, 20 nt, Shigella flexneri 2a str. 2457T
guuucauaucugccagauaa

SEQ ID NO: 1889272 - RNA, 13 nt, Shigella flexneri 2a str. 2457T
uaaaguuagucgc

SEQ ID NO: 1889273 - RNA, 16 nt, Shigella flexneri 2a str. 2457T
uaaaguaggccagaua

SEQ ID NO: 1889274 - RNA, 20 nt, Shigella flexneri 2a str. 2457T
uaaagccgugcugcugccaa

SEQ ID NO: 1889275 - RNA, 16 nt, Shigella flexneri 2a str. 2457T
uaaagccuuuuaccgc

SEQ ID NO: 1889276 - RNA, 14 nt, Shigella flexneri 2a str. 2457T
uaaagcggcggugu

SEQ ID NO: 1889277 - RNA, 22 nt, Shigella flexneri 2a str. 2457T
uaaacugagccaaacgcccagc

SEQ ID NO: 1889278 - RNA, 17 nt, Shigella flexneri 2a str. 2457T
uaaacagcgcugcgaaa

SEQ ID NO: 1889279 - RNA, 21 nt, Shigella flexneri 2a str. 2457T
uaaauauugucgauacgccuc

SEQ ID NO: 1889280 - RNA, 20 nt, Shigella flexneri 2a str. 2457T
uaaaugccuuauccggccua

SEQ ID NO: 1889281 - RNA, 19 nt, Shigella flexneri 2a str. 2457T
uaaaugaacucaacgccuu

SEQ ID NO: 1889282 - RNA, 22 nt, Shigella flexneri 2a str. 2457T
uaaaucgggcgguguuggggca

SEQ ID NO: 1889283 - RNA, 14 nt, Shigella flexneri 2a str. 2457T
uaaaucccgccauu

SEQ ID NO: 1889284 - RNA, 20 nt, Shigella flexneri 2a str. 2457T
uaaaucagaacuucgcguug

SEQ ID NO: 1889285 - RNA, 22 nt, Shigella flexneri 2a str. 2457T
uaaauccccggcggcguucagu

SEQ ID NO: 1889286 - RNA, 14 nt, Shigella flexneri 2a str. 2457T
uaaauugcgccaga

SEQ ID NO: 1889287 - RNA, 15 nt, Shigella flexneri 2a str. 2457T
uaaauuaucaacuau

SEQ ID NO: 1889288 - RNA, 15 nt, Shigella flexneri 2a str. 2457T
uaaccuggcaguucg

SEQ ID NO: 1889289 - RNA, 14 nt, Shigella flexneri 2a str. 2457T
uaaccguugaccag

SEQ ID NO: 1889290 - RNA, 14 nt, Shigella flexneri 2a str. 2457T
uaaccguccaguug

SEQ ID NO: 1889291 - RNA, 18 nt, Shigella flexneri 2a str. 2457T
uaacacuucaucacuacc

SEQ ID NO: 1889292 - RNA, 11 nt, Shigella flexneri 2a str. 2457T
uaaugacucca

SEQ ID NO: 1889293 - RNA, 18 nt, Shigella flexneri 2a str. 2457T
uaaucuuccagaucaccg

SEQ ID NO: 1889294 - RNA, 16 nt, Shigella flexneri 2a str. 2457T
uaaucgagauaccuaa

SEQ ID NO: 1889295 - RNA, 17 nt, Shigella flexneri 2a str. 2457T
uaaucgauaaaccagca

SEQ ID NO: 1889296 - RNA, 17 nt, Shigella flexneri 2a str. 2457T
uaaucgcauugacgcca

SEQ ID NO: 1889297 - RNA, 19 nt, Shigella flexneri 2a str. 2457T
uaaugcagaucuuacggcu

SEQ ID NO: 1889298 - RNA, 11 nt, Shigella flexneri 2a str. 2457T
uaaugccggau

SEQ ID NO: 1889299 - RNA, 16 nt, Shigella flexneri 2a str. 2457T
uaaugcugucgguuua

SEQ ID NO: 1889300 - RNA, 22 nt, Shigella flexneri 2a str. 2457T
uaaugguccgugacccggaaua

SEQ ID NO: 1889301 - RNA, 11 nt, Shigella flexneri 2a str. 2457T
uaauucagccg

SEQ ID NO: 1889302 - RNA, 13 nt, Shigella flexneri 2a str. 2457T
uaagcugaugacg

SEQ ID NO: 1889303 - RNA, 16 nt, Shigella flexneri 2a str. 2457T
uaagcucagaaacgcu

SEQ ID NO: 1889304 - RNA, 16 nt, Shigella flexneri 2a str. 2457T
uaagcguaagcgcauc

SEQ ID NO: 1889305 - RNA, 19 nt, Shigella flexneri 2a str. 2457T
uaagcguagcgcaucaggc

SEQ ID NO: 1889306 - RNA, 17 nt, Shigella flexneri 2a str. 2457T
uaaggcauuuacgccgc

SEQ ID NO: 1889307 - RNA, 12 nt, Shigella flexneri 2a str. 2457T
uaaguuuaaccu

SEQ ID NO: 1889308 - RNA, 23 nt, Shigella flexneri 2a str. 2457T
uaauaaagcggcucauugccauu

SEQ ID NO: 1889309 - RNA, 14 nt, Shigella flexneri 2a str. 2457T
uaauaaacaucagc

SEQ ID NO: 1889310 - RNA, 16 nt, Shigella flexneri 2a str. 2457T
uaauacgcaucgacau

SEQ ID NO: 1889311 - RNA, 12 nt, Shigella flexneri 2a str. 2457T
uaauacgccaga

SEQ ID NO: 1889312 - RNA, 17 nt, Shigella flexneri 2a str. 2457T
uaauacccuugcagacg

SEQ ID NO: 1889313 - RNA, 11 nt, Shigella flexneri 2a str. 2457T
uaauaccggau

SEQ ID NO: 1889314 - RNA, 23 nt, Shigella flexneri 2a str. 2457T
uaauaagguaauuauuguaagcu

SEQ ID NO: 1889315 - RNA, 14 nt, Shigella flexneri 2a str. 2457T
uaaccuucaccgug

SEQ ID NO: 1889316 - RNA, 20 nt, Shigella flexneri 2a str. 2457T
uaacgaacgcagugauaacu

SEQ ID NO: 1889317 - RNA, 23 nt, Shigella flexneri 2a str. 2457T
uaagacgcgacaagcgucgcauc

SEQ ID NO: 1889318 - RNA, 18 nt, Shigella flexneri 2a str. 2457T
uaagacuggcaaaugaca

SEQ ID NO: 1889319 - RNA, 20 nt, Shigella flexneri 2a str. 2457T
uaagaguagcccgauacgcu

SEQ ID NO: 1889320 - RNA, 21 nt, Shigella flexneri 2a str. 2457T
uaagagauggaaugagcaucu

SEQ ID NO: 1889321 - RNA, 14 nt, Shigella flexneri 2a str. 2457T
uaagcaacugacug

SEQ ID NO: 1889322 - RNA, 13 nt, Shigella flexneri 2a str. 2457T
uaagauucagccc

SEQ ID NO: 1889323 - RNA, 14 nt, Shigella flexneri 2a str. 2457T
guuuaccgccauca

SEQ ID NO: 1889324 - RNA, 20 nt, Shigella flexneri 2a str. 2457T
guuuacgccgcauccggcau

SEQ ID NO: 1889325 - RNA, 23 nt, Shigella flexneri 2a str. 2457T
guuuacccuucgcacgcgaacaa

SEQ ID NO: 1889326 - RNA, 20 nt, Shigella flexneri 2a str. 2457T
guuuaauaugcaauucacac

SEQ ID NO: 1889327 - RNA, 21 nt, Shigella flexneri 2a str. 2457T
guuuaacacgcucuggcaggc

SEQ ID NO: 1889328 - RNA, 22 nt, Shigella flexneri 2a str. 2457T
guuuaacuaccguguucagcgu

SEQ ID NO: 1889329 - RNA, 20 nt, Shigella flexneri 2a str. 2457T
guugucgauaaacaguuucg

SEQ ID NO: 1889330 - RNA, 12 nt, Shigella flexneri 2a str. 2457T
guugucgauaaa

SEQ ID NO: 1889331 - RNA, 16 nt, Shigella flexneri 2a str. 2457T
guuguccucgccguuu

SEQ ID NO: 1889332 - RNA, 21 nt, Shigella flexneri 2a str. 2457T
guuggcggugccaucgauaau

SEQ ID NO: 1889333 - RNA, 12 nt, Shigella flexneri 2a str. 2457T
guugcuucaucu

SEQ ID NO: 1889334 - RNA, 14 nt, Shigella flexneri 2a str. 2457T
guugcugucgacaa

SEQ ID NO: 1889335 - RNA, 15 nt, Shigella flexneri 2a str. 2457T
guugcuuuucacaac

SEQ ID NO: 1889336 - RNA, 21 nt, Shigella flexneri 2a str. 2457T
guugagagguaaaaccugaca

SEQ ID NO: 1889337 - RNA, 15 nt, Shigella flexneri 2a str. 2457T
guugagcggcaguaa

SEQ ID NO: 1889338 - RNA, 14 nt, Shigella flexneri 2a str. 2457T
guuauugaucgcca

SEQ ID NO: 1889339 - RNA, 12 nt, Shigella flexneri 2a str. 2457T
guucaacaguaa

SEQ ID NO: 1889340 - RNA, 18 nt, Shigella flexneri 2a str. 2457T
guucgagcaucacaucaa

SEQ ID NO: 1889341 - RNA, 21 nt, Shigella flexneri 2a str. 2457T
guucgauauccaguccgcgcu

SEQ ID NO: 1889342 - RNA, 22 nt, Shigella flexneri 2a str. 2457T
guucgcaaagguuuuaccgcac

SEQ ID NO: 1889343 - RNA, 21 nt, Shigella flexneri 2a str. 2457T
guucgcguacugcugaccguu

SEQ ID NO: 1889344 - RNA, 22 nt, Shigella flexneri 2a str. 2457T
guucgcgaaaguuaccgcgcca

SEQ ID NO: 1889345 - RNA, 20 nt, Shigella flexneri 2a str. 2457T
guucgugacgucucaaucac

SEQ ID NO: 1889346 - RNA, 18 nt, Shigella flexneri 2a str. 2457T
guugacguucaugccggu

SEQ ID NO: 1889347 - RNA, 22 nt, Shigella flexneri 2a str. 2457T
guucugcagcguuagacgcguu

SEQ ID NO: 1889348 - RNA, 18 nt, Shigella flexneri 2a str. 2457T
guucugcgacgcgcggug

SEQ ID NO: 1889349 - RNA, 16 nt, Shigella flexneri 2a str. 2457T
guucuggcgcgaacag

SEQ ID NO: 1889350 - RNA, 20 nt, Shigella flexneri 2a str. 2457T
guuaaaacuuuccaugccau

SEQ ID NO: 1889351 - RNA, 14 nt, Shigella flexneri 2a str. 2457T
guuaaccagcacca

SEQ ID NO: 1889352 - RNA, 13 nt, Shigella flexneri 2a str. 2457T
guuaacagcgcau

SEQ ID NO: 1889353 - RNA, 16 nt, Shigella flexneri 2a str. 2457T
guguucucaucgccau

SEQ ID NO: 1889354 - RNA, 14 nt, Shigella flexneri 2a str. 2457T
guuaacguuuuucg

SEQ ID NO: 1889355 - RNA, 20 nt, Shigella flexneri 2a str. 2457T
guuaacgccuuauccggccu

SEQ ID NO: 1889356 - RNA, 14 nt, Shigella flexneri 2a str. 2457T
guuaaugcccauca

SEQ ID NO: 1889357 - RNA, 20 nt, Shigella flexneri 2a str. 2457T
guuaauggcuuuacgcgcca

SEQ ID NO: 1889358 - RNA, 22 nt, Shigella flexneri 2a str. 2457T
guuacaaucugcgcuggaacaa

SEQ ID NO: 1889359 - RNA, 21 nt, Shigella flexneri 2a str. 2457T
guuacaacauccuauauuccu

SEQ ID NO: 1889360 - RNA, 14 nt, Shigella flexneri 2a str. 2457T
guuacagcuggagu

SEQ ID NO: 1889361 - RNA, 16 nt, Shigella flexneri 2a str. 2457T
guucaaaguuaccgga

SEQ ID NO: 1889362 - RNA, 18 nt, Shigella flexneri 2a str. 2457T
guuauuaaaaagccugcc

SEQ ID NO: 1889363 - RNA, 14 nt, Shigella flexneri 2a str. 2457T
guuaugugaguuga

SEQ ID NO: 1889364 - RNA, 20 nt, Shigella flexneri 2a str. 2457T
guuauuaaauaaccagcgca

SEQ ID NO: 1889365 - RNA, 15 nt, Shigella flexneri 2a str. 2457T
guuaccgaucgccag

SEQ ID NO: 1889366 - RNA, 15 nt, Shigella flexneri 2a str. 2457T
aaguguggccgccag

SEQ ID NO: 1889367 - RNA, 19 nt, Shigella flexneri 2a str. 2457T
guggguauauuucaggcca

SEQ ID NO: 1889368 - RNA, 15 nt, Shigella flexneri 2a str. 2457T
guguuaucaaaucac

SEQ ID NO: 1889369 - RNA, 22 nt, Shigella flexneri 2a str. 2457T
guguuacgcggaucgagaaucu

SEQ ID NO: 1889370 - RNA, 24 nt, Shigella flexneri 2a str. 2457T
guguuagcccugucgaggccaauu

SEQ ID NO: 1889371 - RNA, 19 nt, Shigella flexneri 2a str. 2457T
guguuaaaugauaccgggc

SEQ ID NO: 1889372 - RNA, 14 nt, Shigella flexneri 2a str. 2457T
guguagcgcaucac

SEQ ID NO: 1889373 - RNA, 18 nt, Shigella flexneri 2a str. 2457T
gugggaucacaucuucaa

SEQ ID NO: 1889374 - RNA, 16 nt, Shigella flexneri 2a str. 2457T
gugggcaggaaaauca

SEQ ID NO: 1889375 - RNA, 16 nt, Shigella flexneri 2a str. 2457T
guggcguggcgcucca

SEQ ID NO: 1889376 - RNA, 21 nt, Shigella flexneri 2a str. 2457T
guggcgauguaauucagccau

SEQ ID NO: 1889377 - RNA, 14 nt, Shigella flexneri 2a str. 2457T
gugcucauccuuca

SEQ ID NO: 1889378 - RNA, 20 nt, Shigella flexneri 2a str. 2457T
gugcucucaaauaucugccg

SEQ ID NO: 1889379 - RNA, 20 nt, Shigella flexneri 2a str. 2457T
gugcugaaaucacagcggcg

SEQ ID NO: 1889380 - RNA, 15 nt, Shigella flexneri 2a str. 2457T
gugcgguccaugcga

SEQ ID NO: 1889381 - RNA, 13 nt, Shigella flexneri 2a str. 2457T
gugcgcggcuuaa

SEQ ID NO: 1889382 - RNA, 16 nt, Shigella flexneri 2a str. 2457T
gugcgcgcccauacgg

SEQ ID NO: 1889383 - RNA, 18 nt, Shigella flexneri 2a str. 2457T
gugcgccacaaccguccu

SEQ ID NO: 1889384 - RNA, 22 nt, Shigella flexneri 2a str. 2457T
gugccggauuucauauccggca

SEQ ID NO: 1889385 - RNA, 19 nt, Shigella flexneri 2a str. 2457T
aagugauacccaucaucgc

SEQ ID NO: 1889386 - RNA, 23 nt, Shigella flexneri 2a str. 2457T
aagugagcuuuguucaugccgga

SEQ ID NO: 1889387 - RNA, 15 nt, Shigella flexneri 2a str. 2457T
gugauuuaucuucga

SEQ ID NO: 1889388 - RNA, 15 nt, Shigella flexneri 2a str. 2457T
gugauuaacgcgccg

SEQ ID NO: 1889389 - RNA, 17 nt, Shigella flexneri 2a str. 2457T
gugaugguaacgcgcca

SEQ ID NO: 1889390 - RNA, 16 nt, Shigella flexneri 2a str. 2457T
gugaucacccagacgc

SEQ ID NO: 1889391 - RNA, 22 nt, Shigella flexneri 2a str. 2457T
gugcaucaggcaaacuucacgc

SEQ ID NO: 1889392 - RNA, 15 nt, Shigella flexneri 2a str. 2457T
gugcaaaugccagau

SEQ ID NO: 1889393 - RNA, 22 nt, Shigella flexneri 2a str. 2457T
gugcacgauugccggaugcggc

SEQ ID NO: 1889394 - RNA, 16 nt, Shigella flexneri 2a str. 2457T
gugcagcacggagaga

SEQ ID NO: 1889395 - RNA, 16 nt, Shigella flexneri 2a str. 2457T
gugcagcaugcacccu

SEQ ID NO: 1889396 - RNA, 18 nt, Shigella flexneri 2a str. 2457T
gugcacuuugucaauaau

SEQ ID NO: 1889397 - RNA, 19 nt, Shigella flexneri 2a str. 2457T
ucacucccuuucugccacg

SEQ ID NO: 1889398 - RNA, 16 nt, Shigella flexneri 2a str. 2457T
ucacuccggccagagc

SEQ ID NO: 1889399 - RNA, 16 nt, Shigella flexneri 2a str. 2457T
ucacuccagccagagc

SEQ ID NO: 1889400 - RNA, 21 nt, Shigella flexneri 2a str. 2457T
ucacgucaggaucgugcggca

SEQ ID NO: 1889401 - RNA, 14 nt, Shigella flexneri 2a str. 2457T
ucacgcgccagaga

SEQ ID NO: 1889402 - RNA, 14 nt, Shigella flexneri 2a str. 2457T
ucacgaucacagca

SEQ ID NO: 1889403 - RNA, 18 nt, Shigella flexneri 2a str. 2457T
ucacgccgcauccggcag

SEQ ID NO: 1889404 - RNA, 18 nt, Shigella flexneri 2a str. 2457T
ucacgccgcauccggcau

SEQ ID NO: 1889405 - RNA, 20 nt, Shigella flexneri 2a str. 2457T
ucagcaaucugaagccgcac

SEQ ID NO: 1889406 - RNA, 16 nt, Shigella flexneri 2a str. 2457T
ucagcaaggaaagcca

SEQ ID NO: 1889407 - RNA, 13 nt, Shigella flexneri 2a str. 2457T
ucagcaaucucuu

SEQ ID NO: 1889408 - RNA, 14 nt, Shigella flexneri 2a str. 2457T
ucagcaaauccauc

SEQ ID NO: 1889409 - RNA, 15 nt, Shigella flexneri 2a str. 2457T
ucagcaacuguaacg

SEQ ID NO: 1889410 - RNA, 17 nt, Shigella flexneri 2a str. 2457T
ucagacuuaagccuguu

SEQ ID NO: 1889411 - RNA, 13 nt, Shigella flexneri 2a str. 2457T
ucacugggcgauu

SEQ ID NO: 1889412 - RNA, 21 nt, Shigella flexneri 2a str. 2457T
ucacugccguacaggcagcuu

SEQ ID NO: 1889413 - RNA, 14 nt, Shigella flexneri 2a str. 2457T
aauacagccagcca

SEQ ID NO: 1889414 - RNA, 17 nt, Shigella flexneri 2a str. 2457T
aauacagguccccgcuu

SEQ ID NO: 1889415 - RNA, 23 nt, Shigella flexneri 2a str. 2457T
aauacaaaugccucuuucauccg

SEQ ID NO: 1889416 - RNA, 20 nt, Shigella flexneri 2a str. 2457T
aauacaaggccaauccagcc

SEQ ID NO: 1889417 - RNA, 12 nt, Shigella flexneri 2a str. 2457T
ucagcgcagaca

SEQ ID NO: 1889418 - RNA, 20 nt, Shigella flexneri 2a str. 2457T
ucagcagauaucccgccagc

SEQ ID NO: 1889419 - RNA, 15 nt, Shigella flexneri 2a str. 2457T
ucacccccguuaacc

SEQ ID NO: 1889420 - RNA, 19 nt, Shigella flexneri 2a str. 2457T
ucaccccacaccaccguuu

SEQ ID NO: 1889421 - RNA, 13 nt, Shigella flexneri 2a str. 2457T
ucacccgcaauca

SEQ ID NO: 1889422 - RNA, 14 nt, Shigella flexneri 2a str. 2457T
ucacgaauccgcac

SEQ ID NO: 1889423 - RNA, 15 nt, Shigella flexneri 2a str. 2457T
ucacgaaucgccgca

SEQ ID NO: 1889424 - RNA, 19 nt, Shigella flexneri 2a str. 2457T
ucaccggcuucucgccuac

SEQ ID NO: 1889425 - RNA, 19 nt, Shigella flexneri 2a str. 2457T
ucaccgguucggccauauc

SEQ ID NO: 1889426 - RNA, 22 nt, Shigella flexneri 2a str. 2457T
ucaccacugacgggaaacucug

SEQ ID NO: 1889427 - RNA, 21 nt, Shigella flexneri 2a str. 2457T
ucaccauccacggacugaacg

SEQ ID NO: 1889428 - RNA, 14 nt, Shigella flexneri 2a str. 2457T
ucaccaucgccauu

SEQ ID NO: 1889429 - RNA, 16 nt, Shigella flexneri 2a str. 2457T
ucaccagcaaauccag

SEQ ID NO: 1889430 - RNA, 18 nt, Shigella flexneri 2a str. 2457T
ucaccagcugacguagca

SEQ ID NO: 1889431 - RNA, 20 nt, Shigella flexneri 2a str. 2457T
ucaaccacuuuaucgagaau

SEQ ID NO: 1889432 - RNA, 16 nt, Shigella flexneri 2a str. 2457T
ucaacgccaucgccag

SEQ ID NO: 1889433 - RNA, 21 nt, Shigella flexneri 2a str. 2457T
ucacaccauugauaauccauc

SEQ ID NO: 1889434 - RNA, 18 nt, Shigella flexneri 2a str. 2457T
ucaacggcaucguccauu

SEQ ID NO: 1889435 - RNA, 22 nt, Shigella flexneri 2a str. 2457T
ucaacggcggcuuguacgccgc

SEQ ID NO: 1889436 - RNA, 14 nt, Shigella flexneri 2a str. 2457T
ucacaucgcuaccg

SEQ ID NO: 1889437 - RNA, 15 nt, Shigella flexneri 2a str. 2457T
ucacaucagcgcauu

SEQ ID NO: 1889438 - RNA, 16 nt, Shigella flexneri 2a str. 2457T
ucacaggccgccaggc

SEQ ID NO: 1889439 - RNA, 19 nt, Shigella flexneri 2a str. 2457T
ucacagguucgaaucccgu

SEQ ID NO: 1889440 - RNA, 17 nt, Shigella flexneri 2a str. 2457T
ucacauuuuuaagccgu

SEQ ID NO: 1889441 - RNA, 20 nt, Shigella flexneri 2a str. 2457T
uccacgccgcugucuaccag

SEQ ID NO: 1889442 - RNA, 18 nt, Shigella flexneri 2a str. 2457T
uccacgcugcaucgccaa

SEQ ID NO: 1889443 - RNA, 13 nt, Shigella flexneri 2a str. 2457T
uccacgccugcau

SEQ ID NO: 1889444 - RNA, 13 nt, Shigella flexneri 2a str. 2457T
uccagcgccugaa

SEQ ID NO: 1889445 - RNA, 23 nt, Shigella flexneri 2a str. 2457T
uccagccagucggaaccggcgau

SEQ ID NO: 1889446 - RNA, 21 nt, Shigella flexneri 2a str. 2457T
uccagccacggcuccagcaau

SEQ ID NO: 1889447 - RNA, 19 nt, Shigella flexneri 2a str. 2457T
uccagcuucagauucagcg

SEQ ID NO: 1889448 - RNA, 23 nt, Shigella flexneri 2a str. 2457T
uccagcuuauuagggaucaucuu

SEQ ID NO: 1889449 - RNA, 20 nt, Shigella flexneri 2a str. 2457T
uccagcuuuuuaaucgccau

SEQ ID NO: 1889450 - RNA, 19 nt, Shigella flexneri 2a str. 2457T
uccacauuuuccaucacga

SEQ ID NO: 1889451 - RNA, 18 nt, Shigella flexneri 2a str. 2457T
uccacgaaacggcguuga

SEQ ID NO: 1889452 - RNA, 12 nt, Shigella flexneri 2a str. 2457T
ucaugccggaug

SEQ ID NO: 1889453 - RNA, 22 nt, Shigella flexneri 2a str. 2457T
ucaugacgauacggaauaucgc

SEQ ID NO: 1889454 - RNA, 13 nt, Shigella flexneri 2a str. 2457T
uccaacaggcgag

SEQ ID NO: 1889455 - RNA, 23 nt, Shigella flexneri 2a str. 2457T
ucaucggcguugcccaucgccac

SEQ ID NO: 1889456 - RNA, 22 nt, Shigella flexneri 2a str. 2457T
ucaucccgaucaaacgccgaug

SEQ ID NO: 1889457 - RNA, 15 nt, Shigella flexneri 2a str. 2457T
ucaucaccaucaggc

SEQ ID NO: 1889458 - RNA, 14 nt, Shigella flexneri 2a str. 2457T
ucaucaaugccagc

SEQ ID NO: 1889459 - RNA, 14 nt, Shigella flexneri 2a str. 2457T
ucaucaccagaauc

SEQ ID NO: 1889460 - RNA, 20 nt, Shigella flexneri 2a str. 2457T
ucauaucugccagauaaugg

SEQ ID NO: 1889461 - RNA, 14 nt, Shigella flexneri 2a str. 2457T
ucaguuccaguuca

SEQ ID NO: 1889462 - RNA, 19 nt, Shigella flexneri 2a str. 2457T
ucaguguuggauggcggcu

SEQ ID NO: 1889463 - RNA, 15 nt, Shigella flexneri 2a str. 2457T
ucagugagcacaucu

SEQ ID NO: 1889464 - RNA, 21 nt, Shigella flexneri 2a str. 2457T
ucagucucaaaccggcuccag

SEQ ID NO: 1889465 - RNA, 15 nt, Shigella flexneri 2a str. 2457T
ucagugcaaaugcca

SEQ ID NO: 1889466 - RNA, 13 nt, Shigella flexneri 2a str. 2457T
ucaguaaugacug

SEQ ID NO: 1889467 - RNA, 15 nt, Shigella flexneri 2a str. 2457T
ucaguacaccaccua

SEQ ID NO: 1889468 - RNA, 18 nt, Shigella flexneri 2a str. 2457T
ucaguacguucacgcagc

SEQ ID NO: 1889469 - RNA, 16 nt, Shigella flexneri 2a str. 2457T
ucaguagaauaaucug

SEQ ID NO: 1889470 - RNA, 18 nt, Shigella flexneri 2a str. 2457T
ucaggcggcuucgucguu

SEQ ID NO: 1889471 - RNA, 13 nt, Shigella flexneri 2a str. 2457T
ucagggcgcuggc

SEQ ID NO: 1889472 - RNA, 16 nt, Shigella flexneri 2a str. 2457T
ucagggccgaucaacg

SEQ ID NO: 1889473 - RNA, 15 nt, Shigella flexneri 2a str. 2457T
uaccgaucaccgaug

SEQ ID NO: 1889474 - RNA, 13 nt, Shigella flexneri 2a str. 2457T
uaccgaucaccga

SEQ ID NO: 1889475 - RNA, 13 nt, Shigella flexneri 2a str. 2457T
uaccgaucgccag

SEQ ID NO: 1889476 - RNA, 19 nt, Shigella flexneri 2a str. 2457T
uaccgcaccuuccggaaua

SEQ ID NO: 1889477 - RNA, 17 nt, Shigella flexneri 2a str. 2457T
uaccgacauaugcuuaa

SEQ ID NO: 1889478 - RNA, 22 nt, Shigella flexneri 2a str. 2457T
uaccauuaaucgauaaaccagc

SEQ ID NO: 1889479 - RNA, 14 nt, Shigella flexneri 2a str. 2457T
uaccauuucaccgu

SEQ ID NO: 1889480 - RNA, 16 nt, Shigella flexneri 2a str. 2457T
uaccaucuucaccgcc

SEQ ID NO: 1889481 - RNA, 11 nt, Shigella flexneri 2a str. 2457T
uaccaucaggu

SEQ ID NO: 1889482 - RNA, 18 nt, Shigella flexneri 2a str. 2457T
uaccauggcucaccagca

SEQ ID NO: 1889483 - RNA, 16 nt, Shigella flexneri 2a str. 2457T
uaccauuugcauagcg

SEQ ID NO: 1889484 - RNA, 20 nt, Shigella flexneri 2a str. 2457T
uacaaaguguuguucuagcg

SEQ ID NO: 1889485 - RNA, 21 nt, Shigella flexneri 2a str. 2457T
uacaaagggcuaacgugcagg

SEQ ID NO: 1889486 - RNA, 12 nt, Shigella flexneri 2a str. 2457T
uaccgucaccga

SEQ ID NO: 1889487 - RNA, 15 nt, Shigella flexneri 2a str. 2457T
uaccgugcacaauau

SEQ ID NO: 1889488 - RNA, 17 nt, Shigella flexneri 2a str. 2457T
uaccgugaaucaccaca

SEQ ID NO: 1889489 - RNA, 18 nt, Shigella flexneri 2a str. 2457T
uaccgugcuguacagcag

SEQ ID NO: 1889490 - RNA, 14 nt, Shigella flexneri 2a str. 2457T
uaccguugcggcgu

SEQ ID NO: 1889491 - RNA, 17 nt, Shigella flexneri 2a str. 2457T
uaccgguuucaauccag

SEQ ID NO: 1889492 - RNA, 19 nt, Shigella flexneri 2a str. 2457T
uaccgccucgcggcagcag

SEQ ID NO: 1889493 - RNA, 16 nt, Shigella flexneri 2a str. 2457T
uaccgcuguccacgcc

SEQ ID NO: 1889494 - RNA, 14 nt, Shigella flexneri 2a str. 2457T
uaccgcuccgggua

SEQ ID NO: 1889495 - RNA, 14 nt, Shigella flexneri 2a str. 2457T
uacgccaucgccag

SEQ ID NO: 1889496 - RNA, 15 nt, Shigella flexneri 2a str. 2457T
uacgccaucgccagc

SEQ ID NO: 1889497 - RNA, 18 nt, Shigella flexneri 2a str. 2457T
uacgcccgucaacggugc

SEQ ID NO: 1889498 - RNA, 16 nt, Shigella flexneri 2a str. 2457T
uacgccgagcgccagc

SEQ ID NO: 1889499 - RNA, 17 nt, Shigella flexneri 2a str. 2457T
uacgccggugucauggc

SEQ ID NO: 1889500 - RNA, 20 nt, Shigella flexneri 2a str. 2457T
uaccuaaggaauccagcgac

SEQ ID NO: 1889501 - RNA, 12 nt, Shigella flexneri 2a str. 2457T
uaccugacagca

SEQ ID NO: 1889502 - RNA, 17 nt, Shigella flexneri 2a str. 2457T
uaccugacagcagagca

SEQ ID NO: 1889503 - RNA, 18 nt, Shigella flexneri 2a str. 2457T
uaccugcuuaaucauauu

SEQ ID NO: 1889504 - RNA, 21 nt, Shigella flexneri 2a str. 2457T
uaccuguguuuugcaucaacu

SEQ ID NO: 1889505 - RNA, 16 nt, Shigella flexneri 2a str. 2457T
uaccuuccugccagau

SEQ ID NO: 1889506 - RNA, 13 nt, Shigella flexneri 2a str. 2457T
uaccuuaaccguu

SEQ ID NO: 1889507 - RNA, 14 nt, Shigella flexneri 2a str. 2457T
uagcaguuccagca

SEQ ID NO: 1889508 - RNA, 22 nt, Shigella flexneri 2a str. 2457T
uagccgcgcaguuucuuaccua

SEQ ID NO: 1889509 - RNA, 13 nt, Shigella flexneri 2a str. 2457T
uagccgcgcaguu

SEQ ID NO: 1889510 - RNA, 14 nt, Shigella flexneri 2a str. 2457T
uagccagccucauc

SEQ ID NO: 1889511 - RNA, 14 nt, Shigella flexneri 2a str. 2457T
uagcgccuucuaca

SEQ ID NO: 1889512 - RNA, 21 nt, Shigella flexneri 2a str. 2457T
uagcggcgguaaaaucauccu

SEQ ID NO: 1889513 - RNA, 15 nt, Shigella flexneri 2a str. 2457T
uagcgucguggcaaa

SEQ ID NO: 1889514 - RNA, 24 nt, Shigella flexneri 2a str. 2457T
uagcgcauaugcuuugccgucauc

SEQ ID NO: 1889515 - RNA, 15 nt, Shigella flexneri 2a str. 2457T
uagcgcaucaggcaa

SEQ ID NO: 1889516 - RNA, 18 nt, Shigella flexneri 2a str. 2457T
uagcgauaaaugucggca

SEQ ID NO: 1889517 - RNA, 22 nt, Shigella flexneri 2a str. 2457T
uagagagcagucagguucagcg

SEQ ID NO: 1889518 - RNA, 22 nt, Shigella flexneri 2a str. 2457T
uagaacaaaagaccugaccaga

SEQ ID NO: 1889519 - RNA, 15 nt, Shigella flexneri 2a str. 2457T
uagaacccuaccagc

SEQ ID NO: 1889520 - RNA, 17 nt, Shigella flexneri 2a str. 2457T
uagaaccuugcuggcga

SEQ ID NO: 1889521 - RNA, 15 nt, Shigella flexneri 2a str. 2457T
uagagcaaccaccug

SEQ ID NO: 1889522 - RNA, 16 nt, Shigella flexneri 2a str. 2457T
uacuggcaaucgccag

SEQ ID NO: 1889523 - RNA, 16 nt, Shigella flexneri 2a str. 2457T
uacuggcagauuaugc

SEQ ID NO: 1889524 - RNA, 13 nt, Shigella flexneri 2a str. 2457T
uacucugacccag

SEQ ID NO: 1889525 - RNA, 13 nt, Shigella flexneri 2a str. 2457T
uauaaacaacggc

SEQ ID NO: 1889526 - RNA, 19 nt, Shigella flexneri 2a str. 2457T
uaguuuugccgacuggcgc

SEQ ID NO: 1889527 - RNA, 14 nt, Shigella flexneri 2a str. 2457T
uaucacauccagcg

SEQ ID NO: 1889528 - RNA, 23 nt, Shigella flexneri 2a str. 2457T
uaucaccuggagccaguuggcgu

SEQ ID NO: 1889529 - RNA, 16 nt, Shigella flexneri 2a str. 2457T
uaucacaaauucuggc

SEQ ID NO: 1889530 - RNA, 21 nt, Shigella flexneri 2a str. 2457T
uaucaucauuugcauacccag

SEQ ID NO: 1889531 - RNA, 14 nt, Shigella flexneri 2a str. 2457T
uaucaaucaccgcu

SEQ ID NO: 1889532 - RNA, 20 nt, Shigella flexneri 2a str. 2457T
uaucaaacgugacauucuga

SEQ ID NO: 1889533 - RNA, 20 nt, Shigella flexneri 2a str. 2457T
uauccugucaguucguuuua

SEQ ID NO: 1889534 - RNA, 19 nt, Shigella flexneri 2a str. 2457T
uaucauugccgguuggcga

SEQ ID NO: 1889535 - RNA, 21 nt, Shigella flexneri 2a str. 2457T
uauccacgucgacaacucccg

SEQ ID NO: 1889536 - RNA, 14 nt, Shigella flexneri 2a str. 2457T
uauccacugucaaa

SEQ ID NO: 1889537 - RNA, 20 nt, Shigella flexneri 2a str. 2457T
uagucacgguaguuagccgg

SEQ ID NO: 1889538 - RNA, 20 nt, Shigella flexneri 2a str. 2457T
uaguauuugaguucacugcc

SEQ ID NO: 1889539 - RNA, 12 nt, Shigella flexneri 2a str. 2457T
uagcuucagccg

SEQ ID NO: 1889540 - RNA, 13 nt, Shigella flexneri 2a str. 2457T
uagcuuuacccaa

SEQ ID NO: 1889541 - RNA, 15 nt, Shigella flexneri 2a str. 2457T
uagcuucaccgcauc

SEQ ID NO: 1889542 - RNA, 15 nt, Shigella flexneri 2a str. 2457T
uagugaaaucgccaa

SEQ ID NO: 1889543 - RNA, 16 nt, Shigella flexneri 2a str. 2457T
uaguuccacuauuuca

SEQ ID NO: 1889544 - RNA, 14 nt, Shigella flexneri 2a str. 2457T
uagugaaaucgcca

SEQ ID NO: 1889545 - RNA, 18 nt, Shigella flexneri 2a str. 2457T
ucaacaaaauagaauccg

SEQ ID NO: 1889546 - RNA, 12 nt, Shigella flexneri 2a str. 2457T
ucaaaaauggcu

SEQ ID NO: 1889547 - RNA, 16 nt, Shigella flexneri 2a str. 2457T
ucaaaacguccggcaa

SEQ ID NO: 1889548 - RNA, 14 nt, Shigella flexneri 2a str. 2457T
ucaacaucgcguug

SEQ ID NO: 1889549 - RNA, 15 nt, Shigella flexneri 2a str. 2457T
ucaacauggacgcaa

SEQ ID NO: 1889550 - RNA, 19 nt, Shigella flexneri 2a str. 2457T
ucaacagggcagacauucg

SEQ ID NO: 1889551 - RNA, 20 nt, Shigella flexneri 2a str. 2457T
ucaacaccuguugcgcgucg

SEQ ID NO: 1889552 - RNA, 17 nt, Shigella flexneri 2a str. 2457T
uauuuuuaaccguauuu

SEQ ID NO: 1889553 - RNA, 12 nt, Shigella flexneri 2a str. 2457T
uauucagcagca

SEQ ID NO: 1889554 - RNA, 14 nt, Shigella flexneri 2a str. 2457T
uauggugguaacua

SEQ ID NO: 1889555 - RNA, 20 nt, Shigella flexneri 2a str. 2457T
uaugggcgaauaaaaagccu

SEQ ID NO: 1889556 - RNA, 13 nt, Shigella flexneri 2a str. 2457T
uauguaccgucau

SEQ ID NO: 1889557 - RNA, 14 nt, Shigella flexneri 2a str. 2457T
uaucgcucggcaga

SEQ ID NO: 1889558 - RNA, 13 nt, Shigella flexneri 2a str. 2457T
uaucgcuggccuc

SEQ ID NO: 1889559 - RNA, 16 nt, Shigella flexneri 2a str. 2457T
uaucgaucacauccag

SEQ ID NO: 1889560 - RNA, 22 nt, Shigella flexneri 2a str. 2457T
uaucgauaaauggcgcauccag

SEQ ID NO: 1889561 - RNA, 13 nt, Shigella flexneri 2a str. 2457T
uaugcgccacagg

SEQ ID NO: 1889562 - RNA, 15 nt, Shigella flexneri 2a str. 2457T
uaugccggaugcgga

SEQ ID NO: 1889563 - RNA, 18 nt, Shigella flexneri 2a str. 2457T
uaucggagaacaggaaua

SEQ ID NO: 1889564 - RNA, 11 nt, Shigella flexneri 2a str. 2457T
uaugccggaua

SEQ ID NO: 1889565 - RNA, 13 nt, Shigella flexneri 2a str. 2457T
ugauaauccauca

SEQ ID NO: 1889566 - RNA, 17 nt, Shigella flexneri 2a str. 2457T
ugauaauuagugcugcu

SEQ ID NO: 1889567 - RNA, 15 nt, Shigella flexneri 2a str. 2457T
ugauacaggcgcugu

SEQ ID NO: 1889568 - RNA, 12 nt, Shigella flexneri 2a str. 2457T
ugauacaacgac

SEQ ID NO: 1889569 - RNA, 21 nt, Shigella flexneri 2a str. 2457T
ugaguuuacgcagcagauugc

SEQ ID NO: 1889570 - RNA, 14 nt, Shigella flexneri 2a str. 2457T
ugacgugucuuauc

SEQ ID NO: 1889571 - RNA, 21 nt, Shigella flexneri 2a str. 2457T
ugacgugucuuaucaggccua

SEQ ID NO: 1889572 - RNA, 21 nt, Shigella flexneri 2a str. 2457T
ugacucuccccguuuuccggg

SEQ ID NO: 1889573 - RNA, 13 nt, Shigella flexneri 2a str. 2457T
ugacucgccugaa

SEQ ID NO: 1889574 - RNA, 17 nt, Shigella flexneri 2a str. 2457T
ugacuauccuggacuuu

SEQ ID NO: 1889575 - RNA, 13 nt, Shigella flexneri 2a str. 2457T
ugagcgacaucuu

SEQ ID NO: 1889576 - RNA, 13 nt, Shigella flexneri 2a str. 2457T
ugagcuucucgau

SEQ ID NO: 1889577 - RNA, 15 nt, Shigella flexneri 2a str. 2457T
ugagcggacugaacg

SEQ ID NO: 1889578 - RNA, 14 nt, Shigella flexneri 2a str. 2457T
ugaucgcuuucagu

SEQ ID NO: 1889579 - RNA, 19 nt, Shigella flexneri 2a str. 2457T
ugaucgcgccgccgcccau

SEQ ID NO: 1889580 - RNA, 13 nt, Shigella flexneri 2a str. 2457T
ugaucgauccacg

SEQ ID NO: 1889581 - RNA, 15 nt, Shigella flexneri 2a str. 2457T
ugaucaacagcauca

SEQ ID NO: 1889582 - RNA, 18 nt, Shigella flexneri 2a str. 2457T
ugaugacguaauccgccu

SEQ ID NO: 1889583 - RNA, 19 nt, Shigella flexneri 2a str. 2457T
ugaugacuugccuccagcg

SEQ ID NO: 1889584 - RNA, 23 nt, Shigella flexneri 2a str. 2457T
ugaugagggcgcuaaaugccgcg

SEQ ID NO: 1889585 - RNA, 11 nt, Shigella flexneri 2a str. 2457T
ugaugaccaga

SEQ ID NO: 1889586 - RNA, 15 nt, Shigella flexneri 2a str. 2457T
ugaucuggcgcguua

SEQ ID NO: 1889587 - RNA, 18 nt, Shigella flexneri 2a str. 2457T
ugaccgcgaguaaucaca

SEQ ID NO: 1889588 - RNA, 21 nt, Shigella flexneri 2a str. 2457T
ugaccgaaccuguuuucaccg

SEQ ID NO: 1889589 - RNA, 20 nt, Shigella flexneri 2a str. 2457T
ugaacgccuuauccgaccua

SEQ ID NO: 1889590 - RNA, 20 nt, Shigella flexneri 2a str. 2457T
ugaacgccuaauccagccua

SEQ ID NO: 1889591 - RNA, 15 nt, Shigella flexneri 2a str. 2457T
ugacgaaggucgagg

SEQ ID NO: 1889592 - RNA, 14 nt, Shigella flexneri 2a str. 2457T
ugaccgucuuucau

SEQ ID NO: 1889593 - RNA, 14 nt, Shigella flexneri 2a str. 2457T
ugacgcauacagcc

SEQ ID NO: 1889594 - RNA, 16 nt, Shigella flexneri 2a str. 2457T
ugacgcauccgaucgc

SEQ ID NO: 1889595 - RNA, 19 nt, Shigella flexneri 2a str. 2457T
ugacgccuuuaccgcgcau

SEQ ID NO: 1889596 - RNA, 20 nt, Shigella flexneri 2a str. 2457T
ugacgcgucuuaucuggccu

SEQ ID NO: 1889597 - RNA, 14 nt, Shigella flexneri 2a str. 2457T
ugacgcgucuuauc

SEQ ID NO: 1889598 - RNA, 21 nt, Shigella flexneri 2a str. 2457T
ugacgcgucuuaucaggccua

SEQ ID NO: 1889599 - RNA, 16 nt, Shigella flexneri 2a str. 2457T
ugacgcgucuuaucag

SEQ ID NO: 1889600 - RNA, 19 nt, Shigella flexneri 2a str. 2457T
ugacggaaaucauccagca

SEQ ID NO: 1889601 - RNA, 14 nt, Shigella flexneri 2a str. 2457T
ugcagcuccaccga

SEQ ID NO: 1889602 - RNA, 20 nt, Shigella flexneri 2a str. 2457T
ugcagcuuucccuucaggcg

SEQ ID NO: 1889603 - RNA, 20 nt, Shigella flexneri 2a str. 2457T
ugcaggccagauaaggcguu

SEQ ID NO: 1889604 - RNA, 16 nt, Shigella flexneri 2a str. 2457T
ugcagcccguaagcaa

SEQ ID NO: 1889605 - RNA, 14 nt, Shigella flexneri 2a str. 2457T
ugcagcaucaccgg

SEQ ID NO: 1889606 - RNA, 20 nt, Shigella flexneri 2a str. 2457T
ugcagcaguauuaacgccau

SEQ ID NO: 1889607 - RNA, 20 nt, Shigella flexneri 2a str. 2457T
ugcagaguauccaugcgcau

SEQ ID NO: 1889608 - RNA, 20 nt, Shigella flexneri 2a str. 2457T
ugcagacaugacgcccggca

SEQ ID NO: 1889609 - RNA, 13 nt, Shigella flexneri 2a str. 2457T
ugcacgucauacu

SEQ ID NO: 1889610 - RNA, 20 nt, Shigella flexneri 2a str. 2457T
ugcacguccgguggcauccg

SEQ ID NO: 1889611 - RNA, 19 nt, Shigella flexneri 2a str. 2457T
ugcacggagauauccagcg

SEQ ID NO: 1889612 - RNA, 21 nt, Shigella flexneri 2a str. 2457T
ugcacgcagacacugcugaua

SEQ ID NO: 1889613 - RNA, 21 nt, Shigella flexneri 2a str. 2457T
ugcacgcagaucgguugccau

SEQ ID NO: 1889614 - RNA, 17 nt, Shigella flexneri 2a str. 2457T
ugcacgauauaccgugc

SEQ ID NO: 1889615 - RNA, 18 nt, Shigella flexneri 2a str. 2457T
ugcaccauaugagcggaa

SEQ ID NO: 1889616 - RNA, 14 nt, Shigella flexneri 2a str. 2457T
ugauggcuggcuuc

SEQ ID NO: 1889617 - RNA, 18 nt, Shigella flexneri 2a str. 2457T
ugaugcggcgcuuucagc

SEQ ID NO: 1889618 - RNA, 16 nt, Shigella flexneri 2a str. 2457T
ugcccgccccggcgau

SEQ ID NO: 1889619 - RNA, 20 nt, Shigella flexneri 2a str. 2457T
ugcccgcgagcguggaacuu

SEQ ID NO: 1889620 - RNA, 16 nt, Shigella flexneri 2a str. 2457T
ugcccgcgauccagcg

SEQ ID NO: 1889621 - RNA, 18 nt, Shigella flexneri 2a str. 2457T
ugcccggcaaaauagagu

SEQ ID NO: 1889622 - RNA, 18 nt, Shigella flexneri 2a str. 2457T
ugcccggucgggugcuca

SEQ ID NO: 1889623 - RNA, 16 nt, Shigella flexneri 2a str. 2457T
ugccaucgggcaaaau

SEQ ID NO: 1889624 - RNA, 22 nt, Shigella flexneri 2a str. 2457T
ugccagacuucaucggcgguga

SEQ ID NO: 1889625 - RNA, 19 nt, Shigella flexneri 2a str. 2457T
ugccagaccuuaucacaau

SEQ ID NO: 1889626 - RNA, 21 nt, Shigella flexneri 2a str. 2457T
ugccagaucaucguuuccgau

SEQ ID NO: 1889627 - RNA, 21 nt, Shigella flexneri 2a str. 2457T
ugccagaaagcguauccauca

SEQ ID NO: 1889628 - RNA, 16 nt, Shigella flexneri 2a str. 2457T
ugcauacaguacgugu

SEQ ID NO: 1889629 - RNA, 17 nt, Shigella flexneri 2a str. 2457T
ugcauaauuucuucguu

SEQ ID NO: 1889630 - RNA, 15 nt, Shigella flexneri 2a str. 2457T
ugcaguuaucugccg

SEQ ID NO: 1889631 - RNA, 21 nt, Shigella flexneri 2a str. 2457T
ucugcugcugcguuccggcau

SEQ ID NO: 1889632 - RNA, 19 nt, Shigella flexneri 2a str. 2457T
ucugcuucgccugagcggc

SEQ ID NO: 1889633 - RNA, 21 nt, Shigella flexneri 2a str. 2457T
ucugcgccuuuuuucgccgca

SEQ ID NO: 1889634 - RNA, 22 nt, Shigella flexneri 2a str. 2457T
ucuggccgcuuccagcauuucu

SEQ ID NO: 1889635 - RNA, 19 nt, Shigella flexneri 2a str. 2457T
ucuuucccggcaaucaccg

SEQ ID NO: 1889636 - RNA, 15 nt, Shigella flexneri 2a str. 2457T
ucuuucccggcaauc

SEQ ID NO: 1889637 - RNA, 18 nt, Shigella flexneri 2a str. 2457T
ucuuugaugaaacaugau

SEQ ID NO: 1889638 - RNA, 15 nt, Shigella flexneri 2a str. 2457T
ugaaacucgaccagc

SEQ ID NO: 1889639 - RNA, 15 nt, Shigella flexneri 2a str. 2457T
ugaaagauaaucaca

SEQ ID NO: 1889640 - RNA, 21 nt, Shigella flexneri 2a str. 2457T
ugaaagauaaucacacagcgg

SEQ ID NO: 1889641 - RNA, 20 nt, Shigella flexneri 2a str. 2457T
ugaaaguuuaacuaccgugu

SEQ ID NO: 1889642 - RNA, 22 nt, Shigella flexneri 2a str. 2457T
ugaacgagaaaaugacgaugac

SEQ ID NO: 1889643 - RNA, 17 nt, Shigella flexneri 2a str. 2457T
ugaaccgugucgccauc

SEQ ID NO: 1889644 - RNA, 22 nt, Shigella flexneri 2a str. 2457T
ugaaaucguuugcauccagcuc

SEQ ID NO: 1889645 - RNA, 17 nt, Shigella flexneri 2a str. 2457T
ugaaaugaugucgcugu

SEQ ID NO: 1889646 - RNA, 14 nt, Shigella flexneri 2a str. 2457T
ugaaauauccagcg

SEQ ID NO: 1889647 - RNA, 22 nt, Shigella flexneri 2a str. 2457T
ugaaaugugguuucacuuucug

SEQ ID NO: 1889648 - RNA, 14 nt, Shigella flexneri 2a str. 2457T
ugaacacguaauuc

SEQ ID NO: 1889649 - RNA, 17 nt, Shigella flexneri 2a str. 2457T
ugaacaccuucucaggc

SEQ ID NO: 1889650 - RNA, 21 nt, Shigella flexneri 2a str. 2457T
ugaaauucuccuuucuuucug

SEQ ID NO: 1889651 - RNA, 12 nt, Shigella flexneri 2a str. 2457T
ugaacaaagcgc

SEQ ID NO: 1889652 - RNA, 15 nt, Shigella flexneri 2a str. 2457T
ucucgccgcccugaa

SEQ ID NO: 1889653 - RNA, 17 nt, Shigella flexneri 2a str. 2457T
ucucggugaacgccugc

SEQ ID NO: 1889654 - RNA, 15 nt, Shigella flexneri 2a str. 2457T
ucucccagccgggua

SEQ ID NO: 1889655 - RNA, 12 nt, Shigella flexneri 2a str. 2457T
ucucccucgcuc

SEQ ID NO: 1889656 - RNA, 19 nt, Shigella flexneri 2a str. 2457T
ucucauccauucgaugaga

SEQ ID NO: 1889657 - RNA, 14 nt, Shigella flexneri 2a str. 2457T
ucucucuucagcuu

SEQ ID NO: 1889658 - RNA, 12 nt, Shigella flexneri 2a str. 2457T
ucugauaagccc

SEQ ID NO: 1889659 - RNA, 20 nt, Shigella flexneri 2a str. 2457T
ucugaaggauuagccggaua

SEQ ID NO: 1889660 - RNA, 20 nt, Shigella flexneri 2a str. 2457T
ucucuucaacacggcgcauu

SEQ ID NO: 1889661 - RNA, 16 nt, Shigella flexneri 2a str. 2457T
ucugcaaaaaugccuu

SEQ ID NO: 1889662 - RNA, 16 nt, Shigella flexneri 2a str. 2457T
ucugcaaaauaccaau

SEQ ID NO: 1889663 - RNA, 13 nt, Shigella flexneri 2a str. 2457T
ucugauugccgcu

SEQ ID NO: 1889664 - RNA, 15 nt, Shigella flexneri 2a str. 2457T
ucugcaucgcgcuga

SEQ ID NO: 1889665 - RNA, 12 nt, Shigella flexneri 2a str. 2457T
ucugccaaacgc

SEQ ID NO: 1889666 - RNA, 17 nt, Shigella flexneri 2a str. 2457T
ucugcccgagauacauc

SEQ ID NO: 1889667 - RNA, 12 nt, Shigella flexneri 2a str. 2457T
ucugccgcaauu

SEQ ID NO: 1889668 - RNA, 17 nt, Shigella flexneri 2a str. 2457T
ucugccuguccggcaua

SEQ ID NO: 1889669 - RNA, 20 nt, Shigella flexneri 2a str. 2457T
ucugccguaccaucgccagc

SEQ ID NO: 1889670 - RNA, 19 nt, Shigella flexneri 2a str. 2457T
ucugccguaccaucgccag

SEQ ID NO: 1889671 - RNA, 20 nt, Shigella flexneri 2a str. 2457T
ucgugaauaugucgcgccag

SEQ ID NO: 1889672 - RNA, 21 nt, Shigella flexneri 2a str. 2457T
ucgucuguuuuaucucccugu

SEQ ID NO: 1889673 - RNA, 16 nt, Shigella flexneri 2a str. 2457T
ucgguccgacgugcuc

SEQ ID NO: 1889674 - RNA, 20 nt, Shigella flexneri 2a str. 2457T
ucguaggccagauaaggcgu

SEQ ID NO: 1889675 - RNA, 14 nt, Shigella flexneri 2a str. 2457T
ucguaggccugaua

SEQ ID NO: 1889676 - RNA, 20 nt, Shigella flexneri 2a str. 2457T
ucguaggccugauaagacgc

SEQ ID NO: 1889677 - RNA, 22 nt, Shigella flexneri 2a str. 2457T
ucgucaaucagcgugaccaguu

SEQ ID NO: 1889678 - RNA, 16 nt, Shigella flexneri 2a str. 2457T
ucguccaugcugucgg

SEQ ID NO: 1889679 - RNA, 22 nt, Shigella flexneri 2a str. 2457T
ucgggcuuugcuacagccuggu

SEQ ID NO: 1889680 - RNA, 13 nt, Shigella flexneri 2a str. 2457T
ucggguaacggac

SEQ ID NO: 1889681 - RNA, 13 nt, Shigella flexneri 2a str. 2457T
ucgggaagaccug

SEQ ID NO: 1889682 - RNA, 17 nt, Shigella flexneri 2a str. 2457T
ucggcuucugccuuauc

SEQ ID NO: 1889683 - RNA, 22 nt, Shigella flexneri 2a str. 2457T
ucgggcacagauuuccaagcgc

SEQ ID NO: 1889684 - RNA, 14 nt, Shigella flexneri 2a str. 2457T
uccgcgaaggcggc

SEQ ID NO: 1889685 - RNA, 18 nt, Shigella flexneri 2a str. 2457T
uccgcccggcaauauucu

SEQ ID NO: 1889686 - RNA, 22 nt, Shigella flexneri 2a str. 2457T
uccgacaaauguguucagcgau

SEQ ID NO: 1889687 - RNA, 18 nt, Shigella flexneri 2a str. 2457T
ucccuggcccaucgccag

SEQ ID NO: 1889688 - RNA, 15 nt, Shigella flexneri 2a str. 2457T
ucccuggcgcuauca

SEQ ID NO: 1889689 - RNA, 19 nt, Shigella flexneri 2a str. 2457T
ucccugcgccagcggcagu

SEQ ID NO: 1889690 - RNA, 13 nt, Shigella flexneri 2a str. 2457T
uccggcgucgcuu

SEQ ID NO: 1889691 - RNA, 17 nt, Shigella flexneri 2a str. 2457T
uccggcgggcaaauucu

SEQ ID NO: 1889692 - RNA, 23 nt, Shigella flexneri 2a str. 2457T
uccggccuuccuguaucaggcug

SEQ ID NO: 1889693 - RNA, 24 nt, Shigella flexneri 2a str. 2457T
uccgguaauuuuuauauagccagc

SEQ ID NO: 1889694 - RNA, 17 nt, Shigella flexneri 2a str. 2457T
uccgcuuaucaggccua

SEQ ID NO: 1889695 - RNA, 21 nt, Shigella flexneri 2a str. 2457T
uccgcugauucaaaaccgguu

SEQ ID NO: 1889696 - RNA, 18 nt, Shigella flexneri 2a str. 2457T
uccgcucucauccauucg

SEQ ID NO: 1889697 - RNA, 21 nt, Shigella flexneri 2a str. 2457T
uccggcacuuacuuuccuuaa

SEQ ID NO: 1889698 - RNA, 21 nt, Shigella flexneri 2a str. 2457T
uccggcaauaagcaacgcgca

SEQ ID NO: 1889699 - RNA, 13 nt, Shigella flexneri 2a str. 2457T
uccggaucgccaa

SEQ ID NO: 1889700 - RNA, 15 nt, Shigella flexneri 2a str. 2457T
uccggcaaccaccgu

SEQ ID NO: 1889701 - RNA, 18 nt, Shigella flexneri 2a str. 2457T
ucccagaagguuucgccg

SEQ ID NO: 1889702 - RNA, 16 nt, Shigella flexneri 2a str. 2457T
ucccagcguggagagc

SEQ ID NO: 1889703 - RNA, 13 nt, Shigella flexneri 2a str. 2457T
ucccagccgggua

SEQ ID NO: 1889704 - RNA, 17 nt, Shigella flexneri 2a str. 2457T
ucccaguagugcuuuca

SEQ ID NO: 1889705 - RNA, 12 nt, Shigella flexneri 2a str. 2457T
ucccagucuuca

SEQ ID NO: 1889706 - RNA, 17 nt, Shigella flexneri 2a str. 2457T
ucccauaggaugagguu

SEQ ID NO: 1889707 - RNA, 23 nt, Shigella flexneri 2a str. 2457T
ucccagucacgcaacaugucagc

SEQ ID NO: 1889708 - RNA, 17 nt, Shigella flexneri 2a str. 2457T
ucccgccgcuggcggga

SEQ ID NO: 1889709 - RNA, 16 nt, Shigella flexneri 2a str. 2457T
ucccgugccagagcau

SEQ ID NO: 1889710 - RNA, 19 nt, Shigella flexneri 2a str. 2457T
ucccgcugacggcgauaaa

SEQ ID NO: 1889711 - RNA, 20 nt, Shigella flexneri 2a str. 2457T
ucccgcuucaacgaccgcuu

SEQ ID NO: 1889712 - RNA, 24 nt, Shigella flexneri 2a str. 2457T
ucccguacccagcaagaccgcgac

SEQ ID NO: 1889713 - RNA, 18 nt, Shigella flexneri 2a str. 2457T
uccugguuucuggucauu

SEQ ID NO: 1889714 - RNA, 23 nt, Shigella flexneri 2a str. 2457T
uccuuucgccgguagugucugga

SEQ ID NO: 1889715 - RNA, 19 nt, Shigella flexneri 2a str. 2457T
ucgaaaaacucuccucguu

SEQ ID NO: 1889716 - RNA, 13 nt, Shigella flexneri 2a str. 2457T
uccuggcgcuggg

SEQ ID NO: 1889717 - RNA, 23 nt, Shigella flexneri 2a str. 2457T
uccuggcgaaaacgcccggcauu

SEQ ID NO: 1889718 - RNA, 18 nt, Shigella flexneri 2a str. 2457T
uccuggcgaucgggcauu

SEQ ID NO: 1889719 - RNA, 18 nt, Shigella flexneri 2a str. 2457T
uccugacuccuguaucgu

SEQ ID NO: 1889720 - RNA, 21 nt, Shigella flexneri 2a str. 2457T
uccugcacggucacaucgcug

SEQ ID NO: 1889721 - RNA, 19 nt, Shigella flexneri 2a str. 2457T
uccugcaaauucaucgcug

SEQ ID NO: 1889722 - RNA, 19 nt, Shigella flexneri 2a str. 2457T
uccugccaguuauagcgca

SEQ ID NO: 1889723 - RNA, 15 nt, Shigella flexneri 2a str. 2457T
uccugcgcugcguag

SEQ ID NO: 1889724 - RNA, 17 nt, Shigella flexneri 2a str. 2457T
uccugcgcuuccagcuc

SEQ ID NO: 1889725 - RNA, 16 nt, Shigella flexneri 2a str. 2457T
uccugccgcaguuucu

SEQ ID NO: 1889726 - RNA, 18 nt, Shigella flexneri 2a str. 2457T
uccugcccacuccagcua

SEQ ID NO: 1889727 - RNA, 23 nt, Shigella flexneri 2a str. 2457T
uccgguuuacuuccgggaaaacc

SEQ ID NO: 1889728 - RNA, 14 nt, Shigella flexneri 2a str. 2457T
uccgguacgugcgu

SEQ ID NO: 1889729 - RNA, 19 nt, Shigella flexneri 2a str. 2457T
ucgagaaucacgucguucg

SEQ ID NO: 1889730 - RNA, 20 nt, Shigella flexneri 2a str. 2457T
ucgaccacuuuaaccagucg

SEQ ID NO: 1889731 - RNA, 21 nt, Shigella flexneri 2a str. 2457T
ucgaccaggccaucagcagcg

SEQ ID NO: 1889732 - RNA, 23 nt, Shigella flexneri 2a str. 2457T
ucgauaaaaccuuccucaccguu

SEQ ID NO: 1889733 - RNA, 14 nt, Shigella flexneri 2a str. 2457T
ucgauaaaccagca

SEQ ID NO: 1889734 - RNA, 16 nt, Shigella flexneri 2a str. 2457T
ucgcgaccaaucacac

SEQ ID NO: 1889735 - RNA, 15 nt, Shigella flexneri 2a str. 2457T
ucgcgaugaugcgac

SEQ ID NO: 1889736 - RNA, 16 nt, Shigella flexneri 2a str. 2457T
ucgcgcagcacuugca

SEQ ID NO: 1889737 - RNA, 21 nt, Shigella flexneri 2a str. 2457T
ucgccuaccaacgacauacuc

SEQ ID NO: 1889738 - RNA, 15 nt, Shigella flexneri 2a str. 2457T
ucgccuccagcgcug

SEQ ID NO: 1889739 - RNA, 18 nt, Shigella flexneri 2a str. 2457T
ucgccauuuugcgcggca

SEQ ID NO: 1889740 - RNA, 13 nt, Shigella flexneri 2a str. 2457T
ucgccagcggcag

SEQ ID NO: 1889741 - RNA, 14 nt, Shigella flexneri 2a str. 2457T
ucgccagcaucggc

SEQ ID NO: 1889742 - RNA, 20 nt, Shigella flexneri 2a str. 2457T
ucgcccguucauccgcuuca

SEQ ID NO: 1889743 - RNA, 23 nt, Shigella flexneri 2a str. 2457T
ucgcccguuucaaugauaagccu

SEQ ID NO: 1889744 - RNA, 20 nt, Shigella flexneri 2a str. 2457T
ucgccccgugaugaacugcg

SEQ ID NO: 1889745 - RNA, 16 nt, Shigella flexneri 2a str. 2457T
ucgcagguauaccgga

SEQ ID NO: 1889746 - RNA, 17 nt, Shigella flexneri 2a str. 2457T
ucgcaguagccaugcau

SEQ ID NO: 1889747 - RNA, 23 nt, Shigella flexneri 2a str. 2457T
ucgcaucccgguaucaaagcgcc

SEQ ID NO: 1889748 - RNA, 19 nt, Shigella flexneri 2a str. 2457T
ucgcaucaggcaucaugcu

SEQ ID NO: 1889749 - RNA, 14 nt, Shigella flexneri 2a str. 2457T
ucgcaucuggcaua

SEQ ID NO: 1889750 - RNA, 13 nt, Shigella flexneri 2a str. 2457T
ucgccaccggcac

SEQ ID NO: 1889751 - RNA, 15 nt, Shigella flexneri 2a str. 2457T
ucgcuuaccaugcca

SEQ ID NO: 1889752 - RNA, 23 nt, Shigella flexneri 2a str. 2457T
ucgcuuacccuaaauccgccauc

SEQ ID NO: 1889753 - RNA, 21 nt, Shigella flexneri 2a str. 2457T
ucgcugaauaccgauucccag

SEQ ID NO: 1889754 - RNA, 16 nt, Shigella flexneri 2a str. 2457T
ucgcugcgcggcagcu

SEQ ID NO: 1889755 - RNA, 12 nt, Shigella flexneri 2a str. 2457T
ucgcuucagccg

SEQ ID NO: 1889756 - RNA, 21 nt, Shigella flexneri 2a str. 2457T
ucgcuugaucuuccugauaac

SEQ ID NO: 1889757 - RNA, 23 nt, Shigella flexneri 2a str. 2457T
ucgcucacccagggaaaggauug

SEQ ID NO: 1889758 - RNA, 14 nt, Shigella flexneri 2a str. 2457T
ucgcguaaggcuuc

SEQ ID NO: 1889759 - RNA, 17 nt, Shigella flexneri 2a str. 2457T
ucgcguaguaaagccuu

SEQ ID NO: 1889760 - RNA, 23 nt, Shigella flexneri 2a str. 2457T
ucgcguaacugcugcucaaucug

SEQ ID NO: 1889761 - RNA, 17 nt, Shigella flexneri 2a str. 2457T
ucgcgguaaacugcaug

SEQ ID NO: 1889762 - RNA, 18 nt, Shigella flexneri 2a str. 2457T
ucgcgcccuccugcagcg

SEQ ID NO: 1889763 - RNA, 20 nt, Shigella flexneri 2a str. 2457T
aauaccguucauuaacgccc

SEQ ID NO: 1889764 - RNA, 19 nt, Shigella flexneri 2a str. 2457T
aauaccuucuuccugcgcc

SEQ ID NO: 1889765 - RNA, 17 nt, Shigella flexneri 2a str. 2457T
aauacgccggucacgcc

SEQ ID NO: 1889766 - RNA, 21 nt, Shigella flexneri 2a str. 2457T
aauaccggcgucccaucggca

SEQ ID NO: 1889767 - RNA, 14 nt, Shigella flexneri 2a str. 2457T
ucggcaaucacauc

SEQ ID NO: 1889768 - RNA, 16 nt, Shigella flexneri 2a str. 2457T
ucggcacugaccacuu

SEQ ID NO: 1889769 - RNA, 14 nt, Shigella flexneri 2a str. 2457T
ucggccagcguguu

SEQ ID NO: 1889770 - RNA, 15 nt, Shigella flexneri 2a str. 2457T
acccauuuauccagc

SEQ ID NO: 1889771 - RNA, 14 nt, Shigella flexneri 2a str. 2457T
accccacgucaucu

SEQ ID NO: 1889772 - RNA, 15 nt, Shigella flexneri 2a str. 2457T
acccccauccacgca

SEQ ID NO: 1889773 - RNA, 15 nt, Shigella flexneri 2a str. 2457T
accccgcagcaaccg

SEQ ID NO: 1889774 - RNA, 21 nt, Shigella flexneri 2a str. 2457T
accccgcaauuucauuauuca

SEQ ID NO: 1889775 - RNA, 12 nt, Shigella flexneri 2a str. 2457T
accaggcaaacc

SEQ ID NO: 1889776 - RNA, 19 nt, Shigella flexneri 2a str. 2457T
accaggaacgcgccaagau

SEQ ID NO: 1889777 - RNA, 23 nt, Shigella flexneri 2a str. 2457T
accaggaagauguacgccagugc

SEQ ID NO: 1889778 - RNA, 23 nt, Shigella flexneri 2a str. 2457T
acccagaagaaagccggaugauc

SEQ ID NO: 1889779 - RNA, 19 nt, Shigella flexneri 2a str. 2457T
acccagcaagaccgcgacc

SEQ ID NO: 1889780 - RNA, 12 nt, Shigella flexneri 2a str. 2457T
acccagcaaucc

SEQ ID NO: 1889781 - RNA, 15 nt, Shigella flexneri 2a str. 2457T
acccagcaccgcaga

SEQ ID NO: 1889782 - RNA, 16 nt, Shigella flexneri 2a str. 2457T
acccaggccugcccac

SEQ ID NO: 1889783 - RNA, 23 nt, Shigella flexneri 2a str. 2457T
acccaguuucggcaucagcagaa

SEQ ID NO: 1889784 - RNA, 18 nt, Shigella flexneri 2a str. 2457T
acccauguugaucgccac

SEQ ID NO: 1889785 - RNA, 20 nt, Shigella flexneri 2a str. 2457T
acccgcucauucguaaacga

SEQ ID NO: 1889786 - RNA, 14 nt, Shigella flexneri 2a str. 2457T
accccugauaaccg

SEQ ID NO: 1889787 - RNA, 18 nt, Shigella flexneri 2a str. 2457T
acccgucguugcaaucag

SEQ ID NO: 1889788 - RNA, 19 nt, Shigella flexneri 2a str. 2457T
acccucuccccagaagggc

SEQ ID NO: 1889789 - RNA, 21 nt, Shigella flexneri 2a str. 2457T
accgcgaaucauaacugccgu

SEQ ID NO: 1889790 - RNA, 17 nt, Shigella flexneri 2a str. 2457T
accgccugauaacgaau

SEQ ID NO: 1889791 - RNA, 12 nt, Shigella flexneri 2a str. 2457T
accgcgcauacg

SEQ ID NO: 1889792 - RNA, 18 nt, Shigella flexneri 2a str. 2457T
accgcaguaaucggcgaa

SEQ ID NO: 1889793 - RNA, 19 nt, Shigella flexneri 2a str. 2457T
accgcagcaucgucaucag

SEQ ID NO: 1889794 - RNA, 21 nt, Shigella flexneri 2a str. 2457T
accgcaucggcaucaaaccau

SEQ ID NO: 1889795 - RNA, 15 nt, Shigella flexneri 2a str. 2457T
accgccagcaucggc

SEQ ID NO: 1889796 - RNA, 12 nt, Shigella flexneri 2a str. 2457T
accgccgauacc

SEQ ID NO: 1889797 - RNA, 19 nt, Shigella flexneri 2a str. 2457T
accgggcucuuuucgaaaa

SEQ ID NO: 1889798 - RNA, 20 nt, Shigella flexneri 2a str. 2457T
accgguaaagaagagcggca

SEQ ID NO: 1889799 - RNA, 17 nt, Shigella flexneri 2a str. 2457T
accgggugcagagcccg

SEQ ID NO: 1889800 - RNA, 15 nt, Shigella flexneri 2a str. 2457T
accgcucaucgcccg

SEQ ID NO: 1889801 - RNA, 20 nt, Shigella flexneri 2a str. 2457T
accgcuucaacagcggcauu

SEQ ID NO: 1889802 - RNA, 22 nt, Shigella flexneri 2a str. 2457T
accgcucuucauacgcggcaga

SEQ ID NO: 1889803 - RNA, 21 nt, Shigella flexneri 2a str. 2457T
accaccuccacgcccagcgca

SEQ ID NO: 1889804 - RNA, 16 nt, Shigella flexneri 2a str. 2457T
accaaucucccagccg

SEQ ID NO: 1889805 - RNA, 12 nt, Shigella flexneri 2a str. 2457T
accaauccgcca

SEQ ID NO: 1889806 - RNA, 18 nt, Shigella flexneri 2a str. 2457T
accaaucacgucgcccac

SEQ ID NO: 1889807 - RNA, 15 nt, Shigella flexneri 2a str. 2457T
accacaucaaucccu

SEQ ID NO: 1889808 - RNA, 14 nt, Shigella flexneri 2a str. 2457T
accacagacaaaca

SEQ ID NO: 1889809 - RNA, 16 nt, Shigella flexneri 2a str. 2457T
accacacggucuauca

SEQ ID NO: 1889810 - RNA, 22 nt, Shigella flexneri 2a str. 2457T
accacaugaucauucaccagcc

SEQ ID NO: 1889811 - RNA, 17 nt, Shigella flexneri 2a str. 2457T
accaccaaaaacgccau

SEQ ID NO: 1889812 - RNA, 17 nt, Shigella flexneri 2a str. 2457T
accacccaccagcgccg

SEQ ID NO: 1889813 - RNA, 14 nt, Shigella flexneri 2a str. 2457T
accagcuccggcac

SEQ ID NO: 1889814 - RNA, 17 nt, Shigella flexneri 2a str. 2457T
accagcuuaugccuguc

SEQ ID NO: 1889815 - RNA, 12 nt, Shigella flexneri 2a str. 2457T
accagcggcuga

SEQ ID NO: 1889816 - RNA, 15 nt, Shigella flexneri 2a str. 2457T
accacucaccgccgu

SEQ ID NO: 1889817 - RNA, 12 nt, Shigella flexneri 2a str. 2457T
accacugauaag

SEQ ID NO: 1889818 - RNA, 15 nt, Shigella flexneri 2a str. 2457T
accacuucagaaccg

SEQ ID NO: 1889819 - RNA, 22 nt, Shigella flexneri 2a str. 2457T
accacuggcgauauugccgcga

SEQ ID NO: 1889820 - RNA, 14 nt, Shigella flexneri 2a str. 2457T
accagaaucgccag

SEQ ID NO: 1889821 - RNA, 17 nt, Shigella flexneri 2a str. 2457T
accagcagcauuucaaa

SEQ ID NO: 1889822 - RNA, 13 nt, Shigella flexneri 2a str. 2457T
accacuuuaacca

SEQ ID NO: 1889823 - RNA, 15 nt, Shigella flexneri 2a str. 2457T
acagucgcucggcga

SEQ ID NO: 1889824 - RNA, 18 nt, Shigella flexneri 2a str. 2457T
acaguacguguuguucca

SEQ ID NO: 1889825 - RNA, 17 nt, Shigella flexneri 2a str. 2457T
acaguuccgcaaagccc

SEQ ID NO: 1889826 - RNA, 14 nt, Shigella flexneri 2a str. 2457T
acagugauuacuaa

SEQ ID NO: 1889827 - RNA, 15 nt, Shigella flexneri 2a str. 2457T
acagugcaccggaca

SEQ ID NO: 1889828 - RNA, 14 nt, Shigella flexneri 2a str. 2457T
acaguuucaccugc

SEQ ID NO: 1889829 - RNA, 22 nt, Shigella flexneri 2a str. 2457T
acaguuuuaucuccauccggga

SEQ ID NO: 1889830 - RNA, 15 nt, Shigella flexneri 2a str. 2457T
acaucuccagcgcau

SEQ ID NO: 1889831 - RNA, 11 nt, Shigella flexneri 2a str. 2457T
acauccggcaa

SEQ ID NO: 1889832 - RNA, 17 nt, Shigella flexneri 2a str. 2457T
acauccggcaauauuca

SEQ ID NO: 1889833 - RNA, 11 nt, Shigella flexneri 2a str. 2457T
acauccggcuu

SEQ ID NO: 1889834 - RNA, 18 nt, Shigella flexneri 2a str. 2457T
acauccguggguugccag

SEQ ID NO: 1889835 - RNA, 22 nt, Shigella flexneri 2a str. 2457T
acauaccuaaaagcacgccaga

SEQ ID NO: 1889836 - RNA, 14 nt, Shigella flexneri 2a str. 2457T
acauaucagcgcaa

SEQ ID NO: 1889837 - RNA, 15 nt, Shigella flexneri 2a str. 2457T
acaugacgcgcauca

SEQ ID NO: 1889838 - RNA, 19 nt, Shigella flexneri 2a str. 2457T
acauuucugcugccuacac

SEQ ID NO: 1889839 - RNA, 20 nt, Shigella flexneri 2a str. 2457T
acauuuaaacaauuucagaa

SEQ ID NO: 1889840 - RNA, 19 nt, Shigella flexneri 2a str. 2457T
acauucgcgcacggugcau

SEQ ID NO: 1889841 - RNA, 14 nt, Shigella flexneri 2a str. 2457T
acauucuccggcag

SEQ ID NO: 1889842 - RNA, 14 nt, Shigella flexneri 2a str. 2457T
acauucugacuggu

SEQ ID NO: 1889843 - RNA, 13 nt, Shigella flexneri 2a str. 2457T
accaaacgggcaa

SEQ ID NO: 1889844 - RNA, 18 nt, Shigella flexneri 2a str. 2457T
accaacaauugucgccac

SEQ ID NO: 1889845 - RNA, 18 nt, Shigella flexneri 2a str. 2457T
accaauaucaacguaaug

SEQ ID NO: 1889846 - RNA, 16 nt, Shigella flexneri 2a str. 2457T
acaauccgcucuuuca

SEQ ID NO: 1889847 - RNA, 22 nt, Shigella flexneri 2a str. 2457T
acaauacgucggcaucgggcag

SEQ ID NO: 1889848 - RNA, 14 nt, Shigella flexneri 2a str. 2457T
acaauugccggaug

SEQ ID NO: 1889849 - RNA, 14 nt, Shigella flexneri 2a str. 2457T
acacaacgcuuuca

SEQ ID NO: 1889850 - RNA, 21 nt, Shigella flexneri 2a str. 2457T
acaacgcgcacuuugucuuca

SEQ ID NO: 1889851 - RNA, 11 nt, Shigella flexneri 2a str. 2457T
acaacgccgcc

SEQ ID NO: 1889852 - RNA, 15 nt, Shigella flexneri 2a str. 2457T
acaacugcugacgca

SEQ ID NO: 1889853 - RNA, 22 nt, Shigella flexneri 2a str. 2457T
acaacucgcuuaagccaucauc

SEQ ID NO: 1889854 - RNA, 19 nt, Shigella flexneri 2a str. 2457T
acaagcgauaacucgcuuu

SEQ ID NO: 1889855 - RNA, 15 nt, Shigella flexneri 2a str. 2457T
acaagcuaccagccc

SEQ ID NO: 1889856 - RNA, 23 nt, Shigella flexneri 2a str. 2457T
acaaguccgggauuaucccgcag

SEQ ID NO: 1889857 - RNA, 22 nt, Shigella flexneri 2a str. 2457T
acaaaaaaaacagcgcccaaca

SEQ ID NO: 1889858 - RNA, 13 nt, Shigella flexneri 2a str. 2457T
acaaaaccugccg

SEQ ID NO: 1889859 - RNA, 21 nt, Shigella flexneri 2a str. 2457T
acaaaacagcgaguucaggcg

SEQ ID NO: 1889860 - RNA, 22 nt, Shigella flexneri 2a str. 2457T
acaaaauuuucagcgugcccac

SEQ ID NO: 1889861 - RNA, 16 nt, Shigella flexneri 2a str. 2457T
acaaacuuaccgccgc

SEQ ID NO: 1889862 - RNA, 23 nt, Shigella flexneri 2a str. 2457T
aauguuuaucuacagcauuuccu

SEQ ID NO: 1889863 - RNA, 22 nt, Shigella flexneri 2a str. 2457T
aauguggcaaugaguggugaaa

SEQ ID NO: 1889864 - RNA, 14 nt, Shigella flexneri 2a str. 2457T
acaaagagcuuuca

SEQ ID NO: 1889865 - RNA, 15 nt, Shigella flexneri 2a str. 2457T
acaaagggcuaacgu

SEQ ID NO: 1889866 - RNA, 23 nt, Shigella flexneri 2a str. 2457T
acaacagaaauaaucgcaauuac

SEQ ID NO: 1889867 - RNA, 14 nt, Shigella flexneri 2a str. 2457T
acaaaugucacugc

SEQ ID NO: 1889868 - RNA, 13 nt, Shigella flexneri 2a str. 2457T
acaacccagcgga

SEQ ID NO: 1889869 - RNA, 18 nt, Shigella flexneri 2a str. 2457T
acaacccaagcgcgcugu

SEQ ID NO: 1889870 - RNA, 13 nt, Shigella flexneri 2a str. 2457T
acaacaucaucug

SEQ ID NO: 1889871 - RNA, 17 nt, Shigella flexneri 2a str. 2457T
acaacaucaucugccac

SEQ ID NO: 1889872 - RNA, 17 nt, Shigella flexneri 2a str. 2457T
acaccgugcauuucuca

SEQ ID NO: 1889873 - RNA, 15 nt, Shigella flexneri 2a str. 2457T
acacgagucauuccg

SEQ ID NO: 1889874 - RNA, 16 nt, Shigella flexneri 2a str. 2457T
acaccgcccaacagac

SEQ ID NO: 1889875 - RNA, 15 nt, Shigella flexneri 2a str. 2457T
acacacuuuccaggc

SEQ ID NO: 1889876 - RNA, 22 nt, Shigella flexneri 2a str. 2457T
acagccuaccagaccgcacacc

SEQ ID NO: 1889877 - RNA, 18 nt, Shigella flexneri 2a str. 2457T
acagcgacagacgacgac

SEQ ID NO: 1889878 - RNA, 19 nt, Shigella flexneri 2a str. 2457T
acagcgagggccguauuga

SEQ ID NO: 1889879 - RNA, 19 nt, Shigella flexneri 2a str. 2457T
acagcggcauuacgcgccc

SEQ ID NO: 1889880 - RNA, 13 nt, Shigella flexneri 2a str. 2457T
acagcgcgccagc

SEQ ID NO: 1889881 - RNA, 17 nt, Shigella flexneri 2a str. 2457T
acacuccagucccaguu

SEQ ID NO: 1889882 - RNA, 17 nt, Shigella flexneri 2a str. 2457T
acacucgcugacugaua

SEQ ID NO: 1889883 - RNA, 19 nt, Shigella flexneri 2a str. 2457T
acacucggcgucaaacggc

SEQ ID NO: 1889884 - RNA, 21 nt, Shigella flexneri 2a str. 2457T
acacuguaagccaccgaacaa

SEQ ID NO: 1889885 - RNA, 12 nt, Shigella flexneri 2a str. 2457T
acacugcugaua

SEQ ID NO: 1889886 - RNA, 23 nt, Shigella flexneri 2a str. 2457T
acacugguucccaacaacagcgc

SEQ ID NO: 1889887 - RNA, 22 nt, Shigella flexneri 2a str. 2457T
acagcacgccccggcugccgga

SEQ ID NO: 1889888 - RNA, 17 nt, Shigella flexneri 2a str. 2457T
acgcaguaagcgccagg

SEQ ID NO: 1889889 - RNA, 14 nt, Shigella flexneri 2a str. 2457T
acgcaguuaacgcg

SEQ ID NO: 1889890 - RNA, 16 nt, Shigella flexneri 2a str. 2457T
acgccaaucugcaaaa

SEQ ID NO: 1889891 - RNA, 21 nt, Shigella flexneri 2a str. 2457T
acgcauccgaucgcgcaucag

SEQ ID NO: 1889892 - RNA, 21 nt, Shigella flexneri 2a str. 2457T
acgcauccgcuggcccaucag

SEQ ID NO: 1889893 - RNA, 18 nt, Shigella flexneri 2a str. 2457T
acgccaugagcggacuga

SEQ ID NO: 1889894 - RNA, 19 nt, Shigella flexneri 2a str. 2457T
acgcccagcgcgcggccuu

SEQ ID NO: 1889895 - RNA, 22 nt, Shigella flexneri 2a str. 2457T
acgcaggucgucuuuuacagcg

SEQ ID NO: 1889896 - RNA, 22 nt, Shigella flexneri 2a str. 2457T
acgcagaaucuucuucucagcc

SEQ ID NO: 1889897 - RNA, 14 nt, Shigella flexneri 2a str. 2457T
acgcagacuggauu

SEQ ID NO: 1889898 - RNA, 22 nt, Shigella flexneri 2a str. 2457T
acgcaaucaaauaccaccagcg

SEQ ID NO: 1889899 - RNA, 18 nt, Shigella flexneri 2a str. 2457T
acgcaagucauacagccg

SEQ ID NO: 1889900 - RNA, 24 nt, Shigella flexneri 2a str. 2457T
acgcaagucauacagccgguacau

SEQ ID NO: 1889901 - RNA, 16 nt, Shigella flexneri 2a str. 2457T
acgauucggcaaucac

SEQ ID NO: 1889902 - RNA, 18 nt, Shigella flexneri 2a str. 2457T
acgauucggcaaucacca

SEQ ID NO: 1889903 - RNA, 20 nt, Shigella flexneri 2a str. 2457T
acgaugguguuggcaaucag

SEQ ID NO: 1889904 - RNA, 14 nt, Shigella flexneri 2a str. 2457T
acgaugacugguag

SEQ ID NO: 1889905 - RNA, 12 nt, Shigella flexneri 2a str. 2457T
acgauggcgcgc

SEQ ID NO: 1889906 - RNA, 16 nt, Shigella flexneri 2a str. 2457T
acgaugaccgcaucaa

SEQ ID NO: 1889907 - RNA, 18 nt, Shigella flexneri 2a str. 2457T
acgccgacgcccugcgcu

SEQ ID NO: 1889908 - RNA, 15 nt, Shigella flexneri 2a str. 2457T
acgccgagcgccagc

SEQ ID NO: 1889909 - RNA, 22 nt, Shigella flexneri 2a str. 2457T
acgccgagacguuuugccaguu

SEQ ID NO: 1889910 - RNA, 16 nt, Shigella flexneri 2a str. 2457T
acgccgaggaguuuau

SEQ ID NO: 1889911 - RNA, 17 nt, Shigella flexneri 2a str. 2457T
acgccgcauccggcauu

SEQ ID NO: 1889912 - RNA, 14 nt, Shigella flexneri 2a str. 2457T
acgcgaggcgcuaa

SEQ ID NO: 1889913 - RNA, 15 nt, Shigella flexneri 2a str. 2457T
acgccuuauccggcc

SEQ ID NO: 1889914 - RNA, 20 nt, Shigella flexneri 2a str. 2457T
acgccuuauccggccuacca

SEQ ID NO: 1889915 - RNA, 19 nt, Shigella flexneri 2a str. 2457T
acgccuguuaaucagcuaa

SEQ ID NO: 1889916 - RNA, 20 nt, Shigella flexneri 2a str. 2457T
acgccuggcagucacggcgc

SEQ ID NO: 1889917 - RNA, 22 nt, Shigella flexneri 2a str. 2457T
acgccuaaugccagcgauaucg

SEQ ID NO: 1889918 - RNA, 19 nt, Shigella flexneri 2a str. 2457T
acgcgcagcgucgcaucag

SEQ ID NO: 1889919 - RNA, 23 nt, Shigella flexneri 2a str. 2457T
accuuucagauguuccgccauuu

SEQ ID NO: 1889920 - RNA, 23 nt, Shigella flexneri 2a str. 2457T
accuuucguggugagggcaaaca

SEQ ID NO: 1889921 - RNA, 21 nt, Shigella flexneri 2a str. 2457T
acgaccgcuuuugucggcacu

SEQ ID NO: 1889922 - RNA, 13 nt, Shigella flexneri 2a str. 2457T
acgacgugccgca

SEQ ID NO: 1889923 - RNA, 20 nt, Shigella flexneri 2a str. 2457T
accugggcgaugcuggcaga

SEQ ID NO: 1889924 - RNA, 15 nt, Shigella flexneri 2a str. 2457T
accugcggugcagcc

SEQ ID NO: 1889925 - RNA, 14 nt, Shigella flexneri 2a str. 2457T
accuccagcaucag

SEQ ID NO: 1889926 - RNA, 23 nt, Shigella flexneri 2a str. 2457T
accucccgucgcccacaccagau

SEQ ID NO: 1889927 - RNA, 23 nt, Shigella flexneri 2a str. 2457T
accucgccccgugaugaacugcg

SEQ ID NO: 1889928 - RNA, 11 nt, Shigella flexneri 2a str. 2457T
accucaccgcu

SEQ ID NO: 1889929 - RNA, 21 nt, Shigella flexneri 2a str. 2457T
accucauuaagaugcauuuau

SEQ ID NO: 1889930 - RNA, 14 nt, Shigella flexneri 2a str. 2457T
accugccuggcagu

SEQ ID NO: 1889931 - RNA, 20 nt, Shigella flexneri 2a str. 2457T
accugcaguucaucaacgcc

SEQ ID NO: 1889932 - RNA, 22 nt, Shigella flexneri 2a str. 2457T
accugcaaauucaauaaauugc

SEQ ID NO: 1889933 - RNA, 22 nt, Shigella flexneri 2a str. 2457T
accugcacgaaaccacugcaac

SEQ ID NO: 1889934 - RNA, 15 nt, Shigella flexneri 2a str. 2457T
accugaaucgucaga

SEQ ID NO: 1889935 - RNA, 16 nt, Shigella flexneri 2a str. 2457T
acucaugggucugcgg

SEQ ID NO: 1889936 - RNA, 14 nt, Shigella flexneri 2a str. 2457T
acucauugccaguc

SEQ ID NO: 1889937 - RNA, 13 nt, Shigella flexneri 2a str. 2457T
acuaucaucgccg

SEQ ID NO: 1889938 - RNA, 13 nt, Shigella flexneri 2a str. 2457T
acuccaugaguaa

SEQ ID NO: 1889939 - RNA, 12 nt, Shigella flexneri 2a str. 2457T
acuccagcagac

SEQ ID NO: 1889940 - RNA, 21 nt, Shigella flexneri 2a str. 2457T
acuccuuucugagcaucacau

SEQ ID NO: 1889941 - RNA, 18 nt, Shigella flexneri 2a str. 2457T
acucgauaauaaagcggc

SEQ ID NO: 1889942 - RNA, 16 nt, Shigella flexneri 2a str. 2457T
acuccgagaaucauaa

SEQ ID NO: 1889943 - RNA, 14 nt, Shigella flexneri 2a str. 2457T
acugccgaagcggu

SEQ ID NO: 1889944 - RNA, 23 nt, Shigella flexneri 2a str. 2457T
acugccaugaccgcuccgccauc

SEQ ID NO: 1889945 - RNA, 13 nt, Shigella flexneri 2a str. 2457T
acugcgacgcggc

SEQ ID NO: 1889946 - RNA, 20 nt, Shigella flexneri 2a str. 2457T
acugcgagaaguucugcagc

SEQ ID NO: 1889947 - RNA, 13 nt, Shigella flexneri 2a str. 2457T
acugcgagcaaaa

SEQ ID NO: 1889948 - RNA, 15 nt, Shigella flexneri 2a str. 2457T
acugcgccgaagcgc

SEQ ID NO: 1889949 - RNA, 18 nt, Shigella flexneri 2a str. 2457T
acugcgccaucaaugccg

SEQ ID NO: 1889950 - RNA, 16 nt, Shigella flexneri 2a str. 2457T
acugcgccagcgucau

SEQ ID NO: 1889951 - RNA, 18 nt, Shigella flexneri 2a str. 2457T
acugcgccagcgucauca

SEQ ID NO: 1889952 - RNA, 15 nt, Shigella flexneri 2a str. 2457T
acugccuuaaucaag

SEQ ID NO: 1889953 - RNA, 20 nt, Shigella flexneri 2a str. 2457T
acugccggaugcggcgugaa

SEQ ID NO: 1889954 - RNA, 15 nt, Shigella flexneri 2a str. 2457T
acugccggaugcggc

SEQ ID NO: 1889955 - RNA, 20 nt, Shigella flexneri 2a str. 2457T
acugccguacaggcagcuua

SEQ ID NO: 1889956 - RNA, 14 nt, Shigella flexneri 2a str. 2457T
acugccgcgccuga

SEQ ID NO: 1889957 - RNA, 11 nt, Shigella flexneri 2a str. 2457T
acucggcacau

SEQ ID NO: 1889958 - RNA, 17 nt, Shigella flexneri 2a str. 2457T
acucuuccccgcuucag

SEQ ID NO: 1889959 - RNA, 12 nt, Shigella flexneri 2a str. 2457T
acugaauacgcu

SEQ ID NO: 1889960 - RNA, 14 nt, Shigella flexneri 2a str. 2457T
acugaaugccggau

SEQ ID NO: 1889961 - RNA, 15 nt, Shigella flexneri 2a str. 2457T
acucuuuauugagau

SEQ ID NO: 1889962 - RNA, 19 nt, Shigella flexneri 2a str. 2457T
acucuuucagcaccagccc

SEQ ID NO: 1889963 - RNA, 23 nt, Shigella flexneri 2a str. 2457T
acucuucugaaaaggucacuccc

SEQ ID NO: 1889964 - RNA, 14 nt, Shigella flexneri 2a str. 2457T
acguuggcgcauaa

SEQ ID NO: 1889965 - RNA, 17 nt, Shigella flexneri 2a str. 2457T
acguuuauucccgcgaa

SEQ ID NO: 1889966 - RNA, 15 nt, Shigella flexneri 2a str. 2457T
acguugucgccgcug

SEQ ID NO: 1889967 - RNA, 19 nt, Shigella flexneri 2a str. 2457T
acgucguuccccauuaccu

SEQ ID NO: 1889968 - RNA, 14 nt, Shigella flexneri 2a str. 2457T
acguucgcccacuu

SEQ ID NO: 1889969 - RNA, 21 nt, Shigella flexneri 2a str. 2457T
acguuccuuucuugcgcaaac

SEQ ID NO: 1889970 - RNA, 15 nt, Shigella flexneri 2a str. 2457T
acguucauggcgcga

SEQ ID NO: 1889971 - RNA, 17 nt, Shigella flexneri 2a str. 2457T
acgguaucuuuccagcc

SEQ ID NO: 1889972 - RNA, 22 nt, Shigella flexneri 2a str. 2457T
acguagcuauauuuugccggac

SEQ ID NO: 1889973 - RNA, 18 nt, Shigella flexneri 2a str. 2457T
acguagugaaaucgccaa

SEQ ID NO: 1889974 - RNA, 21 nt, Shigella flexneri 2a str. 2457T
acguaguugcccuuuucacca

SEQ ID NO: 1889975 - RNA, 22 nt, Shigella flexneri 2a str. 2457T
acgucgcuuuauagguggcaaa

SEQ ID NO: 1889976 - RNA, 15 nt, Shigella flexneri 2a str. 2457T
acgggcgacaaacgc

SEQ ID NO: 1889977 - RNA, 18 nt, Shigella flexneri 2a str. 2457T
acgggcgaggaaauugcg

SEQ ID NO: 1889978 - RNA, 17 nt, Shigella flexneri 2a str. 2457T
acgguaccaguacgccc

SEQ ID NO: 1889979 - RNA, 14 nt, Shigella flexneri 2a str. 2457T
acggguucaagucc

SEQ ID NO: 1889980 - RNA, 18 nt, Shigella flexneri 2a str. 2457T
acggcuucgccaaaucgc

SEQ ID NO: 1889981 - RNA, 17 nt, Shigella flexneri 2a str. 2457T
acggcgagccagcgcau

SEQ ID NO: 1889982 - RNA, 14 nt, Shigella flexneri 2a str. 2457T
acggcgauaccagu

SEQ ID NO: 1889983 - RNA, 14 nt, Shigella flexneri 2a str. 2457T
acggcgcagcuuca

SEQ ID NO: 1889984 - RNA, 11 nt, Shigella flexneri 2a str. 2457T
acggcgcuaaa

SEQ ID NO: 1889985 - RNA, 17 nt, Shigella flexneri 2a str. 2457T
acggcauuuaguggauc

SEQ ID NO: 1889986 - RNA, 21 nt, Shigella flexneri 2a str. 2457T
acggcauucugcacauuauca

SEQ ID NO: 1889987 - RNA, 19 nt, Shigella flexneri 2a str. 2457T
acggcauuuccgccaauca

SEQ ID NO: 1889988 - RNA, 19 nt, Shigella flexneri 2a str. 2457T
acgcggcagcgucgcauca

SEQ ID NO: 1889989 - RNA, 11 nt, Shigella flexneri 2a str. 2457T
acggaugcagc

SEQ ID NO: 1889990 - RNA, 15 nt, Shigella flexneri 2a str. 2457T
acggcagagaucgcc

SEQ ID NO: 1889991 - RNA, 18 nt, Shigella flexneri 2a str. 2457T
acggcagagaucgccgcu

SEQ ID NO: 1889992 - RNA, 19 nt, Shigella flexneri 2a str. 2457T
acgcuuguacggcuccgcc

SEQ ID NO: 1889993 - RNA, 18 nt, Shigella flexneri 2a str. 2457T
acgcuuaucaggccuaca

SEQ ID NO: 1889994 - RNA, 21 nt, Shigella flexneri 2a str. 2457T
acgcuugaagcacacgacauc

SEQ ID NO: 1889995 - RNA, 12 nt, Shigella flexneri 2a str. 2457T
aauccagcaaua

SEQ ID NO: 1889996 - RNA, 14 nt, Shigella flexneri 2a str. 2457T
aauccacgguuuau

SEQ ID NO: 1889997 - RNA, 14 nt, Shigella flexneri 2a str. 2457T
aauccacagcaaug

SEQ ID NO: 1889998 - RNA, 22 nt, Shigella flexneri 2a str. 2457T
uuggcaaccguggugaguugug

SEQ ID NO: 1889999 - RNA, 13 nt, Shigella flexneri 2a str. 2457T
uugcgccugcagg

SEQ ID NO: 1890000 - RNA, 15 nt, Shigella flexneri 2a str. 2457T
uugcgccugcuuaac

SEQ ID NO: 1890001 - RNA, 12 nt, Shigella flexneri 2a str. 2457T
aauccaucgccu

SEQ ID NO: 1890002 - RNA, 16 nt, Shigella flexneri 2a str. 2457T
aauccccuccagcgag

SEQ ID NO: 1890003 - RNA, 12 nt, Shigella flexneri 2a str. 2457T
aaucccgccaua

SEQ ID NO: 1890004 - RNA, 12 nt, Shigella flexneri 2a str. 2457T
aaucccgccauu

SEQ ID NO: 1890005 - RNA, 22 nt, Shigella flexneri 2a str. 2457T
aauccccucuucagccgcaaac

SEQ ID NO: 1890006 - RNA, 17 nt, Shigella flexneri 2a str. 2457T
uuggcaccauuaccgcc

SEQ ID NO: 1890007 - RNA, 15 nt, Shigella flexneri 2a str. 2457T
uuggcacccagcgcu

SEQ ID NO: 1890008 - RNA, 20 nt, Shigella flexneri 2a str. 2457T
uuggcgcucugacaccauca

SEQ ID NO: 1890009 - RNA, 13 nt, Shigella flexneri 2a str. 2457T
uuggguaacagcc

SEQ ID NO: 1890010 - RNA, 19 nt, Shigella flexneri 2a str. 2457T
aaucccuuucucuucaaac

SEQ ID NO: 1890011 - RNA, 19 nt, Shigella flexneri 2a str. 2457T
aaucgcacguugucagcaa

SEQ ID NO: 1890012 - RNA, 20 nt, Shigella flexneri 2a str. 2457T
aaucgcacguugucagcaac

SEQ ID NO: 1890013 - RNA, 17 nt, Shigella flexneri 2a str. 2457T
aaucgacgcugcugcgu

SEQ ID NO: 1890014 - RNA, 20 nt, Shigella flexneri 2a str. 2457T
aaucgacggggugcgguaaa

SEQ ID NO: 1890015 - RNA, 22 nt, Shigella flexneri 2a str. 2457T
uugucagcaaucugauugacau

SEQ ID NO: 1890016 - RNA, 16 nt, Shigella flexneri 2a str. 2457T
aaucgauaaaccagca

SEQ ID NO: 1890017 - RNA, 13 nt, Shigella flexneri 2a str. 2457T
aaucgagcccaga

SEQ ID NO: 1890018 - RNA, 16 nt, Shigella flexneri 2a str. 2457T
aaucgauaaaacuucc

SEQ ID NO: 1890019 - RNA, 21 nt, Shigella flexneri 2a str. 2457T
uuguaagccggaucggaggca

SEQ ID NO: 1890020 - RNA, 19 nt, Shigella flexneri 2a str. 2457T
uugucgggcaggcuucaac

SEQ ID NO: 1890021 - RNA, 16 nt, Shigella flexneri 2a str. 2457T
uugucugaacguuuug

SEQ ID NO: 1890022 - RNA, 17 nt, Shigella flexneri 2a str. 2457T
uugucgaaguuaccacc

SEQ ID NO: 1890023 - RNA, 21 nt, Shigella flexneri 2a str. 2457T
uugucaugcagcuccaccgau

SEQ ID NO: 1890024 - RNA, 19 nt, Shigella flexneri 2a str. 2457T
uugugcgccacauccggca

SEQ ID NO: 1890025 - RNA, 22 nt, Shigella flexneri 2a str. 2457T
uugugauuaaacuucaccagca

SEQ ID NO: 1890026 - RNA, 12 nt, Shigella flexneri 2a str. 2457T
aaucauccgcuc

SEQ ID NO: 1890027 - RNA, 18 nt, Shigella flexneri 2a str. 2457T
aaucaguuugaugccugc

SEQ ID NO: 1890028 - RNA, 23 nt, Shigella flexneri 2a str. 2457T
aaucaguugauuaugaucgccac

SEQ ID NO: 1890029 - RNA, 18 nt, Shigella flexneri 2a str. 2457T
aaucaguugccgaauacc

SEQ ID NO: 1890030 - RNA, 18 nt, Shigella flexneri 2a str. 2457T
uugccagagcccaucaca

SEQ ID NO: 1890031 - RNA, 13 nt, Shigella flexneri 2a str. 2457T
uugccagaucgcc

SEQ ID NO: 1890032 - RNA, 17 nt, Shigella flexneri 2a str. 2457T
uugccagcaugacuacc

SEQ ID NO: 1890033 - RNA, 19 nt, Shigella flexneri 2a str. 2457T
uugccgaagauagcgucau

SEQ ID NO: 1890034 - RNA, 17 nt, Shigella flexneri 2a str. 2457T
uugcccgguuucgccac

SEQ ID NO: 1890035 - RNA, 15 nt, Shigella flexneri 2a str. 2457T
uugccaucaucacca

SEQ ID NO: 1890036 - RNA, 18 nt, Shigella flexneri 2a str. 2457T
uugcccagcgcaucaggc

SEQ ID NO: 1890037 - RNA, 19 nt, Shigella flexneri 2a str. 2457T
uugccccagcgggaucggc

SEQ ID NO: 1890038 - RNA, 16 nt, Shigella flexneri 2a str. 2457T
uugccauguugauccc

SEQ ID NO: 1890039 - RNA, 21 nt, Shigella flexneri 2a str. 2457T
uugccugauggccugcucaac

SEQ ID NO: 1890040 - RNA, 13 nt, Shigella flexneri 2a str. 2457T
uugccguuggcgg

SEQ ID NO: 1890041 - RNA, 18 nt, Shigella flexneri 2a str. 2457T
uugccguuuaccgccauc

SEQ ID NO: 1890042 - RNA, 15 nt, Shigella flexneri 2a str. 2457T
uugcgcaguaccagc

SEQ ID NO: 1890043 - RNA, 17 nt, Shigella flexneri 2a str. 2457T
uugccggaugugaugca

SEQ ID NO: 1890044 - RNA, 12 nt, Shigella flexneri 2a str. 2457T
uugcaucgccau

SEQ ID NO: 1890045 - RNA, 19 nt, Shigella flexneri 2a str. 2457T
uugcaccugauccagcucu

SEQ ID NO: 1890046 - RNA, 16 nt, Shigella flexneri 2a str. 2457T
uugcaacgaacgcauc

SEQ ID NO: 1890047 - RNA, 14 nt, Shigella flexneri 2a str. 2457T
uucuggcggcggug

SEQ ID NO: 1890048 - RNA, 22 nt, Shigella flexneri 2a str. 2457T
uucuggcagcgcgcauucagca

SEQ ID NO: 1890049 - RNA, 16 nt, Shigella flexneri 2a str. 2457T
uucugcuucguuaacg

SEQ ID NO: 1890050 - RNA, 21 nt, Shigella flexneri 2a str. 2457T
uugaugccugcaucgauagcu

SEQ ID NO: 1890051 - RNA, 17 nt, Shigella flexneri 2a str. 2457T
uugauggucucgccgau

SEQ ID NO: 1890052 - RNA, 18 nt, Shigella flexneri 2a str. 2457T
uuuuugucugcuauuuac

SEQ ID NO: 1890053 - RNA, 19 nt, Shigella flexneri 2a str. 2457T
uuuuugcgcgaagaaacga

SEQ ID NO: 1890054 - RNA, 21 nt, Shigella flexneri 2a str. 2457T
uuuuucugcacuacgcaggga

SEQ ID NO: 1890055 - RNA, 18 nt, Shigella flexneri 2a str. 2457T
aaucguacucaccagaca

SEQ ID NO: 1890056 - RNA, 17 nt, Shigella flexneri 2a str. 2457T
aaucggugcaaaugcca

SEQ ID NO: 1890057 - RNA, 22 nt, Shigella flexneri 2a str. 2457T
uuuuacuccacuuccugccagu

SEQ ID NO: 1890058 - RNA, 23 nt, Shigella flexneri 2a str. 2457T
uuuuacucuuucucggaguaacu

SEQ ID NO: 1890059 - RNA, 24 nt, Shigella flexneri 2a str. 2457T
aaucgcgaaauaacugcuauucac

SEQ ID NO: 1890060 - RNA, 17 nt, Shigella flexneri 2a str. 2457T
aaucgcuacugauaaua

SEQ ID NO: 1890061 - RNA, 22 nt, Shigella flexneri 2a str. 2457T
aaucggcuuucaccgccugauc

SEQ ID NO: 1890062 - RNA, 18 nt, Shigella flexneri 2a str. 2457T
aaucggcugaacgugcuc

SEQ ID NO: 1890063 - RNA, 15 nt, Shigella flexneri 2a str. 2457T
aaucggcgaucccau

SEQ ID NO: 1890064 - RNA, 15 nt, Shigella flexneri 2a str. 2457T
aaugacuagcgccau

SEQ ID NO: 1890065 - RNA, 23 nt, Shigella flexneri 2a str. 2457T
aaugaugccgccagaaauggaga

SEQ ID NO: 1890066 - RNA, 19 nt, Shigella flexneri 2a str. 2457T
aaugccucuccccagcgga

SEQ ID NO: 1890067 - RNA, 17 nt, Shigella flexneri 2a str. 2457T
aaugcguggcgcguacc

SEQ ID NO: 1890068 - RNA, 14 nt, Shigella flexneri 2a str. 2457T
aauggcaaugacua

SEQ ID NO: 1890069 - RNA, 19 nt, Shigella flexneri 2a str. 2457T
aauggcccauuuucucggc

SEQ ID NO: 1890070 - RNA, 13 nt, Shigella flexneri 2a str. 2457T
aaugccuuauccg

SEQ ID NO: 1890071 - RNA, 20 nt, Shigella flexneri 2a str. 2457T
aaugcgcccagcgucagcau

SEQ ID NO: 1890072 - RNA, 20 nt, Shigella flexneri 2a str. 2457T
aaugcgcuccucgccguuaa

SEQ ID NO: 1890073 - RNA, 13 nt, Shigella flexneri 2a str. 2457T
aauggucagcgcc

SEQ ID NO: 1890074 - RNA, 17 nt, Shigella flexneri 2a str. 2457T
aauggcuuuacgcgcca

SEQ ID NO: 1890075 - RNA, 21 nt, Shigella flexneri 2a str. 2457T
aauggcgucaacaacacucuc

SEQ ID NO: 1890076 - RNA, 23 nt, Shigella flexneri 2a str. 2457T
aauggccgucgccacaaccagcg

SEQ ID NO: 1890077 - RNA, 16 nt, Shigella flexneri 2a str. 2457T
aauggcgacuucugcu

SEQ ID NO: 1890078 - RNA, 21 nt, Shigella flexneri 2a str. 2457T
aauguacucuuuauugcaaac

SEQ ID NO: 1890079 - RNA, 20 nt, Shigella flexneri 2a str. 2457T
uuucgcugacgaguggcgga

SEQ ID NO: 1890080 - RNA, 21 nt, Shigella flexneri 2a str. 2457T
uuucgcuucaaccaccucagu

SEQ ID NO: 1890081 - RNA, 23 nt, Shigella flexneri 2a str. 2457T
uuuccggaucgccaaagcggcag

SEQ ID NO: 1890082 - RNA, 13 nt, Shigella flexneri 2a str. 2457T
uuucgccaggcac

SEQ ID NO: 1890083 - RNA, 16 nt, Shigella flexneri 2a str. 2457T
uuucuuccagcgccau

SEQ ID NO: 1890084 - RNA, 19 nt, Shigella flexneri 2a str. 2457T
uuucuggacacagcgugca

SEQ ID NO: 1890085 - RNA, 23 nt, Shigella flexneri 2a str. 2457T
uuucguagacugcagcggucaca

SEQ ID NO: 1890086 - RNA, 14 nt, Shigella flexneri 2a str. 2457T
uuuaaccguggugc

SEQ ID NO: 1890087 - RNA, 15 nt, Shigella flexneri 2a str. 2457T
uuuccauauguacgc

SEQ ID NO: 1890088 - RNA, 21 nt, Shigella flexneri 2a str. 2457T
uuuccaucauuagugugauca

SEQ ID NO: 1890089 - RNA, 23 nt, Shigella flexneri 2a str. 2457T
uuuccgccaccugauccaucguc

SEQ ID NO: 1890090 - RNA, 15 nt, Shigella flexneri 2a str. 2457T
uuucccccuggcgag

SEQ ID NO: 1890091 - RNA, 14 nt, Shigella flexneri 2a str. 2457T
uuuaccgucaccga

SEQ ID NO: 1890092 - RNA, 13 nt, Shigella flexneri 2a str. 2457T
uuugcccaucaug

SEQ ID NO: 1890093 - RNA, 19 nt, Shigella flexneri 2a str. 2457T
uuugcaccgauugccggau

SEQ ID NO: 1890094 - RNA, 12 nt, Shigella flexneri 2a str. 2457T
uuugauccagcc

SEQ ID NO: 1890095 - RNA, 17 nt, Shigella flexneri 2a str. 2457T
uuuguaguuugauaauu

SEQ ID NO: 1890096 - RNA, 15 nt, Shigella flexneri 2a str. 2457T
uuuguaggccggaua

SEQ ID NO: 1890097 - RNA, 20 nt, Shigella flexneri 2a str. 2457T
uuuguccaccaauagcccau

SEQ ID NO: 1890098 - RNA, 14 nt, Shigella flexneri 2a str. 2457T
uuugugucagcgcc

SEQ ID NO: 1890099 - RNA, 20 nt, Shigella flexneri 2a str. 2457T
uuuggacacccuugccggau

SEQ ID NO: 1890100 - RNA, 13 nt, Shigella flexneri 2a str. 2457T
uuuggccgcgcca

SEQ ID NO: 1890101 - RNA, 20 nt, Shigella flexneri 2a str. 2457T
uuugcgucauaccgcaucuu

SEQ ID NO: 1890102 - RNA, 16 nt, Shigella flexneri 2a str. 2457T
uuugcuaucgggaaua

SEQ ID NO: 1890103 - RNA, 23 nt, Shigella flexneri 2a str. 2457T
uucaucacugaauuucgccgcac

SEQ ID NO: 1890104 - RNA, 11 nt, Shigella flexneri 2a str. 2457T
uucauccagca

SEQ ID NO: 1890105 - RNA, 19 nt, Shigella flexneri 2a str. 2457T
uucagcucccgcugacggc

SEQ ID NO: 1890106 - RNA, 19 nt, Shigella flexneri 2a str. 2457T
uucaucgcggucagcugcu

SEQ ID NO: 1890107 - RNA, 22 nt, Shigella flexneri 2a str. 2457T
uucaucggauacgccacucuga

SEQ ID NO: 1890108 - RNA, 14 nt, Shigella flexneri 2a str. 2457T
uucauccagcauca

SEQ ID NO: 1890109 - RNA, 15 nt, Shigella flexneri 2a str. 2457T
uucaugccauccgca

SEQ ID NO: 1890110 - RNA, 22 nt, Shigella flexneri 2a str. 2457T
uucaugguacgggacagcaggu

SEQ ID NO: 1890111 - RNA, 15 nt, Shigella flexneri 2a str. 2457T
uuauccgccagcgcc

SEQ ID NO: 1890112 - RNA, 19 nt, Shigella flexneri 2a str. 2457T
uucacgcacuuccggugcc

SEQ ID NO: 1890113 - RNA, 18 nt, Shigella flexneri 2a str. 2457T
uucacgcaggcgagaauc

SEQ ID NO: 1890114 - RNA, 22 nt, Shigella flexneri 2a str. 2457T
uucacgcauuuacacucgcccc

SEQ ID NO: 1890115 - RNA, 18 nt, Shigella flexneri 2a str. 2457T
uucacgcggguugccacc

SEQ ID NO: 1890116 - RNA, 19 nt, Shigella flexneri 2a str. 2457T
uucacugccaccagcagcg

SEQ ID NO: 1890117 - RNA, 12 nt, Shigella flexneri 2a str. 2457T
uucacugcccac

SEQ ID NO: 1890118 - RNA, 21 nt, Shigella flexneri 2a str. 2457T
uucacugccguacaggcagcu

SEQ ID NO: 1890119 - RNA, 17 nt, Shigella flexneri 2a str. 2457T
uucagcgucgcgguugc

SEQ ID NO: 1890120 - RNA, 14 nt, Shigella flexneri 2a str. 2457T
uucagcgugcccac

SEQ ID NO: 1890121 - RNA, 15 nt, Shigella flexneri 2a str. 2457T
uucagaccuguugcc

SEQ ID NO: 1890122 - RNA, 23 nt, Shigella flexneri 2a str. 2457T
uucagaucgguuuuuuucgaacc

SEQ ID NO: 1890123 - RNA, 21 nt, Shigella flexneri 2a str. 2457T
uucagauaaaucacgcuucac

SEQ ID NO: 1890124 - RNA, 23 nt, Shigella flexneri 2a str. 2457T
uuccacgccguuuuuacccagca

SEQ ID NO: 1890125 - RNA, 23 nt, Shigella flexneri 2a str. 2457T
uuccagcgcaaggaaauaacguu

SEQ ID NO: 1890126 - RNA, 17 nt, Shigella flexneri 2a str. 2457T
uuccagcaguuccagca

SEQ ID NO: 1890127 - RNA, 11 nt, Shigella flexneri 2a str. 2457T
uuccagcaucg

SEQ ID NO: 1890128 - RNA, 19 nt, Shigella flexneri 2a str. 2457T
uucauuucacgcugacggc

SEQ ID NO: 1890129 - RNA, 12 nt, Shigella flexneri 2a str. 2457T
uuccaccgccgg

SEQ ID NO: 1890130 - RNA, 18 nt, Shigella flexneri 2a str. 2457T
uuccagcuccauccacca

SEQ ID NO: 1890131 - RNA, 15 nt, Shigella flexneri 2a str. 2457T
uuccaggcaucagca

SEQ ID NO: 1890132 - RNA, 13 nt, Shigella flexneri 2a str. 2457T
uucccaaagaucu

SEQ ID NO: 1890133 - RNA, 17 nt, Shigella flexneri 2a str. 2457T
uuccaucagauucagca

SEQ ID NO: 1890134 - RNA, 14 nt, Shigella flexneri 2a str. 2457T
uuccauaucaagca

SEQ ID NO: 1890135 - RNA, 15 nt, Shigella flexneri 2a str. 2457T
uucccaacaacagcg

SEQ ID NO: 1890136 - RNA, 19 nt, Shigella flexneri 2a str. 2457T
uucccagauagcaacagca

SEQ ID NO: 1890137 - RNA, 13 nt, Shigella flexneri 2a str. 2457T
uucgcccgucgug

SEQ ID NO: 1890138 - RNA, 16 nt, Shigella flexneri 2a str. 2457T
uucgaagaaaccgaug

SEQ ID NO: 1890139 - RNA, 14 nt, Shigella flexneri 2a str. 2457T
uuccgccgguugcc

SEQ ID NO: 1890140 - RNA, 15 nt, Shigella flexneri 2a str. 2457T
uuccgccguacgccg

SEQ ID NO: 1890141 - RNA, 18 nt, Shigella flexneri 2a str. 2457T
uuccgcgcaaucgcccag

SEQ ID NO: 1890142 - RNA, 16 nt, Shigella flexneri 2a str. 2457T
uucggacguuugccau

SEQ ID NO: 1890143 - RNA, 21 nt, Shigella flexneri 2a str. 2457T
uucgcuuaccaugccaacgcg

SEQ ID NO: 1890144 - RNA, 13 nt, Shigella flexneri 2a str. 2457T
uucggcaauccag

SEQ ID NO: 1890145 - RNA, 18 nt, Shigella flexneri 2a str. 2457T
uucggcaaccgcauccag

SEQ ID NO: 1890146 - RNA, 18 nt, Shigella flexneri 2a str. 2457T
uucgcgccgcauccggca

SEQ ID NO: 1890147 - RNA, 13 nt, Shigella flexneri 2a str. 2457T
uucgcgcgggcag

SEQ ID NO: 1890148 - RNA, 16 nt, Shigella flexneri 2a str. 2457T
uucgcgccaauccaga

SEQ ID NO: 1890149 - RNA, 16 nt, Shigella flexneri 2a str. 2457T
uucgccgcacgcucaa

SEQ ID NO: 1890150 - RNA, 13 nt, Shigella flexneri 2a str. 2457T
aaucacugccaga

SEQ ID NO: 1890151 - RNA, 21 nt, Shigella flexneri 2a str. 2457T
uucuaccgucuguaaccagau

SEQ ID NO: 1890152 - RNA, 13 nt, Shigella flexneri 2a str. 2457T
aaucagcagaacc

SEQ ID NO: 1890153 - RNA, 21 nt, Shigella flexneri 2a str. 2457T
uucucgcuccauuccaucgcc

SEQ ID NO: 1890154 - RNA, 15 nt, Shigella flexneri 2a str. 2457T
uucugccgcuuccag

SEQ ID NO: 1890155 - RNA, 17 nt, Shigella flexneri 2a str. 2457T
uucugccgcuuccagca

SEQ ID NO: 1890156 - RNA, 18 nt, Shigella flexneri 2a str. 2457T
uucuccucccuugucuga

SEQ ID NO: 1890157 - RNA, 16 nt, Shigella flexneri 2a str. 2457T
uucgucgcggguugcc

SEQ ID NO: 1890158 - RNA, 18 nt, Shigella flexneri 2a str. 2457T
uucggcgucuuguugaac

SEQ ID NO: 1890159 - RNA, 19 nt, Shigella flexneri 2a str. 2457T
uucguuacgcggcauugca

SEQ ID NO: 1890160 - RNA, 10 nt, Shigella flexneri 2a str. 2457T
uucgucgcua

SEQ ID NO: 1890161 - RNA, 19 nt, Shigella flexneri 2a str. 2457T
uguugccguuuaccgccau

SEQ ID NO: 1890162 - RNA, 15 nt, Shigella flexneri 2a str. 2457T
uguugcaucgccugc

SEQ ID NO: 1890163 - RNA, 15 nt, Shigella flexneri 2a str. 2457T
uuaacauccaucgcc

SEQ ID NO: 1890164 - RNA, 23 nt, Shigella flexneri 2a str. 2457T
uuaacaacacccggucagccauu

SEQ ID NO: 1890165 - RNA, 15 nt, Shigella flexneri 2a str. 2457T
uuaaucgagauaccu

SEQ ID NO: 1890166 - RNA, 22 nt, Shigella flexneri 2a str. 2457T
uuaauacugcuccccgaacgau

SEQ ID NO: 1890167 - RNA, 12 nt, Shigella flexneri 2a str. 2457T
uuacaucaucag

SEQ ID NO: 1890168 - RNA, 23 nt, Shigella flexneri 2a str. 2457T
uuaaucggcgucauuuuuucgac

SEQ ID NO: 1890169 - RNA, 17 nt, Shigella flexneri 2a str. 2457T
uuaucacuuaacccauu

SEQ ID NO: 1890170 - RNA, 17 nt, Shigella flexneri 2a str. 2457T
uuaucagguauugaucu

SEQ ID NO: 1890171 - RNA, 20 nt, Shigella flexneri 2a str. 2457T
uuaucaggccuacagcauau

SEQ ID NO: 1890172 - RNA, 14 nt, Shigella flexneri 2a str. 2457T
uuaucacugugaug

SEQ ID NO: 1890173 - RNA, 18 nt, Shigella flexneri 2a str. 2457T
uuaggcacaguagcccac

SEQ ID NO: 1890174 - RNA, 21 nt, Shigella flexneri 2a str. 2457T
uuagggugagggggcguucac

SEQ ID NO: 1890175 - RNA, 16 nt, Shigella flexneri 2a str. 2457T
uuagguaaugacucca

SEQ ID NO: 1890176 - RNA, 21 nt, Shigella flexneri 2a str. 2457T
uuagcauaaaaacucgagccu

SEQ ID NO: 1890177 - RNA, 13 nt, Shigella flexneri 2a str. 2457T
uuagagacgcauu

SEQ ID NO: 1890178 - RNA, 20 nt, Shigella flexneri 2a str. 2457T
uuacgaucaagauugauccc

SEQ ID NO: 1890179 - RNA, 13 nt, Shigella flexneri 2a str. 2457T
uuacccauucaag

SEQ ID NO: 1890180 - RNA, 13 nt, Shigella flexneri 2a str. 2457T
uuacccagcagca

SEQ ID NO: 1890181 - RNA, 17 nt, Shigella flexneri 2a str. 2457T
uuacgccugccagcucu

SEQ ID NO: 1890182 - RNA, 15 nt, Shigella flexneri 2a str. 2457T
uguucgcccugcagu

SEQ ID NO: 1890183 - RNA, 13 nt, Shigella flexneri 2a str. 2457T
uguucaauaucga

SEQ ID NO: 1890184 - RNA, 22 nt, Shigella flexneri 2a str. 2457T
uguuauccaccgaaauaaucag

SEQ ID NO: 1890185 - RNA, 21 nt, Shigella flexneri 2a str. 2457T
ugugcuaacucaucaccauca

SEQ ID NO: 1890186 - RNA, 13 nt, Shigella flexneri 2a str. 2457T
ugugcuuuacacc

SEQ ID NO: 1890187 - RNA, 20 nt, Shigella flexneri 2a str. 2457T
ugucaagauugauacgggga

SEQ ID NO: 1890188 - RNA, 23 nt, Shigella flexneri 2a str. 2457T
ugucaccgccaggugaaauccgg

SEQ ID NO: 1890189 - RNA, 19 nt, Shigella flexneri 2a str. 2457T
ugucgggcguuucgccagg

SEQ ID NO: 1890190 - RNA, 21 nt, Shigella flexneri 2a str. 2457T
ugucacuaugagguagccuga

SEQ ID NO: 1890191 - RNA, 17 nt, Shigella flexneri 2a str. 2457T
ugugacgacaccaucuc

SEQ ID NO: 1890192 - RNA, 21 nt, Shigella flexneri 2a str. 2457T
ugugacagauuuugccagcau

SEQ ID NO: 1890193 - RNA, 13 nt, Shigella flexneri 2a str. 2457T
ugugacagcagcg

SEQ ID NO: 1890194 - RNA, 11 nt, Shigella flexneri 2a str. 2457T
ugucuuaucug

SEQ ID NO: 1890195 - RNA, 15 nt, Shigella flexneri 2a str. 2457T
ugucuguacggcagu

SEQ ID NO: 1890196 - RNA, 15 nt, Shigella flexneri 2a str. 2457T
ugucucagauucaga

SEQ ID NO: 1890197 - RNA, 18 nt, Shigella flexneri 2a str. 2457T
ugucguuuagacguugug

SEQ ID NO: 1890198 - RNA, 23 nt, Shigella flexneri 2a str. 2457T
ugucuaacaugagguccagcgag

SEQ ID NO: 1890199 - RNA, 17 nt, Shigella flexneri 2a str. 2457T
ugcugauguucgccaga

SEQ ID NO: 1890200 - RNA, 17 nt, Shigella flexneri 2a str. 2457T
ugcugcacgcccugaua

SEQ ID NO: 1890201 - RNA, 17 nt, Shigella flexneri 2a str. 2457T
ugcucgcgagaacggcg

SEQ ID NO: 1890202 - RNA, 19 nt, Shigella flexneri 2a str. 2457T
ugcguucaccgaagacgug

SEQ ID NO: 1890203 - RNA, 14 nt, Shigella flexneri 2a str. 2457T
ugcguuaaucgccg

SEQ ID NO: 1890204 - RNA, 14 nt, Shigella flexneri 2a str. 2457T
ugcguucaauaccg

SEQ ID NO: 1890205 - RNA, 20 nt, Shigella flexneri 2a str. 2457T
ugcucaggcgaggcggacug

SEQ ID NO: 1890206 - RNA, 18 nt, Shigella flexneri 2a str. 2457T
ugcucauuugauugccgg

SEQ ID NO: 1890207 - RNA, 16 nt, Shigella flexneri 2a str. 2457T
ugcuccagugcgcuuu

SEQ ID NO: 1890208 - RNA, 23 nt, Shigella flexneri 2a str. 2457T
ugcuccggcgcgauaucgacgac

SEQ ID NO: 1890209 - RNA, 20 nt, Shigella flexneri 2a str. 2457T
uggaauggucaaugguggca

SEQ ID NO: 1890210 - RNA, 14 nt, Shigella flexneri 2a str. 2457T
ugcuuuuucgcgau

SEQ ID NO: 1890211 - RNA, 18 nt, Shigella flexneri 2a str. 2457T
ugcuugccagauacgaug

SEQ ID NO: 1890212 - RNA, 14 nt, Shigella flexneri 2a str. 2457T
ugcugugugccgcg

SEQ ID NO: 1890213 - RNA, 15 nt, Shigella flexneri 2a str. 2457T
ugcugugugccgcga

SEQ ID NO: 1890214 - RNA, 18 nt, Shigella flexneri 2a str. 2457T
ugcuguuaauucaggauu

SEQ ID NO: 1890215 - RNA, 13 nt, Shigella flexneri 2a str. 2457T
ugcuggacgcauu

SEQ ID NO: 1890216 - RNA, 13 nt, Shigella flexneri 2a str. 2457T
ugcugugccggaa

SEQ ID NO: 1890217 - RNA, 17 nt, Shigella flexneri 2a str. 2457T
ugcugcgccgagcaaua

SEQ ID NO: 1890218 - RNA, 17 nt, Shigella flexneri 2a str. 2457T
ugcggcugauggucagu

SEQ ID NO: 1890219 - RNA, 20 nt, Shigella flexneri 2a str. 2457T
ugcggcgugaacgccuuauc

SEQ ID NO: 1890220 - RNA, 17 nt, Shigella flexneri 2a str. 2457T
ugcggcguaaacgccuu

SEQ ID NO: 1890221 - RNA, 20 nt, Shigella flexneri 2a str. 2457T
ugcggcguuaacgccuuauc

SEQ ID NO: 1890222 - RNA, 15 nt, Shigella flexneri 2a str. 2457T
ugcggcguucaucgc

SEQ ID NO: 1890223 - RNA, 21 nt, Shigella flexneri 2a str. 2457T
ugcggauuuguaauuucagcg

SEQ ID NO: 1890224 - RNA, 22 nt, Shigella flexneri 2a str. 2457T
ugcggcacccauuuauccagcg

SEQ ID NO: 1890225 - RNA, 19 nt, Shigella flexneri 2a str. 2457T
ugcggaaagcuugcgucgc

SEQ ID NO: 1890226 - RNA, 16 nt, Shigella flexneri 2a str. 2457T
ugcgcuuccugcaacg

SEQ ID NO: 1890227 - RNA, 15 nt, Shigella flexneri 2a str. 2457T
ugcgcuucgcuuauc

SEQ ID NO: 1890228 - RNA, 16 nt, Shigella flexneri 2a str. 2457T
ugcgcuuauccggccc

SEQ ID NO: 1890229 - RNA, 22 nt, Shigella flexneri 2a str. 2457T
ugcgcuuauccggcccacauca

SEQ ID NO: 1890230 - RNA, 15 nt, Shigella flexneri 2a str. 2457T
ugcgggcaucaucuu

SEQ ID NO: 1890231 - RNA, 21 nt, Shigella flexneri 2a str. 2457T
ugcggucuaaaucuuccgccg

SEQ ID NO: 1890232 - RNA, 12 nt, Shigella flexneri 2a str. 2457T
ugcggucgcuga

SEQ ID NO: 1890233 - RNA, 18 nt, Shigella flexneri 2a str. 2457T
ugcgucuggguaaaccga

SEQ ID NO: 1890234 - RNA, 20 nt, Shigella flexneri 2a str. 2457T
ugcgccaugcuucaauuucc

SEQ ID NO: 1890235 - RNA, 16 nt, Shigella flexneri 2a str. 2457T
ugcgcccaucaucauc

SEQ ID NO: 1890236 - RNA, 18 nt, Shigella flexneri 2a str. 2457T
ugcgcccccgauccagcg

SEQ ID NO: 1890237 - RNA, 20 nt, Shigella flexneri 2a str. 2457T
ugcgcccccgauccagcggu

SEQ ID NO: 1890238 - RNA, 17 nt, Shigella flexneri 2a str. 2457T
ugcgccgaaaucgcauc

SEQ ID NO: 1890239 - RNA, 14 nt, Shigella flexneri 2a str. 2457T
ugcgccagagcgcg

SEQ ID NO: 1890240 - RNA, 13 nt, Shigella flexneri 2a str. 2457T
ugcgccagcaucc

SEQ ID NO: 1890241 - RNA, 17 nt, Shigella flexneri 2a str. 2457T
ugcgccagcaucgcauc

SEQ ID NO: 1890242 - RNA, 18 nt, Shigella flexneri 2a str. 2457T
ugcgccacauccggcaua

SEQ ID NO: 1890243 - RNA, 16 nt, Shigella flexneri 2a str. 2457T
ugcgccacgcagcgau

SEQ ID NO: 1890244 - RNA, 17 nt, Shigella flexneri 2a str. 2457T
ugcgccagcgcgcguug

SEQ ID NO: 1890245 - RNA, 18 nt, Shigella flexneri 2a str. 2457T
ugcgccagcguuacuuca

SEQ ID NO: 1890246 - RNA, 16 nt, Shigella flexneri 2a str. 2457T
ugcgacgcuugacgcg

SEQ ID NO: 1890247 - RNA, 15 nt, Shigella flexneri 2a str. 2457T
ugcgacgcuugcgcg

SEQ ID NO: 1890248 - RNA, 16 nt, Shigella flexneri 2a str. 2457T
ugcgacgcuugcagcg

SEQ ID NO: 1890249 - RNA, 18 nt, Shigella flexneri 2a str. 2457T
ugcgaugcugacgcaucu

SEQ ID NO: 1890250 - RNA, 13 nt, Shigella flexneri 2a str. 2457T
ugcgcaacgccgu

SEQ ID NO: 1890251 - RNA, 16 nt, Shigella flexneri 2a str. 2457T
ugcgaugcuggcggcg

SEQ ID NO: 1890252 - RNA, 17 nt, Shigella flexneri 2a str. 2457T
ugcgauguucuucaccg

SEQ ID NO: 1890253 - RNA, 21 nt, Shigella flexneri 2a str. 2457T
ugccuuccaccagauggcuuu

SEQ ID NO: 1890254 - RNA, 16 nt, Shigella flexneri 2a str. 2457T
ugccuuaugcccggca

SEQ ID NO: 1890255 - RNA, 23 nt, Shigella flexneri 2a str. 2457T
ugcgaaagcgagcaguacagccg

SEQ ID NO: 1890256 - RNA, 17 nt, Shigella flexneri 2a str. 2457T
ugccuugaguaccauuu

SEQ ID NO: 1890257 - RNA, 21 nt, Shigella flexneri 2a str. 2457T
ugccuugugggccugaaagcu

SEQ ID NO: 1890258 - RNA, 22 nt, Shigella flexneri 2a str. 2457T
ugccggaugcggcgugaacgcc

SEQ ID NO: 1890259 - RNA, 15 nt, Shigella flexneri 2a str. 2457T
ugccggaugcaucgc

SEQ ID NO: 1890260 - RNA, 15 nt, Shigella flexneri 2a str. 2457T
ugccggauagcgugu

SEQ ID NO: 1890261 - RNA, 15 nt, Shigella flexneri 2a str. 2457T
ugccggagucgcauu

SEQ ID NO: 1890262 - RNA, 13 nt, Shigella flexneri 2a str. 2457T
ugccggccugaua

SEQ ID NO: 1890263 - RNA, 16 nt, Shigella flexneri 2a str. 2457T
aauagcccucgccgcu

SEQ ID NO: 1890264 - RNA, 24 nt, Shigella flexneri 2a str. 2457T
aauagccgcagccaucagcgagac

SEQ ID NO: 1890265 - RNA, 14 nt, Shigella flexneri 2a str. 2457T
ugccggucggcagu

SEQ ID NO: 1890266 - RNA, 19 nt, Shigella flexneri 2a str. 2457T
ugccguccggcaucgcaaa

SEQ ID NO: 1890267 - RNA, 22 nt, Shigella flexneri 2a str. 2457T
uggccgaaaaaggaucaaccga

SEQ ID NO: 1890268 - RNA, 18 nt, Shigella flexneri 2a str. 2457T
uggcgaccaaagccuuuc

SEQ ID NO: 1890269 - RNA, 20 nt, Shigella flexneri 2a str. 2457T
uggcgaaccuugcgcggugu

SEQ ID NO: 1890270 - RNA, 14 nt, Shigella flexneri 2a str. 2457T
uggcgcgacauccg

SEQ ID NO: 1890271 - RNA, 14 nt, Shigella flexneri 2a str. 2457T
uggcgcacauugug

SEQ ID NO: 1890272 - RNA, 19 nt, Shigella flexneri 2a str. 2457T
uggcgauguaauucagcca

SEQ ID NO: 1890273 - RNA, 16 nt, Shigella flexneri 2a str. 2457T
uggcgcuaucaauacu

SEQ ID NO: 1890274 - RNA, 18 nt, Shigella flexneri 2a str. 2457T
uggcgcguuuaaucacac

SEQ ID NO: 1890275 - RNA, 16 nt, Shigella flexneri 2a str. 2457T
uggcgguaacauccag

SEQ ID NO: 1890276 - RNA, 23 nt, Shigella flexneri 2a str. 2457T
uggcgggcguuaucacguugcug

SEQ ID NO: 1890277 - RNA, 23 nt, Shigella flexneri 2a str. 2457T
uggcgggaucaccugcacaugca

SEQ ID NO: 1890278 - RNA, 11 nt, Shigella flexneri 2a str. 2457T
uggcggcuggc

SEQ ID NO: 1890279 - RNA, 21 nt, Shigella flexneri 2a str. 2457T
ugggugccagaauuaacgcug

SEQ ID NO: 1890280 - RNA, 19 nt, Shigella flexneri 2a str. 2457T
ugguaucgcgccagccagu

SEQ ID NO: 1890281 - RNA, 19 nt, Shigella flexneri 2a str. 2457T
aauaugcauaaaccggguc

SEQ ID NO: 1890282 - RNA, 17 nt, Shigella flexneri 2a str. 2457T
aauaugcccauguucgc

SEQ ID NO: 1890283 - RNA, 22 nt, Shigella flexneri 2a str. 2457T
aauaugcccauguucgcggcuu

SEQ ID NO: 1890284 - RNA, 13 nt, Shigella flexneri 2a str. 2457T
aauauccugcgcu

SEQ ID NO: 1890285 - RNA, 11 nt, Shigella flexneri 2a str. 2457T
ugggcgcuggc

SEQ ID NO: 1890286 - RNA, 17 nt, Shigella flexneri 2a str. 2457T
aaucaccaucagcagca

SEQ ID NO: 1890287 - RNA, 20 nt, Shigella flexneri 2a str. 2457T
uguaggccggauaaggcauu

SEQ ID NO: 1890288 - RNA, 19 nt, Shigella flexneri 2a str. 2457T
uguaggccggauaagcgua

SEQ ID NO: 1890289 - RNA, 20 nt, Shigella flexneri 2a str. 2457T
uguaggccggauaaagcguu

SEQ ID NO: 1890290 - RNA, 18 nt, Shigella flexneri 2a str. 2457T
uguaggcggauaaggcgu

SEQ ID NO: 1890291 - RNA, 19 nt, Shigella flexneri 2a str. 2457T
uguaggcuggauaaggcgu

SEQ ID NO: 1890292 - RNA, 16 nt, Shigella flexneri 2a str. 2457T
uguagauauacugcac

SEQ ID NO: 1890293 - RNA, 20 nt, Shigella flexneri 2a str. 2457T
uguagaccggaaaagguguu

SEQ ID NO: 1890294 - RNA, 18 nt, Shigella flexneri 2a str. 2457T
uguacuuuccagccacag

SEQ ID NO: 1890295 - RNA, 20 nt, Shigella flexneri 2a str. 2457T
uguaggccagauaagacguu

SEQ ID NO: 1890296 - RNA, 19 nt, Shigella flexneri 2a str. 2457T
uguaggcaggauaaggcgu

SEQ ID NO: 1890297 - RNA, 19 nt, Shigella flexneri 2a str. 2457T
uguaggccagauaagacgc

SEQ ID NO: 1890298 - RNA, 20 nt, Shigella flexneri 2a str. 2457T
uguaggacggauaaggcguu

SEQ ID NO: 1890299 - RNA, 17 nt, Shigella flexneri 2a str. 2457T
uguaauacgcucaucug

SEQ ID NO: 1890300 - RNA, 13 nt, Shigella flexneri 2a str. 2457T
uguaauuaccagc

SEQ ID NO: 1890301 - RNA, 23 nt, Shigella flexneri 2a str. 2457T
uguaauuaggcuaaauaaccagc

SEQ ID NO: 1890302 - RNA, 17 nt, Shigella flexneri 2a str. 2457T
uguaccguugcugccag

SEQ ID NO: 1890303 - RNA, 13 nt, Shigella flexneri 2a str. 2457T
ugguuuggcggcg

SEQ ID NO: 1890304 - RNA, 17 nt, Shigella flexneri 2a str. 2457T
uggugauuuucgccgcg

SEQ ID NO: 1890305 - RNA, 16 nt, Shigella flexneri 2a str. 2457T
aaaugaaaaucaccau

SEQ ID NO: 1890306 - RNA, 22 nt, Shigella flexneri 2a str. 2457T
aaaugaaaaucaccauuuccgg

SEQ ID NO: 1890307 - RNA, 21 nt, Shigella flexneri 2a str. 2457T
aaaucugucagguaacaagcc

SEQ ID NO: 1890308 - RNA, 23 nt, Shigella flexneri 2a str. 2457T
aaaugcucuccguaggccagaua

SEQ ID NO: 1890309 - RNA, 19 nt, Shigella flexneri 2a str. 2457T
aaaugggugacaucgcccu

SEQ ID NO: 1890310 - RNA, 20 nt, Shigella flexneri 2a str. 2457T
aaaucagaucgacgccgaug

SEQ ID NO: 1890311 - RNA, 15 nt, Shigella flexneri 2a str. 2457T
aaaucaacgccgcau

SEQ ID NO: 1890312 - RNA, 22 nt, Shigella flexneri 2a str. 2457T
aaaucaacauguuccugccagu

SEQ ID NO: 1890313 - RNA, 17 nt, Shigella flexneri 2a str. 2457T
aaaugucagcugccagu

SEQ ID NO: 1890314 - RNA, 19 nt, Shigella flexneri 2a str. 2457T
aaauucagaugaugauacu

SEQ ID NO: 1890315 - RNA, 14 nt, Shigella flexneri 2a str. 2457T
aaauuccagcggca

SEQ ID NO: 1890316 - RNA, 16 nt, Shigella flexneri 2a str. 2457T
aaauugacuacaccau

SEQ ID NO: 1890317 - RNA, 17 nt, Shigella flexneri 2a str. 2457T
aaaagcauuuaauacug

SEQ ID NO: 1890318 - RNA, 21 nt, Shigella flexneri 2a str. 2457T
aacagggcgucaccggucaga

SEQ ID NO: 1890319 - RNA, 19 nt, Shigella flexneri 2a str. 2457T
aacagucaguuaucgcauu

SEQ ID NO: 1890320 - RNA, 11 nt, Shigella flexneri 2a str. 2457T
aacaguaaccc

SEQ ID NO: 1890321 - RNA, 12 nt, Shigella flexneri 2a str. 2457T
aacaggaucugg

SEQ ID NO: 1890322 - RNA, 17 nt, Shigella flexneri 2a str. 2457T
aacagcgcaaaacgcag

SEQ ID NO: 1890323 - RNA, 11 nt, Shigella flexneri 2a str. 2457T
aacagcgcauu

SEQ ID NO: 1890324 - RNA, 23 nt, Shigella flexneri 2a str. 2457T
aacaagccgaaacggaaaucgcc

SEQ ID NO: 1890325 - RNA, 17 nt, Shigella flexneri 2a str. 2457T
aacaagauugccugaug

SEQ ID NO: 1890326 - RNA, 23 nt, Shigella flexneri 2a str. 2457T
aacaacuggcguuucucgccacu

SEQ ID NO: 1890327 - RNA, 19 nt, Shigella flexneri 2a str. 2457T
aaaagggcgaucuugcgac

SEQ ID NO: 1890328 - RNA, 16 nt, Shigella flexneri 2a str. 2457T
aacagcaccauccgcc

SEQ ID NO: 1890329 - RNA, 14 nt, Shigella flexneri 2a str. 2457T
aacacucuuuuuga

SEQ ID NO: 1890330 - RNA, 21 nt, Shigella flexneri 2a str. 2457T
aacacugcgcucuucuggcac

SEQ ID NO: 1890331 - RNA, 19 nt, Shigella flexneri 2a str. 2457T
aacacuuuacgcuuuuuga

SEQ ID NO: 1890332 - RNA, 19 nt, Shigella flexneri 2a str. 2457T
aacagaccagcaccggugc

SEQ ID NO: 1890333 - RNA, 17 nt, Shigella flexneri 2a str. 2457T
aacagaauuacuggcag

SEQ ID NO: 1890334 - RNA, 17 nt, Shigella flexneri 2a str. 2457T
aaauaccgagcagccac

SEQ ID NO: 1890335 - RNA, 17 nt, Shigella flexneri 2a str. 2457T
aaauagaauccgcgacu

SEQ ID NO: 1890336 - RNA, 15 nt, Shigella flexneri 2a str. 2457T
aaaguuaucgagcug

SEQ ID NO: 1890337 - RNA, 14 nt, Shigella flexneri 2a str. 2457T
aaauacaaggccaa

SEQ ID NO: 1890338 - RNA, 16 nt, Shigella flexneri 2a str. 2457T
aaagcugucaccaauc

SEQ ID NO: 1890339 - RNA, 21 nt, Shigella flexneri 2a str. 2457T
aaaggaaaaucacaggcgcga

SEQ ID NO: 1890340 - RNA, 19 nt, Shigella flexneri 2a str. 2457T
aaaaauauugagcagaagg

SEQ ID NO: 1890341 - RNA, 16 nt, Shigella flexneri 2a str. 2457T
aaacgguccggcaucc

SEQ ID NO: 1890342 - RNA, 22 nt, Shigella flexneri 2a str. 2457T
aaacgucucacuaacgguguaa

SEQ ID NO: 1890343 - RNA, 20 nt, Shigella flexneri 2a str. 2457T
aaacgguuucagcagcggca

SEQ ID NO: 1890344 - RNA, 22 nt, Shigella flexneri 2a str. 2457T
aaacgucgcaacuccaccagca

SEQ ID NO: 1890345 - RNA, 18 nt, Shigella flexneri 2a str. 2457T
aaacgugaacggcuucgc

SEQ ID NO: 1890346 - RNA, 16 nt, Shigella flexneri 2a str. 2457T
aaacgugacagcauac

SEQ ID NO: 1890347 - RNA, 20 nt, Shigella flexneri 2a str. 2457T
aaacgcaacauugccugaug

SEQ ID NO: 1890348 - RNA, 20 nt, Shigella flexneri 2a str. 2457T
aaacgcaaaauugccugaug

SEQ ID NO: 1890349 - RNA, 16 nt, Shigella flexneri 2a str. 2457T
aaacgcacgucugaug

SEQ ID NO: 1890350 - RNA, 15 nt, Shigella flexneri 2a str. 2457T
aaacgcaccucagca

SEQ ID NO: 1890351 - RNA, 22 nt, Shigella flexneri 2a str. 2457T
aaacucacgccagcagcgcaau

SEQ ID NO: 1890352 - RNA, 17 nt, Shigella flexneri 2a str. 2457T
aaacguuucaaacaggc

SEQ ID NO: 1890353 - RNA, 21 nt, Shigella flexneri 2a str. 2457T
aaacugcgauuuaacgccugg

SEQ ID NO: 1890354 - RNA, 12 nt, Shigella flexneri 2a str. 2457T
aaacucugcggc

SEQ ID NO: 1890355 - RNA, 14 nt, Shigella flexneri 2a str. 2457T
aaagcaauagccgc

SEQ ID NO: 1890356 - RNA, 17 nt, Shigella flexneri 2a str. 2457T
aaagagugugaauauuc

SEQ ID NO: 1890357 - RNA, 12 nt, Shigella flexneri 2a str. 2457T
aaagaucgccac

SEQ ID NO: 1890358 - RNA, 21 nt, Shigella flexneri 2a str. 2457T
aaccaucgagaaucagcgaga

SEQ ID NO: 1890359 - RNA, 16 nt, Shigella flexneri 2a str. 2457T
aaccagcgcagacacc

SEQ ID NO: 1890360 - RNA, 22 nt, Shigella flexneri 2a str. 2457T
aaccaucgagaaucagcgagac

SEQ ID NO: 1890361 - RNA, 14 nt, Shigella flexneri 2a str. 2457T
aaccauuucugcga

SEQ ID NO: 1890362 - RNA, 12 nt, Shigella flexneri 2a str. 2457T
aacccacacauu

SEQ ID NO: 1890363 - RNA, 17 nt, Shigella flexneri 2a str. 2457T
aacccagccgccggaua

SEQ ID NO: 1890364 - RNA, 20 nt, Shigella flexneri 2a str. 2457T
aacccagggccaacuggcaa

SEQ ID NO: 1890365 - RNA, 22 nt, Shigella flexneri 2a str. 2457T
aacccaugccggaugcgccagc

SEQ ID NO: 1890366 - RNA, 23 nt, Shigella flexneri 2a str. 2457T
aaccgcaguguaguucuggccuu

SEQ ID NO: 1890367 - RNA, 21 nt, Shigella flexneri 2a str. 2457T
aaccgcagugauuucaaccgg

SEQ ID NO: 1890368 - RNA, 14 nt, Shigella flexneri 2a str. 2457T
aacagugcaccgga

SEQ ID NO: 1890369 - RNA, 22 nt, Shigella flexneri 2a str. 2457T
aacauacugcccgagcgccauu

SEQ ID NO: 1890370 - RNA, 13 nt, Shigella flexneri 2a str. 2457T
aacaucaggcauu

SEQ ID NO: 1890371 - RNA, 15 nt, Shigella flexneri 2a str. 2457T
aacauccagaucacg

SEQ ID NO: 1890372 - RNA, 15 nt, Shigella flexneri 2a str. 2457T
aacaugagaacaguu

SEQ ID NO: 1890373 - RNA, 13 nt, Shigella flexneri 2a str. 2457T
aacaugccacugg

SEQ ID NO: 1890374 - RNA, 17 nt, Shigella flexneri 2a str. 2457T
aaccacucaccgccguu

SEQ ID NO: 1890375 - RNA, 19 nt, Shigella flexneri 2a str. 2457T
aaccacuauuauggcgcag

SEQ ID NO: 1890376 - RNA, 23 nt, Shigella flexneri 2a str. 2457T
aaccacugacacaggcagcaauc

SEQ ID NO: 1890377 - RNA, 17 nt, Shigella flexneri 2a str. 2457T
aaccagagaaucugcgu

SEQ ID NO: 1890378 - RNA, 21 nt, Shigella flexneri 2a str. 2457T
aaccagagagcuuauccagca

SEQ ID NO: 1890379 - RNA, 15 nt, Shigella flexneri 2a str. 2457T
aaccagaucggacuu

SEQ ID NO: 1890380 - RNA, 13 nt, Shigella flexneri 2a str. 2457T
aaccacauucagc

SEQ ID NO: 1890381 - RNA, 14 nt, Shigella flexneri 2a str. 2457T
aaccacaaugucac

SEQ ID NO: 1890382 - RNA, 14 nt, Shigella flexneri 2a str. 2457T
aaccacagauccgg

SEQ ID NO: 1890383 - RNA, 21 nt, Shigella flexneri 2a str. 2457T
aacgcaguaagcgccagggca

SEQ ID NO: 1890384 - RNA, 21 nt, Shigella flexneri 2a str. 2457T
aacgcaucaggcaacccagaa

SEQ ID NO: 1890385 - RNA, 15 nt, Shigella flexneri 2a str. 2457T
aacgcaacaucgcaa

SEQ ID NO: 1890386 - RNA, 21 nt, Shigella flexneri 2a str. 2457T
aacgcaccaggcgaaaacgcu

SEQ ID NO: 1890387 - RNA, 16 nt, Shigella flexneri 2a str. 2457T
aacgccgccaguacgc

SEQ ID NO: 1890388 - RNA, 16 nt, Shigella flexneri 2a str. 2457T
aacgaugcaugacagc

SEQ ID NO: 1890389 - RNA, 17 nt, Shigella flexneri 2a str. 2457T
aacgaucgcuuucaacg

SEQ ID NO: 1890390 - RNA, 15 nt, Shigella flexneri 2a str. 2457T
aaccgcucgucacau

SEQ ID NO: 1890391 - RNA, 20 nt, Shigella flexneri 2a str. 2457T
aaccuucacccucacgcauu

SEQ ID NO: 1890392 - RNA, 22 nt, Shigella flexneri 2a str. 2457T
aacguaaacgcagcaucaugcc

SEQ ID NO: 1890393 - RNA, 13 nt, Shigella flexneri 2a str. 2457T
aacgguuucagca

SEQ ID NO: 1890394 - RNA, 22 nt, Shigella flexneri 2a str. 2457T
aacguaggcaauuggcgcauca

SEQ ID NO: 1890395 - RNA, 17 nt, Shigella flexneri 2a str. 2457T
aacgucuuugcguucca

SEQ ID NO: 1890396 - RNA, 14 nt, Shigella flexneri 2a str. 2457T
aacgugacauucug

SEQ ID NO: 1890397 - RNA, 19 nt, Shigella flexneri 2a str. 2457T
aacgguccggcauccagcc

SEQ ID NO: 1890398 - RNA, 12 nt, Shigella flexneri 2a str. 2457T
aacgguaucuuu

SEQ ID NO: 1890399 - RNA, 20 nt, Shigella flexneri 2a str. 2457T
aacggguugcgguuucaacu

SEQ ID NO: 1890400 - RNA, 18 nt, Shigella flexneri 2a str. 2457T
aacgggcaaucucauacc

SEQ ID NO: 1890401 - RNA, 20 nt, Shigella flexneri 2a str. 2457T
aacgcuuucuuuggcaucaa

SEQ ID NO: 1890402 - RNA, 20 nt, Shigella flexneri 2a str. 2457T
aacggauucagugagcacau

SEQ ID NO: 1890403 - RNA, 22 nt, Shigella flexneri 2a str. 2457T
aacggcaaaccggacgaucgga

SEQ ID NO: 1890404 - RNA, 14 nt, Shigella flexneri 2a str. 2457T
aacggcaaacgcaa

SEQ ID NO: 1890405 - RNA, 21 nt, Shigella flexneri 2a str. 2457T
aacggcguuuucucaucgcug

SEQ ID NO: 1890406 - RNA, 17 nt, Shigella flexneri 2a str. 2457T
aaucaucuuaauggcga

SEQ ID NO: 1890407 - RNA, 14 nt, Shigella flexneri 2a str. 2457T
aauccccgcgccaa

SEQ ID NO: 1890408 - RNA, 13 nt, Shigella flexneri 2a str. 2457T
aaucccugcgaac

SEQ ID NO: 1890409 - RNA, 13 nt, Shigella flexneri 2a str. 2457T
aauccagaacacc

SEQ ID NO: 1890410 - RNA, 21 nt, Shigella flexneri 2a str. 2457T
aauccagcgguugggcaucgg

SEQ ID NO: 1890411 - RNA, 14 nt, Shigella flexneri 2a str. 2457T
aauccaucccgcuc

SEQ ID NO: 1890412 - RNA, 15 nt, Shigella flexneri 2a str. 2457T
aauccauucaucgcc

SEQ ID NO: 1890413 - RNA, 14 nt, Shigella flexneri 2a str. 2457T
aauagcgaagacug

SEQ ID NO: 1890414 - RNA, 19 nt, Shigella flexneri 2a str. 2457T
aauagcgugauuguggcaa

SEQ ID NO: 1890415 - RNA, 11 nt, Shigella flexneri 2a str. 2457T
aaucagcgcag

SEQ ID NO: 1890416 - RNA, 11 nt, Shigella flexneri 2a str. 2457T
aaucagcgcca

SEQ ID NO: 1890417 - RNA, 21 nt, Shigella flexneri 2a str. 2457T
aaucaguaaauugcagcacac

SEQ ID NO: 1890418 - RNA, 20 nt, Shigella flexneri 2a str. 2457T
aaucagccagaacagcggug

SEQ ID NO: 1890419 - RNA, 23 nt, Shigella flexneri 2a str. 2457T
aauauaagucaggguauuaaccg

SEQ ID NO: 1890420 - RNA, 23 nt, Shigella flexneri 2a str. 2457T
aauccuucacuuuugccagacga

SEQ ID NO: 1890421 - RNA, 19 nt, Shigella flexneri 2a str. 2457T
aaucgccaucuuuacaccu

SEQ ID NO: 1890422 - RNA, 21 nt, Shigella flexneri 2a str. 2457T
aaucgccagcaaaaucaccau

SEQ ID NO: 1890423 - RNA, 14 nt, Shigella flexneri 2a str. 2457T
aaucgccagcggca

SEQ ID NO: 1890424 - RNA, 17 nt, Shigella flexneri 2a str. 2457T
aaucgcaacgccuuccg

SEQ ID NO: 1890425 - RNA, 20 nt, Shigella flexneri 2a str. 2457T
aaucgagcccagaugccgga

SEQ ID NO: 1890426 - RNA, 22 nt, Shigella flexneri 2a str. 2457T
aaucgagcccagaugccggaug

SEQ ID NO: 1890427 - RNA, 17 nt, Shigella flexneri 2a str. 2457T
aaucucaauguauuccc

SEQ ID NO: 1890428 - RNA, 14 nt, Shigella flexneri 2a str. 2457T
aaucucacccgcuu

SEQ ID NO: 1890429 - RNA, 15 nt, Shigella flexneri 2a str. 2457T
aaucguaaucagcau

SEQ ID NO: 1890430 - RNA, 13 nt, Shigella flexneri 2a str. 2457T
aauuucagcaaua

SEQ ID NO: 1890431 - RNA, 13 nt, Shigella flexneri 2a str. 2457T
aauuucagcgccu

SEQ ID NO: 1890432 - RNA, 15 nt, Shigella flexneri 2a str. 2457T
aauuucagcgccuga

SEQ ID NO: 1890433 - RNA, 20 nt, Shigella flexneri 2a str. 2457T
aauuugcuucuggcuggcgc

SEQ ID NO: 1890434 - RNA, 19 nt, Shigella flexneri 2a str. 2457T
aauuugccaucucugcaac

SEQ ID NO: 1890435 - RNA, 17 nt, Shigella flexneri 2a str. 2457T
aauucagccgcgcgcuu

SEQ ID NO: 1890436 - RNA, 21 nt, Shigella flexneri 2a str. 2457T
aauucagaugaugauacugac

SEQ ID NO: 1890437 - RNA, 21 nt, Shigella flexneri 2a str. 2457T
aauucagaaaaauacaauucu

SEQ ID NO: 1890438 - RNA, 20 nt, Shigella flexneri 2a str. 2457T
aauuaucacaacuucgcgaa

SEQ ID NO: 1890439 - RNA, 15 nt, Shigella flexneri 2a str. 2457T
aauguuccagugcgu

SEQ ID NO: 1890440 - RNA, 15 nt, Shigella flexneri 2a str. 2457T
aauguuaccgaucgc

SEQ ID NO: 1890441 - RNA, 21 nt, Shigella flexneri 2a str. 2457T
aaugucggauuucgcagccau

SEQ ID NO: 1890442 - RNA, 18 nt, Shigella flexneri 2a str. 2457T
aaugucgauuaucgacuc

SEQ ID NO: 1890443 - RNA, 15 nt, Shigella flexneri 2a str. 2457T
aaugaugcggcgcuu

SEQ ID NO: 1890444 - RNA, 23 nt, Shigella flexneri 2a str. 2457T
aaugccgauauaaauuccacgcg

SEQ ID NO: 1890445 - RNA, 22 nt, Shigella flexneri 2a str. 2457T
aaugauugggauuaaagcgcuc

SEQ ID NO: 1890446 - RNA, 21 nt, Shigella flexneri 2a str. 2457T
aaugccgcguggccuggaauu

SEQ ID NO: 1890447 - RNA, 14 nt, Shigella flexneri 2a str. 2457T
aaucuggccugaga

SEQ ID NO: 1890448 - RNA, 23 nt, Shigella flexneri 2a str. 2457T
aaucugcaucaccaucuugagaa

SEQ ID NO: 1890449 - RNA, 13 nt, Shigella flexneri 2a str. 2457T
aaucugccugaug

SEQ ID NO: 1890450 - RNA, 13 nt, Shigella flexneri 2a str. 2457T
aaucugcaaaaua

SEQ ID NO: 1890451 - RNA, 11 nt, Shigella flexneri 2a str. 2457T
aaugccugaug

SEQ ID NO: 1890452 - RNA, 14 nt, Shigella flexneri 2a str. 2457T
aaugccuaccgcau

SEQ ID NO: 1890453 - RNA, 18 nt, Shigella flexneri 2a str. 2457T
aaugcgacaacagaaaua

SEQ ID NO: 1890454 - RNA, 14 nt, Shigella flexneri 2a str. 2457T
aaugcgacccaugc

SEQ ID NO: 1890455 - RNA, 17 nt, Shigella flexneri 2a str. 2457T
aauggagcuaaacagcg

SEQ ID NO: 1890456 - RNA, 19 nt, Shigella flexneri 2a str. 2457T
aauggagcuaaacagcgcu

SEQ ID NO: 1890457 - RNA, 14 nt, Shigella flexneri 2a str. 2457T
aauggcagauaauc

SEQ ID NO: 1890458 - RNA, 17 nt, Shigella flexneri 2a str. 2457T
aauggcaucugauaagc

SEQ ID NO: 1890459 - RNA, 13 nt, Shigella flexneri 2a str. 2457T
aauggccugcgcg

SEQ ID NO: 1890460 - RNA, 21 nt, Shigella flexneri 2a str. 2457T
aauaaacgccauauucugauc

SEQ ID NO: 1890461 - RNA, 17 nt, Shigella flexneri 2a str. 2457T
aauaaaagcauaccgga

SEQ ID NO: 1890462 - RNA, 18 nt, Shigella flexneri 2a str. 2457T
aaguuuuuaugaguuugg

SEQ ID NO: 1890463 - RNA, 19 nt, Shigella flexneri 2a str. 2457T
aagucacgccaauaaucga

SEQ ID NO: 1890464 - RNA, 19 nt, Shigella flexneri 2a str. 2457T
aauaccaucggcagcgcca

SEQ ID NO: 1890465 - RNA, 20 nt, Shigella flexneri 2a str. 2457T
aauaccgccugacggugaug

SEQ ID NO: 1890466 - RNA, 23 nt, Shigella flexneri 2a str. 2457T
aauaccgagcagccacugcggca

SEQ ID NO: 1890467 - RNA, 19 nt, Shigella flexneri 2a str. 2457T
aauaccggcgucccaucgg

SEQ ID NO: 1890468 - RNA, 13 nt, Shigella flexneri 2a str. 2457T
aauaccugccugu

SEQ ID NO: 1890469 - RNA, 21 nt, Shigella flexneri 2a str. 2457T
aauaccagccuucuucaucca

SEQ ID NO: 1890470 - RNA, 15 nt, Shigella flexneri 2a str. 2457T
aauacaguugcgcca

SEQ ID NO: 1890471 - RNA, 14 nt, Shigella flexneri 2a str. 2457T
aauacaaccugcug

SEQ ID NO: 1890472 - RNA, 15 nt, Shigella flexneri 2a str. 2457T
aauaauuucggcagc

SEQ ID NO: 1890473 - RNA, 14 nt, Shigella flexneri 2a str. 2457T
aaguacuccugcuc

SEQ ID NO: 1890474 - RNA, 23 nt, Shigella flexneri 2a str. 2457T
aaguaaugcggcaagggcgaauc

SEQ ID NO: 1890475 - RNA, 18 nt, Shigella flexneri 2a str. 2457T
aagggguuuuccaguuca

SEQ ID NO: 1890476 - RNA, 13 nt, Shigella flexneri 2a str. 2457T
aagggcaaaguca

SEQ ID NO: 1890477 - RNA, 14 nt, Shigella flexneri 2a str. 2457T
aagcugugccugaa

SEQ ID NO: 1890478 - RNA, 19 nt, Shigella flexneri 2a str. 2457T
aaggaaccuccauguccag

SEQ ID NO: 1890479 - RNA, 17 nt, Shigella flexneri 2a str. 2457T
aagaguuuuaaacgcag

SEQ ID NO: 1890480 - RNA, 16 nt, Shigella flexneri 2a str. 2457T
aagagcagcugauuga

SEQ ID NO: 1890481 - RNA, 21 nt, Shigella flexneri 2a str. 2457T
aacguugcucaaggguuucgc

SEQ ID NO: 1890482 - RNA, 23 nt, Shigella flexneri 2a str. 2457T
aacuacggcuccgcaagcgaaug

SEQ ID NO: 1890483 - RNA, 20 nt, Shigella flexneri 2a str. 2457T
aacguggggugaauaaucgc

SEQ ID NO: 1890484 - RNA, 13 nt, Shigella flexneri 2a str. 2457T
aacguuauauccc

SEQ ID NO: 1890485 - RNA, 14 nt, Shigella flexneri 2a str. 2457T
aagcaaaaacgcau

SEQ ID NO: 1890486 - RNA, 18 nt, Shigella flexneri 2a str. 2457T
aagcaacgcgcaccguga

SEQ ID NO: 1890487 - RNA, 13 nt, Shigella flexneri 2a str. 2457T
aagcaaauuguga

SEQ ID NO: 1890488 - RNA, 24 nt, Shigella flexneri 2a str. 2457T
aagcacuggcggcagcaggugcgc

SEQ ID NO: 1890489 - RNA, 14 nt, Shigella flexneri 2a str. 2457T
aagaucgccacugc

SEQ ID NO: 1890490 - RNA, 21 nt, Shigella flexneri 2a str. 2457T
aagaucgcccugagggacguu

SEQ ID NO: 1890491 - RNA, 17 nt, Shigella flexneri 2a str. 2457T
aagauaugcauccgcug

SEQ ID NO: 1890492 - RNA, 18 nt, Shigella flexneri 2a str. 2457T
aagcccaguaccgccagu

SEQ ID NO: 1890493 - RNA, 19 nt, Shigella flexneri 2a str. 2457T
aagcccccgcaacauugcg

SEQ ID NO: 1890494 - RNA, 15 nt, Shigella flexneri 2a str. 2457T
aagcccgccaucgcc

SEQ ID NO: 1890495 - RNA, 13 nt, Shigella flexneri 2a str. 2457T
aagcaugauauuc

SEQ ID NO: 1890496 - RNA, 22 nt, Shigella flexneri 2a str. 2457T
aagcaggucggcucagccgaug

SEQ ID NO: 1890497 - RNA, 23 nt, Shigella flexneri 2a str. 2457T
aagcaggucggcucagccgauga

SEQ ID NO: 1890498 - RNA, 23 nt, Shigella flexneri 2a str. 2457T
aagccugagcucuaguuaaccaa

SEQ ID NO: 1890499 - RNA, 18 nt, Shigella flexneri 2a str. 2457T
aagcccgccaucgcccau

SEQ ID NO: 1890500 - RNA, 14 nt, Shigella flexneri 2a str. 2457T
aagcgucgcaucag

SEQ ID NO: 1890501 - RNA, 19 nt, Shigella flexneri 2a str. 2457T
aagcgcugagacgcgcuug

SEQ ID NO: 1890502 - RNA, 18 nt, Shigella flexneri 2a str. 2457T
aagcucucuuccaguucg

SEQ ID NO: 1890503 - RNA, 17 nt, Shigella flexneri 2a str. 2457T
aagcugcauacggugaa

SEQ ID NO: 1890504 - RNA, 19 nt, Shigella flexneri 2a str. 2457T
aagcugacaggcgcugaug

SEQ ID NO: 1890505 - RNA, 19 nt, Shigella flexneri 2a str. 2457T
accccgucaccacuucacc

SEQ ID NO: 1890506 - RNA, 15 nt, Shigella flexneri 2a str. 2457T
acccgcagccaucac

SEQ ID NO: 1890507 - RNA, 15 nt, Shigella flexneri 2a str. 2457T
acccacugcgcagug

SEQ ID NO: 1890508 - RNA, 14 nt, Shigella flexneri 2a str. 2457T
acccaaccgguaau

SEQ ID NO: 1890509 - RNA, 15 nt, Shigella flexneri 2a str. 2457T
acccaccgcaauaac

SEQ ID NO: 1890510 - RNA, 13 nt, Shigella flexneri 2a str. 2457T
acccaccgguccu

SEQ ID NO: 1890511 - RNA, 13 nt, Shigella flexneri 2a str. 2457T
accagcugacgua

SEQ ID NO: 1890512 - RNA, 15 nt, Shigella flexneri 2a str. 2457T
accgacgucgauaua

SEQ ID NO: 1890513 - RNA, 22 nt, Shigella flexneri 2a str. 2457T
accgacuccguagaaccuugcu

SEQ ID NO: 1890514 - RNA, 14 nt, Shigella flexneri 2a str. 2457T
acccugugcgccac

SEQ ID NO: 1890515 - RNA, 21 nt, Shigella flexneri 2a str. 2457T
acccuguguggugagauugcu

SEQ ID NO: 1890516 - RNA, 17 nt, Shigella flexneri 2a str. 2457T
acccugcucuuucagca

SEQ ID NO: 1890517 - RNA, 18 nt, Shigella flexneri 2a str. 2457T
acccuugccggaugcggc

SEQ ID NO: 1890518 - RNA, 17 nt, Shigella flexneri 2a str. 2457T
acccugaguuuucagua

SEQ ID NO: 1890519 - RNA, 14 nt, Shigella flexneri 2a str. 2457T
acccuaccagcugc

SEQ ID NO: 1890520 - RNA, 24 nt, Shigella flexneri 2a str. 2457T
acccguaggccggauaagaugcgc

SEQ ID NO: 1890521 - RNA, 18 nt, Shigella flexneri 2a str. 2457T
acccggcugauuuaucag

SEQ ID NO: 1890522 - RNA, 15 nt, Shigella flexneri 2a str. 2457T
accgcgacaguauca

SEQ ID NO: 1890523 - RNA, 15 nt, Shigella flexneri 2a str. 2457T
accgcuacuggcaau

SEQ ID NO: 1890524 - RNA, 14 nt, Shigella flexneri 2a str. 2457T
accgcucagcuccu

SEQ ID NO: 1890525 - RNA, 19 nt, Shigella flexneri 2a str. 2457T
accgcgguguauaccagcu

SEQ ID NO: 1890526 - RNA, 19 nt, Shigella flexneri 2a str. 2457T
accgccgucgauggcgcag

SEQ ID NO: 1890527 - RNA, 16 nt, Shigella flexneri 2a str. 2457T
accgccacagcagccu

SEQ ID NO: 1890528 - RNA, 22 nt, Shigella flexneri 2a str. 2457T
accgcccagugcggugccgcga

SEQ ID NO: 1890529 - RNA, 18 nt, Shigella flexneri 2a str. 2457T
accgccaccagcgucaga

SEQ ID NO: 1890530 - RNA, 22 nt, Shigella flexneri 2a str. 2457T
accgccaccaggaacgcgccaa

SEQ ID NO: 1890531 - RNA, 16 nt, Shigella flexneri 2a str. 2457T
accgccaucauggaug

SEQ ID NO: 1890532 - RNA, 23 nt, Shigella flexneri 2a str. 2457T
accggcauguuuaauucugcggc

SEQ ID NO: 1890533 - RNA, 18 nt, Shigella flexneri 2a str. 2457T
accggaaggauuaucccg

SEQ ID NO: 1890534 - RNA, 22 nt, Shigella flexneri 2a str. 2457T
accggaaaaggcguucacgccg

SEQ ID NO: 1890535 - RNA, 18 nt, Shigella flexneri 2a str. 2457T
accggcuucucgccuacc

SEQ ID NO: 1890536 - RNA, 13 nt, Shigella flexneri 2a str. 2457T
accggcuccagau

SEQ ID NO: 1890537 - RNA, 14 nt, Shigella flexneri 2a str. 2457T
accaccugcaauac

SEQ ID NO: 1890538 - RNA, 18 nt, Shigella flexneri 2a str. 2457T
accacgacaccuuucacg

SEQ ID NO: 1890539 - RNA, 16 nt, Shigella flexneri 2a str. 2457T
accacggcgugccguc

SEQ ID NO: 1890540 - RNA, 18 nt, Shigella flexneri 2a str. 2457T
accacggccuuccucggc

SEQ ID NO: 1890541 - RNA, 15 nt, Shigella flexneri 2a str. 2457T
accacguaccacggc

SEQ ID NO: 1890542 - RNA, 18 nt, Shigella flexneri 2a str. 2457T
accaccggcaccacuugc

SEQ ID NO: 1890543 - RNA, 22 nt, Shigella flexneri 2a str. 2457T
accacccccagaugacggcugc

SEQ ID NO: 1890544 - RNA, 17 nt, Shigella flexneri 2a str. 2457T
accacccagcagcgccg

SEQ ID NO: 1890545 - RNA, 13 nt, Shigella flexneri 2a str. 2457T
accacaacgacaa

SEQ ID NO: 1890546 - RNA, 16 nt, Shigella flexneri 2a str. 2457T
accaauguaauacgcu

SEQ ID NO: 1890547 - RNA, 12 nt, Shigella flexneri 2a str. 2457T
accaaugucagg

SEQ ID NO: 1890548 - RNA, 14 nt, Shigella flexneri 2a str. 2457T
accaccagcaccgc

SEQ ID NO: 1890549 - RNA, 19 nt, Shigella flexneri 2a str. 2457T
accagaucuucaucaccga

SEQ ID NO: 1890550 - RNA, 17 nt, Shigella flexneri 2a str. 2457T
accagcaaauauugcau

SEQ ID NO: 1890551 - RNA, 22 nt, Shigella flexneri 2a str. 2457T
accagcaacaaauaaccgccug

SEQ ID NO: 1890552 - RNA, 13 nt, Shigella flexneri 2a str. 2457T
accagcaacgcuu

SEQ ID NO: 1890553 - RNA, 14 nt, Shigella flexneri 2a str. 2457T
accacugcaaugac

SEQ ID NO: 1890554 - RNA, 13 nt, Shigella flexneri 2a str. 2457T
accacuccggcau

SEQ ID NO: 1890555 - RNA, 13 nt, Shigella flexneri 2a str. 2457T
accacucaccgcu

SEQ ID NO: 1890556 - RNA, 17 nt, Shigella flexneri 2a str. 2457T
accacuauuauggcgca

SEQ ID NO: 1890557 - RNA, 13 nt, Shigella flexneri 2a str. 2457T
accacucaccgcc

SEQ ID NO: 1890558 - RNA, 23 nt, Shigella flexneri 2a str. 2457T
accagaaucaaucccaucaggcg

SEQ ID NO: 1890559 - RNA, 14 nt, Shigella flexneri 2a str. 2457T
accacuucggcaaa

SEQ ID NO: 1890560 - RNA, 14 nt, Shigella flexneri 2a str. 2457T
accacugcgccagc

SEQ ID NO: 1890561 - RNA, 23 nt, Shigella flexneri 2a str. 2457T
accagcggacaaugccuaccgca

SEQ ID NO: 1890562 - RNA, 18 nt, Shigella flexneri 2a str. 2457T
accagcguuuccagcacc

SEQ ID NO: 1890563 - RNA, 19 nt, Shigella flexneri 2a str. 2457T
accagcgucgcaucaggca

SEQ ID NO: 1890564 - RNA, 14 nt, Shigella flexneri 2a str. 2457T
acauguugaaauuc

SEQ ID NO: 1890565 - RNA, 21 nt, Shigella flexneri 2a str. 2457T
acauugccugaugcgacgcug

SEQ ID NO: 1890566 - RNA, 21 nt, Shigella flexneri 2a str. 2457T
acauucugcaucgcgcugaac

SEQ ID NO: 1890567 - RNA, 20 nt, Shigella flexneri 2a str. 2457T
accaaaaucaucaauugcca

SEQ ID NO: 1890568 - RNA, 15 nt, Shigella flexneri 2a str. 2457T
accaaaggcgaugcu

SEQ ID NO: 1890569 - RNA, 11 nt, Shigella flexneri 2a str. 2457T
acauccggcau

SEQ ID NO: 1890570 - RNA, 19 nt, Shigella flexneri 2a str. 2457T
acauccgggcgaacuggcg

SEQ ID NO: 1890571 - RNA, 20 nt, Shigella flexneri 2a str. 2457T
acauccugcguuaaucgccg

SEQ ID NO: 1890572 - RNA, 20 nt, Shigella flexneri 2a str. 2457T
acaucaugguuugcauccac

SEQ ID NO: 1890573 - RNA, 15 nt, Shigella flexneri 2a str. 2457T
acauccgccaucgac

SEQ ID NO: 1890574 - RNA, 16 nt, Shigella flexneri 2a str. 2457T
acaugcagggcaaacu

SEQ ID NO: 1890575 - RNA, 19 nt, Shigella flexneri 2a str. 2457T
acaugaaccgugucgccau

SEQ ID NO: 1890576 - RNA, 21 nt, Shigella flexneri 2a str. 2457T
acaugaaccgugucgccauca

SEQ ID NO: 1890577 - RNA, 21 nt, Shigella flexneri 2a str. 2457T
acagugacuuccguaccggcc

SEQ ID NO: 1890578 - RNA, 17 nt, Shigella flexneri 2a str. 2457T
acauacaaauagccaau

SEQ ID NO: 1890579 - RNA, 19 nt, Shigella flexneri 2a str. 2457T
acaucaucagaaaugccag

SEQ ID NO: 1890580 - RNA, 22 nt, Shigella flexneri 2a str. 2457T
acagggccaggaaucgcaaacc

SEQ ID NO: 1890581 - RNA, 19 nt, Shigella flexneri 2a str. 2457T
acaggcagggccaccagcg

SEQ ID NO: 1890582 - RNA, 23 nt, Shigella flexneri 2a str. 2457T
acagcgccuguuuaccgcucacc

SEQ ID NO: 1890583 - RNA, 21 nt, Shigella flexneri 2a str. 2457T
acagccgccagacaauugccg

SEQ ID NO: 1890584 - RNA, 22 nt, Shigella flexneri 2a str. 2457T
acagccccaggguuuugcccag

SEQ ID NO: 1890585 - RNA, 16 nt, Shigella flexneri 2a str. 2457T
acagccccugagcguu

SEQ ID NO: 1890586 - RNA, 22 nt, Shigella flexneri 2a str. 2457T
acagcaucaggcuaaucgccag

SEQ ID NO: 1890587 - RNA, 20 nt, Shigella flexneri 2a str. 2457T
acagccaaaucaucaguacc

SEQ ID NO: 1890588 - RNA, 23 nt, Shigella flexneri 2a str. 2457T
acgccagucacggugcagcucgc

SEQ ID NO: 1890589 - RNA, 14 nt, Shigella flexneri 2a str. 2457T
acgccaugaagaug

SEQ ID NO: 1890590 - RNA, 16 nt, Shigella flexneri 2a str. 2457T
acgcccaaugcccaga

SEQ ID NO: 1890591 - RNA, 18 nt, Shigella flexneri 2a str. 2457T
acgcccacgccagccugc

SEQ ID NO: 1890592 - RNA, 17 nt, Shigella flexneri 2a str. 2457T
acgccagacucgccaga

SEQ ID NO: 1890593 - RNA, 12 nt, Shigella flexneri 2a str. 2457T
acgccagcagca

SEQ ID NO: 1890594 - RNA, 12 nt, Shigella flexneri 2a str. 2457T
acgccagucacg

SEQ ID NO: 1890595 - RNA, 17 nt, Shigella flexneri 2a str. 2457T
acgccccuucugccgca

SEQ ID NO: 1890596 - RNA, 14 nt, Shigella flexneri 2a str. 2457T
acgccacaaucuca

SEQ ID NO: 1890597 - RNA, 21 nt, Shigella flexneri 2a str. 2457T
acgcaucacgaaucgccgcau

SEQ ID NO: 1890598 - RNA, 15 nt, Shigella flexneri 2a str. 2457T
acgcauaugcaucag

SEQ ID NO: 1890599 - RNA, 12 nt, Shigella flexneri 2a str. 2457T
acgcaucgacau

SEQ ID NO: 1890600 - RNA, 18 nt, Shigella flexneri 2a str. 2457T
acgcaucgcugcgcuuac

SEQ ID NO: 1890601 - RNA, 19 nt, Shigella flexneri 2a str. 2457T
acgcaucuucuccggccuu

SEQ ID NO: 1890602 - RNA, 21 nt, Shigella flexneri 2a str. 2457T
acgcagcgucucauaccggau

SEQ ID NO: 1890603 - RNA, 15 nt, Shigella flexneri 2a str. 2457T
acgcagugauaacuc

SEQ ID NO: 1890604 - RNA, 22 nt, Shigella flexneri 2a str. 2457T
acgaugccgccgaggauacagc

SEQ ID NO: 1890605 - RNA, 21 nt, Shigella flexneri 2a str. 2457T
acgaugccugaugcgacgcuu

SEQ ID NO: 1890606 - RNA, 21 nt, Shigella flexneri 2a str. 2457T
accuucgaaugccgcagcacc

SEQ ID NO: 1890607 - RNA, 21 nt, Shigella flexneri 2a str. 2457T
accuuccucaccguuuaagaa

SEQ ID NO: 1890608 - RNA, 16 nt, Shigella flexneri 2a str. 2457T
accuuccgguuucaaa

SEQ ID NO: 1890609 - RNA, 20 nt, Shigella flexneri 2a str. 2457T
accuucgccgcccagccagc

SEQ ID NO: 1890610 - RNA, 20 nt, Shigella flexneri 2a str. 2457T
accuuacuuaauuugccgca

SEQ ID NO: 1890611 - RNA, 14 nt, Shigella flexneri 2a str. 2457T
accuuacccgcgac

SEQ ID NO: 1890612 - RNA, 21 nt, Shigella flexneri 2a str. 2457T
accuuaucaaucucagcaaga

SEQ ID NO: 1890613 - RNA, 19 nt, Shigella flexneri 2a str. 2457T
acgaugacugaacaggcaa

SEQ ID NO: 1890614 - RNA, 23 nt, Shigella flexneri 2a str. 2457T
acgaucaucgacaguaccagcag

SEQ ID NO: 1890615 - RNA, 20 nt, Shigella flexneri 2a str. 2457T
accugcuggaaaggccgcga

SEQ ID NO: 1890616 - RNA, 15 nt, Shigella flexneri 2a str. 2457T
accugcucgucaucc

SEQ ID NO: 1890617 - RNA, 22 nt, Shigella flexneri 2a str. 2457T
accugcugauuaucggcaucgc

SEQ ID NO: 1890618 - RNA, 19 nt, Shigella flexneri 2a str. 2457T
accugggugagcgucaucg

SEQ ID NO: 1890619 - RNA, 19 nt, Shigella flexneri 2a str. 2457T
acgccguucuucagcgucc

SEQ ID NO: 1890620 - RNA, 20 nt, Shigella flexneri 2a str. 2457T
acgccuaauccagccuacaa

SEQ ID NO: 1890621 - RNA, 15 nt, Shigella flexneri 2a str. 2457T
acgccuaauccagcc

SEQ ID NO: 1890622 - RNA, 22 nt, Shigella flexneri 2a str. 2457T
acgccgcuuuuuuuacgucugc

SEQ ID NO: 1890623 - RNA, 12 nt, Shigella flexneri 2a str. 2457T
acgccgguugcg

SEQ ID NO: 1890624 - RNA, 16 nt, Shigella flexneri 2a str. 2457T
acgccgcauccggcau

SEQ ID NO: 1890625 - RNA, 15 nt, Shigella flexneri 2a str. 2457T
acgccgcaucaggca

SEQ ID NO: 1890626 - RNA, 23 nt, Shigella flexneri 2a str. 2457T
acgccgcgcccgcuaaugcgacc

SEQ ID NO: 1890627 - RNA, 13 nt, Shigella flexneri 2a str. 2457T
acgccgaagugcg

SEQ ID NO: 1890628 - RNA, 13 nt, Shigella flexneri 2a str. 2457T
acgccgacggguc

SEQ ID NO: 1890629 - RNA, 16 nt, Shigella flexneri 2a str. 2457T
acgcggcaacggcuuc

SEQ ID NO: 1890630 - RNA, 20 nt, Shigella flexneri 2a str. 2457T
acgcggcagcgucgcaucag

SEQ ID NO: 1890631 - RNA, 22 nt, Shigella flexneri 2a str. 2457T
acgccuguaccagcggcuucca

SEQ ID NO: 1890632 - RNA, 19 nt, Shigella flexneri 2a str. 2457T
acgccuuauccagccuaca

SEQ ID NO: 1890633 - RNA, 19 nt, Shigella flexneri 2a str. 2457T
acgccuuauccggccuaca

SEQ ID NO: 1890634 - RNA, 20 nt, Shigella flexneri 2a str. 2457T
acgccuucuccggcuuacaa

SEQ ID NO: 1890635 - RNA, 20 nt, Shigella flexneri 2a str. 2457T
acgccuuauccggccuacga

SEQ ID NO: 1890636 - RNA, 17 nt, Shigella flexneri 2a str. 2457T
acgccuuccgucagcaa

SEQ ID NO: 1890637 - RNA, 20 nt, Shigella flexneri 2a str. 2457T
acgcgccagcgucgcaucag

SEQ ID NO: 1890638 - RNA, 19 nt, Shigella flexneri 2a str. 2457T
acgcguccgguuucgugaa

SEQ ID NO: 1890639 - RNA, 20 nt, Shigella flexneri 2a str. 2457T
acgcgucagcgucgcaucug

SEQ ID NO: 1890640 - RNA, 20 nt, Shigella flexneri 2a str. 2457T
acgcgucagaguguugcggc

SEQ ID NO: 1890641 - RNA, 15 nt, Shigella flexneri 2a str. 2457T
acgcguaaagcgucg

SEQ ID NO: 1890642 - RNA, 22 nt, Shigella flexneri 2a str. 2457T
acgcguacccagcagcgccaca

SEQ ID NO: 1890643 - RNA, 17 nt, Shigella flexneri 2a str. 2457T
acgcguggcaauggcga

SEQ ID NO: 1890644 - RNA, 19 nt, Shigella flexneri 2a str. 2457T
acgcguuagcaucgcauca

SEQ ID NO: 1890645 - RNA, 19 nt, Shigella flexneri 2a str. 2457T
acgcgucuuaucaggccag

SEQ ID NO: 1890646 - RNA, 20 nt, Shigella flexneri 2a str. 2457T
acgcguuagcaucgcaucag

SEQ ID NO: 1890647 - RNA, 20 nt, Shigella flexneri 2a str. 2457T
acgcguuauccggcuaacaa

SEQ ID NO: 1890648 - RNA, 22 nt, Shigella flexneri 2a str. 2457T
aaaccaacgcuguccggcgcac

SEQ ID NO: 1890649 - RNA, 23 nt, Shigella flexneri 2a str. 2457T
acgcuggcgcgucuuaucaggcc

SEQ ID NO: 1890650 - RNA, 22 nt, Shigella flexneri 2a str. 2457T
acgcuacauccgacaaaacgau

SEQ ID NO: 1890651 - RNA, 14 nt, Shigella flexneri 2a str. 2457T
acggcgcauugcca

SEQ ID NO: 1890652 - RNA, 16 nt, Shigella flexneri 2a str. 2457T
acggcgaccgaagccu

SEQ ID NO: 1890653 - RNA, 18 nt, Shigella flexneri 2a str. 2457T
aaaccaguuuuuacgccc

SEQ ID NO: 1890654 - RNA, 20 nt, Shigella flexneri 2a str. 2457T
aaaccacuauuauggcgcag

SEQ ID NO: 1890655 - RNA, 18 nt, Shigella flexneri 2a str. 2457T
aaaccaaucaccgccacu

SEQ ID NO: 1890656 - RNA, 22 nt, Shigella flexneri 2a str. 2457T
aaaccacugcaacagcuguuga

SEQ ID NO: 1890657 - RNA, 18 nt, Shigella flexneri 2a str. 2457T
aaaccacagaccggacug

SEQ ID NO: 1890658 - RNA, 18 nt, Shigella flexneri 2a str. 2457T
aaaccaacuccagcggcg

SEQ ID NO: 1890659 - RNA, 17 nt, Shigella flexneri 2a str. 2457T
acgcugguaacggcguc

SEQ ID NO: 1890660 - RNA, 22 nt, Shigella flexneri 2a str. 2457T
acggcgucgauugcucaacgcc

SEQ ID NO: 1890661 - RNA, 17 nt, Shigella flexneri 2a str. 2457T
acggcucacgcccauca

SEQ ID NO: 1890662 - RNA, 14 nt, Shigella flexneri 2a str. 2457T
acggcucgcccguu

SEQ ID NO: 1890663 - RNA, 22 nt, Shigella flexneri 2a str. 2457T
acggcugcugcuuucgccgcga

SEQ ID NO: 1890664 - RNA, 19 nt, Shigella flexneri 2a str. 2457T
acggcuugcgcgcaaucag

SEQ ID NO: 1890665 - RNA, 16 nt, Shigella flexneri 2a str. 2457T
acguagcaauucggau

SEQ ID NO: 1890666 - RNA, 12 nt, Shigella flexneri 2a str. 2457T
acguagcaccga

SEQ ID NO: 1890667 - RNA, 20 nt, Shigella flexneri 2a str. 2457T
acguacaaacgcuuuacuca

SEQ ID NO: 1890668 - RNA, 20 nt, Shigella flexneri 2a str. 2457T
acguaccacgcacagcccgc

SEQ ID NO: 1890669 - RNA, 14 nt, Shigella flexneri 2a str. 2457T
acgugacauucuga

SEQ ID NO: 1890670 - RNA, 23 nt, Shigella flexneri 2a str. 2457T
acgucuuccauugccgcuuucca

SEQ ID NO: 1890671 - RNA, 20 nt, Shigella flexneri 2a str. 2457T
acgucuuugcguuccaucag

SEQ ID NO: 1890672 - RNA, 16 nt, Shigella flexneri 2a str. 2457T
acgugccgcagcuucu

SEQ ID NO: 1890673 - RNA, 14 nt, Shigella flexneri 2a str. 2457T
acucguucagcgca

SEQ ID NO: 1890674 - RNA, 18 nt, Shigella flexneri 2a str. 2457T
acucgugcgucgcauccg

SEQ ID NO: 1890675 - RNA, 17 nt, Shigella flexneri 2a str. 2457T
acucggcggcuuaaccg

SEQ ID NO: 1890676 - RNA, 12 nt, Shigella flexneri 2a str. 2457T
acuccagcgcca

SEQ ID NO: 1890677 - RNA, 14 nt, Shigella flexneri 2a str. 2457T
acuccagcgccagc

SEQ ID NO: 1890678 - RNA, 14 nt, Shigella flexneri 2a str. 2457T
acucccgugccaga

SEQ ID NO: 1890679 - RNA, 15 nt, Shigella flexneri 2a str. 2457T
acucaucaccaucag

SEQ ID NO: 1890680 - RNA, 22 nt, Shigella flexneri 2a str. 2457T
acguugauuuugucauggcgca

SEQ ID NO: 1890681 - RNA, 21 nt, Shigella flexneri 2a str. 2457T
acguugagagguaaaaccuga

SEQ ID NO: 1890682 - RNA, 23 nt, Shigella flexneri 2a str. 2457T
acguugcugacuguaggccggau

SEQ ID NO: 1890683 - RNA, 16 nt, Shigella flexneri 2a str. 2457T
acucagcgccugcugc

SEQ ID NO: 1890684 - RNA, 13 nt, Shigella flexneri 2a str. 2457T
acucagcggcugc

SEQ ID NO: 1890685 - RNA, 18 nt, Shigella flexneri 2a str. 2457T
acucagcggcugccagca

SEQ ID NO: 1890686 - RNA, 22 nt, Shigella flexneri 2a str. 2457T
acucagccaaaucccgugaugc

SEQ ID NO: 1890687 - RNA, 19 nt, Shigella flexneri 2a str. 2457T
acucaccgaugaucgccau

SEQ ID NO: 1890688 - RNA, 15 nt, Shigella flexneri 2a str. 2457T
acucaauggcauccg

SEQ ID NO: 1890689 - RNA, 19 nt, Shigella flexneri 2a str. 2457T
acucaauggcauccgccac

SEQ ID NO: 1890690 - RNA, 15 nt, Shigella flexneri 2a str. 2457T
acugucgcagccagc

SEQ ID NO: 1890691 - RNA, 14 nt, Shigella flexneri 2a str. 2457T
acuucaaucgccac

SEQ ID NO: 1890692 - RNA, 15 nt, Shigella flexneri 2a str. 2457T
acuucacaucaccau

SEQ ID NO: 1890693 - RNA, 11 nt, Shigella flexneri 2a str. 2457T
acuucaugacc

SEQ ID NO: 1890694 - RNA, 16 nt, Shigella flexneri 2a str. 2457T
acuucggucaccguca

SEQ ID NO: 1890695 - RNA, 13 nt, Shigella flexneri 2a str. 2457T
acuuuaaucaccu

SEQ ID NO: 1890696 - RNA, 13 nt, Shigella flexneri 2a str. 2457T
acuugauacugaa

SEQ ID NO: 1890697 - RNA, 21 nt, Shigella flexneri 2a str. 2457T
acucugccguaccaucgccag

SEQ ID NO: 1890698 - RNA, 19 nt, Shigella flexneri 2a str. 2457T
acucuaccguuaaaauacg

SEQ ID NO: 1890699 - RNA, 22 nt, Shigella flexneri 2a str. 2457T
acugcgugucguaagccaccgc

SEQ ID NO: 1890700 - RNA, 21 nt, Shigella flexneri 2a str. 2457T
acugcgccaucaaugccgcaa

SEQ ID NO: 1890701 - RNA, 19 nt, Shigella flexneri 2a str. 2457T
acugguuuuccugagcaau

SEQ ID NO: 1890702 - RNA, 23 nt, Shigella flexneri 2a str. 2457T
acuggcaugccgguagaagccag

SEQ ID NO: 1890703 - RNA, 15 nt, Shigella flexneri 2a str. 2457T
acuggcaaucgccag

SEQ ID NO: 1890704 - RNA, 23 nt, Shigella flexneri 2a str. 2457T
acuggcaaucgccagcggcagcu

SEQ ID NO: 1890705 - RNA, 16 nt, Shigella flexneri 2a str. 2457T
acuggcaaaaucaaaa

SEQ ID NO: 1890706 - RNA, 20 nt, Shigella flexneri 2a str. 2457T
agcacucugacggauaguau

SEQ ID NO: 1890707 - RNA, 23 nt, Shigella flexneri 2a str. 2457T
agcacgauuuuguaggccggaua

SEQ ID NO: 1890708 - RNA, 15 nt, Shigella flexneri 2a str. 2457T
agcacgaccgccauu

SEQ ID NO: 1890709 - RNA, 13 nt, Shigella flexneri 2a str. 2457T
aaacccaacggca

SEQ ID NO: 1890710 - RNA, 17 nt, Shigella flexneri 2a str. 2457T
aaacccaccagcugaug

SEQ ID NO: 1890711 - RNA, 22 nt, Shigella flexneri 2a str. 2457T
agcagacuuuuugcggcagcaa

SEQ ID NO: 1890712 - RNA, 16 nt, Shigella flexneri 2a str. 2457T
aaaccgcuauuuacgg

SEQ ID NO: 1890713 - RNA, 18 nt, Shigella flexneri 2a str. 2457T
aaaccgauuaauugccgc

SEQ ID NO: 1890714 - RNA, 17 nt, Shigella flexneri 2a str. 2457T
aaaccgaugcagugcgg

SEQ ID NO: 1890715 - RNA, 20 nt, Shigella flexneri 2a str. 2457T
aaaccgcucgugggcaucgc

SEQ ID NO: 1890716 - RNA, 14 nt, Shigella flexneri 2a str. 2457T
aaaccggacgaucg

SEQ ID NO: 1890717 - RNA, 18 nt, Shigella flexneri 2a str. 2457T
aaaccguaagcgccccga

SEQ ID NO: 1890718 - RNA, 16 nt, Shigella flexneri 2a str. 2457T
agcagccacaccaauc

SEQ ID NO: 1890719 - RNA, 18 nt, Shigella flexneri 2a str. 2457T
agcagcccugccggaacg

SEQ ID NO: 1890720 - RNA, 19 nt, Shigella flexneri 2a str. 2457T
agcagcacaaugccgguga

SEQ ID NO: 1890721 - RNA, 22 nt, Shigella flexneri 2a str. 2457T
agcaauucucucuucagcuucc

SEQ ID NO: 1890722 - RNA, 23 nt, Shigella flexneri 2a str. 2457T
agcaauaaucagauggcggcugg

SEQ ID NO: 1890723 - RNA, 14 nt, Shigella flexneri 2a str. 2457T
agcaauaccgcgaa

SEQ ID NO: 1890724 - RNA, 21 nt, Shigella flexneri 2a str. 2457T
agcaauaaucagauggcggcu

SEQ ID NO: 1890725 - RNA, 22 nt, Shigella flexneri 2a str. 2457T
agcaauaacuaagauaauccag

SEQ ID NO: 1890726 - RNA, 19 nt, Shigella flexneri 2a str. 2457T
agcaauaaaaacuccgccg

SEQ ID NO: 1890727 - RNA, 17 nt, Shigella flexneri 2a str. 2457T
agcaacucgaugcugcc

SEQ ID NO: 1890728 - RNA, 21 nt, Shigella flexneri 2a str. 2457T
acuuuccaugccaucugccag

SEQ ID NO: 1890729 - RNA, 16 nt, Shigella flexneri 2a str. 2457T
acuuucaacagguuaa

SEQ ID NO: 1890730 - RNA, 13 nt, Shigella flexneri 2a str. 2457T
acuuucagcgcag

SEQ ID NO: 1890731 - RNA, 13 nt, Shigella flexneri 2a str. 2457T
agcaaagcgugca

SEQ ID NO: 1890732 - RNA, 20 nt, Shigella flexneri 2a str. 2457T
agcaaacuaucuguguaaug

SEQ ID NO: 1890733 - RNA, 22 nt, Shigella flexneri 2a str. 2457T
agcaccgcgugcgcggcagcca

SEQ ID NO: 1890734 - RNA, 14 nt, Shigella flexneri 2a str. 2457T
agcaccggcggaau

SEQ ID NO: 1890735 - RNA, 15 nt, Shigella flexneri 2a str. 2457T
agcaccagcagguga

SEQ ID NO: 1890736 - RNA, 19 nt, Shigella flexneri 2a str. 2457T
agccccuggaaaaagugcc

SEQ ID NO: 1890737 - RNA, 14 nt, Shigella flexneri 2a str. 2457T
agcccgccgccauc

SEQ ID NO: 1890738 - RNA, 23 nt, Shigella flexneri 2a str. 2457T
agccauuuggugaagacguuuau

SEQ ID NO: 1890739 - RNA, 20 nt, Shigella flexneri 2a str. 2457T
agcccaaucaucgcggcaca

SEQ ID NO: 1890740 - RNA, 16 nt, Shigella flexneri 2a str. 2457T
agccgcuaacagcagc

SEQ ID NO: 1890741 - RNA, 20 nt, Shigella flexneri 2a str. 2457T
aaacgcaaaacugccugaug

SEQ ID NO: 1890742 - RNA, 22 nt, Shigella flexneri 2a str. 2457T
agccacacguuaaugcaaucaa

SEQ ID NO: 1890743 - RNA, 17 nt, Shigella flexneri 2a str. 2457T
agccacauugcugcaca

SEQ ID NO: 1890744 - RNA, 14 nt, Shigella flexneri 2a str. 2457T
agcauuggguaaaa

SEQ ID NO: 1890745 - RNA, 15 nt, Shigella flexneri 2a str. 2457T
agccagauggcugcc

SEQ ID NO: 1890746 - RNA, 13 nt, Shigella flexneri 2a str. 2457T
agccagaccaccc

SEQ ID NO: 1890747 - RNA, 14 nt, Shigella flexneri 2a str. 2457T
agcauucgccgcau

SEQ ID NO: 1890748 - RNA, 16 nt, Shigella flexneri 2a str. 2457T
agcaucuuauccagca

SEQ ID NO: 1890749 - RNA, 13 nt, Shigella flexneri 2a str. 2457T
agcaucgcaucaa

SEQ ID NO: 1890750 - RNA, 19 nt, Shigella flexneri 2a str. 2457T
agcagcuuauggugcacag

SEQ ID NO: 1890751 - RNA, 20 nt, Shigella flexneri 2a str. 2457T
agcaggaauguuguccaggg

SEQ ID NO: 1890752 - RNA, 20 nt, Shigella flexneri 2a str. 2457T
agcagccuauuucgucgcua

SEQ ID NO: 1890753 - RNA, 22 nt, Shigella flexneri 2a str. 2457T
agcucuucuucacucucaccac

SEQ ID NO: 1890754 - RNA, 23 nt, Shigella flexneri 2a str. 2457T
agcucuuuuaacuuacgcgucag

SEQ ID NO: 1890755 - RNA, 14 nt, Shigella flexneri 2a str. 2457T
agcugcucgcggug

SEQ ID NO: 1890756 - RNA, 17 nt, Shigella flexneri 2a str. 2457T
agcugcucccagcgcau

SEQ ID NO: 1890757 - RNA, 19 nt, Shigella flexneri 2a str. 2457T
agcgucccacgaccgcagc

SEQ ID NO: 1890758 - RNA, 21 nt, Shigella flexneri 2a str. 2457T
agcgugacaccagcacaucau

SEQ ID NO: 1890759 - RNA, 23 nt, Shigella flexneri 2a str. 2457T
agcgugcucucaaauaucugccg

SEQ ID NO: 1890760 - RNA, 20 nt, Shigella flexneri 2a str. 2457T
agcguuccauaauggcgcga

SEQ ID NO: 1890761 - RNA, 12 nt, Shigella flexneri 2a str. 2457T
agcguuucaaca

SEQ ID NO: 1890762 - RNA, 18 nt, Shigella flexneri 2a str. 2457T
agcguucuuuaacugccg

SEQ ID NO: 1890763 - RNA, 20 nt, Shigella flexneri 2a str. 2457T
agcggccagccauccgucau

SEQ ID NO: 1890764 - RNA, 21 nt, Shigella flexneri 2a str. 2457T
agcggcggcaauggcugcggc

SEQ ID NO: 1890765 - RNA, 22 nt, Shigella flexneri 2a str. 2457T
agcgguaaagaacugagcgccg

SEQ ID NO: 1890766 - RNA, 14 nt, Shigella flexneri 2a str. 2457T
agcgcuaccgccga

SEQ ID NO: 1890767 - RNA, 13 nt, Shigella flexneri 2a str. 2457T
agcgcguugcgcc

SEQ ID NO: 1890768 - RNA, 12 nt, Shigella flexneri 2a str. 2457T
agcgccagggcu

SEQ ID NO: 1890769 - RNA, 16 nt, Shigella flexneri 2a str. 2457T
agcgccuuauccugcc

SEQ ID NO: 1890770 - RNA, 22 nt, Shigella flexneri 2a str. 2457T
agcgcgcugacauuacgcgcuu

SEQ ID NO: 1890771 - RNA, 15 nt, Shigella flexneri 2a str. 2457T
agcgcagcgcaucag

SEQ ID NO: 1890772 - RNA, 13 nt, Shigella flexneri 2a str. 2457T
agcgcagcgcauc

SEQ ID NO: 1890773 - RNA, 16 nt, Shigella flexneri 2a str. 2457T
agcgcacaacguuccu

SEQ ID NO: 1890774 - RNA, 14 nt, Shigella flexneri 2a str. 2457T
agcgcaaucaccac

SEQ ID NO: 1890775 - RNA, 23 nt, Shigella flexneri 2a str. 2457T
agcgacuccaguuuguucagcug

SEQ ID NO: 1890776 - RNA, 16 nt, Shigella flexneri 2a str. 2457T
agcgacgggcuaaucg

SEQ ID NO: 1890777 - RNA, 19 nt, Shigella flexneri 2a str. 2457T
aaacgccuuauccggccua

SEQ ID NO: 1890778 - RNA, 12 nt, Shigella flexneri 2a str. 2457T
aaacgcugguga

SEQ ID NO: 1890779 - RNA, 12 nt, Shigella flexneri 2a str. 2457T
aaacgcugacgg

SEQ ID NO: 1890780 - RNA, 22 nt, Shigella flexneri 2a str. 2457T
aaacgccagauacaucagcgac

SEQ ID NO: 1890781 - RNA, 19 nt, Shigella flexneri 2a str. 2457T
aaacgcccaaugcccagaa

SEQ ID NO: 1890782 - RNA, 23 nt, Shigella flexneri 2a str. 2457T
agcgacaccucccagcgcgguga

SEQ ID NO: 1890783 - RNA, 16 nt, Shigella flexneri 2a str. 2457T
agcgacaaacgccuga

SEQ ID NO: 1890784 - RNA, 21 nt, Shigella flexneri 2a str. 2457T
agcgacgggcgacaaacgcug

SEQ ID NO: 1890785 - RNA, 14 nt, Shigella flexneri 2a str. 2457T
agccgcuaccagcg

SEQ ID NO: 1890786 - RNA, 13 nt, Shigella flexneri 2a str. 2457T
agccgcuacggaa

SEQ ID NO: 1890787 - RNA, 23 nt, Shigella flexneri 2a str. 2457T
agccuguuuagccgcuucugcag

SEQ ID NO: 1890788 - RNA, 15 nt, Shigella flexneri 2a str. 2457T
agccgucauucugca

SEQ ID NO: 1890789 - RNA, 14 nt, Shigella flexneri 2a str. 2457T
aucacucugccgua

SEQ ID NO: 1890790 - RNA, 16 nt, Shigella flexneri 2a str. 2457T
aucacuccccgccguu

SEQ ID NO: 1890791 - RNA, 17 nt, Shigella flexneri 2a str. 2457T
aucagcaauuucuccgc

SEQ ID NO: 1890792 - RNA, 17 nt, Shigella flexneri 2a str. 2457T
aucagaucgacgccgau

SEQ ID NO: 1890793 - RNA, 22 nt, Shigella flexneri 2a str. 2457T
aucaccagaucguaauggucgu

SEQ ID NO: 1890794 - RNA, 19 nt, Shigella flexneri 2a str. 2457T
aucaccauauucagcagca

SEQ ID NO: 1890795 - RNA, 22 nt, Shigella flexneri 2a str. 2457T
aucaccagcggugguagcgaug

SEQ ID NO: 1890796 - RNA, 19 nt, Shigella flexneri 2a str. 2457T
aucacccacaucagcggca

SEQ ID NO: 1890797 - RNA, 13 nt, Shigella flexneri 2a str. 2457T
aucaccaucagca

SEQ ID NO: 1890798 - RNA, 16 nt, Shigella flexneri 2a str. 2457T
aucaccgccagcggcg

SEQ ID NO: 1890799 - RNA, 15 nt, Shigella flexneri 2a str. 2457T
aucacgacagcacca

SEQ ID NO: 1890800 - RNA, 13 nt, Shigella flexneri 2a str. 2457T
aucacgucgccuu

SEQ ID NO: 1890801 - RNA, 19 nt, Shigella flexneri 2a str. 2457T
aucaccugauugaccgcca

SEQ ID NO: 1890802 - RNA, 22 nt, Shigella flexneri 2a str. 2457T
aucaccacaauauuauggcugu

SEQ ID NO: 1890803 - RNA, 15 nt, Shigella flexneri 2a str. 2457T
aucacaucagcgcau

SEQ ID NO: 1890804 - RNA, 17 nt, Shigella flexneri 2a str. 2457T
aucacaucgcgcucgua

SEQ ID NO: 1890805 - RNA, 12 nt, Shigella flexneri 2a str. 2457T
aucacaucgccg

SEQ ID NO: 1890806 - RNA, 21 nt, Shigella flexneri 2a str. 2457T
aucaauuuugaugauaucagc

SEQ ID NO: 1890807 - RNA, 23 nt, Shigella flexneri 2a str. 2457T
aucacaaaacgaauaauugcugg

SEQ ID NO: 1890808 - RNA, 13 nt, Shigella flexneri 2a str. 2457T
aucaagaaaugca

SEQ ID NO: 1890809 - RNA, 15 nt, Shigella flexneri 2a str. 2457T
aucaagccauagcgc

SEQ ID NO: 1890810 - RNA, 15 nt, Shigella flexneri 2a str. 2457T
aucaacugcgcuaua

SEQ ID NO: 1890811 - RNA, 14 nt, Shigella flexneri 2a str. 2457T
aucaacuccgccag

SEQ ID NO: 1890812 - RNA, 20 nt, Shigella flexneri 2a str. 2457T
aucaagcccugguaacugcc

SEQ ID NO: 1890813 - RNA, 21 nt, Shigella flexneri 2a str. 2457T
aucaagcccugguaacugcca

SEQ ID NO: 1890814 - RNA, 22 nt, Shigella flexneri 2a str. 2457T
aucaauucggaaauaaucaccu

SEQ ID NO: 1890815 - RNA, 13 nt, Shigella flexneri 2a str. 2457T
auauuaacgacaa

SEQ ID NO: 1890816 - RNA, 21 nt, Shigella flexneri 2a str. 2457T
auauuauuaauagcauaucga

SEQ ID NO: 1890817 - RNA, 20 nt, Shigella flexneri 2a str. 2457T
auauuauccccugcgauggu

SEQ ID NO: 1890818 - RNA, 13 nt, Shigella flexneri 2a str. 2457T
auaugucgcgcca

SEQ ID NO: 1890819 - RNA, 16 nt, Shigella flexneri 2a str. 2457T
auauggggauccccau

SEQ ID NO: 1890820 - RNA, 15 nt, Shigella flexneri 2a str. 2457T
aucaaaucucgccgu

SEQ ID NO: 1890821 - RNA, 17 nt, Shigella flexneri 2a str. 2457T
auauucaacaccgaugc

SEQ ID NO: 1890822 - RNA, 14 nt, Shigella flexneri 2a str. 2457T
aucaacgucugcgc

SEQ ID NO: 1890823 - RNA, 21 nt, Shigella flexneri 2a str. 2457T
auaguucgcgaucgcgccaga

SEQ ID NO: 1890824 - RNA, 18 nt, Shigella flexneri 2a str. 2457T
auaggcaaaaaaaaugcc

SEQ ID NO: 1890825 - RNA, 18 nt, Shigella flexneri 2a str. 2457T
auaggaugagguuucccg

SEQ ID NO: 1890826 - RNA, 16 nt, Shigella flexneri 2a str. 2457T
auauaaaccaucggcg

SEQ ID NO: 1890827 - RNA, 16 nt, Shigella flexneri 2a str. 2457T
auauaaaaauccgccu

SEQ ID NO: 1890828 - RNA, 21 nt, Shigella flexneri 2a str. 2457T
auaugcgccgacggcgcuacc

SEQ ID NO: 1890829 - RNA, 13 nt, Shigella flexneri 2a str. 2457T
auaugcgcuggca

SEQ ID NO: 1890830 - RNA, 15 nt, Shigella flexneri 2a str. 2457T
auacuuuccagcaua

SEQ ID NO: 1890831 - RNA, 15 nt, Shigella flexneri 2a str. 2457T
auagcccaugcaucg

SEQ ID NO: 1890832 - RNA, 21 nt, Shigella flexneri 2a str. 2457T
auagccagccucauccauacg

SEQ ID NO: 1890833 - RNA, 16 nt, Shigella flexneri 2a str. 2457T
auagccccagcgcaga

SEQ ID NO: 1890834 - RNA, 20 nt, Shigella flexneri 2a str. 2457T
auagcacauaaaauggccgu

SEQ ID NO: 1890835 - RNA, 23 nt, Shigella flexneri 2a str. 2457T
auagauuaguuguacauuaccac

SEQ ID NO: 1890836 - RNA, 19 nt, Shigella flexneri 2a str. 2457T
auagcauuggagacugaug

SEQ ID NO: 1890837 - RNA, 14 nt, Shigella flexneri 2a str. 2457T
auacugcaucagcg

SEQ ID NO: 1890838 - RNA, 18 nt, Shigella flexneri 2a str. 2457T
auacugcgauugucgauc

SEQ ID NO: 1890839 - RNA, 22 nt, Shigella flexneri 2a str. 2457T
auacugcgauugucgaucgcau

SEQ ID NO: 1890840 - RNA, 18 nt, Shigella flexneri 2a str. 2457T
auacuuauuaugaaugau

SEQ ID NO: 1890841 - RNA, 17 nt, Shigella flexneri 2a str. 2457T
auacucagcgccugcug

SEQ ID NO: 1890842 - RNA, 22 nt, Shigella flexneri 2a str. 2457T
auacugaucgucaucaaacggc

SEQ ID NO: 1890843 - RNA, 20 nt, Shigella flexneri 2a str. 2457T
auacugaucgucaucaaacg

SEQ ID NO: 1890844 - RNA, 21 nt, Shigella flexneri 2a str. 2457T
auacgcgccacaucagacuca

SEQ ID NO: 1890845 - RNA, 18 nt, Shigella flexneri 2a str. 2457T
auacggugucacgguguc

SEQ ID NO: 1890846 - RNA, 15 nt, Shigella flexneri 2a str. 2457T
auacguacaaacgcu

SEQ ID NO: 1890847 - RNA, 16 nt, Shigella flexneri 2a str. 2457T
auacguaggccugaua

SEQ ID NO: 1890848 - RNA, 15 nt, Shigella flexneri 2a str. 2457T
auacaucgcgccaac

SEQ ID NO: 1890849 - RNA, 16 nt, Shigella flexneri 2a str. 2457T
auacaacgcgcgguga

SEQ ID NO: 1890850 - RNA, 16 nt, Shigella flexneri 2a str. 2457T
auacaggaacagccac

SEQ ID NO: 1890851 - RNA, 16 nt, Shigella flexneri 2a str. 2457T
auaccgaaaucgccau

SEQ ID NO: 1890852 - RNA, 19 nt, Shigella flexneri 2a str. 2457T
auaccggcgucccaucggc

SEQ ID NO: 1890853 - RNA, 16 nt, Shigella flexneri 2a str. 2457T
auaccggaucgcaucg

SEQ ID NO: 1890854 - RNA, 23 nt, Shigella flexneri 2a str. 2457T
auaccgcguaauacaucagcuaa

SEQ ID NO: 1890855 - RNA, 22 nt, Shigella flexneri 2a str. 2457T
auaccuaacacgaucagccaua

SEQ ID NO: 1890856 - RNA, 19 nt, Shigella flexneri 2a str. 2457T
auacgccaucgccagcagc

SEQ ID NO: 1890857 - RNA, 21 nt, Shigella flexneri 2a str. 2457T
auacgccggucacgcccggaa

SEQ ID NO: 1890858 - RNA, 13 nt, Shigella flexneri 2a str. 2457T
aguuucagcggcg

SEQ ID NO: 1890859 - RNA, 21 nt, Shigella flexneri 2a str. 2457T
aguuugaacauaucagcgcaa

SEQ ID NO: 1890860 - RNA, 21 nt, Shigella flexneri 2a str. 2457T
aguuuucauauaccgcaucag

SEQ ID NO: 1890861 - RNA, 21 nt, Shigella flexneri 2a str. 2457T
auaaaaaaagagcggucgcaa

SEQ ID NO: 1890862 - RNA, 21 nt, Shigella flexneri 2a str. 2457T
aguuuugucuucggccauuga

SEQ ID NO: 1890863 - RNA, 19 nt, Shigella flexneri 2a str. 2457T
aguuuuuccgugagcggca

SEQ ID NO: 1890864 - RNA, 13 nt, Shigella flexneri 2a str. 2457T
auaacaucgccag

SEQ ID NO: 1890865 - RNA, 20 nt, Shigella flexneri 2a str. 2457T
auaaccgaaucccgcugcaa

SEQ ID NO: 1890866 - RNA, 20 nt, Shigella flexneri 2a str. 2457T
auaaccgcaaaaccaacgcc

SEQ ID NO: 1890867 - RNA, 14 nt, Shigella flexneri 2a str. 2457T
auaacccagcgcac

SEQ ID NO: 1890868 - RNA, 13 nt, Shigella flexneri 2a str. 2457T
auaaccguccagu

SEQ ID NO: 1890869 - RNA, 10 nt, Shigella flexneri 2a str. 2457T
auaacgcuua

SEQ ID NO: 1890870 - RNA, 16 nt, Shigella flexneri 2a str. 2457T
auaacguaaaaacccg

SEQ ID NO: 1890871 - RNA, 17 nt, Shigella flexneri 2a str. 2457T
auaacguaggccugaua

SEQ ID NO: 1890872 - RNA, 22 nt, Shigella flexneri 2a str. 2457T
auaacgcgaucgcgaaaccacg

SEQ ID NO: 1890873 - RNA, 17 nt, Shigella flexneri 2a str. 2457T
auaagccaaauccagcg

SEQ ID NO: 1890874 - RNA, 14 nt, Shigella flexneri 2a str. 2457T
auaagauacuggau

SEQ ID NO: 1890875 - RNA, 22 nt, Shigella flexneri 2a str. 2457T
auaacuccccgagaaauacugg

SEQ ID NO: 1890876 - RNA, 22 nt, Shigella flexneri 2a str. 2457T
agucaacaccuguugcgcgucg

SEQ ID NO: 1890877 - RNA, 16 nt, Shigella flexneri 2a str. 2457T
agucucugccggguuc

SEQ ID NO: 1890878 - RNA, 23 nt, Shigella flexneri 2a str. 2457T
agucuccuuuauagugugcaauc

SEQ ID NO: 1890879 - RNA, 22 nt, Shigella flexneri 2a str. 2457T
agugaccaaucauuggcgcuug

SEQ ID NO: 1890880 - RNA, 22 nt, Shigella flexneri 2a str. 2457T
agucuuuuuugguuauccagca

SEQ ID NO: 1890881 - RNA, 13 nt, Shigella flexneri 2a str. 2457T
aguggcagcaauu

SEQ ID NO: 1890882 - RNA, 17 nt, Shigella flexneri 2a str. 2457T
agugagauaccaguuga

SEQ ID NO: 1890883 - RNA, 18 nt, Shigella flexneri 2a str. 2457T
aguuuauagaacggcaga

SEQ ID NO: 1890884 - RNA, 16 nt, Shigella flexneri 2a str. 2457T
agugucggugaggccu

SEQ ID NO: 1890885 - RNA, 15 nt, Shigella flexneri 2a str. 2457T
aguggugauaccacc

SEQ ID NO: 1890886 - RNA, 20 nt, Shigella flexneri 2a str. 2457T
aguucgaucucuucgccugc

SEQ ID NO: 1890887 - RNA, 20 nt, Shigella flexneri 2a str. 2457T
aguagugguaacgcacacau

SEQ ID NO: 1890888 - RNA, 22 nt, Shigella flexneri 2a str. 2457T
aguagauacccggauacaacuc

SEQ ID NO: 1890889 - RNA, 19 nt, Shigella flexneri 2a str. 2457T
aguaagcaguccagcgccu

SEQ ID NO: 1890890 - RNA, 16 nt, Shigella flexneri 2a str. 2457T
aguacgggcagcgcau

SEQ ID NO: 1890891 - RNA, 18 nt, Shigella flexneri 2a str. 2457T
aguaaagcgcgucaccac

SEQ ID NO: 1890892 - RNA, 22 nt, Shigella flexneri 2a str. 2457T
agguuguucacggcacucgcug

SEQ ID NO: 1890893 - RNA, 11 nt, Shigella flexneri 2a str. 2457T
agguauucgcc

SEQ ID NO: 1890894 - RNA, 14 nt, Shigella flexneri 2a str. 2457T
agguauuuucugaa

SEQ ID NO: 1890895 - RNA, 14 nt, Shigella flexneri 2a str. 2457T
aggugaaauugucg

SEQ ID NO: 1890896 - RNA, 14 nt, Shigella flexneri 2a str. 2457T
aggucgacagcagc

SEQ ID NO: 1890897 - RNA, 15 nt, Shigella flexneri 2a str. 2457T
aggcggcuucgcauc

SEQ ID NO: 1890898 - RNA, 22 nt, Shigella flexneri 2a str. 2457T
aggcgguaaaucggcgaagaga

SEQ ID NO: 1890899 - RNA, 13 nt, Shigella flexneri 2a str. 2457T
aggcgucacaucc

SEQ ID NO: 1890900 - RNA, 20 nt, Shigella flexneri 2a str. 2457T
aggcguucacgccgcaucug

SEQ ID NO: 1890901 - RNA, 21 nt, Shigella flexneri 2a str. 2457T
aggcguucuacauaaaacgcu

SEQ ID NO: 1890902 - RNA, 20 nt, Shigella flexneri 2a str. 2457T
aggcguuuacgccgcauccg

SEQ ID NO: 1890903 - RNA, 22 nt, Shigella flexneri 2a str. 2457T
aggcguuuucgccgcauccggc

SEQ ID NO: 1890904 - RNA, 22 nt, Shigella flexneri 2a str. 2457T
aggcguuuacgccgcauccggc

SEQ ID NO: 1890905 - RNA, 20 nt, Shigella flexneri 2a str. 2457T
aggcguuuucgccacaucag

SEQ ID NO: 1890906 - RNA, 19 nt, Shigella flexneri 2a str. 2457T
aggcuauuccacgcaucaa

SEQ ID NO: 1890907 - RNA, 16 nt, Shigella flexneri 2a str. 2457T
aggcucgccgccgcug

SEQ ID NO: 1890908 - RNA, 18 nt, Shigella flexneri 2a str. 2457T
aggcuggcguguucugaa

SEQ ID NO: 1890909 - RNA, 21 nt, Shigella flexneri 2a str. 2457T
aggcugugaaccgcacagguu

SEQ ID NO: 1890910 - RNA, 19 nt, Shigella flexneri 2a str. 2457T
aggccggauaagaugcgcc

SEQ ID NO: 1890911 - RNA, 15 nt, Shigella flexneri 2a str. 2457T
aggccgacuggcaug

SEQ ID NO: 1890912 - RNA, 20 nt, Shigella flexneri 2a str. 2457T
aggcaucggugcuggccuau

SEQ ID NO: 1890913 - RNA, 14 nt, Shigella flexneri 2a str. 2457T
aggcaucagcaauu

SEQ ID NO: 1890914 - RNA, 16 nt, Shigella flexneri 2a str. 2457T
aggcaucccgcaccag

SEQ ID NO: 1890915 - RNA, 22 nt, Shigella flexneri 2a str. 2457T
agcuggcaucagcaaacaugcc

SEQ ID NO: 1890916 - RNA, 18 nt, Shigella flexneri 2a str. 2457T
aggcagguuaaugaccca

SEQ ID NO: 1890917 - RNA, 18 nt, Shigella flexneri 2a str. 2457T
aggcagacguauccugga

SEQ ID NO: 1890918 - RNA, 19 nt, Shigella flexneri 2a str. 2457T
aggcgcugaaagaagcggu

SEQ ID NO: 1890919 - RNA, 17 nt, Shigella flexneri 2a str. 2457T
aggcgcuacgcuaucag

SEQ ID NO: 1890920 - RNA, 20 nt, Shigella flexneri 2a str. 2457T
aggcgcugaaagaagcggug

SEQ ID NO: 1890921 - RNA, 11 nt, Shigella flexneri 2a str. 2457T
aggcgcugauu

SEQ ID NO: 1890922 - RNA, 22 nt, Shigella flexneri 2a str. 2457T
aggcgcaggguuugcaucgcca

SEQ ID NO: 1890923 - RNA, 21 nt, Shigella flexneri 2a str. 2457T
aggccguggaucacaucgccg

SEQ ID NO: 1890924 - RNA, 20 nt, Shigella flexneri 2a str. 2457T
aggccuacaauguuucugca

SEQ ID NO: 1890925 - RNA, 19 nt, Shigella flexneri 2a str. 2457T
aggccuacaaguccguuga

SEQ ID NO: 1890926 - RNA, 21 nt, Shigella flexneri 2a str. 2457T
aggccuaacaccaucaguggc

SEQ ID NO: 1890927 - RNA, 14 nt, Shigella flexneri 2a str. 2457T
aggccuacagcaua

SEQ ID NO: 1890928 - RNA, 21 nt, Shigella flexneri 2a str. 2457T
aggccuacgugguuuaugcaa

SEQ ID NO: 1890929 - RNA, 23 nt, Shigella flexneri 2a str. 2457T
aggccuacgcguccccugcaaua

SEQ ID NO: 1890930 - RNA, 19 nt, Shigella flexneri 2a str. 2457T
aggcgaacauuccgguuau

SEQ ID NO: 1890931 - RNA, 16 nt, Shigella flexneri 2a str. 2457T
augccgguggugaccu

SEQ ID NO: 1890932 - RNA, 22 nt, Shigella flexneri 2a str. 2457T
augccgcggcgcggcggguuaa

SEQ ID NO: 1890933 - RNA, 21 nt, Shigella flexneri 2a str. 2457T
augccugaugcgacgcugaua

SEQ ID NO: 1890934 - RNA, 16 nt, Shigella flexneri 2a str. 2457T
augccguuauacaucg

SEQ ID NO: 1890935 - RNA, 23 nt, Shigella flexneri 2a str. 2457T
augaugaugccuacacgccagau

SEQ ID NO: 1890936 - RNA, 14 nt, Shigella flexneri 2a str. 2457T
augaugccggaauc

SEQ ID NO: 1890937 - RNA, 18 nt, Shigella flexneri 2a str. 2457T
augccgccauugacagaa

SEQ ID NO: 1890938 - RNA, 14 nt, Shigella flexneri 2a str. 2457T
augccgcagcaccc

SEQ ID NO: 1890939 - RNA, 14 nt, Shigella flexneri 2a str. 2457T
augccgaucaucau

SEQ ID NO: 1890940 - RNA, 18 nt, Shigella flexneri 2a str. 2457T
augccgaugccgacgaug

SEQ ID NO: 1890941 - RNA, 23 nt, Shigella flexneri 2a str. 2457T
augccgaugccgacgauguuagc

SEQ ID NO: 1890942 - RNA, 15 nt, Shigella flexneri 2a str. 2457T
augccgaguggcauu

SEQ ID NO: 1890943 - RNA, 18 nt, Shigella flexneri 2a str. 2457T
augcugucgaacgcuaug

SEQ ID NO: 1890944 - RNA, 21 nt, Shigella flexneri 2a str. 2457T
augcuguaaccagcgcagaca

SEQ ID NO: 1890945 - RNA, 17 nt, Shigella flexneri 2a str. 2457T
augcuuccgccagcggc

SEQ ID NO: 1890946 - RNA, 18 nt, Shigella flexneri 2a str. 2457T
augcgcuacgcucaucag

SEQ ID NO: 1890947 - RNA, 15 nt, Shigella flexneri 2a str. 2457T
augcgauggauuauc

SEQ ID NO: 1890948 - RNA, 16 nt, Shigella flexneri 2a str. 2457T
augcgcuuuaucgccg

SEQ ID NO: 1890949 - RNA, 19 nt, Shigella flexneri 2a str. 2457T
augcgguaaccuggcaguu

SEQ ID NO: 1890950 - RNA, 16 nt, Shigella flexneri 2a str. 2457T
auggaaccguacagca

SEQ ID NO: 1890951 - RNA, 13 nt, Shigella flexneri 2a str. 2457T
auggaaaucaccc

SEQ ID NO: 1890952 - RNA, 20 nt, Shigella flexneri 2a str. 2457T
auggaaaucacccagcgaag

SEQ ID NO: 1890953 - RNA, 13 nt, Shigella flexneri 2a str. 2457T
auggccagccagc

SEQ ID NO: 1890954 - RNA, 23 nt, Shigella flexneri 2a str. 2457T
auggcccccguuuuuugaaacag

SEQ ID NO: 1890955 - RNA, 20 nt, Shigella flexneri 2a str. 2457T
augguggccgccacgcguga

SEQ ID NO: 1890956 - RNA, 21 nt, Shigella flexneri 2a str. 2457T
auggucggcagagaguuguau

SEQ ID NO: 1890957 - RNA, 19 nt, Shigella flexneri 2a str. 2457T
auggucuuguaggccagau

SEQ ID NO: 1890958 - RNA, 18 nt, Shigella flexneri 2a str. 2457T
auggucuauugcgcuaaa

SEQ ID NO: 1890959 - RNA, 23 nt, Shigella flexneri 2a str. 2457T
auguuuuaacacacaauuaccuu

SEQ ID NO: 1890960 - RNA, 20 nt, Shigella flexneri 2a str. 2457T
auuaaacgccucugucagaa

SEQ ID NO: 1890961 - RNA, 19 nt, Shigella flexneri 2a str. 2457T
auuaaacgccauccggcag

SEQ ID NO: 1890962 - RNA, 21 nt, Shigella flexneri 2a str. 2457T
auuaaacugucgucgcuuuca

SEQ ID NO: 1890963 - RNA, 17 nt, Shigella flexneri 2a str. 2457T
auguuugaaccagauau

SEQ ID NO: 1890964 - RNA, 17 nt, Shigella flexneri 2a str. 2457T
auguucgacuuaacgcg

SEQ ID NO: 1890965 - RNA, 20 nt, Shigella flexneri 2a str. 2457T
auguucguccauuucagcgc

SEQ ID NO: 1890966 - RNA, 16 nt, Shigella flexneri 2a str. 2457T
auguugcugcaccagg

SEQ ID NO: 1890967 - RNA, 14 nt, Shigella flexneri 2a str. 2457T
auguugaccgcccg

SEQ ID NO: 1890968 - RNA, 13 nt, Shigella flexneri 2a str. 2457T
auguugagcggca

SEQ ID NO: 1890969 - RNA, 13 nt, Shigella flexneri 2a str. 2457T
augugauccauca

SEQ ID NO: 1890970 - RNA, 18 nt, Shigella flexneri 2a str. 2457T
augugcaguuccugcaac

SEQ ID NO: 1890971 - RNA, 18 nt, Shigella flexneri 2a str. 2457T
auguucccaccagccacg

SEQ ID NO: 1890972 - RNA, 21 nt, Shigella flexneri 2a str. 2457T
auguuaccgaucgccagcagg

SEQ ID NO: 1890973 - RNA, 15 nt, Shigella flexneri 2a str. 2457T
auuaacgauacuucu

SEQ ID NO: 1890974 - RNA, 14 nt, Shigella flexneri 2a str. 2457T
auuaagcgucggua

SEQ ID NO: 1890975 - RNA, 17 nt, Shigella flexneri 2a str. 2457T
auuaagcgcaaaggcca

SEQ ID NO: 1890976 - RNA, 23 nt, Shigella flexneri 2a str. 2457T
auuaguggcaaccacaaccgccg

SEQ ID NO: 1890977 - RNA, 16 nt, Shigella flexneri 2a str. 2457T
auuagcauugaugcgu

SEQ ID NO: 1890978 - RNA, 13 nt, Shigella flexneri 2a str. 2457T
auucaaucucuuc

SEQ ID NO: 1890979 - RNA, 18 nt, Shigella flexneri 2a str. 2457T
auucagugcaaaugccag

SEQ ID NO: 1890980 - RNA, 19 nt, Shigella flexneri 2a str. 2457T
auuaucauuuuacguugca

SEQ ID NO: 1890981 - RNA, 17 nt, Shigella flexneri 2a str. 2457T
auuauugcgcacaucaa

SEQ ID NO: 1890982 - RNA, 15 nt, Shigella flexneri 2a str. 2457T
auuaucccgugcaca

SEQ ID NO: 1890983 - RNA, 13 nt, Shigella flexneri 2a str. 2457T
auucuucagcgac

SEQ ID NO: 1890984 - RNA, 22 nt, Shigella flexneri 2a str. 2457T
auucuugccaucaaucacuuug

SEQ ID NO: 1890985 - RNA, 20 nt, Shigella flexneri 2a str. 2457T
auucuuuugcagcagcguga

SEQ ID NO: 1890986 - RNA, 13 nt, Shigella flexneri 2a str. 2457T
auugagaaccaca

SEQ ID NO: 1890987 - RNA, 18 nt, Shigella flexneri 2a str. 2457T
auugaguaauugauugau

SEQ ID NO: 1890988 - RNA, 21 nt, Shigella flexneri 2a str. 2457T
auugaagccaaaucauccaga

SEQ ID NO: 1890989 - RNA, 21 nt, Shigella flexneri 2a str. 2457T
auucugaaaacggacaugcca

SEQ ID NO: 1890990 - RNA, 16 nt, Shigella flexneri 2a str. 2457T
auucugauccugcacu

SEQ ID NO: 1890991 - RNA, 19 nt, Shigella flexneri 2a str. 2457T
auucggguucauguucaga

SEQ ID NO: 1890992 - RNA, 12 nt, Shigella flexneri 2a str. 2457T
auucgaaaucug

SEQ ID NO: 1890993 - RNA, 14 nt, Shigella flexneri 2a str. 2457T
auucauuaaaacug

SEQ ID NO: 1890994 - RNA, 21 nt, Shigella flexneri 2a str. 2457T
auuccucccguuaugaucagc

SEQ ID NO: 1890995 - RNA, 22 nt, Shigella flexneri 2a str. 2457T
auuggagacugaugacaaacgc

SEQ ID NO: 1890996 - RNA, 22 nt, Shigella flexneri 2a str. 2457T
auugcuuuuacauuauccagcg

SEQ ID NO: 1890997 - RNA, 16 nt, Shigella flexneri 2a str. 2457T
auugggauuaaagcgc

SEQ ID NO: 1890998 - RNA, 14 nt, Shigella flexneri 2a str. 2457T
auuggaguaucacc

SEQ ID NO: 1890999 - RNA, 22 nt, Shigella flexneri 2a str. 2457T
auuguucgcaccggugcugguc

SEQ ID NO: 1891000 - RNA, 14 nt, Shigella flexneri 2a str. 2457T
auuguuaaucacau

SEQ ID NO: 1891001 - RNA, 12 nt, Shigella flexneri 2a str. 2457T
auugccggaaug

SEQ ID NO: 1891002 - RNA, 20 nt, Shigella flexneri 2a str. 2457T
auugcacagguggcaaacgc

SEQ ID NO: 1891003 - RNA, 20 nt, Shigella flexneri 2a str. 2457T
auugcacaguauagcaucau

SEQ ID NO: 1891004 - RNA, 18 nt, Shigella flexneri 2a str. 2457T
auugcaaacagagcgggc

SEQ ID NO: 1891005 - RNA, 16 nt, Shigella flexneri 2a str. 2457T
auugauucaucucuuc

SEQ ID NO: 1891006 - RNA, 19 nt, Shigella flexneri 2a str. 2457T
auugauguaauuaucgcag

SEQ ID NO: 1891007 - RNA, 16 nt, Shigella flexneri 2a str. 2457T
auugaugcucuccgcc

SEQ ID NO: 1891008 - RNA, 17 nt, Shigella flexneri 2a str. 2457T
auugcuguaaauugccg

SEQ ID NO: 1891009 - RNA, 15 nt, Shigella flexneri 2a str. 2457T
auugccggaugcggc

SEQ ID NO: 1891010 - RNA, 11 nt, Shigella flexneri 2a str. 2457T
auugccggaug

SEQ ID NO: 1891011 - RNA, 16 nt, Shigella flexneri 2a str. 2457T
auugccgggcgcauca

SEQ ID NO: 1891012 - RNA, 19 nt, Shigella flexneri 2a str. 2457T
aucgccccggaagcaucaa

SEQ ID NO: 1891013 - RNA, 17 nt, Shigella flexneri 2a str. 2457T
aucgccauugccgguga

SEQ ID NO: 1891014 - RNA, 18 nt, Shigella flexneri 2a str. 2457T
aucgccauuuaacgcauc

SEQ ID NO: 1891015 - RNA, 20 nt, Shigella flexneri 2a str. 2457T
aucgccaggaacaacgacaa

SEQ ID NO: 1891016 - RNA, 17 nt, Shigella flexneri 2a str. 2457T
aucgccacugcugggga

SEQ ID NO: 1891017 - RNA, 18 nt, Shigella flexneri 2a str. 2457T
aucgccaacaaucucuuc

SEQ ID NO: 1891018 - RNA, 21 nt, Shigella flexneri 2a str. 2457T
aucgcagcgcaagcugaacag

SEQ ID NO: 1891019 - RNA, 16 nt, Shigella flexneri 2a str. 2457T
aucgcacccgccauca

SEQ ID NO: 1891020 - RNA, 16 nt, Shigella flexneri 2a str. 2457T
aucgcacagaugcgac

SEQ ID NO: 1891021 - RNA, 15 nt, Shigella flexneri 2a str. 2457T
aucgcaccaaacggg

SEQ ID NO: 1891022 - RNA, 23 nt, Shigella flexneri 2a str. 2457T
aucgaugguugcccugcugguga

SEQ ID NO: 1891023 - RNA, 21 nt, Shigella flexneri 2a str. 2457T
aucaggcaucugagcaugaug

SEQ ID NO: 1891024 - RNA, 16 nt, Shigella flexneri 2a str. 2457T
aucgacaguaccagca

SEQ ID NO: 1891025 - RNA, 18 nt, Shigella flexneri 2a str. 2457T
aucgaccaaccuugcgcc

SEQ ID NO: 1891026 - RNA, 14 nt, Shigella flexneri 2a str. 2457T
aucgacguucugcc

SEQ ID NO: 1891027 - RNA, 14 nt, Shigella flexneri 2a str. 2457T
aucgacgcaaacgc

SEQ ID NO: 1891028 - RNA, 21 nt, Shigella flexneri 2a str. 2457T
aucgacgcugcugcguauggu

SEQ ID NO: 1891029 - RNA, 15 nt, Shigella flexneri 2a str. 2457T
aucgauaaacggcac

SEQ ID NO: 1891030 - RNA, 17 nt, Shigella flexneri 2a str. 2457T
aucgagauugucggcag

SEQ ID NO: 1891031 - RNA, 15 nt, Shigella flexneri 2a str. 2457T
aucgcgugcggcauc

SEQ ID NO: 1891032 - RNA, 14 nt, Shigella flexneri 2a str. 2457T
aucgcucagcgcau

SEQ ID NO: 1891033 - RNA, 19 nt, Shigella flexneri 2a str. 2457T
aucgcugagcuccugcauu

SEQ ID NO: 1891034 - RNA, 16 nt, Shigella flexneri 2a str. 2457T
aucgcugaacgcaccu

SEQ ID NO: 1891035 - RNA, 13 nt, Shigella flexneri 2a str. 2457T
aucgcuuucagug

SEQ ID NO: 1891036 - RNA, 23 nt, Shigella flexneri 2a str. 2457T
aucgcuguuaauguugauccagu

SEQ ID NO: 1891037 - RNA, 22 nt, Shigella flexneri 2a str. 2457T
aucgcuuacccuaaauccgcca

SEQ ID NO: 1891038 - RNA, 23 nt, Shigella flexneri 2a str. 2457T
aucgcuuucggaaagaucgccac

SEQ ID NO: 1891039 - RNA, 22 nt, Shigella flexneri 2a str. 2457T
aucgcgcccaaaccacccagca

SEQ ID NO: 1891040 - RNA, 18 nt, Shigella flexneri 2a str. 2457T
aucgcgcccgccgccauu

SEQ ID NO: 1891041 - RNA, 17 nt, Shigella flexneri 2a str. 2457T
aucgcgcguguugcgcc

SEQ ID NO: 1891042 - RNA, 16 nt, Shigella flexneri 2a str. 2457T
aucgccgcuggcgcgg

SEQ ID NO: 1891043 - RNA, 18 nt, Shigella flexneri 2a str. 2457T
aucgcccugauggcgcgc

SEQ ID NO: 1891044 - RNA, 14 nt, Shigella flexneri 2a str. 2457T
aucgcgcagcagau

SEQ ID NO: 1891045 - RNA, 19 nt, Shigella flexneri 2a str. 2457T
aucgcgccaaucagcgcag

SEQ ID NO: 1891046 - RNA, 12 nt, Shigella flexneri 2a str. 2457T
aucgcgcaucag

SEQ ID NO: 1891047 - RNA, 18 nt, Shigella flexneri 2a str. 2457T
aucgccuaccaacgacau

SEQ ID NO: 1891048 - RNA, 19 nt, Shigella flexneri 2a str. 2457T
aucgccucgccgaaacgcu

SEQ ID NO: 1891049 - RNA, 22 nt, Shigella flexneri 2a str. 2457T
aucgccuguggcguaaagccuu

SEQ ID NO: 1891050 - RNA, 21 nt, Shigella flexneri 2a str. 2457T
aucgccuucgcaaaaaaccau

SEQ ID NO: 1891051 - RNA, 17 nt, Shigella flexneri 2a str. 2457T
aucggcguacuggcaau

SEQ ID NO: 1891052 - RNA, 18 nt, Shigella flexneri 2a str. 2457T
aucggcuaguaauugcgc

SEQ ID NO: 1891053 - RNA, 15 nt, Shigella flexneri 2a str. 2457T
aucggcaucacccca

SEQ ID NO: 1891054 - RNA, 13 nt, Shigella flexneri 2a str. 2457T
aucggcaaaucgc

SEQ ID NO: 1891055 - RNA, 14 nt, Shigella flexneri 2a str. 2457T
aucggcaaucgccu

SEQ ID NO: 1891056 - RNA, 14 nt, Shigella flexneri 2a str. 2457T
aucucacaaucauc

SEQ ID NO: 1891057 - RNA, 20 nt, Shigella flexneri 2a str. 2457T
aucuacaaaaccacacuucu

SEQ ID NO: 1891058 - RNA, 21 nt, Shigella flexneri 2a str. 2457T
aucuacgcucucuucaaacgc

SEQ ID NO: 1891059 - RNA, 17 nt, Shigella flexneri 2a str. 2457T
aucguccgccagccuac

SEQ ID NO: 1891060 - RNA, 22 nt, Shigella flexneri 2a str. 2457T
aucgucaguagcgcaaucacca

SEQ ID NO: 1891061 - RNA, 17 nt, Shigella flexneri 2a str. 2457T
aucguccacgucaucaa

SEQ ID NO: 1891062 - RNA, 16 nt, Shigella flexneri 2a str. 2457T
aucgucucgauacgcc

SEQ ID NO: 1891063 - RNA, 22 nt, Shigella flexneri 2a str. 2457T
aucgguaccgccagcaggaacg

SEQ ID NO: 1891064 - RNA, 14 nt, Shigella flexneri 2a str. 2457T
aucgggucaccgcc

SEQ ID NO: 1891065 - RNA, 16 nt, Shigella flexneri 2a str. 2457T
aucgggucaccgccga

SEQ ID NO: 1891066 - RNA, 18 nt, Shigella flexneri 2a str. 2457T
aucuuuaucacacagaug

SEQ ID NO: 1891067 - RNA, 17 nt, Shigella flexneri 2a str. 2457T
aucuuuaucaaucaccg

SEQ ID NO: 1891068 - RNA, 14 nt, Shigella flexneri 2a str. 2457T
aucuucuccacgcc

SEQ ID NO: 1891069 - RNA, 15 nt, Shigella flexneri 2a str. 2457T
aucuuccagaucacc

SEQ ID NO: 1891070 - RNA, 11 nt, Shigella flexneri 2a str. 2457T
aucuucccagc

SEQ ID NO: 1891071 - RNA, 15 nt, Shigella flexneri 2a str. 2457T
aucuucccagcgcag

SEQ ID NO: 1891072 - RNA, 15 nt, Shigella flexneri 2a str. 2457T
aucuucauccggcug

SEQ ID NO: 1891073 - RNA, 18 nt, Shigella flexneri 2a str. 2457T
aucuucacuguccgccag

SEQ ID NO: 1891074 - RNA, 15 nt, Shigella flexneri 2a str. 2457T
aucuuaagucugcgc

SEQ ID NO: 1891075 - RNA, 22 nt, Shigella flexneri 2a str. 2457T
aucuguuuuccgaugagcgaca

SEQ ID NO: 1891076 - RNA, 21 nt, Shigella flexneri 2a str. 2457T
aucuguuugccagucuggcuu

SEQ ID NO: 1891077 - RNA, 23 nt, Shigella flexneri 2a str. 2457T
aucugcucuucuuucaucaugug

SEQ ID NO: 1891078 - RNA, 15 nt, Shigella flexneri 2a str. 2457T
aucugcguggcgcgc

SEQ ID NO: 1891079 - RNA, 20 nt, Shigella flexneri 2a str. 2457T
aucugcggguuagucugcau

SEQ ID NO: 1891080 - RNA, 13 nt, Shigella flexneri 2a str. 2457T
augaaaaaauccc

SEQ ID NO: 1891081 - RNA, 22 nt, Shigella flexneri 2a str. 2457T
augaauagcggaaaucuccaga

SEQ ID NO: 1891082 - RNA, 13 nt, Shigella flexneri 2a str. 2457T
augaauauuccac

SEQ ID NO: 1891083 - RNA, 13 nt, Shigella flexneri 2a str. 2457T
aucuuucuucagc

SEQ ID NO: 1891084 - RNA, 17 nt, Shigella flexneri 2a str. 2457T
aucuuucacaaagacgc

SEQ ID NO: 1891085 - RNA, 21 nt, Shigella flexneri 2a str. 2457T
augaauguuuuccugcuucac

SEQ ID NO: 1891086 - RNA, 15 nt, Shigella flexneri 2a str. 2457T
augaccguuacugau

SEQ ID NO: 1891087 - RNA, 20 nt, Shigella flexneri 2a str. 2457T
augaccgcguugcagcauau

SEQ ID NO: 1891088 - RNA, 17 nt, Shigella flexneri 2a str. 2457T
augaccgcuccgccauc

SEQ ID NO: 1891089 - RNA, 14 nt, Shigella flexneri 2a str. 2457T
augacuccagcgcc

SEQ ID NO: 1891090 - RNA, 14 nt, Shigella flexneri 2a str. 2457T
augacucgccgcug

SEQ ID NO: 1891091 - RNA, 13 nt, Shigella flexneri 2a str. 2457T
augaccugcaaau

SEQ ID NO: 1891092 - RNA, 18 nt, Shigella flexneri 2a str. 2457T
augauaggucauaucaca

SEQ ID NO: 1891093 - RNA, 21 nt, Shigella flexneri 2a str. 2457T
augaguuuggugccacgcgca

SEQ ID NO: 1891094 - RNA, 22 nt, Shigella flexneri 2a str. 2457T
augaucaaccgcuauaccgccg

SEQ ID NO: 1891095 - RNA, 14 nt, Shigella flexneri 2a str. 2457T
caccgccaccaccg

SEQ ID NO: 1891096 - RNA, 23 nt, Shigella flexneri 2a str. 2457T
caccgauucccgggcacacuuag

SEQ ID NO: 1891097 - RNA, 18 nt, Shigella flexneri 2a str. 2457T
caccgacgcagucaugcg

SEQ ID NO: 1891098 - RNA, 21 nt, Shigella flexneri 2a str. 2457T
caccgacgucgauauaauuga

SEQ ID NO: 1891099 - RNA, 15 nt, Shigella flexneri 2a str. 2457T
caccgccgauaccga

SEQ ID NO: 1891100 - RNA, 18 nt, Shigella flexneri 2a str. 2457T
cacccugugcgccaccgc

SEQ ID NO: 1891101 - RNA, 15 nt, Shigella flexneri 2a str. 2457T
cacccgguaccuuug

SEQ ID NO: 1891102 - RNA, 14 nt, Shigella flexneri 2a str. 2457T
cacccgcuucauaa

SEQ ID NO: 1891103 - RNA, 21 nt, Shigella flexneri 2a str. 2457T
caccgcuggcugcgaacgcaa

SEQ ID NO: 1891104 - RNA, 22 nt, Shigella flexneri 2a str. 2457T
caccgguacaaacaucauccag

SEQ ID NO: 1891105 - RNA, 19 nt, Shigella flexneri 2a str. 2457T
caccgggcagacgugacca

SEQ ID NO: 1891106 - RNA, 17 nt, Shigella flexneri 2a str. 2457T
caccggcgacccgcgac

SEQ ID NO: 1891107 - RNA, 20 nt, Shigella flexneri 2a str. 2457T
caccgucagcguacaggacg

SEQ ID NO: 1891108 - RNA, 21 nt, Shigella flexneri 2a str. 2457T
caccguguucaugaccgugau

SEQ ID NO: 1891109 - RNA, 13 nt, Shigella flexneri 2a str. 2457T
caccaucagcagc

SEQ ID NO: 1891110 - RNA, 17 nt, Shigella flexneri 2a str. 2457T
caccauucugcgcugac

SEQ ID NO: 1891111 - RNA, 15 nt, Shigella flexneri 2a str. 2457T
caccauucugcgcug

SEQ ID NO: 1891112 - RNA, 13 nt, Shigella flexneri 2a str. 2457T
caccauucugcgc

SEQ ID NO: 1891113 - RNA, 16 nt, Shigella flexneri 2a str. 2457T
caccauuggcauuggu

SEQ ID NO: 1891114 - RNA, 14 nt, Shigella flexneri 2a str. 2457T
caccauuaccgccg

SEQ ID NO: 1891115 - RNA, 21 nt, Shigella flexneri 2a str. 2457T
caccauuuuacguccgcgcac

SEQ ID NO: 1891116 - RNA, 15 nt, Shigella flexneri 2a str. 2457T
cacccgcgaccacca

SEQ ID NO: 1891117 - RNA, 19 nt, Shigella flexneri 2a str. 2457T
caccaguuacaucggugcc

SEQ ID NO: 1891118 - RNA, 13 nt, Shigella flexneri 2a str. 2457T
caccagcgcacgc

SEQ ID NO: 1891119 - RNA, 18 nt, Shigella flexneri 2a str. 2457T
cacaguuucagccccauc

SEQ ID NO: 1891120 - RNA, 15 nt, Shigella flexneri 2a str. 2457T
cacauaugaucggaa

SEQ ID NO: 1891121 - RNA, 19 nt, Shigella flexneri 2a str. 2457T
cacauaacggcccggcgac

SEQ ID NO: 1891122 - RNA, 16 nt, Shigella flexneri 2a str. 2457T
cacaucauuacaacgc

SEQ ID NO: 1891123 - RNA, 15 nt, Shigella flexneri 2a str. 2457T
cacaucaucaucgcg

SEQ ID NO: 1891124 - RNA, 16 nt, Shigella flexneri 2a str. 2457T
cacaugaguugcugga

SEQ ID NO: 1891125 - RNA, 14 nt, Shigella flexneri 2a str. 2457T
cacaugcaacguca

SEQ ID NO: 1891126 - RNA, 16 nt, Shigella flexneri 2a str. 2457T
cacaaauagccagcag

SEQ ID NO: 1891127 - RNA, 17 nt, Shigella flexneri 2a str. 2457T
caauuuuguaggccgga

SEQ ID NO: 1891128 - RNA, 22 nt, Shigella flexneri 2a str. 2457T
cacaaaaaaucgugcugcaaua

SEQ ID NO: 1891129 - RNA, 14 nt, Shigella flexneri 2a str. 2457T
cacaaaaaccgcug

SEQ ID NO: 1891130 - RNA, 18 nt, Shigella flexneri 2a str. 2457T
cacaggccugauaagacg

SEQ ID NO: 1891131 - RNA, 21 nt, Shigella flexneri 2a str. 2457T
cacaggccaucacauccugau

SEQ ID NO: 1891132 - RNA, 21 nt, Shigella flexneri 2a str. 2457T
caccaaaguguuccaucgcgu

SEQ ID NO: 1891133 - RNA, 13 nt, Shigella flexneri 2a str. 2457T
caccaccagacgc

SEQ ID NO: 1891134 - RNA, 13 nt, Shigella flexneri 2a str. 2457T
caccaccagcagc

SEQ ID NO: 1891135 - RNA, 14 nt, Shigella flexneri 2a str. 2457T
caacaaacgcugac

SEQ ID NO: 1891136 - RNA, 18 nt, Shigella flexneri 2a str. 2457T
caacaacgcaacuccagc

SEQ ID NO: 1891137 - RNA, 16 nt, Shigella flexneri 2a str. 2457T
caacaaccuugcguuu

SEQ ID NO: 1891138 - RNA, 14 nt, Shigella flexneri 2a str. 2457T
caacaaucgucagc

SEQ ID NO: 1891139 - RNA, 22 nt, Shigella flexneri 2a str. 2457T
caacaaucgucagcucgcugcc

SEQ ID NO: 1891140 - RNA, 20 nt, Shigella flexneri 2a str. 2457T
caaaugaacaccaaacccug

SEQ ID NO: 1891141 - RNA, 22 nt, Shigella flexneri 2a str. 2457T
caaaucucccuugcgggaucag

SEQ ID NO: 1891142 - RNA, 13 nt, Shigella flexneri 2a str. 2457T
caaaucugccgau

SEQ ID NO: 1891143 - RNA, 17 nt, Shigella flexneri 2a str. 2457T
caaaugcagcauugccu

SEQ ID NO: 1891144 - RNA, 17 nt, Shigella flexneri 2a str. 2457T
caaaugucaccagccga

SEQ ID NO: 1891145 - RNA, 19 nt, Shigella flexneri 2a str. 2457T
caaagcaugaugcgcgacc

SEQ ID NO: 1891146 - RNA, 20 nt, Shigella flexneri 2a str. 2457T
caaaguggaugaucgcggca

SEQ ID NO: 1891147 - RNA, 21 nt, Shigella flexneri 2a str. 2457T
caaagugagcuuuguucaugc

SEQ ID NO: 1891148 - RNA, 19 nt, Shigella flexneri 2a str. 2457T
caaagugauauccaccgcg

SEQ ID NO: 1891149 - RNA, 14 nt, Shigella flexneri 2a str. 2457T
caacagcggcauua

SEQ ID NO: 1891150 - RNA, 17 nt, Shigella flexneri 2a str. 2457T
caacaccuguuccagug

SEQ ID NO: 1891151 - RNA, 16 nt, Shigella flexneri 2a str. 2457T
caacaccuaccggcug

SEQ ID NO: 1891152 - RNA, 13 nt, Shigella flexneri 2a str. 2457T
caacacgccagcg

SEQ ID NO: 1891153 - RNA, 19 nt, Shigella flexneri 2a str. 2457T
caacacgccagcguuaucc

SEQ ID NO: 1891154 - RNA, 17 nt, Shigella flexneri 2a str. 2457T
caacagugaaacacaug

SEQ ID NO: 1891155 - RNA, 14 nt, Shigella flexneri 2a str. 2457T
caacauaacgcauc

SEQ ID NO: 1891156 - RNA, 21 nt, Shigella flexneri 2a str. 2457T
caacaucaaauuacagcaccu

SEQ ID NO: 1891157 - RNA, 17 nt, Shigella flexneri 2a str. 2457T
caaccacacccacauca

SEQ ID NO: 1891158 - RNA, 18 nt, Shigella flexneri 2a str. 2457T
caaccagauaaccaucgc

SEQ ID NO: 1891159 - RNA, 15 nt, Shigella flexneri 2a str. 2457T
caaccacuacgugau

SEQ ID NO: 1891160 - RNA, 21 nt, Shigella flexneri 2a str. 2457T
caaccagaucgcucaucugcu

SEQ ID NO: 1891161 - RNA, 21 nt, Shigella flexneri 2a str. 2457T
caaccaaggaaggucacgaug

SEQ ID NO: 1891162 - RNA, 18 nt, Shigella flexneri 2a str. 2457T
caacaucgaaaacgccac

SEQ ID NO: 1891163 - RNA, 21 nt, Shigella flexneri 2a str. 2457T
caaccuuuuccauugccgcag

SEQ ID NO: 1891164 - RNA, 14 nt, Shigella flexneri 2a str. 2457T
caacgaccagaaau

SEQ ID NO: 1891165 - RNA, 19 nt, Shigella flexneri 2a str. 2457T
caacgacgcugaugucagc

SEQ ID NO: 1891166 - RNA, 15 nt, Shigella flexneri 2a str. 2457T
caacgacggccaguu

SEQ ID NO: 1891167 - RNA, 16 nt, Shigella flexneri 2a str. 2457T
caacgacggccaguug

SEQ ID NO: 1891168 - RNA, 19 nt, Shigella flexneri 2a str. 2457T
caacgccguaaguaaggcg

SEQ ID NO: 1891169 - RNA, 16 nt, Shigella flexneri 2a str. 2457T
caacgccgccagacca

SEQ ID NO: 1891170 - RNA, 18 nt, Shigella flexneri 2a str. 2457T
caacgccuuugucgggca

SEQ ID NO: 1891171 - RNA, 14 nt, Shigella flexneri 2a str. 2457T
caacgcugaauggc

SEQ ID NO: 1891172 - RNA, 15 nt, Shigella flexneri 2a str. 2457T
caacgcggcacagca

SEQ ID NO: 1891173 - RNA, 15 nt, Shigella flexneri 2a str. 2457T
caaccguccuccgua

SEQ ID NO: 1891174 - RNA, 21 nt, Shigella flexneri 2a str. 2457T
caaccgguggcaguagcgccu

SEQ ID NO: 1891175 - RNA, 13 nt, Shigella flexneri 2a str. 2457T
caacccuugacgc

SEQ ID NO: 1891176 - RNA, 13 nt, Shigella flexneri 2a str. 2457T
caaccgccaccga

SEQ ID NO: 1891177 - RNA, 20 nt, Shigella flexneri 2a str. 2457T
caacccgcucuggauaauca

SEQ ID NO: 1891178 - RNA, 17 nt, Shigella flexneri 2a str. 2457T
caauauuuucaaucugg

SEQ ID NO: 1891179 - RNA, 14 nt, Shigella flexneri 2a str. 2457T
caaucaaauacccu

SEQ ID NO: 1891180 - RNA, 15 nt, Shigella flexneri 2a str. 2457T
caaucaaauauucug

SEQ ID NO: 1891181 - RNA, 18 nt, Shigella flexneri 2a str. 2457T
caaucaccgccagcggcg

SEQ ID NO: 1891182 - RNA, 20 nt, Shigella flexneri 2a str. 2457T
caaucacgucgcccaccgcg

SEQ ID NO: 1891183 - RNA, 16 nt, Shigella flexneri 2a str. 2457T
caaucaccaccagcgg

SEQ ID NO: 1891184 - RNA, 19 nt, Shigella flexneri 2a str. 2457T
caaucaacaccacugccag

SEQ ID NO: 1891185 - RNA, 15 nt, Shigella flexneri 2a str. 2457T
caaucaccaugccgu

SEQ ID NO: 1891186 - RNA, 17 nt, Shigella flexneri 2a str. 2457T
caaucaccgccagcaag

SEQ ID NO: 1891187 - RNA, 21 nt, Shigella flexneri 2a str. 2457T
caaucagcacacauaagagcg

SEQ ID NO: 1891188 - RNA, 14 nt, Shigella flexneri 2a str. 2457T
caaucagcaccgcg

SEQ ID NO: 1891189 - RNA, 20 nt, Shigella flexneri 2a str. 2457T
caaucacuuccucaagcguu

SEQ ID NO: 1891190 - RNA, 13 nt, Shigella flexneri 2a str. 2457T
caaucgaccaggc

SEQ ID NO: 1891191 - RNA, 17 nt, Shigella flexneri 2a str. 2457T
caauacugacaucagca

SEQ ID NO: 1891192 - RNA, 18 nt, Shigella flexneri 2a str. 2457T
caauaguguugccgccac

SEQ ID NO: 1891193 - RNA, 14 nt, Shigella flexneri 2a str. 2457T
caauauccauuugu

SEQ ID NO: 1891194 - RNA, 14 nt, Shigella flexneri 2a str. 2457T
caauagacaguucu

SEQ ID NO: 1891195 - RNA, 22 nt, Shigella flexneri 2a str. 2457T
caauacuggcaccgaagcccau

SEQ ID NO: 1891196 - RNA, 16 nt, Shigella flexneri 2a str. 2457T
caauacuuccgcuucc

SEQ ID NO: 1891197 - RNA, 15 nt, Shigella flexneri 2a str. 2457T
caaucugcuugcgau

SEQ ID NO: 1891198 - RNA, 18 nt, Shigella flexneri 2a str. 2457T
caaucugcaaaucgaucu

SEQ ID NO: 1891199 - RNA, 20 nt, Shigella flexneri 2a str. 2457T
caaucuccguguaggccuga

SEQ ID NO: 1891200 - RNA, 15 nt, Shigella flexneri 2a str. 2457T
caaugccauccagcu

SEQ ID NO: 1891201 - RNA, 22 nt, Shigella flexneri 2a str. 2457T
caaugcaggcaucggugaugcu

SEQ ID NO: 1891202 - RNA, 14 nt, Shigella flexneri 2a str. 2457T
caauggcauccgcc

SEQ ID NO: 1891203 - RNA, 20 nt, Shigella flexneri 2a str. 2457T
caauuugcuuaagccgcucu

SEQ ID NO: 1891204 - RNA, 20 nt, Shigella flexneri 2a str. 2457T
caauucgcgucggcgucagc

SEQ ID NO: 1891205 - RNA, 17 nt, Shigella flexneri 2a str. 2457T
caauucaguacguucac

SEQ ID NO: 1891206 - RNA, 11 nt, Shigella flexneri 2a str. 2457T
caauggcgucu

SEQ ID NO: 1891207 - RNA, 15 nt, Shigella flexneri 2a str. 2457T
caauguuauccggcu

SEQ ID NO: 1891208 - RNA, 20 nt, Shigella flexneri 2a str. 2457T
caauuacgccgagcgccagc

SEQ ID NO: 1891209 - RNA, 16 nt, Shigella flexneri 2a str. 2457T
caacgguucgccauca

SEQ ID NO: 1891210 - RNA, 23 nt, Shigella flexneri 2a str. 2457T
caacgguuaacaguuuguuuagc

SEQ ID NO: 1891211 - RNA, 17 nt, Shigella flexneri 2a str. 2457T
caacguaguaucguaau

SEQ ID NO: 1891212 - RNA, 17 nt, Shigella flexneri 2a str. 2457T
caacguguuuguucaac

SEQ ID NO: 1891213 - RNA, 19 nt, Shigella flexneri 2a str. 2457T
caacguguuuguucaacga

SEQ ID NO: 1891214 - RNA, 12 nt, Shigella flexneri 2a str. 2457T
caacugccugau

SEQ ID NO: 1891215 - RNA, 12 nt, Shigella flexneri 2a str. 2457T
caacucacgauu

SEQ ID NO: 1891216 - RNA, 18 nt, Shigella flexneri 2a str. 2457T
caacggcgagccagcgca

SEQ ID NO: 1891217 - RNA, 23 nt, Shigella flexneri 2a str. 2457T
caacggaggauuuuucgcgaccg

SEQ ID NO: 1891218 - RNA, 18 nt, Shigella flexneri 2a str. 2457T
caacggcggaucaccgcg

SEQ ID NO: 1891219 - RNA, 17 nt, Shigella flexneri 2a str. 2457T
caacugcgacguggauc

SEQ ID NO: 1891220 - RNA, 18 nt, Shigella flexneri 2a str. 2457T
caagagacugcuggcuua

SEQ ID NO: 1891221 - RNA, 16 nt, Shigella flexneri 2a str. 2457T
caagauaacagacaug

SEQ ID NO: 1891222 - RNA, 23 nt, Shigella flexneri 2a str. 2457T
caagcuuacguuacccagcacgg

SEQ ID NO: 1891223 - RNA, 22 nt, Shigella flexneri 2a str. 2457T
caagcucguugguuccacggca

SEQ ID NO: 1891224 - RNA, 18 nt, Shigella flexneri 2a str. 2457T
ccaugaacaaaauuccag

SEQ ID NO: 1891225 - RNA, 17 nt, Shigella flexneri 2a str. 2457T
ccaugaaaauagacguu

SEQ ID NO: 1891226 - RNA, 21 nt, Shigella flexneri 2a str. 2457T
ccaugauuucguagacugcag

SEQ ID NO: 1891227 - RNA, 18 nt, Shigella flexneri 2a str. 2457T
ccaugccaguuaucgcag

SEQ ID NO: 1891228 - RNA, 17 nt, Shigella flexneri 2a str. 2457T
ccaugacguucaguuca

SEQ ID NO: 1891229 - RNA, 21 nt, Shigella flexneri 2a str. 2457T
ccaugccggaugcgccagcau

SEQ ID NO: 1891230 - RNA, 12 nt, Shigella flexneri 2a str. 2457T
ccauggacgaug

SEQ ID NO: 1891231 - RNA, 12 nt, Shigella flexneri 2a str. 2457T
ccauggauuacc

SEQ ID NO: 1891232 - RNA, 20 nt, Shigella flexneri 2a str. 2457T
ccauccgcgcugaugcgauc

SEQ ID NO: 1891233 - RNA, 14 nt, Shigella flexneri 2a str. 2457T
ccauccaucaacgc

SEQ ID NO: 1891234 - RNA, 15 nt, Shigella flexneri 2a str. 2457T
ccaucaggcguuugu

SEQ ID NO: 1891235 - RNA, 13 nt, Shigella flexneri 2a str. 2457T
ccaucaggucauc

SEQ ID NO: 1891236 - RNA, 13 nt, Shigella flexneri 2a str. 2457T
ccaucaucaucgg

SEQ ID NO: 1891237 - RNA, 21 nt, Shigella flexneri 2a str. 2457T
ccaucaucaucgguaccgcca

SEQ ID NO: 1891238 - RNA, 14 nt, Shigella flexneri 2a str. 2457T
ccaucaucggcaaa

SEQ ID NO: 1891239 - RNA, 18 nt, Shigella flexneri 2a str. 2457T
ccaucgucggguaguuaa

SEQ ID NO: 1891240 - RNA, 14 nt, Shigella flexneri 2a str. 2457T
ccaucgggcuauuu

SEQ ID NO: 1891241 - RNA, 17 nt, Shigella flexneri 2a str. 2457T
ccaucggaaugcgaauu

SEQ ID NO: 1891242 - RNA, 19 nt, Shigella flexneri 2a str. 2457T
ccaucgcgguuaaucggca

SEQ ID NO: 1891243 - RNA, 20 nt, Shigella flexneri 2a str. 2457T
ccaucgcgguuaaucggcag

SEQ ID NO: 1891244 - RNA, 16 nt, Shigella flexneri 2a str. 2457T
ccaucgcaucuucgcc

SEQ ID NO: 1891245 - RNA, 13 nt, Shigella flexneri 2a str. 2457T
ccaucgccagcag

SEQ ID NO: 1891246 - RNA, 15 nt, Shigella flexneri 2a str. 2457T
cccagcccccagcau

SEQ ID NO: 1891247 - RNA, 16 nt, Shigella flexneri 2a str. 2457T
cccagccaaugcaggc

SEQ ID NO: 1891248 - RNA, 16 nt, Shigella flexneri 2a str. 2457T
cccagcaccgcagaga

SEQ ID NO: 1891249 - RNA, 13 nt, Shigella flexneri 2a str. 2457T
cccagcgcaucag

SEQ ID NO: 1891250 - RNA, 19 nt, Shigella flexneri 2a str. 2457T
cccaggcaaguagcgccau

SEQ ID NO: 1891251 - RNA, 13 nt, Shigella flexneri 2a str. 2457T
cccacaacgaccu

SEQ ID NO: 1891252 - RNA, 20 nt, Shigella flexneri 2a str. 2457T
cccaauacgauuaacgccag

SEQ ID NO: 1891253 - RNA, 18 nt, Shigella flexneri 2a str. 2457T
cccacgccgcccagagaa

SEQ ID NO: 1891254 - RNA, 20 nt, Shigella flexneri 2a str. 2457T
ccaggcggaguaaacggcag

SEQ ID NO: 1891255 - RNA, 17 nt, Shigella flexneri 2a str. 2457T
ccaggccaucagcagcg

SEQ ID NO: 1891256 - RNA, 22 nt, Shigella flexneri 2a str. 2457T
ccagguuuuaguuucgccguuu

SEQ ID NO: 1891257 - RNA, 14 nt, Shigella flexneri 2a str. 2457T
ccaguaauccggcu

SEQ ID NO: 1891258 - RNA, 18 nt, Shigella flexneri 2a str. 2457T
ccaguaaucuggccaaug

SEQ ID NO: 1891259 - RNA, 13 nt, Shigella flexneri 2a str. 2457T
ccaguaguaacca

SEQ ID NO: 1891260 - RNA, 17 nt, Shigella flexneri 2a str. 2457T
ccaggucgcauccggca

SEQ ID NO: 1891261 - RNA, 21 nt, Shigella flexneri 2a str. 2457T
ccauacugacuaucaucgccg

SEQ ID NO: 1891262 - RNA, 20 nt, Shigella flexneri 2a str. 2457T
ccauaguguguuccucugcu

SEQ ID NO: 1891263 - RNA, 20 nt, Shigella flexneri 2a str. 2457T
ccauacggcagagaucgccg

SEQ ID NO: 1891264 - RNA, 17 nt, Shigella flexneri 2a str. 2457T
ccauacccgcaacauac

SEQ ID NO: 1891265 - RNA, 14 nt, Shigella flexneri 2a str. 2457T
ccauacccagcauc

SEQ ID NO: 1891266 - RNA, 15 nt, Shigella flexneri 2a str. 2457T
ccauaauggacguuu

SEQ ID NO: 1891267 - RNA, 19 nt, Shigella flexneri 2a str. 2457T
ccaguuucggacgcggcac

SEQ ID NO: 1891268 - RNA, 15 nt, Shigella flexneri 2a str. 2457T
ccaguuguucgcgca

SEQ ID NO: 1891269 - RNA, 18 nt, Shigella flexneri 2a str. 2457T
ccauaaucucaucagcgu

SEQ ID NO: 1891270 - RNA, 22 nt, Shigella flexneri 2a str. 2457T
ccauaacgccugcuccagugca

SEQ ID NO: 1891271 - RNA, 21 nt, Shigella flexneri 2a str. 2457T
ccauaacggcuguccauacgu

SEQ ID NO: 1891272 - RNA, 20 nt, Shigella flexneri 2a str. 2457T
ccauauuuugaaucggcggc

SEQ ID NO: 1891273 - RNA, 24 nt, Shigella flexneri 2a str. 2457T
ccauauguugaaaagccagguuca

SEQ ID NO: 1891274 - RNA, 19 nt, Shigella flexneri 2a str. 2457T
ccaucaacgccaucgccag

SEQ ID NO: 1891275 - RNA, 16 nt, Shigella flexneri 2a str. 2457T
ccaucaaccacuacgu

SEQ ID NO: 1891276 - RNA, 14 nt, Shigella flexneri 2a str. 2457T
ccaucacuaccuga

SEQ ID NO: 1891277 - RNA, 18 nt, Shigella flexneri 2a str. 2457T
ccaucaccaucguugcua

SEQ ID NO: 1891278 - RNA, 16 nt, Shigella flexneri 2a str. 2457T
ccaucacuaucgccau

SEQ ID NO: 1891279 - RNA, 12 nt, Shigella flexneri 2a str. 2457T
ccaucagcagca

SEQ ID NO: 1891280 - RNA, 17 nt, Shigella flexneri 2a str. 2457T
ccaguucaaaguugcau

SEQ ID NO: 1891281 - RNA, 14 nt, Shigella flexneri 2a str. 2457T
ccagugguuucgcc

SEQ ID NO: 1891282 - RNA, 21 nt, Shigella flexneri 2a str. 2457T
ccaguucuuccaguuccggca

SEQ ID NO: 1891283 - RNA, 20 nt, Shigella flexneri 2a str. 2457T
ccaguugauucgcgcguucg

SEQ ID NO: 1891284 - RNA, 18 nt, Shigella flexneri 2a str. 2457T
ccaguugcuuauccagca

SEQ ID NO: 1891285 - RNA, 17 nt, Shigella flexneri 2a str. 2457T
ccagucuuccugcggca

SEQ ID NO: 1891286 - RNA, 23 nt, Shigella flexneri 2a str. 2457T
ccagugaggaugcgggucaggcc

SEQ ID NO: 1891287 - RNA, 21 nt, Shigella flexneri 2a str. 2457T
ccagucauugagcuucucgau

SEQ ID NO: 1891288 - RNA, 16 nt, Shigella flexneri 2a str. 2457T
ccagucccaguucaug

SEQ ID NO: 1891289 - RNA, 19 nt, Shigella flexneri 2a str. 2457T
ccccucuaacucuucugaa

SEQ ID NO: 1891290 - RNA, 17 nt, Shigella flexneri 2a str. 2457T
ccccugagacaguuauu

SEQ ID NO: 1891291 - RNA, 21 nt, Shigella flexneri 2a str. 2457T
ccccagugguuucgccagcac

SEQ ID NO: 1891292 - RNA, 22 nt, Shigella flexneri 2a str. 2457T
ccccaguaaauggugauaucac

SEQ ID NO: 1891293 - RNA, 14 nt, Shigella flexneri 2a str. 2457T
ccccaggccagcag

SEQ ID NO: 1891294 - RNA, 20 nt, Shigella flexneri 2a str. 2457T
ccccaggcugugcgccagcu

SEQ ID NO: 1891295 - RNA, 21 nt, Shigella flexneri 2a str. 2457T
cccgcuucguuuucagcuucg

SEQ ID NO: 1891296 - RNA, 21 nt, Shigella flexneri 2a str. 2457T
cccgcugguuaacgcaccaau

SEQ ID NO: 1891297 - RNA, 16 nt, Shigella flexneri 2a str. 2457T
cccgccagcgcggcga

SEQ ID NO: 1891298 - RNA, 19 nt, Shigella flexneri 2a str. 2457T
cccgccgaucagcgcggaa

SEQ ID NO: 1891299 - RNA, 14 nt, Shigella flexneri 2a str. 2457T
cccgccgccgccau

SEQ ID NO: 1891300 - RNA, 18 nt, Shigella flexneri 2a str. 2457T
cccgcaggagcgccgaau

SEQ ID NO: 1891301 - RNA, 18 nt, Shigella flexneri 2a str. 2457T
cccgcaacagcaauacgu

SEQ ID NO: 1891302 - RNA, 23 nt, Shigella flexneri 2a str. 2457T
cccgcaagacgaaccggcaccca

SEQ ID NO: 1891303 - RNA, 18 nt, Shigella flexneri 2a str. 2457T
cccggcaauggguaacgg

SEQ ID NO: 1891304 - RNA, 14 nt, Shigella flexneri 2a str. 2457T
cccugccaguccug

SEQ ID NO: 1891305 - RNA, 20 nt, Shigella flexneri 2a str. 2457T
cccugcaaauuauuugcgua

SEQ ID NO: 1891306 - RNA, 17 nt, Shigella flexneri 2a str. 2457T
cccugacaaaucaugcg

SEQ ID NO: 1891307 - RNA, 15 nt, Shigella flexneri 2a str. 2457T
cccugauaaccgcau

SEQ ID NO: 1891308 - RNA, 19 nt, Shigella flexneri 2a str. 2457T
cccugugcgcccuguucug

SEQ ID NO: 1891309 - RNA, 13 nt, Shigella flexneri 2a str. 2457T
ccgaaacgcaccu

SEQ ID NO: 1891310 - RNA, 12 nt, Shigella flexneri 2a str. 2457T
cccuuaguaacg

SEQ ID NO: 1891311 - RNA, 13 nt, Shigella flexneri 2a str. 2457T
cccuucaucgcuc

SEQ ID NO: 1891312 - RNA, 21 nt, Shigella flexneri 2a str. 2457T
cccgguugcuuuucacaaccg

SEQ ID NO: 1891313 - RNA, 11 nt, Shigella flexneri 2a str. 2457T
cccuauucgca

SEQ ID NO: 1891314 - RNA, 16 nt, Shigella flexneri 2a str. 2457T
cccgugggcaggccug

SEQ ID NO: 1891315 - RNA, 15 nt, Shigella flexneri 2a str. 2457T
ccagccagacgccag

SEQ ID NO: 1891316 - RNA, 15 nt, Shigella flexneri 2a str. 2457T
ccagccacugcgcca

SEQ ID NO: 1891317 - RNA, 17 nt, Shigella flexneri 2a str. 2457T
ccagcaugaaacgccag

SEQ ID NO: 1891318 - RNA, 20 nt, Shigella flexneri 2a str. 2457T
ccagcagcgaaucagcccag

SEQ ID NO: 1891319 - RNA, 16 nt, Shigella flexneri 2a str. 2457T
aaauacugacuggcaa

SEQ ID NO: 1891320 - RNA, 20 nt, Shigella flexneri 2a str. 2457T
aaauagccagcagagcaaaa

SEQ ID NO: 1891321 - RNA, 15 nt, Shigella flexneri 2a str. 2457T
aaauagccagcagag

SEQ ID NO: 1891322 - RNA, 14 nt, Shigella flexneri 2a str. 2457T
ccagcacugccgca

SEQ ID NO: 1891323 - RNA, 22 nt, Shigella flexneri 2a str. 2457T
ccagcgcggcgauaaugcccag

SEQ ID NO: 1891324 - RNA, 12 nt, Shigella flexneri 2a str. 2457T
ccagcgcguucu

SEQ ID NO: 1891325 - RNA, 12 nt, Shigella flexneri 2a str. 2457T
aaaucacaccau

SEQ ID NO: 1891326 - RNA, 18 nt, Shigella flexneri 2a str. 2457T
aaaucaccgccaccagcg

SEQ ID NO: 1891327 - RNA, 18 nt, Shigella flexneri 2a str. 2457T
aaaucaccucaucaccac

SEQ ID NO: 1891328 - RNA, 11 nt, Shigella flexneri 2a str. 2457T
aaaucaacgcc

SEQ ID NO: 1891329 - RNA, 22 nt, Shigella flexneri 2a str. 2457T
aaaucaacaugaaaauaaccau

SEQ ID NO: 1891330 - RNA, 23 nt, Shigella flexneri 2a str. 2457T
ccagccuggcggaaagccagaau

SEQ ID NO: 1891331 - RNA, 15 nt, Shigella flexneri 2a str. 2457T
ccagccgugaauggu

SEQ ID NO: 1891332 - RNA, 21 nt, Shigella flexneri 2a str. 2457T
ccagcgauuuaucggcaauuu

SEQ ID NO: 1891333 - RNA, 22 nt, Shigella flexneri 2a str. 2457T
ccagcgaaaucaccgccaccag

SEQ ID NO: 1891334 - RNA, 20 nt, Shigella flexneri 2a str. 2457T
ccagccuucuucauccagcg

SEQ ID NO: 1891335 - RNA, 15 nt, Shigella flexneri 2a str. 2457T
ccagccuuuccggca

SEQ ID NO: 1891336 - RNA, 15 nt, Shigella flexneri 2a str. 2457T
ccagaaacgccacca

SEQ ID NO: 1891337 - RNA, 17 nt, Shigella flexneri 2a str. 2457T
ccagaaaaccuggcgca

SEQ ID NO: 1891338 - RNA, 16 nt, Shigella flexneri 2a str. 2457T
ccagaaaagagacgcu

SEQ ID NO: 1891339 - RNA, 14 nt, Shigella flexneri 2a str. 2457T
ccacuucauccgga

SEQ ID NO: 1891340 - RNA, 13 nt, Shigella flexneri 2a str. 2457T
ccacugccagauu

SEQ ID NO: 1891341 - RNA, 15 nt, Shigella flexneri 2a str. 2457T
ccacugacacggaac

SEQ ID NO: 1891342 - RNA, 21 nt, Shigella flexneri 2a str. 2457T
ccagauauuuuucaauccgca

SEQ ID NO: 1891343 - RNA, 20 nt, Shigella flexneri 2a str. 2457T
ccagagugaugcguccgcua

SEQ ID NO: 1891344 - RNA, 16 nt, Shigella flexneri 2a str. 2457T
ccagcaauaaugccag

SEQ ID NO: 1891345 - RNA, 15 nt, Shigella flexneri 2a str. 2457T
ccagcaacugauggc

SEQ ID NO: 1891346 - RNA, 23 nt, Shigella flexneri 2a str. 2457T
ccagcaagaaccaugcaauuacc

SEQ ID NO: 1891347 - RNA, 22 nt, Shigella flexneri 2a str. 2457T
ccagcacaaaguggcggcuacc

SEQ ID NO: 1891348 - RNA, 17 nt, Shigella flexneri 2a str. 2457T
ccagaauuaacgcugac

SEQ ID NO: 1891349 - RNA, 15 nt, Shigella flexneri 2a str. 2457T
ccagaaucgccagca

SEQ ID NO: 1891350 - RNA, 13 nt, Shigella flexneri 2a str. 2457T
ccagaauccagga

SEQ ID NO: 1891351 - RNA, 16 nt, Shigella flexneri 2a str. 2457T
ccagacaaaagcgaag

SEQ ID NO: 1891352 - RNA, 13 nt, Shigella flexneri 2a str. 2457T
ccagacaucccag

SEQ ID NO: 1891353 - RNA, 20 nt, Shigella flexneri 2a str. 2457T
ccagacccaguuuugcgcgu

SEQ ID NO: 1891354 - RNA, 22 nt, Shigella flexneri 2a str. 2457T
ccagaccuaacuuggcaaagcu

SEQ ID NO: 1891355 - RNA, 18 nt, Shigella flexneri 2a str. 2457T
ccagacuccaggcguuuu

SEQ ID NO: 1891356 - RNA, 20 nt, Shigella flexneri 2a str. 2457T
ccagacugaucaucgcccag

SEQ ID NO: 1891357 - RNA, 19 nt, Shigella flexneri 2a str. 2457T
aaaguguggggauaacuau

SEQ ID NO: 1891358 - RNA, 16 nt, Shigella flexneri 2a str. 2457T
ccaccuggaaccaggc

SEQ ID NO: 1891359 - RNA, 21 nt, Shigella flexneri 2a str. 2457T
ccaccucaguacccgcguucu

SEQ ID NO: 1891360 - RNA, 13 nt, Shigella flexneri 2a str. 2457T
ccaccgaccaggc

SEQ ID NO: 1891361 - RNA, 17 nt, Shigella flexneri 2a str. 2457T
ccaccgggguaaaucca

SEQ ID NO: 1891362 - RNA, 20 nt, Shigella flexneri 2a str. 2457T
aaauaccggacacacuucau

SEQ ID NO: 1891363 - RNA, 14 nt, Shigella flexneri 2a str. 2457T
aaauaccaccagcg

SEQ ID NO: 1891364 - RNA, 13 nt, Shigella flexneri 2a str. 2457T
aaauacagagcac

SEQ ID NO: 1891365 - RNA, 16 nt, Shigella flexneri 2a str. 2457T
aaauaaucgaucgcgu

SEQ ID NO: 1891366 - RNA, 22 nt, Shigella flexneri 2a str. 2457T
aaauaauacguagcaccgacgu

SEQ ID NO: 1891367 - RNA, 18 nt, Shigella flexneri 2a str. 2457T
aaauaaggccaugcugcu

SEQ ID NO: 1891368 - RNA, 21 nt, Shigella flexneri 2a str. 2457T
aaauaacagcggcaaccagcc

SEQ ID NO: 1891369 - RNA, 19 nt, Shigella flexneri 2a str. 2457T
ccacgccgcugucuaccag

SEQ ID NO: 1891370 - RNA, 14 nt, Shigella flexneri 2a str. 2457T
ccacaucagcggca

SEQ ID NO: 1891371 - RNA, 21 nt, Shigella flexneri 2a str. 2457T
ccaccagaaucgccagcaucg

SEQ ID NO: 1891372 - RNA, 16 nt, Shigella flexneri 2a str. 2457T
ccaccagaaucgccag

SEQ ID NO: 1891373 - RNA, 19 nt, Shigella flexneri 2a str. 2457T
ccaccagaaucgccagcau

SEQ ID NO: 1891374 - RNA, 13 nt, Shigella flexneri 2a str. 2457T
ccaccagcaccag

SEQ ID NO: 1891375 - RNA, 19 nt, Shigella flexneri 2a str. 2457T
ccaccagauggcuuuccac

SEQ ID NO: 1891376 - RNA, 23 nt, Shigella flexneri 2a str. 2457T
ccaccagcaugaaacgccaggau

SEQ ID NO: 1891377 - RNA, 22 nt, Shigella flexneri 2a str. 2457T
ccaccccacgauguauccggca

SEQ ID NO: 1891378 - RNA, 22 nt, Shigella flexneri 2a str. 2457T
ccacagugacccgcagccagca

SEQ ID NO: 1891379 - RNA, 23 nt, Shigella flexneri 2a str. 2457T
ccacagugacccgcagccagcac

SEQ ID NO: 1891380 - RNA, 17 nt, Shigella flexneri 2a str. 2457T
ccacaccaagccggaau

SEQ ID NO: 1891381 - RNA, 16 nt, Shigella flexneri 2a str. 2457T
ccacagcucugcuguc

SEQ ID NO: 1891382 - RNA, 16 nt, Shigella flexneri 2a str. 2457T
ccaauuccgcagcgcg

SEQ ID NO: 1891383 - RNA, 21 nt, Shigella flexneri 2a str. 2457T
ccacaauggcauauuccgcca

SEQ ID NO: 1891384 - RNA, 16 nt, Shigella flexneri 2a str. 2457T
ccaauacgauuaacgc

SEQ ID NO: 1891385 - RNA, 20 nt, Shigella flexneri 2a str. 2457T
ccaauacgauuaacgccaga

SEQ ID NO: 1891386 - RNA, 16 nt, Shigella flexneri 2a str. 2457T
ccaauagucaucgucg

SEQ ID NO: 1891387 - RNA, 20 nt, Shigella flexneri 2a str. 2457T
ccaagcuucgggauggcgau

SEQ ID NO: 1891388 - RNA, 21 nt, Shigella flexneri 2a str. 2457T
ccaaccgauaucuuuccggca

SEQ ID NO: 1891389 - RNA, 23 nt, Shigella flexneri 2a str. 2457T
ccaaccguggcguaaaucaucgg

SEQ ID NO: 1891390 - RNA, 19 nt, Shigella flexneri 2a str. 2457T
ccaaacuuaugcagcugcu

SEQ ID NO: 1891391 - RNA, 23 nt, Shigella flexneri 2a str. 2457T
ccaaacugauuuagcaucagcgc

SEQ ID NO: 1891392 - RNA, 17 nt, Shigella flexneri 2a str. 2457T
ccaaacgcucccugcca

SEQ ID NO: 1891393 - RNA, 16 nt, Shigella flexneri 2a str. 2457T
ccaacaauugucgcca

SEQ ID NO: 1891394 - RNA, 17 nt, Shigella flexneri 2a str. 2457T
ccaacaccuaccggcug

SEQ ID NO: 1891395 - RNA, 23 nt, Shigella flexneri 2a str. 2457T
ccaaaauugguuucagccggauc

SEQ ID NO: 1891396 - RNA, 12 nt, Shigella flexneri 2a str. 2457T
ccaaaaccgcuc

SEQ ID NO: 1891397 - RNA, 12 nt, Shigella flexneri 2a str. 2457T
cauuucgucguc

SEQ ID NO: 1891398 - RNA, 16 nt, Shigella flexneri 2a str. 2457T
cauuucuuuugagcgu

SEQ ID NO: 1891399 - RNA, 14 nt, Shigella flexneri 2a str. 2457T
cauuuugacccggu

SEQ ID NO: 1891400 - RNA, 18 nt, Shigella flexneri 2a str. 2457T
cauuuuacuuacuucagc

SEQ ID NO: 1891401 - RNA, 22 nt, Shigella flexneri 2a str. 2457T
cauuuacgccgcauccggcaau

SEQ ID NO: 1891402 - RNA, 15 nt, Shigella flexneri 2a str. 2457T
cauuuacgccgcauc

SEQ ID NO: 1891403 - RNA, 13 nt, Shigella flexneri 2a str. 2457T
cauuguguuaucc

SEQ ID NO: 1891404 - RNA, 15 nt, Shigella flexneri 2a str. 2457T
cauuguuucucugac

SEQ ID NO: 1891405 - RNA, 20 nt, Shigella flexneri 2a str. 2457T
cauuggguucaucugauagc

SEQ ID NO: 1891406 - RNA, 23 nt, Shigella flexneri 2a str. 2457T
cauugguuuuuugguaaugacuc

SEQ ID NO: 1891407 - RNA, 14 nt, Shigella flexneri 2a str. 2457T
cauugcugccagaa

SEQ ID NO: 1891408 - RNA, 23 nt, Shigella flexneri 2a str. 2457T
cauuggguauucauugccugaug

SEQ ID NO: 1891409 - RNA, 15 nt, Shigella flexneri 2a str. 2457T
cauggauucgaugau

SEQ ID NO: 1891410 - RNA, 15 nt, Shigella flexneri 2a str. 2457T
caugguaaugaucgc

SEQ ID NO: 1891411 - RNA, 15 nt, Shigella flexneri 2a str. 2457T
cauggacgcgucagu

SEQ ID NO: 1891412 - RNA, 21 nt, Shigella flexneri 2a str. 2457T
caugcuccagcagauggcagu

SEQ ID NO: 1891413 - RNA, 17 nt, Shigella flexneri 2a str. 2457T
caugcucagucacuuca

SEQ ID NO: 1891414 - RNA, 18 nt, Shigella flexneri 2a str. 2457T
caugcucagaugccugau

SEQ ID NO: 1891415 - RNA, 23 nt, Shigella flexneri 2a str. 2457T
caugcucagaugccugaugcggc

SEQ ID NO: 1891416 - RNA, 17 nt, Shigella flexneri 2a str. 2457T
caugcucagaugccuga

SEQ ID NO: 1891417 - RNA, 18 nt, Shigella flexneri 2a str. 2457T
caugcuauugcgccagcc

SEQ ID NO: 1891418 - RNA, 19 nt, Shigella flexneri 2a str. 2457T
caucgcccuuuuuucaggu

SEQ ID NO: 1891419 - RNA, 23 nt, Shigella flexneri 2a str. 2457T
caucgcccugauggcgcgccacc

SEQ ID NO: 1891420 - RNA, 14 nt, Shigella flexneri 2a str. 2457T
cauugacgcaucgc

SEQ ID NO: 1891421 - RNA, 23 nt, Shigella flexneri 2a str. 2457T
cauugaauuuuauguuucgcauc

SEQ ID NO: 1891422 - RNA, 19 nt, Shigella flexneri 2a str. 2457T
cauugaacgggugauuucc

SEQ ID NO: 1891423 - RNA, 22 nt, Shigella flexneri 2a str. 2457T
cauucuggagcuggacggucug

SEQ ID NO: 1891424 - RNA, 19 nt, Shigella flexneri 2a str. 2457T
cauucuugccaucaaucac

SEQ ID NO: 1891425 - RNA, 23 nt, Shigella flexneri 2a str. 2457T
cauucgucguauagaucacuuug

SEQ ID NO: 1891426 - RNA, 22 nt, Shigella flexneri 2a str. 2457T
cauugccggaugacgcgucagg

SEQ ID NO: 1891427 - RNA, 16 nt, Shigella flexneri 2a str. 2457T
cauucgcgaugcugau

SEQ ID NO: 1891428 - RNA, 16 nt, Shigella flexneri 2a str. 2457T
cauucgguugccagcg

SEQ ID NO: 1891429 - RNA, 13 nt, Shigella flexneri 2a str. 2457T
cauuauucagcga

SEQ ID NO: 1891430 - RNA, 15 nt, Shigella flexneri 2a str. 2457T
cauucaccagcccac

SEQ ID NO: 1891431 - RNA, 16 nt, Shigella flexneri 2a str. 2457T
cauucacacuccaguc

SEQ ID NO: 1891432 - RNA, 22 nt, Shigella flexneri 2a str. 2457T
cauucagugcaaaugccagaua

SEQ ID NO: 1891433 - RNA, 19 nt, Shigella flexneri 2a str. 2457T
cauuagugauuaacgcuug

SEQ ID NO: 1891434 - RNA, 16 nt, Shigella flexneri 2a str. 2457T
cauuaaucugcucggc

SEQ ID NO: 1891435 - RNA, 20 nt, Shigella flexneri 2a str. 2457T
cauuaaugcacuuccagcgg

SEQ ID NO: 1891436 - RNA, 19 nt, Shigella flexneri 2a str. 2457T
cauuaaugucggaugcggc

SEQ ID NO: 1891437 - RNA, 16 nt, Shigella flexneri 2a str. 2457T
cauguugaucccggcu

SEQ ID NO: 1891438 - RNA, 21 nt, Shigella flexneri 2a str. 2457T
cauuaacaggccaaaugcgga

SEQ ID NO: 1891439 - RNA, 15 nt, Shigella flexneri 2a str. 2457T
cauuaagccacgguu

SEQ ID NO: 1891440 - RNA, 19 nt, Shigella flexneri 2a str. 2457T
cauuaaaguaggccagaua

SEQ ID NO: 1891441 - RNA, 16 nt, Shigella flexneri 2a str. 2457T
cagugccguuccagcc

SEQ ID NO: 1891442 - RNA, 18 nt, Shigella flexneri 2a str. 2457T
cagugacuucugccagcu

SEQ ID NO: 1891443 - RNA, 20 nt, Shigella flexneri 2a str. 2457T
cagugacccgcagccagcac

SEQ ID NO: 1891444 - RNA, 23 nt, Shigella flexneri 2a str. 2457T
cagugaugaaaacgaaggccgga

SEQ ID NO: 1891445 - RNA, 15 nt, Shigella flexneri 2a str. 2457T
cagugaggaugcggg

SEQ ID NO: 1891446 - RNA, 16 nt, Shigella flexneri 2a str. 2457T
cagugaaauacaguua

SEQ ID NO: 1891447 - RNA, 18 nt, Shigella flexneri 2a str. 2457T
cagugaaaguuuucaccg

SEQ ID NO: 1891448 - RNA, 15 nt, Shigella flexneri 2a str. 2457T
cagucggcguaaucc

SEQ ID NO: 1891449 - RNA, 17 nt, Shigella flexneri 2a str. 2457T
cagucgggauauucagc

SEQ ID NO: 1891450 - RNA, 22 nt, Shigella flexneri 2a str. 2457T
caguaccgccaccaccagacgc

SEQ ID NO: 1891451 - RNA, 13 nt, Shigella flexneri 2a str. 2457T
caguaccagcagc

SEQ ID NO: 1891452 - RNA, 20 nt, Shigella flexneri 2a str. 2457T
caguaaugaucggcgcgaaa

SEQ ID NO: 1891453 - RNA, 20 nt, Shigella flexneri 2a str. 2457T
caguaauaugggucggcgau

SEQ ID NO: 1891454 - RNA, 22 nt, Shigella flexneri 2a str. 2457T
caguaagacaccccacagcucu

SEQ ID NO: 1891455 - RNA, 14 nt, Shigella flexneri 2a str. 2457T
caguaacguugcau

SEQ ID NO: 1891456 - RNA, 13 nt, Shigella flexneri 2a str. 2457T
caguaaacgcuuu

SEQ ID NO: 1891457 - RNA, 19 nt, Shigella flexneri 2a str. 2457T
caguuccagcagcgcaauu

SEQ ID NO: 1891458 - RNA, 17 nt, Shigella flexneri 2a str. 2457T
caguuacccagcggaua

SEQ ID NO: 1891459 - RNA, 23 nt, Shigella flexneri 2a str. 2457T
caguggcuaagcaggcuggcuac

SEQ ID NO: 1891460 - RNA, 19 nt, Shigella flexneri 2a str. 2457T
caguugaucuauaccaccg

SEQ ID NO: 1891461 - RNA, 12 nt, Shigella flexneri 2a str. 2457T
caguugaucacc

SEQ ID NO: 1891462 - RNA, 16 nt, Shigella flexneri 2a str. 2457T
caguucuggcaccgga

SEQ ID NO: 1891463 - RNA, 13 nt, Shigella flexneri 2a str. 2457T
caguucgcggaua

SEQ ID NO: 1891464 - RNA, 20 nt, Shigella flexneri 2a str. 2457T
caguucgccguacugacggc

SEQ ID NO: 1891465 - RNA, 16 nt, Shigella flexneri 2a str. 2457T
caguucgccguacuga

SEQ ID NO: 1891466 - RNA, 20 nt, Shigella flexneri 2a str. 2457T
caggucggugugaaugacua

SEQ ID NO: 1891467 - RNA, 15 nt, Shigella flexneri 2a str. 2457T
caggugcgccagcga

SEQ ID NO: 1891468 - RNA, 13 nt, Shigella flexneri 2a str. 2457T
cagguaucgacaa

SEQ ID NO: 1891469 - RNA, 21 nt, Shigella flexneri 2a str. 2457T
cagguaguguuggaucugauc

SEQ ID NO: 1891470 - RNA, 14 nt, Shigella flexneri 2a str. 2457T
caggucaucaauca

SEQ ID NO: 1891471 - RNA, 18 nt, Shigella flexneri 2a str. 2457T
caggucagagagccagcc

SEQ ID NO: 1891472 - RNA, 22 nt, Shigella flexneri 2a str. 2457T
caggucaaaaaaugaaacugga

SEQ ID NO: 1891473 - RNA, 21 nt, Shigella flexneri 2a str. 2457T
cagguaagaguuucaacauca

SEQ ID NO: 1891474 - RNA, 18 nt, Shigella flexneri 2a str. 2457T
cagguaauuugaucaaau

SEQ ID NO: 1891475 - RNA, 19 nt, Shigella flexneri 2a str. 2457T
cagggacgagucgucgaua

SEQ ID NO: 1891476 - RNA, 21 nt, Shigella flexneri 2a str. 2457T
cagggccaucgcgguuaaucg

SEQ ID NO: 1891477 - RNA, 20 nt, Shigella flexneri 2a str. 2457T
cagggacgagucgucgauau

SEQ ID NO: 1891478 - RNA, 13 nt, Shigella flexneri 2a str. 2457T
caucaacuggcaa

SEQ ID NO: 1891479 - RNA, 15 nt, Shigella flexneri 2a str. 2457T
caucaacgccauacg

SEQ ID NO: 1891480 - RNA, 19 nt, Shigella flexneri 2a str. 2457T
caucaagauuagcgacgaa

SEQ ID NO: 1891481 - RNA, 21 nt, Shigella flexneri 2a str. 2457T
caucaacgcccauaaauacgu

SEQ ID NO: 1891482 - RNA, 21 nt, Shigella flexneri 2a str. 2457T
caucaaaguuuuuaugaguuu

SEQ ID NO: 1891483 - RNA, 22 nt, Shigella flexneri 2a str. 2457T
caucaaauuacccugcacguug

SEQ ID NO: 1891484 - RNA, 23 nt, Shigella flexneri 2a str. 2457T
caucaacaacaauuucacuugcu

SEQ ID NO: 1891485 - RNA, 14 nt, Shigella flexneri 2a str. 2457T
cauaugcgccagcu

SEQ ID NO: 1891486 - RNA, 16 nt, Shigella flexneri 2a str. 2457T
cauaugcgcuggcagu

SEQ ID NO: 1891487 - RNA, 22 nt, Shigella flexneri 2a str. 2457T
cauauacgccaucgccagcagc

SEQ ID NO: 1891488 - RNA, 15 nt, Shigella flexneri 2a str. 2457T
cauauaccgcaucag

SEQ ID NO: 1891489 - RNA, 12 nt, Shigella flexneri 2a str. 2457T
cauauaagcguu

SEQ ID NO: 1891490 - RNA, 21 nt, Shigella flexneri 2a str. 2457T
cauaucauucgacaacugcug

SEQ ID NO: 1891491 - RNA, 13 nt, Shigella flexneri 2a str. 2457T
cauauccgcaaug

SEQ ID NO: 1891492 - RNA, 22 nt, Shigella flexneri 2a str. 2457T
cauacccgccagugcugaaggu

SEQ ID NO: 1891493 - RNA, 15 nt, Shigella flexneri 2a str. 2457T
cauagcgacaggcuu

SEQ ID NO: 1891494 - RNA, 21 nt, Shigella flexneri 2a str. 2457T
cauacccgcaacauacugccc

SEQ ID NO: 1891495 - RNA, 19 nt, Shigella flexneri 2a str. 2457T
caguugaucagccaggcga

SEQ ID NO: 1891496 - RNA, 21 nt, Shigella flexneri 2a str. 2457T
caguugguagguccagccgcc

SEQ ID NO: 1891497 - RNA, 16 nt, Shigella flexneri 2a str. 2457T
caguuggcugugguac

SEQ ID NO: 1891498 - RNA, 13 nt, Shigella flexneri 2a str. 2457T
cauaaaacgcuua

SEQ ID NO: 1891499 - RNA, 13 nt, Shigella flexneri 2a str. 2457T
caguuuugugccc

SEQ ID NO: 1891500 - RNA, 21 nt, Shigella flexneri 2a str. 2457T
caguuucgcgucgucaaccug

SEQ ID NO: 1891501 - RNA, 21 nt, Shigella flexneri 2a str. 2457T
caguuucgacgccuucagcga

SEQ ID NO: 1891502 - RNA, 15 nt, Shigella flexneri 2a str. 2457T
caguuucgaggcgau

SEQ ID NO: 1891503 - RNA, 13 nt, Shigella flexneri 2a str. 2457T
caguugguuaauc

SEQ ID NO: 1891504 - RNA, 21 nt, Shigella flexneri 2a str. 2457T
cauaccacuuccagcagacca

SEQ ID NO: 1891505 - RNA, 15 nt, Shigella flexneri 2a str. 2457T
cauaccauccggcau

SEQ ID NO: 1891506 - RNA, 15 nt, Shigella flexneri 2a str. 2457T
cauaccaccgacgug

SEQ ID NO: 1891507 - RNA, 23 nt, Shigella flexneri 2a str. 2457T
cauaaagaaaucaccugccggag

SEQ ID NO: 1891508 - RNA, 20 nt, Shigella flexneri 2a str. 2457T
cauaaacaacgagcuucagc

SEQ ID NO: 1891509 - RNA, 14 nt, Shigella flexneri 2a str. 2457T
caucgcccaggcga

SEQ ID NO: 1891510 - RNA, 23 nt, Shigella flexneri 2a str. 2457T
caucgccaaucugcugauaaucg

SEQ ID NO: 1891511 - RNA, 14 nt, Shigella flexneri 2a str. 2457T
caucgccacaccag

SEQ ID NO: 1891512 - RNA, 20 nt, Shigella flexneri 2a str. 2457T
caucgcagggaucauccacc

SEQ ID NO: 1891513 - RNA, 13 nt, Shigella flexneri 2a str. 2457T
caucgcagcaaac

SEQ ID NO: 1891514 - RNA, 21 nt, Shigella flexneri 2a str. 2457T
caucgcauccgacaucaaccg

SEQ ID NO: 1891515 - RNA, 19 nt, Shigella flexneri 2a str. 2457T
caucgauaccaucgcuuca

SEQ ID NO: 1891516 - RNA, 19 nt, Shigella flexneri 2a str. 2457T
cauccuuugggcauuugca

SEQ ID NO: 1891517 - RNA, 13 nt, Shigella flexneri 2a str. 2457T
caucgacagcaaa

SEQ ID NO: 1891518 - RNA, 16 nt, Shigella flexneri 2a str. 2457T
caucgaauugcgcauc

SEQ ID NO: 1891519 - RNA, 13 nt, Shigella flexneri 2a str. 2457T
cauccgcugcggu

SEQ ID NO: 1891520 - RNA, 14 nt, Shigella flexneri 2a str. 2457T
caucaccccgcgcu

SEQ ID NO: 1891521 - RNA, 19 nt, Shigella flexneri 2a str. 2457T
caucauaaauaagaugcga

SEQ ID NO: 1891522 - RNA, 16 nt, Shigella flexneri 2a str. 2457T
caucaugcacuccgcu

SEQ ID NO: 1891523 - RNA, 15 nt, Shigella flexneri 2a str. 2457T
caucaucgauaccaa

SEQ ID NO: 1891524 - RNA, 17 nt, Shigella flexneri 2a str. 2457T
cauccagacugcucagc

SEQ ID NO: 1891525 - RNA, 19 nt, Shigella flexneri 2a str. 2457T
cauccagagaucgcguagc

SEQ ID NO: 1891526 - RNA, 14 nt, Shigella flexneri 2a str. 2457T
cauccagcagacgc

SEQ ID NO: 1891527 - RNA, 21 nt, Shigella flexneri 2a str. 2457T
cagcguaccaugauccugcaa

SEQ ID NO: 1891528 - RNA, 13 nt, Shigella flexneri 2a str. 2457T
cagcgucacguca

SEQ ID NO: 1891529 - RNA, 21 nt, Shigella flexneri 2a str. 2457T
cagcguuccggcguccaccug

SEQ ID NO: 1891530 - RNA, 15 nt, Shigella flexneri 2a str. 2457T
cagcgucgcaucugg

SEQ ID NO: 1891531 - RNA, 21 nt, Shigella flexneri 2a str. 2457T
cagcgucgcaucaggcaaugu

SEQ ID NO: 1891532 - RNA, 16 nt, Shigella flexneri 2a str. 2457T
cagcgucgcacccggc

SEQ ID NO: 1891533 - RNA, 16 nt, Shigella flexneri 2a str. 2457T
cagcuaaucaucauca

SEQ ID NO: 1891534 - RNA, 17 nt, Shigella flexneri 2a str. 2457T
cagcucacaaauacgcu

SEQ ID NO: 1891535 - RNA, 18 nt, Shigella flexneri 2a str. 2457T
cagcguuuuguagaccug

SEQ ID NO: 1891536 - RNA, 20 nt, Shigella flexneri 2a str. 2457T
cagcguuucgaacaggccga

SEQ ID NO: 1891537 - RNA, 14 nt, Shigella flexneri 2a str. 2457T
cagcguuuccagcc

SEQ ID NO: 1891538 - RNA, 20 nt, Shigella flexneri 2a str. 2457T
cagcucauccauaaauaccu

SEQ ID NO: 1891539 - RNA, 17 nt, Shigella flexneri 2a str. 2457T
cagcucuugcagcagcu

SEQ ID NO: 1891540 - RNA, 21 nt, Shigella flexneri 2a str. 2457T
cagcucuugcuccacaagcuc

SEQ ID NO: 1891541 - RNA, 23 nt, Shigella flexneri 2a str. 2457T
cagcucucagacgauuacucgcc

SEQ ID NO: 1891542 - RNA, 18 nt, Shigella flexneri 2a str. 2457T
cagcucucagccagcugg

SEQ ID NO: 1891543 - RNA, 20 nt, Shigella flexneri 2a str. 2457T
cagcugacaaucgcugcggc

SEQ ID NO: 1891544 - RNA, 13 nt, Shigella flexneri 2a str. 2457T
cagcucgcugcca

SEQ ID NO: 1891545 - RNA, 20 nt, Shigella flexneri 2a str. 2457T
cagcugcgcuucaauacgcu

SEQ ID NO: 1891546 - RNA, 17 nt, Shigella flexneri 2a str. 2457T
cagcuuauucaccgaua

SEQ ID NO: 1891547 - RNA, 22 nt, Shigella flexneri 2a str. 2457T
cagcuucacaaaggcuugcugc

SEQ ID NO: 1891548 - RNA, 18 nt, Shigella flexneri 2a str. 2457T
cagcuucgguuucaccga

SEQ ID NO: 1891549 - RNA, 16 nt, Shigella flexneri 2a str. 2457T
cagcuucgaggccgga

SEQ ID NO: 1891550 - RNA, 22 nt, Shigella flexneri 2a str. 2457T
cagcuguggucuuuaaugacac

SEQ ID NO: 1891551 - RNA, 23 nt, Shigella flexneri 2a str. 2457T
cagcuugaucaauaacgccauga

SEQ ID NO: 1891552 - RNA, 17 nt, Shigella flexneri 2a str. 2457T
cagcuugcgauccugca

SEQ ID NO: 1891553 - RNA, 22 nt, Shigella flexneri 2a str. 2457T
caggcguucuacauaaaacgcu

SEQ ID NO: 1891554 - RNA, 23 nt, Shigella flexneri 2a str. 2457T
caggcucagaagacgcuccagug

SEQ ID NO: 1891555 - RNA, 15 nt, Shigella flexneri 2a str. 2457T
caggcgaugccaguc

SEQ ID NO: 1891556 - RNA, 22 nt, Shigella flexneri 2a str. 2457T
caggcaucuauagugaggcuau

SEQ ID NO: 1891557 - RNA, 18 nt, Shigella flexneri 2a str. 2457T
caggcaaucagcaaucgc

SEQ ID NO: 1891558 - RNA, 21 nt, Shigella flexneri 2a str. 2457T
caggcaauagggcaacuggag

SEQ ID NO: 1891559 - RNA, 13 nt, Shigella flexneri 2a str. 2457T
caggcaucgugca

SEQ ID NO: 1891560 - RNA, 22 nt, Shigella flexneri 2a str. 2457T
caggcacaaguuuuuaggcaug

SEQ ID NO: 1891561 - RNA, 12 nt, Shigella flexneri 2a str. 2457T
caggccagcagc

SEQ ID NO: 1891562 - RNA, 13 nt, Shigella flexneri 2a str. 2457T
caggccagcagca

SEQ ID NO: 1891563 - RNA, 16 nt, Shigella flexneri 2a str. 2457T
caggccagcagcagag

SEQ ID NO: 1891564 - RNA, 22 nt, Shigella flexneri 2a str. 2457T
aaagcaggcgauuuacuggcag

SEQ ID NO: 1891565 - RNA, 17 nt, Shigella flexneri 2a str. 2457T
aaagcccaucauccgcg

SEQ ID NO: 1891566 - RNA, 15 nt, Shigella flexneri 2a str. 2457T
cagcuuucagcagcg

SEQ ID NO: 1891567 - RNA, 16 nt, Shigella flexneri 2a str. 2457T
caggaaaaucagcauc

SEQ ID NO: 1891568 - RNA, 19 nt, Shigella flexneri 2a str. 2457T
caggaaaagguaggccuga

SEQ ID NO: 1891569 - RNA, 18 nt, Shigella flexneri 2a str. 2457T
caggaauaaucagcaacg

SEQ ID NO: 1891570 - RNA, 19 nt, Shigella flexneri 2a str. 2457T
caggaauaaucagcaacga

SEQ ID NO: 1891571 - RNA, 14 nt, Shigella flexneri 2a str. 2457T
caggagauuaacgg

SEQ ID NO: 1891572 - RNA, 15 nt, Shigella flexneri 2a str. 2457T
cagcgagcggcggau

SEQ ID NO: 1891573 - RNA, 23 nt, Shigella flexneri 2a str. 2457T
cagcgaacaccagcaguaaacca

SEQ ID NO: 1891574 - RNA, 18 nt, Shigella flexneri 2a str. 2457T
cagcgaacaggaccuuga

SEQ ID NO: 1891575 - RNA, 18 nt, Shigella flexneri 2a str. 2457T
cagccuuucaauaccgcc

SEQ ID NO: 1891576 - RNA, 16 nt, Shigella flexneri 2a str. 2457T
cagccugaccgcacac

SEQ ID NO: 1891577 - RNA, 13 nt, Shigella flexneri 2a str. 2457T
cagccucugccgc

SEQ ID NO: 1891578 - RNA, 23 nt, Shigella flexneri 2a str. 2457T
cagccucgcuggucagcgccagu

SEQ ID NO: 1891579 - RNA, 15 nt, Shigella flexneri 2a str. 2457T
cagccugcaaacgcu

SEQ ID NO: 1891580 - RNA, 18 nt, Shigella flexneri 2a str. 2457T
cagccugcaaacgcuggu

SEQ ID NO: 1891581 - RNA, 15 nt, Shigella flexneri 2a str. 2457T
cagccugcacgaccg

SEQ ID NO: 1891582 - RNA, 21 nt, Shigella flexneri 2a str. 2457T
cagccugggucgccaucguua

SEQ ID NO: 1891583 - RNA, 13 nt, Shigella flexneri 2a str. 2457T
cagccuucgccac

SEQ ID NO: 1891584 - RNA, 16 nt, Shigella flexneri 2a str. 2457T
cagccuugcggcaacg

SEQ ID NO: 1891585 - RNA, 14 nt, Shigella flexneri 2a str. 2457T
cagcgcaucaggca

SEQ ID NO: 1891586 - RNA, 19 nt, Shigella flexneri 2a str. 2457T
cagcgcauccauuacauca

SEQ ID NO: 1891587 - RNA, 17 nt, Shigella flexneri 2a str. 2457T
cagcgccacauccggcu

SEQ ID NO: 1891588 - RNA, 17 nt, Shigella flexneri 2a str. 2457T
cagcgagcuggcgcuga

SEQ ID NO: 1891589 - RNA, 23 nt, Shigella flexneri 2a str. 2457T
cagcgauuaccauuucaccguca

SEQ ID NO: 1891590 - RNA, 17 nt, Shigella flexneri 2a str. 2457T
cagcgaugaugagcgau

SEQ ID NO: 1891591 - RNA, 16 nt, Shigella flexneri 2a str. 2457T
cagcgccaccgguuua

SEQ ID NO: 1891592 - RNA, 21 nt, Shigella flexneri 2a str. 2457T
cagcgccgccagaaucaccuc

SEQ ID NO: 1891593 - RNA, 22 nt, Shigella flexneri 2a str. 2457T
cagccgaguagaucaacacauc

SEQ ID NO: 1891594 - RNA, 20 nt, Shigella flexneri 2a str. 2457T
cagccagucggaaccggcga

SEQ ID NO: 1891595 - RNA, 15 nt, Shigella flexneri 2a str. 2457T
cagccaucaccacgc

SEQ ID NO: 1891596 - RNA, 19 nt, Shigella flexneri 2a str. 2457T
cagccaguuuuucagcgcc

SEQ ID NO: 1891597 - RNA, 21 nt, Shigella flexneri 2a str. 2457T
cagccaguuuacccagcgaau

SEQ ID NO: 1891598 - RNA, 13 nt, Shigella flexneri 2a str. 2457T
cagccauugccau

SEQ ID NO: 1891599 - RNA, 16 nt, Shigella flexneri 2a str. 2457T
cagccccaucaacgcc

SEQ ID NO: 1891600 - RNA, 20 nt, Shigella flexneri 2a str. 2457T
cagcacguuuaacacgcucu

SEQ ID NO: 1891601 - RNA, 20 nt, Shigella flexneri 2a str. 2457T
cagcagcaaugcaggcaccu

SEQ ID NO: 1891602 - RNA, 18 nt, Shigella flexneri 2a str. 2457T
cagcagccacaccaauca

SEQ ID NO: 1891603 - RNA, 14 nt, Shigella flexneri 2a str. 2457T
cagcacgucuucca

SEQ ID NO: 1891604 - RNA, 17 nt, Shigella flexneri 2a str. 2457T
cagcaccaucccgcuaa

SEQ ID NO: 1891605 - RNA, 16 nt, Shigella flexneri 2a str. 2457T
cagcaccguaccggca

SEQ ID NO: 1891606 - RNA, 22 nt, Shigella flexneri 2a str. 2457T
cagcacauaagucagcccguga

SEQ ID NO: 1891607 - RNA, 20 nt, Shigella flexneri 2a str. 2457T
cagcacacuguaagccaccg

SEQ ID NO: 1891608 - RNA, 13 nt, Shigella flexneri 2a str. 2457T
cagcacaaugccg

SEQ ID NO: 1891609 - RNA, 15 nt, Shigella flexneri 2a str. 2457T
cagcacaaugccggu

SEQ ID NO: 1891610 - RNA, 10 nt, Shigella flexneri 2a str. 2457T
cagcaaccaa

SEQ ID NO: 1891611 - RNA, 13 nt, Shigella flexneri 2a str. 2457T
cagauagcccgga

SEQ ID NO: 1891612 - RNA, 10 nt, Shigella flexneri 2a str. 2457T
cagcaaccag

SEQ ID NO: 1891613 - RNA, 13 nt, Shigella flexneri 2a str. 2457T
cagcaaccaggua

SEQ ID NO: 1891614 - RNA, 22 nt, Shigella flexneri 2a str. 2457T
cagauacaaaaaaggccgcagg

SEQ ID NO: 1891615 - RNA, 13 nt, Shigella flexneri 2a str. 2457T
cagauagccaggu

SEQ ID NO: 1891616 - RNA, 17 nt, Shigella flexneri 2a str. 2457T
cagccagaaagaaccgu

SEQ ID NO: 1891617 - RNA, 17 nt, Shigella flexneri 2a str. 2457T
cagccagcagcgaauca

SEQ ID NO: 1891618 - RNA, 13 nt, Shigella flexneri 2a str. 2457T
cagccagcgcuga

SEQ ID NO: 1891619 - RNA, 17 nt, Shigella flexneri 2a str. 2457T
cagccacuucuuccagc

SEQ ID NO: 1891620 - RNA, 15 nt, Shigella flexneri 2a str. 2457T
cagccacuccacugg

SEQ ID NO: 1891621 - RNA, 16 nt, Shigella flexneri 2a str. 2457T
cagcaugcacccucaa

SEQ ID NO: 1891622 - RNA, 14 nt, Shigella flexneri 2a str. 2457T
cagccaaugcaacg

SEQ ID NO: 1891623 - RNA, 18 nt, Shigella flexneri 2a str. 2457T
cagcaucguccgccagcc

SEQ ID NO: 1891624 - RNA, 19 nt, Shigella flexneri 2a str. 2457T
cagcaucggcagcgccagc

SEQ ID NO: 1891625 - RNA, 13 nt, Shigella flexneri 2a str. 2457T
cagcagcgcaauu

SEQ ID NO: 1891626 - RNA, 18 nt, Shigella flexneri 2a str. 2457T
cagcagccgguauccagc

SEQ ID NO: 1891627 - RNA, 16 nt, Shigella flexneri 2a str. 2457T
cagcaguauuaacgcc

SEQ ID NO: 1891628 - RNA, 15 nt, Shigella flexneri 2a str. 2457T
cagcauacgucgaua

SEQ ID NO: 1891629 - RNA, 20 nt, Shigella flexneri 2a str. 2457T
cacgggcgcggaaagcaccu

SEQ ID NO: 1891630 - RNA, 14 nt, Shigella flexneri 2a str. 2457T
cacgguauuugcca

SEQ ID NO: 1891631 - RNA, 13 nt, Shigella flexneri 2a str. 2457T
cacgguaaugacu

SEQ ID NO: 1891632 - RNA, 14 nt, Shigella flexneri 2a str. 2457T
cacggugucgguau

SEQ ID NO: 1891633 - RNA, 14 nt, Shigella flexneri 2a str. 2457T
cacguaccaugcgc

SEQ ID NO: 1891634 - RNA, 14 nt, Shigella flexneri 2a str. 2457T
cacguaccacggca

SEQ ID NO: 1891635 - RNA, 22 nt, Shigella flexneri 2a str. 2457T
cacguaacgacugacuuucggc

SEQ ID NO: 1891636 - RNA, 23 nt, Shigella flexneri 2a str. 2457T
cacggcguggcaucaauaccgcg

SEQ ID NO: 1891637 - RNA, 23 nt, Shigella flexneri 2a str. 2457T
aaacuucuugcaauuuuuaccgc

SEQ ID NO: 1891638 - RNA, 18 nt, Shigella flexneri 2a str. 2457T
cacggcgcugacggucug

SEQ ID NO: 1891639 - RNA, 13 nt, Shigella flexneri 2a str. 2457T
aaacugccugaug

SEQ ID NO: 1891640 - RNA, 15 nt, Shigella flexneri 2a str. 2457T
aaacugcccgugaug

SEQ ID NO: 1891641 - RNA, 13 nt, Shigella flexneri 2a str. 2457T
cacggcgauacca

SEQ ID NO: 1891642 - RNA, 21 nt, Shigella flexneri 2a str. 2457T
cacgcggagcgccugucugca

SEQ ID NO: 1891643 - RNA, 23 nt, Shigella flexneri 2a str. 2457T
cacgcggucaauggucagcgcca

SEQ ID NO: 1891644 - RNA, 19 nt, Shigella flexneri 2a str. 2457T
cacgcggcuguugccggau

SEQ ID NO: 1891645 - RNA, 17 nt, Shigella flexneri 2a str. 2457T
cacgcgguuacgcaccg

SEQ ID NO: 1891646 - RNA, 13 nt, Shigella flexneri 2a str. 2457T
cacggcaccagcc

SEQ ID NO: 1891647 - RNA, 13 nt, Shigella flexneri 2a str. 2457T
cacgcuggcguca

SEQ ID NO: 1891648 - RNA, 12 nt, Shigella flexneri 2a str. 2457T
cacgcuugauaa

SEQ ID NO: 1891649 - RNA, 18 nt, Shigella flexneri 2a str. 2457T
cacgcuuugcaggcuggu

SEQ ID NO: 1891650 - RNA, 17 nt, Shigella flexneri 2a str. 2457T
cacgcugucuggcgucu

SEQ ID NO: 1891651 - RNA, 13 nt, Shigella flexneri 2a str. 2457T
cacgcugucggca

SEQ ID NO: 1891652 - RNA, 21 nt, Shigella flexneri 2a str. 2457T
cacugccugucacggcgcaug

SEQ ID NO: 1891653 - RNA, 15 nt, Shigella flexneri 2a str. 2457T
cacugaaugacgacg

SEQ ID NO: 1891654 - RNA, 17 nt, Shigella flexneri 2a str. 2457T
cacucgugcgucgcauc

SEQ ID NO: 1891655 - RNA, 22 nt, Shigella flexneri 2a str. 2457T
cacucgugcgucgcauccggca

SEQ ID NO: 1891656 - RNA, 15 nt, Shigella flexneri 2a str. 2457T
cacucugaaaacgcu

SEQ ID NO: 1891657 - RNA, 21 nt, Shigella flexneri 2a str. 2457T
cacuaacgcauugaacucuuc

SEQ ID NO: 1891658 - RNA, 16 nt, Shigella flexneri 2a str. 2457T
cacguuuucucaaguc

SEQ ID NO: 1891659 - RNA, 15 nt, Shigella flexneri 2a str. 2457T
cacucgcugacugau

SEQ ID NO: 1891660 - RNA, 15 nt, Shigella flexneri 2a str. 2457T
cacguaggccggaua

SEQ ID NO: 1891661 - RNA, 20 nt, Shigella flexneri 2a str. 2457T
cacgucgucaggcaaccgcu

SEQ ID NO: 1891662 - RNA, 14 nt, Shigella flexneri 2a str. 2457T
cagauaauagguaa

SEQ ID NO: 1891663 - RNA, 15 nt, Shigella flexneri 2a str. 2457T
cagagcagcaacaag

SEQ ID NO: 1891664 - RNA, 22 nt, Shigella flexneri 2a str. 2457T
cagagaaagcaaaaauaaaugc

SEQ ID NO: 1891665 - RNA, 11 nt, Shigella flexneri 2a str. 2457T
cagacuuugcg

SEQ ID NO: 1891666 - RNA, 15 nt, Shigella flexneri 2a str. 2457T
cagagaagaacaccg

SEQ ID NO: 1891667 - RNA, 14 nt, Shigella flexneri 2a str. 2457T
cagagaagcaccgc

SEQ ID NO: 1891668 - RNA, 20 nt, Shigella flexneri 2a str. 2457T
cagacgggcaacuucaacgc

SEQ ID NO: 1891669 - RNA, 15 nt, Shigella flexneri 2a str. 2457T
cagacugaauacgcu

SEQ ID NO: 1891670 - RNA, 22 nt, Shigella flexneri 2a str. 2457T
cagacugaugugauccaucagg

SEQ ID NO: 1891671 - RNA, 16 nt, Shigella flexneri 2a str. 2457T
cagacuggauugccag

SEQ ID NO: 1891672 - RNA, 17 nt, Shigella flexneri 2a str. 2457T
cagaccgcucagcuccu

SEQ ID NO: 1891673 - RNA, 21 nt, Shigella flexneri 2a str. 2457T
cagaccggcaaucgcgccaga

SEQ ID NO: 1891674 - RNA, 15 nt, Shigella flexneri 2a str. 2457T
cagacgcucgccauu

SEQ ID NO: 1891675 - RNA, 20 nt, Shigella flexneri 2a str. 2457T
cagacggaacaucugcccca

SEQ ID NO: 1891676 - RNA, 17 nt, Shigella flexneri 2a str. 2457T
cagacccagacgcucag

SEQ ID NO: 1891677 - RNA, 17 nt, Shigella flexneri 2a str. 2457T
cagaccgacuuucaggu

SEQ ID NO: 1891678 - RNA, 20 nt, Shigella flexneri 2a str. 2457T
cagaccgacuacccgcgcac

SEQ ID NO: 1891679 - RNA, 21 nt, Shigella flexneri 2a str. 2457T
cagaccgacauuaaugccucg

SEQ ID NO: 1891680 - RNA, 19 nt, Shigella flexneri 2a str. 2457T
cagaccagcuaccacgccg

SEQ ID NO: 1891681 - RNA, 15 nt, Shigella flexneri 2a str. 2457T
cagaauaacggcuga

SEQ ID NO: 1891682 - RNA, 20 nt, Shigella flexneri 2a str. 2457T
cagaauagaaaguugccaga

SEQ ID NO: 1891683 - RNA, 21 nt, Shigella flexneri 2a str. 2457T
cagaagcgcagaucgaacacg

SEQ ID NO: 1891684 - RNA, 17 nt, Shigella flexneri 2a str. 2457T
cagaccaaucccgccau

SEQ ID NO: 1891685 - RNA, 16 nt, Shigella flexneri 2a str. 2457T
cagaccaauggcgagg

SEQ ID NO: 1891686 - RNA, 17 nt, Shigella flexneri 2a str. 2457T
cagaccaauccagccgg

SEQ ID NO: 1891687 - RNA, 19 nt, Shigella flexneri 2a str. 2457T
cagaaucaaucccaucagg

SEQ ID NO: 1891688 - RNA, 23 nt, Shigella flexneri 2a str. 2457T
cacuuaauaagaagaaaccgcua

SEQ ID NO: 1891689 - RNA, 16 nt, Shigella flexneri 2a str. 2457T
cacuuacagcaacgcc

SEQ ID NO: 1891690 - RNA, 16 nt, Shigella flexneri 2a str. 2457T
cagaaauaaaaccggu

SEQ ID NO: 1891691 - RNA, 23 nt, Shigella flexneri 2a str. 2457T
cagaaacaguguauuuccugauu

SEQ ID NO: 1891692 - RNA, 19 nt, Shigella flexneri 2a str. 2457T
cacugguuccgguuuaucc

SEQ ID NO: 1891693 - RNA, 19 nt, Shigella flexneri 2a str. 2457T
cacuguucacuuuugcugc

SEQ ID NO: 1891694 - RNA, 20 nt, Shigella flexneri 2a str. 2457T
cacuguucauuaaagccgcc

SEQ ID NO: 1891695 - RNA, 17 nt, Shigella flexneri 2a str. 2457T
ccgaugauucccaguca

SEQ ID NO: 1891696 - RNA, 22 nt, Shigella flexneri 2a str. 2457T
ccgaugccagcacagaucgcac

SEQ ID NO: 1891697 - RNA, 20 nt, Shigella flexneri 2a str. 2457T
ccgaugaguuaagaagaucg

SEQ ID NO: 1891698 - RNA, 18 nt, Shigella flexneri 2a str. 2457T
ccgaugcgcaaacuuauc

SEQ ID NO: 1891699 - RNA, 22 nt, Shigella flexneri 2a str. 2457T
ccgauggcuugcgucauccagc

SEQ ID NO: 1891700 - RNA, 20 nt, Shigella flexneri 2a str. 2457T
ccgauuaaucuuccagauca

SEQ ID NO: 1891701 - RNA, 21 nt, Shigella flexneri 2a str. 2457T
ccgauacggacaguauaacga

SEQ ID NO: 1891702 - RNA, 21 nt, Shigella flexneri 2a str. 2457T
ccgauauguucagaaagcgcc

SEQ ID NO: 1891703 - RNA, 13 nt, Shigella flexneri 2a str. 2457T
ccgaucaaggcau

SEQ ID NO: 1891704 - RNA, 18 nt, Shigella flexneri 2a str. 2457T
ccgauccuagaucgggca

SEQ ID NO: 1891705 - RNA, 19 nt, Shigella flexneri 2a str. 2457T
ccgauaaaggucgacagca

SEQ ID NO: 1891706 - RNA, 18 nt, Shigella flexneri 2a str. 2457T
ccgaggauacagccgaag

SEQ ID NO: 1891707 - RNA, 15 nt, Shigella flexneri 2a str. 2457T
ccgagguagaacccu

SEQ ID NO: 1891708 - RNA, 21 nt, Shigella flexneri 2a str. 2457T
ccgaacaaaacagcgaguuca

SEQ ID NO: 1891709 - RNA, 23 nt, Shigella flexneri 2a str. 2457T
ccgagcggucggagguucgaauc

SEQ ID NO: 1891710 - RNA, 19 nt, Shigella flexneri 2a str. 2457T
ccgagcgccccagaccuga

SEQ ID NO: 1891711 - RNA, 22 nt, Shigella flexneri 2a str. 2457T
ccgcagauauucccguggcgag

SEQ ID NO: 1891712 - RNA, 22 nt, Shigella flexneri 2a str. 2457T
ccgcagcacggcgacgcauacg

SEQ ID NO: 1891713 - RNA, 17 nt, Shigella flexneri 2a str. 2457T
ccgcacggccgcaagca

SEQ ID NO: 1891714 - RNA, 16 nt, Shigella flexneri 2a str. 2457T
ccgcaccugccagcgc

SEQ ID NO: 1891715 - RNA, 15 nt, Shigella flexneri 2a str. 2457T
ccgcaaucgccagua

SEQ ID NO: 1891716 - RNA, 20 nt, Shigella flexneri 2a str. 2457T
ccgcaauggccguuccggca

SEQ ID NO: 1891717 - RNA, 14 nt, Shigella flexneri 2a str. 2457T
ccgcaauuccggug

SEQ ID NO: 1891718 - RNA, 15 nt, Shigella flexneri 2a str. 2457T
ccgcaagcagacgcu

SEQ ID NO: 1891719 - RNA, 17 nt, Shigella flexneri 2a str. 2457T
ccgcaaggaagccugac

SEQ ID NO: 1891720 - RNA, 12 nt, Shigella flexneri 2a str. 2457T
ccgcaccagcgg

SEQ ID NO: 1891721 - RNA, 14 nt, Shigella flexneri 2a str. 2457T
ccgcaaaccuggca

SEQ ID NO: 1891722 - RNA, 15 nt, Shigella flexneri 2a str. 2457T
ccgcaaaaccaacgc

SEQ ID NO: 1891723 - RNA, 13 nt, Shigella flexneri 2a str. 2457T
ccgcaaauaacgu

SEQ ID NO: 1891724 - RNA, 14 nt, Shigella flexneri 2a str. 2457T
ccgcaaagcccauc

SEQ ID NO: 1891725 - RNA, 20 nt, Shigella flexneri 2a str. 2457T
ccgcaaaugauuagugccag

SEQ ID NO: 1891726 - RNA, 21 nt, Shigella flexneri 2a str. 2457T
ccgcaacagcaauacguuuca

SEQ ID NO: 1891727 - RNA, 17 nt, Shigella flexneri 2a str. 2457T
ccgccaucucuuccagc

SEQ ID NO: 1891728 - RNA, 12 nt, Shigella flexneri 2a str. 2457T
ccgccagccgca

SEQ ID NO: 1891729 - RNA, 19 nt, Shigella flexneri 2a str. 2457T
ccgccaauucguaaguaca

SEQ ID NO: 1891730 - RNA, 16 nt, Shigella flexneri 2a str. 2457T
ccgccaccaccagacg

SEQ ID NO: 1891731 - RNA, 22 nt, Shigella flexneri 2a str. 2457T
ccgcauuuuuucuucaguuccg

SEQ ID NO: 1891732 - RNA, 18 nt, Shigella flexneri 2a str. 2457T
ccgcauggaaccaguuca

SEQ ID NO: 1891733 - RNA, 16 nt, Shigella flexneri 2a str. 2457T
ccgccgcuucaucggu

SEQ ID NO: 1891734 - RNA, 21 nt, Shigella flexneri 2a str. 2457T
ccgcccgauaaaacgguuuau

SEQ ID NO: 1891735 - RNA, 19 nt, Shigella flexneri 2a str. 2457T
aaaugacgaugacugguag

SEQ ID NO: 1891736 - RNA, 18 nt, Shigella flexneri 2a str. 2457T
aaaugauguagaccugau

SEQ ID NO: 1891737 - RNA, 18 nt, Shigella flexneri 2a str. 2457T
aaaugguaaagaaggcau

SEQ ID NO: 1891738 - RNA, 12 nt, Shigella flexneri 2a str. 2457T
aaauggccgaua

SEQ ID NO: 1891739 - RNA, 12 nt, Shigella flexneri 2a str. 2457T
aaauggcgcuuu

SEQ ID NO: 1891740 - RNA, 22 nt, Shigella flexneri 2a str. 2457T
aaauggcaaugacuagcgccau

SEQ ID NO: 1891741 - RNA, 19 nt, Shigella flexneri 2a str. 2457T
ccgccgugcugccagcgau

SEQ ID NO: 1891742 - RNA, 12 nt, Shigella flexneri 2a str. 2457T
ccgcgacuggga

SEQ ID NO: 1891743 - RNA, 14 nt, Shigella flexneri 2a str. 2457T
ccgcggaucacgcg

SEQ ID NO: 1891744 - RNA, 16 nt, Shigella flexneri 2a str. 2457T
aaauuaacgucaccau

SEQ ID NO: 1891745 - RNA, 13 nt, Shigella flexneri 2a str. 2457T
ccgcgugcgcggc

SEQ ID NO: 1891746 - RNA, 14 nt, Shigella flexneri 2a str. 2457T
ccgcgugcgcggca

SEQ ID NO: 1891747 - RNA, 22 nt, Shigella flexneri 2a str. 2457T
ccgcucaccugauacgcgccaa

SEQ ID NO: 1891748 - RNA, 16 nt, Shigella flexneri 2a str. 2457T
ccgcuucaucgugcuc

SEQ ID NO: 1891749 - RNA, 22 nt, Shigella flexneri 2a str. 2457T
ccgcuucaucgguuaaccggca

SEQ ID NO: 1891750 - RNA, 14 nt, Shigella flexneri 2a str. 2457T
ccgcucucaaucuc

SEQ ID NO: 1891751 - RNA, 20 nt, Shigella flexneri 2a str. 2457T
ccgcucuuucaccgccgaga

SEQ ID NO: 1891752 - RNA, 18 nt, Shigella flexneri 2a str. 2457T
ccggcgucgcauccggca

SEQ ID NO: 1891753 - RNA, 17 nt, Shigella flexneri 2a str. 2457T
ccggcgucgcuucucaa

SEQ ID NO: 1891754 - RNA, 23 nt, Shigella flexneri 2a str. 2457T
ccggcguaugcccagggcaaugu

SEQ ID NO: 1891755 - RNA, 22 nt, Shigella flexneri 2a str. 2457T
aaauucucagugguugucgcag

SEQ ID NO: 1891756 - RNA, 19 nt, Shigella flexneri 2a str. 2457T
aaauugcuguuacgccaga

SEQ ID NO: 1891757 - RNA, 20 nt, Shigella flexneri 2a str. 2457T
aaauugcuguuacgccagaa

SEQ ID NO: 1891758 - RNA, 19 nt, Shigella flexneri 2a str. 2457T
aaauucuggguaaugacuc

SEQ ID NO: 1891759 - RNA, 16 nt, Shigella flexneri 2a str. 2457T
ccgggcaucagcagca

SEQ ID NO: 1891760 - RNA, 14 nt, Shigella flexneri 2a str. 2457T
ccgggaucacauca

SEQ ID NO: 1891761 - RNA, 13 nt, Shigella flexneri 2a str. 2457T
ccgggcuuuccgc

SEQ ID NO: 1891762 - RNA, 19 nt, Shigella flexneri 2a str. 2457T
ccgggcuuccggcaauggc

SEQ ID NO: 1891763 - RNA, 22 nt, Shigella flexneri 2a str. 2457T
ccgggcuguucacugugcuggu

SEQ ID NO: 1891764 - RNA, 21 nt, Shigella flexneri 2a str. 2457T
ccgcuuuuuucagcgccagcu

SEQ ID NO: 1891765 - RNA, 22 nt, Shigella flexneri 2a str. 2457T
ccgcuuuguguaaguuuaaccu

SEQ ID NO: 1891766 - RNA, 12 nt, Shigella flexneri 2a str. 2457T
ccggccagcauc

SEQ ID NO: 1891767 - RNA, 23 nt, Shigella flexneri 2a str. 2457T
ccggccaguaagcaguccagcgc

SEQ ID NO: 1891768 - RNA, 15 nt, Shigella flexneri 2a str. 2457T
ccggccaucgccuga

SEQ ID NO: 1891769 - RNA, 17 nt, Shigella flexneri 2a str. 2457T
ccggccuaucaacgucg

SEQ ID NO: 1891770 - RNA, 15 nt, Shigella flexneri 2a str. 2457T
ccggcgcauccauga

SEQ ID NO: 1891771 - RNA, 22 nt, Shigella flexneri 2a str. 2457T
ccggugguuaacgaaucaaucg

SEQ ID NO: 1891772 - RNA, 22 nt, Shigella flexneri 2a str. 2457T
ccggugccaaagucaucaaucg

SEQ ID NO: 1891773 - RNA, 14 nt, Shigella flexneri 2a str. 2457T
ccggugcaucaaca

SEQ ID NO: 1891774 - RNA, 14 nt, Shigella flexneri 2a str. 2457T
ccgguucaucacga

SEQ ID NO: 1891775 - RNA, 22 nt, Shigella flexneri 2a str. 2457T
ccguaaaucccagugccugcau

SEQ ID NO: 1891776 - RNA, 14 nt, Shigella flexneri 2a str. 2457T
ccguaagcgcggag

SEQ ID NO: 1891777 - RNA, 12 nt, Shigella flexneri 2a str. 2457T
ccgguuucgcca

SEQ ID NO: 1891778 - RNA, 17 nt, Shigella flexneri 2a str. 2457T
ccgguuuggcauaacca

SEQ ID NO: 1891779 - RNA, 17 nt, Shigella flexneri 2a str. 2457T
ccggugaaucgcaauuu

SEQ ID NO: 1891780 - RNA, 19 nt, Shigella flexneri 2a str. 2457T
ccggucuaccgauccggca

SEQ ID NO: 1891781 - RNA, 15 nt, Shigella flexneri 2a str. 2457T
ccggucgcgcgggaa

SEQ ID NO: 1891782 - RNA, 17 nt, Shigella flexneri 2a str. 2457T
ccgugaacaauuucagc

SEQ ID NO: 1891783 - RNA, 13 nt, Shigella flexneri 2a str. 2457T
ccgugaauaugga

SEQ ID NO: 1891784 - RNA, 17 nt, Shigella flexneri 2a str. 2457T
ccgugacugggugccgc

SEQ ID NO: 1891785 - RNA, 16 nt, Shigella flexneri 2a str. 2457T
ccgugccccauauggc

SEQ ID NO: 1891786 - RNA, 17 nt, Shigella flexneri 2a str. 2457T
ccguacguuacguacuu

SEQ ID NO: 1891787 - RNA, 16 nt, Shigella flexneri 2a str. 2457T
ccguacgcaucaccag

SEQ ID NO: 1891788 - RNA, 23 nt, Shigella flexneri 2a str. 2457T
ccguccguuauaucgcgcugacg

SEQ ID NO: 1891789 - RNA, 23 nt, Shigella flexneri 2a str. 2457T
ccguccuucaucuucauccggcu

SEQ ID NO: 1891790 - RNA, 16 nt, Shigella flexneri 2a str. 2457T
ccuaugcauaauccug

SEQ ID NO: 1891791 - RNA, 20 nt, Shigella flexneri 2a str. 2457T
ccuauguggaaacagugauu

SEQ ID NO: 1891792 - RNA, 14 nt, Shigella flexneri 2a str. 2457T
ccguugccgcagcg

SEQ ID NO: 1891793 - RNA, 19 nt, Shigella flexneri 2a str. 2457T
ccguugcaauacuuccgcu

SEQ ID NO: 1891794 - RNA, 15 nt, Shigella flexneri 2a str. 2457T
ccguuaauuuccgcg

SEQ ID NO: 1891795 - RNA, 20 nt, Shigella flexneri 2a str. 2457T
ccuagaaggaacaacguauc

SEQ ID NO: 1891796 - RNA, 15 nt, Shigella flexneri 2a str. 2457T
ccuaccggaaucgcg

SEQ ID NO: 1891797 - RNA, 18 nt, Shigella flexneri 2a str. 2457T
ccuaccggcuggcgcaua

SEQ ID NO: 1891798 - RNA, 18 nt, Shigella flexneri 2a str. 2457T
ccuaagccauuuaacuca

SEQ ID NO: 1891799 - RNA, 14 nt, Shigella flexneri 2a str. 2457T
ccuaacccaacauu

SEQ ID NO: 1891800 - RNA, 12 nt, Shigella flexneri 2a str. 2457T
ccuaaaucgcua

SEQ ID NO: 1891801 - RNA, 17 nt, Shigella flexneri 2a str. 2457T
ccuaaaagcacgccaga

SEQ ID NO: 1891802 - RNA, 22 nt, Shigella flexneri 2a str. 2457T
ccuaauuccgcgcgaacgguaa

SEQ ID NO: 1891803 - RNA, 17 nt, Shigella flexneri 2a str. 2457T
ccuacaggaaacgauuc

SEQ ID NO: 1891804 - RNA, 21 nt, Shigella flexneri 2a str. 2457T
ccguugcuugaugcacuggga

SEQ ID NO: 1891805 - RNA, 12 nt, Shigella flexneri 2a str. 2457T
ccguuuuccagc

SEQ ID NO: 1891806 - RNA, 22 nt, Shigella flexneri 2a str. 2457T
ccguuuuuacccagcagcagcg

SEQ ID NO: 1891807 - RNA, 21 nt, Shigella flexneri 2a str. 2457T
ccguuucgcagucgccagcaa

SEQ ID NO: 1891808 - RNA, 14 nt, Shigella flexneri 2a str. 2457T
cgcagugacauuca

SEQ ID NO: 1891809 - RNA, 16 nt, Shigella flexneri 2a str. 2457T
cgcagugagaagccac

SEQ ID NO: 1891810 - RNA, 16 nt, Shigella flexneri 2a str. 2457T
cgcagugauugccgca

SEQ ID NO: 1891811 - RNA, 20 nt, Shigella flexneri 2a str. 2457T
cgcaguugcaacucgacugg

SEQ ID NO: 1891812 - RNA, 15 nt, Shigella flexneri 2a str. 2457T
cgcagucgccagcaa

SEQ ID NO: 1891813 - RNA, 22 nt, Shigella flexneri 2a str. 2457T
cgcaguaccacuucauccggau

SEQ ID NO: 1891814 - RNA, 23 nt, Shigella flexneri 2a str. 2457T
cgcauaacugccggaugcggcgu

SEQ ID NO: 1891815 - RNA, 18 nt, Shigella flexneri 2a str. 2457T
cgcaucaggcaucgugca

SEQ ID NO: 1891816 - RNA, 18 nt, Shigella flexneri 2a str. 2457T
cgcaucaggcaucugcgc

SEQ ID NO: 1891817 - RNA, 21 nt, Shigella flexneri 2a str. 2457T
cgcaucaggcaaugggcaaac

SEQ ID NO: 1891818 - RNA, 16 nt, Shigella flexneri 2a str. 2457T
cgcaggauaucguggc

SEQ ID NO: 1891819 - RNA, 15 nt, Shigella flexneri 2a str. 2457T
cgcaggauaucgugg

SEQ ID NO: 1891820 - RNA, 14 nt, Shigella flexneri 2a str. 2457T
cgcagccaucagcg

SEQ ID NO: 1891821 - RNA, 16 nt, Shigella flexneri 2a str. 2457T
cgcagggaguuaccgu

SEQ ID NO: 1891822 - RNA, 21 nt, Shigella flexneri 2a str. 2457T
cgcaggucgucuuuuacagcg

SEQ ID NO: 1891823 - RNA, 13 nt, Shigella flexneri 2a str. 2457T
cgcaucgggcgau

SEQ ID NO: 1891824 - RNA, 20 nt, Shigella flexneri 2a str. 2457T
cgcaucggugauaacuguau

SEQ ID NO: 1891825 - RNA, 16 nt, Shigella flexneri 2a str. 2457T
cgcaugaauuacgcaa

SEQ ID NO: 1891826 - RNA, 13 nt, Shigella flexneri 2a str. 2457T
cgcaugacaugcg

SEQ ID NO: 1891827 - RNA, 15 nt, Shigella flexneri 2a str. 2457T
cgcaucuucgcccac

SEQ ID NO: 1891828 - RNA, 20 nt, Shigella flexneri 2a str. 2457T
cgcaucgaauugcgcauccg

SEQ ID NO: 1891829 - RNA, 21 nt, Shigella flexneri 2a str. 2457T
cgcauccgggauggucagcgg

SEQ ID NO: 1891830 - RNA, 16 nt, Shigella flexneri 2a str. 2457T
cgcauccggcaguaau

SEQ ID NO: 1891831 - RNA, 13 nt, Shigella flexneri 2a str. 2457T
cgcauccggcaau

SEQ ID NO: 1891832 - RNA, 22 nt, Shigella flexneri 2a str. 2457T
cgcauccggcaauaagcaacgc

SEQ ID NO: 1891833 - RNA, 23 nt, Shigella flexneri 2a str. 2457T
cgcauccgaucgcgcaucagcag

SEQ ID NO: 1891834 - RNA, 16 nt, Shigella flexneri 2a str. 2457T
cgcauccgacaucaac

SEQ ID NO: 1891835 - RNA, 17 nt, Shigella flexneri 2a str. 2457T
cgcauccgacaucaacc

SEQ ID NO: 1891836 - RNA, 13 nt, Shigella flexneri 2a str. 2457T
cgccacagcagcc

SEQ ID NO: 1891837 - RNA, 21 nt, Shigella flexneri 2a str. 2457T
cgccacagccgagcgccacca

SEQ ID NO: 1891838 - RNA, 16 nt, Shigella flexneri 2a str. 2457T
cgccaccacaacauuc

SEQ ID NO: 1891839 - RNA, 19 nt, Shigella flexneri 2a str. 2457T
cgccaacaaucucuuccag

SEQ ID NO: 1891840 - RNA, 14 nt, Shigella flexneri 2a str. 2457T
cgccaaccagcuga

SEQ ID NO: 1891841 - RNA, 17 nt, Shigella flexneri 2a str. 2457T
cgcacaguaaugcgcca

SEQ ID NO: 1891842 - RNA, 16 nt, Shigella flexneri 2a str. 2457T
cgcacauuucaaucau

SEQ ID NO: 1891843 - RNA, 20 nt, Shigella flexneri 2a str. 2457T
cgcacaaugcuguaaccagc

SEQ ID NO: 1891844 - RNA, 19 nt, Shigella flexneri 2a str. 2457T
cgcaauuccagcaagccac

SEQ ID NO: 1891845 - RNA, 12 nt, Shigella flexneri 2a str. 2457T
cgcaauccggaa

SEQ ID NO: 1891846 - RNA, 21 nt, Shigella flexneri 2a str. 2457T
cgauuucaaccacucacgaua

SEQ ID NO: 1891847 - RNA, 16 nt, Shigella flexneri 2a str. 2457T
cgauuucaucgcccag

SEQ ID NO: 1891848 - RNA, 18 nt, Shigella flexneri 2a str. 2457T
cgauuuccaucuccagcu

SEQ ID NO: 1891849 - RNA, 19 nt, Shigella flexneri 2a str. 2457T
cgauggcccgcuugccaga

SEQ ID NO: 1891850 - RNA, 22 nt, Shigella flexneri 2a str. 2457T
cgaugcugauguacccgcugca

SEQ ID NO: 1891851 - RNA, 19 nt, Shigella flexneri 2a str. 2457T
cgcaagcagacgcucguua

SEQ ID NO: 1891852 - RNA, 16 nt, Shigella flexneri 2a str. 2457T
cgcaacguaucaucgc

SEQ ID NO: 1891853 - RNA, 15 nt, Shigella flexneri 2a str. 2457T
cgcaacguaucuggu

SEQ ID NO: 1891854 - RNA, 15 nt, Shigella flexneri 2a str. 2457T
cgcaacggugcggcu

SEQ ID NO: 1891855 - RNA, 15 nt, Shigella flexneri 2a str. 2457T
cgcaacgguugcgga

SEQ ID NO: 1891856 - RNA, 13 nt, Shigella flexneri 2a str. 2457T
cgcaccagcuugc

SEQ ID NO: 1891857 - RNA, 20 nt, Shigella flexneri 2a str. 2457T
cgcaccgggcuuccggcaau

SEQ ID NO: 1891858 - RNA, 18 nt, Shigella flexneri 2a str. 2457T
cgcaccgggcuuccggca

SEQ ID NO: 1891859 - RNA, 16 nt, Shigella flexneri 2a str. 2457T
cgcaccugccagcgcc

SEQ ID NO: 1891860 - RNA, 17 nt, Shigella flexneri 2a str. 2457T
cgcacuauacaaccaga

SEQ ID NO: 1891861 - RNA, 14 nt, Shigella flexneri 2a str. 2457T
cgcacucgcccuga

SEQ ID NO: 1891862 - RNA, 21 nt, Shigella flexneri 2a str. 2457T
cgcagaugaagcuggcaaagu

SEQ ID NO: 1891863 - RNA, 18 nt, Shigella flexneri 2a str. 2457T
cgcagaugaagcuggcaa

SEQ ID NO: 1891864 - RNA, 15 nt, Shigella flexneri 2a str. 2457T
cgcagccagcacugc

SEQ ID NO: 1891865 - RNA, 16 nt, Shigella flexneri 2a str. 2457T
cgcagcaguugccagu

SEQ ID NO: 1891866 - RNA, 16 nt, Shigella flexneri 2a str. 2457T
cgagcuuuccggcggu

SEQ ID NO: 1891867 - RNA, 23 nt, Shigella flexneri 2a str. 2457T
cgagcuuuccggcggucagcgcc

SEQ ID NO: 1891868 - RNA, 17 nt, Shigella flexneri 2a str. 2457T
cgagggcgauauccuga

SEQ ID NO: 1891869 - RNA, 15 nt, Shigella flexneri 2a str. 2457T
cgaggcgcuggcaga

SEQ ID NO: 1891870 - RNA, 18 nt, Shigella flexneri 2a str. 2457T
cgaucagcggacgcugcu

SEQ ID NO: 1891871 - RNA, 14 nt, Shigella flexneri 2a str. 2457T
cgauaaccacgcuc

SEQ ID NO: 1891872 - RNA, 19 nt, Shigella flexneri 2a str. 2457T
cgagucgcguuaaggcguc

SEQ ID NO: 1891873 - RNA, 18 nt, Shigella flexneri 2a str. 2457T
cgauaaucagcgccagcg

SEQ ID NO: 1891874 - RNA, 16 nt, Shigella flexneri 2a str. 2457T
cgauacuuauaagcuc

SEQ ID NO: 1891875 - RNA, 15 nt, Shigella flexneri 2a str. 2457T
cgauagagcaaccac

SEQ ID NO: 1891876 - RNA, 18 nt, Shigella flexneri 2a str. 2457T
cgauaggcuuccgccauc

SEQ ID NO: 1891877 - RNA, 13 nt, Shigella flexneri 2a str. 2457T
cgauagcaacgag

SEQ ID NO: 1891878 - RNA, 15 nt, Shigella flexneri 2a str. 2457T
cgauccuguucaaac

SEQ ID NO: 1891879 - RNA, 16 nt, Shigella flexneri 2a str. 2457T
cgauccagugauucca

SEQ ID NO: 1891880 - RNA, 18 nt, Shigella flexneri 2a str. 2457T
cgaucauuaacaccacgc

SEQ ID NO: 1891881 - RNA, 14 nt, Shigella flexneri 2a str. 2457T
cgaucgagugcaau

SEQ ID NO: 1891882 - RNA, 16 nt, Shigella flexneri 2a str. 2457T
cgaugacaucgcagca

SEQ ID NO: 1891883 - RNA, 16 nt, Shigella flexneri 2a str. 2457T
cgaugagacccgccac

SEQ ID NO: 1891884 - RNA, 20 nt, Shigella flexneri 2a str. 2457T
cgaugaugcagccagugauu

SEQ ID NO: 1891885 - RNA, 16 nt, Shigella flexneri 2a str. 2457T
cgaugccaucauggcg

SEQ ID NO: 1891886 - RNA, 13 nt, Shigella flexneri 2a str. 2457T
cgaugccuggcaa

SEQ ID NO: 1891887 - RNA, 22 nt, Shigella flexneri 2a str. 2457T
cgaaauacagguccccgcuucg

SEQ ID NO: 1891888 - RNA, 21 nt, Shigella flexneri 2a str. 2457T
cgaaaguuaauccacagcaau

SEQ ID NO: 1891889 - RNA, 19 nt, Shigella flexneri 2a str. 2457T
cgaaaugacaguaucguga

SEQ ID NO: 1891890 - RNA, 14 nt, Shigella flexneri 2a str. 2457T
cgaagcccacgccg

SEQ ID NO: 1891891 - RNA, 20 nt, Shigella flexneri 2a str. 2457T
cgaagaacauaaacagcgua

SEQ ID NO: 1891892 - RNA, 18 nt, Shigella flexneri 2a str. 2457T
cgaaucacguugccguau

SEQ ID NO: 1891893 - RNA, 20 nt, Shigella flexneri 2a str. 2457T
cgaaugacguuuacuucgcu

SEQ ID NO: 1891894 - RNA, 17 nt, Shigella flexneri 2a str. 2457T
cgaaugacaugcccggu

SEQ ID NO: 1891895 - RNA, 18 nt, Shigella flexneri 2a str. 2457T
cgaaucaaccgcgccuga

SEQ ID NO: 1891896 - RNA, 17 nt, Shigella flexneri 2a str. 2457T
cgaauaccguaacgacu

SEQ ID NO: 1891897 - RNA, 19 nt, Shigella flexneri 2a str. 2457T
cgaagccugcgaugucuga

SEQ ID NO: 1891898 - RNA, 23 nt, Shigella flexneri 2a str. 2457T
cgaagcucucugcuauuccguua

SEQ ID NO: 1891899 - RNA, 15 nt, Shigella flexneri 2a str. 2457T
cgaaguacgcggcaa

SEQ ID NO: 1891900 - RNA, 14 nt, Shigella flexneri 2a str. 2457T
cgaaguacgcggca

SEQ ID NO: 1891901 - RNA, 21 nt, Shigella flexneri 2a str. 2457T
ccuugcgauuacgcucggcaa

SEQ ID NO: 1891902 - RNA, 23 nt, Shigella flexneri 2a str. 2457T
ccuugcggaaauuccagcggcag

SEQ ID NO: 1891903 - RNA, 20 nt, Shigella flexneri 2a str. 2457T
ccuugugcacuggcgcgaau

SEQ ID NO: 1891904 - RNA, 16 nt, Shigella flexneri 2a str. 2457T
ccuuuuaccagcgccu

SEQ ID NO: 1891905 - RNA, 22 nt, Shigella flexneri 2a str. 2457T
ccuuuguaggccagauaagacg

SEQ ID NO: 1891906 - RNA, 17 nt, Shigella flexneri 2a str. 2457T
ccuuuguaggccagaua

SEQ ID NO: 1891907 - RNA, 18 nt, Shigella flexneri 2a str. 2457T
ccuuuggcgagccagauc

SEQ ID NO: 1891908 - RNA, 18 nt, Shigella flexneri 2a str. 2457T
ccuuugccuuccagcgau

SEQ ID NO: 1891909 - RNA, 17 nt, Shigella flexneri 2a str. 2457T
ccuuuuuuacagguguu

SEQ ID NO: 1891910 - RNA, 14 nt, Shigella flexneri 2a str. 2457T
cgaaaaaugaauac

SEQ ID NO: 1891911 - RNA, 15 nt, Shigella flexneri 2a str. 2457T
cgaaaaugcgcauga

SEQ ID NO: 1891912 - RNA, 23 nt, Shigella flexneri 2a str. 2457T
cgaaaaugcccgccgugcugcca

SEQ ID NO: 1891913 - RNA, 16 nt, Shigella flexneri 2a str. 2457T
cgaaagcgccaucaau

SEQ ID NO: 1891914 - RNA, 19 nt, Shigella flexneri 2a str. 2457T
cgaaacgaaagucccgaua

SEQ ID NO: 1891915 - RNA, 12 nt, Shigella flexneri 2a str. 2457T
ccuucgcggcac

SEQ ID NO: 1891916 - RNA, 17 nt, Shigella flexneri 2a str. 2457T
ccuucgcccugcgucgc

SEQ ID NO: 1891917 - RNA, 21 nt, Shigella flexneri 2a str. 2457T
ccuucagguuuuucagcugcc

SEQ ID NO: 1891918 - RNA, 14 nt, Shigella flexneri 2a str. 2457T
ccuuccagcuccag

SEQ ID NO: 1891919 - RNA, 20 nt, Shigella flexneri 2a str. 2457T
ccuuccgcaauacagccagc

SEQ ID NO: 1891920 - RNA, 20 nt, Shigella flexneri 2a str. 2457T
ccuucaucccuuucgcuuca

SEQ ID NO: 1891921 - RNA, 23 nt, Shigella flexneri 2a str. 2457T
ccuucguuauccucugcaagaua

SEQ ID NO: 1891922 - RNA, 19 nt, Shigella flexneri 2a str. 2457T
ccuucggggcuaaugccag

SEQ ID NO: 1891923 - RNA, 22 nt, Shigella flexneri 2a str. 2457T
ccuuacgcagcgguauaaucug

SEQ ID NO: 1891924 - RNA, 17 nt, Shigella flexneri 2a str. 2457T
ccuuaguaacgccagcg

SEQ ID NO: 1891925 - RNA, 18 nt, Shigella flexneri 2a str. 2457T
ccuuacugcccccggcgu

SEQ ID NO: 1891926 - RNA, 12 nt, Shigella flexneri 2a str. 2457T
ccuuauccggcc

SEQ ID NO: 1891927 - RNA, 17 nt, Shigella flexneri 2a str. 2457T
ccuuaacuggcgcgacg

SEQ ID NO: 1891928 - RNA, 17 nt, Shigella flexneri 2a str. 2457T
ccuguuuagccgcuucu

SEQ ID NO: 1891929 - RNA, 16 nt, Shigella flexneri 2a str. 2457T
ccuguugaugccagua

SEQ ID NO: 1891930 - RNA, 20 nt, Shigella flexneri 2a str. 2457T
ccuguuuagccgcuucugca

SEQ ID NO: 1891931 - RNA, 16 nt, Shigella flexneri 2a str. 2457T
ccuguugccauuucug

SEQ ID NO: 1891932 - RNA, 17 nt, Shigella flexneri 2a str. 2457T
ccuguugaaaaaccaga

SEQ ID NO: 1891933 - RNA, 21 nt, Shigella flexneri 2a str. 2457T
ccugucugcaaaaaugccuuu

SEQ ID NO: 1891934 - RNA, 18 nt, Shigella flexneri 2a str. 2457T
cgaccacuucaugcccca

SEQ ID NO: 1891935 - RNA, 13 nt, Shigella flexneri 2a str. 2457T
cgaccaccaccgc

SEQ ID NO: 1891936 - RNA, 16 nt, Shigella flexneri 2a str. 2457T
cgacaugcaucacgcg

SEQ ID NO: 1891937 - RNA, 21 nt, Shigella flexneri 2a str. 2457T
cgacauacaccgcagccgcca

SEQ ID NO: 1891938 - RNA, 23 nt, Shigella flexneri 2a str. 2457T
cgacaaaacgauguccgcucuca

SEQ ID NO: 1891939 - RNA, 23 nt, Shigella flexneri 2a str. 2457T
cgacaaauaccaccgugccgccg

SEQ ID NO: 1891940 - RNA, 17 nt, Shigella flexneri 2a str. 2457T
cgaaugaccgccccugc

SEQ ID NO: 1891941 - RNA, 24 nt, Shigella flexneri 2a str. 2457T
cgagacgguuaaaaacagccagca

SEQ ID NO: 1891942 - RNA, 23 nt, Shigella flexneri 2a str. 2457T
cgagaagucggcuuuuagcgaca

SEQ ID NO: 1891943 - RNA, 15 nt, Shigella flexneri 2a str. 2457T
cgagaaucagcgaga

SEQ ID NO: 1891944 - RNA, 16 nt, Shigella flexneri 2a str. 2457T
cgagaauaucgauauc

SEQ ID NO: 1891945 - RNA, 21 nt, Shigella flexneri 2a str. 2457T
cgagagagaaaauaauccgcu

SEQ ID NO: 1891946 - RNA, 23 nt, Shigella flexneri 2a str. 2457T
cgacugauugaacuguggcgcga

SEQ ID NO: 1891947 - RNA, 12 nt, Shigella flexneri 2a str. 2457T
aacaaugcguuu

SEQ ID NO: 1891948 - RNA, 21 nt, Shigella flexneri 2a str. 2457T
aacacaauaccuucugcgccc

SEQ ID NO: 1891949 - RNA, 16 nt, Shigella flexneri 2a str. 2457T
aacaauacaaaugccu

SEQ ID NO: 1891950 - RNA, 14 nt, Shigella flexneri 2a str. 2457T
cgacguaccagcgu

SEQ ID NO: 1891951 - RNA, 19 nt, Shigella flexneri 2a str. 2457T
cgacggcgaaucaaccgcg

SEQ ID NO: 1891952 - RNA, 17 nt, Shigella flexneri 2a str. 2457T
cgggcaagccagcauac

SEQ ID NO: 1891953 - RNA, 18 nt, Shigella flexneri 2a str. 2457T
cgggcaugauagcccgga

SEQ ID NO: 1891954 - RNA, 19 nt, Shigella flexneri 2a str. 2457T
aacaugcggugauuuugcc

SEQ ID NO: 1891955 - RNA, 13 nt, Shigella flexneri 2a str. 2457T
cgggauuauggau

SEQ ID NO: 1891956 - RNA, 21 nt, Shigella flexneri 2a str. 2457T
aacauuccacuuucgcggcuu

SEQ ID NO: 1891957 - RNA, 13 nt, Shigella flexneri 2a str. 2457T
aacauuagcgcau

SEQ ID NO: 1891958 - RNA, 19 nt, Shigella flexneri 2a str. 2457T
cggcuguuggaaucacuca

SEQ ID NO: 1891959 - RNA, 15 nt, Shigella flexneri 2a str. 2457T
cggcuuuuuccugcc

SEQ ID NO: 1891960 - RNA, 20 nt, Shigella flexneri 2a str. 2457T
cgggaagcucucuuccaguu

SEQ ID NO: 1891961 - RNA, 17 nt, Shigella flexneri 2a str. 2457T
cgggaauauuaacgaca

SEQ ID NO: 1891962 - RNA, 23 nt, Shigella flexneri 2a str. 2457T
cgggguuugcguuugcagcauug

SEQ ID NO: 1891963 - RNA, 20 nt, Shigella flexneri 2a str. 2457T
cggggauuauugccgcagcg

SEQ ID NO: 1891964 - RNA, 12 nt, Shigella flexneri 2a str. 2457T
cggggccagcau

SEQ ID NO: 1891965 - RNA, 16 nt, Shigella flexneri 2a str. 2457T
cggggacgcugucggc

SEQ ID NO: 1891966 - RNA, 20 nt, Shigella flexneri 2a str. 2457T
cgggcugguuuucagcgaaa

SEQ ID NO: 1891967 - RNA, 22 nt, Shigella flexneri 2a str. 2457T
cggcguaaacgccuuauccggc

SEQ ID NO: 1891968 - RNA, 13 nt, Shigella flexneri 2a str. 2457T
cggcguaacgcac

SEQ ID NO: 1891969 - RNA, 22 nt, Shigella flexneri 2a str. 2457T
cggcgguguucuuguuugauga

SEQ ID NO: 1891970 - RNA, 17 nt, Shigella flexneri 2a str. 2457T
cggcguaucgacaauca

SEQ ID NO: 1891971 - RNA, 22 nt, Shigella flexneri 2a str. 2457T
cggcgugaaugccuuauccgau

SEQ ID NO: 1891972 - RNA, 18 nt, Shigella flexneri 2a str. 2457T
cggcgugaccucuucggc

SEQ ID NO: 1891973 - RNA, 19 nt, Shigella flexneri 2a str. 2457T
cggcggugagaagaccgcc

SEQ ID NO: 1891974 - RNA, 18 nt, Shigella flexneri 2a str. 2457T
cggcgguaaaaucauccu

SEQ ID NO: 1891975 - RNA, 15 nt, Shigella flexneri 2a str. 2457T
cggcgcuuuugcauc

SEQ ID NO: 1891976 - RNA, 22 nt, Shigella flexneri 2a str. 2457T
cggaugaggcguuaacagcgca

SEQ ID NO: 1891977 - RNA, 20 nt, Shigella flexneri 2a str. 2457T
cggaugcgaguuuucgcauc

SEQ ID NO: 1891978 - RNA, 18 nt, Shigella flexneri 2a str. 2457T
cggauccacaccugacga

SEQ ID NO: 1891979 - RNA, 16 nt, Shigella flexneri 2a str. 2457T
cggaugcuuaaccgcc

SEQ ID NO: 1891980 - RNA, 18 nt, Shigella flexneri 2a str. 2457T
cggaugcggcgugaaugc

SEQ ID NO: 1891981 - RNA, 20 nt, Shigella flexneri 2a str. 2457T
cggaugcggcgugaaugccu

SEQ ID NO: 1891982 - RNA, 22 nt, Shigella flexneri 2a str. 2457T
cggauuggucgcucgcgccgca

SEQ ID NO: 1891983 - RNA, 19 nt, Shigella flexneri 2a str. 2457T
cggcaaacaguuucugcag

SEQ ID NO: 1891984 - RNA, 14 nt, Shigella flexneri 2a str. 2457T
cggcaaagcgcuga

SEQ ID NO: 1891985 - RNA, 16 nt, Shigella flexneri 2a str. 2457T
cggcaaacuucgucaa

SEQ ID NO: 1891986 - RNA, 23 nt, Shigella flexneri 2a str. 2457T
aacagguuuugacgugucugaua

SEQ ID NO: 1891987 - RNA, 23 nt, Shigella flexneri 2a str. 2457T
cggcaccguuuuugccgaugucu

SEQ ID NO: 1891988 - RNA, 17 nt, Shigella flexneri 2a str. 2457T
cggcaauuagcggcugg

SEQ ID NO: 1891989 - RNA, 20 nt, Shigella flexneri 2a str. 2457T
cggcaauggguaacggcaga

SEQ ID NO: 1891990 - RNA, 23 nt, Shigella flexneri 2a str. 2457T
cggcaccacaaacucuuuuccgg

SEQ ID NO: 1891991 - RNA, 14 nt, Shigella flexneri 2a str. 2457T
cggcaccaaucacc

SEQ ID NO: 1891992 - RNA, 15 nt, Shigella flexneri 2a str. 2457T
cggcaauaagcaacg

SEQ ID NO: 1891993 - RNA, 14 nt, Shigella flexneri 2a str. 2457T
cggcaauaccugac

SEQ ID NO: 1891994 - RNA, 14 nt, Shigella flexneri 2a str. 2457T
cggcaaucacauca

SEQ ID NO: 1891995 - RNA, 22 nt, Shigella flexneri 2a str. 2457T
cggcaauauagauaucaugcuc

SEQ ID NO: 1891996 - RNA, 23 nt, Shigella flexneri 2a str. 2457T
cggcaaucgccagaucagcuuca

SEQ ID NO: 1891997 - RNA, 23 nt, Shigella flexneri 2a str. 2457T
cggcaaucggugcaaaugccaga

SEQ ID NO: 1891998 - RNA, 22 nt, Shigella flexneri 2a str. 2457T
cggcaacuuuggguugccgcca

SEQ ID NO: 1891999 - RNA, 21 nt, Shigella flexneri 2a str. 2457T
cggcaacgucggaaaccgcuu

SEQ ID NO: 1892000 - RNA, 23 nt, Shigella flexneri 2a str. 2457T
cggcaaauucauuaccaaccuga

SEQ ID NO: 1892001 - RNA, 17 nt, Shigella flexneri 2a str. 2457T
cggcaaaugacgaugca

SEQ ID NO: 1892002 - RNA, 16 nt, Shigella flexneri 2a str. 2457T
cgcugagagaagcacg

SEQ ID NO: 1892003 - RNA, 21 nt, Shigella flexneri 2a str. 2457T
cggaccagccgcuaccagcgc

SEQ ID NO: 1892004 - RNA, 14 nt, Shigella flexneri 2a str. 2457T
cggaccgcauucac

SEQ ID NO: 1892005 - RNA, 23 nt, Shigella flexneri 2a str. 2457T
cggacguuugccaugcauaucca

SEQ ID NO: 1892006 - RNA, 13 nt, Shigella flexneri 2a str. 2457T
cggagaagcguag

SEQ ID NO: 1892007 - RNA, 21 nt, Shigella flexneri 2a str. 2457T
cggagcucccaggcuccgcca

SEQ ID NO: 1892008 - RNA, 17 nt, Shigella flexneri 2a str. 2457T
cggauaaagcagagcag

SEQ ID NO: 1892009 - RNA, 22 nt, Shigella flexneri 2a str. 2457T
cggauaaacaauguuauccggc

SEQ ID NO: 1892010 - RNA, 19 nt, Shigella flexneri 2a str. 2457T
cggauaagacgcgccagcg

SEQ ID NO: 1892011 - RNA, 19 nt, Shigella flexneri 2a str. 2457T
cggauaagaugcgccagca

SEQ ID NO: 1892012 - RNA, 22 nt, Shigella flexneri 2a str. 2457T
cggauaaggcgcucgcgccgca

SEQ ID NO: 1892013 - RNA, 20 nt, Shigella flexneri 2a str. 2457T
cggaucaggcggcucaccug

SEQ ID NO: 1892014 - RNA, 15 nt, Shigella flexneri 2a str. 2457T
cggauauugccggau

SEQ ID NO: 1892015 - RNA, 17 nt, Shigella flexneri 2a str. 2457T
cggauauuuugccaggu

SEQ ID NO: 1892016 - RNA, 15 nt, Shigella flexneri 2a str. 2457T
cggccauauccagcc

SEQ ID NO: 1892017 - RNA, 17 nt, Shigella flexneri 2a str. 2457T
cggccagugcuucgcgg

SEQ ID NO: 1892018 - RNA, 14 nt, Shigella flexneri 2a str. 2457T
cggcauauaguggg

SEQ ID NO: 1892019 - RNA, 22 nt, Shigella flexneri 2a str. 2457T
cggcaggaagugauugccgaag

SEQ ID NO: 1892020 - RNA, 18 nt, Shigella flexneri 2a str. 2457T
cggcaggaaaaaagcgcu

SEQ ID NO: 1892021 - RNA, 16 nt, Shigella flexneri 2a str. 2457T
cggcagcucgaccgcu

SEQ ID NO: 1892022 - RNA, 23 nt, Shigella flexneri 2a str. 2457T
aacagucgcccgaccaucgccag

SEQ ID NO: 1892023 - RNA, 13 nt, Shigella flexneri 2a str. 2457T
cggcaucgccaua

SEQ ID NO: 1892024 - RNA, 15 nt, Shigella flexneri 2a str. 2457T
cggcauucagugcaa

SEQ ID NO: 1892025 - RNA, 23 nt, Shigella flexneri 2a str. 2457T
cggcauucagugcaaaugccaga

SEQ ID NO: 1892026 - RNA, 17 nt, Shigella flexneri 2a str. 2457T
cggccuaucaacgucgu

SEQ ID NO: 1892027 - RNA, 15 nt, Shigella flexneri 2a str. 2457T
cggccuaccaugacc

SEQ ID NO: 1892028 - RNA, 13 nt, Shigella flexneri 2a str. 2457T
cggccguuccauu

SEQ ID NO: 1892029 - RNA, 18 nt, Shigella flexneri 2a str. 2457T
cggcccggcccaacgcau

SEQ ID NO: 1892030 - RNA, 17 nt, Shigella flexneri 2a str. 2457T
cgcgcaauugccagaca

SEQ ID NO: 1892031 - RNA, 17 nt, Shigella flexneri 2a str. 2457T
cgcgauagcaagcgcug

SEQ ID NO: 1892032 - RNA, 15 nt, Shigella flexneri 2a str. 2457T
cgcgauauugcugca

SEQ ID NO: 1892033 - RNA, 18 nt, Shigella flexneri 2a str. 2457T
cgcgccgacugcgccaau

SEQ ID NO: 1892034 - RNA, 18 nt, Shigella flexneri 2a str. 2457T
cgcgcaucuguaacggag

SEQ ID NO: 1892035 - RNA, 17 nt, Shigella flexneri 2a str. 2457T
cgcgcaguaaauccgcc

SEQ ID NO: 1892036 - RNA, 14 nt, Shigella flexneri 2a str. 2457T
cgcgccaauccaga

SEQ ID NO: 1892037 - RNA, 16 nt, Shigella flexneri 2a str. 2457T
cgcgccaaugccugau

SEQ ID NO: 1892038 - RNA, 22 nt, Shigella flexneri 2a str. 2457T
cgcgcguccccugcccgcgauc

SEQ ID NO: 1892039 - RNA, 16 nt, Shigella flexneri 2a str. 2457T
cgcgcguguugcgcca

SEQ ID NO: 1892040 - RNA, 19 nt, Shigella flexneri 2a str. 2457T
cgcgcgcuuuuaccgcguc

SEQ ID NO: 1892041 - RNA, 21 nt, Shigella flexneri 2a str. 2457T
cgcgcgcugccagaaccgcuu

SEQ ID NO: 1892042 - RNA, 14 nt, Shigella flexneri 2a str. 2457T
cgcgccugcggcca

SEQ ID NO: 1892043 - RNA, 12 nt, Shigella flexneri 2a str. 2457T
cgcucaucggca

SEQ ID NO: 1892044 - RNA, 22 nt, Shigella flexneri 2a str. 2457T
cgcuaucggguacgggcgcgag

SEQ ID NO: 1892045 - RNA, 12 nt, Shigella flexneri 2a str. 2457T
cgcuaucagcgc

SEQ ID NO: 1892046 - RNA, 23 nt, Shigella flexneri 2a str. 2457T
cgcuauaccgccgaucgccguuu

SEQ ID NO: 1892047 - RNA, 16 nt, Shigella flexneri 2a str. 2457T
cgcuauccagcgcaua

SEQ ID NO: 1892048 - RNA, 15 nt, Shigella flexneri 2a str. 2457T
cgcuauacagcagcc

SEQ ID NO: 1892049 - RNA, 14 nt, Shigella flexneri 2a str. 2457T
cgcguggccuggaa

SEQ ID NO: 1892050 - RNA, 21 nt, Shigella flexneri 2a str. 2457T
cgcguuaucagcaacuggcaa

SEQ ID NO: 1892051 - RNA, 14 nt, Shigella flexneri 2a str. 2457T
cgcguuaucgacaa

SEQ ID NO: 1892052 - RNA, 16 nt, Shigella flexneri 2a str. 2457T
cgcgucuuaucaugcc

SEQ ID NO: 1892053 - RNA, 22 nt, Shigella flexneri 2a str. 2457T
cgcgucuuaucaugccuacggg

SEQ ID NO: 1892054 - RNA, 19 nt, Shigella flexneri 2a str. 2457T
cgcgucaagcgucgcauca

SEQ ID NO: 1892055 - RNA, 13 nt, Shigella flexneri 2a str. 2457T
cgcgucacgcacu

SEQ ID NO: 1892056 - RNA, 19 nt, Shigella flexneri 2a str. 2457T
cgcucgccaaagcagugaa

SEQ ID NO: 1892057 - RNA, 20 nt, Shigella flexneri 2a str. 2457T
cgcucauuuucucuuucagc

SEQ ID NO: 1892058 - RNA, 22 nt, Shigella flexneri 2a str. 2457T
cgcucggcagaugagacguuau

SEQ ID NO: 1892059 - RNA, 22 nt, Shigella flexneri 2a str. 2457T
cgcucucgcagcucaucaacac

SEQ ID NO: 1892060 - RNA, 12 nt, Shigella flexneri 2a str. 2457T
cgcucuggcagg

SEQ ID NO: 1892061 - RNA, 15 nt, Shigella flexneri 2a str. 2457T
cgcugaaagauggcg

SEQ ID NO: 1892062 - RNA, 20 nt, Shigella flexneri 2a str. 2457T
cgcugacaguacccagauuc

SEQ ID NO: 1892063 - RNA, 20 nt, Shigella flexneri 2a str. 2457T
cgcugaaguuucuuuaccgg

SEQ ID NO: 1892064 - RNA, 15 nt, Shigella flexneri 2a str. 2457T
cgcugaauggcgauu

SEQ ID NO: 1892065 - RNA, 23 nt, Shigella flexneri 2a str. 2457T
cgcugaauggcgauuucacaaga

SEQ ID NO: 1892066 - RNA, 19 nt, Shigella flexneri 2a str. 2457T
cgcugaagguguaauggau

SEQ ID NO: 1892067 - RNA, 22 nt, Shigella flexneri 2a str. 2457T
cgcucguagguuucugccagcg

SEQ ID NO: 1892068 - RNA, 21 nt, Shigella flexneri 2a str. 2457T
cgcucuaaaaucaucacgcgg

SEQ ID NO: 1892069 - RNA, 14 nt, Shigella flexneri 2a str. 2457T
cgcggugcgccgua

SEQ ID NO: 1892070 - RNA, 21 nt, Shigella flexneri 2a str. 2457T
cgcguaaauaccuuccggcgu

SEQ ID NO: 1892071 - RNA, 17 nt, Shigella flexneri 2a str. 2457T
cgcguaaaacagccagc

SEQ ID NO: 1892072 - RNA, 22 nt, Shigella flexneri 2a str. 2457T
cgcguaaaacagccagcgcuga

SEQ ID NO: 1892073 - RNA, 20 nt, Shigella flexneri 2a str. 2457T
aacagcgguuuacccugcuc

SEQ ID NO: 1892074 - RNA, 15 nt, Shigella flexneri 2a str. 2457T
cgcgggucaguauuc

SEQ ID NO: 1892075 - RNA, 18 nt, Shigella flexneri 2a str. 2457T
cgcggggaucacuggcag

SEQ ID NO: 1892076 - RNA, 19 nt, Shigella flexneri 2a str. 2457T
cgcggggaucacuggcaga

SEQ ID NO: 1892077 - RNA, 19 nt, Shigella flexneri 2a str. 2457T
cgcggcgauauccagcgcg

SEQ ID NO: 1892078 - RNA, 16 nt, Shigella flexneri 2a str. 2457T
cgcggcgauauccagc

SEQ ID NO: 1892079 - RNA, 22 nt, Shigella flexneri 2a str. 2457T
cgccgcguuuaucgacagacgc

SEQ ID NO: 1892080 - RNA, 12 nt, Shigella flexneri 2a str. 2457T
aacacuugcggc

SEQ ID NO: 1892081 - RNA, 18 nt, Shigella flexneri 2a str. 2457T
aacacggcgcauugccau

SEQ ID NO: 1892082 - RNA, 21 nt, Shigella flexneri 2a str. 2457T
cgccguuuuuacccagcagca

SEQ ID NO: 1892083 - RNA, 23 nt, Shigella flexneri 2a str. 2457T
cgccguuuuuacccagcagcagc

SEQ ID NO: 1892084 - RNA, 22 nt, Shigella flexneri 2a str. 2457T
cgccguuaacuucaccgguuca

SEQ ID NO: 1892085 - RNA, 20 nt, Shigella flexneri 2a str. 2457T
aacagauaguuaccguacuc

SEQ ID NO: 1892086 - RNA, 19 nt, Shigella flexneri 2a str. 2457T
cgccugccagaugcagcgg

SEQ ID NO: 1892087 - RNA, 22 nt, Shigella flexneri 2a str. 2457T
cgccgguugauuuuuuugauaa

SEQ ID NO: 1892088 - RNA, 18 nt, Shigella flexneri 2a str. 2457T
cgcccaguggaugcgcca

SEQ ID NO: 1892089 - RNA, 13 nt, Shigella flexneri 2a str. 2457T
cgccaccgcacgc

SEQ ID NO: 1892090 - RNA, 17 nt, Shigella flexneri 2a str. 2457T
cgccaccggcaaucugc

SEQ ID NO: 1892091 - RNA, 22 nt, Shigella flexneri 2a str. 2457T
cgcccaggcaaguagcgccaua

SEQ ID NO: 1892092 - RNA, 20 nt, Shigella flexneri 2a str. 2457T
cgcccggaaacgggcgcuga

SEQ ID NO: 1892093 - RNA, 15 nt, Shigella flexneri 2a str. 2457T
cgccgacggcgcuac

SEQ ID NO: 1892094 - RNA, 18 nt, Shigella flexneri 2a str. 2457T
cgcccuucggcaucacga

SEQ ID NO: 1892095 - RNA, 17 nt, Shigella flexneri 2a str. 2457T
cgcccugcucgucggca

SEQ ID NO: 1892096 - RNA, 15 nt, Shigella flexneri 2a str. 2457T
cgcccugcuccagca

SEQ ID NO: 1892097 - RNA, 19 nt, Shigella flexneri 2a str. 2457T
cgcccugauggcgcgccac

SEQ ID NO: 1892098 - RNA, 19 nt, Shigella flexneri 2a str. 2457T
cgcccugcagcaucaccgg

SEQ ID NO: 1892099 - RNA, 16 nt, Shigella flexneri 2a str. 2457T
cgcccucgaucggcuc

SEQ ID NO: 1892100 - RNA, 14 nt, Shigella flexneri 2a str. 2457T
cgcccgguuuccgu

SEQ ID NO: 1892101 - RNA, 16 nt, Shigella flexneri 2a str. 2457T
cgcccguuaaccgcuc

SEQ ID NO: 1892102 - RNA, 15 nt, Shigella flexneri 2a str. 2457T
gcgccgacagcagcc

SEQ ID NO: 1892103 - RNA, 16 nt, Shigella flexneri 2a str. 2457T
gcgccagggcuuacaa

SEQ ID NO: 1892104 - RNA, 18 nt, Shigella flexneri 2a str. 2457T
gcgccagcgucaucauag

SEQ ID NO: 1892105 - RNA, 14 nt, Shigella flexneri 2a str. 2457T
gcgccagccagcca

SEQ ID NO: 1892106 - RNA, 14 nt, Shigella flexneri 2a str. 2457T
gcgcauccagcgcu

SEQ ID NO: 1892107 - RNA, 12 nt, Shigella flexneri 2a str. 2457T
gcgcauccggca

SEQ ID NO: 1892108 - RNA, 12 nt, Shigella flexneri 2a str. 2457T
gcgcaucaaagc

SEQ ID NO: 1892109 - RNA, 18 nt, Shigella flexneri 2a str. 2457T
gcgcaucagcuccgguau

SEQ ID NO: 1892110 - RNA, 16 nt, Shigella flexneri 2a str. 2457T
gcgcgauaucgcggua

SEQ ID NO: 1892111 - RNA, 21 nt, Shigella flexneri 2a str. 2457T
gcgccuucuacagcuucacgc

SEQ ID NO: 1892112 - RNA, 20 nt, Shigella flexneri 2a str. 2457T
gcgauauuauccccugcgau

SEQ ID NO: 1892113 - RNA, 14 nt, Shigella flexneri 2a str. 2457T
gcgauauugcugca

SEQ ID NO: 1892114 - RNA, 14 nt, Shigella flexneri 2a str. 2457T
gcgauaaucagcgc

SEQ ID NO: 1892115 - RNA, 19 nt, Shigella flexneri 2a str. 2457T
gcgagguauuuucugaaac

SEQ ID NO: 1892116 - RNA, 19 nt, Shigella flexneri 2a str. 2457T
gcgaggggaccgccccugc

SEQ ID NO: 1892117 - RNA, 15 nt, Shigella flexneri 2a str. 2457T
gcgacgucugccggu

SEQ ID NO: 1892118 - RNA, 14 nt, Shigella flexneri 2a str. 2457T
gcgacaccagccau

SEQ ID NO: 1892119 - RNA, 21 nt, Shigella flexneri 2a str. 2457T
gcgacgcuugacgcgucuuau

SEQ ID NO: 1892120 - RNA, 20 nt, Shigella flexneri 2a str. 2457T
gcgacgcuuacgcgucuuau

SEQ ID NO: 1892121 - RNA, 21 nt, Shigella flexneri 2a str. 2457T
gcgacgcuuaccgcgucuuau

SEQ ID NO: 1892122 - RNA, 17 nt, Shigella flexneri 2a str. 2457T
gcgaucgggaaccggcu

SEQ ID NO: 1892123 - RNA, 13 nt, Shigella flexneri 2a str. 2457T
gcgaugaccgcca

SEQ ID NO: 1892124 - RNA, 21 nt, Shigella flexneri 2a str. 2457T
gcgaucccacgccgaaugccg

SEQ ID NO: 1892125 - RNA, 17 nt, Shigella flexneri 2a str. 2457T
gcgauuuaucggcaauu

SEQ ID NO: 1892126 - RNA, 18 nt, Shigella flexneri 2a str. 2457T
gcgcaaauccacguucca

SEQ ID NO: 1892127 - RNA, 15 nt, Shigella flexneri 2a str. 2457T
gcgcaaaauaccagc

SEQ ID NO: 1892128 - RNA, 19 nt, Shigella flexneri 2a str. 2457T
gcgcaaaauaccagcaauu

SEQ ID NO: 1892129 - RNA, 23 nt, Shigella flexneri 2a str. 2457T
gcgauuaauaaaauuauccagcu

SEQ ID NO: 1892130 - RNA, 15 nt, Shigella flexneri 2a str. 2457T
gcgauuaaacgccau

SEQ ID NO: 1892131 - RNA, 20 nt, Shigella flexneri 2a str. 2457T
gcgauuaaacgccauccggc

SEQ ID NO: 1892132 - RNA, 12 nt, Shigella flexneri 2a str. 2457T
gcgcaauaccga

SEQ ID NO: 1892133 - RNA, 17 nt, Shigella flexneri 2a str. 2457T
gcgcacuauuccggcgu

SEQ ID NO: 1892134 - RNA, 12 nt, Shigella flexneri 2a str. 2457T
gccggugauuac

SEQ ID NO: 1892135 - RNA, 14 nt, Shigella flexneri 2a str. 2457T
gccguccagccgga

SEQ ID NO: 1892136 - RNA, 19 nt, Shigella flexneri 2a str. 2457T
gccgucaggugacacuuca

SEQ ID NO: 1892137 - RNA, 18 nt, Shigella flexneri 2a str. 2457T
gccguacugcauaaugcc

SEQ ID NO: 1892138 - RNA, 15 nt, Shigella flexneri 2a str. 2457T
gccguagagcaccgg

SEQ ID NO: 1892139 - RNA, 17 nt, Shigella flexneri 2a str. 2457T
gccggugucauggcuga

SEQ ID NO: 1892140 - RNA, 14 nt, Shigella flexneri 2a str. 2457T
gccguggcaaccuu

SEQ ID NO: 1892141 - RNA, 16 nt, Shigella flexneri 2a str. 2457T
gccguugacgguuucc

SEQ ID NO: 1892142 - RNA, 15 nt, Shigella flexneri 2a str. 2457T
gccugcgacaagaau

SEQ ID NO: 1892143 - RNA, 20 nt, Shigella flexneri 2a str. 2457T
gccugaugugacgcuuguca

SEQ ID NO: 1892144 - RNA, 16 nt, Shigella flexneri 2a str. 2457T
gccugcaacgcuuuca

SEQ ID NO: 1892145 - RNA, 11 nt, Shigella flexneri 2a str. 2457T
gccugccagag

SEQ ID NO: 1892146 - RNA, 14 nt, Shigella flexneri 2a str. 2457T
gccugaugcggcgu

SEQ ID NO: 1892147 - RNA, 23 nt, Shigella flexneri 2a str. 2457T
gccugagaagcgcaacgcaucag

SEQ ID NO: 1892148 - RNA, 22 nt, Shigella flexneri 2a str. 2457T
gccugaugcgcuucgcuuauca

SEQ ID NO: 1892149 - RNA, 18 nt, Shigella flexneri 2a str. 2457T
aagcccacgccgcccaga

SEQ ID NO: 1892150 - RNA, 13 nt, Shigella flexneri 2a str. 2457T
aagccacgccgaa

SEQ ID NO: 1892151 - RNA, 23 nt, Shigella flexneri 2a str. 2457T
gccuacaaauucaauaaauugca

SEQ ID NO: 1892152 - RNA, 19 nt, Shigella flexneri 2a str. 2457T
gccuacaggaaacgauucg

SEQ ID NO: 1892153 - RNA, 16 nt, Shigella flexneri 2a str. 2457T
aagcccaguaccgcca

SEQ ID NO: 1892154 - RNA, 17 nt, Shigella flexneri 2a str. 2457T
gccuguauuacgccuuc

SEQ ID NO: 1892155 - RNA, 23 nt, Shigella flexneri 2a str. 2457T
gccuuauccgacauuucugcugc

SEQ ID NO: 1892156 - RNA, 22 nt, Shigella flexneri 2a str. 2457T
gccuuaccacucugaccugaca

SEQ ID NO: 1892157 - RNA, 14 nt, Shigella flexneri 2a str. 2457T
gccuuauccggccu

SEQ ID NO: 1892158 - RNA, 18 nt, Shigella flexneri 2a str. 2457T
gccuuaccaauaccgcgu

SEQ ID NO: 1892159 - RNA, 19 nt, Shigella flexneri 2a str. 2457T
gccuguuuauccaucacgc

SEQ ID NO: 1892160 - RNA, 14 nt, Shigella flexneri 2a str. 2457T
gccuguugcgucgc

SEQ ID NO: 1892161 - RNA, 16 nt, Shigella flexneri 2a str. 2457T
gccugcucaacugcca

SEQ ID NO: 1892162 - RNA, 21 nt, Shigella flexneri 2a str. 2457T
gccugcuccucggugaucuca

SEQ ID NO: 1892163 - RNA, 15 nt, Shigella flexneri 2a str. 2457T
gccugcggccagcag

SEQ ID NO: 1892164 - RNA, 16 nt, Shigella flexneri 2a str. 2457T
aagcauaauaagcuuu

SEQ ID NO: 1892165 - RNA, 20 nt, Shigella flexneri 2a str. 2457T
aagcaguccagcgccugacg

SEQ ID NO: 1892166 - RNA, 17 nt, Shigella flexneri 2a str. 2457T
aagcauucacgccgcau

SEQ ID NO: 1892167 - RNA, 14 nt, Shigella flexneri 2a str. 2457T
aagcauucgcgagg

SEQ ID NO: 1892168 - RNA, 15 nt, Shigella flexneri 2a str. 2457T
aagccaaaucaucca

SEQ ID NO: 1892169 - RNA, 22 nt, Shigella flexneri 2a str. 2457T
gccggaugcggcguaaacgccu

SEQ ID NO: 1892170 - RNA, 18 nt, Shigella flexneri 2a str. 2457T
gccggaugcgccagcauc

SEQ ID NO: 1892171 - RNA, 21 nt, Shigella flexneri 2a str. 2457T
gccggauaagcguaagcgcau

SEQ ID NO: 1892172 - RNA, 15 nt, Shigella flexneri 2a str. 2457T
gccggauaagacgcg

SEQ ID NO: 1892173 - RNA, 17 nt, Shigella flexneri 2a str. 2457T
gccggauaaggcgcucg

SEQ ID NO: 1892174 - RNA, 16 nt, Shigella flexneri 2a str. 2457T
gccggacguucgccca

SEQ ID NO: 1892175 - RNA, 16 nt, Shigella flexneri 2a str. 2457T
gccggagacgacgccc

SEQ ID NO: 1892176 - RNA, 18 nt, Shigella flexneri 2a str. 2457T
gccggaggcaaguuuccu

SEQ ID NO: 1892177 - RNA, 16 nt, Shigella flexneri 2a str. 2457T
gccggaaaacguuuca

SEQ ID NO: 1892178 - RNA, 22 nt, Shigella flexneri 2a str. 2457T
gccggaccaucuuccaguugca

SEQ ID NO: 1892179 - RNA, 13 nt, Shigella flexneri 2a str. 2457T
gccggacaugcug

SEQ ID NO: 1892180 - RNA, 23 nt, Shigella flexneri 2a str. 2457T
gccgcuguguguaggccagcgau

SEQ ID NO: 1892181 - RNA, 18 nt, Shigella flexneri 2a str. 2457T
gccgcuuccagcauuucu

SEQ ID NO: 1892182 - RNA, 17 nt, Shigella flexneri 2a str. 2457T
gccgcugcgcgugaagc

SEQ ID NO: 1892183 - RNA, 14 nt, Shigella flexneri 2a str. 2457T
gccgccgcggacaa

SEQ ID NO: 1892184 - RNA, 16 nt, Shigella flexneri 2a str. 2457T
gccgccgcgcucuuca

SEQ ID NO: 1892185 - RNA, 17 nt, Shigella flexneri 2a str. 2457T
gcggcgaaccagccguu

SEQ ID NO: 1892186 - RNA, 20 nt, Shigella flexneri 2a str. 2457T
gcggcgacaaauguugcauc

SEQ ID NO: 1892187 - RNA, 18 nt, Shigella flexneri 2a str. 2457T
gcggcgacuuccagcgau

SEQ ID NO: 1892188 - RNA, 17 nt, Shigella flexneri 2a str. 2457T
gcggcgauauccagcgc

SEQ ID NO: 1892189 - RNA, 16 nt, Shigella flexneri 2a str. 2457T
aagcugcaaggugaaa

SEQ ID NO: 1892190 - RNA, 18 nt, Shigella flexneri 2a str. 2457T
aagcugaaaauggcgcug

SEQ ID NO: 1892191 - RNA, 17 nt, Shigella flexneri 2a str. 2457T
gcggcguaaacgccuua

SEQ ID NO: 1892192 - RNA, 15 nt, Shigella flexneri 2a str. 2457T
gcggcggugauauaa

SEQ ID NO: 1892193 - RNA, 16 nt, Shigella flexneri 2a str. 2457T
gcgggucaggccagga

SEQ ID NO: 1892194 - RNA, 17 nt, Shigella flexneri 2a str. 2457T
gcgggucaggccaggau

SEQ ID NO: 1892195 - RNA, 16 nt, Shigella flexneri 2a str. 2457T
gcgggugaacgcguua

SEQ ID NO: 1892196 - RNA, 22 nt, Shigella flexneri 2a str. 2457T
gcggcuauauucaaacacccga

SEQ ID NO: 1892197 - RNA, 16 nt, Shigella flexneri 2a str. 2457T
gcggagaguaaacggu

SEQ ID NO: 1892198 - RNA, 14 nt, Shigella flexneri 2a str. 2457T
gcggagcgccuguc

SEQ ID NO: 1892199 - RNA, 23 nt, Shigella flexneri 2a str. 2457T
gcggaucguuaaacucugccgca

SEQ ID NO: 1892200 - RNA, 18 nt, Shigella flexneri 2a str. 2457T
gcggauaaacuuggcuau

SEQ ID NO: 1892201 - RNA, 22 nt, Shigella flexneri 2a str. 2457T
gcggaguuuucggggcgaucgc

SEQ ID NO: 1892202 - RNA, 19 nt, Shigella flexneri 2a str. 2457T
gcggauacaggaagcgaau

SEQ ID NO: 1892203 - RNA, 18 nt, Shigella flexneri 2a str. 2457T
gcggauuuuauucagcag

SEQ ID NO: 1892204 - RNA, 23 nt, Shigella flexneri 2a str. 2457T
gcggauugcuucugcuucagccg

SEQ ID NO: 1892205 - RNA, 23 nt, Shigella flexneri 2a str. 2457T
aagccuauggugaagcuuaucgu

SEQ ID NO: 1892206 - RNA, 18 nt, Shigella flexneri 2a str. 2457T
aagccgucccuaccggua

SEQ ID NO: 1892207 - RNA, 15 nt, Shigella flexneri 2a str. 2457T
aagccgccgccgcug

SEQ ID NO: 1892208 - RNA, 23 nt, Shigella flexneri 2a str. 2457T
aagccgcuaacagcagcagcgca

SEQ ID NO: 1892209 - RNA, 17 nt, Shigella flexneri 2a str. 2457T
gcggcaggguuugcgcc

SEQ ID NO: 1892210 - RNA, 17 nt, Shigella flexneri 2a str. 2457T
gcggcaguauagcggca

SEQ ID NO: 1892211 - RNA, 18 nt, Shigella flexneri 2a str. 2457T
aagccugcuucaaacgcu

SEQ ID NO: 1892212 - RNA, 21 nt, Shigella flexneri 2a str. 2457T
gcgcugaaagaagcggugaaa

SEQ ID NO: 1892213 - RNA, 17 nt, Shigella flexneri 2a str. 2457T
gcgcugagguuaugcaa

SEQ ID NO: 1892214 - RNA, 15 nt, Shigella flexneri 2a str. 2457T
gcgcuuauccggccc

SEQ ID NO: 1892215 - RNA, 16 nt, Shigella flexneri 2a str. 2457T
gcgcuuauagcgacca

SEQ ID NO: 1892216 - RNA, 14 nt, Shigella flexneri 2a str. 2457T
gcgcuuaucgccag

SEQ ID NO: 1892217 - RNA, 22 nt, Shigella flexneri 2a str. 2457T
gcgcuucacaugccacacacga

SEQ ID NO: 1892218 - RNA, 23 nt, Shigella flexneri 2a str. 2457T
gcgcuucgcuuaccaugccaacg

SEQ ID NO: 1892219 - RNA, 21 nt, Shigella flexneri 2a str. 2457T
gcgcuggcgcauguuggcgcg

SEQ ID NO: 1892220 - RNA, 18 nt, Shigella flexneri 2a str. 2457T
gcggaauauuuuuaccgu

SEQ ID NO: 1892221 - RNA, 15 nt, Shigella flexneri 2a str. 2457T
gcggaaauuaccgca

SEQ ID NO: 1892222 - RNA, 16 nt, Shigella flexneri 2a str. 2457T
gcgcuuuuaccgcguc

SEQ ID NO: 1892223 - RNA, 14 nt, Shigella flexneri 2a str. 2457T
gcgcuuuuggcgcg

SEQ ID NO: 1892224 - RNA, 13 nt, Shigella flexneri 2a str. 2457T
gcgcuuggcgacg

SEQ ID NO: 1892225 - RNA, 17 nt, Shigella flexneri 2a str. 2457T
gcuccgguuaacgccgc

SEQ ID NO: 1892226 - RNA, 14 nt, Shigella flexneri 2a str. 2457T
gcuccugcauugac

SEQ ID NO: 1892227 - RNA, 23 nt, Shigella flexneri 2a str. 2457T
gcucgccgcagagaucagauaau

SEQ ID NO: 1892228 - RNA, 15 nt, Shigella flexneri 2a str. 2457T
gcugacgcacuguug

SEQ ID NO: 1892229 - RNA, 17 nt, Shigella flexneri 2a str. 2457T
gcugaacgggccaucca

SEQ ID NO: 1892230 - RNA, 21 nt, Shigella flexneri 2a str. 2457T
gcucuuguucuuccggcacac

SEQ ID NO: 1892231 - RNA, 14 nt, Shigella flexneri 2a str. 2457T
gcucuucaucgcua

SEQ ID NO: 1892232 - RNA, 21 nt, Shigella flexneri 2a str. 2457T
gcucuggauaaucacaauggu

SEQ ID NO: 1892233 - RNA, 15 nt, Shigella flexneri 2a str. 2457T
gcugcggcgcgcauc

SEQ ID NO: 1892234 - RNA, 17 nt, Shigella flexneri 2a str. 2457T
gcugcggaauugccggu

SEQ ID NO: 1892235 - RNA, 13 nt, Shigella flexneri 2a str. 2457T
gcugcgcuaucag

SEQ ID NO: 1892236 - RNA, 16 nt, Shigella flexneri 2a str. 2457T
gcugcgaaucgcuuca

SEQ ID NO: 1892237 - RNA, 17 nt, Shigella flexneri 2a str. 2457T
gcugacuguaggccgga

SEQ ID NO: 1892238 - RNA, 17 nt, Shigella flexneri 2a str. 2457T
gcuggcagcugcuacgc

SEQ ID NO: 1892239 - RNA, 15 nt, Shigella flexneri 2a str. 2457T
gcuggcaucggcaaa

SEQ ID NO: 1892240 - RNA, 13 nt, Shigella flexneri 2a str. 2457T
gcuggcaacaugg

SEQ ID NO: 1892241 - RNA, 16 nt, Shigella flexneri 2a str. 2457T
gcuggcacgcucuuca

SEQ ID NO: 1892242 - RNA, 13 nt, Shigella flexneri 2a str. 2457T
gcuggcagcugcu

SEQ ID NO: 1892243 - RNA, 19 nt, Shigella flexneri 2a str. 2457T
gcuggcccaguugauucgc

SEQ ID NO: 1892244 - RNA, 20 nt, Shigella flexneri 2a str. 2457T
gcuggacguugcguugcagc

SEQ ID NO: 1892245 - RNA, 23 nt, Shigella flexneri 2a str. 2457T
gcuggacucccagaacaacccgg

SEQ ID NO: 1892246 - RNA, 17 nt, Shigella flexneri 2a str. 2457T
gcuggauaaggcguuua

SEQ ID NO: 1892247 - RNA, 21 nt, Shigella flexneri 2a str. 2457T
gcuggauuuuagggacaaaga

SEQ ID NO: 1892248 - RNA, 19 nt, Shigella flexneri 2a str. 2457T
gcuggauggcgcaaugcca

SEQ ID NO: 1892249 - RNA, 19 nt, Shigella flexneri 2a str. 2457T
gcuggaucagacgcagcca

SEQ ID NO: 1892250 - RNA, 17 nt, Shigella flexneri 2a str. 2457T
gcuggaucugcggguua

SEQ ID NO: 1892251 - RNA, 15 nt, Shigella flexneri 2a str. 2457T
gcugcuucauugcuc

SEQ ID NO: 1892252 - RNA, 18 nt, Shigella flexneri 2a str. 2457T
gcugcugcguuccggcau

SEQ ID NO: 1892253 - RNA, 12 nt, Shigella flexneri 2a str. 2457T
gcugcugccgcu

SEQ ID NO: 1892254 - RNA, 21 nt, Shigella flexneri 2a str. 2457T
gcgucguucgcgccaacagcg

SEQ ID NO: 1892255 - RNA, 19 nt, Shigella flexneri 2a str. 2457T
gcgugaacugggccugcau

SEQ ID NO: 1892256 - RNA, 22 nt, Shigella flexneri 2a str. 2457T
gcgugaacgccuaauccagccu

SEQ ID NO: 1892257 - RNA, 20 nt, Shigella flexneri 2a str. 2457T
gcgugcccgggucagcgcca

SEQ ID NO: 1892258 - RNA, 21 nt, Shigella flexneri 2a str. 2457T
gcguggcgauaaucagcgcca

SEQ ID NO: 1892259 - RNA, 14 nt, Shigella flexneri 2a str. 2457T
gcguccgccgauac

SEQ ID NO: 1892260 - RNA, 19 nt, Shigella flexneri 2a str. 2457T
gcgucauccagcacuugca

SEQ ID NO: 1892261 - RNA, 22 nt, Shigella flexneri 2a str. 2457T
gcgucauauuacugcaacugcg

SEQ ID NO: 1892262 - RNA, 15 nt, Shigella flexneri 2a str. 2457T
gcgucauaauccggc

SEQ ID NO: 1892263 - RNA, 17 nt, Shigella flexneri 2a str. 2457T
gcgucauuaugucuggc

SEQ ID NO: 1892264 - RNA, 21 nt, Shigella flexneri 2a str. 2457T
gcgucauuuucaucgcuuucu

SEQ ID NO: 1892265 - RNA, 17 nt, Shigella flexneri 2a str. 2457T
gcguagccgauccgcgu

SEQ ID NO: 1892266 - RNA, 12 nt, Shigella flexneri 2a str. 2457T
gcgucaaacggc

SEQ ID NO: 1892267 - RNA, 14 nt, Shigella flexneri 2a str. 2457T
gcucaccgccagca

SEQ ID NO: 1892268 - RNA, 16 nt, Shigella flexneri 2a str. 2457T
gcuauugcgccagccu

SEQ ID NO: 1892269 - RNA, 19 nt, Shigella flexneri 2a str. 2457T
gcucaacaauaaacuggcu

SEQ ID NO: 1892270 - RNA, 11 nt, Shigella flexneri 2a str. 2457T
gcucaaacgaa

SEQ ID NO: 1892271 - RNA, 21 nt, Shigella flexneri 2a str. 2457T
gcuauuuuuugcaggccagau

SEQ ID NO: 1892272 - RNA, 15 nt, Shigella flexneri 2a str. 2457T
gcuauuauaucgcuc

SEQ ID NO: 1892273 - RNA, 16 nt, Shigella flexneri 2a str. 2457T
gcuaucagcgccacca

SEQ ID NO: 1892274 - RNA, 14 nt, Shigella flexneri 2a str. 2457T
gcuauauugcagga

SEQ ID NO: 1892275 - RNA, 17 nt, Shigella flexneri 2a str. 2457T
gcuauccacgucgacaa

SEQ ID NO: 1892276 - RNA, 13 nt, Shigella flexneri 2a str. 2457T
gcuaucgcugaua

SEQ ID NO: 1892277 - RNA, 15 nt, Shigella flexneri 2a str. 2457T
gcuaccgccagacca

SEQ ID NO: 1892278 - RNA, 14 nt, Shigella flexneri 2a str. 2457T
gcuauacagcagcc

SEQ ID NO: 1892279 - RNA, 22 nt, Shigella flexneri 2a str. 2457T
gcuacgcuuaucaggccuacgc

SEQ ID NO: 1892280 - RNA, 22 nt, Shigella flexneri 2a str. 2457T
gcguuuccagcaguuccagcau
